(12) United States Patent
Berka et al.

(10) Patent No.: US 6,902,887 B1
(45) Date of Patent: Jun. 7, 2005

(54) METHODS FOR MONITORING MULTIPLE GENE EXPRESSION

(75) Inventors: Randy M. Berka, Davis, CA (US); Michael W. Rey, Davis, CA (US); Jeffrey R. Shuster, Davis, CA (US); Sakari Kauppinen, Smoerum (DK); Ib Groth Clausen, Hillerod (DK); Peter Bjarke Olsen, Copenhagen (DK)

(73) Assignees: Novozymes Biotech, Inc., Davis, CA (US); Novozymes A/S, Bagsvaerd (DK)

( * ) Notice: Subject to any disclaimer, the term of this patent is extended or adjusted under 35 U.S.C. 154(b) by 0 days.

(21) Appl. No.: 09/533,559

(22) Filed: Mar. 22, 2000

Related U.S. Application Data

(63) Continuation-in-part of application No. 09/273,623, filed on Mar. 22, 1999, now abandoned.

(51) Int. Cl.$^7$ ............. C12Q 1/68; C12N 15/31
(52) U.S. Cl. ........................ 435/6; 536/23.7
(58) Field of Search ............ 435/6; 536/23.7; 702/19

(56) References Cited

PUBLICATIONS

DeRisi et al., Exploring the Metabolic and Genetic Control of Gene Expression on a Genomic Scale, Oct. 1997, Science, vol. 278, pp. 680–686.*

Machida et al., Molecular cloning of a cDNA encoding enolase from the filamentous fungus, *Aspergullus oryzae*, 1996, Current Genetics, vol. 30, pp. 423–431.*

Minetoki et al., Nucleotide Sequence and Expression of x–Glucosidase–encoding Gene (agd A) from *Aspergillus oryzae*, 1995, Biosci., Biotech., Biochem., 59, 1516–1521.*

Hata et al, Functional elements of the promoter region of the *Aspergillus oryzae* glaA gene encoding glucoamylase. 1992. Current Genetics, vol. 22, pp. 85–91.*

Watson et al., 1998, Current Opinion In Biotechnology 9: 609–614.

Chu et al., 1998, Science 282: 699–705.

Ruan et al., 1998 The Plant Journal 15: 821–833.

Iyer et al., 1999, Science 283: 83–87.

Hayward et al., 2000, Molecular Microbiolgy 35: 6–14.

* cited by examiner

*Primary Examiner*—John S. Brusca
(74) *Attorney, Agent, or Firm*—Robert L. Stames

(57) ABSTRACT

The present invention relates to methods for monitoring differential expression of a plurality of genes in a first filamentous fungal cell relative to expression of the same genes in one or more second filamentous fungal cells using microarrays containing filamentous fungal expressed sequenced tags. The present invention also relates to filamentous fungal expressed sequenced tags and to computer readable media and substrates containing such expressed sequenced tags for monitoring expression of a plurality of genes in filamentous fungal cells.

8 Claims, No Drawings

US 6,902,887 B1

METHODS FOR MONITORING MULTIPLE GENE EXPRESSION

CROSS-REFERENCE TO RELATED APPLICATION

This application is a continuation-in-part of U.S. application Ser. No. 09/273,623 filed Mar. 22, 1999 now abandoned, which application is fully incorporated herein by reference.

BACKGROUND OF THE INVENTION

1. Field of the Invention

The present invention relates to methods for monitoring expression of a plurality of genes in filamentous fungal cells. The present invention also relates to expressed sequenced tags and to substrates and computer readable media containing such expressed sequenced tags for monitoring expression of a plurality of genes in filamentous fungal cells.

2. Description of the Related Art

Microarray technology is increasingly becoming the method of choice for the quantitative and simultaneous analysis of the expression levels of many thousands of genes. Microarray analyses typically follow the steps of gene selection, microarray synthesis, sample preparation, array hybridization, detection, and data analysis (Watson et al. 1998, *Current Opinion in Biotechnology* 9: 609–614).

PCR-amplified coding sequences of genomic DNA are particularly useful in microarrays for obtaining global expression profiles where the genome of the organism has been fully sequenced.

Chu et al., 1998, *Science* 282: 699–705 disclose the use of microarrays containing PCR-amplified genome coding sequences for determining the temporal expression of *Saccharomyces cerevisiae* genes during sporulation.

For other organisms whose genomes have not been sequenced, global expression profiles may be obtained with arraying (1) random genomic DNA segments or clones (e.g. from a genomic DNA library): (2) random cDNA clones (e.g., from one or more cDNA libraries) that are uncharacterized at the DNA sequence level, or (3) EST clones that have been sequenced and partially characterized with respect to putative identification and function.

However, there are disadvantages with using random genomic or cDNA clones from organisms whose genomes have not been fully sequenced. These disadvantages include (1) more than one gene may be represented on a single clone; (2) no gene(s) may be encoded on a single clone; (3) extensive characterization and DNA sequencing is required to follow-up array spots that appear interesting; and (4) duplicity, multiplicity, and reduncancy add to the follow-up work.

Expressed sequenced tags (ESTs) are partial cDNA sequences of expressed genes. Simply state, an EST is a segment of a sequence from a cDNA clone that corresponds to the mRNA of a specific gene. The use of sequenced ESTs in microarrays compared to genomic clones or random cDNA clones provides several advantages especially for organisms whose genomes have not been sequenced. First, one spot on an array equals one gene or open reading frame, so redundancy is eliminated. Second, since sequence information is available so that redundancy and follow-up characterization is minimized. Third, EST microarrays can be organized based on function of the gene products to facilitate analysis of the results (e.g., ESTs encoding enzymes from the same metabolic pathway can be arranged or grouped accordingly).

Ruan et al., 1998, *The Plant Journal* 15: 821–833, disclose the use of microarrays containing *Arabidopsis thaliana* EST sequences for determining the temporal expression of *Arabidopsis thaliana* genes in root, leaf, and two stages of floral development.

Iyer et al., 1999, *Science* 283: 83–87, disclose the use of microarrays containing human EST sequences for determining the temporal expression of human fibroblast cells in response to serum.

Hayward et al., 2000, *Molecular Microbiology* 35: 6–14, disclose shotgun DNA microarrays and stage-specific gene expression in *Plasmodium falciparum* malaria.

Filamentous fungi are increasingly being used as host microorganisms for the industrial production of enzymes and other proteins whether endogenous or heterogenous to the microorganisms. There is a need in the art to provide methods for monitoring the global expression of genes from filamentous fungal cells to improve the production potential of these microorganisms.

It is an object of the present invention to provide alternative methods for monitoring expression of a plurality of genes in filamentous fungal cells.

SUMMARY OF THE INVENTION

The present invention relates to methods for monitoring differential expression of a plurality of genes in a first filamentous fungal cell relative to expression of the same genes in one or more second filamentous fungal cells, comprising:

(a) adding a mixture of fluorescence-labeled nucleic acids isolated from the filamentous fungal cells to a substrate containing an array of filamentous fungal ESTs under conditions where the nucleic acids hybridize to complementary sequences of the ESTs in the array, wherein the nucleic acids from the first filamentous fungal cell and the one or more second filamentous fungal cells are labeled with a first fluorescent reporter and one or more different second fluorescent reporters, respectively; and (b) examining the array by fluorescence under fluorescence excitation conditions wherein the relative expression of the genes in the filamentous fungal cells is determined by the observed fluorescence emission color of each spot in the array in which (i) the ESTs in the array that hybridize to the nucleic acids obtained from either the first or the one or more second filamentous fungal cells produce a distinct first fluorescence emission color or one or more second fluorescence emission colors, respectively, and (ii) the ESTs in the array that hybridize to the nucleic acids obtained from both the first and one or more second filamentous fungal cells produce a distinct combined fluorescence emission color. In a preferred embodiment, the filamentous fungal ESTs are selected from the group consisting of SEQ ID NOs. 1–7860, nucleic acid fragments of SEQ ID NOs. 1–7860, and nucleic acid sequences having at least 90%, preferably at least 95%, more preferably at least 99%, and most preferably at least 99.9% homology to the sequences of SEQ ID NOs. 1–7860.

The present invention further relates to isolated ESTs obtained from *Fusarium venenatum* (SEQ ID NOs. 1–3770), *Aspergillus niger* (SEQ ID NOs. 3771–4376), *Aspergillus oryzae* (SEQ ID NOs. 4377–7401), and *Trichoderma reesei* (SEQ ID NOs. 7402–7860).

The present invention also relates to computer readable media and substrates containing an array of such filamentous fungal ESTs for monitoring differential expression of a plurality of genes in a first filamentous fungal cell relative to expression of the same genes in one or more second filamentous fungal cells.

DETAILED DESCRIPTION OF THE INVENTION

The present invention relates to methods for monitoring differential expression of a plurality of genes in a first filamentous fungal cell relative to expression of the same genes in one or more second filamentous fungal cells. The methods comprise (a) adding a mixture of fluorescence-labeled nucleic acids isolated from the two or more filamentous fungal cells with different fluorescent reporters for each cell's nucleic acids to a substrate containing an array of filamentous fungal ESTs under conditions where the nucleic acids hybridize to complementary sequences of the ESTs in the array; and (b) examining the array by fluorescence under fluorescence excitation conditions wherein the relative expression of the genes in the two or more cells is determined by the observed fluorescence emission color of each spot in the array.

The methods of the present invention may be used to monitor global expression of a plurality of genes from a filamentous fungal cell, discover new genes, identify possible functions of unknown open reading frames, and monitor gene copy number variation and stability. For example, the global view of changes in expression of genes may be used to provide a picture of the way in which filamentous fungal cells adapt to changes in culture conditions, environmental stress, or other physiological provocation. Other possibilities for monitoring global expression include spore morphogenesis, recombination, metabolic or catabolic pathway engineering.

The methods of the present invention are particularly advantages because one spot on an array equal one gene or open reading frame; extensive follow-up characterization is unnecessary since sequence information is available, and EST microarrays can be organized based on function of the gene products.

Expressed Sequenced Tags

The term "expressed sequenced tag" or "EST" is defined herein as a segment of a sequence from a cDNA clone of an expressed filamentous fungal gene. The term "EST" will be understood to also include two or more ESTs assembled into a contig. In the methods of the present invention, the filamentous fungal ESTs described herein preferably represent a plurality of genes present in the two or more filamentous fungal cells to be evaluated.

ESTs are generally generated as follows: Total polyadenylated mRNA is isolated from a filamentous fungal cell and reverse transcribed into total cDNA. The total cDNA is digested with a restriction endonuclease, size-selected by agarose gel electrophoresis, isolated, and ligated into a vector, e.g., pZErO-2.1. The ligation mixture is transformed into competent *E. coli* cells and transformants are selected under selective pressure, e.g., kanamycin selection. The cDNA libraries isolated from the selected transformants are amplified, isolated, and partially sequenced. The partial sequences are then compared to sequences in various publicly available databases for identification.

Any method known in the art may be used for generating ESTs (see, for example, Adams et al., 1991, *Science* 252: 1651–1656; Fields, 1996, *Tibtech* 14: 286–289; Weinstock et al., 1994, *Current Opinion in Biotechnology* 5: 599–603; Matsubara and Okubo, 1993, *Current Opinions in Biotechnology* 4: 672–677; Nelson et al., 1997, *Fungal Genet. Biol.* 21: 348–363; Roe at al., http://www.genome.ou.edu/fungal.html).

In the methods of the present invention, the filamentous fungal ESTs are preferably at least about 50 bp in length, more preferably at least about 100 bp in length, even more preferably at least about 150 bp in length, and most preferably at least about 200 bp in length. Furthermore, the ESTs are preferably directional ESTs. However, nondirectional ESTs may also be used. A "directional EST" is defined as a cDNA cloned in the same orientation relative to the vector cloning sites, e.g., 5'→3' or 3'→5'.

The filamentous fungal ESTs may be obtained from any filamentous fungal cell but preferably from an *Acremonium, Aspergillus, Fusarium, Humicola, Mucor, Myceliophthora, Neurospora, Penicillium, Thielavia, Tolypocladium,* or *Trichoderma* cell, and more preferably from an *Aspergillus aculeatus, Aspergillus awamori, Aspergillus foetidus, Aspergillus japonicus, Asperigillus nidulans, Aspergillus niger, Aspergillus oryzae, Fusarium bactridioides, Fusarium cerealis, Fusarium crookwellense, Fusarium culmorum, Fusarium graminearum, Fusarium gramimum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Thielavia terrestris, Trichoderma harzianium, Trichoderma koningii, Trichoderma longibrachiatum, Trichoderma reesei,* or *Trichoderma viride* cell.

In a preferred embodiment, the ESTs are obtained from *Fusarium venenatum*. In a more preferred embodiment, the ESTs are obtained from *Fusarium venenatum* A3/5, which was originally deposited as *Fusarium gramincarum* ATCC 20334 and recently reclassified as *Fusarium venenatum* by Yoder and Christianson, 1998, *Fungal genetics and Biology* 23: 62–80 and O'Donnell et al., 1998, Fungal Genetics and Biology 23: 57–67; as well as taxonomic equivalents of *Fusarium venenatum* regardless of the species name by which they are currently known. In another more preferred embodiment, the *Fusarium venenatum* cell is a morphological mutant of *Fusarium venenatum* A3/5 or *Fusarium venenatum* ATCC 20334, as disclosed in WO 97/26330. In a most preferred embodiment, the *Fusarium venenatum* ESTs are selected from the group consisting of SEQ ID NOs. 1–3770, nucleic acid fragments of SEQ ID NOs. 1–3770, and nucleic acid sequences having at least 90%, preferably at least 95%, more preferably at least 99%, and most preferably at least 99.9% homology to SEQ ID NOs. 1–3770.

In another preferred embodiment, the ESTs are obtained from *Aspergillus niger*. In another more preferred embodiment, the *Aspergillus niger* ESTs are selected from the group consisting of SEQ ID NOs. 3771–4376, nucleic acid fragments of SEQ ID NOs. 3771–4376, and nucleotide sequences having at least 90%, preferably at least 95%, more preferably at least 99%, and most preferably at least 99.9% homology to SEQ ID NOs. 3771–4376.

In another preferred embodiment, the ESTs are obtained from *Aspergillus oryzae*. In another more preferred embodiment, the ESTs are obtained from *Aspergillus oryzae* strain IFO 4177. In another most preferred embodiment, the *Aspergillus oryzae* ESTs are selected from the group consisting of SEQ ID NOs. 4377–7401, nucleic acid fragments of SEQ ID NOs. 4377–7401, and nucleic acid sequences having at least 90%, preferably at least 95%, more preferably at least 99%, and most preferably at least 99.9% homology to the sequences of SEQ ID NOs. 4377–7401.

In another preferred embodiment, the ESTs are obtained from *Trichoderma reesei*. In another more preferred embodiment, the ESTs are obtained from *Trichoderma reesei* strain RutC-30 (Montenecourt and Eveleigh, 1979, *Adv. Chem. Ser.* 181: 289–301). In another most preferred embodiment, the *Trichoderma reesei* ESTs are selected from the group consisting of SEQ ID NOs. 7402–7860, nucleic acid fragments of SEQ ID NOs. 7402–7860, or nucleic acid sequences having at least 95%, preferably at least 99% and most preferably at least 99.9% homology to a sequence of SEQ ID NOs. 7402–7860.

For purposes of the present invention, the degree of homology between two nucleic acid sequences is determined by the Wilbur-Lipman method (Wilbur and Lipman, 1983, *Proceedings of the National Academy of Science USA* 80: 726–730) using the LASERGENE™ MEGALIGN™ software (DNASTAR, Inc., Madison, Wis.) with an identity table and the following multiple alignment parameters: Gap penalty of 10 and gap length penalty of 10. Pairwise alignment parameters are Ktuple=3, gap penalty=3, and windows=20.

Microarrays

The term "an array of ESTs" is defined herein as a linear or two-dimensional array of preferably discrete elements of ESTs, each having a finite area, formed on the surface of a solid support.

The term "microarray" is defined herein as an array of EST elements having a density of discrete EST elements of at least about 100/cm$^2$, and preferably at least about 1000/cm$^2$. The EST elements in a microarray have typical dimensions, e.g., diameters, in the range of between about 10 to about 250 $\mu$m, preferably in the range of between about 10 to about 200 $\mu$m, more preferably in the range of between about 20 to about 150 $\mu$m, even more preferably in the range of between about 20 to about 100 $\mu$m, most preferably in the range of between about 20 to about 75 $\mu$m, and even most preferably in the range of between about 25 to about 50 $\mu$m, and are separated from other EST elements in the microarray by about the same distance.

Methods and instruments for forming microarrays on the surface of a solid support are well known in the art. See, for example, U.S. Pat. No. 5,807,522; U.S. Pat. No. 5,700,637; and U.S. Pat. No. 5,770,151. The instrument may be an automated device such as described in U.S. Pat. No. 5,807,522.

The term "a substrate containing an array of ESTs" is defined herein as a solid support having deposited on the surface of the support one or more of a plurality of ESTs for use in detecting binding of labeled cDNAs to the ESTs.

The substrate may, in one aspect, be a glass support (e.g., glass slide) having a hydrophilic or hydrophobic coating on the surface of the support, and an array of distinct ESTs electrostatically bound non-covalently to the coating, where each distinct EST is disposed at a separate, defined position.

Each microarray in the substrate preferably contains at least 10$^3$ distinct ESTs in a surface area of less than about 1 cm$^2$. Each distinct EST (i) is disposed at a separate, defined position in the array, (ii) has a length of at least 50 bp, and (iii) is present in a defined amount between about 0.1 femtomoles and 100 nanomoles or higher if necessary.

For a hydrophilic coating, the glass slide is coated by placing a film of a polycationic polymer with a uniform thickness on the surface of the slide and drying the film to form a dried coating. The amount of polycationic polymer added should be sufficient to form at least a monolayer of polymers on the glass surface. The polymer film is bound to the surface via electrostatic binding between negative silyl-OH groups on the surface and charged cationic groups in the polymers. Such polycationic polymers include, but are not limited to, polylysine and polyarginine.

Another coating strategy employs reactive aldehydes to couple DNA to the slides (Schena et al., 1996, *Proceedings of the National Academy of Science USA* 93: 10614–10619; Heller at al., 1997, *Proceedings of the National Academy of Science USA* 94: 2150–2155).

Alternatively, the surface may have a relatively hydrophobic character, i.e., one that causes aqueous medium deposited on the surface to bead. A variety of known hydrophobic polymers, such as polystyrene, polypropylene, or polyethylene, have desirable hydrophobic properties, as do glass and a variety of lubricant or other hydrophobic films that may be applied to the support surface. A support surface is "hydrophobic" if an aqueous droplet applied to the surface does not spread out substantially beyond the area size of the applied droplet, wherein the surface acts to prevent spreading of the droplet applied to the surface by hydrophobic interaction with the droplet.

In another aspect, the substrate may be a multi-cell substrate where each cell contains a microarray of ESTs, and preferably an identical microarray, formed on a porous surface. For example, a 96-cell array may typically have array dimensions between about 12 and 244 mm in width and 8 and 400 mm in length, with the cells in the array having width and length dimension of $\frac{1}{12}$ and $\frac{1}{8}$ the array width and length dimensions, respectively, i.e., between about 1 and 20 in width and 1 and 50 mm in length.

The solid support may include a water-impermeable backing such as a glass slide or rigid polymer sheet, or other non-porous material. Formed on the surface of the backing is a water-permeable film which is formed of porous material. Such porous materials include, but are not limited to, nitrocellulose membrane nylon, polypropylene, and PVDF polymer. The thickness of the film is preferably between about 10 and 1000 $\mu$m. The film may be applied to the backing by spraying or coating, or by applying a preformed membrane to the backing.

The film surface may be partitioned into a desirable array of cells by water-impermeable grid lines typically at a distance of about 100 to 2000 $\mu$m above the film surface. The grid lines can be formed on the surface of the film by laying down an uncured flowable resin or elastomer solution in an array grid, allowing the material to infiltrate the porous film down to the backing, and then curing the grid lines to form the cell-array substrate.

The barrier material of the grid lines may be a flowable silicone, wax-based material, thermoset material (e.g., epoxy), or any other useful material. The grid lines may be applied to the solid support using a narrow syringe, printing techniques, heat-seal stamping, or any other useful method known in the art.

Each well preferably contains a microarray of distinct ESTs. "Distinct ESTs" as applied to the ESTs forming a microarray is defined herein as an array member which is distinct from other array members on the basis of a different EST sequence, and/or different concentrations of the same or distinct ESTs, and/or different mixtures of distinct ESTs or different-concentrations of ESTs. Thus an array of "distinct ESTs" may be an array containing, as its members, (i) distinct ESTs, which may have a defined amount in each member, (ii) different, graded concentrations of given-sequence ESTs, and/or (iii) different-composition mixtures of two or more distinct ESTs.

However, any type of substrate known in the art may be used in the methods of the present invention.

The delivery of a known amount of a selected EST to a specific position on the support surface is preferably performed with a dispensing device equipped with one or more tips for insuring reproducible deposition and location of the ESTs and for preparing multiple arrays. Any dispensing device known in the art may be used in the methods of the present invention. See, for example, U.S. Pat. No. 5,807,522. The dispensing device preferably contains a plurality of tips.

For liquid-dispensing on a hydrophilic surface, the liquid will have less of a tendency to bead, and the dispensed volume will be more sensitive to the total dwell time of the dispenser tip in the immediate vicinity of the support surface.

For liquid-dispensing on a hydrophobic surface, flow of fluid from the tip onto the support surface will continue from the dispenser onto the support surface until it forms a liquid bead. At a given bead size, i.e., volume, the tendency of liquid to flow onto the surface will be balanced by the hydrophobic surface interaction of the bead with the support surface, which acts to limit the total bead area on the surface, and by the surface tension of the droplet, which tends toward a given bead curvature. At this point, a given bead volume will have formed, and continued contact of the dispenser tip with the bead, as the dispenser tip is being withdrawn, will have little or no effect on bead volume.

The desired deposition volume, i.e., bead volume, formed is preferably in the range 2 pl (picoliters) to 2 nl (nanoliters), although volumes as high as 100 nl or more may be dispensed. It will be appreciated that the selected dispensed volume will depend on (i) the "footprint" of the dispenser tip(s), i.e., the size of the area spanned by the tip(s), (ii) the hydrophobicity of the support surface, and (iii) the time of contact with and rate of withdrawal of the tip(s) from the support surface. In addition, bead size may be reduced by increasing the viscosity of the medium, effectively reducing the flow time of liquid from the dispensing device onto the support surface. The drop size may be further constrained by depositing the drop in a hydrophilic region surrounded by a hydrophobic grind pattern on the support surface.

At a given tip size, bead volume can be reduced in a controlled fashion by increasing surface hydrophobicity, reducing time of contact of the tip with the surface, increasing rate of movement of the tip away from the surface, and/or increasing the viscosity of the medium. Once these parameters are fixed, a selected deposition volume in the desired pl to nl range can be achieved in a repeatable fashion.

After depositing a liquid droplet of an EST sample at one selected location on a support, the tip may be moved to a corresponding position on a second support, the EST sample is deposited at that position, and this process is repeated until the EST sample has been deposited at a selected position on a plurality of supports.

This deposition process may then be repeated with another EST sample at another microarray position on each of the supports.

The diameter of each EST region is preferably between about 20–200 µm. The spacing between each region and its closest (non-diagonal) neighbor, measured from center-to-center, is preferably in the range of about 20–400 µm. Thus, for example, an array having a center-to-center spacing of about 250 µm contains about 40 regions/cm$^2$ or 1,600 regions/cm$^2$. After formation of the array, the support is treated to evaporate the liquid of the droplet forming each region, to leave a desired array of dried, relatively flat EST regions. This drying may be done by heating or under vacuum.

Filamentous Fungal Cells

In the methods of the present invention, the two or more filamentous fungal cells may be any filamentous fungal cell where one of the cells is used as a reference for identifying differences in expression of the same or similar complement of genes in the other cell. In one aspect, the two or more cells are the same cell. For example, they may be compared under different growth conditions, e.g., oxygen limitation, nutrition, and/or physiology. In another aspect, one or more cells are mutants of the reference cell. For example, the mutant(s) may have a different phenotype. In a further aspect, the two or more cells are of different species (e.g., *Aspergillus oryzae* and *Asperigillus sojae*). In another further aspect, the two or more cells are of different genera. In an even further aspect, one or more cells are transformants of the reference cell, wherein the one or more transformants exhibit a different property. For example, the transformants may have an improved phenotype relative to the reference cell and/or one of the other transformants. The term "phenotype" is defined herein as an observable or outward characteristic of a cell determined by its genotype and modulated by its environment. Such improved phenotypes may include, but are not limited to, improved secretion or production of a protein or compound, reduced or no secretion or production of a protein or compound, improved or reduced expression of a gene, desirable morphology, an altered growth rate under desired conditions, relief of overexpression mediated growth inhibition, or tolerance to low oxygen conditions.

The filamentous fungal cells may be any filamentous fungal cells, but preferably *Acremonium, Aspergillus, Fusarium, Humicola, Mucor, Myceliophthora, Neurospora, Penicillium, Thielavia, Tolypocladium,* or *Trichoderma* cells, and more preferably *Aspergillus aculeatus, Aspergillus awamori, Aspergillus foetidus, Aspergillus japonicus, Aspergillus nidulans, Aspergillus niger, Aspergillus oryzae, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulation, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Thielavia terrestris, Trichoderma harzianum, Trichoderma koningii, Trichoderma longibrachiatum, Trichoderma reesei,* or *Trichoderma viride* cells.

In a preferred embodiment, the filamentous fungal cells are *Fusarium* or *Aspergillus* cells. In a more preferred embodiment, the *Fusarium* cells are *Fusarium venenatum* cells. In another more preferred embodiment, the *Aspergillus* cells are *Aspergillus niger* cells. In another more preferred embodiment, the *Aspergillus* cells are *Aspergillus oryzae* cells.

In a most preferred embodiment, the *Fusarium venenatum* cells are *Fusarium venenatum* A3/5 cells as described herein. In another most preferred embodiment, the *Fusarium venenatum* cells are morphological mutants of *Fusarium venenatum* A3/5 as described herein. In another most preferred embodiment, the *Aspergillus oryzae* cells are *Aspergillus oryzae* strain IFO 4177 cells.

In the methods of the present invention, the cells are cultivated in a nutrient medium suitable for growth using methods well known in the art for isolation of the nucleic acids to be used as probes. For example, the cells may be cultivated by shake flask cultivation, small-scale or large-scale fermentation (including continuous, batch, fed-batch, or solid state fermentations) in laboratory or industrial fermentors performed in a suitable medium. cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection).

Nucleic Acid Probes

The nucleic acid probes from the two or more filamentous fungal cells may be any nucleic acid including genomic DNA, cDNA, and RNA, and may be isolated using standard methods known in the art. For example, cDNA probes may be obtained from the total polyadenylated mRNA isolated from the cells using standard methods and reverse transcribed into total cDNA.

The populations of isolated nucleic acid probes may be labeled with colorimetric, radioactive, fluorescent reporters, or other reporters using methods known in the art (Chen et. al., 1998, *Genomics* 51: 313–324: DeRisi et al., 1997, *Science* 278: 680–686: U.S. Pat. No. 5,770,367).

In a preferred embodiment, the probes are labeled with fluorescent reporters. For example, cDNA probes may be labeled during reverse transcription from the respective mRNA pools by incorporation of fluorophores as dye-labeled nucleotides (DeRisi et al., 1997, supra), e.g., Cy5-labeled deoxyuridine triphosphate, or the isolated cDNAs may be directly labeled with different fluorescent functional groups. Fluoroescent-labeled nucleotides include, but are not limited to, fluorescein conjugated nucleotide analogs (green fluorescence), lissamine nucleotide analogs (red fluorescence). Fluoroescent functional groups include, but are not limited to, Cy3 (a green fluorescent dye) and Cy5 (red fluorescent dye).

Array Hybridization

The labeled nucleic acids from the two or more filamentous fungal cells are then added to a substrate containing an array of ESTs under conditions where the nucleic acid pools from the two or more filamentous fungal cells hybridize to complementary sequences of the ESTs in the array. For purposes of the present invention, hybridization indicates that the labeled nucleic acids from the two or more cells hybridize to the ESTs under very low to very high stringency conditions.

A small volume of the labeled nucleic acids mixture is loaded onto the substrate. The solution will spread to cover the entire microarray. In the case of a multi-cell substrate, one or more solutions are loaded into each cell which stop at the barrier elements.

For nucleic acid probes of at least about 100 nucleotides in length, very low to very high stringency conditions are defined as prehybridization and hybridization at 42° C. in 5× SSPE, 0.3% SDS, 200 μg/ml sheared and denatured salmon sperm DNA, and either 25% formamide for very low and low stringencies, 35% formamide for medium and medium-high stringencies, or 50% formamide for high and very high stringencies, following standard Southern blotting procedures.

For nucleic acid probes of at least about 100 nucleotides in length, the carrier material is finally washed three times each for 15 minutes using 2× SSC, 0.2% SDS preferably at least at 45° C. (very low stringency), more preferably at least at 50° C. (low stringency), more preferably at least at 55° C. (medium stringency), more preferably at least at 60° C. (medium-high stringency), even more preferably at least at 65° C. (high stringency), and most preferably at least at 70° C. (very high stringency).

For shorter nucleic acid probes which are about 50 nucleotides to about 100 nucleotides in length, stringency conditions are defined as prehybridization, hybridization, and washing post-hybridization at 5° C. to 10° C. below the calculated $T_m$ using the calculation according to Bolton and McCarthy (1962, *Proceedings of the National Academy of Sciences USA* 48:1390) in 0.9 M NaCl, 0.09 M Tris-HCl pH 7.6, 6 mM EDTA, 0.5% NP-40, 1× Denhardt's solution, 1 mM sodium pyrophosphate, 1 mM sodium monobasic phosphate, 0.1 mM ATP, and 0.2 mg of yeast RNA per ml following standard Southern blotting procedures.

For shorter nucleic acid probes which are about 50 nucleotides to about 100 nucleotides in length, the carrier material is washed once in 6× SCC plus 0.1% SDS for 15 minutes and twice each for 15 minutes using 6× SSC at 5° C. to 10° C. below the calculated $T_m$.

The choice of hybridization conditions will depend on the degree of homology between the ESTs and the nucleic acids obtained from the two or more filamentous fungal cells. For example, where the cells are the same cell from which the ESTs were obtained, high stringency conditions may be most suitable. Where the cells are from a genus or species different from which the ESTs were obtained, low or medium stringency conditions may be more suitable.

In a preferred embodiment, the hybridization is conducted under low stringency conditions. In a more preferred embodiment, the hybridization is conducted under medium stringency conditions. In a most preferred embodiment, the hybridization is conducted under high stringency conditions.

The entire solid support is then reacted with detection reagents if needed and analyzed using standard calorimetric, radioactive, or fluorescent detection means. All processing and detection steps are performed simultaneously to all of the microarrays on the solid support ensuring uniform assay conditions for all of the microarrays on the solid support.

Detection

The most common detection method is laser-induced fluorescence detection using confocal optics (Cheung et al., 1998, *Nat. Genet.* 18: 225–230). The array is examined under fluorescence excitation conditions such that (i) the ESTs in the array that hybridize to the nucleic acid probes obtained from one of the first cell and one or more second cells produces a distinct first fluorescence emission color or one or second fluorescence emission colors, respectively, and (ii) ESTs in the array that hybridize to substantially equal numbers of nucleic acid probes obtained from the first cell and one of the one or more second cells produce a distinct combined fluorescence emission color, respectively: wherein the relative expression of the genes in the two or more cells can be determined by the observed fluorescence emission color of each spot in the array.

The fluorescence excitation conditions are based on the selection of the fluorescence reporters. For example, Cy3 and Cy5 reporters are detected with solid state lasers operating at 532 nm and 632 nm, respectively.

Other methods of detection may be used as described herein.

Data Analysis

The fluorescence data obtained from the scanned image may then be analyzed using any of the commercially available image analysis software. The software preferably identifies array elements, subtracts backgrounds, deconvolutes multi-color images, flags or removes artifacts, verifies that controls have performed properly, and normalizes the signals (Chen et al., 1997, *Journal of Biomedical Optics* 2: 364–374).

Several computational methods have been described for the analysis and interpretation of microarray-based expression profiles including cluster analysis (Eisen et al., 1998, *Proc. Nat. Acad. Sci. USA* 95: 14863–14868), and supervised clustering methods based on representative hand-picked or computer-generated expression profiles (Chu et al., 1998, *Science* 282: 699–705).

Computer Readable Media

The filamentous fungal ESTs described herein may be "provided" in a variety of mediums to facilitate their use. The term "provided" refers to a manufacture comprising an array of filamentous fungal ESTs. Such manufactures provide a large portion of the genomes of *Fusarium venenatum, Aspergillus niger, Aspergillus oryzae,* or *Trichoderma reesei* and parts thereof (e.g., an open reading frame (ORF)) in a form which allows one skilled in the art to examine the manufacture using means not directly applicable to examining the genome of a subset thereof as it exists in nature or in purified form.

Thus, the present invention also relates to such a manufacture in the form of a computer readable medium comprising an array of ESTs selected from the group consisting of SEQ ID NOs. 1–7860, nucleic acid fragments of SEQ ID NOs. 1–7860, and nucleic acid sequences having at least 90%, preferably at least 95%, more preferably at least 99%, and most preferably at least 99.9% homology to SEQ ID NOs. 1–7860.

In a preferred embodiment, the computer readable medium comprises an array of *Fusarium venenatum* ESTs selected from the group consisting of SEQ ID NOs. 1—3770, nucleic acid fragments of SEQ ID NOs. 1–3770, and nucleic acid sequences having at least 90%, preferably at least 95%, more preferably at least 99%, and most preferably at least 99.9% homology to SEQ ID NOs. 1–3770. In a more preferred embodiment, the computer readable medium comprises an array of ESTs selected from the group consisting of SEQ ID NOs. 1–3770.

In another preferred embodiment, the computer readable medium comprises an array of *Aspergillus niger* ESTs selected from the group consisting of SEQ ID NOs. 3771–4376, nucleic acid fragments of SEQ ID NOs. 3771–4376, and nucleotide sequences having at least 90%, preferably at least 95%, more preferably at least 99%, and most preferably at least 99.9% homology to SEQ ID NOs. 3771–4376. In another more preferred embodiment, the computer readable medium comprises an array of ESTs selected from the group consisting of SEQ ID NOs. 3771–4376.

In another preferred embodiment, the computer readable medium comprises an array of *Aspergillus oryzae* ESTs selected from the group consisting of SEQ ID NOs. 4377–7401, nucleic acid fragments of SEQ ID NOs. 4377–7401, and nucleic acid sequences having at least 90%, preferably at least 95%, more preferably at least 99%, and most preferably at least 99.9% homology to the sequences of SEQ ID NOs. 4377–7401. In another more preferred embodiment, the computer readable medium comprises an array of ESTs selected from the group consisting of SEQ ID NOs. 4377–7401.

In another preferred embodiment, the computer readable medium comprises an array of *Trichoderma reesei* ESTs selected from the group consisting of SEQ ID NOs. 7402–7860, nucleic acid fragments of SEQ ID NOs. 7402–7860, or nucleic acid sequences having at least 95%, preferably at least 99% and most preferably at least 99.9% homology to a sequence of SEQ ID NOs. 7402–7860. In another more preferred embodiment, the computer readable medium comprises an array of *Trichoderma reesei* ESTs selected from the group consisting of SEQ ID NOs. 7402–7860.

In one application of this embodiment, the ESTs of the present invention can be recorded on computer readable media. The term "computer readable media" is defined herein as any medium which can be read and accessed directly by a computer. Such computer readable media include, but are not limited to, magnetic storage media, e.g., floppy discs, hard disc storage medium, and magnetic tape; optical storage media, e.g., CD-ROM, DVD; electrical storage media, e.g., RAM and ROM; and hybrids of these categories, e.g., magnetic/optical storage media. One skilled in the art can readily appreciate how any of the presently known computer readable media can be used to create a manufacture comprising computer readable medium having recorded thereon a nucleotide sequence of the present invention. Likewise, it will be clear to those of skill how additional computer readable media that may be developed also can be used to create analogous manufactures having recorded thereon a nucleotide sequence of the present invention.

As used herein, "recorded" refers to a process for storing information on computer readable medium. One skilled in the art can readily adopt any of the presently known methods for recording information on computer readable medium to generate manufactures comprising the nucleotide sequence information of the present invention.

A variety of data storage structures are available for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data-processor structuring formats (e.g., text file or database) in order to obtain computer readable medium having recorded thereon the nucleotide sequence information of the present invention.

Various computer software are publicly available that allow a skilled artisan to access sequence information provided in a computer readable medium. Thus, by providing in computer readable form an array of ESTs selected from the group consisting of SEQ ID NOs. 1–7860, nucleic acid fragments of SEQ ID NOs. 1–7860, and nucleic acid sequences having at least 90%, preferably at least 95%, more preferably at least 99%, and most preferably at least 99.9% homology to SEQ ID NOs. 1–7860 enables one skilled in the art to routinely access the provided sequence information for a wide variety of purposes.

Software utilizing the BLAST (Altschul et al., 1990, *Journal of Molecular Biology* 215: 403–410) and BLAZE (Brutlag et al., 1993, *Comp. Chem.* 17: 203–207) search algorithms may be used to identify open reading frames (ORFs) within a genome of interest, which contain homology to ORFs or proteins from both *Fusarium venenatum, Aspergillus niger, Aspergillus oryzae,* or *Trichoderma reesei* and from other organisms. Among the ORFs discussed herein are protein encoding fragments of the *Fusarium venenatum, Aspergillus niger, Aspergillus oryzae,* and *Trichoderma reesei* genome useful in producing commercially important proteins, such as enzymes used in fermentation reactions and in the production of commercially useful metabolites.

The present invention further provides systems, particularly computer-based systems, which contain the sequence information described herein. Such systems are designed to identify, among other things, genes and gene products—many of which could be products themselves or used to genetically modify an industrial expression host through increased or decreased expression of a specific gene sequence(s).

The term "a computer-based system" is defined here the hardware means, software means, and data storage means used to analyze the nucleotide sequence information of the present invention. The minimum hardware means of the computer-based systems of the present invention comprises a central processing unit (CPU), input means, output means, and data storage means. One skilled in the art can readily appreciate that any currently available computer-based system is suitable for use in the present invention.

As stated above, the computer-based systems of the present invention comprise a data storage means having stored therein a nucleotide sequence of the present invention and the necessary hardware means and software means for supporting and implementing a search means.

The term "data storage means" is defined herein as memory which can store nucleotide sequence information of the present invention, or a memory access means which can access manufactures having recorded thereon the nucleotide sequence information of the present invention.

The term "search means" refers is defined herein as one or more programs which are implemented on the computer-based system to compare a target sequence or target structural motif with the sequence information stored within the data storage means. Search means are used to identify fragments or regions of the present genomic sequences which match a particular target sequence or target motif. A variety of known algorithms are disclosed publicly and a variety of commercially available software for conducting search means are and can be used in the computer-based systems of the present invention. Examples of such software includes, but is not limited to, MacPattern (Fuchs, 1991, *Comput. Appl. Biosci.* 7: 105–106). BLASTN and BLASTX (NCBI). One skilled in the art can readily recognize that any one of the available algorithms or implementing software packages for conducting homology searches can be adapted for use in the present computer-based systems.

The term "target sequence" is defined here as any DNA or amino acid sequence of six or more nucleotides or two or more amino acids. One skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that searches for commercially important fragments, such as sequence fragments involved in gene expression and protein processing, may be of shorter length.

The term "a target structural motif" or "target motif" is defined herein as any rationally selected sequence or combination of sequences in which the sequence(s) are chosen based on a three-dimensional configuration which is formed upon the folding of the target motif. There are a variety of target motifs known in the art. Protein target motifs include, but are not limited to, enzyme active sites and signal sequences, substrate and cofactor binding domains, transmembrane domains, and sites for post-translational modifications. Nucleic acid target motifs include, but are not limited to, promoter sequences, hairpin structures and inducible expression elements (protein binding sequences), repeats, palindromes, dyad symmetries, intron-exon boundaries, transcription and translation start and stop sites, and polyadenylation signals.

A variety of structural formats for the input and output means can be used to input and output the information in the computer-based systems of the present invention. A preferred format for an output means ranks fragments of the *Fusarium venenatum, Aspergillus niger, Aspergillus oryzae*, and *Trichoderma reesei* genomic sequences possessing varying degrees of homology to the target sequence or target motif. Such presentation provides one skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *Fusarium venenatum, Aspergillus niger, Aspergillus oryzae*, and *Trichoderma reesei* genomes. For example, implementing software which utilize the BLAST and BLAZE algorithms, described in Altschul et al., 1990, *Journal of Molecular Biology* 215: 403–410, may be used to identify open reading frames within the *Fusarium venenatum, Aspergillus niger, Aspergillus oryzae*, or *Trichoderma reesei* genome or the genomes of other organisms. A skilled artisan can readily recognize that any one of the publicly available homology search programs can be used as the search means for the computer-based systems of the present invention. Of course, suitable proprietary systems that may be known to those of skill also may be employed in this regard.

Tables 1–4 in the present application provide listings of sequences, which can be products themselves or used to genetically modify an industrial expression host through increased or decreased expression of a specific gene sequence(s). These were generated by applying the above-mentioned computer based systems to the sequences of the invention. Tables 1–4 are generally referred to as lists of annotated EST sequences and furthermore serve an important task in the interpretation of the data generated by the method of the present invention.

Substrates

The present invention also relates to substrates as described herein comprising an array of filamentous fungal ESTs. In a preferred embodiment, the substrate comprises an array of filamentous fungal ESTs selected from the group consisting of SEQ ID NOs. 1–7860, nucleic acid fragments of SEQ ID NOs. 1–7860, and nucleic acid sequences having at least 90%, preferably at least 95%, more preferably at least 99%, and most preferably at least 99.9% homology to SEQ ID NOs. 1–7860. In a more preferred embodiment, the substrate comprises an array of EST sequences selected from the group consisting of SEQ ID NOs. 1–7860.

In a preferred embodiment, the substrate comprises an array of *Fusarium venenatum* ESTs selected from the group consisting of SEQ ID NOs. 1–3770, nucleic acid fragments of SEQ ID NOs. 1–3770, and nucleic acid sequences having at least 90%, preferably at least 95%, more preferably at least 99%, and most preferably at least 99.9% homology to SEQ ID NOs. 1–3770. In a more preferred embodiment, the substrate comprises an array of *Fusarium venenatum* ESTs selected from the group consisting of SEQ ID NOs. 1–3770.

In another preferred embodiment, the substrate comprises an array of *Aspergillus niger* ESTs selected from the group consisting of SEQ ID NOs. 3771–4376, nucleic acid fragments of SEQ ID NOs. 3771–4376, and nucleotide sequences having at least 90%, preferably at least 95%, more preferably at least 99%, and most preferably at least 99.9% homology to SEQ ID NOs. 3771–4376. In another more preferred embodiments, the substrate comprises an array of *Aspergillus niger* ESTs selected from the group consisting of SEQ ID NOs. 3771–4376.

In another preferred embodiment, the substrate comprises an array of *Aspergillus oryzae* ESTs selected from the group consisting of SEQ ID NOs. 4377–7401, nucleic acid fragments of SEQ ID NOs. 4377–7401, and nucleic acid sequences having at least 90%, preferably at least 95%, more preferably at least 99%, and most preferably at least 99.9% homology to the sequences of SEQ ID NOs. 4377–7401. In another more preferred embodiment, the substrate comprises an array of *Aspergillus oryzae* ESTs selected from the group consisting of SEQ ID NOs. 4377–7401.

In another preferred embodiment, the substrate comprises an array of *Trichoderma reesei* ESTs selected from the group consisting of SEQ ID NOs. 7402–7860, nucleic acid fragments of SEQ ID NOs. 7402–7860, or nucleic acid sequences having at least 95%, preferably at least 99% and most preferably at least 99.9% homology to a sequence of SEQ ID NOs. 7402–7860. In another more preferred embodiment, the substrate comprises an array of *Trichoderma reesei* ESTs selected from the group consisting of SEQ ID NOs. 7402–7860.

Isolated Nucleic Acids

The present invention also relates to isolated filamentous fungal ESTs.

In a preferred embodiment, the isolated ESTs are *Fusarium venenatum* ESTs selected from the group consisting of SEQ ID NOs. 1–3770, nucleic acid fragments of SEQ ID NOs. 1–3770, and nucleic acid sequences having at least 90%, preferably at least 95%, more preferably at least 99%, and most preferably at least 99.9% homology to SEQ ID NOs. 1–3770. In a more preferred embodiment, the *Fusarium venenatum* ESTs are SEQ ID NOs. 1–3770.

In another preferred embodiment, the isolated ESTs are *Aspergillus niger* ESTs selected from the group consisting of SEQ ID NOs. 3771–4376, nucleic acid fragments of SEQ ID NOs. 3771–4376, and nucleotide sequences having at least 90%, preferably at least 95%, more preferably at least 99%, and most preferably at least 99.9% homology to SEQ ID NOs. 3771–4376. In another more preferred embodiment, the *Aspergillus niger* ESTs are SEQ ID NOs. 3771–4376.

In another preferred embodiment, the isolated ESTs are *Aspergillus oryzae* ESTs selected from the group consisting of SEQ ID NOs. 4377–7401, nucleic acid fragments of SEQ ID NOs. 4377–7401, and nucleic acid sequences having at least 90%, preferably at least 95%, more preferably at least 99%, and most preferably at least 99.9% homology to the sequences of SEQ ID NOs. 4377–7401.

In another preferred embodiment, the isolated ESTs are *Trichoderma reesei* ESTs selected from the group consisting of SEQ ID NOs. 7402–7860, nucleic acid fragments of SEQ ID NOs. 7402–7860, or nucleic acid sequences having at least 95%, preferably at least 99% and most preferably at least 99.9% homology to a sequence of SEQ ID NOs. 7402–7860. In another more preferred embodiment, the *Trichoderma reesei* ESTs are SEQ ID NOs. 7402–7860.

The present invention also relates to isolated nucleic acid sequences comprising any of the filamentous fungal ESTs selected from the group consisting of SEQ ID NOs. 1–7860, nucleic acid fragments of SEQ ID NOs. 1–7860, and nucleic acid sequences having at least 90%, preferably at least 95%, more preferably at least 99%, and most preferably at least 99.9% homology to the sequences of SEQ ID NOs. 1–7860.

The present invention is further described by the following examples which should not be construed as limiting the scope of the invention.

EXAMPLES

Chemicals used as buffers and substrates were commercial products of at least reagent grade.

Example 1

Fermentation and Mycelial Tissue

*Fusarium venenatum* CC1–3, a morphological mutant of *Fusarium* strain ATCC 20334 (Wiebe et al., 1991, *Mycol. Research* 95: 1284–1288), was grown in a two-liter lab-scale fermentor using a fed-batch fermentation scheme with maltose syrup as the carbon source and yeast extract. Ammonium phosphate was provided in the feed. The pH was maintained at 6 to 6.5, and the temperature was kept at 30° C. with positive dissolved oxygen. Mycelial samples were harvested at 2, 4, 6, and 8 days post-inoculum and quick-frozen in liquid nitrogen. The samples were stored at −80° C. until they were disrupted for RNA extraction.

*Aspergillus niger* strain Bo-95 was fermented in a minimal salts, maltodextrin based medium with a subsequent carbon feed of glucose at pH 4.75 and 34° C. Mycelia were harvested and frozen at −80° C. The *Aspergillus niger* mycelial sample was ground to a fine powder in the presence of liquid nitrogen prior to extraction of total cellular RNA.

*Aspergillus oryzae* strain A1560 (IFO 4177) was grown in two 20-liter lab fermentors on a 10-liter scale at 34° C. using yeast extract and dextrose in the batch medium, and maltose syrup, urea, yeast extract, and trace metals in the feed. Fungal mycelia from the first lab fermentor were harvested by filtering through a cellulose filter (pore size 7–11 microns) after 27 hours, 68.5 hours, 118 hours, and 139 hours of growth. The growth conditions for the second fermentor were identical to the first one, except for a slower growth rate during the first 20 hours of fermentation. Fungal mycelia from the second lab fermentor were harvested as above after 68.3 hours of growth. The harvested mycelia were immediately frozen in liquid $N_2$ and stored at −80° C.

The *Aspergillus oryzae* strain A1560 was also grown in four 20-liter lab fermentors on a 10-liter scale at 34° C. using sucrose in the batch medium, and maltose syrup, ammonia, and yeast extract in the feed.

The first of the four fermentations was carried out at pH 4.0.

The second of the four fermentations was carried out at pH 7.0 with a constant low agitation rate (550 rpm) to achieve the rapid development of reductive metabolism.

The third of the four fermentations was carried out at pH 7.0 under phosphate limited growth by lowering the amount of phosphate and yeast extract added to the batch medium.

The fourth of the four fermentations was carried out at pH 7.0 and 39° C. After 75 hours of fermentation the temperature was lowered to 34° C. At 98 hours of fermentation the addition of carbon feed was stopped and the culture was allowed to starve for the last 30 hours of the fermentation.

Fungal mycelial samples from the four lab fermentors above were then collected as described above, immediately frozen in liquid $N_2$, and stored at −80° C.

*Aspergillus oryzae* strain A1560 was also grown on Whatman filters placed on Cove-N agar plates for two days. The mycelia were collected, immediately frozen in liquid N$_2$, and stored at −80° C.

*Aspergillus oryzae* strain A1560 was also grown at 30° C. in 150 ml shake flasks containing RS-2 medium (Kofod et al., 1994, *Journal of Biological Chemistry* 269: 29182–19189) or a defined minimal medium. Fungal mycelia were collected after 5 days of growth in the RS-2 medium and 3 and 4 days of growth in the defined minimal medium, immediately frozen in liquid N$_2$, and stored at −80° C.

*Aspergillus oryzae* strain AL-11 was fermented similarly as described above for *Aspergillus oryzae* strain A1560 in a 20-liter lab fermentor on a 10-liter scale at 34° C. using yeast extract and dextrose in the batch medium, and maltose syrup, urea, yeast extract, and trace metals in the feed with a slow growth rate during the first 20 hours of fermentation. Fungal mycelia were harvested at 74.1 hours as above, immediately frozen in liquid N$_2$ and stored at −80° C.

*Trichoderma reesei* strain RutC-30 (Montenecourt and Eveleigh, 1979, *Adv. Chem. Ser.* 181: 289–301) was cultivated in a pilot scale fermentation tank in growth medium containing a complex carbon source. Fungal mycelium was collected from a one-liter sample, and immediately frozen in liquid N$_2$ and stored at −80° C.

*Trichoderma reesei* strain RutC-30 (Montenecourt and Eveleigh, 1979, *Adv. Chem. Ser.* 181: 289–301) was cultivated in a pilot scale fermentation tank in growth medium containing a complex carbon source. Fungal mycelium was collected from a one-liter sample, and immediately frozen in liquid N$_2$ and stored at −80° C.

Example 2

*Fusarium venenatum* Directional cDNA Library Construction

Total cellular RNA was extracted from the *Fusarium venenatum* mycelial samples described in Example 1 according to the method of Timberlake and Barnard (1981, *Cell* 26: 29–37), and the RNA samples were analyzed by Northern hybridization after blotting from 1% formaldehyde-agarose gels (Davis et al., 1986, *Basic Methods in Molecular Biology*. Elsevier Science Publishing Co., Inc., New York). Polyadenylated mRNA fractions were isolated from total RNA with an mRNA Separator Kit™ (Clontech Laboratories, Inc., Palo Alto, Calif.) according to the manufacturer's instructions. Double-stranded cDNA was synthesized using approximately 5 µg of poly(A)+ mRNA according to the method of Gubler and Hoffman (1983, *Gene* 25: 263–269) except a NotI-(dT)18 primer (Pharmacia Biotech, Inc., Piscataway, N.J.) was used to initiate first strand synthesis. The cDNA was treated with mung bean nuclease (Boehringer Mannheim Corporation, Indianapolis, Ind.) and the ends were made blunt with T4 DNA polymerase (New England Biolabs, Beverly, Mass.).

The cDNA was digested with NotI, size selected by agarose gel electrophoresis (ca. 0.7–4.5 kb), and ligated with pZErO-2.1 (Invitrogen Corporation, Carlsbad, Calif.) which had been cleaved with NotI plus EcoRVm and dephosphorylated with calf-intestine alkaline phosphatase (Boehringer Mannheim Corporation, Indianapolis, Ind.). The ligation mixture was used to transform competent *E. coli* TOP 10 cells (Invitrogen Corporation, Carlsbad, Calif.). Transformants were selected on 2YT agar plates (Miller, 1992, *A Short Course in Bacterial Genetics, A Laboratory Manual and Handbook for Escherichia coli and Related Bacteria*, Cold Spring Harbor Press, Cold Spring Harbor, N.Y.) which contained kanamycin at a final concentration of 50 µg/ml.

Two independent directional cDNA libraries were constructed using the plasmid cloning vector pZErO-2.1. Library A was made using mRNA from mycelia harvested at four days, and Library B was constructed with mRNA from the six day time point. One library (prepared from 4 day cells) consisted about 7.5×10$^4$ independent clones and a second library B (prepared from 6 day cells) consisted of roughly 1.2×10$^5$ clones. Miniprep DNA was isolated from forty colonies in each library and checked for the presence and size of cDNA inserts. In this analysis 39 of 40 colonies (97.5%) from Library A contained inserts with sizes ranging from 600 bp to 2200 bp (avg.=1050 bp). Similarly, 39 of 40 colonies (97.5%) picked from Library B had inserts with sizes ranging from 800 bp to 3600 bp (avg.=1380 bp). Each of these libraries was amplified using standard techniques (Birren, et al., 1998*Genome Analysis*, Volume 2, *Detecting Genes. A Laboratory Manual*, Cold Spring Harbor Laboratory Press, Cold Spring Harbor, N.Y.), and each amplified library was stored as a DNA pool at 4° C. in 10 mM Tris-HCl, pH 7.6, 1 mM EDTA.

Example 3

*Fusarium venenatum* EST Template Preparation

From each directional cDNA library described in Example 2, transformant colonies were picked directly from the transformation plates into 96-well microtiter dishes which contained 200 µl of 2YT broth (Miller, 1992, supra) with 50 µg/ml kanamycin. The plates were incubated overnight at 37° C. without shaking. After incubation 100 µl of sterile 50% glycerol was added to each well. The transformants were replicated into secondary, deep-dish 96-well microculture plates (Advanced Genetic Technologies Corporation, Gaithersburg, Md.) containing 1 ml of Magnificent Broth™ (MacConnell Research, San Diego, Calif.) supplemented with 50 µg of kanamycin per ml in each well. The primary microtiter plates were stored frozen at −80° C. The secondary deep-dish plates were incubated at 37° C. overnight with vigorous agitation (300 rpm) on rotary shaker. To prevent spilling and cross-contamination, and to allow sufficient aeration, each secondary culture plate was covered with a polypropylene pad (Advanced Genetic Technologies Corporation, Gaithersburg, Md.) and a plastic microtiter dish cover. DNA was isolated from each well using the 96-well Miniprep Kit protocol of Advanced Genetic Technologies Corporation (Gaithersburg, Md.) as modified by Utterback et al. (1995, *Genome Sci. Technol.* 1: 1–8).

Example 4

*Aspergillus niger* Directional cDNA Library Construction

Total cellular RNA was extracted from the *Aspergillus niger* mycelial samples described in Example 1 using a QiaEasy RNA maxi kit (QIAGEN, Valencia, Calif.) with the following modification. The extract was sheared by passage up and down in a 16-guage needle three times before the addition of the 70% ethanol step. PolyA+ RNA was isolated using a Qiagen Oligotex kit following the instructions provided by the manufacturer (QIAGEN, Valencia, Calif.).

Double-stranded cDNA was synthesizsed from 5 µg of *Aspergillus oryzae* A1560 poly(A)⁻ RNA by the RNase H method (Gubler and Hoffman 1983, *Gene* 25: 263–269; Sambrook et al., 1989, *Molecular Cloning: A Laboratory Manual*, Cold Spring Harbor Laboratory, Cold Spring Harbor, N.Y.) using a hair-pin modification. The poly(A)⁻ RNA (5 µg in 5 µl of 0.1% diethylpyrocarbonate-treated water) was heated at 70° C. for 8 minutes in a presiliconized. RNase-free Eppendorf tube, quenched on ice, and combined in a final volume of 50 µl with reverse transcriptase buffer (50 mM Tris-Cl pH 8.3, 75 mM KCl, 3 mM MgCl$_2$, 10 mM DTT) containing 1 mM of dATP, dGTP and dTTP, and 0.5 mM of 5-methyl-dClP (Pharmacia, Uppsala, Sweden), 40 units of human placental ribonuclease inhibitor (Promega, Madison, Wis.), 4.81 µg of oligo(dT)$_{1X}$-NotI primer (Pharmacia, Uppsala, Sweden) and 1000 units of SuperScript II RNase H—reverse transcriptase (Life Technologies, Gaithersburg, Md.).

First-strand cDNA was synthesized by incubating the reaction mixture at 45° C. for 1 hour. After synthesis, the mRNA cDNA hybrid mixture was gel filtered through a MicroSpin S-400 HR (Pharmacia, Uppsala, Sweden) spin column according to the manufacturer's instructions.

After gel filtration, the hybrids were diluted in 250 µl of second strand buffer (20 mM Tris-Cl pH 7.4, 90 mM KCl, 4.6 mM MgCl$_2$, 10 mM (NH$_4$)$_2$SO$_4$, 0.16 mM βNAD⁻) containing 200 µM of each dNTP, 60 units of E. coli DNA polymerase 1 (Pharmacia, Uppsala, Sweden), 5.25 units of RNase H (Promega, Madison, Wis.), and 15 units of E. coli DNA ligase (Boehringer Mannheim, Indianapolis, Ind.). Second strand cDNA synthesis was performed by incubating the reaction tube at 16° C. for 2 hours, and an additional 15 minutes at 25° C. The reaction was stopped by addition of EDTA to 20 mM final concentration followed by phenol and chloroform extractions.

The double-stranded cDNA was purified using a QiaQuick PCR spin column according to the manufacturer's instructions (QIAGEN, Valencia, Calif.), washed in 70% ethanol, dried (SpeedVac), and resuspended in 30 µl of Mung bean nuclease buffer (30 mM sodium acetate pH 4.6, 300 mM NaCl, 1 mM ZnSO$_4$, 0.35 mM dithiothreitol, 2% glycerol) containing 25 units of Mung bean nuclease (Pharmacia, Uppsala, Sweden). The single-stranded hair-pin DNA was clipped by incubating the reaction at 30° C. for 30 minutes, followed by addition of 70 µl of 10 mM Tris-Cl, pH 7.5, 1 mM EDTA, phenol extraction, and ethanol precipitation with 2 volumes of 96% ethanol and 0.1 volume 3 M sodium acetate pH 5.2 on ice for 30 minutes.

After treatment of the cDNA with mung bean nuclease, the cDNA was cut with the restriction endonuclease NotI. The cDNA was ligated into a pZERo2 vector (Invitrogen, Carlsbad, Calif.) that had been previously cut with restriction endonucleases EcoRV and NotI. The ligation mixture was used to transform by electroporation E. coli strain DH10B (Life Technologies, Gaithersburg, Md.) to generate approximately 4.5 million kanamycin resistant transformants. The transformants were plated onto 2YT agar plates containing 50 µg/ml kanamycin. The colonies were harvested and DNA was isolated using Qiagen Maxi kits (QIAGEN, Valencia, Calif.) and the instructions supplied by the manufacturer.

An aliquot of the Aspergillus niger DNA preparation was cut with restriction endonuclease NotI and run on an agarose gel. Based upon the migration of standard DNA markers, a band containing DNA from molecular size approximately 3.8 kb to 6.1 kb was excised from the gel and purified with a QiaExII purification kit (QIAGEN, Valencia, Calif.). The cDNA was ligated with T4 DNA polymerase using standard conditions, and used to transform E. coli strain DH10B to kanamycin resistance by electroporation to generate colonies for sequence analysis.

Example 5

Aspergillus niger EST Template Preparation cDNA was isolated from individual kanamycin resistant colonies using a Qiagen 96-well manifold plasmid preparation system (QIAGEN, Valencia, Calif.) and the instructions supplied by the manufacturer.

Example 6

Aspergillus oryzae Directional cDNA Library Construction

Total RNA was prepared from the Aspergillus oryzae mycelial samples described in Example 1 by extraction with guanidinium thiocyanate followed by ultracentrifugation through a 5.7 M CsCl cushion (Chirgwin et al., 1979, Biochemistry 18: 5294–5299) using the following modifications. The frozen mycelia were ground in liquid N$_2$ to a fine powder with a mortar and a pestle, followed by grinding in a precooled coffee mill, and immediately suspended in 5 volumes of RNA extraction buffer (4 M guanidinium thiocyanate, 0.5% sodium laurylsarcosine, 25 mM sodium citrate pH 7.0, 0.1 M β-mercaptoethanol). The mixture was stirred for 30 minutes at room temperature and centrifuged (20 minutes at 10 000 rpm, Beckman) to pellet the cell debris. The supernatant was collected, carefully layered onto a 5.7 M CsCl cushion (5.7 M CsCl, 10 mM EDTA, pH 7.5, 0.1% DEPC; autoclaved prior to use) using 26.5 ml supernatant per 12.0 ml of CsCl cushion, and centrifuged to obtain the total RNA (Beckman, SW 28 rotor, 25 000 rpm, room temperature, 24 hours). After centrifugation the supernatant was carefully removed and the bottom of the tube containing the RNA pellet was cut off and rinsed with 70% ethanol. The total RNA pellet was transferred to an Eppendorf tube, suspended in 500 µl of TE, pH 7.6 (if difficult, heat occasionally for 5 minutes at 65° C.), phenol extracted, and precipitated with ethanol for 12 hours at −20° C. (2.5 volumes of ethanol, 0.1 volume of 3M sodium acetate pH 5.2). The RNA was collected by centrifugation, washed in 70% ethanol, and resuspended in a minimum volume of DEPC. The RNA concentration was determined by measuring OD$_{260-280}$.

The poly(A)⁻ RNA was isolated by oligo(dT)-cellulose affinity chromatography (Aviv & Leder, 1972, Proceedings of the National Academy of Sciences USA 69: 1408–1412). A total of 0.2 g of oligo(dT) cellulose (Boehringer Mannheim, Indianapolis, Ind.) was preswollen in 10 ml of 1× of column loading buffer (20 mM Tris-Cl, pH 7.6, 0.5 M NaCl, 1 mM EDTA, 0.1% SDS), loaded onto a DEPC-treated, plugged plastic column (Poly Prep Chromatography Column, BioRad, Hercules, Calif.), and equilibrated with 20 ml of 1× loading buffer. The total RNA (1–2 mg) was heated at 65° C. for 8 minutes, quenched on ice for 5 minutes and after addition of 1 volume of 2× column loading buffer to the RNA sample loaded onto the column. The eluate was collected and reloaded 2≧3 times by heating the sample as above and quenching on ice prior to each loading. The oligo(dT) column was washed with 10 volumes of 1× loading buffer, then with 3 volumes of medium salt buffer (20 mM Tris-Cl, pH 7.6, 0.1 M NaCl, 1 mM EDTA, 0.1% SDS), followed by elution of the poly(A)⁻ RNA with 3 volumes of elution buffer (10 mM Tris-Cl, pH 7.6, 1 mM EDTA, 0.05% SDS) preheated to 65° C., by collecting 500 µl fractions. The OD$_{260}$ was read for each collected fraction, and the mRNA containing fractions were pooled and ethanol precipitated at −20° C. for 12 hours. The poly(A)⁻ RNA was collected by centrifugation, resuspended in DEPC-DIW and stored in 5–10 µg aliquots at −80° C.

Double-stranded cDNA was synthesized from 5 µg of *Aspergillus oryzae* A1560 poly(A)⁻ RNA by the RNase II method (Gubler and Hoffman 1983, supra; Sambrook et al., 1989, supra) using a hair-pin modification. The poly(A)⁻ RNA (5 µg in 5 µl of DEPC-treated water) was heated at 70° C. for 8 minutes in a pre-siliconized. RNase-free Eppendorf tube, quenched on ice, and combined in a final volume of 50 µl with reverse transcriptase buffer (50 mM Tris-Cl pH 8.3, 75 mM KCl, 3 mM $MgCl_2$, 10 mM DTT) containing 1 mM of dATP, dGTP and dTTP, and 0.5 mM of 5-methyl-dCTP, 40 units of human placental ribonuclease inhibitor, 4.81 µg of oligo(dT)$_{18}$-NotI primer and 1000 units of SuperScript II RNase H—reverse transcriptase.

First-strand cDNA was synthesized by incubating the reaction mixture at 45° C. for 1 hour. After synthesis, the mRNA:cDNA hybrid mixture was gel filtrated through a Pharmacia MicroSpin S-400 HR spin column according to the manufacturer's instructions.

After the gel filtration, the hybrids were diluted in 250 µl of second strand buffer (20 mM Tris-Cl pH 7.4, 90 mM KCl, 4.6 mM $MgCl_2$, 10 mM $(NH_4)_2SO_4$, 0.16 mM βNAD⁻) containing 200 µM of each dNTP, 60 units of *E. coli* DNA polymerase I (Pharmacia, Uppsala, Sweden), 5.25 units of RNase H, and 15 units of *E. coli* DNA ligase. Second strand cDNA synthesis was performed by incubating the reaction tube at 16° C. for 2 hours, and an additional 15 minutes at 25° C. The reaction was stopped by addition of EDTA to 20 mM final concentration followed by phenol and chloroform extractions.

The double-stranded cDNA was ethanol precipitated at −20° C. for 12 hours by addition of 2 volumes of 96% ethanol and 0.2 volume of 10 M ammonium acetate, recovered by centrifugation, washed in 70% ethanol, dried (SpeedVac), and resuspended in 30 µl of Mung bean nuclease buffer (30 mM sodium acetate pH 4.6, 300 mM NaCl, 1 mM $ZnSO_4$, 0.35 mM dithiothreitol, 2% glycerol) containing 25 units of Mung bean nuclease. The single-stranded hair-pin DNA was clipped by incubating the reaction at 30° C. for 30 minutes, followed by addition of 70 µl of 10 mM Tris-Cl, pH 7.5, 1 mM EDTA, phenol extraction, and ethanol precipitation with 2 volumes of 96% ethanol and 0.1 volume 3 M sodium acetate pH 5.2 on ice for 30 minutes.

The double-stranded cDNAs were recovered by centrifugation (20,000 rpm, 30 minutes), and blunt-ended with T4 DNA polymerase in 30 µl of T4 DNA polymerase buffer (20 mM Tris-acetate, pH 7.9, 10 mM magnesium acetate, 50 mM potassium acetate, 1 mM dithiothreitol) containing 0.5 mM of each dNTP, and 5 units of T4 DNA polymerase by incubating the reaction mixture at +16° C. for 1 hour. The reaction was stopped by addition of EDTA to 20 mM final concentration, followed by phenol and chloroform extractions and ethanol precipitation for 12 h at −20° C. by adding 2 volumes of 96% ethanol and 0.1 volume of 3M sodium acetate pH 5.2.

After the fill-in reaction the cDNAs were recovered by centrifugation as above, washed in 70% ethanol, and the DNA pellet was dried in a SpeedVac. The cDNA pellet was resuspended in 25 µl of ligation buffer (30 mM Tris-Cl, pH 7.8, 10 mM $MgCl_2$, 10 mM dithiothreitol, 0.5 mM ATP) containing 2 µg EcoRI adaptors (0.2 µg/µl, Pharmacia, Uppsala, Sweden) and 20 units of T4 ligase by incubating the reaction mix at 16° C. for 12 hours. The reaction was stopped by heating at 65° C. for 20 minutes, and then placed on ice for 5 minutes. The adapted cDNA was digested with NotI by addition of 20 µl autoclaved water, 5 µl of 10× NotI restriction enzyme buffer and 50 units of NotI, followed by incubation for 3 hours at 37° C. The reaction was stopped by heating the sample at 65° C. for 15 minutes. The cDNAs were size-fractionated by agarose gel electrophoresis on a 0.8% SeaPlaque GTG low melting temperature agarose gel (FMC, Rockland, Me.) in 1× TBE (in autoclaved water) to separate unligated adaptors and small cDNAs. The gel was run for 12 hours at 15 V, and the cDNA was size-selected with a cut-off at 0.7 kb by cutting out the lower part of the agarose gel. Then a 1.5% agarose gel was poured in front of the cDNA-containing gel, and the double-stranded cDNAs were concentrated by running the gel backwards until it appeared as a compressed band on the gel. The cDNA-containing gel piece was cut out from the gel and the cDNA was extracted from the gel using the GFX gel hand purification kit (Amersham, Arlington Heights, Ill.) as follows. The trimmed gel slice was weighed in a 2 ml Biopure Eppendorf tube, then 10 ml of Capture Buffer was added for each 10 mg of gel slice, the gel slice was dissolved by incubation at 60° C. for 10 minutes, until the agarose was completely solublized, the sample at the bottom of the tube by brief centrifugation. The melted sample was transferred to the FGX spin column placed in a collection tube, incubated at 25° C. for 1 minite, and then spun at full speed in a microcentrifuge for 30 seconds. The flow-through was discarded, and the column was washed with 500 µl of wash buffer, followed by centrifugation at full speed for 30 seconds. The collection tube was discarded, and the column was placed in a 1.5 ml Eppendorf tube, followed by elution of the cDNA by addition of 50 µl of TE pH 7.5 to the center of the column, incubation at 25° C. for 1 minute, and finally by centrifugation for 1 minute at maximum speed. The eluted cDNA was stored at −20° C. until library construction.

A plasmid DNA preparation for a EcoRI-NotI insert-containing pYES2.0 cDNA clone, was purified using a QIAGEN Tip-100 according to the manufacturer's instructions (QIAGEN, Valencia, Calif. A total of 10 µg of purified plasmid DNA was digested to completion with NotI and EcoRI in a total volume of 60 µl by addition of 6 µl of 10× NEBuffer for EcoRI (New England Biolabs, Beverly, Mass.), 40 units of NotI, and 20 units of EcoRI followed by incubation for 6 hours at 37° C. The reaction was stopped by heating the sample at 65° C. for 20 minutes. The digested plasmid DNA was extracted once with phenol-chloroform, then with chloroform, followed by ethanol precipitation for 12 hours at −20° C. by adding 2 volumes of 96% ethanol and 0.1 volume of 3 M sodium acetate pH 5.2. The precipitated DNA was resuspended in 25 µl in 1× TE pH 7.5, loaded on a 0.8% SeaKem agarose gel in 1× TBE, and run on the gel for 3 hours at 60 V. The digested vector was cut out from the gel, and the DNA was extracted from the gel using the GFX gel band purification kit (Amersham-Pharmacia Biotech. Uppsala, Sweden) according to the manufacturer's instructions. After measuring the DNA concentration by $OD_{208/280}$, the eluted vector was stored at −20° C. until library construction.

To establish the optimal ligation conditions for the cDNA library, four test ligations were carried out in 10 µl of ligation buffer (30 mM Tris-Cl pH 7.8, 10 mM $MgCl_2$, 10 mM DTT, 0.5 mM ATP) containing 7 µl of double-stranded cDNA, (corresponding to approximately ¹⁄₁₀ of the total volume in the cDNA sample), 2 units of T4 ligase, and 25 ng, 50 ng and 75 ng of EcoRI-NotI cleaved pYES2.0 vector, respectively (Invitrogen). The vector background control ligation reaction contained 75 ng of EcoRI-NotI cleaved pYES.0 vector without cDNA. The ligation reactions were performed by incubation at 16° C. for 12 hours, heated at 65° C. for 20 minutes, and then 10 μl of autoclaved water was added to each tube. One μl of the ligation mixtures was electroporated (200 W, 2.5 kV, 25 mF) to 40 μl electrocompetent *E. coli* DH10B cells (Life Technologies, Gaithersburg, Md.). After addition of 1 ml SOC to each transformation mix, the cells were grown at 37° C. for 1 hour, 50 μl and 5 μl from each electroporation were plated on LB plates supplemented with ampicillin at 100 μg per ml and grown at 37° C. for 12 hours. Using the optimal conditions, 18 *Aspergillus oryzae* A1560 cDNA libraries containing 1–2.5×10$^7$ independent colony forming units was established in *E. coil*, with a vector background of ca. 1%. The cDNA library was stored as (1) individual pools (25,000 c.f.u./pool) in 20% glycerol at −80° C.; (2) cell pellets of the same pools at −20° C.; (3) Qiagen purified plasmid DNA from individual pools at −20° C. (Qiagen Tip 100); and (4) directional, double-stranded cDNA at −20° C.

Example 7

*Aspergillus oryzae* EST Template Preparation

From each cDNA library described in Example 6, transformant colonies were picked directly from the transformation plates into 96-well microtiter dishes (QIAGEN, GmbH, Hilden Germany) which contained 200 μl TB broth (Life Technologies, Frederick, Md.) with 100 μg ampicillin per ml. The plates were incubated 24 hours with agitation (300 rpm) on a rotary shaker. To prevent spilling and cross-contamination, and to allow sufficient aeration, the plates were covered with a microporous tape sheet AirPore™ (QIAGEN GmbH, Hinden Germany).

cDNA was isolated from each well using the QIAprep 96 Turbo kit (QIAGEN GmbH, Hilden Germany).

Example 8

*Trichoderma reesei* Directional cDNA Library Construction

Total RNA was prepared from the *Trichoderma reesi* mycelial samples described in Example 1 by extraction with guanidinium thiocyanate followed by ultracentrifugation through a 5.7 M CsCl cushion (Chirgwin et al., 1979, *Biochemistry* 18: 5294–5299) as described in Example 6. The total RNA concentration was determined by measuring OD$_{260/280}$.

The poly(A)$^+$RNA was isolated by oligo(dT)-cellulose affinity chromatography (Aviv & Leder, 1972, *Proceedings of the National Academy of Sciences USA* 69: 1408–1412) as described in example 6. Double-stranded EcoRI-NotI-directional cDNA was synthesized from 5 μg of *Trichoderma reesei* RutC-30 poly(A)$^+$ RNA by the method described in example 6. The cDNAs wee size-fractionated by agarose gel electrophoresis on a 0.8% SeaPlaque GTG low melting temperature agarose gel (FMC, Rockland, Me.) in 1× TBE (in autoclaved water) to separate unligated adaptors and small cDNAs. The gel was run for 12 hours at 15 V, and the cDNA was size-selected with a cut-off at 0.7 kb by cutting out the lower part of the agarose gel. The cDNAs were recovered from the agarose gel as described in Example 6, and ligated into EcoRI-NotI cleaved pYES2.0 vector, using the optimal ligation conditions described in Example 6, resulting in a cDNA library comprising ca. 1×10$^7$ independent colony forming units was established in *E. coli*, with a vector background of 1%. The cDNA library was stored as (1) individual pools (25,000 c.f.u./pool) in 20% glycerol at −80° C.; (2) cell pellets of the same pools at −20° C.; (3) Qiagen purified plasmid DNA from individual pools at −20° C. (Qiagen Tip 100); and (4) directional, double-stranded cDNA at −20° C.

Example 9

*Trichoderma reesei* EST Template Preparation cDNA was isolated from individual *Trichoderma reesei* colonies using a Qiagen 96-well manifold plasmid preparation system (QIAGEN, Valencia, Calif.) and the instructions supplied by the manufacturer.

Example 10

DNA Sequencing and Analysis of Nucleotide Sequence Data of the *Fusarium venenatum* EST Library Single-pass DNA sequencing was conducted with a Perkin-Elmer Applied Biosystems Model 377 XI. Automatic DNA Sequencer (Perkin-Elmer Applied Biosystems, Inc., Foster City, Calif.) using dye-terminator chemistry (Giesecke et al., 1992, *Journal of Virology Methods* 38: 47–60) and the reverse lac sequencing primer.

Nucleotide sequence data were scrutinized for quality, and samples giving improper spacing or ambiguity levels exceeding 2% were discarded or re-run. Vector sequences were trimmed manually with assistance of FACTURA™ software (Perkin-Elmer Applied Biosystems, Inc. Foster City, Calif.). In addition, sequences were truncated at the end of each sample when the number of ambiguous base calls increased. All sequences were compared to each other to construct overlapping contigs using AutoAssembler™ software (Perkin-Elmer Applied Biosystems, Inc., Foster City, Calif.). The contigs were subsequently used in combination with TIGR Assembler software (Sutton et al., 1995, *Genome Science and Technology* 1: 9019) to determine multiplicity of various cDNA species represented in each library. Lastly, all sequences were translated in three frames and searched against a non-redundant data base (NRDB) using GeneAssist™ software (Perkin-Elmer Applied Biosystems, Inc., Foster City, Calif.) with a modified Smith-Waterman algorithm using the BLOSUM 62 matrix with a threshold score of 70. The NRDB was assembled from Genpept, Swiss-Prot, and PIR databases.

The *Fusarium venenatum* EST sequences are designated SEQ ID NOs. 1–3770. An "N" in a nucleic acid sequence means that the nucleotide is an A, C, G, or T.

Example 11

DNA Sequencing and Analysis of Nucleotide Sequence Data of the *Aspergillus niger* EST Library DNA sequencing was performed as described in Example 10. Following DNA sequencing, the generation of individual EST sequence files was performed by removal of flanking vector and polyA sequences, removal of sequences with a high percentage of ambiguous base calls, and removal of all sequences less than 100 processed nucleotides in length. Contiguous EST sequences were identified using the TIGR Assembler software (Sutton et al., 1995, supra).

The *Aspergillus niger* EST sequences are designated SEQ ID NOs. 3771–4376. An "N" in a nucleic acid sequence means that the nucleotide is an A, C, G, or T.

Example 12

DNA Sequencing and Analysis of Nucleotide Sequence Data of the *Aspergillus oryzae* EST Library Single-pass DNA sequencing of the *Aspergillus oryzae* ESTs was conducted with a Perkin-Elmer Applied Biosystems Model 377 XL Automatic DNA Sequencer (Perkin-Elmer Applied Biosystems, Inc., Foster City, Calif.) using dye-terminator chemistry (Giesecke et al., 1992, *Journal of Virology Methods* 38: 47–60) and a pYES specific primer (Invitrogen, Carlsbad, Calif.). Vector sequences were removed with the crossmatch program from the Phred/Phrap package (Ewing and Green, 1998, *Genome Research* 8: 186–194). The sequences were assembled with Phrap also from the Phred/Phrap package. The assembled sequences were searched with fatx3 (Pearson and Lipman, 1988, *Proceedings of the National Academy of Science USA* 85: 2444–2448; Pearson, 1990, *Methods in Enzymology* 183: 63–98) against a customized database consisting of protein sequences from SWISSPROT, SWISSPROTNEW, TREMBL, TREMBLNEW, REMTREMBL, PDB and GeneSeqP. The matrix used was BL50.

The *Aspergillus oryzae* EST sequences are designated SEQ ID NOs. 4377–7401. An "N" in a nucleic acid sequence means that the nucleotide is an A, C, G, or T.

Example 13

DNA Sequencing and Analysis of Nucleotide Sequence Data of the *Trichoderma reesei* EST Library Single-pass DNA sequencing of the *Trichoderma reesei* ESTs was conducted with a Perkin-Elmer Applied Biosystems Model 377 XL Automatic DNA Sequencer (Perkin-Elmer Applied Biosystems, Inc., Foster City, Calif.) using dye-terminator chemistry (Giesecke et al., 1992, *Journal of Virology Methods* 38: 47–60) and a pYES specific primer (Invitrogen, Carlsbad, Calif.). Vector sequence and low quality 3' sequence were removed with the pregap program from the Staden package (MRC, Cambridge, England). The sequences were assembled with Cap2 (Huang, 1996, *Genomics* 33: 21–31). The assembled sequences were searched with fastx3 (see Pcarson and Lipman, 1988, *Proceedings of the National Academy of Science USA* 85: 2444–2448; Pearson, 1990, *Methods in Enzymology* 183: 63–98) against a customized database consisting of protein sequences from SWISSPROT, SWISSPROTNEW, TREMBL, TREMBLNEW, REMTREMBL, PDB and GeneSeqP. The matrix used was BL50.

The *Trichoderma reesei* EST sequences are designated SEQ ID NOs. 7402–7860. An "N" in a nucleic acid sequence means that the nucleotide is an A, C, G, or T.

Example 14

Compilation of *Fusarium venenatum*, *Aspergillus niger*, *Aspergillus oryzae*, and *Trichoderma reesei* ESTs Tables 1–4 summarize the open reading frames (ORFs) in the *Fusarium venenatum*, *Aspergillus oryzae*, *Aspergillus oryzae*, and *Trichoderma reesei* EST sequences of the invention.

The EST's were annotated by searching the databases as specified in Example 12. The description field from the database hit was assigned to a given EST if the z-score exceeded 200.

Functional categorization was done by use of the COG database (Tatusov et al., *Science* 1997 Oct 24; 278). This database contains 21 complete genomes: Each gene in the database is placed into one of the following categories: Translation, ribosomal structure and biogenesis; transcription; DNA replication, recombination and repair; cell division and chromosome partitioning; posttranslational modification, protein turnover, chaperones; cell envelope biogenesis, outer membrane; cell motility and secretion; inorganic ion transport and metabolism; signal transduction mechanisms; energy production and conversion; carbohydrate transport and metabolism; amino acid transport and metabolism; nucleotide transport and metabolism; coenzyme metabolism; lipid metabolism; general function prediction only; and function unknown. The EST's were searched against the COG database with fastx3 and a functional category was assigned to a sequence if a match was found with a z-score higher than 400.

The sequences were furthermore categorized into enzyme families. Examples of such classification are CAZy (Coutinho, P. M. & Henrissat, B., 1999, Carbohydrate-active enzymes: an integrated database approach, In *Recent Advances in Carbohydrate Bioengineering*, H. J. Gilbert, G. Davies, B. Henrissat and B. Svensson, eds., The Royal Society of Chemistry, Cambridge, in press) and (Coutinho, P. M. & Henrissat, B. (1999) The modular structure of cellulases and other carbohydrate-active enzymes: an integrated database approach, In "*Genetics, Biochemistry and Ecology of Cellulose Degradation*", K. Ohmya. K. Hyashi, K. Sakka, Y. Kobayashi, S. Karita and T. Kimura eds., Uni Publishers Co., Tokyo, pp. 15–23) accessible from Coutinho, P. M. & Henrissat, B. (1999); Carbohydrate-Active Enzymes server at URI, http://afmb.cnrs-mrs.fr/~pedro/CAZY/db.huml. At this site classifications into (a) Glycosidases and Transglycosidases (or Glycoside Hydrolases), (b) Glycosyltransferases, and (c) Polysaccharide Lyases and Carbohydrate Esterases are available.

Similarly, classifications of peptidases are available at the MEROPS database at http://www.bi.bbsrc.ac.uk/Merops/Merops.htm. This classification is essentially as identified by Rawlings and Barrett (Rawlings, N. D., Barrett A. J., 1993, Evolutionary families of peptidases. *Biochemical Journal* 290: 205–218; Rawlings N. D., Barrett A. J., 1994, Families of serine peptidases. *Methods of Enzymology* 244: 19–61; Rawlings N. D., Barrett A. J., 1994, Families of cysteine peptidases. *Methods of Enzymology* 244: 461–486; Rawlings N. D., Barrett A. J., 1995. Families of aspartic peptidases and those of unknown catalytic mechanism. *Methods of Enzymology* 248: 105–120; and Rawlings N. D., Barrett A. J., 1995, Evolutionary families of metallopeptidases, *Methods of Enzymology* 248: 183–228.

Other classifications of lipases and oxidoreductase families were constructed in a similar manner, where structurally related enzymes were separated into distinct categories.

The EST sequences of the invention were compared by means of computer algorithms for homologies to the content of individual families. All sequences from a given family were used individually as a query to search a database of EST sequences of the invention using a number of different homology search algorithms like FASTA and BLAST (W. R. Pearson, 1990, Rapid and Sensitive Sequence Comparison with FASTP and FASTA, *Methods in Enzymology* 183: 63–98; and Altschul, Stephen F., Warren Gish, Webb Miller, Eugene W. Myers, and David J. Lipman, 1990. Basic local alignment search tool, *Journal of Molecular Biology* 215: 403–10). A distinct hit to a sequence of a given family predicted the particular EST sequence to encode a protein of that family. Using this method, part of the EST sequences listed in the table were shown to belong to distinct enzyme families.

TABLE 1

Fusarium venenatum ESTs

| Sequence Listing | zscore | Annotation | Database | Functional category |
|---|---|---|---|---|
| 1 | 2667.2 | *Talaromyces emersonii* glucoamylase | geneseqp Y23339 | ND |
| 2 | 4203.8 | ELONGATION FACTOR 2 (EF-2). | swissprot P32324 | ND |
| 3 | 3198.0 | ATP SYNTHASE BETA CHAIN, MITOCHONDRIAL PRECURSOR (EC 3.6.1 34). | swissnew P23704 | ND |
| 4 | 1956.9 | TRANSPORTER MEPA | sptrembl q9y877 | Inorganic ion transport and metabolism |
| 6 | 2960.4 | ELONGATION FACTOR 1-ALPHA (EF-1-ALPHA) | swissprot P34825 | ND |
| 7 | 2917.2 | ABCI TRANSPORTER. | sptrembl O13407 | ND |
| 8 | 2791.3 | GAMMA-ACTIN. | tremblnew AAF00008 | ND |
| 9 | 2703.6 | TUBULIN BETA CHAIN. | swissprot P53374 | ND |
| 12 | 2561.0 | CITRATE SYNTHASE. MITOCHONDRIAL PRECURSOR (EC 4.1.3.7). | swissprot P34085 | ND |
| 13 | 2554.9 | 60S RIBOSOMAL PROTEIN L3. | tremblnew AAF15600 | ND |
| 14 | 2522.1 | *Microscilla furvescens* catalase-53CA1. | geneseqp W33810 | Inorganic ion transport and metabolism |
| 15 | 2436.2 | *Cladosporium herbarum* allergen C1ah53. | geneseqp R71891 | Energy production and conversion |
| 16 | 2350.6 | THIAZOLE BIOSYNTHETIC ENZYME PRECURSOR (STRESS-INDUCIBILE PROTEIN ST135). | swissprot P23618 | ND |
| 17 | 2331.8 | SUBTILISIN-LIKE PROTEASE PR1H. | tremblnew CAB63907 | Posttranslational modification. protein turnover. chaperones |
| 18 | 2293.3 | ALPHA-TUBULIN. | tremblnew CAA74848 | ND |
| 21 | 2165.4 | GUANINE NUCLEOTIDE-BINDING PROTEIN BETA SUBUNIT-LIKE PROTEIN (CROSS-PATHWAY CONTROL WD-REPEAT PROTEIN CPC-2). | swissprot Q01369 | ND |
| 22 | 2148.3 | AMINO-ACID PERMEASE INDA1. | swissprot P34054 | ND |
| 24 | 2125.9 | NMT1 PROTEIN HOMOLOG. | swissprot P42882 | Inorganic ion transport and metabolism |
| 25 | 2090.9 | PUTATIVE MULTICOPPER OXIDASE YFL041W PRECURSOR (EC 1.-.-.-). | swissprot P43561 | ND |
| 26 | 2082.1 | PLASMA MEMBRANE ATPASE (EC 3.6.1.35) (PROTON PUMP). | swissprot Q07421 | Inorganic ion transport and metabolism |
| 27 | 2071.7 | PLASMA MEMBRANE ATPASE (EC 3.6.1.35) (PROTON PUMP). | swissprot Q07421 | ND |
| 28 | 2039.0 | ADP.ATP CARRIER PROTEIN (ADP/ATP TRANSLOCASE) (ADENINE NUCLEOTIDE TRANSLOCATOR) (ANT). | swissprot P02723 | ND |
| 29 | 2026.4 | AIP SYNTHASE ALPHA CHAIN. MITOCHONDRIAL PRECURSOR (EC 3.6.1.34). | swissnew P87211 | ND |
| 30 | 2025.5 | HEAT SHOCK 70 KD PROTEIN. | swissprot Q05944 | Posttranslational modification. protein turnover. chaperones |
| 31 | 1960.7 | *T. harzianum* exochitinase. | geneseqp W01639 | ND |

TABLE 1-continued

*Fusarium venenatum* ESTs

| Sequence Listing | zscore | Annotation | Database | Functional category |
|---|---|---|---|---|
| 32 | 1916.8 | PUTATIVE DEHYDROXY-ACID DEHYDRATASE, MITOCHONDRIAL PRECURSOR(EC 4.2.1.9) (DAD) (2.3-DIHYDROXY ACID HYDROLYASE). | swissprot Q10318 | ND |
| 33 | 1905.0 | CUTINASE TRANSCRIPTION FACTOR 1 ALPHA. | swissprot P52958 | ND |
| 34 | 1903.2 | EUKARYOTIC INITIATION FACTOR 4A-LIKE PROTEIN C1F5.10. | swissprot Q10055 | ND |
| 35 | 1894.8 | NADH DEHYDROGENASE SUBUNIT. | sptrembl Q01388 | ND |
| 36 | 1869.1 | TRANSLATION RELEASE FACTOR ERF3. | sptrembl O42787 | Amino acid transport and metabolism |
| 37 | 1868.4 | GLYCERALDEHYDE 3-PHOSPHATE DEHYDROGENASE (EC 1.2.1.12) (GAPDH). | swissprot P35143 | ND |
| 38 | 1852.7 | VACUOLAR ATP SYNTHASE CATALYTIC SUBUNIT A (EC 3.6.1.34)(V-ATPASE 67 KD SUBUNIT). | swissprot P11592 | ND |
| 39 | 1838.0 | PEROXISOMAL HYDRATASE-DEHYDROGENASE-EPIMERASE (HDE) (MULTINATIONAL BETA-OXIDATION PROTEIN) (MFP) [INCLUDES: 2-ENOYL-COA HYDRATASE (EC 4.2.1.-); D-3-HYDROXYACYL COA DEHYDROGENASE (EC 1.1.1.-)]. | swissnew Q01373 | ND |
| 42 | 1816.8 | *N. crassa* glucoamylase. | geneseqp R71034 | ND |
| 43 | 1798.7 | XANTHINE DEHYDROGENASE (EC 1.1.1.204)(PURINE HYDROXYLASE 1). | swissprot Q12553 | ND |
| 44 | 1769.7 | 78 KD GLUCOSE-REGULATED PROTEIN HOMOLOG PRECURSOR (GRP 78) (IMMUNOGLOBULIN HEAVY CHAIN BINDING PROTEIN HOMOLOG) (BIP). | swissnew P78695 | ND |
| 45 | 1769.5 | RIBONUCLEOSIDE-DIPHOSPHATE REDUCTASE M2 CHAIN (EC 1.17.4.1) REDUCTASE) | swissprot P31350 | Nucleotide transport |
| 47 | 1740.5 | 6-PHOSPHOGLUCONATE DEHYDROGENASE. DECARBOXYLATING 1 (EC 1.1.1.44). | swissprot P38720 | ND |
| 48 | 1711.5 | SERINE/THREONINE PROTEIN PHOSPHATASE PP2A CATALYTIC SUBUNIT (EC 3.1.3.16). | swissprot P48580 | ND |
| 49 | 1701.5 | GEL 1 PROTEIN. | sptrembl O74687 | ND |
| 50 | 1691.1 | PUTATIVE LYSYL-TRNA SYNTHETASE. | tremblnew CAB52801 | ND |
| 51 | 1671.7 | SIMILAR TO GLUTAMATE DECARBOXYLASE. | sptrembl Q05567 | ND |
| 52 | 1634.0 | GLYCOGEN SYNTHASE. | sptrembl O93869 | Cell envelope biogenesis, outer membrane |
| 53 | 1630.0 | CHROMOSOME XVI READING FRAME ORF YPL235W | sptrembl Q12464 | DNA replication, recombination and repair |

TABLE 1-continued

_Fusarium venenatum ESTs_

| Sequence Listing | zscore | Annotation | Database | Functional category |
|---|---|---|---|---|
| 54 | 1626.3 | TRANSALDOLASE (EC 2.2.1.2). | sptrembl O42700 | Carbohydrate transport and metabolism |
| 56 | 1614.8 | KETOL-ACID REDUCTOISOMERASE PRECURSOR (EC 1.1.1.86) (ACETOHYDROXY-ACID REDUCTOISOMERASE) (ALPHA-KETO-BETA-HYDROXYLACIL REDUCTOISOMERASE). | swissnew P38674 | Amino acid transport and metabolism |
| 57 | 1609.5 | GLUTAMATE SYNTHASE [NADH] PRECURSOR (EC 1.4 1.14) (NADH-GOGAT) | swissnew Q03460 | ND |
| 58 | 1600.3 | DICARBOXYLIC AMINO ACID PERMEASE. | swissprot P53388 | ND |
| 59 | 1599.3 | Yeast ribosomal protein 57. | geneseqp W36115 | ND |
| 60 | 1579.6 | SODIUM TRANSPORT ATPASE EST. | sptrembl Q00877 | ND |
| 61 | 1577.3 | SIMILAR TO ASPARTATE AMINOTRANSFERASE. | sptrembl Q17994 | Amino acid transport and metabolism |
| 63 | 1562.2 | EUKARYOTIC INITIATION FACTOR 4A (EIF-4A). | swissprot P47943 | ND |
| 65 | 1552.1 | SUCCINATE DEHYDROGENASE [UBIQUINONE] IRON-SULFUR PROTEIN. MITOCHONDRIAL PRECURSOR (EC 1.3.5.1) (IP). | swissnew O42772 | ND |
| 67 | 1546.9 | ACTIN-LIKE PROTEIN 3. | swissprot P78712 | Cell division and chromosome partitioning |
| 68 | 1538.6 | HYPOTHETICAL 44.3 KD PROTEIN (C27E2.03C IN CHROMOSOME I. | sptrembl O13998 | ND |
| 69 | 1529.6 | BETA-GLUCOSIDASE 1 PRECURSOR (EC 3.2.1.21) (GENTIOBIASE) (CELLOBIASE) (BETA-D-GLUCOSIDE GLUCOHYDROLASE). | swissprot P48825 | ND |
| 70 | 1528.3 | GLUCOSE-6-PHOSPHATE ISOMERASE (GPI) (EC 5.3.1.9) (PHOSPHOGLUCOSE ISOMERASE) (PGI) (PHOSPHOHEXOSE ISOMERASE)(PHI). | swissprot P12709 | Carbohydrate transport and metabolism |
| 71 | 1527.0 | 2-OXOGLUTARATE DEHYDROGENASE E1 COMPONENT. MITOCHONDRIAL PRECURSOR (EC 1.2.4.2) (ALPHA-KETOGLUTARATE DEHYDROGENASE) | swissprot P20967 | ND |
| 72 | 1505.5 | PROTEIN DISULPHIDE ISOMERASE PRECURSOR. | sptrembl O74568 | ND |
| 74 | 1497.5 | NADH-UBIQUINONE OXIDOREDUCTASE 51 KD SUBUNIT PRECURSOR (EC 1.6.5.3) (EC 1.6.99.3) (COMPLEX 1-51 KD) (C1-51KD). | swissprot P24917 | Energy production and conversion |
| 75 | 1483.5 | HYPOTHETICAL 26.6 KD PROTEIN IN THYA-COTC INTERGENIC REGION. | swissprot O31803 | ND |
| 76 | 1466.7 | 60S RIBOSOMAL PROTEIN L2 (YL6) (L5) (RP8). | swissprot P05736 | ND |
| 77 | 1464.3 | BETA ADAPTIN - LIKE PROTEIN. | sptrembl O81742 | ND |
| 78 | 1461.9 | 60S RIBOSOMAL PROTEIN L5. | swissprot O59953 | ND |

TABLE 1-continued

*Fusarium venenatum* ESTs

| Sequence Listing | zscore | Annotation | Database | Functional category |
|---|---|---|---|---|
| 79 | 1457.7 | GTP-BINDING NUCLEAR PROTEIN GSP2/CNR2. | swissprot P32836 | ND |
| 80 | 1454.0 | 3-KETOACYL-COA THIOLASE, PEROXISOMAL PRECURSOR (EC 2.3.1.16) (BETA-KETOTHIOLASE) (ACETYL-COA ACYLTRANSFERASE) (PEROXISOMAL 3-OXOACYL-COA THIOLASE). | swissprot Q05493 | ND |
| 81 | 1442.5 | ELONGATION FACTOR 3 (FRAGMENT). | sptrembl O94226 | ND |
| 82 | 1435.1 | 60S RIBOSOMAL PROTEIN 1.1-B (L10A). | swissprot O71836 | ND |
| 83 | 1432.7 | HEAT SHOCK PROTEIN 70. | sptrembl O42808 | ND |
| 84 | 1427.4 | TRANSCRIPTIONAL ACTIVATOR PROTEIN ACU-15. | swissprot P87000 | ND |
| 85 | 1423.2 | INORGANIC PYROPHOSPHATASE (EC 3 6.1.1) (PYROPHOSPHATE PHOSPHO- HYDROLASE) (PPASE). | swissprot O13505 | Energy production and conversion |
| 86 | 1419.8 | MITOCHONDRIAL ATP-DEPENDENT PROTEASE PRECURSOR (EC 3.4.21.-). | swissprot P36775 | Posttranslational modification, protein turnover, chaperones |
| 87 | 1408.4 | 60S RIBOSOMAL PROTEIN L10. | tremblnew CAA22664 | ND |
| 88 | 1405.9 | CHITINASE. | sptrembl Q92222 | ND |
| 89 | 1399.7 | HISTIDINE KINASE (FRAGMENT). | tremblnew AAD40816 | Signal transduction mechanisms |
| 90 | 1389.9 | CUTINASE G-BOX BINDING PROTEIN. | sptrembl Q00878 | ND |
| 91 | 1388.1 | FLAVOHEMOGLOBIN. | sptrembl O74183 | ND |
| 92 | 1384.8 | ACTIN-LIKE PROTEIN. | tremblnew CAB52711 | Cell division and chromosome partitioning |
| 93 | 1383.3 | *Trichoderma reesei* ACEI transcriptional activator protein. | geneseqp W58572 | ND |
| 94 | 1375.8 | 40S RIBOSOMAL PROTEIN S3AE (SI). | swissprot P40910 | ND |
| 95 | 1370.2 | GLUCOSAMINE-6-PHOSPHATE ISOMERASE (EC 5.3.1.10) (GLUCOSAMINE-6-PHOSPHATE DEAMINASE) (GNPDA) (GLCN6P DEAMINASE)(OSCILLIN) (KIAA0060). | swissprot P46926 | Carbohydrate transport and metabolism |
| 96 | 1365.9 | 14-3-3. | tremblnew BAA89421 | ND |
| 97 | 1360.4 | C-1-TETRAHYDROFOLATE SYNTHASE. | sptrembl O42992 | ND |
| 98 | 1353.6 | PYRABCN (EC 6.3.5.5). | sptrembl O93937 | Nucleotide transport |
| 99 | 1350.8 | ASPARAGINE SYNTHETASE. | sptrembl O42902 | ND |
| 100 | 1349.2 | UBIQUITIN--PROTEIN LIGASE RSP5 (EC 6.3.2.-). | swissprot P39940 | ND |
| 101 | 1346.1 | ELONGATION FACTOR 3 (EF-3). | swissprot P25997 | ND |
| 102 | 1338.9 | ENOLASE (EC 4.2.1.11). | tremblnew BAA23760 | ND |
| 103 | 1334.9 | GTP-BINDING PROTEIN YPT1. | swissprot P33723 | ND |
| 104 | 1331.5 | CONSERVED HYPOTHETICAL PROTEIN. | sptrembl O59761 | Energy production and conversion |
| 105 | 1328.2 | CYCLOPHILIN. MITOCHONDRIAL FORM PRECURSOR (EC 5.2.1.8). | sptrembl Q99009 | ND |

TABLE 1-continued

*Fusarium venenatum* ESTs

| Sequence Listing | zscore | Annotation | Database | Functional category |
|---|---|---|---|---|
| 107 | 1314.0 | 40S RIBOSOMAL PROTEIN S6. | swissprot P05752 | ND |
| 108 | 1310.8 | 26S PROTEASE REGULATORY SUBUNIT 7 HOMOLOG (CIM5 PROTEIN) (TAT-BINDING HOMOLOG 3). | swissprot P33299 | Posttranslational modification. protein turnover. chaperones |
| 109 | 1309.4 | ACETYL-COA HYDROLASE (EC 3.1.2.1) (ACETYL-COA DEACYLASE) (ACETYL-COA ACYLASE) (ACETATE UTILIZATION PROTEIN). | swissprot P15937 | ND |
| 110 | 1309.1 | 60S ACIDIC RIBOSOMAL PROTEIN P0 (L10E). | swissprot P05317 | ND |
| 111 | 1308.8 | CCAAT-BINDING TRANSCRIPTION FACTOR SUBUNIT AAB-1. | sptrembl O13381 | ND |
| 113 | 1291.3 | ADP-RIBOSYLATION FACTOR. | swissprot P34727 | ND |
| 114 | 1290.9 | MALATE DEHYDROGENASE MITOCHONDRIAL PRECURSOR (EC 1.1.1.37). | swissprot P17505 | ND |
| 116 | 1289.4 | HOMOCITRATE SYNTHASE (EC 4.1 .3.2 I). | sptrembl O94225 | ND |
| 117 | 1285.6 | FIMBRIN. | sptrembl O93981 | ND |
| 118 | 1284.9 | EUKARYOTIC TRANSLATION INITIATION FACTOR 6 (EIF-6). | swissprot Q12522 | ND |
| 119 | 1283.8 | *Malassezia fungus* ME-5 antigenic protein. | geneseqp W29772 | ND |
| 120 | 1282.5 | HOMEODOMAIN DNA-BINDING TRANSCRIPTION FACTOR. | sptrembl O74252 | ND |
| 121 | 1281.8 | CARNITINE ACETYL TRANSFERASE FACC. | sptrembl O13363 | ND |
| 122 | 1281.4 | UBIQUITIN-CONJUGATING ENZYME E2-16 KD (EC 6.3.2.19) (UBIQUITIN-PROTEIN LIGASE) (UBIQUITIN CARRIER PROTEIN) (COLLETOTRICHUM HARD-SURFACE- INDUCED PROTEIN 1). | sptrembl O74196 | ND |
| 123 | 1278.4 | FLAVOHEMOGLOBIN. | sptrembl O74183 | ND |
| 124 | 1275.7 | MUS38. | sptrembl O74126 | DNA replication. recombination and repair |
| 125 | 1274.0 | An enzyme with sugar transferase activity. | geneseqp W88044 | ND |
| 126 | 1270.2 | TUBULIN ALPHA-A CHAIN. | swissprot P38668 | ND |
| 128 | 1266.0 | 40S RIBOSOMAL PROTEIN 59 (57). | swissprot P52810 | ND |
| 129 | 1244.7 | S-RELATED PROTEIN RAB-11B (ORA3). | swissprot P22129 | ND |
| 130 | 1241.0 | PUTATIVE SODIUM P-TYPE ATPASE (FRAGMENT) | tremblnew CAB65298 | ND |
| 131 | 1237.4 | HYDROXYMETHYLGLUTARYL-COA SYNTHASE (EC 4.1.3.5) (HMG-COA SYNTHASE) (3-HYDROXY-3-METHYLGLUTARYL COENZYME A SYNTHASE). | swissprot P54874 | ND |
| 132 | 1232.2 | VACUOLAR ATP SYNTHASE CATALYTIC SUBUNIT A (EC 3.6.1.34) (V-ATPASE 67 KD SUBUNIT). | swissprot P11592 | Energy production and conversion |
| 133 | 1231.7 | SQUALENE SYNTHASE. | sptrembl Q9Y753 | ND |

TABLE 1-continued

*Fusarium venenatum* ESTs

| Sequence Listing | zscore | Annotation | Database | Functional category |
|---|---|---|---|---|
| 134 | 1230.8 | ADENOSYLHOMOCYSTEINASE (EC 3.3.1.1)(S-ADENOSYL-L-HOMOCYSTEINE HYDROLASE) (ADOHCYASE). | swissprot P39954 | ND |
| 135 | 1224.8 | PYRUVATE CARBOXYLASE | sptrembl O93918 | Amino acid transport and metabolism |
| 136 | 1217.4 | AMINONITROPHENYL. PROPANEDIOL RESISTANCE PROTEIN. | swissprot P32629 | ND |
| 137 | 1213.0 | HYPOTHETICAL 161.2 KD PROTEIN IN NMD5-HOM6 INTERGENIC REGION. | swissprot P47169 | ND |
| 138 | 1211.4 | DIPHTHINE SYNTHASE (EC 2.1.1.98) (DIPHTAMIDE BIOSYNTHESIS METHYLTRANSFERASE). | swissprot P32469 | Translation, ribosomal structure and biogenesis |
| 130 | 1211.2 | 60S RIBOSOMAL PROTEIN 1-15. | swissprot O13418 | ND |
| 140 | 1211.1 | ENOLASE (EC 4.2.1.11.)(2-PHOSPHOGLYCERATE DEHYDRATASE) (2-PHOSPHO-D-GLYCERATE HYDRO-LYASE) (ALLERGEN CLA H 6) (CLA H VI). | swissprot P42040 | Carbohydrate transport and metabolism |
| 141 | 1210.2 | 26S PROTEASOME REGULATORY COMPLEX SUBUNIT P42D. | tremblnew AAF08391 | Posttranslational modification. protein turnover. chaperones |
| 142 | 1208.8 | NADH-UBIQUINONE OXIDOREDUCTASE 23 KD SUBUNIT PRECURSOR (EC 1.6.5.3) (EC 1.6.99.3) (COMPLEX I-23KD) (C1-23KD). | swissprot Q12644 | ND |
| 143 | 1208.5 | HEAT SHOCK PROTEIN 90 HOMOLOG (SUPPRESSOR OF VEGETATIVE INCOMPATIBILITY MOD-E). | swissprot O43109 | Posttransitional modification. protein turnover. chaperones |
| 144 | 1208.2 | ATP-DEPENDENT BILE ACID PERMEASE | swissprot P32386 | ND |
| 145 | 1206.4 | 14-3-3 PROTEIN HOMOLOG (TH1433). | swissprot Q99002 | ND |
| 146 | 1206.4 | AMINOTRANSFERASE 412 aa, chain A + B + C + D | pdb 1YAA | ND |
| 147 | 1205.0 | 40S RIBOSOMAL PROTEIN 50 (RIBOSOME-ASSOCIATED PROTEIN 1). | Swissprot Q01291 | Translation. ribosomal Structure and biogenesis |
| 148 | 1200.1 | ARGINASE (EC 3.5.3.1). | swissprot P33280 | ND |
| 149 | 1197.8 | RAS-RELATED C3 BOTULINUM TOXIN SUBSTRATE 1 (P21-RAC1) (RAS-LIKE PROTEIN TC25). | swissprot P15154 | ND |
| 150 | 1196.8 | ATP SYNTHASE ALPHA CHAIN, MITOCHONDRIAL PRECURSOR (EC 3.6.1.34). | swissnew P37211 | Energy production and conversion |
| 151 | 1195.9 | MITOCHONDRIAL PROCESSING PEPTIDASE BETA SUBUNIT PRECURSOR (EC 3.4.24.64) (BETA-MPP) (UBIQUINOL-CYTOCHROME C REDUCTASE COMPLEX CORE PROTEIN 1) (EC 1.10.2.2). | swissprot P11913 | ND |
| 152 | 1194.5 | POLYUBIQUITIN. | sptrembl O74274 | ND |

TABLE 1-continued

*Fusarium venenatum* ESTs

| Sequence Listing | zscore | Annotation | Database | Functional category |
|---|---|---|---|---|
| 153 | 1190.6 | FARNESYL PYROPHOSPHATE SYNTHETASE (EPP SYNTHETASE) (EPS) (FARNESYL DIPHOSPHATE SYNTHETASE) [INCLUDES: DIMETHYLALLYLTRANS-FERASE (EC 2.5.1.1): GERANYLTRANSTRANSFERASE (EC 2.5.1.10)]. | swissprot Q92235 | Coenzyme metabolism |
| 154 | 1188.3 | ALCOHOL DEHYDROGENASE I (EC 1.1.1.1). | swissprot P41747 | ND |
| 155 | 1185.7 | ISOCITRATE DEHYOROGENASE [NADP], MITOCHONDRIAL PRECURSOR (EC 1.1.1.1): (OXALOSUCCINATE DECARBOXYLASE) (IDH) (NADP+-SPECIFIC ICDH) (IDP). | swissprot P79089 | Energy production and conversion |
| 156 | 1184.8 | GLUCOSE-6-PHOSPHATE 1-DEHYDROGENASE (EC 1.1.1.49) (G6PD). | swissprot P41764 | Carbohydrate transport and metabolism |
| 157 | 1184.7 | *A. nidulans* atrC polypeptide. | geneseqp Y21815 | ND |
| 158 | 1183.3 | CALCINEURIN B SUBUNIT (PROTEIN PHOSPHATASE 2B REGULATORY SUBUNIT) (CALCINEURIN REGULATORY SUBUNIT) | swissprot Q02751 | ND |
| 159 | 1175.6 | ALPHA-GLUCOSIDASE (EC 3.2.1.20) (MALTASE). | swissprot Q02751 | Carbohydrate transport and metabolism |
| 160 | 1170.2 | RHOI PROTEIN. | swissprot Q09914 | ND |
| 161 | 1166.6 | HNRNP ARGININE N-METHYLTRANSFERASE (EC 2.1.1.-) (ODP) PROTEIN). | swissprot P38074 | ND |
| 162 | 1160.6 | VACUOLAR PROTEASE A PRECURSOR (EC 3.4.23.-). | swissprot Q01294 | ND |
| 163 | 1160.4 | PLASMA MEMBRANE ATPASE (EC 3.6.1.35) (PROTON PUMP). | swissprot P07038 | ND |
| 164 | 1156.7 | ISOCITRATE DEHYDROGENASE [NADP], MITOCHONDRIAL PRECURSOR (EC 1.1.1.42) (OXALOSUCCINATE DECARBOXYLASE) (IDH) (NADP+-SPECIFIC ICDH) (IDP). | swissprot P79089 | Energy production and conversion |
| 165 | 1150.9 | 40S RIBOSOMAL PROTEIN S2 (S4) (YS5) (RP12) (OMNIPOTENT SUPRESSOR PROTEIN SUP44). | swissprot O42829 | ND |
| 166 | 1149.4 | CROI PROTEIN. | sptrembl O42829 | ND |
| 167 | 1147.5 | RIBOSOMAL PROTEIN L13A. | tremblnew AAD54383 | ND |
| 168 | 1143.0 | MITOCHONDRIAL PHOSPHATE CARRIER PROTEIN (PHOSPHATE TRANSPORT PROTEIN) (PTP) (MITOCHONDRIAL IMPORT RECEPTOR) (P32). | swissprot P23641 | ND |
| 170 | 1136.4 | LONG-CHAIN-FATTY-ACID--COA LIGASE 2 (EC 6.2.1.3) (LONG-CHAIN ACYL-COA SYNTHETASE 2) (FATTY ACID ACTIVATOR 2). | swissprot P39518 | Lipid metabolism |
| 171 | 1136.2 | *B. bassiana* POPS reductase protein. | geneseqp Y33673 | Inorganic ion transport and metabolism |
| 173 | 1135.0 | CPC3 PROTEIN. | sptrembl O74297 | ND |

TABLE 1-continued

*Fusarium venenatum* ESTs

| Sequence Listing | zscore | Annotation | Database | Functional category |
|---|---|---|---|---|
| 174 | 1131.1 | LINOLEATE DIOL SYNTHASE PRECURSOR. | tremblnew AAD49559 | ND |
| 175 | 1120.3 | HYPOTHETICAL 68.3 KD PROTEIN. | sptrembl Q03195 | ND |
| 176 | 1127.7 | ISOCITRATE LYASE (EC 4.1.3.1) (ISOCITRASE) (ISOCITRATASE) (ICL). | swissprot P28299 | Energy production and conversion |
| 177 | 1125.6 | PUTATIVE CASEIN KINASE II CATALYTIC SUBUNIT. | sptrembl O64816 | Signal transduction mechanisms#in; |
| 178 | 1124.8 | PUTATIVE PHOSPHATIDYL INOSITOL-) KINASE (FRAGMENT). | sptrembl Q9Y7K2 | ND |
| 179 | 1119.1 | PHOSPHOGLYCERATE KINASE (EC 2.7.2.3). | swissprot P24590 | ND |
| 180 | 1118.8 | NADH-UBIQUINONE OXIDOREDUCTASE 20.8 KD SUBUNIT (EC 1.6.5.3) (EC 1.6.99.3). | swissprot P21976 | ND |
| 181 | 1117.8 | PROTEIN PHOSPHOTASE 2A 65KD REGULATORY SUBUBIT (A SUBUNIT). | sptrembl Q10293 | ND |
| 182 | 1117.6 | Peptide transport protein ATPTR2Ap. | geneseqp R84891 | ND |
| 183 | 1115.8 | FREQUENCY CLOCK PROTEIN. | swissnew Q00586 | ND |
| 184 | 1114.9 | 60S RIBOSOMAL PROTEIN L11 (L16) (YL16) (39A) (RP39). | swissprot P06380 | ND |
| 185 | 1109.0 | *S. brevicaulis* beta-fructofuranosidase protein sequence. | geneseqp Y05278 | ND |
| 186 | 1104.2 | UBIQUINOL-CYTOCHROME C REDUCTASE COMPLEX CORE PROTEIN 2 PRECURSOR (EC 1.10.2.2). | swissprot O60044 | ND |
| 187 | 1101.6 | NAD-SPECIFIC GLUTAMATE DEHYDROGENASE (EC 1.4.1.2) (NAD-GDH) (FRAGMENTS). | swissprot P00365 | Amino acid transport and metabolism |
| 188 | 1100.9 | PUTATIVE MITOCHONDRIAL CARRIER PROTEIN YHMI SHMI. | swissprot P38988 | ND |
| 189 | 1096.7 | CYCLOPHILIN (EC 5.2.1.8). | sptrembl O93826 | ND |
| 190 | 1096.0 | THIOREDOXIN REDUCTASE (EC 1.6.4.5). | swissprot P51978 | ND |
| 191 | 1092.3 | 40S RIBOSOMAL PROTEIN S5 (FRAGMENT). | sptrembl O65731 | ND |
| 192 | 1091.5 | HEAT SHOCK PROTEIN 90 HOMOLOG (SUPPRESSOR OF VEGETATIVE INCOMPATIBILITY MOD-E). | swissprot O43109 | Posttranslational modification. protein turnover, chaperones |
| 193 | 1090.3 | 40S RIBOSOMAL PROTEIN S15 (S12). | swissprot P34737 | Translation. ribosomal structure and biogenesis |
| 194 | 1085.4 | MALATE SYNTHASE. GLYOXYSOMAL (EC 4.1.3.2). | swissnew P28344 | ND |
| 195 | 1085.1 | *N. crassa* mtr gene product. | geneseqp R79909 | ND |
| 196 | 1081.1 | 60S RIBOSOMAL PROTEIN L8 (L7A) (L4). | swissprot O13672 | ND |
| 197 | 1080.8 | MITOGEN-ACTIVATED PROTEIN KINASE KINASE CPK1. | sptrembl O93876 | Signal transduction mechanism |
| 198 | 1080.3 | CORONIN-LIKE PROTEIN | swissprot O13923 | ND |
| 199 | 1078.7 | PROBABLE ATP-DEPENDENT RNA HELICASE HASI | swissprot Q03532 | DNA replication. recombination and repair |
| 200 | 1078.1 | UBIL | tremblnew AAF24230 | ND |

TABLE 1-continued

*Fusarium venenatum* ESTs

| Sequence Listing | zscore | Annotation | Database | Functional category |
|---|---|---|---|---|
| 201 | 1077.3 | 60S RIBOSOMAL PROTEIN L7-C. | swissprot O60143 | ND |
| 202 | 1076.8 | 40S RIBOSOMAL PROTEIN S7. | swissprot O43105 | ND |
| 203 | 1076.3 | CHROMOSOME XII COSMID 9470. | sptrembl Q06287 | ND |
| 204 | 1072.5 | SERINE/THREONINE PROTEIN KINASE FSK (FRAGMENT). | sptrembl Q00875 | Signal transduction mechanisms |
| 205 | 1066.5 | RIBOSOMAL PROTEIN S28. | tremblnew CAB56815 | ND |
| 206 | 1064.5 | STRESS-RESPONSIVE GENE PRODUCT. | tremblnew BAA85305 | ND |
| 208 | 1063.3 | TOM70 GENE. | sptrembl O13499 | ND |
| 209 | 1056.9 | TUBULIN BETA CHAIN. | swissprot O42786 | ND |
| 210 | 1056.2 | NADP-SPECIFIC GLUTAMATE. DEHYDROGENASE (EC 1.4.1.4) (NADP-GDH). | swissprot P00369 | ND |
| 211 | 1056 0 | PHOSPHORIBOSYLAMIDOL MIDAZOLE-SUCCINOCARBOXAMIDE SYNTHASE, SAICAR SYNTHETASE. | tremblnew CAB52612 | Nucleotide transport |
| 212 | 1054.7 | ADENYLATE KINASE CYTOSOLIC (EC 2.7.4.3) (ATP-AMP TRANSPHOSPHORYLASE). | swissprot P07170 | Nucleotide transport |
| 213 | 1051.1 | LPG22P. | sptrembl Q02908 | Transcription |
| 214 | 1046.3 | ADENOSINE-5'PHOSPHOSULFATE KINASE (EC 2.7.1.25) (ADENYLYLSULFATE KINASE) (APS KINASE). | sptrembl Q12657 | ND |
| 215 | 1045.7 | HYPOTHETICAL 34.2 KD PROTEIN IN CUS1-RPL20A INTERGENIC REGION. | swissprot Q04013 | ND |
| 216 | 1045.0 | RAS-RELATED PROTEIN RAB6. | tremblnew AAD25535 | ND |
| 217 | 1044.8 | 40S RIBOSOMAL PROTEIN S17 (CRP3). | swissprot P27770 | ND |
| 218 | 1039.9 | CLATHRIN HEAVY CHAIN. | swissprot P22137 | ND |
| 219 | 1039.8 | KINESIN. | sptrembl P78718 | ND |
| 220 | 1038.9 | VACUOLAR ASPARTIC PROTEASE PRECURSOR. | sptrembl O42630 | ND |
| 221 | 1036.7 | TUBULIN ALPHA-A CHAIN. | swissprot P38668 | ND |
| 222 | 1035.8 | PROBABLE GYP7 PROTEIN (FRAGMENT). | swissprot P09379 | ND |
| 223 | 1035.7 | PEROXISOMAL HYDRATASE-DEHYDROGENASE-EPIMERASE (HDE) BETA-OXIDATION PROTEIN) (MFP) [INCLUDES: 2-ENOYL-COA HYDRATASE (EC 4.2.1.-); D-3-HYDROXYACYL COA DEHYDROGENASE (EC 1.1.1.-)]. | swissnew Q01373 | ND |
| 224 | 1035.5 | SEPTIN HOMOLOG SPN2. | tremblnew CAB57440 | ND |
| 225 | 1032.1 | MYO-INOSITOL I-PHOSPHATE SYNTHASE (EC 5.5.1.4). | sptrembl O65196 | Lipid metabolism |
| 226 | 1031.5 | GAMMA-ACTIN. | tremblnew AAF00008 | Cell division and chromosome partitioning |

TABLE 1-continued

*Fusarium venenatum* ESTs

| Sequence Listing | zscore | Annotation | Database | Functional category |
|---|---|---|---|---|
| 227 | 1031.2 | PHOSPHO-2-DEHYDRO-3-DEOXYHEPTONATE ALDOLASE, TYROSINE-INHIBITED (EC 4.1.2.15) (PHOSPHO-2-KETO-3-DEOXYHEPTONATE ALDOLASE) (DAHP SYNTHETASE) (3-DEOXY-D-ARABINO-HEPTULOSONATE 7-PHOSPHATE SYNTHASE). | swissprot P32449 | Amino acid transport and metabolism |
| 228 | 1026.8 | PUTATIVE CALCIUM P-TYPE ATPASE (FRAGMENT). | tremblnew CAB65295 | Inorganic ion transport and metabolism |
| 229 | 1026.3 | 60S RIBOSOMAL PROTEIN L2. | sptrembl O94253 | ND |
| 230 | 1026.2 | CU-ZN SUPEROXIDE DISMUTASE. | sptrembl O94175 | ND |
| 231 | 1024.2 | CARBOXY-CIS,CIS-MUCONATE CYCLASE (EC 5.5.1.5 (3-CARBOXY-CIS,CIS- MUCONATE LACTONIZING ENZYME) (CMLE). | swissprot P38677 | ND |
| 232 | 1020.5 | PRP12P/SAP130. | tremblnew BAA86918 | ND |
| 233 | 1020.1 | 26S PROTEASE REGULATORY SUBUNIT 6B HOMOLOG. | swissprot P75578 | Posttranslational modification. protein turnover. chaperones |
| 234 | 1019.3 | NADH-UBIQUINONE OXIDOREDUCTASE 40 KD SUBUNIT PRECURSOR (EC 1.6.5.3) (EC 1.6.90.3) (COMPLEX I-40KD) (C1-40KD). | swissprot P25284 | ND |
| 235 | 1017.4 | GLUCOSE-6-PHOSPHATE 1-DEHYDROGENASE (EC 1.1.1.49) (G6PD). | swissprot P48826 | Carbohydrate transport and metabolism |
| 236 | 1012.5 | HEXOKINASE (EC 2.7.1.1). | sptrembl O93964 | ND |
| 237 | 1008.0 | 60S RIBOSOMAL PROTEIN L12. | swissprot P23358 | ND |
| 238 | 1007.8 | POP3. A WD REPEAT PROTEIN. | tremblnew CAB57925 | ND |
| 239 | 1007.4 | 14-3-3 PROTEIN HOMOLOG (TH1433). | swissprot Q99002 | ND |
| 240 | 1007.4 | TRICHODIENE SYNTHASE (EC 4.1.99.6) (SESQUITERPENE CYCLASE) (TS). | swissprot P27679 | ND |
| 241 | 1004.9 | PUTATIVE PROTEOSOME COMPONENT CG610.04C (EC 3.4.99.46) (MACROPAIN SUBUNIT C6G10.04C) (PROTEINASE YSCE SUBUNIT C6G10.04C) (MULTICATALYTIC ENDOPEPTIDASE COMPLEX SUBUNIT C6G10.04C) | sptrembl O14250 | ND |
| 212 | 1001.3 | YMEI PROTEIN (EC 3.4.24 -) (TAT-BINDING HOMOLOG II) (OSDI PROTEIN). | swissprot P32795 | Posttransitional modification. protein turnover. chaperones |
| 243 | 1000.7 | SERINE/THREONINE PROTEIN KINASE. | sptrembl Q99012 | Signal transduction mechanisms |
| 244 | 996.2 | INTRACELLULAR METALLOPROTEINASE MFPR. | sptrembl P97996 | Amino acid transport and metabolism |

TABLE 1-continued

*Fusarium venenatum* ESTs

| Sequence Listing | zscore | Annotation | Database | Functional category |
|---|---|---|---|---|
| 245 | 995.1 | NADH-UBIQUINONE OXIDOREDUCTASE 30.4 KD SUBUNIT PRECURSOR (EC 1.6.5.3) (EC 1.6.99.3) (COMPLEX 1-30KD) (C1-31KD). | swissprot P23710 | ND |
| 246 | 990.8 | GENERAL AMINO-ACID PERMEASE GAP1. | swissprot P19145 | Amino acid transport and metabolism |
| 247 | 986.5 | SULPHUR METABOLITE REPRESSION REGULATION PROTEIN SCONCP. | sptrembl Q92229 | ND |
| 248 | 985.2 | DOLICHOL-PHOSPHATE MANNOSYLTRANSFERASE (EC 2.4.1.83) (DOLICHOL-PHOSPHATE MANNOSE SYNTHASE) (POLICHYL-PHOSPHATE BETA-D-MANNOSYLTRANSFERASE | sptrembl O14466 | Cell envelope biogenesis. outer membrane |
| 250 | 983.7 | AR1 PROTEIN | sptrembl Q94981 | ND |
| 253 | 979.4 | 40S RIBOSOMAL PROTEIN S13 (S15). | swissprot P33192 | ND |
| 254 | 979.4 | PROBABLE SUCCINYL-COA LIGASE [GDP-FORMING] ALPHA-CHAIN. MITOCHONDRIAL PRECURSOR (EC 6.2.1.4) SUCCINYL-COA SYNTHETASE. ALPHA CHAIN) (SCS-ALPHA). | swissprot O13750 | ND |
| 255 | 976.7 | 40S RIBOSOMAL PROTEIN S19 (S16). | swissprot P27073 | ND |
| 256 | 976.2 | 40S RIBOSOMAL PROTEIN 514 (CRP2). | swissprot P19115 | ND |
| 257 | 975.8 | SUPEROXIDE DISMUTASE PRECURSOR (EC 1.15.1.1). | sptrembl Q9Y783 | ND |
| 258 | 974.3 | 40S RIBOSOMAL PROTEIN S8 (S14) (YS9) (RP19). | swissprot P05754 | ND |
| 259 | 972.5 | Cystathionine gamma lyase. | geneseqp R66223 | Amino acid transport and metabolism |
| 260 | 966.7 | AMINO-ACID PERMEASE INDA1 | swissprot P34054 | Amino acid transport and metabolism |
| 261 | 965.2 | 78 KD GLUCOSE-REGULATED PROTEIN HOMOLOG PRECURSOR (GRP 78) (IMMUNOGLOBULIN HEAVY CHAIN BINDING PROTEIN HOMOLOG) (BIP). | swissnew P78695 | Posttranslational modification, protein turnover. chaperones |
| 262 | 965.1 | PHOSPHOGLUCOMUTASE. | sptrembl O74374 | ND |
| 263 | 964.1 | CALMODULIN. | sptrembl O93930 | ND |
| 264 | 962.0 | EUKARYOTIC TRANSLATION INITIATION FACTOR 2 ALPHA SUBUNIT (EIF-2-ALPHA). | swissprot P20459 | Translation. ribosomal structure and biogenesis |
| 265 | 961.7 | S-ADENOSYLMETHIONINE SYNTHETASE (EC 2.5.1.6) (METHIONINE. ADENOSYLTRANSFERASE) (ADOMET SYNTHETASE). | swissprot P48466 | ND |
| 266 | 960.7 | PROBABLE UTP--GLUCOSE-1-PHOSPHATE URIDYLYLTRANSFERASE. | tremblnew CAA22857 | ND |
| 267 | 959.5 | PRPD PROTEIN. | swissprot P77243 | ND |
| 268 | 957.5 | TRANSMEMBRANE PROTEIN. | tremblnew CAB65007 | ND |
| 269 | 955.2 | HYPOTHETICAL 63.5 KD PROTEIN. | sptrembl O74965 | ND |
| 270 | 954.6 | *Aspergillus niger* trehalose synthase. | geneseqp W49027 | Carbohydrate transport and metabolism |

TABLE 1-continued

_Fusarium venenatum ESTs_

| Sequence Listing | zscore | Annotation | Database | Functional category |
|---|---|---|---|---|
| 271 | 954.6 | SERENE/THREONINE-PROTEIN KINASE STE20 (EC 2.7.1.-). | swissnew Q03497 | Signal transduction mechanisms |
| 272 | 952.4 | HYPOTHETICAL 55.8 KD PROTEIN. | tremblnew CAB63552 | ND |
| 273 | 949.3 | 40S RIBOSOMAL PROTEIN S11 (S18) (YS12) (RP41). | swissprot P26781 | ND |
| 274 | 949.1 | HYPOTHETICAL 44.3 KD PROTEIN C1F7.07C IN CHROMOSOME I. | swissprot Q09919 | Inorganic ion transport and metabolism |
| 275 | 947.0 | 60S RIBOSOMAL PROTEIN L27A (L29). | swissprot P78987 | ribosomal structure and biogenesis |
| 276 | 946.1 | OXIDOREDUCTASE (H202(A)) 293 aa | pdb 2CYP | ND |
| 277 | 944.5 | HYPOTHETICAL 22.1 KD PROTEIN IN CCP1-MET1 INTERGENIC REGION. | swissprot P36149 | ND |
| 278 | 944.4 | PROTEASOME SUBUNIT YC7-ALPHA. | tremblnew CAA40292 | ND |
| 279 | 943.8 | SERINE/THREONINE PROTEIN KINASE. | sptrembl O42795 | Signal transduction mechanisms |
| 280 | 942.9 | CYTOCHROME C1, HEME PROTEIN PRECURSOR. | swissprot P07142 | ND |
| 281 | 942.6 | Yeast ribosomal protein S7. | geneseqp W36115 | Translation, ribosomal structure and biogenesis |
| 282 | 938.9 | FIMBRIN. | sptrembl O93981 | ND |
| 283 | 934.4 | PUTATIVE CHOLINEPHOSPHATE CYTIDYLYLTRANSFERASE. | tremblnew CAA19310 | ND |
| 284 | 930.5 | 40S RIBOSOMAL PROTEIN S12. | sptrembl O59936 | ND |
| 285 | 929.6 | REHYDRIN-LIKE PROTEIN. | sptrembl O94014 | Posttranslational modification, protein turnover, chaperones |
| 286 | 928.1 | PROTEASOME COMPONENT PRE3 PRECURSOR (EC 3.4.99.46) (MACROPAIN SUBUNIT PRE3) (PROTEINASE YSCE SUBUNIT PRE3) (MULTICATALYTIC ENDOPEPTIDASE COMPLEX SUBUNIT PRE3). | swissnew P38624 | Posttranslational modification. protein turnover, chaperones |
| 287 | 927.7 | CARBOXYPEPTIDASE CPDS PRECURSOR (EC 3.4.16.-). | swissprot P52719 | ND |
| 288 | 927.2 | PROBABLE PHOSPHATIDYLINOSITOL-4-PHOSPHATE 5-KINASE FAB1 (EC 2.7.1.68) (1-PHOSPHATIDYLINOSITOL-4-PHOSPHATE KINASE) (PIP5K) (PTDINS(4)P-5-KINASE) (DIPHOSPHOINOSITIDE KINASE). | swissprot P34756 | ND |
| 289 | 926.2 | 40S RIBOSOMAL PROTEIN S18. | swissprot P35971 | ND |
| 290 | 925.6 | GLUTATHIONE-DEPENDENT FORMALDEHYDE DEHYDROGENASE (EC 1.2.1.1) (EDH) (FALDH). | swissprot Q06099 | ND |
| 291 | 925.2 | PROTEIN PHOSPHATASE 2A DELTA (B") REGULATORY SUBUNIT, DELTA3 ISOFORM (B"). | sptrembl O00494 | ND |

TABLE 1-continued

_Fusarium venenatum ESTs_

| Sequence Listing | zscore | Annotation | Database | Functional category |
|---|---|---|---|---|
| 292 | 924.5 | MANNOSE-I-PHOSPHATE GUANYLTRANSFERASE (EC 2.7.7.13) (MPG1 TRANSFERASE) (ATP-MANNOSE-I-PHOSPHATE GUANYLYLTRANSFERASE) | sptrembl O74624 | Cell envelope biogenesis, outer membrane |
| 293 | 924.2 | HYPOTHETICAL 39.3 KD PROTEIN C31G5.04 IN CHROMOSOME I. | sptrembl O14104 | Amino acid transport and metabolism |
| 294 | 921.8 | 60S RIBOSOMAL PROTEIN L20 (L18A). | swissprot P47913 | ND |
| 295 | 917.7 | BETAINEALDEHYDE DEHYDROGENASE (EC 1.2.18) (BADII). | swissprot P17445 | Energy production and conversion |
| 296 | 917.3 | V-TYPE ATPASE SUBUNIT C'. | sptrembl Q9Y874 | Energy production and conversion |
| 297 | 916.8 | 60S RIBOSOMAL PROTEIN L23 (L17). | swissprot P04451 | ND |
| 298 | 915.2 | Amino acid sequence of a maltogenic alpha amylase. | geneseqp Y30621 | ND |
| 299 | 914.0 | PUTATIVE 20KDA SUBUNIT OF THE V-ATPASE. | sptrembl P87252 | ND |
| 300 | 914.0 | OUTER MITOCHONDRIAL MEMBRANE PROTEIN PORIN. | swissprot P07144 | ND |
| 301 | 913.0 | UTP-AMMONIA LIGASE. | sptrembl O74638 | Nucleotide transport |
| 302 | 912.2 | CYCLIN-DEPENDENT PROTEIN KINASE | sptrembl Q9Y8B7 | Signal transduction mechanisms |
| 303 | 910.8 | HYPOTHETICAL 57.0 KD TRP-ASP REPEATS CONTAINING PROTEIN IN CPR4-SSK22 INTERGENIC REGION. | swissprot P25382 | ND |
| 304 | 907.5 | VACUOLAR ATP SYNTHASE 16 KD PROTEOLIPID SUBUNIT (EC 3.6.1.34). | swissprot P31413 | Energy production and conversion |
| 305 | 907.4 | 40S RIBOSOMAL PROTEIN S26E (CRP5) (13.6 KD RIBOSOMAL PROTEIN). | swissprot P21772 | ND |
| 306 | 907.4 | PUTATIVE 30.7 KD METHYLTRANSFERASE IN TSMI-ARE1 INTERGENIC REGION. | swissprot P25627 | ND |
| 307 | 906.5 | PEROXISOMAL HYDRATASE-DEHYDROGENASE-EPIMERASE (HDE) (MULTIFUNCTIONAL BETA-OXIDATION PROTEIN) (MFP) [INCLUDES. 2-ENOYL-COA HYDRATASE (EC 4.2.1.-); D-3-HYDROXYACYL COA DEHYDROGENASE (EC 1.1.1.-)]. | swissnew Q01373 | ND |
| 308 | 905.6 | HISTONE H2A | swissprot P08844 | ND |
| 309 | 905.0 | PUTATIVE SEC14 CYTOSOLIC FACTOR (PHOSPHATIDYLINOSITOL/ PHOSPHATIDYL- CHOLINE TRANSFER PROTEIN) (PI/PC TP). | swissprot Q10137 | ND |
| 310 | 903.7 | PUTATIVE UBIQUITIN FUSION DEGRADATION PROTEIN (FRAGMENT). | tremblnew CAA22594 | ND |
| 311 | 902.0 | CONSERVED HYPOTHETICAL PROTEIN | tremblnew CAB54867 | Translation. ribosomal structure and biogenesis |

TABLE 1-continued

Fusarium venenatum ESTs

| Sequence Listing | zscore | Annotation | Database | Functional category |
|---|---|---|---|---|
| 312 | 901.5 | FK506-BINDING PROTEIN PRECURSOR (EKBP-21) (PEPTIDYL-PROLYL CIS-TRANS ISOMERASE) (PPIASE) (EC 5.2.1.8). | swissprot O60046 | Posttranslational modification. protein turnover . chaperones |
| 313 | 901.0 | PUTATIVE COATOMER BETA SUBUNIT FRAGMENT). | sptrembl O74812 | ND |
| 314 | 900.5 | Human aflatoxin B1 aldehyde reductase. | geneseqp Y24920 | ND |
| 316 | 898.6 | HISTIDYL-TRNA SYNTHETASE. | sptrembl O43011 | Translation. ribosomal structure and biogenesis |
| 317 | 897.7 | CHITIN SYNTHASE 3 (EC 24.1.16) (CHITIN-UDP ACETYL-GLUCOSAMINYL TRANSFERASE 3) (CLASS-III CHITIN SYNTHASE 3). | swissprot P29070 | ND |
| 318 | 894.2 | PROBABLE T-COMPLEX PROTEIN I. BETA SUBUNIT (TCP-1-BETA) (CCT-BETA). | swissprot Q10147 | Posttranslational modification. protein turnover . chaperones |
| 319 | 893.0 | ISOCITRATE LYASE (EC 4.1.3.1) (ISOCITRASE) (ISOCITRATASE) (ICL). | swissprot P28299 | Energy production and conversion |
| 320 | 892.9 | EIF-5A. | sptrembl O94083 | ND |
| 321 | 891.6 | 40S RIBOSOMAL PROTEIN S22 (S15A) (YS24). | swissprot P33953 | ND |
| 322 | 889.1 | CUTINASE TRANSCRIPTION FACTOR 1 BETA. | swissprot P52950 | ND |
| 323 | 886.6 | ORNITHINE CARBAMOYLTRANSFERASE PRECURSOR (EC 2.1.3.3) (OTCASE) (ORNITHINE TRANSCARBAMYLASE). | swissprot P11803 | Amino acid transport and metabolism |
| 324 | 885.1 | PUTATIVE ARP2/3 COMPLEX 41KD SUBUNIT. | tremblnew CAA70202 | ND |
| 325 | 885.0 | LEUCYL-TRNA SYNTHETASE, CYTOPLASMIC (EC 6.1.1.4) (LEUCINE--TRNA LIGASE) (LEURS). | swissprot P10857 | ND |
| 326 | 883.2 | 3-HYDROXY-3-METHYLGLUTARYL-COENZYME A REDUCTASE (EC 1.1.1.34) (HMG-COA REDUCTASE). | swissnew Q12577 | ND |
| 327 | 882.6 | GLYCOSYLTRANSFERASE 858 aa, chain A + B | pdb 1YGP | Carbohydrate transport and metabolism |
| 328 | 880.5 | MINOR ALLERGEN ALT A 7 (ALT A VII). | swissprot P42058 | ND |
| 329 | 879.0 | CARBON CATABOLITE REPRESSION REGULATOR. | sptrembl O94131 | ND |
| 330 | 876.4 | PDI RELATED PROTEIN A. | sptrembl O93914 | Energy production and conversion |
| 331 | 874.2 | ELONGATION FACTOR TU, MITOCHONDRIAL PRECURSOR. | swissprot P02992 | Amino acid transport and metabolism |
| 332 | 872.7 | RAS-LIKE PROTEIN. | swissprot O42785 | ND |
| 333 | 870.4 | SEVERIN KINASE. | sptrembl O61122 | Signal transduction mechanisms |
| 334 | 869.8 | HYPOTHETICAL 65.3 KD PROTEIN IN MAD1-SCY1 INTERGENIC REGION. | swissprot P53154 | Cell envelope biogenesis. outer membrane |
| 335 | 868.3 | T-COMPLEX PROTEIN 1. DELTA SUBUNIT (TCP-1-DELTA) (CCT-DELTA) (STIMULATOR OF TAR RNA BINDING). | swissprot P50991 | Posttranslational modification, protein turnover, chaperones |

TABLE 1-continued

*Fusarium venenatum* ESTs

| Sequence Listing | zscore | Annotation | Database | Functional category |
|---|---|---|---|---|
| 336 | 867.2 | HISTONE H3. | swissprot P07041 | ND |
| 337 | 865.7 | UBIQUITIN-CONJUGATING ENZYME E2 (EC 6.3.2.19) UBIQUITIN-PROTEIN LIGASE) (UBIQUITIN CARRIER PROTEIN). | sptrembl O76069 | ND |
| 338 | 863.9 | 60S RIBOSOMAL PROTEIN 1.19 (1.23) (YL14) (RP33) (RP15L). | swissprot P05735 | Translation. ribosomal structure and biogenesis |
| 339 | 863.3 | MRNA CLEAVAGE FACTOR 125 KDA SUBUNIT. | sptrembl O43809 | ND |
| 340 | 862.1 | PROTEIN PHOSPHATASE-1. | tremblnew AAD47567 | ND |
| 341 | 861.8 | PROHIBITIN (FRAGMENT). | sptrembl O13357 | Posttranslational modification. protein turnover, chaperones |
| 342 | 861.0 | 40S RIBOSOMAL PROTEIN S3. | swissprot O60128 | ND |
| 343 | 860.4 | MDM10 GENE. | sptrembl O13498 | ND |
| 344 | 850.6 | PEPTIDYLPROLYL ISOMERASE (EC 5.2.1.8). | sptrembl O60045 | ND |
| 345 | 858.8 | NUCLEAR MIGRATION PROTEIN NUDE. | swissprot Q00664 | ND |
| 347 | 855.8 | SERINE/THREONINE PROTEIN KINASE 55K22 (EC 2.7.-.-). | swissprot P25390 | Signal transduction mechanisms |
| 348 | 853.1 | PROTEIN PHOSPHATASE SSD1 HOMOLOG. | sptrembl O13327 | ND |
| 349 | 853.0 | Fusarium 5-aminolevulinic acid synthase (hemA). | geneseqp Y17297 | Coenzyme metabolism |
| 350 | 852.7 | GTP CYCLOHYDROLASE I (EC 3.54.16) (GTP-CH-1). | swissprot P51601 | Coenzyme metabolism |
| 351 | 851.7 | POLYMERASE. | sptrembl Q10295 | ND |
| 352 | 851.5 | PUTATIVE SPLICING FACTOR BBP/SF1. | tremblnew AAF02214 | ND |
| 353 | 850.4 | 60S RIBOSOMAL PROTEIN L18. | swissnew Q10192 | Translation, ribosomal structure and biogenesis |
| 354 | 850.1 | PUTATIVE CHROMATIN BINDING SNW FAMILY NUCLEAR PROTEIN. | tremblnew CAB37421 | ND |
| 355 | 849.8 | 5-METHYLTETRAHYDROPTE ROYLTRIGLUTAMATE--HOMOCYSTEIN METHYLTRANSFERASE (EC 2.1.1.14). | tremblnew CAB57427 | Amino acid transport and metabolism |
| 356 | 849.4 | CONSERVED HYPOTHETICAL PROTEIN. | sptrembl O74739 | ND |
| 357 | 848.6 | ADENYLOSUCCINATE LYASE (EC 4.3.2.2). | sptrembl O75495 | Nucleotide transport |
| 358 | 846.7 | PROBABLE SUCCINATE DEHYDROGENASE FLAVOPROTEIN SUBUNIT PRECURSOR (EC 1.3.5.1). | tremblnew CAB61213 | Energy production and conversion |
| 359 | 846.5 | ACETYL-COA-ACETYLTRANSFERASE (EC 2.3.1.9). | sptrembl Q9Y838 | Lipid metabolism |
| 360 | 846.4 | ABC TRANSPORTER CDR4. | swissprot O74676 | ND |
| 361 | 846.4 | ACETYL-COA ACETYLTRANSFERASE 1B (EC 2.3.1.9) (PEROXISOMAL ACETOACETYL-COA THIOLASE) (THIOLASE 1B) | swissprot Q04677 | ND |
| 362 | 846.0 | REPRESSIBLE ALKALINE PHOSPHATASE PRECURSOR (EC 3.1.3.1) | swissprot P11491 | Inorganic ion transport and metabolism |
| 363 | 845.2 | NUCLEOSIDE DIPHOSPHATE KINASE. | tremblnew BAA8345 | ND |

TABLE 1-continued

Fusarium venenatum ESTs

| Sequence Listing | zscore | Annotation | Database | Functional category |
|---|---|---|---|---|
| 364 | 844.7 | PYRUVATE DEXHYDROGENASE E1 COMPONENT BETA SUBUNIT, MITOCHONDRIAL PRECURSOR (EC 1.2.4.1) (PDHE1-B). | swissprot Q09171 | Energy production and conversion |
| 365 | 840.2 | BETA-GLUCOSIDASE PRECURSOR (EC 3.2.1.21) (GENTOBIASE) (CELLOBIASE) (AMYGDALASE). | sptrembl Q12601 | ND |
| 366 | 839.4 | PUTATIVE FAMILY-31 GLUCOSIDASE. | tremblnew CAB65603 | Carbohydrate transport and metabolism |
| 367 | 838.8 | NONSENSE-MEDIATED MRNA DECAY PROTEIN 3. | swissprot P38861 | Transcription |
| 368 | 837.9 | HEAT SHOCK PROTEIN SSCI. MITOCHONDRIAL PRECURSOR (ENDONUCLEASE SCEI 75 KD SUBUNIT). | swissprot P12398 | Posttranslational modification. protein turnover. chaperones |
| 369 | 837.0 | GLUTAMATE SYNTHASE (NADPH) PRECURSOR (EC 1.4.1.13) (NADPH-GOGAT). | swissnew Q12680 | ND |
| 370 | 836.5 | TRANSMEMBRANE TRANSPORTER LIZIP. | sptrembl O43000 | ND |
| 371 | 836.2 | FRUCTOSE-BISPHOSPHATE ALDOLASE (EC 4.1.2.13). | swissprot P36580 | Carbohydrate transport and metabolism |
| 372 | 835.8 | TRICHODIENE OXYGENASE (EC 1.14.-.-) (CYTOCHROME P450 58). | swissprot Q12612 | ND |
| 373 | 834.7 | HEXOKINASE (EC 2.7.1.1). | sptrembl O93964 | ND |
| 374 | 834.3 | PROBABLE ACETYL-COA HYDROLASE. | tremblnew CAB52573 | Energy production and conversion |
| 375 | 833.0 | HYPOTHETICAL 57.3 KD TRP-ASP REPEATS CONTAINING PROTEIN IN POM152-REC114 INTERGENIC REGION. | swissprot Q04225 | ND |
| 376 | 832.9 | 26S PROTEASE REGULATORY SUBUNIT 7 HOMOLOG. | tremblnew CAA16915 | ND |
| 377 | 831.6 | GUANINE NUCLEOTIDE-BINDING PROTEIN BETA SUBUNIT. | swissprot O14435 | ND |
| 378 | 831.5 | SYMBIOSIS-RELATED PROTEIN. | swissprot P87068 | ND |
| 379 | 831.0 | CHAPERONE IN HSP78P. | sptrembl O74402 | Posttransitional modification. protein turnover. chaperones |
| 380 | 830.0 | 60S RIBOSOMAL PROTEIN L9-B (1.8) (YL11) (RP25). | swissprot P51401 | ND |
| 381 | 829.2 | CLATHRIN COAT ASSEMBLY PROTEIN. | sptrembl Q9Y71.6 | ND |
| 382 | 828.7 | PROBABLE T-COMPLEX PROTEIN I, ETA SUBUNIT (TCP-I-ETA) (CCT-ETA). | swissprot P87153 | Posttranslational modification, protein turnover, chaperones |
| 383 | 827.2 | HYPOTHETICAL 49.6 KD PROTEIN IN ELM1-PR12 INTERGENIC REGION. | swissprot P36091 | ND |

TABLE 1-continued

*Fusarium venenatum* ESTs

| Sequence Listing | zscore | Annotation | Database | Functional category |
|---|---|---|---|---|
| 384 | 826.9 | CLATHRIN COAT ASSEMBLY PROTEIN AP19 (CLATHRIN COAT ASSOCIATED PROTEIN AP19) (GOLGI ADAPTOR AP-1 19 KD ADAPTIN) (HA1 19 KD SUBUNIT) (CLATHRIN ASSEMBLY PROTEIN COMPLEX 1 SMALL CHAIN). | swissprot P56377 | ND |
| 385 | 826.6 | NUCLEAR MOVEMENT PROTEIN NUDC. | swissprot P17624 | ND |
| 386 | 825.8 | SERINE/THREONINE-PROTEIN KINASE NRC-2 (EC 2.7.1.-) (NONREPRESSIBLE CONIDIATION PROTEIN 2). | swissprot O42626 | ND |
| 387 | 824.9 | PUTATIVE HOMOSERINE O-ACETYL TRANSFERASE. | sptrembl O13389 | ND |
| 388 | 824.3 | SERINE PROTEASE PRECURSOR. | sptrembl O74236 | Posttranslational modification. protein turnover. chaperones |
| 389 | 823.9 | EUKARYOTIC TRANSLATION INITIATION FACTOR 2 GAMMA SUBUNIT (EIF-2- GAMMA). | swissprot P32481 | Amino acid transport and metabolism |
| 390 | 823.1 | PSU1. | tremblnew BAA83907 | ND |
| 391 | 822.5 | GLUTAMIC ACID DECARBOXYLASE. | tremblnew BAA88152 | Amino acid transport and metabolism |
| 302 | 820.8 | CHROMOSOME XV READING FRAME ORF YOR091W. | sptrembl Q12000 | ND |
| 393 | 820.2 | HYPOTHETICAL 22.4 KD PROTEIN. | sptrembl O13610 | ND |
| 394 | 819.7 | CYTOCHROME C549. | tremblnew BAA85768 | ND |
| 395 | 818.8 | 40S RIBOSOMAL PROTEIN S16 (RP61R) | swissprot P40213 | ND |
| 397 | 817.5 | CALNEXIN (FRAGMENT). | sptrembl Q41798 | ND |
| 398 | 816.8 | PROBABLE UTP--GLUCOSE-1-PHOSPHATE URIDYLYLTRANSFERASE (EC 2.7.7.9) (UDP-GLUCOSE PYROPHOSPHORYLASE) (UDPGP) (UGPASE) (FRAGMENT). | swissprot P78811 | ND |
| 399 | 814.6 | BRANCHING ENZYME. | sptrembl Q9Y8H3 | Carbohydrate transport and metabolism |
| 400 | 814.1 | HEAT SHOCK PROTEIN SSC1. MITOCHONDRIAL PRECURSOR (ENDONUCLEASE SCEI 75 KD SUBUNIT). | swissprot P12398 | Posttranslational modification. protein turnover. chaperones |
| 401 | 813.9 | BENZOATE 4-MONOOXYGENASE (EC 1.14.13.12) (BENZOATE-PARA-HYDROXYLASE) (CYTOCHROME P450 53). | swissnew P17549 | ND |
| 402 | 811.4 | TRANSKETOLASE (EC 2.2.1.1) (TK). | swissprot Q12630 | Carbohydrate transport and metabolism |
| 403 | 811.2 | PROBABLE SERINE/THREONINE-PROTEIN KINASE C1D4.HC (EC 2.7.1.-). | swissprot Q10156 | ND |
| 404 | 811.0 | HAPC. | sptrembl O59848 | DNA replication, recombination and repair |
| 405 | 810.6 | SULFITE OXIDASE PRECURSOR (EC 1.8.3.1). | swissprot O07116 | ND |

TABLE 1-continued

*Fusarium venenatum* ESTs

| Sequence Listing | zscore | Annotation | Database | Functional category |
|---|---|---|---|---|
| 406 | 809.6 | BETA-ADAPTIN (PLASMA MEMBRANE ADAPTOR HA2/AP2 ADAPTIN BETA SUBUNIT) (CLATHRIN ASSEMBLY PROTEIN COMPLEX 2 BETA LARGE CHAIN) (AP105B). | swissprot P21851 | ND |
| 407 | 809.6 | Murine RENTI protein. | geneseqp W36509 | DNA replication. recombination and repair |
| 408 | 809.5 | HYPOTHETICAL 69.9 KD PROTEIN IN MIC1-SRB5 INTERGENIC REGION. | swissprot P53261 | ND |
| 409 | 808.8 | Ester hydrolase protein encoded by rec 511 gene. | geneseqp R44609 | ND |
| 410 | 807.7 | PUTATIVE SACCHAROPINE DEHYDROGENASE. | sptrembl O59711 | Amino acid transport and metabolism |
| 411 | 807.2 | PROTEIN TRANSPORT PROTEIN SEC13. | swissprot P53024 | ND |
| 412 | 807.0 | HISTONE H4. | swissprot P04914 | DNA replication. recombination and repair |
| 413 | 806.7 | RHO3 PROTEIN. | swissprot Q00245 | ND |
| 414 | 805.6 | TRANSLATIONALLY CONTROLLED TUMOR PROTEIN HOMOLOG (TCTP). | swissprot P35691 | ND |
| 415 | 805.5 | PROBABLE ATP-DEPENDENT PERMEASE PRECURSOR. | swissprot P25371 | ND |
| 416 | 8050 | NATURAL KILLER CELL ENHANCING FACTOR. | sptrembl O93241 | Posttranslational modification. protein turnover, chaperones |
| 417 | 804.9 | HYPOTHETICAL 61.8 KD PROTEIN C12B10.03 IN CHROMOSOME I. | swissprot Q10437 | ND |
| 418 | 803.1 | ALPHA-MANNOSIDASE. | sptrembl O13344 | Carbohydrate transport and metabolism |
| 419 | 800.6 | UBIQUITIN. | sptrembl Q9Y736 | ND |
| 420 | 800.3 | ACETYL-COA ACETYLTRANSFERASE. | tremblnew CAA22123 | Lipid metabolism |
| 421 | 800.1 | VANADATE RESISTANCE PROTEIN GOG5/VRG4/VAN2. | swissprot P40107 | ND |
| 422 | 799.0 | HISTONE H4. | swissprot P04914 | ND |
| 423 | 797.3 | CARNITINE ACETYL TRANSFERASE FACC. | sptrembl O13363 | ND |
| 424 | 795.3 | EBURICOL 14 ALPHA-DEMETHYLASE. | tremblnew AAF15469 | ND |
| 425 | 795.1 | HYPOTHETICAL 45.2 KD GTP-BINDING PROTEIN IN TRX1-ZPR INTERGENIC REGION. | swissprot P42942 | ND |
| 426 | 793.9 | 26S PROTEASOME REGULATORY SUBUNIT MTS4 (19S REGULATORY CAP REGION OF 26S PROTEASE SUBUNIT 2). | swissprot P87048 | ND |
| 427 | 792.2 | OLIGOSACCHARYLTRANS-FERASE SUBUNIT. | sptrembl Q9Y716 | ND |
| 428 | 792.0 | PROBABLE METHYLMALONATE-SEMIALDEHYDE DEHYDROGENASE [ACYLATING] PRECURSOR (EC 1.2.1.27) (MMSDH). | swissprot P52713 | Energy production and conversion |

TABLE 1-continued

_Fusarium venenatum ESTs_

| Sequence Listing | zscore | Annotation | Database | Functional category |
|---|---|---|---|---|
| 429 | 791.6 | NAM7 PROTEIN (NONSENSE-MEDIATED MRNA DECAY PROTEIN 1) (UP-FRAMESHIFT SUPPRESSOR 1). | swissprot P30771 | DNA replication, recombination and repair |
| 430 | 791.4 | Murine Int6 protein associated with MMTV integration and tumour growth. | geneseqp W02113 | ND |
| 431 | 789.7 | SULFUR METABOLITE REPRESSION CONTROL PROTEIN. | swissprot Q00659 | ND |
| 432 | 788.3 | RRNA BIOGENESIS PROTEIN RRP5. | swissprot Q05022 | ND |
| 433 | 787.5 | PUTATIVE POTASSIUM CHANNEL SUBUNIT. | sptrembl O59826 | Energy production, and conversion |
| 434 | 787.2 | 40S RIBOSOMAL PROTEIN S26E (CRP5) (13.6 KD RIBOSOMAL PROTEIN). | swissprot P21772 | ND |
| 435 | 786.8 | ELONGATION FACTOR 1-BETA (EF-1-BETA) (P30). | swissprot P30151 | ND |
| 436 | 786.6 | METHIONYL-TRNA SYNTHETASE-LIKE PROTEIN. | tremblnew CAB36842 | Translation. ribosomal structure and biogenesis |
| 437 | 786.4 | Mutant _Aspergillus oryzae_ DEBY1058 rescued locus. | geneseqp W37993 | ND |
| 438 | 781.2 | GLUTAMATE--CYSTEINE LIGASE CATALYTIC SUBUNIT (EC 6.3.2.2) (GAMMA-GLUTAMYLCYSTEINE SYNTHETASE) (GAMMA-ECS) (GCS HEAVY CHAIN). | swissprot P19468 | ND |
| 439 | 781.2 | 60S RIBOSOMAL PROTEIN L17-A (YL17-A). | swissprot P05740 | ND |
| 440 | 780.5 | IMPORTIN ALPHA SUBUNIT (KARYOPHERIN ALPHA SUBUNIT (SERINE-RICH RNA POLYMERASE I SUPPRESSOR PROTEIN). | swissnew O14063 | ND |
| 441 | 780.4 | UBIQUITIN-CONJUGATING ENZYME E2-28.4 KD (EC 6.3.2.19) (UBIQUITIN-PROTEIN LIGASE) (UBIQUITIN CARRIER PROTEIN). | swissprot P33296 | ND |
| 442 | 780.0 | Corn SUG1 polypeptide. | geneseqp W97652 | Posttranslational modification. protein turnover, chaperones |
| 443 | 777.0 | FIBRILLARIN (NUCLEOLAR PROTEIN 1). | swissprot P15646 | ND |
| 444 | 775.9 | HYPOTHETICAL 33.9 KD PROTEIN. | sptrembl P78995 | Amino acid transport and metabolism |
| 445 | 774.0 | NADPH-DEPENDENT ALDEHYDE REDUCTASE (EC 1.1.1.2) (ALCOHOL DEHYDROGENASE (NADP-)) (ALDEHYDE REDUCTASE (NADPH)). | sptrembl Q12707 | ND |
| 446 | 772.5 | ATP SYNTHASE DELTA CHAIN. MITOCHONDRIAL PRECURSOR (EC 3.6.1.34) (FRAGMENT). | swissnew P56525 | ND |
| 447 | 771.5 | UBIQUITIN-CONJUGATING PROTEIN. | tremblnew AAD55983 | ND |
| 448 | 770.1 | HYPOTHETICAL 23.6 KD PROTEIN C23C11 13C IN CHROMOSOME I. | swissprot O13917 | ND |
| 449 | 769.6 | HYPOTHETICAL 68.5 KD PROTEIN. | sptrembl O60111 | ND |

TABLE 1-continued

*Fusarium venenatum* ESTs

| Sequence Listing | zscore | Annotation | Database | Functional category |
|---|---|---|---|---|
| 450 | 768.7 | UDP-N-ACETYLGLUCOSAMINE PYROPHOSPHORYLASE (EC 2.7.7.23). | swissprot O74933 | ND |
| 451 | 768.1 | ALUMINIUM RESISTANCE PROTEIN 2. | swissprot P43553 | Inorganic ion transport and metabolism |
| 452 | 765.4 | VACUOLAR AMINOPEPTIDASE 1 PRECURSOR (EC 3.4.11.22) POLYPEPTIDASE) (LEUCINE AMINOPEPTIDASE IV) (LAPIV) (AMINOPEPTIDASE III) (AMINOPEPTIDASE YSCI). | swissprot P14904 metabolism | Amino acid transport and |
| 453 | 764.2 | NUCLEOSOME ASSEMBLY PROTEIN. | sptrembl O59797 | ND |
| 454 | 763.6 | HYPOTHETICAL 107.9 KD PROTEIN IN POL4-SRD1 INTERGENIC REGION. | swissprot P25618 | ND |
| 455 | 762.7 | GAL10 BIFUNCTIONAL PROTEIN INCLUDES: UDP-GLUCOSE 4-EPIMERASE. (EC 5.1.3.2) (GALACTOWALDENASE); ALDOSE 1-EPIMERASE (EC 5.1.3.3) (MUTAROTASE)]. | swissprot P40801 | Cell envelope biogenesis outer membrane |
| 456 | 761.4 | REPLICATION PROTEIN. | swissprot P03858 | ND |
| 457 | 760.5 | UBIQUINOL-CYTOCHROME C REDUCTASE IRON-SULFUR SUBUNIT. MITOCHONDRIAL PRECURSOR (EC 1.10.2.2) (RIESKE IRON-SULFUR PROTEIN) (RISP). | swissprot P07056 | Energy production and conversion |
| 458 | 759.8 | POTENTIAL CAAX PRENYL PROTEASE 1 (EC 3.4.24.-) (PRENYL PROTEIN-SPECIFIC ENDOPROTEASE 1) (PPSEP 1). | swissprot Q10071 | Posttranslational modification, protein turnover. chaperones |
| 459 | 758.2 | PUTATIVE MITOCHONDRIAL PHOSPHATE CARRIER PROTEIN | tremblnew CAR55764 | ND |
| 460 | 757.5 | 31.1 KD PROTEIN IN DCM-SERU INTERGENIC REGION. | swissprot P31658 | ND |
| 461 | 757.3 | BIFUNCTIONAL PURINE BIOSYNTHETIC PROTEIN ADE1 [INCLUDES-PHOSPHORIBOSYLAMINE--GLYCINELIGASE (EC 6.3.4.13) (GARS) (GLYCINAMIDE RIBONUCLEOTIDE SYNTHETASE) (PHOSPHORIBOSYLGLYCIN AMIDE SYNTHETASE): PHOSPHORIBOSYLFORMYL GLYCINAMIDINE CYCLO-LIGASE (EC 6.3.3.1) (AIRS) (PHOSPHORIBOSYL-AMINOIMIDAZOLE SYNTHETASE) (AIR SYNTHASE)]. | swissprot Q99148 | Nucleotide transport |
| 462 | 757.2 | PATHOGENICITY PROTEIN. | sptrembl O93846 | ND |
| 463 | 754.9 | PUTATIVE DNA-DIRECTED RNA POLYMERASE III LARGEST SUBUNIT. | sptrembl O94666 | Transcription |

TABLE 1-continued

*Fusarium venenatum* ESTs

| Sequence Listing | zscore | Annotation | Database | Functional category |
|---|---|---|---|---|
| 464 | 753.8 | SECRETORY PATHWAY GDP DISSOCIATION INHIBITOR. | swissprot P39958 | ND |
| 465 | 752.6 | GUANINE NUCLEOTIDE-BINDING PROTEIN ALPHA SUBUNIT. | swissprot O42784 | ND |
| 466 | 752.2 | HYPOTHETICAL 22.7 KD PROTEIN. | sptrembl O60073 | ND |
| 467 | 749.7 | ALLANTOINASE (EC 3.5.2.5). | swissprot P32375 | Nucleotide transport |
| 468 | 748.8 | TRANSCRIPTION FACTOR TRI6. | tremblnew BAA83724 | ND |
| 469 | 748.3 | Ribosomal protein L41. | geneseqp R77658 | Translation, ribosomal structure and biogenesis |
| 470 | 748.0 | RAN/SP11 BINDING PROTEIN. | sptrembl Q09717 | ND |
| 471 | 746.4 | MITOCHONDRIAL PROCESSING PEPTIDASE ALPHA SUBUNIT PRECURSOR (EC 3.4.24.64) (ALPHA-MPP). | swissprot P23955 | ND |
| 472 | 745.3 | Human mammastatin amino acid sequence. | geneseqp Y23756 | ND |
| 473 | 744.9 | NADH-UBIQUINONE OXIDOREDUCTASE 21.3 KD SUBUNIT (EC 1.6.5.3) (EC 1.6.99.3). | swissprot P19968 | ND |
| 474 | 741.1 | MYO-INOSITOL-1-PHOSPHATE SYNTHASE (EC 5.5.1.4) (IPS). | swissprot P42800 | Lipid metabolism |
| 475 | 743.9 | HYPOTHETICAL 61.3 KD PROTEIN CY369.29. | sptrembl P71838 | ND |
| 476 | 743.6 | 60S RIBOSOMAL PROTEIN L27-A. | tremblnew CAB39364 | ND |
| 477 | 741.1 | EUKARYOTIC TRANSLATION INITIATION FACTOR 2 GAMMA SUBUNIT (EIF-2-GAMMA). | swissprot P32481 | Amino acid transport and metabolism |
| 478 | 741.0 | PROTEASOME COMPONENT PRE4 (EC 3.4.99 46) (MACROPAIN SUBUNIT PRE4) (PROTEINASE YSCE SUBUNIT PRE4) (MULTICATALYTIC ENDOPEPTIDASE COMPLEX SUBUNIT PRE4). | swissprot P30657 | ND |
| 479 | 740.3 | MULTICATALYTIC PROTEINASE 222 aa, chain M + 1 | pdb IRYP | ND |
| 480 | 739.6 | EPD1 PROTEIN PRECURSOR. | swissprot P56092 | ND |
| 481 | 738.3 | PROBABLE GAMMA-GLUTAMYL PHOSPHATE REDUCTASE. | tremblnew CAB57445 | Amino acid transport and metabolism |
| 482 | 737.8 | CONSERVED HYPOTHETICAL PROTEIN. | tremblnew CAB39853 | ND |
| 483 | 736.5 | PROBABLE ARGININOSUCCINATE LYASE (EC 4.3.2.1) (ARGINOSUCCINASE) (ASAL). | swissprot P50514 | Amino acid transport and metabolism |

TABLE 1-continued

*Fusarium venenatum* ESTs

| Sequence Listing | zscore | Annotation | Database | Functional category |
|---|---|---|---|---|
| 484 | 735.3 | ANTHRANILATE SYNTHASE COMPONENT II (EC 4.3.2.1) [INCLUDES: GLUTAMINE AMIDOTRANSFERASE, INDOLE-3-GLYCEROL PHOSPHATE SYNTHASE (EC 4.1.1.48) (IGPS); N-(5'-PHOSPHORIBOSYL)ANTHR ANILATE ISOMERASE (EC 5.3.1.24) (PRA1)] | swissprot P00908 | ND |
| 485 | 734.4 | ACONITATE HYDRATASE. MITOCHONDRIAL PRECURSOR (EC 4.2.1.3) (CITRATE HYDRO-LYASE) (ACONITASE). | swissprot O13966 | Energy production and conversion |
| 486 | 733.9 | PROBABLE SUCCINYL-COA LIGASE [GDP-FORMING] BETA-CHAIN, MITOCHONDRIAL PRECURSOR (EC 6.2.1.4) (SUCCINYL-COA SYNTHETASE, BETA CHAIN) (SCS- BETA). | swissprot P53312 | Energy production and conversion |
| 487 | 732.9 | Urate oxidase encoded by *A. flavus*-derived cDNA clone 9C. | geneseqp R10222 | ND |
| 488 | 732.0 | PUTATIVE PHOPHODIESTERASE - NUCLEOTIDE PYROPHOSPHATASE PRECURSOR. | sptrembl O94323 | ND |
| 489 | 731.2 | CAMP-DEPENDENT PROTEIN KINASE REGULATORY CHAIN. | swissnew O14448 | ND |
| 490 | 731.7 | K06A5.6 PROTEIN. | sptrembl O44549 | Lipid metabolism |
| 491 | 730.0 | 60S RIBOSOMAL PROTEIN L21. | tremblnew CAB4755 | Translation. ribosomal structure and biogenesis |
| 492 | 729.0 | PUTATIVE ALANINE AMINOTRANSFERASE. MITOCHONDRIAL PRECURSOR (EC 2.6.1.2) (GLUTAMIC--PYRUVIC TRANSAMINASE) (GPT) (GLUTAMIC--ALANINE TRANSAMINASE). | swissprot P52893 | ND |
| 493 | 726.0 | PUTATIVE NADH-CYTOCHROME B5 REDUCTASE. | sptrembl O74557 | Coenzyme metabolism |
| 494 | 725.9 | CYTOCHROME C1. HEME PROTEIN PRECURSOR. | swissprot P07142 | ND |
| 495 | 725.2 | HYPOTHETICAL 74.5 KD PROTEIN C4113.03C IN CHROMOSOME I | swissprot Q10211 | ND |
| 496 | 724.2 | MITOCHONDRIAL PRECURSOR PROTEINS IMPORT RECEPTOR (72 KD MITOCHONDRIAL OUTER MEMBRANE PROTEIN) (MITOCHONDRIAL IMPORT RECEPTOR FOR THE ADP/ATP CARRIER) (TRANSLOCASE OF OUTER MEMBRANE TOM70). | swissprot P23231 | ND |
| 497 | 724.1 | MITOCHONDRIAL RIBOSOMAL PROTEIN S24. | swissprot P08580 | Translation. ribosomal structure and biogenesis |
| 498 | 722.5 | SPERMIDINE SYNTHASE. | sptrembl Q9Y8H7 | Amino acid transport and metabolism |

TABLE 1-continued

*Fusarium venenatum* ESTs

| Sequence Listing | zscore | Annotation | Database | Functional category |
|---|---|---|---|---|
| 499 | 721.9 | RNA BINDING PROTEIN. | sptrembl O60059 | ND |
| 500 | 721.0 | RNA BINDING PROTEIN. | sptrembl O59800 | ND |
| 501 | 720.5 | HYPOTHETICAL 60.7 KD PROTEIN C1B1.02C IN CHROMOSOME I | sptrembl O13863 | ND |
| 502 | 718.8 | P-TYPE ATPASE (FRAGMENT). | tremblnew (CAB65297 | Inorganic ion transport and metabolism |
| 503 | 718.3 | MNN9 PROTEIN. | swissprot P39107 | ND |
| 504 | 718.3 | HISTONE H2B. | swissprot P23754 | ND |
| 505 | 717.6 | HYPOTHETICAL 67.3 KD PROTEIN IN IK11-ERG9 INTERGENIC REGION. | swissprot P38875 | ND |
| 506 | 716.6 | BIFUNCTIONAL PURINE BIOSYNTHESIS PROTEIN ADE17 [INCLUDES: PHOSPHORIBOSYLAMINO IMIDAZOLECARBOXAMIDE FORMYLTRANSFERASE (EC 2.1.2.3) (AICAR TRANSFORMYLASE), IMP CYCLOHYDROLASE (EC 3.5.4.10) (INOSINICASE) (IMP SYNTHETASE) (ATIC)]. | swissprot P38009 | Nucleotide transport |
| 507 | 716.2 | GABA PERMEASE. | sptrembl Q9Y860 | Amino acid transport and metabolism |
| 508 | 715.8 | PUTATIVE MANNOSE-1-PHOSPHATE GAUNYL TRANSFERASE. | sptrembl O60064 | ND |
| 509 | 715.5 | PUTATIVE CYSTINE-RICH TRANSCRIPTIONAL REGULATOR. | sptrembl O74853 | ND |
| 510 | 713.6 | BETA-GLUCOSIDASE PRECURSOR (EC 3.2.1.21). | tremblnew AAF21242 | ND |
| 511 | 712.6 | CHORISMATE MUTASE (EC 5.4.99.5). | sptrembl Q9Y7B2 | ND |
| | | PROBABLE ATP-DEPENDENT TRANSPORTER YOL075C. | swissprot Q08234 | ND |
| 513 | 709.4 | CYCLOPHILIN, MITOCHONDRIAL FORM PRECURSOR (EC 5.2.1.8). | sptrembl Q99009 | Posttranslational modification. protein turnover, chaperones |
| 514 | 709.2 | ER-DERIVED VESICLES PROTEIN ERV14 | swissnew P53173 | ND |
| 515 | 707.3 | PUTATIVE CALCIUM P-TYPE ATPASE (FRAGMENT) | tremblnew CAB65293 | Inorganic ion transport and metabolism |
| 516 | 705.7 | RASP F 9 (FRAGMENT). | sptrembl O42800 | ND |
| 517 | 704.8 | HYPOTHETICAL 20.9 KD PROTEIN | sptrembl O94286 | ND |
| 518 | 704.7 | COATOMER BETA SUBUNIT (BETA-COAT PROTEIN) (BETA-COP). | swissprot P23514 | ND |
| 519 | 702.9 | MSH3 PROTEIN. | sptrembl O81818 | DNA replication, recombination and repair |
| 520 | 702.1 | POTASSIUM-TRANSPORTING ATPASE ALPHA CHAIN (EC 3.6.1.36) (PROTON PUMP) (GASTRIC III K ATPASE ALPHA SUBUNIT). | swissprot P19156 | ND |

TABLE 1-continued

*Fusarium venenatum* ESTs

| Sequence Listing | zscore | Annotation | Database | Functional category |
|---|---|---|---|---|
| 521 | 702.0 | PHOSPHATIDATE CYTIDYLYLTRANSFERASE (EC 2.7.7.41) (CDP-DIGLYCERIDE SYNTHETASE) (CDP PYROPHOSPHORYLASE) (CDP-DIACYLGLYCEROL SYNTHASE) (CDS) (CTP:PHOSPHATIDATE) (CDP-DAG SYNTHASE). | swissprot P38221 | Lipid metabolism |
| 522 | 701.7 | VIRULENCE PROTEIN CAP20. | sptrembl Q00368 | ND |
| 523 | 700.9 | CHROMOSOME XII READING FRAME ORF YLR009W. | sptrembl Q07915 | Translation, ribosomal structure and biogenesis |
| 525 | 699.5 | PUTATIVE YEAST CELL DIVISION CYCLE CDC50 HOMOLOG. | sptrembl O94568 | ND |
| 526 | 698.2 | ACONITATE HYDRATASE, MITOCHONDRIAL PRECURSOR (EC 4.2.1.3) (CITRATE HYDRO-LYASE) (ACONITASE). | swissprot O13966 | Energy production and conversion |
| 527 | 695.7 | PUTATIVE DELTA-1-PYROLINE-5-CARBOXYLATE DEHYDROGENASE | sptrembl O74766 | Energy production and conversion |
| 528 | 694.5 | GLUTATHIONE PEROXIDASE HYR1 (EC 1.11.1.9). | swissprot P40581 | Posttranslational modification, protein turnover, chaperones |
| 529 | 693.9 | PROBABLE VACUOLAR SORTING PROTEIN C9G1.14C (FRAGMENT). | sptrembl O14309 | ND |
| 530 | 693.0 | UBIQUITIN-CONJUGATING ENZYME E2-24 KD (EC 6.3.2.19) (UBIQUITIN-PROTEIN LIGASE) (UBIQUITIN CARRIER PROTEIN). | swissprot P21734 | ND |
| 531 | 692.8 | CYTOCHROME C OXIDASE POLYPEPTIDE V PRECURSOR (EC 1.9.3.1). | swissprot P06810 | ND |
| 532 | 691.7 | HYPOTHETICAL ZINC-TYPE ALCOHOL DEHYDROGENASE-LIKE PROTEIN IN PRE5-FET4 INTERGENIC REGION. | swissprot Q04894 | ND |
| 533 | 691.5 | SECRETORY PATHWAY GDP DISSOCIATION INHIBITOR. | swissprot P39958 | ND |
| 534 | 690.1 | GLUCAN SYNTHASE. | sptrembl Q9Y8B3 | ND |
| 535 | 689.7 | SUPEROXIDE DISMUTASE PRECURSOR (EC 1.15.1 1). | sptrembl Q9Y783 | ND |
| 536 | 689.2 | DOLICHOL-PHOSPHATE MANNOSYLTRANSFERASE (EC 2.4.1.83) (DOLICHOL-PHOSPHATE MANNOSE SYNTHASE) (DOLICHYL-PHOSPHATE BETA-D-) MANNOSYLTRANSFERASE). | sptrembl O14466 | ND |
| 537 | 688.9 | PUTATIVE FUMARASE | sptrembl O24649 | ND |
| 538 | 688.8 | PROBABLE INOSINE-5'-MONOPHOSPHATE DEHYDROGENASE (EC 1.1.1.205) (IMP DEHYDROGENASE) (IMPDH) (IMPD). | swissprot P50095 | ND |
| 539 | 687.4 | CHROMOSOME XV READING FRAME ORF YOR197W. | sptrembl Q08601 | ND |

TABLE 1-continued

*Fusarium venenatum* ESTs

| Sequence Listing | zscore | Annotation | Database | Functional category |
|---|---|---|---|---|
| 540 | 686.5 | PUTATIVE PROTEASOME COMPONENT PUP1 PRECURSOR (EC 3.4.99.46) (MACROPAIN SUBUNIT) (MULTICATALYTIC ENDOPEPTIDASE COMPLEX SUBUNIT). | swissprot Q09841 | Posttranslational modification. protein turnover. chaperones |
| 541 | 685.3 | SERYL-TRNA SYNTHETASE (EC 6.1.1.11) (SERINE--TRNA LIGASE) (SERRS). | swissprot Q39230 | Translation. ribosomal structure and biogenesis |
| 542 | 684.0 | HYPOTHETICAL 41.3 KD PROTEIN C26F1.12C IN CHROMOSOME I. | swissprot Q10498 | ND |
| 543 | 683.8 | SEXUAL DIFFERENTIATION PROCESS PROTEIN ISP4. | swissprot P40900 | ND |
| 544 | 682.8 | FATTY ACID OMEGA-HYDROXYLASE (P450FOXY). | sptrembl Q9YSG7 | ND |
| 545 | 680.9 | METHIONINE AMINOPEPTIDASE. | sptrembl O60085 | Translation. ribosomal structure and biogenesis |
| 546 | 679.8 | UBIQUITIN CONJUGATING ENZYME. | tremblnew CAB38416 | ND |
| 547 | 679.5 | NITRITE REDUCTASE. | sptrembl Q92198 | ND |
| 548 | 679.5 | PUTATIVE GOLGI MEMBRANE PROTEIN-SORTING PROTEIN. | sptrembl O94291 | ND |
| 540 | 677.1 | COLONY 1. | sptrembl Q01491 | ND |
| 550 | 671.0 | MALTOSE PERMEASE. | sptrembl Q9Y845 | ND |
| 551 | 668.6 | ANNEXIN XIV. | sptrembl O59907 | ND |
| 552 | 667.7 | SQUALENE MONOOXYGENASE (EC 1.14.99.7) (SQUALENE EPOXIDASE) (SE). | swissprot Q92206 | Coenzyme metabolism |
| 553 | 667.2 666.7 | PROBABLE ATP-DEPENDENT RNA HELICASE DBP8. | swissprot P38719 | DNA replication. recombination and repair |
| 554 | 666.7 | HYPOTHETICAL 55.8 KD PROTEIN. | tremblnew CAB63552 | ND |
| 555 | 664.9 | CYTOCHROME P450 MONOOXYGENASE (FRAGMENT). | sptrembl O64410 | ND |
| 556 | 664.4 | ATP SYNTHASE PROTEIN 9. MITOCHONDRIAL PRECURSOR (EC 3.6.1.34) (LIPID-BINDING PROTEIN). | swissprot P00842 | ND |
| 557 | 663.4 | ATP SYNTHASE SUBUNIT 4, MITOCHONDRIAL PRECURSOR (EC 3.6.1.34). | swissprot O13349 | ND |
| 558 | 663.4 | ERGOSTEROL BIOSYNTHESIS PROTEIN (KES1). | sptrembl O74178 | ND |
| 559 | 662.8 | URICASE (EC 1.7.3.3) (URATE OXIDASE). | swissprot Q00511 | ND |
| 560 | 662.4 | GLYCEROL-3-PHOSPHATE DEHYDROGENASE (EC | tremblnew CAB58452 | ND |
| 561 | 661.8 | PUTATIVE GLUTAMYL-TRNA SYNTHETASE, CYTOPLASMIC (EC 6.1.1.17) (GLUTAMATE--TRNA LIGASE) (GLURS). | sptrembl O13775 | Translation, ribosomal structure and biogenesis |
| 562 | 661.5 | PHOSPHORIBOSYLFORMYL GLYCINAMIDE SYNTHASE (EC 6.3.5.3) (FGAM SYNTHASE) (FORMYLGLYCINAMIDE RIBOTIDE AMIDOTRANSFERASE) (FGARAT). | swissprot P15254 | Nucleotide transport |
| 563 | 661.0 | Mutant *Aspergillus oryzae* DEBY932 rescued locus. | geneseqp W37992 | ND |

TABLE 1-continued

*Fusarium venenatum* ESTs

| Sequence Listing | zscore | Annotation | Database | Functional category |
|---|---|---|---|---|
| 564 | 660.6 | N-MYRISTOYL TRANSFERASE. | tremblnew BAA87865 | ND |
| 565 | 660.1 | HYPOTHETICAL 79.2 KD PROTEIN. | sptrembl Q04585 | Energy production and conversion |
| 566 | 659.6 | PUTATIVE ALDEHYDE DEHYDROGENASE (NAD+) (EC 1.2.1.3). | sptrembl O74187 | Energy production and conversion |
| 567 | 657.9 | PROTEASOME COMPONENT PRE2 PRECURSOR (EC 3.4.99.46) (MACROPAIN SUBUNIT PRE2) (PROTEINASE YSCE SUBUNIT PRE2) (MULTICATALYTIC ENDOPEPTIDASE COMPLEX SUBUNIT PRE2). | swissprot P30656 | Posttranslational modification, protein turnover . chaperones |
| 568 | 657.8 | BIFUNCTIONAL HISTIDINE BIOSYNTHESIS PROTEIN HIS7 [INCLUDES: HISH-TYPE AMIDOTRANSFERASE (EC 2.4.2.-): HISP-TYPE CYCLASE]. | swissprot P33734 | Amino acid transport and metabolism |
| 569 | 657.3 | CYCLOPHILIN OVCYP-2 (EC 5.2.1.8). | sptrembl O25633 | Posttranslational modification. protein turnover, chaperones |
| 570 | 657.0 | 40S RIBOSOMAL PROTEIN S3AE (S1). | swissprot Q09781 | Translation. ribosomal structure and biogenesis |
| 571 | 657.0 | PUTATIVE RHO GDP-DISSOCIATION INHIBITOR (RHO GDI). | sptrembl O14224 | ND |
| 572 | 656.5 | NHP2/RS6 FAMILY PROTEIN YEL026W HOMOLOG. | swissprot Q21568 | Translation. ribosomal structure and biogenesis |
| 573 | 655.1 | Aminopeptidase. | geneseqp W05589 | ND |
| 574 | 655.1 | YNT20 PROTEIN. | swissprot P54964 | ND |
| 575 | 651.4 | ATP SYNTHASE D CHAIN. MITOCHONDRIAL (EC 3.6.1.34). | swissprot O13350 | ND |
| 576 | 649.3 | HISTONE H2B. | swissprot P23754 | ND |
| 577 | 648.3 | RIBOFLAVIN SYNTHASE ALPHA CHAIN | sptrembl Q9Y7P0 | Coenzyme metabolism |
| 578 | 648.1 | 60S RIBOSOMAL PROTEIN L6-A (L17) (YL16) (RP18). | swissprot Q02326 | ND |
| 579 | 647.9 | CALNEXIN HOMOLOG PRECURSOR. | swissprot P36581 | ND |
| 580 | 647.0 | HYPOTHETICAL 50.5 KD PROTEIN. | sptrembl Q03940 | DNA replication. recombination and repair |
| 581 | 646.7 | HYDROXYMETHYLGLUTARYL-COA LYASE (EC 4.1.3.4) (HMG-COA LYASE) (HL) (3-HYDROXY-3-METHYLGLUTARATE-COA LYASE). | swissprot P13703 | Amino acid transport and metabolism |
| 582 | 645.8 | FATTY ACID DESATURASE (FRAGMENT). | sptrembl O74645 | ND |
| 583 | 644.7 | HET-C PROTEIN. | tremblnew AAD54275 | ND |
| 584 | 643.9 | SIKI PROTEIN. | swissprot Q12460 | Translation, ribosomal structure and biogenesis |
| 585 | 642.1 | *B. bassiana* POPS reductase protein. | geneseqp Y33673 | ND |
| 586 | 639.7 | CARBONIC ANHYDRASE (EC 4.2.1.1). | sptrembl Q43061 | Inorganic ion transport and metabolism |

TABLE 1-continued

*Fusarium venenatum* ESTs

| Sequence Listing | zscore | Annotation | Database | Functional category |
|---|---|---|---|---|
| 587 | 639.5 | CONSERVED HYPOTHETICAL PROTEIN. | sptrembl Q9Y7K1 | Posttranslational modification. protein turnover. chaperones |
| 588 | 638.9 | 3-ISOPROPYLMALATE DEHYDROGENASE (EC 1.1.1.85) (BETA-IPM DEHYDROGENASE) (IMDH) (3-IPM-DH). | swissprot P34738 | Amino acid transport and metabolism |
| 589 | 638.9 | CELL DIVISION CONTROL PROTEIN NDA4 | swissprot P41389 | ND |
| 590 | 637.4 | HYPOTHETICAL 55.4 KD PROTEIN. | sptrembl Q9Y439 | ND |
| 591 | 633.4 | RIBOSOMAL PROTEIN L37 HOMOLOG. | tremblnew CAB58374 | ND |
| 502 | 633.0 | MITOGEN-ACTIVATED PROTEIN KINASE (EC 2.7.1.-) (MAPK). | sptrembl Q00859 | Signal transduction mechanisms |
| 503 | 631.9 | SLA2P. | sptrembl O94097 | ND |
| 504 | 629.4 | HASNA-1. | sptrembl Q02849 | Inorganic ion transport and metabolism |
| 505 | 627.9 | G2/MITOTIC-SPECIFIC CYCLIN B. | swissprot P30284 | ND |
| 596 | 627.4 | CARBOXYPEPTIDASE S1 (EC 3.4.16.6). | swissprot P34946 | ND |
| 507 | 626.5 | MAL3 PROTEIN. | swissnew Q10113 | ND |
| 598 | 626.1 | Oat HaSGT protein fragment | geneseqp W64390 | ND |
| 599 | 625.2 | HYPOTHETICAL PROTEIN C5D6.13 (FRAGMENT). | sptrembl O14205 | ND |
| 600 | 625.0 | 60S RIBOSOMAL PROTEIN L26. | swissnew P78946 | ND |
| 601 | 623.8 | HYPOTHETICAL 43.9 KD PROTEIN IN MSYB-HTRB INTERGENIC REGION (ORF1). | swissprot P25744 | ND |
| 602 | 623.1 | URIDYLATE KINASE (EC 2.7.4.-) (UK) (URIDINE MONOPHOSPHATE KINASE) (UMP KINASE). | swissprot P15700 | Nucleotide transport |
| 603 | 620.9 | HYPOTHETICAL 29.4 KD PROTEIN C4D7.06C IN CHROMOSOME I. | sptrembl O14172 | ND |
| 604 | 620.7 | EPITHELIAL BASOLATELAR CHLORIDE CONDUCTANCE REGULATOR. | sptrembl Q23689 | ND |
| 605 | 619.2 | ALCOHOL DEHYDROGENASE I (EC 1.1.1.1). | swissprot P41747 | ND |
| 606 | 618.9 | N-MYRISTOYL TRANSFERASE. | tremblnew BAA87865 | ND |
| 607 | 618.8 | *S. cerevisiae* uronate dehydrogenase. | geneseqp W29217 | ND |
| 608 | 617.4 | SEXUAL DIFFERENTIATION PROCESS PROTEIN 1SP4. | swissprot P40900 | ND |
| 609 | 616.1 | GALACTOKINASE (EC 2.7.1.6). | swissnew P04385 | Carbohydrate transport and metabolism |
| 610 | 614.9 | 8 KDA CYTOPLASMIC DYNEIN LIGHT CHAIN | sptrembl O94111 | ND |
| 611 | 614.6 | FATTY ALDEHYDE DEHYDROGENASE (EC 1.2.1.3) ALDEHYDE DEHYDROGENASE. MICROSOMAL) (ALDH CLASS 3). | swissprot P47740 | Energy production and conversion |
| 612 | 614.4 | HYPOTHETICAL 79.2 KD PROTEIN. | sptrembl Q04585 | Energy production and conversion |

TABLE 1-continued

*Fusarium venenatum* ESTs

| Sequence Listing | zscore | Annotation | Database | Functional category |
|---|---|---|---|---|
| 613 | 614.3 | CHROMOSOME IV READING FRAME ORF YDL166C. | sptrembl Q12055 | Nucleotide transport |
| 614 | 612.6 | PHOSPHATIDYLSERINE DECARBOXYLASE PROENZYME 1 PRECURSOR (EC 4.1.1.65). | sptrembl O14333 | Lipid metabolism |
| 615 | 612.5 | RIBOSOMAL PROTEIN CRP7. | sptrembl O93798 | ND |
| 616 | 612.4 | SERINE-TYPE CARBOXYPEPTIDASE F PRECURSOR (EC 3.4.16.-) PROTEINASE F) (CPD-11). | swissprot P52718 | ND |
| 617 | 610.3 | PHOSPHOENOLPYRUVATE CARBOXYKINASE [ATP] (EC 4.1.1.49). | swissprot O13434 | Energy production and conversion |
| 618 | 609.4 | ACYL CARRIER PROTEIN, MITOCHONDRIAL PRECURSOR (ACP) (NADH-UBIQUINONE OXIDOREDUCTASE 9.6 KD SUBUNIT) (EC 1.6.5.3) (EC 1.6.99.3). | swissprot P11943 | ND |
| 619 | 608.2 | GLUCOSE-6-PHOSPHATE ISOMERASE. CYTOSOLIC (EC 5.3.1.9) (GPI) (PHOSPHOGLUCOSE ISOMERASE) (PGI) (PHOSPHOHEXOSE ISOMERASE) (PHI). | sptrembl O94371 | Carbohydrate transport and metabolism |
| 620 | 607.9 | ISOCITRATE LYASE (EC 4.1.3.1) (ISOCITRASE) (ISOCITRATASE) (ECL). | swissprot P28299 | Energy production and conversion |
| 621 | 607.8 | TYROSYL-TRNA SYNTHETASE, MITOCHONDRIAL PRECURSOR (EC 6.1.1.1) (TYROSINE--TRNA LIGASE) (TYRRS). | swissprot P28669 | ND |
| 622 | 605.7 | HYPOTHETICAL 55.8 KD PROTEIN. | tremblnew CAB63552 | ND |
| 623 | 605.6 | HYPOTHETICAL 24.5 KD PROTEIN. | tremblnew CAB52035 | ND |
| 624 | 605.2 | 60S RIBOSOMAL PROTEIN L32-A. | swissprot P79015 | Translation. ribosomal structure and biogenesis |
| 625 | 604.7 | PROBABLE RIBOSE-PHOSPHATE PYROPHOSPHOKINASE 5 (EC 2.7.6.1) (PHOSPHORIBOSYL PYROPHOSPHATE SYNTHETASE 5). | swissprot Q12265 | Nucleotide transport |
| 626 | 604.2 | HYPOTHETICAL 55.5 KD PROTEIN C17A2.05 IN CHROMOSOME I. | sptrembl O13755 | Energy production and conversion |
| 627 | 603.9 | HOMOLOGUES TO NITRILE HYDRATASE REGION 3'-HYPOTHETICAL PROTEIN P47K OF P. CHLORORAPHIS. | sptrembl P94400 | ND |
| 628 | 603.8 | *Cercospora nicotianae* cercosporin resistance sor1 gene product. | geneseqp W71467 | Nucleotide transport |
| 629 | 603.7 | PUTATIVE HYDROXYACYLGLUTATHIONE ONE HYDROLASE. | tremblnew CAB57337 | ND |
| 630 | 602.9 | NADH-UBIQUINONE OXIDOREDUCTASE 21 KD SUBUNIT (EC 1.6.5.3) (EC 1.6.99.3) (COMPLEX 1-21 KD) (C1-21 KD). | swissprot Q02854 | ND |

TABLE 1-continued

*Fusarium venenatum* ESTs

| Sequence Listing | zscore | Annotation | Database | Functional category |
|---|---|---|---|---|
| 631 | 602.6 | OPSIN-1. | tremblnew AAD45253 | ND |
| 632 | 602.0 | PUTATIVE MITOCHONDRIAL PROTEIN IMPORT PROTEIN - DNAJ PROTEIN. | sptrembl O74752 chaperones | Posttranslational modification protein turnover. |
| 633 | 601.4 | SEPTIN B. | sptrembl P78620 | ND |
| 634 | 601.1 | ORNITHINE DECARBOXYLASE (EC 4.1.1.17) (ODC). | swissprot P27121 | ND |
| 635 | 601.1 | FADE13. | sptrembl O86319 | Lipid metabolism |
| 636 | 598.6 | PUTATIVE GTP CYCLOHYDROLASE. | tremblnew CAB65619 | ND |
| 637 | 597.2 | PROBABLE ATP-DEPENDENT PERMEASE C3F10.11C. | swissprot Q10185 | ND |
| 638 | 596.5 | YEAST REDUCED VIABILITY UPON STARVATION PROTEIN 161 HOMOLOG. IMPLICATED IN CELL GROWTH AND CYTOSKELETAL OR GANISATION. | tremblnew CAA22181 | ND |
| 639 | 595.3 | PROTEIN KINASE DSKI (EC 2.7.1.-) (DISI-SUPPRESSING PROTEIN KINASE). | swissprot P36616 | ND |
| 640 | 595.2 | HYPOTHETICAL 46.5 KD PROTEIN C12B10.04 IN CHROMOSOME I. | swissprot Q10438 | ND |
| 641 | 595.1 | PUTATIVE HELICASE C6F12.16 IN CHROMOSOME 1. | swissprot O14232 | DNA replication. recombination and repair |
| 642 | 594.9 | HYPOTHETICAL 48.3 KD PROTEIN IN MOB1-SGA1 INTERGENIC REGION. | swissprot P40487 | Translation. ribosomal structure and biogenesis |
| 643 | 593.8 | *S. cerevisiae* type 2 methionine aminopeptidase (MetAP2). | geneseqp W94766 | Translation, ribosomal structure and biogenesis |
| 644 | 593.1 | HYPOTHETICAL 68.3 KD PROTEIN. | sptrembl Q03195 | ND |
| 645 | 593.0 | RAS-2 PROTEIN. | swissnew Q01387 | ND |
| 646 | 591.1 | DIHYDROLIPOAMIDE SUCCINYLTRANSFERASE. | tremblnew AAD47296 | ND |
| 647 | 590.3 | HYPOTHETICAL 68.1 KD PROTEIN. | tremblnew CAB63538 | Nucteotide transport |
| 648 | 590.2 | PUTATIVE TYPE III ALCOHOL DEHYDROGENASE. | sptrembl Q94532 | ND |
| 649 | 590.0 | NUCLEAR TRANSPORT FACTOR 2 (NTF-2). | swissprot P87102 | ND |
| 650 | 589.8 | *Aspergillus niger* adhA gene. | geneseqp P70497 | ND |
| 651 | 588.9 | NADH-UBIQUINONE OXIDOREDUCTASE 12 KD SUBUNIT PRECURSOR (EC 1.6.5.3) (EC 1.6.99.3) (COMPLEX 1-12 KD) (C1-12KD). | swissprot Q03015 | ND |
| 652 | 588.0 | ALTERNATIVE OXIDASE. | sptrembl O93788 | ND |
| 653 | 587.6 | HYPOTHETICAL 31.1 KD PROTEIN IN SIP18-SPT21 INTERGENIC REGION. | swissprot Q03219 | ND |
| 654 | 587.0 | PISATIN DEMETHYLASE (EC 1.14.-.-) (CYTOCHROME P450 57A1). | swissprot Q12645 | ND |
| 655 | 586.5 | FISSION YEAST. | sptrembl P78771 | ND |
| 656 | 584.1 | ADENYLOSUCCINATE LYASE (EC 4.3.2.2) (ADENYLOSUCCINASE) (ASL). | swissprot Q05911 | Nucleotide transport |

TABLE 1-continued

*Fusarium venenatum* ESTs

| Sequence Listing | zscore | Annotation | Database | Functional category |
|---|---|---|---|---|
| 657 | 583.8 | PROTEIN TRANSLATION FACTOR SU11. | swissprot P32911 | ND |
| 658 | 582.3 | HEAT SHOCK PROTEIN 90 HOMOLOG (SUPPRESSOR OF VEGETATIVE INCOMPATIBILITY MOD-E). | swissprot O43109 | ND |
| 659 | 582.3 | CELL DIVISION CONTROL PROTEIN 54. | swissprot P30665 | DNA replication. recombination and repair |
| 660 | 582.2 | HYPOTHETICAL 36.8 KD PROTEIN C9E9.11 IN CHROMOSOME I | sptrembl O14295 | ND |
| 661 | 581.2 | BIFUNCTIONAL HISTIDINE BIOSYNTHESIS PROTEIN HIS7 [INCLUDES: HIS11-TYPE AMIDOTRANSFERASE (EC 2.4.2.- ): HISF-TYPE CYCLASE]. | swissprot P33734 | Amino acid transport and metabolism |
| 662 | 581.1 | RIBOSOMAL PROTEIN CRP7. | sptrembl O93798 | ND |
| 663 | 580.4 | HSP78P. | sptrembl Q12137 | Posttranslational modification, protein turnover. chaperones |
| 664 | 579.8 | BASIC AMINO-ACID PERMEASE. | swissprot P38971 | Amino acid transport and metabolism |
| 665 | 576.9 | EXTRACELLULAR PUTATIVE DNASE. | tremblnew AAD53090 | ND |
| 666 | 576.2 | TFIID SUBUNIT TAF72P. | sptrembl O13282 | ND |
| 667 | 576.1 | (HISTIDYL-TRNA SYNTHETASE (EC 6.1.1.21) (HISTIDINE--TRNA LIGASE) (HISRS). | swissprot P43823 | ND |
| 668 | 575.2 | 40S RIBOSOMAL PROTEIN S27. | swissprot O74330 | ND |
| 669 | 574.9 | MALTOSE PERMEASE MAL3T (MALTOSE TRANSPORT PROTEIN MAL3T). | swissprot P38156 | ND |
| 670 | 574.3 | HYPOTHETICAL 49.9 KD PROTEIN. | sptrembl Q03441 | ND |
| 671 | 573.6 | 60S RIBOSOMAL PROTEIN L37-A (L35) (YP55). | swissprot P49166 | ND |
| 672 | 573.4 | 60S RIBOSOMAL PROTEIN L31 (L34) (YL28). | swissprot P04649 | ND |
| 673 | 572.7 | NUCLEAR PROTEIN SNF4 (REGULATORY PROTEIN (CAT3). | swissprot P12904 | ND |
| 674 | 572.2 | OLIGOMYCIN SENSITIVITY CONFERRING PROTEIN. | sptrembl O74190 | Energy production and conversion |
| 675 | 571.4 | 40S RIBOSOMAL PROTEIN S8 (S14) (Y59) (RP19). | swissprot P05754 | Translation, ribosomal Structure and biogenesis |
| 676 | 571.1 | 60S RIBOSOMAL PROTEIN L13. | sptrembl Q9Z313 | ND |
| 677 | 570.6 | GARI PROTEIN. | swissnew P28007 | ND |
| 678 | 570.6 | GEPHYRIN (PUTATIVE GLYCINE RECEPTOR-TUBULIN LINKER PROTEIN). | swissprot Q03555 | ND |
| 679 | 570.4 | ZINC FINGER PROTEIN SFP1. | swissprot P32432 | ND |
| 680 | 570.3 | RECESSIVE SUPPRESSOR OF SECRETORY DEFECT. | swissprot P32368 | ND |
| 681 | 569.9 | THIAMINE-4 (FRAGMENT). | sptrembl P79048 | ND |
| 682 | 569.2 | PROBABLE SYNAPTOBREVIN HOMOLOG C6G9.11. | swissprot Q92356 | ND |

TABLE 1-continued

Fusarium venenatum ESTs

| Sequence Listing | zscore | Annotation | Database | Functional category |
|---|---|---|---|---|
| 683 | 560.2 | PYRROLINE-5-CARBOXYLATE REDUCTASE (EC 1.5.1.2) (P5CR) (P5C REDUCTASE). | swissprot P22008 | Amino acid Transport and metabolism |
| 684 | 569.2 | Human secreted protein encoded by gene 35 clone HTXCS21 | geneseqp W78160 | Posttranslational modification, protein turnover. chaperones |
| 685 | 568.5 | HYPOTHETICAL 15.4 KD PROTEIN IN HAS1-JNM1 INTERGENIC REGION. | swissprot Q03554 | ND |
| 686 | 568.4 | COPROPORPHYRINOGEN III OXIDASE (EC 1.3.3.3) (COPROPORPHYRINOGENASE) (COPROGEN OXIDASE) (COX). | swissprot P11353 | Coenzyme metabolism |
| 687 | 568.3 | GTP-BINDING PROTEIN YPT51/VPS21. | swissprot P36017 | ND |
| 688 | 567.8 | HYPOTHETICAL 56.5 KD PROTEIN IN HXT8 5'REGION AND IN PAU6 5'REGION. | swissprot P39941 | Carbohydrate transport and metabolism |
| 689 | 567.2 | OLIGOMYCIN RESISTANCE ATP-DEPENDENT PERMEASE YOR1. | swissprot P53049 | ND |
| 690 | 567.0 | ACTIN INTERACTING PROTEIN 2. | swissprot P46681 | Energy production and conversion |
| 691 | 563.9 | 60S RIBOSOMAL PROTEIN L43 (L37A) (YL35). | swissprot P49631 | ND |
| 692 | 563.6 | HYPOTHETICAL 49.1 KD PROTEIN. | sptrembl O60140 | ND |
| 693 | 563.6 | PEROXISOMAL MEMBRANE PROTEIN PAS20 (PEROXIN-13). | swissprot P80667 | ND |
| 694 | 561.6 | PHOSPHATIDYLGLYCEROL/ PHOSPHATIDYLINOSITOL TRANSFER PROTEIN. | sptrembl O94183 | ND |
| 695 | 561.4 | HYPOTHETICAL 40.7 KD PROTEIN IN PYK1-SNC1 INTERGENIC REGION. | swissprot P39729 | ND |
| 696 | 559.0 | PUTATIVE MITOCHONDRIAL PROTEIN IMPORT PROTEIN - DNAJ PROTEIN. | sptrembl O74752 | Posttranslational modification. protein turnover. chaperones |
| 697 | 558.2 | PEPTIDYL-PROLYL CIS-TRANS ISOMERASE, FK506-BINDING PROTEIN. | tremblnew CAB46710 | ND |
| 698 | 557.9 | PUTATIVE CYSTATHIONINE GAMMA-SYNTHASE (EC 4.2.99.9) (O-SUCCINYLHOMOSERINE (THIOL)-LYASE) | swissprot P47164 | Amino acid transport and metabolism |
| 699 | 557.5 | GLUCOKINASE (EC 2.7.1.2) (GLUCOSE KINASE) (GLK). | swissprot Q92407 | ND |
| 700 | 556.7 | PUTATIVE SEPTIN. | tremblnew CAB61437 | ND |
| 701 | 556.6 | UDP-GLUCOSE 6-DEHYDROGENASE (EC 1.1.1.22) (UDP-GLC DEHYDROGENASE) (UDP-GLCDH) (UDPGDH) (SUGARLESS PROTEIN). | swissprot O02373 | ND |
| 702 | 556.2 | 60S RIBOSOMAL PROTEIN L14-A. | swissprot P36105 | ND |
| 703 | 554.4 | HYPOTHETICAL 25.2 KD PROTEIN. | sptrembl Q9Y7K7 | ND |
| 704 | 553.9 | NADPH-DEPENDENT BETA-KETOACYL REDUCTASE. | tremblnew AAD53514 | ND |
| 705 | 553.3 | HYPOTHETICAL 16.1 KD PROTEIN. | sptrembl O74847 | ND |

TABLE 1-continued

*Fusarium venenatum* ESTs

| Sequence Listing | zscore | Annotation | Database | Functional category |
|---|---|---|---|---|
| 706 | 553.1 | PROTEASOME COMPONENT PUP2 (EC 3.4.99.46) (MACROPAIN SUBUNIT PUP2 PROTEINASE YSCE SUBUNIT PUP2) (MULTICATALYTIC ENDOPEPTIDASE COMPLEX SUBUNIT PUP2). | swissprot P32379 | ND |
| 707 | 551.8 | *A. niger* Bo-1 carboxypeptidase Y. | geneseqp R96737 | ND |
| 708 | 551.5 | SIMILAR TO JUN ACTIVATION DOMAIN BINDING PROTEIN. | sptrembl O23130 | ND |
| 709 | 550.8 | HYPOTHETICAL 47.4 KD PROTEIN IN SHP1-SEC17 INTERGENIC REGION | sptrembl O13630 | ND |
| 710 | 550.5 | DNA-DIRECTED RNA POLYMERASE III LARGEST SUBUNIT (EC 2.7.7.6) (C160). | swissprot P04051 | Transcription |
| 711 | 549.5 | GENE REGULATION 124 aa, chain A + B + C | pdb 1QD9 | Translation, ribosomal structure and biogenesis |
| 712 | 549.2 | GUANINE NUCLEOTIDE-BINDING PROTEIN BETA SUBUNIT. | swissprot O14435 | ND |
| 713 | 548.6 | TRANSMEMBRANE PROTEIN. | tremblnew CAB65007 | ND |
| 714 | 548.6 | *Aspergillus nidulans* essential protein AN17. | geneseqp Y06418 | ND |
| 715 | 547.2 | 2-OXOGLUTARATE DEHYDROGENASE E1 COMPONENT. MITOCHONDRIAL PRECURSOR (EC 1.2.42) (ALPHA-KETOGLUTARATE DEHYDROGENASE). | swissprot P20967 | Energy production and conversion |
| 716 | 547.0 | 40S RIBOSOMAL PROTEIN S20. | swissprot P55828 | Translation. ribosomal structure and biogenesis |
| 717 | 546.7 | NADP(H)-DEPENDENT KETOSE REDUCTASE. | sptrembl O96496 | ND |
| 718 | 545.6 | SIK1 PROTEIN | swissprot Q12460 | Translation. ribosomal structure and biogenesis |
| 719 | 544.4 | PUTATIVE STRUCTURE SPECIFIC REGOGNITION PROTEIN. POSSIBLE CHROMATIN-ASSOCIATED HMG PROTEIN. | sptrembl O94529 | ND |
| 720 | 544.3 | BIOTIN SYNTHASE (EC 2.8.1.6) (BIOTIN SYNTHETASE). | swissprot P32451 | Coenzyme metabolism |
| 721 | 544.2 | WHITE COLLAR 1 PROTEIN (WC1). | swissnew Q01371 | ND |
| 722 | 543.3 | CODED FOR BY C. ELEGANS CDNA YK110HL3. | sptrembl P91125 | ND |
| 723 | 543.2 | SORBITOL UTILIZATION PROTEIN SOU2. | swissprot P87218 | ND |
| 724 | 543.2 | 40S RIBOSOMAL PROTEIN S10-A. | swissprot Q08745 | ND |
| 725 | 541.4 | VANILLIN DEHYDROGENASE. | sptrembl O05619 | ND |
| 726 | 540.5 | ESTERASE A. | sptrembl O87861 | ND |
| 727 | 539.1 | HYPOTHETICAL 22.4 KD PROTEIN C22E12.05C IN CHROMOSOME I. | swissnew Q10358 | ND |

TABLE 1-continued

*Fusarium venenatum* ESTs

| Sequence Listing | zscore | Annotation | Database | Functional category |
|---|---|---|---|---|
| 728 | 537.7 | *Alternaria alternata* allergen Alta1 I. | geneseqp R71833 | Translation. ribosomal structure and biogenesis |
| 729 | 537.7 | *Cladosporium herbarum* allergen ClahbI2. | geneseqp R99961 | ND |
| 730 | 535.6 | PYRUVATE DECARBOXYLASE. | sptrembl O94185 | Coenzyme metabolism |
| 731 | 535.0 | UBIQUITIN FUSION DEGRADATION PROTEIN-2. | sptrembl O60009 | ND |
| 732 | 534.3 | DNA-DIRECTED RNA POLYMERASE I 190 KD POLYPEPTIDE (EC 2.7.7.6) (A190). | swissprot P10964 | Transcription |
| 733 | 534.2 | RIBOSOMAL PROCESSING, RNA BINDING. NUCLEOLAR PROTEIN. | sptrembl O74400 | Transcription |
| 734 | 533.5 | RPL24 PROTEIN. | tremblnew BAA84653 | Translation. ribosomal structure and biogenesis |
| 735 | 533.0 | ALDO/KETO REDUCTASE. | tremblnew AAP11806 | ND |
| 736 | 532.9 | VACUOLAR ATP SYNTHASE SUBUNIT G (EC 3.6.1.34) (V-ATPASE 13 KD SUBUNIT) (VACUOLAR II(+)-ATPASE: SUBUNIT G). | swissprot P78713 | ND |
| 737 | 532.7 | PROBABLE THIAMINE BIOSYNTHETIC BIFUNCTIONAL ENZYME [INCLUDES: TRIAMINE-PHOSPHATE PYROPHOSPHORYLASE (EC 2.5.1.3) (TMP PYROPHOSPHORYLASE) (TMP-PPASE); HYDROXYETHYLTHIAZOLE KINASE (EC 2.7.1.50) (4-METHYL-5-BETA-HYDROXYETHYLTHIAZOLE KINASE) (THZ KINASE) (TH KINASE)]. | swissprot P40386 | Coenzyme metabolism |
| 738 | 532.7 | PUTATIVE MITOCHONDRIAL CARRIER YOR222W. | swissnew Q99297 | ND |
| 739 | 530.9 | TRANSPORTIN | sptrembl O76331 | ND |
| 740 | 530.6 | GLYCOGEN PHOSPHORYLASE (EC 2.4.1.1). | swissprot P06738 | Carbohydrate transport and metabolism |
| 741 | 530.2 | PUTATIVE ADENOSINE KINASE. | tremblnew CAA19345 | Carbohydrate transport and metabolism |
| 742 | 530.2 | HYPOTHETICAL 18.8 KD PROTEIN. | sptrembl O43073 | ND |
| 743 | 529.7 | DDR48 STRESS PROTEIN (DNA DAMAGE-RESPONSIVE PROTEIN 48) (DDRP 48) (YP 75) (FLOCCULENT SPECIFIC PROTEIN). | swissprot P18899 | ND |
| 744 | 529.6 | 40S RIBOSOMAL PROTEIN S24 (RP50). | swissprot P26782 | ND |
| 745 | 529.5 | JAB1 PROTEIN. | sptrembl O81388 | ND |
| 746 | 529.4 | HYPOTHETICAL 43.7 KD PROTEIN C24B11.08C IN CHROMOSOME I. | swissprot Q09895 | ND |
| 747 | 520.3 | PROTEIN KINASE SKP1P. | sptrembl O94456 | ND |
| 748 | 529.1 | ORM1 PROTEIN. | swissprot P53224 | ND |
| 749 | 529.0 | NAALADASE II PROTEIN. | sptrembl Q9Y3Q0 | ND |
| 750 | 528.9 | PROTEIN PHOSPHOTASE 2A 65KD REGULATORY SUBUBIT. | tremblnew CAB55176 | ND |

TABLE 1-continued

*Fusarium venenatum* ESTs

| Sequence Listing | zscore | Annotation | Database | Functional category |
|---|---|---|---|---|
| 751 | 528.3 | NADH-UBIQUINONE OXIDOREDUCTASE 10.5 KD SUBUNIT (EC 1.6.5.3) (EC 1.6.99.3) (COMPLEX 1) (C1) | swissprot Q07842 | ND |
| 752 | 527.2 | PUTATIVE MITOCHONDRIAL CARRIER PROTEIN | swissprot Q10442 | ND |
| 753 | 527.3 | (CLATHRIN HEAVY CHAIN. | swissprot P22137 | ND |
| 754 | 527.2 | YNL123 HOMOLOG (FRAGMENT). | sptrembl O42705 | Posttranslational modification. protein turnover. chaperones |
| 755 | 526.6 | CYCLOPROPANE-FATTY-ACYL-PHOSPHOLIPID SYNTHASE. | sptrembl O67624 | ND |
| 756 | 526.1 | HYPOTHETICAL 107.7 KD PROTEIN IN TSP3-IPP2 INTERGENIC REGION. | swissprot Q03516 | ND |
| 757 | 526.0 | P1021 PROTEIN. | sptrembl O13612 | ND |
| 758 | 525.1 | SRP1 PROTEIN. | swissprot Q10193 | ND |
| 759 | 524.4 | SMALL NUCLEAR RIBONUCLEOPROTEIN SM D3 (SNRNP CORE PROTEIN D3) (SM-D3). | swissprot P43331 | Transcription |
| 760 | 524.3 | KO9H11.1 PROTEIN. | sptrembl O01590 | ND |
| 761 | 524.1 | COENZYME A SYNTHETASE. | sptrembl O74976 | ND |
| 762 | 524.0 | HYPOTHETICAL 47.0 KD PROTEIN C23H3.03C IN CHROMOSOME I. | sptrembl O42857 | ND |
| 763 | 523.8 | TRIOSEPHOSPHATE ISOMERASE (EC 5.3.1.1) (TIM). | swissprot PO4828 | ND |
| 764 | 523.6 | HYPOTHETICAL 56.8 KD PROTEIN IN SCJI-GUA1 INTERGENIC REGION PRECURSOR. | swissprot Q03655 | ND |
| 765 | 522.9 | CG1-110 PROTEIN. | sptrembl Q9Y3B4 | ND |
| 766 | 522.4 | NEUTRAL TREHALASE (EC 3.2.1.28) (ALPHA.ALPHA-TREHALASE) (ALPHA,ALPHA-TREHALOSE GLUCOHYDROLASE). | swissprot O42622 | ND |
| 767 | 521.8 | GTPASE. | sptrembl P87027 | ND |
| 768 | 520.3 | HYPOTHETICAL 12.5 KD PROTEIN. | sptrembl O74948 | ND |
| 769 | 519.1 | Extended human secreted protein sequence, SEQ ID NO. 218. | geneseqp Y35969 | ND |
| 770 | 518.6 | URIC ACID-XANTHINE PERMEASE (UAPA TRANSPORTER). | swissprot Q07307 | ND |
| 771 | 517.3 | DIHYDROLIPOAMIDE ACETYLTRANSFERASE COMPONENT OF PYRUVATE DEHYDROGENASE (COMPLEX. MITOCHONDRIAL PRECURSOR (EC 2.3.1.12) (E2) (PDC-E2) (MRP3). | swissprot P20285 | ND |
| 772 | 517.0 | ATP CITRATE LYASE. | sptrembl O93988 | ND |
| 773 | 515.8 | PUTATIVE ZINC-CONTAINING DEHYDROGENASE | tremblnew CAB53146 | ND |
| 774 | 515.3 | HYPOTHETICAL 25.7 KD PROTEIN IN MSH1-EPT1 INTERGENIC REGION. | swissprot P38829 | ND |
| 775 | 514.4 | PROBABLE CLATHRIN HEAVY CHAIN. | swissprot Q10161 | ND |

TABLE 1-continued

*Fusarium venenatum* ESTs

| Sequence Listing | zscore | Annotation | Database | Functional category |
|---|---|---|---|---|
| 776 | 513.1 | HYPOTHETICAL 143.7 KD PROTEIN C11D3.15 IN CHROMOSOME I. | swissprot Q10094 | Amino acid transport and metabolism |
| 777 | 513.0 | TRANSCRIPTION FACTOR BTF3 HOMOLOG. | swissprot Q92371 | ND |
| 778 | 511.6 | CROSS-PATHWAY CONTROL PROTEIN 1. | swissprot P11115 | ND |
| 779 | 511.2 | HYPOTHETICAL 37.4 KD PROTEIN. | sptrembl O74907 | ND |
| 780 | 511.0 | ACONITASE. | sptrembl O74699 | Energy production and conversion |
| 781 | 510.5 | Yeast NPC1 protein orthologue. | geneseqp W88447 | ND |
| 782 | 510.4 | HYPOTHETICAL 119.1 KD PROTEIN YPL009C. | sptrembl Q12532 | Cell envelope biogenesis, outer membrane |
| 783 | 509.3 | HYPOTHETICAL 30.9 KD PROTEIN. | sptrembl O53327 | ND |
| 784 | 509.2 | HYPOTHETICAL 33.3 KD PROTEIN. | sptrembl O43060 | ND |
| 785 | 508.7 | 30 KD HEAT SHOCK PROTEIN. | swissprot P19752 | ND |
| 786 | 508.5 | *Schizosaccharomyces pombe* IIRR25-like Hhp1 + protein. | geneseqp R76616 | ND |
| 787 | 508.4 | HYPOTHETICAL PROTEIN C22G7.01C IN CHROMOSOME I (FRAGMENT). | swissnew Q09795 | ND |
| 788 | 506.9 | CHROMOSOME XV READING FRAME ORF YOL060C. | sptrembl Q12296 | ND |
| 789 | 506.6 | WD REPEAT-CONTAINING PROTEIN. | sptrembl O94289 | ND |
| 790 | 506.0 | 60S RIBOSOMAL PROTEIN L34-B. | swissprot P4D525 | ND |
| 791 | 504.2 | PHOSPHORIBOSYLGLYCIN AMIDE FORMYLTRANSFERASE (FRAGMENT). | sptrembl Q9Y757 | ND |
| 792 | 504.0 | PUTATIVE AROMATIC AMINO ACID AMINOTRANSFERASE C561-4.03 (EC 2.6.1.-). | sptrembl O14192 | Amino acid transport and metabolism |
| 793 | 503.3 | CALCIUM/CALMODULIN-DEPENDENT PROTEIN KINASE (EC 2.7.1.123). | swissprot O14408 | ND |
| 794 | 502.1 | CYTOCHROME C OXIDASE POLYPEPTIDE IV PRECURSOR (EC 1.9.3.1). | swissprot P04037 | ND |
| 795 | 501.8 | ALCOHOL DEHYDROGENASE 1 (EC 1.1.1.1). | swissprot P41747 | ND |
| 797 | 501.4 | PHOSPHOGLYCERATE KINASE (EC 2.7.2.3). | swissprot P24590 | ND |
| 798 | 500.6 | 2-HYDROXYACID DEHYDROGENASE HOMOLOG (EC 1.1.1.-). | swissprot P30799 | ND |
| 799 | 500.3 | PROTEASOME COMPONENT PUP3 (EC 3.4.99.46) (MACROPAIN SUBUNIT PUP3) (MULTICATALYTIC ENDOPEPTIDASE COMPLEX SUBUNIT PUP3). | swissprot P25451 | Posttranslational modification, protein turnover, chaperones |
| 800 | 500.2 | PLASMID RECOMBINATION ENZYME (MOBILIZATION PROTEIN). | swissprot P03857 | ND |
| 801 | 499.4 | UV EXCISION REPAIR PROTEIN RAD23 HOMOLOG. | sptrembl O74803 | ND |

TABLE 1-continued

*Fusarium venenatum* ESTs

| Sequence Listing | zscore | Annotation | Database | Functional category |
|---|---|---|---|---|
| 802 | 499.0 | CHROMOSOME XVI READING FRAME ORF YPL226W (CHROMOSOME XVI LEFT ARM (EU) DNA SEGMENT). | sptrembl Q08972 | ND |
| 803 | 498.3 | RAN GTPASE ACTIVATING PROTEIN (RNA1 PROTEIN). | swissprot P41391 | ND |
| 804 | 497.6 | 60S RIBOSOMAL PROTEIN L36. | sptrembl O94658 | ND |
| 805 | 497.3 | HYPOTHETICAL 46.4 KD PROTEIN C3A12.1IC IN CHROMOSOME I. | swissprot P87126 | ND |
| 806 | 496.8 | PUTATIVE SEPTIN. CAB61437 | tremblnew | ND |
| 807 | 496.7 | PROBABLE INVOLVEMENT IN ERGOSTEROL BIOSYNTHESIS. | sptrembl O94512 | ND |
| 808 | 496.1 | CYTOPLASMIC AMINOPEPTIDASE P. | sptrembl O54975 | Amino acid transport and metabolism |
| 809 | 495.5 | NADH-UBIQUINONE OXIDOREDUCTASE 21 KD SUBUNIT PRECURSOR (EC 1.6.5.3) (EC 1.6.99.3) (COMPLEX 1-21KD) (C1-21KD). | swissprot P25711 | ND |
| 810 | 494.5 | HYPOTHETICAL 31.5 KD PROTEIN C4F10.03C IN CHROMOSOME I. | sptrembl O36015 | Cell division and chromosome partitioning |
| 811 | 493.5 | PISATIN DEMETHYLASE (EC 1.14.-.-) (CYTOCHROME P450 57A2). | swissprot P38364 | ND |
| 812 | 492.6 | NITRATE REDUCTASE. | sptrembl Q92237 | ND |
| 813 | 492.1 | LSM5 PROTEIN. | sptrembl Q9Y4Y9 | ND |
| 814 | 491.4 | CHROMOSOME IV READING FRAME ORF YDL019C. | sptrembl Q12451 | ND |
| 815 | 491.2 | 10 KD HEAT SHOCK PROTEIN, MITOCHONDRIAL (HSP10) (10 KD CHAPERONIN). | swissprot O59804 | ND |
| 816 | 490.3 | HYPOTHETICAL ZINC-TYPE ALCOHOL DEHYDROGENASE-LIKE PROTEIN IN GDH3-CNE1 INTERGENIC REGION. | swissprot P39714 | ND |
| 817 | 489.0 | 3-HYDROXYACYL-COA DEHYDROGENASE TYPE II (EC 1.1.1.35). | swissprot O02691 | ND |
| 818 | 489.6 | HYPOTHETICAL 30.7 KD PROTEIN IN RVS161-ADP1 INTERGENIC REGION. | swissprot P25613 | ND |
| 819 | 489.4 | ENOYL REDUCTASE. | sptrembl Q9Y7D0 | ND |
| 820 | 489.1 | SHY1 PROTEIN. | swissprot P53266 | ND |
| 821 | 489.1 | RIBONUCLEOPROTEIN RBM8. | sptrembl Q9Y5S9 | ND |
| 822 | 489.1 | CYTOCHROME C OXIDASE POLYPEPTIDE VIB (EC 1.9.3.1) (AED). | swissprot Q01519 | ND |
| 823 | 488.8 | THIOSULFATE SULFURTRANSFERASE. | sptrembl Q9ZPK0 | Inorganic ion transport and metabolism |
| 824 | 488.1 | CONSERVED PROTEIN. | sptrembl O26459 | Amino acid transport and metabolism |
| 825 | 488.1 | PUTATIVE STERIGMATOCYSTIN BIOSYNTHESIS PROTEIN STCT. | swissprot Q00717 | ND |

TABLE 1-continued

*Fusarium venenatum* ESTs

| Sequence Listing | zscore | Annotation | Database | Functional category |
|---|---|---|---|---|
| 826 | 487.9 | NONHISTONE CHROMOSOMAL PROTEIN 6B. | swissprot P11633 | ND |
| 827 | 487.7 | NUCLEOSOME ASSEMBLY PROTEIN. | sptrembl O59797 | ND |
| 828 | 487.2 | HYPOTHETICAL 55.5 KD PROTEIN C17A2.05 IN CHROMOSOME I. | sptrembl O13755 | ND |
| 829 | 487.2 | HYPOTHETICAL 96.1 KD PROTEIN. | sptrembl Q9Y7N9 | ND |
| 830 | 486.7 | CONSERVED PROTEIN. | sptrembl O26459 | ND |
| 831 | 486.0 | PROBABLE NEGATIVE REGULATOR OF TRANSCRIPTION SUBUNIT C4G3.15C. | sptrembl P87240 | ND |
| 832 | 483.3 | D9461.13P. | sptrembl O04053 | ND |
| 833 | 483.2 | SALA. | tremblnew AAF04312 | ND |
| 834 | 483.2 | PROBABLE SODIUM CHANNEL PROTEIN C6F6.01 | sptrembl O14234 | ND |
| 835 | 482.6 | RNA-BINDING POST-TRANSCRIPTIONAL REGULATOR CSX1. | swissprot O13759 | ND |
| 836 | 482.2 | HYPOTHETICAL OXIDOREDUCTASE IN RPB5-CDC28 INTERGENIC REGION (EC 1.-.-.-). | swissprot P38286 | ND |
| 837 | 481.4 | HYPOTHETICAL 13.5 KD PROTEIN C24B11.09 IN CHROMOSOME I. | swissprot Q09896 | ND |
| 838 | 481.4 | RHO2 PROTEIN. | swissprot Q10133 | ND |
| 839 | 480.7 | PUTATIVE ALCOHOL DEHYDROGENASE. | sptrembl O80944 | ND |
| 840 | 480.4 | GLYCERALDLHYDE 3-PHOSPHATE DEHYDROGENASE (EC 1.2.1.12) (GAPDH). | swissprot P32637 | Carbohydrate transport and metabolism |
| 841 | 480.0 | TROPOMYOSIN. | swissprot Q02088 | ND |
| 842 | 479.3 | 60S RIBOSOMAL PROTEIN L22. | tremblnew CAB11194 | ND |
| 843 | 478.6 | NONHISTONE CHROMOSOMAL PROTEIN 6B. | swissprot P11633 | ND |
| 844 | 478.6 | HYPOTHETICAL 52.2 KD PROTEIN. | sptrembl Q12116 | ND |
| 845 | 478.2 | DOLICHYL-PHOSPHATE-MANNOSE--PROTEIN MANNOSYLTRANSFERASE 2 (EC 2.4.1.109). | swissprot P31382 | Posttranslational modification. protein turnover. chaperones |
| 846 | 477.8 | MAJOR ALLERGEN ASP F 2 PRECURSOR (ASP F II). | swissnew P79017 | ND |
| 847 | 477.7 | CYTOCHROME C OXIDASE POLYPEPTIDE VI PRECURSOR (EC 1.9.3.1). | swissprot P00427 | ND |
| 848 | 476.8 | PUTATIVE TRANSPORT PROTEIN. | tremblnew CAB52881 | ND |
| 849 | 476.7 | UBIQUITIN-CONJUGATING ENZYME E2-24 KD (EC 6.3.2.19) (UBIQUITIN-PROTEIN LIGASE) (UBIQUITIN CARRIER PROTEIN). | swissprot P28263 | ND |
| 850 | 476.3 | HYPOTHETICAL 11.8 KD PROTEIN C1B3.02C IN CHROMOSOME I. | swissprot O13868 | ND |
| 851 | 475.7 | PROBABLE NICOTINATE. PHOSPHORIBOSYLTRANS-FERASE (EC 2.4.2.11) (NAPRTASE). | swissnew P39683 | Coenzyme metabolism |
| 852 | 474.6 | CYTOCHROME B2 PRECURSOR (EC 1.1.2.3). | sptrembl Q9Y857 | Energy production and conversion |

TABLE 1-continued

*Fusarium venenatum* ESTs

| Sequence Listing | zscore | Annotation | Database | Functional category |
|---|---|---|---|---|
| 853 | 474.2 | CDC42. | sptrembl O94103 | ND |
| | 471.5 | PUTATIVE 125.2 KD MEMBRANE GLYCOPROTEIN IN BIO3-HXT17 INTERGENIC REGION. | swissprot P53751 | ND |
| 855 | 470.3 | VACUOLAR PROTEIN SORTING-ASSOCIATED PROTEIN VPS13. | swissprot Q07878 | ND |
| 856 | 470.1 | HYPOTHETICAL PROTEIN (FRAGMENT). | tremblnew BAA87315 | ND |
| 857 | 469.2 | HYPOTHETICAL 61.3 KD PROTEIN CY369.29. | sptrembl P71838 | ND |
| 858 | 468.8 | TRYPTOPHAN SYNTHASE (EC 4.2.1.20). | swissnew P13228 | ND |
| 859 | 468.4 | HYPOTHETICAL 23.6 KD PROTEIN. | sptrembl O14451 | ND |
| 860 | 467.6 | BCDNA.GH07774. | sptrembl Q9Y127 | ND |
| 861 | 467.4 | PROBABLE ATP-DEPENDENT PERMEASE PRECURSOR. | swissprot P25371 | ND |
| 862 | 467.4 | DNA-DIRECTED RNA POLYMERASES I, II, AND III 8.3 KD POLYPEPTIDE (EC 2.7.7.6) (ABC10-BETA) ABC8). | swissprot P22139 | Transcription |
| 863 | 467.0 | METHIONYL-TRNA SYNTHETASE. | sptrembl O13634 | ND |
| 864 | 466.6 | DOLICHYL-PHOSPHATE-MANNOSE--PROTEIN MANNOSYLTRANSFERASE 2 (EC 2.4.1.109). | swissprot P31382 | Posttranslational modification. protein turnover, chaperones |
| 865 | 466.6 | CUTINASE G-BOX BINDING PROTEIN. | sptrembl Q00878 | ND |
| 866 | 466.6 | PUTATIVE VANADATE RESISTANCE PROTEIN. | tremblnew CAB59698 | ND |
| 867 | 466.3 | HIGH AFFINITY METHIONINE PERMEASE. | swissprot P50276 | ND |
| 868 | 465.9 | PUTATIVE SMALL NUCLEAR RIBONUCLEOPROTEIN E. | tremblnew CAB59808 | Transcription |
| 869 | 465.2 | HYPOTHETICAL 35.0 KD PROTEIN IN BGL2-ZUO1 INTERGENIC REGION. | swissprot P53337 | ND |
| 870 | 465.1 | HYPOTHETICAL 79.9 KD PROTEIN C3D6.04C IN CHROMOSOME II. | sptrembl P87169 | ND |
| 871 | 464.6 | BROADLY SELECTIVE SODIUM/NUCLEOSIDE. TRANSPORTER HFCNT | tremblnew AAD52151 | ND |
| 872 | 464.3 | PUTATIVE SYNTAXIN. | tremblnew CAB5841 | ND |
| 873 | 463.1 | HYPOTHETICAL 41.8 KD PROTEIN. | sptrembl O59715 | ND |
| 874 | 462.7 | WD-REPEAT PROTEIN POP2 (PROTEOLYSIS FACTOR SUD1). | swissprot O14170 | ND |
| 875 | 461.4 | LONG-CHAIN-FATTY-ACID--COA LIGASE 1 (EC 6.2.1.3) (LONG-CHAIN ACYL-COA SYNTHETASE 1) (FATTY ACID ACTIVATOR 1). | swissprot P30624 | Lipid metabolism |
| 876 | 460.7 | BING4. | sptrembl Q9Z0H1 | ND |
| 877 | 460.6 | 40S RIBOSOMAL PROTEIN S28 (S33). | swissprot Q10421 | Translation, ribosomal structure and biogenesis |
| 878 | 460.4 | HISTONE III. | tremblnew AAF16011 | ND |
| 879 | 459.4 | P21 PROTEIN. | sptrembl Q11118 | ND |
| 880 | 458.9 | INORGANIC PHOSPHATE TRANSPORTER PHO88. | swissprot P38264 | ND |

TABLE 1-continued

*Fusarium venenatum* ESTs

| Sequence Listing | zscore | Annotation | Database | Functional category |
|---|---|---|---|---|
| 881 | 457.7 | EUKARYOTIC TRANSLATION INITIATION FACTOR 4E (EIF-4E) (EIF4E) (MRNA CAP-BINDING PROTEIN) (EIF-4F 25 KD SUBUNIT). | swissprot P78954 | ND |
| 882 | 457.7 | 49 KDA ZINC FINGER PROTEIN. | sptrembl Q9Z326 | ND |
| 883 | 457.4 | PROTEIN KINASE C-LIKE (EC 2.7.1.-). | swissprot Q99014 | ND |
| 884 | 457.2 | MBF1 PROTEIN (ORF YOR298C-A). | sptrembl O14467 | ND |
| 885 | 457.0 | Exon trap L48741. | geneseqp W46753 | Carbohydrate transport and metabolism |
| 886 | 456.9 | CHROMOSOME IV READING FRAME ORF YDL072C. | sptrembl Q07451 | ND |
| 887 | 456.7 | Phaffia derived glyceraldehyde-3-phosphate dehydrogenase PRcDNA64. | geneseqp W22489 | Translation, ribosomal structure and biogenesis |
| 888 | 456.7 | 60S RIBOSOMAL PROTEIN L35. | swissprot P42766 | ND |
| 889 | 456.2 | TRANSCRIPTION INITIATION FACTOR 11E. BETA SUBUNIT (TF11-BETA) (TRANSCRIPTION FACTOR A SMALL SUBUNIT) (FACTOR A 43 KD SUBUNIT). | swissprot P36145 | ND |
| 890 | 456.0 | ALPHA-SOLUBLE NSF ATTACHMENT PROTEIN (SNAP-ALPHA) | swissnew P54920 | ND |
| 891 | | SMALL ZINC FINGER PROTEIN TIM8. | sptrembl Q9Y8C0 | ND |
| 892 | 455.1 | 26S PROTEASE REGULATORY SUBUNIT 4 HOMOLOG (MTS2 PROTEIN). | swissprot P36612 | Posttranslational modification. protein turnover. chaperones |
| 893 | 455.1 | TOXIN PUMP. | sptrembl Q00357 | ND |
| 894 | 454.8 | DEHYDROGENASE. | sptrembl O34788 | ND |
| 895 | 454.7 | UVSB P1-3 KINASE. | tremblnew AAD54313 | ND |
| 896 | 453.2 | PROBABLE T-COMPLEX PROTEIN 1, THETA SUBUNIT. | sptrembl O74816 | Posttranslational modification. protein turnover, chaperones |
| 897 | 453.2 | UBIQUITIN-CONJUGATING ENZYME E2-21 KD (EC 6.3.2.19) (UBIQUITIN-PROTEIN LIGASE) (UBIQUITIN CARRIER PROTEIN) (PEROXIN-4). | swissprot P29340 | ND |
| 898 | 453.0 | DNA-DIRECTED RNA POLYMERASE SUBUNIT. | sptrembl O74825 | ND |
| 899 | 452.3 | TAMEGOLOH. | sptrembl O42346 | ND |
| 900 | 451.4 | HYPOTHETICAL 55.8 KD PROTEIN | tremblnew CAB63552 | ND |
| 901 | 450.7 | HYPOTHETICAL 38.5 KD PROTEIN | sptrembl O74959 | ND |
| 902 | 450.6 | PUTATIVE ENOLASE-PHOSPHATASE. | tremblnew CAB55632 | ND |
| 903 | 449.4 | *Mortierella alpina* cytochrome b5. | geneseqp W22848 | ND |
| 904 | 448.6 | CARBOXYVINYL-CARROXYPHOSPHONATE PHOSPHORYLMUTASE (EC 2.7.8.23) (CARBOXYPHOSPHONOENOLPYRUVATE PHOSPHONOMUTASE) (CPEP PHOSPHONOMUTASE). | swissprot P11435 | ND |

TABLE 1-continued

*Fusarium venenatum* ESTs

| Sequence Listing | zscore | Annotation | Database | Functional category |
|---|---|---|---|---|
| 905 | 448.2 | Ester Hydrolase protein encoded by rec 780-m165r210 gene. | geneseqp R44613 | ND |
| 906 | 447.3 | S-ADENOSYLMETHIONINE DECARBOXYLASE (EC 4.1.1.50) (FRAGMENT). | sptrembl Q9Y8A3 | ND |
| 908 | 446.4 | RASP F 9 (FRAGMENT). | sptrembl O42800 | ND |
| 909 | 446.1 | CHROMOSOME XVI READING FRAME ORF YPL199C. | sptrembl Q08954 | ND |
| 910 | 446.1 | VACUOLAR PROTEIN SORTING-ASSOCIATED PROTEIN VPS35 | swissprot P34110 | ND |
| 911 | 445.9 | PROFILIN. | tremblnew CAB38578 | ND |
| 912 | 445.0 | HET-C PROTEIN. | tremblnew AAD54275 | ND |
| 913 | 444.8 | HYPOTHETICAL 28.0 KD PROTEIN C13C5.04 IN CHROMOSOME I. | swissprot Q09686 | ND |
| 914 | 444.6 | ATP SYNTHASE F CHAIN. MITOCHONDRIAL PRECURSOR (EC 3.6.1.34). | swissprot Q06405 | ND |
| 915 | 444.3 | IONA (SODIUM/POTASSIUM-TRANSPORTING ATPASE) (FRAGMENT). | sptrembl Q95024 | ND |
| 916 | 444.2 | CHITIN SYNTHASE 4 (EC 2.4.1.16) (CHITIN-UDP ACETYL-GLUCOSAMINYL TRANSFERASE 4) (CLASS-IV CHITIN SYNTHASE 4). | swissprot Q01285 | ND |
| 917 | 443.4 | SPP30. | sptrembl Q9XFA1 | ND |
| 918 | 442.9 | UBE-1A. | tremblnew BAA82656 | ND |
| 919 | 442.1 | SIMILAR TO DABA DECARBOXYLASE. | sptrembl Q9Z3R1 | ND |
| 920 | 441.9 | VIP1 PROTEIN (P53 ANTIGEN HOMOLOG) | sptrembl P87216 | ND |
| 921 | 441.5 | HYPOTHETICAL PROTEIN (FRAGMENT). | tremblnew BAA87313 | ND |
| 922 | 441.1 | GENERAL AMINO ACID PERMEASE AGP2. | swissprot P38090 | Amino acid transport and metabolism |
| 923 | 441.0 | PUTATIVE N-ACETYLGLUCOSAMINE-6-PHOSPHATE DEACETYLASE (EC 3.5.1.25) (GLCNAC 6-P DEACETYLASE). | swissprot P34480 | ND |
| 924 | 440.0 | PUTATIVE TYPE III ALCOHOL DEHYDROGENASE. | sptrembl Q94532 | ND |
| 925 | 439.3 | HYPOTHETICAL 33.6 KD PROTEIN. | sptrembl O53363 | ND |
| 926 | 439.3 | Yeast MEC3 protein sequence | geneseqp W73895 | Cell motility and secretion |
| 927 | 438.1 | HYPOTHETICAL 76.3 KD ZINC FINGER PROTEIN IN KTR5-UME3 INTERGENIC REGION. | swissprot P53968 | ND |
| 928 | 438.1 | AMINO ACID PERMEASE. | sptrembl P87251 | ND |
| 929 | 437.9 | STR1 (suppressor of telomeric repression-1) protein. | genesesp R95601 | ND |
| 930 | 436.9 | PUTATIVE CELL WALL PROTEIN. | sptrembl O74708 | ND |
| 931 | 435.9 | TRANSCRIPTION INITIATION FACTOR TFIID 55 KD SUBUNIT (TAF11-55). | sptrembl O13701 | ND |
| 932 | 435.8 | HYPOTHETICAL 38.3 KD PROTEIN IN CWLA-CISA INTERGENIC REGION. | swissprot P45946 | ND |
| 933 | 435.7 | O-METHYLTRANSFERASE. | sptrembl O67476 | ND |

TABLE 1-continued

*Fusarium venenatum* ESTs

| Sequence Listing | zscore | Annotation | Database | Functional category |
|---|---|---|---|---|
| 934 | 435.5 | ARG-6 PROTEIN PRECURSOR\|CONTAINS N-ACETYL-GAMMA-GLUTAMYL-PHOSPHATE REDUCTASE(EC 1.2.1.38) (N-ACETYL-GLUTAMATE SEMIALDEHYDE DEHYDROGENASE) (NAGSA DEHYDROGENASE); ACETYLGLUTAMATE KINASE (EC 2.7.2.8) (NAG KINASE) (AGK) (N-ACETYL-L-GLUTAMATE 5-PHOSPHOTRANSFERASE)]. | swissnew P54898 | ND |
| 935 | 435.5 | IMPORTIN ALPHA SUBUNIT. | sptrembl O94374 | ND |
| 936 | 435.3 | HYPOTHETICAL 46.5 KD PROTEIN. | sptrembl O07730 | ND |
| 937 | 435.2 | UBIQUITIN-CONJUGATING ENZYME E2-16 KD. | tremblnew CAB54826 | ND |
| 938 | 434.3 | HYPOTHETICAL 34.8 KD PROTEIN C4113.04C IN CHROMOSOME I. | swissprot Q10212 | ND |
| 939 | 433.8 | F26A3.2 PROTEIN. | sptrembl Q93594 | Transcription |
| 940 | 432.9 | DYNAMIN-RELATED PROTEIN. | sptrembl P87320 | ND |
| 941 | 432.8 | HYPOTHETICAL 42.7 KD PROTEIN (FRAGMENT). | tremblnew CAB61449 | ND |
| 942 | 431.3 | CHROMOSOME XV READING FRAME ORF YOL119C. | sptrembl Q08268 | ND |
| 943 | 429.4 | Aminopepitdase. | geneseqp W05589 | ND |
| 944 | 429.4 | Phosphoglycerate kinase. | geneseqp R22095 | ND |
| 945 | 428.9 | ADENYLYL CYCLASE. | tremblnew AAD50121 | ND |
| 946 | 426.5 | UBIQUITIN CARBOXYL-TERMINAL HYDROLASE (EC 3.1.2.15). | tremblnew AAF01440 | ND |
| 947 | 426.3 | HYPOTHETICAL 46.7 KD PROTEIN C19G10.05 IN CHROMOSOME I. | swissprot Q10335 | ND |
| 948 | 426.3 | RIBOSOMAL PROTEIN S30. | sptrembl O14314 | ND |
| 949 | 426.2 | GLUCAN 1,3-BETA-GLUCOSIDASE PRECURSOR (EC 3.2.1.58) (EXO-1,3-BETA-GLUCANASE) (GP29). | swissprot P15703 | ND |
| 950 | 424.9 | RIBULOSE-PHOSPHATE 3-EPIMERASE (EC 5.1.3.1) (PENTOSE-5-PHOSPHATE 3-EPIMERASE) (PPE) (RPE) | swissnew P46969 | Carbohydrate transport and metabolism |
| 951 | 423.9 | CHROMOSOME XV READING FRAME ORF YOR16C. | sptrembl Q12412 | ND |
| 952 | 422.7 | PYRUVATE DEHYDROGENASE E1 (COMPONENT BETA SUBUNIT. MITOCHONDRIAL PRECURSOR (EC 1.2.4.1) (PDHE1-B). | swissprot Q09171 | ND |
| 953 | 422.5 | SPLICING FACTOR U2AE 59 KD SUBUNIT. | tremblnew CAB46760 | ND |
| 954 | 421.2 | ASPARTATE AMINOTRANSFERASE, MITOCHONDRIAL PRECURSOR (EC 2.6.1.1) (TRANSAMINASE A) (GLUTAMATE OXALOACETATE TRANSAMINASE-2). | swissprot P05202 | ND |

TABLE 1-continued

*Fusarium venenatum* ESTs

| Sequence Listing | zscore | Annotation | Database | Functional category |
|---|---|---|---|---|
| 955 | 420.9 | ESTERASE HDE. | sptrembl Q9XDR4 | Lipid metabolism |
| 956 | 420.8 | ACETYL-COENZYME A SYNTHETASE (EC 6.2.1.1) (ACETATE--COA LIGASE) (ACYL-ACTIVATING ENZYME). | swissprot P16928 | ND |
| 957 | 420.1 | 6-PHOSPHOGLUCONATE DEHYDROGENASE, DECARBOXYLATING. | tremblnew CAA22536 | Carbohydrate transport and metabolism |
| 958 | 419.9 | 60S RIBOSOMAL PROTEIN L29 (YL43). | swissprot P05747 | ND |
| 959 | 418.4 | PUTATIVE NUCLEOPORIN. | tremblnew CAB63497 | ND |
| 960 | 417.7 | 60S RIBOSOMAL PROTEIN 1.39 (YL36). | swissprot P05767 | Translation. ribosomal structure and biogenesis |
| 961 | 417.0 | PUTATIVE CELL WALL PROTEIN. | sptrembl O74708 | ND |
| 962 | 416.6 | THIAMINE BIOSYNTHETIC BIFUNCTIONAL ENZYME [INCLUDES: THIAMINE-PHOSPHATE PYROPHOSPHORYLASE (EC 2.5.1.3) (TMP PYROPHOSPHORYLASE) (TMP- PPASE): HYDROXYETHYLTHIAZOLE KINASE (EC 2.7.1.50) (4-METHYL-5-BETA-HYDROXYETHYLTHIAZOLE KINASE) (THZ KINASE) (TH KINASE)]. | swissprot P41835 | ND |
| 963 | 415.6 | NUCLEASE. | sptrembl O60168 | ND |
| 964 | 415.3 | HYPOTHETICAL 41.9 KD PROTEIN IN HAC1-CAK1 INTERGENIC REGION. | swissprot P43567 | Amino acid transport and metabolism |
| 965 | 415.0 | HYPOTHETICAL 42.5 KD PROTEIN. | sptrembl O53311 | ND |
| 966 | 414.8 | CELLULAR NUCLEIC ACID BINDING PROTEIN HOMOLOG. | swissprot P36627 | ND |
| 967 | 414.2 | PROBABLE ALPHA-GLUCOSIDASE YIL172C/YJL221C (EC 3.2.1.20) (MALTASE). | swissprot P40439 | Carbohydrate transport and metabolism |
| 968 | 413.0 | PROTEIN KINASE (FRAGMENT). | sptrembl Q41384 | ND |
| 969 | 413.0 | TRNA SPLICING PROTEIN SPL1. | swissprot P87185 | Amino acid transport and metabolism |
| 970 | 412.7 | CPC3 PROTEIN. | sptrembl O74297 | ND |
| 971 | 412.6 | ADRENOLEUKODYSTROPHY PROTEIN (ALDP). | swissprot P33897 | ND |
| 972 | 412.5 | CYTOCHROME B2 PRECURSOR (EC 1.1.2.3) (L-LACTATE DEHYDROGENASE (CYTOCHROME)) (L-LACTATE FERRICYTOCHROME C OXIDOREDUCTASE) (L-LCR). | swissprot P00175 | ND |
| 973 | 412.4 | GLYCINE-RICH RNA-BINDING PROTEIN (FRAGMENT). | sptrembl Q39105 | ND |
| 974 | 410.8 | HYPOTHETICAL 8.9 KD PROTEIN. | tremblnew CAB52163 | ND |
| 975 | 410.4 | HYPOTHETICAL 60.1 KD PROTEIN C23C11.06C IN CHROMOSOME I. | swissprot O13912 | ND |

TABLE 1-continued

*Fusarium venenatum* ESTs

| Sequence Listing | zscore | Annotation | Database | Functional category |
|---|---|---|---|---|
| 976 | 410.2 | OXIDOREDUCTASE. SHORT CHAIN DEHYDROGENASE/REDUCTASE FAMILY. | sptrembl Q9WYD3 | ND |
| 977 | 409.5 | F-ACTIN CAPPING PROTEIN ALPHA-2 SUBUNIT (CAPZ 36/32) (BETA-ACTININ SUBUNIT 1). | swissprot P28497 | ND |
| 978 | 409.0 | RNA BINDING PROTEIN - PUTATIVE PRE MRNA SPLICING FACTOR. | sptrembl O74919 | ND |
| 979 | 408.7 | PUTATIVE DNA-3-METHYLADENINE GLYCOSIDASE (EC 3.2.2.20). | tremblnew CAB42917 | ND |
| 980 | 408.1 | ALP11 PROTEIN. | swissprot Q10235 | ND |
| 981 | 407.9 | SMALL ZINC FINGER-LIKE PROTEIN. | sptrembl Q9Y8A7 | ND |
| 982 | 407.8 | PHOSPHATIDYLINOSITOL 4-KINASE STT4 (EC 2.7.1.67) (PI4-KINASE) (PTDINS-4-KINASE). | swissprot P37297 | ND |
| 983 | 406.3 | F-ACTIN CAPPING PROTEIN BETA SUBUNIT (CAPZ) | swissprot P47756 | ND |
| | | MITOCHONDRIAL RESPIRATORY CHAIN COMPLEXES ASSEMBLY PROTEIN AFG3 (EC 3.4.24.-) (TAT-BINDING HOMOLOG 10). | swissprot P39925 | Translational modification. protein turnover. chaperones |
| 985 | 405.7 | HYPOTHETICAL OXIDOREDUCTASE C23D3.11 IN CHROMOSOME 1 (EC 1.-.-.-). | swissnew Q09851 | ND |
| 986 | 405.3 | SCD2 PROTEIN. | swissprot E40996 | ND |
| 987 | 405.2 | HYPOTHETICAL PROTEIN (FRAGMENT). | sptrembl Q48361 | ND |
| 988 | 404.8 | FOLYLPOLYGLUTAMATE SYN-THETASE. | sptrembl Q9Y893 metabolism | Coenzyme |
| 989 | 404.4 | CLOCK-CONTROLLED GENE-6 PROTEIN. | sptrembl O74694 | ND |
| 990 | 404.3 | 36.7 KD PROTEIN IN CBR5-NOT3 INTERGENIC REGION. | swissprot P40531 | ND |
| 991 | 404.1 | OLIGO-1,6-GLUCOSIDASE (EC 3.2.1.10) (SUCRASE-ISOMALTASE) (LIMIT DEXTRINASE) (ISOMALTASE) (DEXTRIN 6-ALPHA-D-GLUCANOHYDROLASE). | swissprot P29094 | ND |
| 992 | 404.0 | DNA-DIRECTED RNA POLYMERASE II 14.2 KD POLYPEPTIDE (EC 2.7.7.6) (B12.6). | swissprot P27999 | ND |
| 993 | 403.4 | *C. albicans* antigenic protein 4. | geneseqp Y06928 | ND |
| 994 | 401.8 | MULTIDRUG RESISTANCE-ASSOCIATED PROTEIN 3. | swissprot O88563 | ND |
| 995 | 401.8 | COP9 COMPLEX SUBUNIT 4. | sptrembl Q9Y677 | ND |
| 996 | 401.1 | PEROXISOMAL MEMBRANE PROTEIN PER10 (PEROXIN-14). | swissprot P78723 | ND |
| 997 | 400.6 | QUINONE OXIDOREDUCTASE (EC 1.6.5.5) (NADPH:QUINONE REDUCTASE). | swissprot P43903 | ND |
| 998 | 410.3 | HYPOTHETICAL 23.4 KD PROTEIN. | sptrembl Q03201 | Translation. ribosomal structure and biogenesis |

TABLE 1-continued

_Fusarium venenatum ESTs_

| Sequence Listing | zscore | Annotation | Database | Functional category |
|---|---|---|---|---|
| 999 | 399.5 | 40S RIBOSOMAL PROTEIN S25 PRECURSOR (S31) (YS23) (RP45) | swissprot P07282 | ND |
| 1000 | 309.0 | HYPOTHETICAL 49.4 KD PROTEIN. | sptrembl P71984 | Energy production and |
| 1001 | 308.7 | 40S RIBOSOMAL PROTEIN S29-B (S36) (YS29) | swissprot P41058 | Translation. ribosomal structure and biogenesis |
| 1002 | 398.4 | PUTATIVE MITOCHONDRIAL CARRIER YEL006W. | swissprot P39053 | ND |
| 1003 | 398.1 | PUTATIVE ATP-DEPENDENT RNA HELICASE C17G6.14C | sptrembl O13792 | ND |
| 1004 | 397.7 | ABC TRANSPORTER PROTEIN ATRC. | sptrembl Q9Y748 | ND |
| 1005 | 395.7 | VACUOLAR PROTEIN SORTING-ASSOCIATED PROTEIN VPS5. | swissprot Q92331 | ND |
| 1006 | 395.6 | CHORISMATE SYNTHASE (EC 4.6.1.4) (5-ENOLPYRUVYLSHIKIMATE-3-PHOSPHATE PHOSPHOLYASE). | swissprot Q12640 | ND |
| 1007 | 395.1 | PUTATIVE METAL TRANSPORTER. | sptrembl O94639 | ND |
| 1008 | 393.8 | PUTATIVE MICROSOMAL DIPEPTIDASE PRECURSOR (EC 3.4.13.19) (MDP). | sptrembl O14124 | ND |
| 1009 | 393.0 | INTRACELLULAR METALLOPROTEINASE MEPB. | sptrembl P97996 | ND |
| 1010 | 392.8 | HYPOTHETICAL 52.4 KD PROTEIN IN ATP1-ROX3 INTERGENIC REGION PRECURSOR. | swissprot P38169 | Coenzyme metabolism |
| 1011 | 392.7 | CODED FOR BY _C. ELEGANS_ CDNA YK20F6.3. | sptrembl Q18599 | ND |
| 1012 | 391.5 | SEPTIN HOMOLOG SPN2. | tremblnew CAB57440 | ND |
| 1013 | 391.4 | TREHALASE PRECURSOR (EC 3.2.1.28) (ALPHA.ALPHA-TREHALASE) (ALPHA,ALPHA-TREHALOSE GLUCOHYDROLASE). | swissprot P32359 | ND |
| 1014 | 391.1 | PUTATIVE PROTEIN TRANSPORT PROTEIN SEC61 GAMMA SUBUNIT. | swissprot Q09827 | ND |
| 1015 | 390.2 | H(+)/MONOSACCHARIDE COTRANSPORTER. | sptrembl O13411 | ND |
| 1016 | 390.2 | HYPOTHETICAL 14.5 KD PROTEIN C6F12.04 IN CHROMOSOME I. | sptrembl O14223 | ND |
| 1017 | 390.1 | PUTATIVE SNRNP SM-LIKE PROTEIN. | sptrembl Q9Y7M4 | ND |
| 1018 | 387.3 | CHITINASE. | tremblnew BAA88380 | ND |
| 1019 | 387.3 | NONHISTONE CHROMOSOMAL PROTEIN 6B. | swissprot P11633 | ND |
| 1020 | 387.2 | Y48B6A 11 PROTEIN. | tremblnew CAB5445 | ND |
| 1021 | 386.7 | CHROMOSOME XV READING FRAME ORF YOR286W. | sptrembl Q08742 | ND |
| 1022 | 386.0 | PROBABLE TRANSPORTER FEN2. | swissprot P25621 | ND |

TABLE 1-continued

*Fusarium venenatum* ESTs

| Sequence Listing | zscore | Annotation | Database | Functional category |
|---|---|---|---|---|
| 1023 | 385.5 | 3-KETOACYL-COA THIOLASE B. PEROXISOMAL PRECURSOR (EC 2.3.1.16) (BETA- KETOTHIOLASE B) (ACETYL-COA ACYLTRANSFERASE B) (PEROXISOMAL 3-OXOACYL-COA THIOLASE B) (THIOLASE 1B). | swissnew P33291 | ND |
| 1024 | 385.4 | NON-FUNCTIONAL FOLATE BINDING PROTEIN. | sptrembl O14597 | ND |
| 1025 | 385.2 | CONSERVED HYPOTHETICAL PROTEIN. | sptrembl O74741 | ND |
| 1026 | 384.4 | 60S RIBOSOMAL PROTEIN L28. | tremblnew CAA22600 | ND |
| 1027 | 384.2 | HYPOTHETICAL 54.7 KD PROTEIN. | sptrembl Q9Y827 | ND |
| 1028 | 384.2 | PUTATIVE MITOCHONDRIAL CARRIER C8C9.12C. | sptrembl O14281 | ND |
| 1029 | 384.0 | CARNITINE RACEMASE HOMOLOG. | sptrembl O23300 | ND |
| 1030 | 383.9 | STAM-LIKE PROTEIN. VHS DOMAIN CONTAINING. PUTATIVE SIGNAL TRANSDUCING ADAPTOR. | sptrembl O74749 | ND |
| 1031 | 383.5 | INACTIVE ISOCITRATE LYASE (EC 4.1.3.1) (ISOCITRASE) (ISOCITRATASE) (ICL). | swissprot Q12031 | ND |
| 1032 | 383.5 | HYPOTHETICAL 21.4 KD PROTEIN C19A8.14 IN CHROMOSOME I. | sptrembl O13830 | ND |
| 1033 | 383.0 | MANNOSE-6-PHOSPHATE ISOMERASE (EC 5.3.1.8) (PHOSPHOMANNOSE ISOMERASE) (PMI) (PHOSPHOHEXOMUTASE). | swissprot P29951 | ND |
| 1034 | 382.7 | HYPOTHETICAL 36.9 KD PROTEIN C21E11.07 IN CHROMOSOME I. | swissprot Q09929 | ND |
| 1035 | 381.6 | SERYL-TRNA SYNTHETASE, CYTOPLASMIC (EC 6.1.1.11) (SERINE--TRNA LIGASE) (SERRS). | swissprot O14018 | ND |
| 1036 | 381.3 | YMC1P. | sptrembl Q12002 | ND |
| 1037 | 381.0 | PXP-18 | tremblnew BAA85152 | ND |
| 1038 | 380.7 | PUTATIVE MAJOR FACILITATOR FAMILY MULTI-DRUG RESISTANCE PROTEIN. | sptrembl O94341 | ND |
| 1039 | 380.6 | SIMILAR TO ACYL-COA THIOESTERASE. NCB1 GI: 1213545. | sptrembl Q19781 | ND |
| 1040 | 380.5 | CGI-83 PROTEIN. | sptrembl Q9Y392 | ND |
| 1041 | 380.4 | SIMILARITY TO *S. CEREVISIAE* HYPOTHETICAL PROTEIN L8083.10. | sptrembl Q05515 | ND |
| 1042 | 379.7 | DTDP4-KETO-6-DEOXY-D-GLUCOSE 4-REDUCTASE. | tremblnew CAB56837 | ND |
| 1043 | 379.5 | URACIL PHOSPHORIBOSYLTRANS-FERASE (EC 2.4.2.9) (UMP PYROPHOSPHORYLASE) (UPRTASE). | swissnew P18562 | ND |
| 1044 | 377.9 | WCOR719. | sptrembl Q43655 | ND |

TABLE 1-continued

_Fusarium venenatum_ ESTs

| Sequence Listing | zscore | Annotation | Database | Functional category |
|---|---|---|---|---|
| 1045 | 377.6 | HYPOTHETICAL 117.2 KD PROTEIN IN EXO70-ARP4 INTERGENIC REGION. | swissprot P47029 | ND |
| 1046 | 377.1 | F54C4.2 PROTEIN | tremblnew AAC68775 | ND |
| 1047 | 376.6 | XAA-PRO DIPEPTIDASE (EC 3.4.13.9) (X-PRO DIPEPTIDASE) (PROLINE DIPEPTIDASE) (PROLIDASE.) (IMIDODIPEPTIDASE) (PEPTIDASE 4). | swissprot Q11136 | ND |
| 1048 | 375.4 | 60S RIBOSOMAL PROTEIN L6. MITOCHONDRIAL PRECURSOR (YML6). | swissprot P32904 | ND |
| 1049 | 375.3 | GLUCOSE TRANSPORTER TYPE 3, BRAIN. | swissprot P11169 | ND |
| 1050 | 375.0 | Human Ras protein RAPR-1. | geneseqp Y29666 | ND |
| 1051 | 374.8 | UBIQUINOL-CYTOCHROME C REDUCTASE COMPLEX 14 KD PROTEIN (EC 1.10.2.2) (COMPLEX III SUBUNIT VII). | swissprot P49345 | ND |
| 1052 | 374.7 | ATGRP2 (GLYCINE-RICH RNA-BINDING PROTEIN). | sptrembl Q41988 | ND |
| 1053 | 374.4 | Fragment of human secreted protein encoded by gene 3. | geneseqp W78239 | ND |
| 1054 | 374.3 | HYPOTHETICAL 25.7 KD PROTEIN. | sptrembl Q9Y7M6 | ND |
| 1055 | 374.1 | SIMILAR TO RAT SYNAPTIC GLYCOPROTEIN | sptrembl O94511 | ND |
| 1056 | 373.8 | UVSB P1-3 KINASE | tremblnew AAD54313 | ND |
| 1057 | 373.8 | CHROMOSOME XV READING FRAME ORF YOR052C. | sptrembl Q08422 | ND |
| 1058 | 373.3 | TRANSLATIONAL ACTIVATOR GCN1. | swissprot P33892 | ND |
| 1059 | 373.1 | HYPOTHETICAL 43.9 KD PROTEIN. | tremblnew CAB62419 | ND |
| 1060 | 372.9 | HYPOTHETICAL 34.0 KD PROTEIN IN CTF13-VPK2 INTERGENIC REGION. | swissprot Q03161 | ND |
| 1061 | 372.7 | MITOCHONDRIAL PROCESSING PEPTIDASE BETA SUBUNIT PRECURSOR (EC 3.4.24.64) (BETA-MPP) (UBIQUINOL-CYTOCHROME C REDUCTASE COMPLEX CORE PROTEIN 1) (EC 1.10.2.2). | swissprot P11913 | ND |
| 1062 | 372.3 | PUTATIVE SUGAR TRANSPORTER. | sptrembl O48537 | ND |
| 1063 | 371.2 | SHORT-CHAIN ALCOHOL. DEHYDROGENASE-LIKE PROTEIN. | tremblnew CAB63154 | ND |
| 1064 | 371.2 | Protein encoded by open redaing frame 3 (ORF-3. dszC) of dsz cluster. | geneseqp W97051 | ND |
| 1065 | 369.4 | CHROMOSOME XV READING FRAME ORF YOL092W. | sptrembl Q12010 | ND |
| 1066 | 369.3 | DNASE1 PROTEIN. | tremblnew CAB63906 | ND |
| 1067 | 369.1 | PUTATIVE STEROID BINDING PROTEIN. | tremblnew AAD23019 | ND |
| 1068 | 368.8 | Human dUTPase (mitochondrial form). | geneseqp W30281 | ND |
| 1069 | 368.5 | CHIP6. | sptrembl O93841 | ND |
| 1070 | 368.4 | CHROMOSOME XV READING FRAME ORF YOR021C. | sptrembl Q12314 | ND |

TABLE 1-continued

*Fusarium venenatum* ESTs

| Sequence Listing | zscore | Annotation | Database | Functional category |
|---|---|---|---|---|
| 1071 | 368.3 | HYPOTHETICAL 29.3 KD PROTEIN C31G5.18C IN CHROMOSOME I. | sptrembl O14113 | ND |
| 1072 | 368.3 | HYPOTHETICAL 90.1 KD PROTEIN C23H4.15 IN CHROMOSOME I. | sptrembl O13956 | ND |
| 1073 | 367.9 | CYTOCHROME C HEME LYASE (EC 4.4.1.17) (CCHL) (HOLOCYTOCHROME-C SYNTHASE). | swissnew P14187 | ND |
| 1074 | 367.8 | PROBABLE DOLICHYL-PHOSPHATE-MANNOSE--PROTEIN MANNOSYLTRANSFERASE CI6C6.09 (EC 2.4.1.109). | swissprot O42933 | ND |
| 1075 | 367.8 | HYPOTHETICAL 187 1 KD PROTEIN IN OGG1-CNA2 INTERGENIC REGION. | swissnew Q04958 | ND |
| 1076 | 367.7 | HYPOTHETICAL 38.5 KD PROTEIN. | sptrembl O74959 | ND |
| 1077 | 367.6 | PROBABLE GLUCAN 1,3-BETA-GLUCOSIDASE PRECURSOR (EC 3.2.1.58) (EXO-1,3-BETA-GLUCANASE). | swissprot Q10444 | ND |
| 1078 | 367.5 | ANTHRANILATE PHOSPHORIBOSYLTRANS-FERASE (EC 2.4.2.18). | swissnew O60122 | ND |
| 1079 | 367.2 | HYPOTHETICAL 10.4 KD PROTEIN. | sptrembl O43002 | ND |
| 1080 | 367.2 | HYPOTHETICAL 27.0 KD PROTEIN C12B10.13 IN CHROMOSOME I. | swissprot Q10446 | ND |
| 1081 | 366.7 | HYPOTHETICAL 33.9 KD PROTEIN C14C4.12C IN CHROMOSOME I. | swissprot O13719 | ND |
| 1082 | 366.3 | PD1 RELATED PROTEIN A | sptrembl O93914 | ND |
| 1083 | 366.3 | DOLICHYL-DIPHOSPHOOLIGOSACCHARIDE--PROTEIN (OLIGOSACCHARYLTRANSFERASE). | sptrembl O59866 | ND |
| 1084 | 366.2 | HYPOTHETICAL 24.8 KD PROTEIN. | tremblnew CAB54811 | ND |
| 1085 | 366.2 | PHGA PROTEIN. | sptrembl O96904 | ND |
| 1086 | 366.0 | HYPOTHETICAL 69.0 KD PROTEIN IN PPXI-RPS4B INTERGENIC REGION. | swissprot P38887 | Nucleotide transport |
| 1087 | 365.8 | RIBOSOMAL PROTEIN 55 (FRAGMENT) | tremblnew BAA25815 | ND |
| 1088 | 365.7 | HYPOTHETICAL 31.6 KD PROTEIN. | sptrembl O94465 | ND |
| 1089 | 365.7 | HYDROXYPROLINE-RICH GLYCOPROTEIN DZ-HRGP PRECURSOR. | tremblnew CAB62280 | ND |
| 1090 | 365.7 | HYPOTHETICAL 27.7 KD PROTEIN IN CPT1-SPC98 INTERGENIC REGION. | swissprot P53915 | ND |
| 1091 | 365.5 | CURVED DNA-BINDING PROTEIN (42 KD PROTEIN). | swissprot Q09184 | ND |
| 1092 | 364.6 | ACETATE KINASE (EC 2.7.2.1) (ACETOKINASE). | swissnew Q59331 | ND |
| 1093 | 363.9 | NADH-UBIQUINONE OXIDOREDUCTASE 29.9 KD SUBUNIT PRECURSOR (EC 1.6.5.3) (EC 1.6.99.3) (COMPLEX 1-29.9KD) (C1-29.9 KD) | swissprot P24919 | ND |
| 1094 | 363.8 | MUCIN 2 PRECURSOR (INTESTINAL MUCIN 2). | swissprot Q02817 | ND |
| 1096 | 363.4 | T22K18.2 PROTEIN. | tremblnew AAF04409 | ND |

TABLE 1-continued

_Fusarium venenatum ESTs_

| Sequence Listing | zscore | Annotation | Database | Functional category |
|---|---|---|---|---|
| 1097 | 363.4 | FRUCTOSYL AMINE:OXYGEN OXIDOREDUCTASE. | sptrembl O42629 | ND |
| 1098 | 363.1 | HYPOTHETICAL 55.5 KD PROTEIN. | sptrembl O82645 | ND |
| 1099 | 361.7 | UBIQUITIN-CONJUGATING ENZYME E2-18 KD (EC 6.3.2.19) (UBIQUITIN-PROTEIN LIGASE HUS5) (UBIQUITIN CARRIER PROTEIN HUS5). | swissprot P40984 | ND |
| 1100 | 360.9 | SERINE/THREONINE-PROTEIN KINASE IRE1 PRECURSOR (EC 2.7.1.-). | swissprot P32361 | ND |
| 1101 | 360.5 | HYPOTHETICAL 61.8 KD PEPTIDASE IN MPR1-GCN20 INTERGENIC REGION (EC 3.4.-.-.). | swissprot P43590 | ND |
| 1102 | 360.2 | MANNOSE-1-PHOSPHATE GUANYL TRANSFERASE (EC 2.7.7.13) (MPG1 TRANSFERASE) (ATP-MANNOSE-1-PHOSPHATE GUANYLYLTRANSFERASE) | sptrembl O74624 | ND |
| 1103 | 359.6 | ERP6 PROTEIN PRECURSOR. | swissprot P53198 | ND |
| 1104 | 359.2 | HYPOTHETICAL 26.7 KD PROTEIN C3G9.15C IN CHROMOSOME I. | sptrembl O42877 | ND |
| 1105 | 358.7 | PUTATIVE GTP CYCLOHYDROLASE | tremblnew CAB65619 | ND |
| 1106 | 358.3 | HYPOTHETICAL 77.8 KD PROTEIN. | sptrembl O74828 | ND |
| 1107 | 358.1 | CALCIUM/PROTON EXCHANGER. | sptrembl O59940 | ND |
| 1108 | 358.0 | GLUCOSIDASE 558 aa | pdb 1 UOK | ND |
| 1109 | 357.9 | JM5 PROTEIN. | sptrembl Q9Y484 | ND |
| 1110 | 357.7 | CKS1 protein. | geneseqp W01557 | ND |
| 1111 | 357.7 | MDM10 GENE. | sptrembl O13498 | ND |
| 1112 | 356.7 | NADPH QUINONE OXIDOREDUCTASE. PUTATIVE. | tremblnew AAF12387 | ND |
| 1113 | 356.4 | PUTATIVE SPINDLE POLE BODY ASSOCIATED PROTEIN. | sptrembl Q9Y705 | ND |
| 1114 | 355.8 | CHROMOSOME XV READING FRAME ORF YOR306C. | sptrembl Q08777 | ND |
| 1115 | 354.7 | PUTATIVE PROTEASE. | sptrembl Q9X7U3 | ND |
| 1116 | 354.7 | HYPOTHETICAL PROTEIN | sptrembl Q12486 | ND |
| 1117 | 354.6 | PUTATIVE SIGNAL TRANSDUCTION PROTEIN. | sptrembl O94321 | |
| 1118 | 354.3 | 60S RIBOSOMAL PROTEIN L16. MITOCHONDRIAL PRECURSOR (YML47). | swissprot P38064 | ND |
| 1119 | 354.1 | ELONGATION FACTOR G 1. MITOCHONDRIAL PRECURSOR (MEF-G-1). | swissprot P250239 | ND |
| 1120 | 353.7 | HYPOTHETICAL 183.1 KD HELICASE C3G6.12 IN CHROMOSOME I. | sptrembl O14148 | ND |
| 1121 | 353.1 | FOLYLPOLYGLUTAMATE SYNTHETASE (EC 6.3.2.1 | sptrembl O13492 | ND |
| 1122 | 352.4 | DLTE PROTEIN. | swissprot P39577 | ND |
| 1123 | 351.8 | PSI-7 PROTEIN. | sptrembl O13444 | ND |
| 1124 | 351.7 | W02A2.5 PROTEIN. | sptrembl Q9XUB4 | ND |
| 1125 | 351.6 | HYPOTHETICAL ZINC-TYPE ALCOHOL DEHYDROGENASE-LIKE PROTEIN IN GDH3-CNE1 INTERGENIC REGION. | swissprot P39714 | ND |

TABLE 1-continued

*Fusarium venenatum* ESTs

| Sequence Listing | zscore | Annotation | Database | Functional category |
|---|---|---|---|---|
| 1126 | 351.3 | CELL DIFFERENTIATION PROTEIN RCD1. | sptrembl Q92368 | ND |
| 1127 | 351.1 | CONSERVED HYPOTHETICAL NIFU-LIKE PROTEIN. | tremblnew CAB52604 | ND |
| 1128 | 351.1 | TRANSLATION INITIATION FACTOR EIF-2B ALPHA SUBUNIT. | tremblnew CAB57849 | ND |
| 1129 | 351.0 | 26S PROTEASE REGULATORY SUBUNIT 6A (TAT-BINDING PROTEIN HOMOLOG 1) (TBP-1). | swissprot P33297 | ND |
| 1130 | 350.5 | PUTATIVE 26S PROTEASOME SUBUNIT. | tremblnew CAB63792 | ND |
| 1131 | 350.4 | HYPOTHETICAL 26.5 KD PROTEIN C24B11.05 IN CHROMOSOME I. | swissprot Q09893 | ND |
| 1132 | 350.3 | HYPOTHETICAL 83.0 KD PROTEIN IN ATP1-ROX3 INTERGENIC REGION. | swissprot P38170 | ND |
| 1133 | 349.8 | PUTATIVE 60S ACIDIC RIBOSOMAL PROTEIN. | tremblnew CAB59805 | ND |
| 1134 | 349.8 | DJ747H23.3 (N-ACETYLGLUCOSAMINE-PHOSPHATE MUTASE) (FRAGMENT). | tremblnew CAB52346 | ND |
| 1135 | 349.7 | ACETOACETYL-COA SYNTHETASE (EC 6.2.1.16). | sptrembl Q9Z3R3 | ND |
| 1136 | 349.2 | 60S RIBOSOMAL, PROTEIN L38. | tremblnew CAB54810 | ND |
| 1137 | 347.8 | HYPOTHETICAL 82.9 KD PROTEIN. | sptrembl O42958 | ND |
| 1138 | 347.8 | HYPOTHETICAL 30.9 KD PROTEIN. | sptrembl O95564 | ND |
| 1139 | 347.7 | HYPOTHETICAL 51.9 KD PROTEIN IN PYC1-UBC2 INTERGENIC REGION | swissprot P53170 | ND |
| 1140 | 347.0 | Human act V A-ORF4-like protein sequence. | geneseq Y14147 | ND |
| 1141 | 346.9 | PUTATIVE POLY(A)-BINDING PROTEIN FABM. | sptrembl Q92227 | ND |
| 1142 | 346.2 | DJI014D13.1 (PROTEINS HSPC021 AND HSPC025 (SIMILAR TO *C. ELEGANS* FAT-3 ALCOHOL DEHYDROGENASE)) (FRAGMENT). | tremblnew CAB62978 | ND |
| 1143 | 346.0 | CULLIN HOMOLOG 3 (CUL-3). | swissprot Q09760 | ND |
| 1144 | 345.0 | SPHINGOMYELIN PHOSPHODIESTERASE (EC 3.1.4.12) (ACID SPHINGOMYELINASE) (NEUTRAL SPHINGOMYELINASE). | sptrembl Q16841 | ND |
| 1145 | 344.3 | ENOYL-COA HYDRATASE, MITOCHONDRIAL PRECURSOR (EC 4.2.1.17) (SHORT CHAIN ENOYL-COA HYDRATASE) (SCEH) (ENOYL-COA HYDRATASE 1). | swissprot P14604 | ND |
| 1146 | 343.8 | ESTS AU078175(C51476). | tremblnew BAA85408 | ND |
| 1147 | 342.8 | MYO-INOSITOL-1-PHOSPHATE SYNTHASE (EC 5.5.1.4) (IPS). | swissprot P42801 | ND |
| 1148 | 342.8 | 3-OXOACYL-[ACYL-CARRIER PROTEIN] REDUCTASE. | sptrembl O53665 | ND |
| 1149 | 342.7 | HYPOTHETICAL 62.7 KD PROTEIN C29A3.06 IN CHROMOSOME II. | sptrembl P78750 | ND |

TABLE 1-continued

Fusarium venenatum ESTs

| Sequence Listing | zscore | Annotation | Database | Functional category |
|---|---|---|---|---|
| 1150 | 341.9 | MUCIN 2 PRECURSOR (INTESTINAL MUCIN 2). | swissprot Q02817 | ND |
| 1151 | 341.7 | HYPOTHETICAL 27.7 KD PROTEIN IN PRP19-HSP104 INTERGENIC REGION. | swissprot Q07821 | ND |
| 1152 | 3416 | PUTATIVE TRANSPORTER PROTEIN. | tremblnew CAB61275 | ND |
| 1153 | 340.9 | NADH-CYTOCHROME B5 REDUCTASE PRECURSOR (EC 1.6.2.2) (P34/P32). | swissprot P36060 | ND |
| 1154 | 340.3 | PUTATIVE OXIDOREDUCTASE. | tremblnew CAB53292 | ND |
| 1155 | 339.8 | AMINOPEPTIDASE C (EC 3.4.22.-). | swissprot Q48543 | ND |
| 1156 | 339.5 | PUTATIVE PRE-MRNA SPLICING FACTOR C22A12.09C | sptrembl O13900 | ND |
| 1157 | 339.0 | COPPER AMINE OXIDASE 1 (EC 1.4.3.6). | swissprot Q12556 | ND |
| 1158 | 338.9 | S-ADENOSYLMETHIONINE SYNTHETASE (EC 2.5.1.6) (METHIONINE ADENOSYLTRANSFERASE) (ADOMET SYNTHETASE). | swissprot P48466 | ND |
| 1159 | 338.3 | CONSERVED PROTEIN. | sptrembl O26459 | ND |
| 1160 | 338.1 | PUTATIVE METALLOPEPTIDASE. | sptrembl O59824 | ND |
| 1161 | 337.4 | SIMILAR TO YEAST VACUOLAR SORTING PROTEIN VPS29/PEP11. | tremblnew CAB52425 | ND |
| 1162 | 337.4 | PMT3P. | sptrembl O74186 | ND |
| 1163 | 336.8 | 3-KETOACYL-COA THIOLASE B, PEROXISOMAL PRECURSOR (EC 2.3.1.16) (BETA-KETOTHIOLASE B) (ACETYL-COA ACYLTRANSFERASE B) (PEROXISOMAL 3-OXOACYL-COA THIOLASE B) | swissnew P07871 | ND |
| 1104 | 335.8 | PEROXISOMAL MEMBRANE PROTEIN PEX16 (PEROXIN-16). | swissprot P78980 | ND |
| 1165 | 335.8 | CYTOCHROME B5 CONTAINING FUSION PROTEIN. | sptrembl Q43469 | ND |
| 1116 | 335.1 | 2-NITROPROPANE DIOXYGENASE (NCD2). | sptrembl O28109 | ND |
| 1117 | 334.6 | HYPOTHETICAL 25.4 KD PROTEIN IN GUT1-R1M1 INTERGENIC REGION. | swissprot P38736 | ND |
| 1118 | 334.3 | G/T MISMATCH-SPECIFIC THYMINE DNA GLYCOSYLASE (EC 3.2.2.-) (C-JUN LEUCINE ZIPPER INTERACTIVE PROTEIN JZA-3). | swissprot P56581 | ND |
| 1169 | 334.2 | PROBABLE ELECTRON TRANSFER FLAVOPROTEIN ALPHA-SUBUNIT PRECURSOR (ALPHA-ETF) | swissprot P78790 | ND |
| 1170 | 333.9 | PROBABLE GLUTAMINYL-TRNA SYNTHETASE. | sptrembl Q9Y7Y8 | ND |
| 1171 | 333.2 | CYTOCHROME P450 MONOOXYGENASE (FRAGMENT). | sptrembl O64410 | ND |
| 1172 | 332.2 | PEROXISOMAL MEMBRANE PROTEIN. | sptrembl Q9Y8B8 | ND |
| 1173 | 330.7 | SHORT-CHAIN ALCOHOL DEHYDROGENASE. | tremblnew AAB51228 | ND |
| 1174 | 330.6 | CRB3 PROTEIN. | swissprot Q10272 | ND |
| 1175 | 330.6 | HYPOTHETICAL 126.1 KD PROTEIN. | sptrembl O94676 | ND |

TABLE 1-continued

*Fusarium venenatum* ESTs

| Sequence Listing | zscore | Annotation | Database | Functional category |
|---|---|---|---|---|
| 1176 | 330.2 | AUTOPHAGOCYTOSIS PROTEIN AUT1. | swissprot P40344 | ND |
| 1177 | 329.6 | TTP1 PROTEIN. | swissprot P38069 | ND |
| 1178 | 329.6 | HYPOTHETICAL 51.4 KD PROTEIN C13G1.09 IN CHROMOSOME II. | swissprot O60071 | ND |
| 1179 | 329.5 | SERYL-TRNA SYNTHETASE. CYTOPLASMIC (EC 6.1.1.11) (SERINE--TRNA LIGASE) (SERRS). | swissprot P07284 | ND |
| 1180 | 328.9 | HYPOTHETICAL 13.0 KS PROTEIN. | sptrembl P79082 | ND |
| 1181 | 328.6 | ATP11 PROTEIN PRECURSOR. | swissprot P32453 | ND |
| 1182 | 328.3 | GNS1/SUR4 FAMILY PROTEIN. | tremblnew CAB61470 | ND |
| 1183 | 327.6 | GRG-1 PROTEIN. | sptrembl Q9Y836 | ND |
| 1184 | 326.3 | HYPOTHETICAL PROTEIN C26F1.01 IN CHROMOSOME (FRAGMENT). | swissprot Q10491 | ND |
| 1185 | 326.2 | HEMOLYSIN. | sptrembl Q17063 | ND |
| 1186 | 325.6 | PROBABLE ATP DEPENDENT PERMEASE YHL035C. | swissprot P38735 | ND |
| 1187 | 325.1 | CONSERVED HYPOTHETICAL PROTEIN. | tremblnew CAB54870 | ND |
| 1188 | 324.9 | HYPOTHETICAL 15.9 KD PROTEIN. | tremblnew CAB52421 | ND |
| 1189 | 324.7 | HYPOTHETICAL 15.4 KD PROTEIN C10F6.16 IN CHROMOSOME I. | sptrembl P79058 | ND |
| 1190 | 324.6 | HYPOTHETICAL 31.0 KD PROTEIN IN GAP1-NAP1 INTERGENIC REGION. | swissprot P36136 | ND |
| 1191 | 324.5 | PROBABLE CYTOCHROME C OXIDASE POLYPEPTIDE VIA PRECURSOR (EC 1.9.3.1). | swissprot O74471 | ND |
| 1192 | 323.4 | ANUCLEATE PRIMARY STERIGMATA PROTEIN. | swissprot Q00083 | ND |
| 1193 | 322.9 | LECTIN (FRAGMENT). | tremblnew AAD27887 | ND |
| 1194 | 322.5 | PROTEIN SERINE/THREONINE PHOSPHATASE ALPHA. | sptrembl O96914 | ND |
| 1195 | 321.7 | SLA2P. | sptrembl O94097 | ND |
| 1196 | 321.7 | HYPOTHETICAL 42.4 KD PROTEIN IN CDC12-ORC6 INTERGENIC REGION. | swissprot P38716 | ND |
| 1197 | 321.5 | MUCIN 2 PRECURSOR (INTESTINAL MUCIN 2). | swissprot Q02817 | ND |
| 1198 | 320.5 | PUTATIVE CHOLINE KINASE (EC 2.7.1.32) | swissprot Q10276 | ND |
| 1199 | 320.5 | (GLUCAN 1,4-ALPHA-PRECURSOR (EC 3.2.1.3) (GLUCAN 1.4-ALPHA-GLULCOSIDASE) (1.4-ALPHA-D-GLUCAN GLUCOLYDROLASE). | swissprot P36914 | ND |
| 1200 | 319.7 | 60S RIBOSOMAL PROTEIN L27A (L29). | swissprot P78987 | ND |
| 1201 | 319.7 | F26H9.6 PROTEIN. | sptrembl P91857 | ND |
| 1202 | 319.2 | PROBABLE METABOLITE TRANSPORT PROTEIN. | sptrembl O94342 | ND |
| 1203 | 319.0 | HYPOTHETICAL 33.9 KD ESTERASE IN SMC3-MRPL8 INTERGENIC REGION (EC 3.1.1.1). | swissprot P40363 | ND |
| 1204 | 318.8 | RIBOSOMAL PROTEIN S28. | tremblnew CAB56815 | ND |
| 1205 | 317.8 | CELL CYCLE INHIBITOR NIF1. | sptrembl P87159 | ND |

TABLE 1-continued

*Fusarium venenatum* ESTs

| Sequence Listing | zscore | Annotation | Database | Functional category |
|---|---|---|---|---|
| 1206 | 317.8 | GLUCOSEOXIDASE (EC 1.1.3.4). | tremblnew BAA86908 | ND |
| 1208 | 317.1 | SIMILAR TO SDH4P. | sptrembl Q06236 | ND |
| 1209 | 316.7 | PHOSPHATE PHOSPHOLNOLPYRUVATE TRANSLOCATOR PRECURSOR. | sptrembl P93300 | ND |
| 1210 | 316.4 | SERINE THREONINE PROTEIN KINASE. | sptrembl Q9Y7V4 | ND |
| 1211 | 315.4 | HYPOTHETICAL 29.0 KD PROTEIN. | sptrembl Q9Y7C9 | ND |
| 1212 | 314.6 | Human prostate/colon tumour suppressor protein form 2. | geneseqp R85334 | ND |
| 1213 | 313.8 | 50S RIBOSOMAL PROTEIN L1. | swissprot P36248 | ND |
| 1214 | 313.8 | HYPOTHETICAL 15.4 KD PROTEIN C16C10.11 IN CHROMOSOME III. | swissprot Q09254 | ND |
| 1215 | 313.3 | HYPOTHETICAL 20.5 KD PROTEIN IN ESR1-IRA1 INTERGENIC REGION. | swissprot P38276 | ND |
| 1216 | 313.1 | CHROMOSOME XII READING FRAME ORF YLL032C. | sptrembl Q07834 | ND |
| 1217 | 312.9 | ADENYLYL CYCLASE-ASSOCIATED PROTEIN (CAP). | swissprot P36621 | ND |
| 1218 | 312.6 | FREQUENCY CLOCK PROTEIN. | swissnew Q00586 | ND |
| 1219 | 312.4 | HIGH AFFINITY METHIONINE PERMEASE. | swissprot P50276 | ND |
| 1220 | 312.2 | PUTATIVE SHORT-CHAIN DEHYDROGENASE. | sptrembl Q9Y7P2 | ND |
| 1221 | 312.0 | ARYL-ALCOHOL OXIDASE PRECURSOR (EC 1.1.3.7). | sptrembl O94219 | ND |
| 1222 | 311.6 | RIBOSE-PHOSPHATE PYROPHOSPHOKINASE (EC 2.7.6.1) (PHOSPHORIBOSYL PYROPHOSPHATE SYNTHETASE). | swissprot P41831 | ND |
| 1223 | 311.5 | PROBABLE URACIL PHOSPHORIBOSYLTRANS-FERASE | tremblnew CAB65617 | ND |
| 1224 | 310.7 | CG1-82 PROTEIN. | sptrembl Q9Y391 | ND |
| 1225 | 310.5 | HYPOTHETICAL UBIQUINOL-CYTOCHROME C REDUCTASE COMPONENT. | sptrembl O42932 | ND |
| 1226 | 310.3 | HYPOTHETICAL 28.1 KD PROTEIN. | sptrembl O13850 | ND |
| 1227 | 310.3 | PROTEASOME SUBUNIT P55. | sptrembl O00232 | ND |
| 1228 | 310.0 | NADH DEHYDROGENASE SUBUNIT. | sptrembl Q01388 | ND |
| 1229 | 310.0 | CHITINASE PRECURSOR. | sptrembl Q42421 | ND |
| 1230 | 309.6 | CHROMOSOME XII READING FRAME ORF YLL058W. | sptrembl Q12198 | ND |
| 1231 | 309.3 | T02D1.5 PROTEIN. | sptrembl O45730 | ND |
| 1232 | 308.2 | HYPOTHETICAL 34.1 KD PROTEIN. | tremblnew CAB43297 | ND |
| 1233 | 308.2 | L-FUCOSE PERMEASE. | swissprot P44776 | ND |
| 1234 | 307.9 | PHO85P,LPH16P. | sptrembl Q02979 | ND |
| 1235 | 307.6 | LYSOPHOSPHOLIPASE HOMOLOG. | sptrembl O18501 | ND |

TABLE 1-continued

_Fusarium venenatum_ ESTs

| Sequence Listing | zscore | Annotation | Database | Functional category |
|---|---|---|---|---|
| 1236 | 307.0 | UBIQUINOL-CYTOCHROME C REDUCTASE COMPLEX UBIQUINONE-BINDING PROTEIN QP-C (EC 1.10.2.2) (UBIQUINOL-CYTOCHROME C REDUCTASE COMPLEX II KD PROTEIN) (COMPLEX III SUBUNIT VIII). | swissprot P48503 | ND |
| 1237 | 307.0 | HYPOTHETICAL 16.9 KD PROTEIN IN ALD6-PDR12 INTERGENIC REGION. | swissprot Q02784 | ND |
| 1238 | 306.9 | HYPOTHETICAL 102.7 KD PROTEIN IN PRP16-SRP40 INTERGENIC REGION. | swissprot P36165 | ND |
| 1239 | 306.8 | ADENYLOSUCCINATE SYNTHETASE. MUSCLE ISOZYME (EC 6.3.4.4) (IMP--ASPARTATE LIGASE) | swissprot P28650 | ND |
| 1240 | 306.4 | ADENYLATE KINASE 2 (EC 2.7.4.3) (ATP-AMP TRANSPHOSPHORYLASE). | swissprot P26364 | ND |
| 1241 | 305.7 | RNA BINDING PROTEIN - PUTATIVE PRE MRNA SPLICING FACTOR. | sptrembl O74919 | ND |
| 1242 | 305.7 | PUTATIVE PHOSPHOMEVALONA11 KINASE. | tremblnew CAB52264 | ND |
| 1243 | 305.6 | HYPOTHETICAL 24.1 KD PROTEIN | sptrembl O94389 | ND |
| 1244 | 305.6 | ARG-6 PROTEIN PRECURSOR [CONTAINS N-ACETYL-GAMMA-GLUTAMYL-PHOSPHATE REDUCTASE. (EC 1.2.1.38) (N-ACETYL-GLUTAMATE SEMIALDEHYDE DEHYDROGENASE) (NAGSA DEHYDROGENASE); ACETYLGLUTAMATE KINASE (EC 2.7.2.8) (NAG KINASE) (AGK) (N-ACETYL-L-GLUTAMATE 5-PHOSPHOTRANSFERASE)]. | swissnew P54898 | ND |
| 1245 | 305.5 | _Chlamydia pneumoniae_ transmembrane protein sequence. | geneseqp Y34630 | Posttranslational modification. protein turnover. chaperones |
| 1246 | 305.2 | PUTATIVE RNA MATURATION PROTEIN. | sptrembl O94689 | ND |
| 1247 | 305.2 | CYTOSKELETAL P17 PROTEIN (COACTOSIN) (CYCLIC AMP-REGULATED PROTEIN P16). | swissprot P34121 | ND |
| 1248 | 304.7 | UDP-GLUCURONOSYLTRANS-FERASE 2C1 MICROSOMAL (EC 2.4.1.17) (UDPGT) (FRAGMENT). | swissprot P36514 | ND |
| 1249 | 304.5 | C-RECEPTOR. | sptrembl Q9YSY0 | ND |
| 1250 | 304.4 | THIOREDOXIN-LIKE PROTEIN. | tremblnew CAB54816 | ND |
| 1251 | 303.8 | HYDROXYPROLINE-RICH GLYCOPROTEIN DZ-HRGP PRECURSOR. | tremblnew CAB62280 | ND |
| 1252 | 303.6 | PUTATIVE POLYA-BINDING PROTEIN. | sptrembl O94430 | ND |
| 1253 | 303.2 | MITOCHONDRIAL FAD CARRIER PROTEIN FLX1. | sptrembl O13660 | ND |

TABLE 1-continued

*Fusarium venenatum* ESTs

| Sequence Listing | zscore | Annotation | Database | Functional category |
|---|---|---|---|---|
| 1254 | 303.1 | AMINOPEPTIDASE-LIKE PROTEIN. | tremblnew CAB36783 | ND |
| 1255 | 302.8 | HYDROXYPROLINE-RICH GLYCOPROTEIN. | sptrembl Q41814 | ND |
| 1256 | 302.6 | SIMILAR TO MITOCHONDRIAL ADP/ATP CARRIER PROTEIN. | sptrembl Q06497 | ND |
| 1257 | 301.9 | POSSIBLE COPPER TRANSPORT PROTEIN CTR2 (COPPER TRANSPORTER 2). | swissprot P38865 | ND |
| 1258 | 301.8 | HYPOTHETICAL 38.6 KD PROTEIN. | sptrembl O86705 | ND |
| 1259 | 301.4 | PJCHI-2. | sptrembl P91773 | ND |
| 1260 | 300.6 | F14F9.5 PROTEIN. | tremblnew AAC69210 | ND |
| 1261 | 300.1 | HYPOTHETICAL 20.5 KD PROTEIN C31F10.12 IN CHROMOSOME II. | sptrembl P87313 | ND |
| 1262 | 299.9 | *N. crassa* mtr gene product. | geneseqp R79909 | ND |
| 1263 | 299.5 | PUTATIVE DNA POLYMERASE EPSILON, SUBUNIT B. | sptrembl O94263 | ND |
| 1264 | 299.0 | Human act V A-ORF4-like protein sequence. | geneseqp Y14747 | ND |
| 1265 | 298.8 | HYPOTHETICAL ZINC-TYPE ALCOHOL DEHYDROGENASE-LIKE PROTEIN IN GDH3-CNE1 INTERGENIC REGION. | swissprot P39713 | ND |
| 1266 | 298.4 | CHROMOSOME XII COSMID 8167. | sptrembl Q05797 | ND |
| 1267 | 298.2 | H04M03.4 PROTEIN. | tremblnew AAD12787 | ND |
| 1268 | 297.5 | D8035.11P. | sptrembl Q03322 | ND |
| 1269 | 297.2 | HYPOTHETICAL 65.3 KD PROTEIN K12H4.7 IN CHROMOSOME III. | swissprot P34528 | ND |
| 1270 | 297.7 | Protein of the specification. | geneseqp W62553 | ND |
| 1271 | 296.4 | PET191 PROTEIN PRECURSOR. | swissprot Q02772 | ND |
| 1272 | 296.4 | HYPOTHETICAL 22.7 KD PROTEIN. | sptrembl O60073 | ND |
| 1273 | 296.2 | CAMP-DEPENDENT PROTEIN KINASE CATALYTIC SUBUNIT. | sptrembl Q9Y777 | ND |
| 1274 | 296.2 | PUTATIVE ELONGATION FACTOR 3. | sptrembl O94489 | ND |
| 1275 | 296.0 | HYPOTHETICAL 140.6 KD PROTEIN C19A8.02 IN CHROMOSOME I. | sptrembl O13818 | ND |
| 1276 | 295.3 | HYPOTHETICAL 30.8 KD PROTEIN IN DUP2-T1F4632 INTERGENIC REGION. | swissprot P53177 | ND |
| 1277 | 295.3 | CHROMOSOME XV READING FRAME ORF YOR301W. | sptrembl Q08760 | ND |
| 1278 | 294.6 | PUTATIVE TRANSLOCATION PROTEIN C2F3.02. | sptrembl O14085 | ND |
| 1279 | 294.7 | BETA-MANNANASE. | tremblnew CAB56855 | ND |
| 1280 | 293.5 | HYPOTHETICAL 16.8 KD PROTEIN IN SMY2-RPS6B INTERGENIC REGION. | swissprot P35293 | ND |
| 1281 | 293.2 | PROBABLE UDP-N-ACETYLGLUCOSAMINE PYROPHOSPHORYLASE (EC 2.7.7.23). | swissprot O64765 | ND |
| 1282 | 293.1 | IKI3 PROTEIN | swissprot Q06706 | ND |
| 1283 | 292.8 | METHYLMALONYL-COA DECARBOXYLASE GAMMA CHAIN. | tremblnew CAB49799 | ND |

TABLE 1-continued

_Fusarium venenatum ESTs_

| Sequence Listing | zscore | Annotation | Database | Functional category |
|---|---|---|---|---|
| 1284 | 292.8 | UV-INDUCED PROTEIN UV131. | swissprot Q12238 | ND |
| 1285 | 292.7 | HYPOTHETICAL 50.6 KD PROTEIN C1D7.03 IN CHROMOSOME II. | O14336 | ND |
| 1286 | 292.5 | THIOREDOXIN PEROXIDASE PMP20. | tremblnew AAF04855 | ND |
| 1287 | 201.5 | ARG-6 PROTEIN PRECURSOR [CONTAINS: N-ACETYL-GAMMA-GLUTAMYL-PHOSPHATE REDUCTASE (EC 1.2.1.38) (N-ACETYL-GLUTAMATE SEMIALDEHYDE DEHYDROGENASE) (NAGSA DEHYDROGENASE). ACETYLGLUTAMATE KINASE (EC 2.7.2.8) (NAG KINASE) (AGK) (N-ACETYL-L-GLUTAMATE 5-PHOSPHOTRANSFERASE)]. | swissnew P54898 | ND |
| 1288 | 291.5 | HYPOTHETICAL 50.8 KD PROTEIN IN MIR1-STE18 INTERGENIC REGION. | swissprot P47125 | ND |
| 1289 | 291.4 | U1 SMALL NUCLEAR RIBONUCLEOPROTEIN C (U1-C). | swissprot P09234 | ND |
| 1290 | 291.2 | HYPOTHETICAL 43.5 KD PROTEIN IN RPB9-ALG2 INTERGENIC REGION. | swissprot P53164 | ND |
| 1291 | 290.9 | Kidney injury associated molecule HW034 protein #2. | geneseqp W86311 | ND |
| 1292 | 290.9 | HYDROLASE 210 aa. chain C | pdb 1CMX | ND |
| 1293 | 290.4 | PUTATIVE SHORT CHAIN DEHYDROGENASE. | sptrembl Q9X858 | ND |
| 1294 | 290.2 | KIAA0872 PROTEIN. | sptrembl O94949 | ND |
| 1295 | 280.7 | CHROMOSOME XV READING FRAME ORF YOR367W. | sptrembl Q08873 | ND |
| 1296 | 289.4 | HYPOTHETICAL 78.3 KD PROTEIN IN RIP1-GEA2 INTERGENIC REGION. | swissprot P39992 | ND |
| 1297 | 289.1 | RAB GERANYLGERANYL TRANSFERASE ESCORT PROTEIN (REP). | sptrembl O93831 | ND |
| 1298 | 289.0 | HYPOTHETICAL 37.4 KD PROTEIN. | sptrembl Q03976 | ND |
| 1299 | 288.7 | STREPTOMYCIN BIOSYNTHESIS PROTEIN STR1-RELATED PROTEIN. | tremblnew AAF10934 | ND |
| 1300 | 288.5 | HYPOTHETICAL 24.7 KD PROTEIN. | sptrembl O43039 | ND |
| 1301 | 288.5 | SEDOHEPTULOSE-1.7-BISPHOSPHATASE. CHLOROPLAST PRECURSOR (EC 3.1.3.37) (SEDOHEPTULOSE-BISPHOSPHATASE) (SBPASE) (SED(1,7)P2ASE). | swissprot O20252 | ND |
| 1302 | 288.1 | CONSERVED HYPOTHETICAL PROTEIN. | sptrembl Q9WZQ7 | ND |
| 1303 | 287.1 | CYTOCHROME B5 (FRAGMENT). | sptrembl O24651 | ND |
| 1304 | 286.7 | SUR2 PROTEIN (SYRINGOMYCIN RESPONSE PROTEIN 2). | swissprot P38992 | ND |
| 1305 | 286.0 | PUTATIVE TARTRATE TRANSPORTER. | swissprot P70786 | ND |
| 1306 | 285.5 | ER LUMEN PROTEIN RETAINING RECEPTOR (HDEL RECEPTOR). | swissprot P18414 | ND |

TABLE 1-continued

_Fusarium venenatum ESTs_

| Sequence Listing | zscore | Annotation | Database | Functional category |
|---|---|---|---|---|
| 1307 | 285.1 | SORBITOL DEHYDROGENASE (EC 1.1.1.14) (L-IDITOL 2-DEHYDROGENASE). | swissprot Q06004 | ND |
| 1308 | 285.0 | DNA BINDING PROTEIN NSDD. | sptrembl Q92226 | ND |
| 1309 | 284.4 | KIAA1273 PROTEIN (FRAGMENT). | tremblnew BAA86587 | ND |
| 1310 | 284.3 | QUINATE PERMEASE (QUINATE TRANSPORTER). | swissprot P11636 | ND |
| 1311 | 284.3 | IMPORTIN BETA SUBUNIT. | sptrembl O74476 | ND |
| 1312 | 284.1 | PROBABLE TRANSPORTER SEO1. | swissprot P39709 | ND |
| 1313 | 283.6 | VACUOLAR ATP SYNTHASE 98 KD SUBUNIT (EC 3.6.1.34) (VACUOLAR ATPASE 98 KD SUBUNIT). | swissprot Q01290 | ND |
| 1314 | 283.5 | 40S RIBOSOMAL PROTEIN S26E (CRP5) (13.6 KD RIBOSOMAL PROTEIN). | swissprot P21772 | ND |
| 1315 | 283.4 | GLUTAMINE REPEAT PROTEIN 1. | sptrembl Q61118 | ND |
| 1316 | 283.3 | MUCIN 2 PRECURSOR (INTESTINAL MUCIN 2). | swissprot Q02817 | ND |
| 1317 | 283.2 | VACUOLAR PROTEIN SORTING-LIKE PROTEIN. | tremblnew CAB41098 | ND |
| 1318 | 283.1 | HYPOTHETICAL 31.6 KD PROTEIN. | sptrembl Q9Y7Z5 | ND |
| 1319 | 282.8 | PUTATIVE CARBOXYPEPTIDASE S PRECURSOR (EC 3.4.17.4) (YSCS) (GLY-X CARBOXYPEPTIDASE). | sptrembl O13968 | ND |
| 1320 | 282.2 | PUTATIVE ALDOSE 1-EPIMERASE. | tremblnew CAB62725 | ND |
| 1321 | 282.2 | GLYCYL TRNA SNYNTHETASE (FRAGMENT). | Tremblnew AAC71652 | ND |
| 1322 | 281.7 | TRANSCRIPTIONAL ACTIVATOR. | sptrembl O42804 | ND |
| 1323 | 281.6 | Omega-cyclohexane fatty acid biosynthesis enzyme #1 ORF6. | geneseqp W71638 | ND |
| 1324 | 281.0 | 1OXD PROTEIN. | swissprot P54006 | ND |
| 1325 | 280.9 | ADRENAL GLAND PROTEIN AD-002. | tremblnew AAF14858 | ND |
| 1326 | 280.7 | TRNA-SPLICING ENDONUCLEASE SUBUNIT SEN2 (EC 3.1.27.9) (TRNA-INTRON ENDONUCLEASE). | swissprot P16658 | ND |
| 1327 | 280.6 | TRK-1 PROTEIN | sptrembl O74723 | ND |
| 1328 | 280.4 | HYPOTHETICAL 89.6 KD PROTEIN C3H8.11 IN CHROMOSOME I. | swissnew Q10146 | ND |
| 1329 | 280.4 | CHROMOSOME XII COSMID 9672. | sptrembl Q06541 | ND |
| 1330 | 280.4 | HYPOTHETICAL 22.3 KD PROTEIN. | sptrembl O67071 | ND |
| 1331 | 280.4 | HYPOTHETICAL 86.4 KD PROTEIN IN PHO5-VPS15 INTERGENIC REGION. | swissprot P38254 | ND |
| 1332 | 280.4 | FISSION YEAST (FRAGMENT). | sptrembl P78758 | ND |
| 1333 | 279.9 | INOSITOL POLYPHOSPHATE-5-PHOSPHATASE, 75 KDA (INOSITOL POLYPHOSPHATE 5-PHOSPHATASE II). | sptrembl O54996 | ND |
| 1334 | 279.5 | NADH-UBIQUINONE OXIDOREDUCTASE 17.8 KD SUBUNIT PRECURSOR (EC 1.6.5.3) (EC 1.6.99.3) (COMPLEX 1-17.8KD) (C1-17.8KD). | swissprot P42116 | ND |

TABLE 1-continued

_Fusarium venenatum_ ESTs

| Sequence Listing | zscore | Annotation | Database | Functional category |
|---|---|---|---|---|
| 1335 | 278.8 | PUTATIVE TRASCRIPTION FACTOR. CCR4-ASSOCIATED FACTOR HOMOLOG. | sptrembl O74856 | ND |
| 1336 | 278.3 | NODULIN PRECURSOR. | sptrembl Q41402 | ND |
| 1337 | 278.2 | CCAAT-BINDING TRANSCRIPTION FACTOR SUBUNIT AAB-1. | sptrembl O13381 | ND |
| 1338 | 278.2 | HYPOTHETICAL 31.4 KD PROTEIN. | sptrembl Q9ZAM3 | ND |
| 1339 | 278.1 | HYDROXYQUINOL 1,2-DIOXYGENASE. | sptrembl Q9ZAM3 | ND |
| 1340 | 277.7 | HYPOTHETICAL 61.9 KD PROTEIN. | tremblnew CAB58161 | ND |
| 1341 | 277.7 | HYPOTHETICAL 39.4 KD PROTEIN IN MET1-SIS2 INTERGENIC REGION. | swissprot P36151 | ND |
| 1342 | 277.0 | CELL DIVISION PROTEIN KINASE 7 (EC 2.7.1.-) (CDK-ACTIVATING KINASE) (CAK) (MO15 HOMOLOG). | swissprot P54685 | ND |
| 1343 | 276.5 | CURVED DNA-BINDING PROTEIN (42 KD PROTEIN). | swissprot Q09184 | ND |
| 1344 | 276.2 | COSMID T20B6. | sptrembl O02049 | ND |
| 1345 | 275.7 | 26S PROTEASOME REGULATORY SUBUNIT NIN1 (NUCLEAR INTEGRITY PROTEIN 1). | swissprot P32496 | ND |
| 1346 | 275.5 | HYPOTHETICAL 12.6 KD PROTEIN C1D7.01 IN CHROMOSOME II. | swissprot O14334 | ND |
| 1347 | 275.4 | MAF1 PROTEIN. | swissprot P41910 | ND |
| 1348 | 274.8 | SNM 1-2 TS (FRAGMENT). | sptrembl Q07072 | ND |
| 1349 | 274.5 | NADH-UBIQUINONE OXIDOREDUCTASE 9.5 KD SUBUNIT (EC 1.6.5.3) (EC 1.6.99.3) (COMPLEX 1-9.5KD) (C1-9.5) (UBIQUINONE-BINDING PROTEIN). | swissprot P42117 | ND |
| 1350 | 274.1 | HYPOTHETICAL 16.2 KD PROTEIN C3D6.08C IN CHROMOSOME II. | swissprot P87173 | ND |
| 1351 | 274.1 | PUTATIVE CHOLINE KINASE. | sptrembl O81024 | ND |
| 1352 | 273.5 | CHITINASE PRECURSOR. | sptrembl Q42421 | ND |
| 1353 | 273.4 | PENTALENENE SYNTHASE (EC 4.6.1.5). | swissprot Q55012 | ND |
| 1354 | 273.0 | GLUTAMINYL-PEPTIDE CYCLOTRANSFERASE PRECURSOR (EC 2.3.2.5) (QC) (GLUTAMINYL-TRNA CYCLOTRANSFERASE) (GLUTAMINYL CYCLASE). | swissprot Q28120 | ND |
| 1355 | 272.4 | STRONG SIMILARITY TO HUMAN LEUKOTRIENE A-4 HYDROLASE. | sptrembl O94544 | ND |
| 1356 | 272.1 | KIAA0150 PROTEIN (FRAGMENT). | sptrembl Q14163 | ND |
| 1357 | 271.6 | SQUALENE EPOXIDASE (EC 1.14.99.7). | tremblnew AAD10823 | ND |
| 1358 | 271.1 | HYPOTHETICAL 44.9 KD PROTEIN IN URA10-NRC1 INTERGENIC REGION. | swissprot Q03529 | ND |
| 1359 | 270.1 | 30 KD HEAT SHOCK PROTEIN. | swissprot P19752 | ND |
| 1360 | 270.0 | GLYCEROL KINASE (ATP/GLYCEROL 3-PHOSPHOTRANSFERASE) (EC 2.7.1.30). | tremblnew CAB58269 | ND |
| 1361 | 270.0 | HYPOTHETICAL 31.3 KD HOMEOBOX PROTEIN IN PRP20-VPS45 INTERGENIC REGION. | swissprot P53147 | ND |

TABLE 1-continued

*Fusarium venenatum* ESTs

| Sequence Listing | zscore | Annotation | Database | Functional category |
|---|---|---|---|---|
| 1362 | 270.0 | 5',5'''-P-1,P-4-TETRAPHOSPHATE PHOSPHORYLASE II (EC 2.7.7.53) (DIADENOSINE 5',5'''-P-1,P-4-TETRAPHOSPHATE PHOSPHORYLASE) (AT-4-A PHOSPHORYLASE) (AP,A PHOSPHORYLASE) (ATP ADENYLYLTRANSFERASE) | swissprot P49348 | ND |
| 1363 | 269.7 | PEROXISOMAL RECEPTOR FOR PTS2-CONTAINING PROTEINS PEX7P. | sptrembl O59894 | ND |
| 1364 | 269.6 | HYPOTHETICAL 27.1 KD PROTEIN C26H5.13C IN CHROMOSOME I. | sptrembl O13994 | ND |
| 1365 | 269.4 | ISOLEUCYL-TRNA SYNTHETASE, CYTOPLASMIC (EC 6.1.1.5) (ISOLEUCINE--TRNA LIGASE) (ILERS). | swissprot PO9436 | ND |
| 1366 | 269.3 | Intact natural cutinase of *Fusarium sotani* pisi. | geneseqp R06610 | ND |
| 1367 | 268.8 | OXIDOREDUCTASE. ALDO/KETO REDUCTASE FAMILY | sptrembl Q9X0A1 | ND |
| 1368 | 268.8 | TRANSCRIPTION INITIATION FACTOR TFIID (TATA-BOX FACTOR) (TATA SEQUENCE-BINDING PROTEIN) (TBP). | swissprot Q12731 | ND |
| 1369 | 268.7 | PUTATIVE TRANSCRIPTION FACTOR OF THE GCS1-GLO3-SPS18 FAMILY. | sptrembl O74345 | ND |
| 1370 | 268.6 | HYPOTHETICAL 18.5 KD PROTEIN B0024.12 IN CHROMOSOME V. | sptrembl Q17427 | ND |
| 1371 | 268.3 | 2-OXOGLUTARATE. DEHYDROGENASE E1 COMPONENT. MITOCHONDRIAL PRECURSOR (EC 1.2.4.2) (ALPHA-KETOGLUTARATE DEHYDROGENASE). | swissprot P20967 | ND |
| 1372 | 268.1 | HYPOTHETICAL 51.0 KD PROTEIN IN Y1P3-TFC5 INTERGENIC REGION. | swissprot P53960 | ND |
| 1373 | 268.1 | OLIGOSACCHARYLTRANS-FERASE. | sptrembl O43244 | ND |
| 1374 | 267.2 | SYMBIOSIS-RELATED PROTEIN. | swissprot P87068 | ND |
| 1375 | 266.3 | HYPOTHETICAL 130.1 KD PROTEIN YPR021C. | sptrembl Q12139 | ND |
| 1376 | 266.1 | 2-PYRONE-4,6-DICARBOXYLIC ACID HYDROLASE. | sptrembl O87170 | ND |
| 1377 | 265.8 | HYPOTHETICAL 94.9 KD PROTEIN IN MRPL8-NUP82 INTERGENIC REGION. | swissprot P40367 | ND |
| 1378 | 264.9 | HYPOTHETICAL 34.9 KD INTERGENIC REGION. | swissprot P50085 | ND |
| 1379 | 264.5 | PROTEOPHOSPHOGLYCAN (FRAGMENT). | sptrembl Q9Y075 | ND |
| 1380 | 264.5 | HYPOTHETICAL FUNGAL ZN(2)-CYS(6) ZINC-FINGER PROTEIN. | tremblnew CAB57441 | ND |
| 1381 | 264.5 | HOMOSERINE DEHYDROGENASE (EC 1.1.1.3) (HDH). | swissnew P31116 | ND |
| 1382 | 264.4 | CHITIN BIOSYNTHESIS PROTEIN CHS5. | swissprot O74161 | ND |
| 1383 | 264.3 | SCN1 PROTEIN. | swissprot P41890 | ND |

TABLE 1-continued

*Fusarium venenatum* ESTs

| Sequence Listing | zscore | Annotation | Database | Functional category |
|---|---|---|---|---|
| 1384 | 263.4 | PUTATIVE PRE-MRNA SPLICING FACTOR. | sptrembl Q9ZT71 | ND |
| 1385 | 263.1 | FUSCA PROTEIN FUS6. | swissprot P45432 | ND |
| 1386 | 263.0 | VERSICOLORIN B SYNTHASE. | sptrembl Q12062 | ND |
| 1337 | 263.0 | PUTATIVE SUGAR TRANSPORTER. | sptrembl Q9X1H7 | ND |
| 1388 | 262.8 | CLOCK-CONTROLLED GEME-6 PROTEIN. | sptrembl O74694 | ND |
| 1389 | 262.5 | PUTATIVE EXOCYST COMPLEX COMPONENT. | sptrembl O74846 | ND |
| 1390 | 262.2 | RIBOKINASE. | tremblnew AAF12258 | ND |
| 1391 | 262.2 | HYPOTHETICAL ZINC METALLOPROTEINASE YIL108W (EC 3.4.24.-). | swissprot P40483 | ND |
| 1392 | 262.0 | PUTATIVE MITOCHONDRIAL CARRIER YMR166C. | swissprot Q03820 | ND |
| 1393 | 261.8 | D8035.13P. | sptrembl Q03327 | ND |
| 1394 | 261.7 | EXTENSIN (FRAGMENT). | sptrembl Q41645 | ND |
| 1395 | 261.6 | PUTATIVE ACETYLTRANSFERASE ATS1. | sptrembl P79081 | ND |
| 1396 | 260.8 | QUINIC ACID UTILIZATION ACTIVATOR. | swissprot P10563 | ND |
| 1397 | 260.2 | Whale mat sample AD3059 esterase es4. | geneseqp W23084 | ND |
| 1398 | 260.2 | TRANSCRIPTION FACTOR ATF21. | sptrembl P78962 | ND |
| 1399 | 260.1 | PUTATIVE ATP SYNTHASE J CHAIN. MITOCHONDRIAL (EC 3.6.1.34). | swissprot O13931 | ND |
| 1400 | 258.5 | MSF1 PROTEIN. | swissprot P35200 | ND |
| 1401 | 258.5 | PUTATIVE PHOSPHOMEVALONATE KINASE. | tremblnew CAB52264 | ND |
| 1402 | 258.4 | CYTOCHROME C OXIDASE COPPER CHAPERONE. | swissprot Q12287 | ND |
| 1403 | 258.3 | CUT8 PROTEIN. | swissprot P38937 | ND |
| 1404 | 257.7 | K09H11.1 PROTEIN. | sptrembl O01590 | ND |
| 1405 | 257.6 | NAD-DEPENDENT 4-HYDROXYBUTYRATE. DEHYDROGENASE (EC 1.1.1.61) (4HBD). | sptrembl Q59104 | ND |
| 1406 | 257.4 | DIHYDROLIPOAMIDE SUCCINYLTRANSFERASE. | tremblnew AAD47296 | ND |
| 1407 | 257.3 | HYPOTHETICAL 63.9 KD PROTEIN IN IME2-MEF2 INTERGENIC REGION. | swissprot P42948 | ND |
| 1408 | 257.3 | PROBABLE STERIGMATOCYSTIN BIOSYNTHESIS P450 MONOOXYGENASE STCB (EC 1.14.-.-) (CYTOCHROME P450 62). | swissprot Q12608 | ND |
| 1409 | 257.3 | SCP 160 PROTEIN (PROTEIN HX). | swissprot P06105 | ND |
| 1410 | 257.1 | 2,4'-DIHYDROXYACETOPHENONE DIOXYGENASE (EC 1.13.11.41) (FRAGMENT). | tremblnew CAB53781 | ND |
| 1411 | 256.7 | LAMINARINASE. | sptrembl O52754 | ND |
| 1412 | 256.6 | PUTATIVE N-TERMINAL ACETYLTRANSFERASE COMPLEX SUBUNIT. ARD1 FAMILY. | tremblnew CAB52427 | ND |
| 1413 | 256.3 | SERINE/THREONINE-PROTEIN KINASE SAT4 (EC 2.7.1) | swissprot P25333 | ND |
| 1414 | 256.1 | YGL010W-LIKE PROTEIN. | sptrembl O65074 | ND |
| 1415 | 255.7 | ANNEXIN VII (SYNEXIN). | swissprot Q92125 | ND |
| 1416 | 255.7 | FUN34 PROTEIN. | swissprot P32907 | ND |
| 1417 | 255.1 | F55A11.3 PROTEIN. | sptrembl Q20798 | ND |

TABLE 1-continued

*Fusarium venenatum* ESTs

| Sequence Listing | zscore | Annotation | Database | Functional category |
|---|---|---|---|---|
| 1418 | 255.0 | PEROXISOMAL 2.4-DIENOYL COA REDUCTASE PX-2,4-DCR#1. | tremblnew AAF14047 | ND |
| 1419 | 254.9 | PUTATIVE MITOCHONDRIAL CARRIER PROTEIN. | sptrembl O94502 | ND |
| 1420 | 254.5 | ZINC CLUSTER TRANSCRIPTION FACTOR FCRIP. | sptrembl O93870 | ND |
| 1421 | 254.3 | PROBABLE COATOMER GAMMA SUBUNIT (GAMMA-COAT PROTEIN) (GAMMA-COP). | swissprot P87140 | ND |
| 1422 | 254.0 | CONSERVED HYPOTHETICAL PROTEIN. | tremblnew CAB5743Y | ND |
| 1423 | 253.6 | XYLITOL DEHYDROGENASE (EC 1.1.1.9). | sptrembl O74230 | ND |
| 1424 | 253.3 | SEC63 PROTEIN. | tremblnew CAB46275 | ND |
| 1425 | 253.2 | HYPOTHETICAL OXIDOREDUCTASE IN MRPL-44-MTF1 INTERGENIC REGION (EC 1.-.-.-). | swissprot Q05016 | ND |
| 1426 | 252.9 | PROBABLE LYSYL-TRNA SYNTHETASE (EC 6.1.1.6) LYSINE--TRNALIGASE) (LYSRS). | swissprot Q22099 | ND |
| 1427 | 252.8 | *Trichoderma reesei* ACE1 transcriptional activator protein | geneseqp W58572 | ND |
| 1428 | 252.6 | HYPOTHETICAL 13.3 KD PROTEIN C23C4.13 IN CHROMOSOME I. | sptrembl O13932 | ND |
| 1429 | 252.6 | MITOCHONDRIAL BETA SEN-DNA: ND4L GENE 5' END, ARG-TRNA GENE COMPLETE SEQUENCE. CO1 GENE, 3' END (FRAGMENT). | tremblnew AAA32005 | ND |
| 1430 | 252.3 | PUTATIVE 50S RIBOSOMAL PROTEIN L14. | sptrembl O94292 | ND |
| 1431 | 252.2 | PUTATIVE PRT1 PROTEIN. | swissprot P12806 | ND |
| 1432 | 251.7 | PYRUVATE DEHYDROGENASE E1 COMPONENT ALPHA SUBUNIT. MITOCHONDRIAL PRECURSOR (EC 1.2.4.1) (PDHE1-A). | swissprot Q10489 | ND |
| 1433 | 251.2 | Metallothionein protein sequence. | geneseqp W69479 | ND |
| 1434 | 250.4 | ACR-2 PROTEIN. | sptrembl P78704 | ND |
| 1435 | 250.0 | PUTATIVE TRANSCRIPTIONAL REGULATOR. | sptrembl O13337 | ND |
| 1436 | 249.9 | DELTA(24)-STEROL C-METHYL TRANSFERASE (EC 2.1.1.41). | swissprot O74198 | ND |
| 1437 | 249.9 | HALOTOLERANCE PROTEIN. | sptrembl O94505 | ND |
| 1438 | 249.7 | 40S RIBOSOMAL PROTEIN S28, MITOCHONDRIAL PRECURSOR. | swissprot P21771 | ND |
| 1439 | 249.6 | HYPOTHETICAL 51.2 KD PROTEIN (PUTATIVE TRANSCRIPTION FACTOR C31F10.01 IN CHROMOSOME II). | sptrembl P87303 | ND |
| 1440 | 249.4 | HISTONE H3 (FRAGMENT). | sptrembl Q42782 | ND |
| 1441 | 249.3 | DYNEIN LIGHT INTERMEDIATE CHAIN 2. CYTOSOLIC (LIC53/55) (LIC-2). | swissprot Q62698 | ND |

TABLE 1-continued

_Fusarium venenatum ESTs_

| Sequence Listing | zscore | Annotation | Database | Functional category |
|---|---|---|---|---|
| 1442 | 248.4 | ATP SYNTHASE E CHAIN. MITOCHONDRIAL (EC 3.6.1.34). | swissprot P81449 | ND |
| 1443 | 248.3 | _Cladosporium herbarum_ allergen Clah11 | geneseqp R72669 | ND |
| 1444 | 248.1 | METALLOTHIONEIN-LIKE PROTEIN CAP3. | swissprot Q99334 | ND |
| 1445 | 248.1 | DNA BINDING REGULATORY PROTEIN AMDX. | sptrembl P79045 | ND |
| 1446 | 247.9 | HEPATITIS A VIRUS RECEPTOR. | sptrembl O18984 | ND |
| 1447 | 2476 | 1-PHOSPHATIDYLINOSITOL-4,5-BISPHOSPHATE PHOSPHODIESTERASE 1 (EC 3.1.4.11) (PLC-1) (PHOSPHOLIPASE C-1). | swissnew P40977 | ND |
| 1448 | 246.6 | CYTOCHROME C OXIDASE COPPER CHAPERONE. | swissprot Q12287 | ND |
| 1449 | 246.5 | _Mycobacterium tuberculosis_ 55 kDa protein. | geneseqp W31855 | ND |
| 1450 | 245.9 | SIMILAR TO AAC-RICH MRNA CLONE AAC11 PROTEIN. | sptrembl Q22204 | ND |
| 1451 | 245.5 | AUTOPHAGY PROTEIN APG6. | swissprot Q02948 | ND |
| 1452 | 245.3 | Maize UDP-glucose dehydrogenase Zmudpgdh2. | geneseqp Y06307 | ND |
| 1453 | 244.0 | HYDROXYPROLINE-RICH GLYCOPROTEIN PRECURSOR. | sptrembl Q41719 | ND |
| 1454 | 243.9 | HYPOTHETICAL 36.4 KD PROTEIN IN SMP1-MBA1 INTERGENIC REGION. | swissprot P38298 | ND |
| 1455 | 243.6 | CLOCK-CONTROLLED GENE-6 PROTEIN. | sptrembl O74694 | ND |
| 1456 | 243.4 | HYDROXYPROLINE-RICH. GLYCOPROTEIN DZ-HRGP PRECURSOR. | tremblnew CAB62280 | ND |
| 1457 | 243.4 | AMINOPEPTIDASE II (EC 3.4.11.-) (YSC11). | swissprot P32454 | ND |
| 1458 | 243.1 | F17A22.8 PROTEIN. | sptrembl O82238 | ND |
| 1459 | 243.0 | AUTOIMMUNE REGULATOR. | tremblnew AAD46421 | ND |
| 1460 | 242.9 | HYPOTHETICAL 76.3 KD ZINC FINGER PROTEIN IN KTR5-UME3 INTERGENIC REGION. | swissprot P53968 | ND |
| 1461 | 242.8 | ALCOHOL DEHYDROGENASE. | sptrembl O94564 | ND |
| 1462 | 242.8 | PUTATIVE CYTOCHROME C OXIDASE POLYPEPTIDE. | sptrembl O94705 | ND |
| 1463 | 242.8 | PROTEIN KINASE CHK1. | tremblnew CAA22551 | ND |
| 1464 | 242.5 | SIMILAR TO GVPD_HALHA. | sptrembl Q05775 | ND |
| 1465 | 241.9 | HYPOTHETICAL 80.9 KD PROTEIN (FRAGMENT). | tremblnew CAB60246 | ND |
| 1466 | 241.8 | HYPOTHETICAL 53.5 KD PROTEIN C1F5 07C IN CHROMOSOME | swissprot Q10062 | ND |
| 1467 | 241.7 | FISSION YEAST (FRAGMENT). | sptrembl P78824 | ND |
| 1468 | 241.6 | OPSIN-1 | tremblnew AAD45253 | ND |
| 1469 | 241.3 | HYPOTHETICAL 43.1 KD PROTEIN C16E9.14C IN CHROMOSOME II. | sptrembl O14329 | ND |
| 1470 | 241.0 | POSITIVE SULPHUR TRANSCRIPTION REGULATOR METR. | sptrembl Q9Y8B4 | ND |
| 1471 | 241.0 | PHOSPHATE-REPRESSIBLE PHOSPHATE PERMEASE. | swissprot P15710 | ND |

TABLE 1-continued

*Fusarium venenatum* ESTs

| Sequence Listing | zscore | Annotation | Database | Functional category |
|---|---|---|---|---|
| 1472 | 240.9 | HYPOTHETICAL TRANSMEMBRANE PROTEIN. | sptrembl O94060 | ND |
| 1473 | 240.9 | HYPOTHETICAL 11.7 KD PROTEIN C6B12.13 IN CHROMOSOME I. | swissprot O14218 | ND |
| 1474 | 240.7 | HYPOTHETICAL 19.6.KD PROTEIN IN PYK1-SNC1 INTERGENIC REGION. | swissprot P28005 | ND |
| 1475 | 240.7 | HYPOTHETICAL 8.7 KD PROTEIN. | sptrembl Q9ZRV8 | ND |
| 1476 | 240.0 | LETHAL(2)TUMOROUS IMAGINAL DISCS. | sptrembl Q27237 | ND |
| 1477 | 239.7 | HYPOTHETICAL 16.6 KD PROTEIN. | sptrembl O07408 | ND |
| 1478 | 239.7 | Human 5' EST secreted protein SEQ ID NO: 470. | geneseqp Y12157 | ND |
| 1479 | 239.4 | HYDROXYPROLINE-RICH GLYCOPROTEIN PRECURSOR. | sptrembl Q41719 | ND |
| 1480 | 239.3 | MITOCHONDRIAL 60S RIBOSOMAL PROTEIN L25 (YML25). | swissprot P23369 | ND |
| 1481 | 239.0 | HYDROXYPROLINE-RICH GLYCOPROTEIN DZ-HRGP PRECURSOR. | tremblnew CAB62280 | ND |
| 1482 | 239.0 | OXIDOREDUCTASE OF SHORT-CHAIN. | sptrembl Q9X9U8 | ND |
| 1483 | 238.7 | PROH (FRAGMENT). | sptrembl O07508 | ND |
| 1484 | 238.7 | Y25C1A.7B PROTEIN. | tremblnew AAD12839 | ND |
| 1485 | 238.3 | CYTOCHROME C OXIDASE ASSEMBLY PROTEIN COX15. | swissprot P40086 | ND |
| 1486 | 238.1 | DNA REPAIR PROTEIN RHP55 (RAD55 HOMOLOG). | swissnew O14129 | ND |
| 1487 | 238.1 | PEPTIDE SYNTHASE. | sptrembl O69825 | ND |
| 1488 | 238.0 | KIAA1286 PROTEIN (FRAGMENT). | tremblnew BAA86600 | ND |
| 1489 | 237.9 | EXTENSIN (FRAGMENT). | sptrembl O49870 | ND |
| 1490 | | GLYCOPROTEIN X PRECURSOR | swissprot P28968 | ND |
| 1491 | 237.6 | GLUTATHIONE S-TRANSFERASE YA (EC 2.5.1.18) (LIGANDIN) (CHAIN 1) (GST CLASS-ALPHA) (CLONES PGTR112 & PGTB38). | swissprot P04903 | ND |
| 1492 | 236.4 | HYPOTHETICAL 29.0 KD PROTEIN. | sptrembl Q9ZD15 | ND |
| 1493 | 235.9 | 2,3-BISPHOSPHOGLYCERATE-INDEPENDENT PHOSPHOGLYCERATE MUTASE. | sptrembl Q9X519 | ND |
| 1494 | 235.3 | LEU/VAL/ILE AMINO-ACID PERMEASE (BRANCHED-CHAIN AMINO-ACID PERMEASE 2). | swissprot P38084 | ND |
| 1495 | 235.2 | INTEGRAL MEMBRANE PROTEIN | sptrembl Q9Y785 | ND |
| 1496 | 235.2 | Polylysine peptide NBC32. | geneseqp W65939 | ND |
| 1497 | 235.2 | 40S RIBOSOMAL PROTEIN S20. | swissprot O74893 | ND |
| 1498 | 235.1 | HYPOTHETICAL 45.8 KD PROTEIN C30D10.03C IN CHROMOSOME II. | sptrembl O14349 | ND |
| 1499 | 235.1 | HYPOTHETICAL 29.3 KD PROTEIN. | sptrembl O74943 | ND |
| 1500 | 234.6 | HEROIN ESTERASE. | sptrembl O06441 | ND |
| 1501 | 234.5 | HYPOTHETICAL FUNGAL ZN(2)-CYS(6) ZINC-FINGER PROTEIN. | tremblnew CAB5744 | ND |

TABLE 1-continued

Fusarium venenatum ESTs

| Sequence Listing | zscore | Annotation | Database | Functional category |
|---|---|---|---|---|
| 1502 | 234.5 | PUTATIVE TRANSCRIPTIONAL ACTIVATOR. | sptrembl O59830 | ND |
| 1503 | 234.2 | 3′.5′-CYCLIC-NUCLEOTIDE PHOSPHODIESTERASE (EC 3.1.4.17) (PDEASE). | swissprot P32782 | ND |
| 1504 | 234.0 | QUINATE PERMIASE (QUINATE TRANSPORTER). | swissprot P11636 | ND |
| 1505 | 233.9 | INFECTION STRUCTURE SPECIFIC PROTEIN. | sptrembl Q9Y779 | ND |
| 1506 | 233.7 | CHROMOSOME XII COSMID 9638. | sptrembl Q06479 | ND |
| 1507 | 233.0 | QUINIC ACID UTILIZATION ACTIVATOR. | swissprot P10563 | ND |
| 1508 | 233.0 | HYPOTHETICAL 74.0 KD PROTEIN. | sptrembl O65709 | ND |
| 1509 | 232.7 | 26S PROTEASOME REGULATORY SUBUNIT S5A. | sptrembl O81340 | ND |
| 1510 | 232.5 | Mycobacterium species protein sequence 50B. | geneseqp Y04998 | ND |
| 1511 | 232.2 | A-AGGLUTININ ATTACHMENT SUBUNIT PRECURSOR. | swissprot P32323 | ND |
| 1512 | 232.1 | CYTOCHROME B2 PRECURSOR (EC 1.1.2.3) (L-LACTATE DEHYDROGENASE (CYTOCHROME)) (L-LACTATE FERRICYTOCHROME C OXIDOREDUCTASE) (L-LCR). | swissprot P09437 | ND |
| 1513 | 231.9 | ACR-2 PROTEIN. | sptrembl P78704 | ND |
| 1514 | 231.5 | MSS51 PROTEIN. | swissprot P32335 | ND |
| 1515 | 231.4 | Yeast proteasome YC1 subunit. | geneseqp R22996 | ND |
| 1516 | 231.3 | ISOLEUCYL-TRNA SYNTHETASE. | tremblnew CAB52155 | ND |
| 1517 | 231.1 | CELL WALL-PLASMA MEMBRANE LINKER PROTEIN. | sptrembl Q39353 | ND |
| 1518 | 231.0 | PROLINE-RICH PROTEOGLYCAN PRPG2. | sptrembl Q07611 | ND |
| 1519 | 231.0 | Fusarium oxysporum DSM 2672 endoglucanase. | geneseqp R25527 | ND |
| 1520 | 231.0 | SARCOPLASMIC RETICULUM HISTIDINE-RICH CALCIUM-BINDING PROTEIN PRECURSOR (HCP). | swissprot P16230 | ND |
| 1521 | 230.8 | HYPOTHETICAL 28.3 KD PROTEIN (FRAGMENT). | tremblnew CAB55927 | ND |
| 1522 | 230.4 | HYPOTHETICAL 80.2 KD PROTEIN. | sptrembl O74423 | ND |
| 1523 | 230.1 | RCDNA.LD28419. | tremblnew AAD55441 | ND |
| 1524 | 229.9 | TRANSLOCATION ELONGATION FACTOR. | sptrembl O74945 | ND |
| 1525 | 229.9 | HYPOTHETICAL 93.5 KD PROTEIN. | sptrembl O59744 | ND |
| 1526 | 229.7 | HYPOTHETICAL 29.3 KD PROTEIN (ORF92). | swissprot O10341 | ND |
| 1527 | 229.7 | RIBOSOMAL PROTEIN L41. | sptrembl Q9Y710 | ND |
| 1528 | 229.7 | HYPOTHETICAL NUCLEAR PROTEIN (FRAGMENT). | tremblnew BAA87112 | ND |

TABLE 1-continued

_Fusarium venenatum_ ESTs

| Sequence Listing | zscore | Annotation | Database | Functional category |
|---|---|---|---|---|
| 1529 | 229.4 | NEUROLYSIN PRECURSOR (EC 3.4.24.16) (NEUROTENSIN ENDOPEPTIDASE) (MITOCHONDRIAL OLIGOPEPTIDASE M) (MICROSOMAL ENDOPEPTIDASE) (MEP) (SOLUBLE ANGIOTENSIN-BINDING PROTEIN) (SABP) (ENDOPEPTIDASE 24.16). | swissnew Q02038 | ND |
| 1530 | 229.3 | TREHALASE PRECURSOR (EC 3.2.1.28) (ALPHA.ALPHA-TREHALOSE (ALPHA.ALPHA-TREHALOSE GLUCOHYDROLASE). | swissprot O43280 | ND |
| 1531 | 229.1 | ASPARTIC PROTEINASE MKC7 PRECURSOR (EC 3.4.23.-) | swissprot P53379 | ND |
| 1532 | 229.1 | PHOSPHOLIPASE A2 ACTIVATING PROTEIN. | sptrembl Q9Y5L1 | ND |
| 1533 | 229.0 | WUGSC:H_GS098E02.1 PROTEIN (FRAGMENT). | tremblnew AAF19251 | ND |
| 1534 | 228.9 | T6C23.12 PROTEIN. | tremblnew AAF22917 | ND |
| 1535 | 228.4 | _Malassezia fungus_ ME-7 antigenic protein. | geneseqp W29774 | ND |
| 1536 | 228.3 | MNN4 PROTEIN. | swissprot P36044 | ND |
| 1537 | 227.9 | HYPOTHETICAL TRANSMEMBRANE PROTEIN. | sptrembl O94060 | ND |
| 1538 | 227.7 | SYNTAXIN BINDING PROTEIN 1. SEC1 FAMILY SECRETOR Y PROTEIN. | sptrembl O94590 | ND |
| 1539 | 227.6 | NUCLEAR PORE COMPLEX GLYCOPROTEIN P62. | sptrembl O57397 | ND |
| 1540 | 226.9 | HUMAN 4F5S HOMOLOG. | tremblnew CAB59614 | ND |
| 1541 | 226.5 | CHROMOSOME XVI READING FRAME ORF YP1.264C. | sptrembl Q08V80 | ND |
| 1542 | 226.4 | PALMITOYL-PROTEIN THIOESTERASE PRECURSOR. | sptrembl O59747 | ND |
| 1543 | 226.0 | PUTATIVE MEMBRANE GLYCOPROTEIN. | sptrembl Q9Y7Y6 | ND |
| 1544 | 225.3 | Human secreted protein encoded by 5' EST SEQ ID NO: 222. | geneseqp Y13208 | ND |
| 1545 | 225.1 | VELVET A. | sptrembl O74625 | ND |
| 1546 | 225.0 | INTEGRAL MEMBRANE PROTEIN. | sptrembl Q9Y785 | ND |
| 1547 | 224.9 | Protease biosynthetic protein. | geneseqp P70581 | ND |
| 1548 | 224.9 | ARGININE METABOLISM REGULATION PROTEIN II. | swissprot P05085 | ND |
| 1549 | 224.6 | BCDNA.GH06451. | tremblnew AAD55420 | ND |
| 1550 | 224.6 | ORF YBR199W (FRAGMENT). | sptrembl P89506 | ND |
| 1551 | 224.5 | PUTATIVE MITOCHONDRIAL 40S RIBOSOMAL PROTEIN YMR188C. | swissprot Q03246 | ND |
| 1552 | 223.8 | MANNOSE-SPECIFIC LECTIN PRECURSOR (FRAGMENT). | sptrembl Q38726 | ND |
| 1553 | 223.3 | ORF2 of Enod2b genomic clone. | geneseqp R04119 | ND |
| 1554 | 223.3 | COSMID C27A2. | sptrembl Q18238 | ND |
| 1555 | 223.2 | IKI3 PROTEIN. | swissprot Q06706 | ND |
| 1556 | 223.0 | ALPHA-L-ARABINOFURANOSIDASE | sptrembl Q9WYB7 | ND |

TABLE 1-continued

_Fusarium venenatum ESTs_

| Sequence Listing | zscore | Annotation | Database | Functional category |
|---|---|---|---|---|
| 1557 | 222.9 | PUTATIVE ENOYL-COA HYDRATASE. | sptrembl O53211 | ND |
| 1558 | 222.8 | SUGAR TRANSPORTER ST1 1. | swissprot P39932 | ND |
| 1559 | 222.0 | T4B21.2 PROTEIN. | sptrembl Q9ZS88 | ND |
| 1560 | 221.8 | PUTATIVE PROTEOLIPID PROTEIN C2C4.13. | sptrembl O14046 | ND |
| 1561 | 221.6 | PEROXISOMAL MEMBRANE PROTEIN PMP30B (PMP32) (PEROXIN-11B). | swissprot Q00317 | ND |
| 1562 | 221.1 | HYPOTHETICAL 37.7 KD PROTEIN T09A5.8 IN CHROMOSOME III. | swissprot P45968 | ND |
| 1563 | 221.0 | DJ1042K10.5 (NOVEL PROTEIN) (FRAGMENT). | sptrembl O95516 | ND |
| 1564 | 220.9 | CLATHRIN LIGHT CHAIN. | tremblnew CAB42369 | ND |
| 1565 | 220.8 | EXTENSIN PRECURSOR (CELL WALL HYDROXYPROLINE-RICH GLYCOPROTEIN). | swissprot P13983 | ND |
| 1566 | 220.7 | NPGA PROTEIN. | tremblnew AAF12814 | ND |
| 1567 | 220.5 | MUCIN (FRAGMENT). | sptrembl Q28501 | ND |
| 1568 | 220.5 | PIUS. | tremblnew BAA87611 | ND |
| 1569 | 220.4 | CHROMOSOME XV READING FRAME ORF YOR084W. | sptrembl Q12405 | ND |
| 1570 | 219.9 | CYSTEINE-RICH PROTEIN (FRAGMENT). | sptrembl Q16861 | ND |
| 1571 | 219.6 | HYPOTHETICAL 74.7 KD PROTEIN. | sptrembl O94033 | ND |
| 1572 | 219.4 | HEAT SHOCK PROTEIN 70 HOMOLOG C57A7.12. | sptrembl P87142 | ND |
| 1573 | 219.2 | EMM18.1. | sptrembl Q54703 | ND |
| 1574 | 218.8 | HYPOTHETICAL 26.8 KD PROTEIN IN HYR1 3'REGION. | swissprot P40582 | ND |
| 1575 | 218.0 | HYPOTHETICAL 23.2 KD PROTEIN IN SKM1-TRF4 INTERGENIC REGION. | swissprot Q12322 | ND |
| 1576 | 218.0 | SIMILAR TO ALPHA-SNAP PROTEIN. | sptrembl Q18921 | ND |
| 1577 | 218.0 | CHROMOSOME IV READING FRAME ORF YDL237W. | sptrembl Q07716 | ND |
| 1578 | 217.8 | HYPOTHETICAL PROTEIN (FRAGMENT). | sptrembl Q12742 | ND |
| 1579 | 217.5 | CHROMOSOME XV READING FRAME ORF YOL129W. | sptrembl Q12016 | ND |
| 1580 | 217.4 | POTENTIAL MEMBRANE PROTEIN. | sptrembl O94006 | ND |
| 1581 | 2173 | CHROMOSOME IV READING FRAME ORF YDL144C. | sptrembl Q07589 | ND |
| 1582 | 217.2 | LIGAND OF NUMB-PROTEIN X (LNXP80). | sptrembl O70263 | ND |
| 1583 | 217.0 | PIG-B | sptrembl Q92521 | ND |
| 1584 | 216.9 | PHOSPHATIDYLSERINE SYNTHASE. | sptrembl Q9ZQW1 | ND |
| 1585 | 216.9 | PUTATIVE CHOLINE KINASE. | sptrembl O81024 | ND |
| 1586 | 216.5 | UV-DAMAGED DNA-BINDING PROTEIN-LIKE. | sptrembl O49552 | ND |
| 1587 | 216.1 | HYDROXYPROLINE-RICH GLYCOPROTEIN DZ-HRGP PRECURSOR. | tremblnew CAB62280 | ND |
| 1588 | 216.0 | CONSERVED HYPOTHETICAL PROTEIN. | sptrembl Q9Y713 | ND |
| 1589 | 215.2 | ANTIGEN 2. | sptrembl Q12295 | ND |

TABLE 1-continued

*Fusarium venenatum* ESTs

| Sequence Listing | zscore | Annotation | Database | Functional category |
|---|---|---|---|---|
| 1590 | 215.0 | PROTEOPHOSPHOGLYCAN PRECUSOR (FRAGMENT). | sptrembl Q9Y076 | ND |
| 1591 | 214.4 | LET-756 PROTEIN. | sptrembl O76831 | ND |
| 1592 | 214.1 | REPRESSIBLE ALKALINE PHOSPHATASE PRECURSOR (EC 3.1.3.1). | swissprot P11491 | ND |
| 1593 | 214.0 | BACITRACIN SYNTHETASE 2 (BA2) (FRAGMENT). | tremblnew BAA36755 | ND |
| 1594 | 213.9 | IMMUNOREACTIVE HEAT SHOCK PROTEIN DNAJ. | sptrembl Q9XCA6 | ND |
| 1595 | 213.9 | HYPOTHETICAL 107.1 KD PROTEIN C24H6.11C IN CHROMOSOME I. | swissprot Q09764 | ND |
| 1596 | 213.7 | HYPOTHETICAL 34.2 KD PROTEIN C31F10.07 IN CHROMOSOME II. | sptrembl P87308 | ND |
| 1597 | 213.4 | HYPOTHETICAL 12.8 KD PROTEIN IN ARO9-SPS100 INTERGENIC REGION PRECURSOR. | swissprot P38841 | ND |
| 1598 | 213.1 | HYPOTHETICAL PROTEIN C3C7.15C IN CHROMOSOME I (FRAGMENT). | sptrembl O14138 | ND |
| 1599 | 213.1 | HARD SURFACE INDUCED PROTEIN 3. | tremblnew AAF00024 | ND |
| 1600 | 213.0 | S18 CHORION PROTEIN. | sptrembl O62009 | ND |
| 1601 | 212.8 | HYPOTHETICAL SH3-CONTAINING PROTEIN. | tremblnew CAB52037 | ND |
| 1602 | 212.4 | ANKYRIN. | sptrembl Q24241 | ND |
| 1603 | 212.0 | PEROXISOMAL MEMBRANE PROTEIN PER9 (PEROXIN-3). | swissprot Q01497 | ND |
| 1604 | 212.0 | HYPOTHETICAL 26.3 KD PROTEIN IN OYE2-GND1 INTERGENIC REGION. | swissprot P38869 | ND |
| 1605 | 211.2 | F24J5 8 PROTEIN. | tremblnew AAD49974 | ND |
| 1606 | 211.1 | HYDROXYPROLINE-RICH GLYCOPROTEIN. | sptrembl Q42366 | ND |
| 1607 | 210.5 | HYPOTHETICAL RHO1 GDP-GTP EXCHANGE PROTEIN. | sptrembl Q9Y7115 | ND |
| 1608 | 209.8 | PRB1M PROTEIN (FRAGMENT). | sptrembl Q16038 | ND |
| 1600 | 209.6 | CONSERVED HYPOTHETICAL PROTEIN. | sptrembl Q9Y7P1 | ND |
| 1610 | 209.4 | HYPOTHETICAL 30.3 KD PROTEIN | sptrembl Q9ZC03 | ND |
| 1611 | 209.1 | NONE. | sptrembl Q9XDF2 | ND |
| 1612 | 208.9 | CAP22 PROTEIN. | sptrembl O94177 | ND |
| 1613 | 208.8 | ORIGIN RECOGNITION COMPLEX SUBUNIT 1. | swissprot O74270 | ND |
| 1614 | 208.7 | PUTATIVE SECRETED PROLINE-RICH PROTEIN. | tremblnew CAB63180 | ND |
| 1615 | 208.5 | NON-CLASSICAL EXPORT PROTEIN NCE2. | swissprot Q12207 | ND |
| 1616 | 208.2 | HYPOTHETICAL 36.8 KD PROTEIN. | sptrembl P71847 | ND |
| 1617 | 208.1 | LIGF PROTEIN. | swissprot P30347 | ND |
| 1618 | 208.0 | EUKARYOTIC TRANSLATION INITIATION FACTOR 5 (E1F-5). | swissprot P35431 | ND |
| 1619 | 207.2 | PUTATIVE FRUCTOSYL AMINO ACIDOXIDASE | tremblnew CAB59618 | |
| 1620 | 207.0 | RNA POLYMERASE II SUBUNIT RPB7 (FRAGMENT). | tremblnew CAA20136 | ND |
| 1621 | 206.7 | KYNURENINASE (EC 3.7.1.3) (L-KYNURENINE HYDROLASE). | swissprot Q16719 | ND |

TABLE 1-continued

*Fusarium venenatum* ESTs

| Sequence Listing | zscore | Annotation | Database | Functional category |
|---|---|---|---|---|
| 1622 | 206.3 | HYPOTHETICAL- 25.4 KD PROTEIN IN SAP185-BCK1 INTERGENIC REGION. | swissprot P40558 | ND |
| 1623 | 206.2 | CPC3 PROTEIN. | sptrembl O74297 | ND |
| 1624 | 205.7 | SEVERIN KINASE. | sptrembl O61122 | ND |
| 1625 | 205.7 | HYPOTHETICAL 42.2 KD PROTEIN. | tremblnew CAB62412 | ND |
| 1626 | 205.6 | HYPOTHETICAL PROTEIN HI0828. | swissprot P44887 | ND |
| 1627 | 205.2 | DEVELOPMENTAL REGULATORY PROTEIN. | sptrembl Q00760 | ND |
| 1628 | 205.1 | PUTATIVE GAMMA-BUTYROBETAINE,2-OXOGLUTARATE DIOXYGENASE (EC 1.14.11.1) (GAMMA-BUTYROBETAINE HYDROXYLASE) (GAMMA-BBH) | swissprot Q19000 | ND |
| 1629 | 204.9 | Human epidermoid carcinoma cell line KB clone HP10301 protein. | geneseqp | ND |
| 1630 | 204.9 | PROTEIN-TYROSINE PHOSPHALASE 99A PRECURSOR (EC 3.1.3.45) (RECEPTOR-LINKED PROTEIN-TYROSINE PHOSPHATASE 99A). | swissprot | ND |
| 1631 | 204.3 | (VSP-3) PRECURSOR. | sptrembl Q39620 | ND |
| 1632 | 204.3 | HYPOTHETICAL 26.2 KD PROTEIN IN SPC42-PTM1 INTERGENIC REGION. | swissprot P36095 | ND |
| 1633 | 204.3 | PUTATIVE TRANSPORTER C11D3.18C. | swissprot Q10097 | ND |
| 1634 | 204.2 | STERIGMATOCYSTIN BIOSYNTHESIS REGULATORY PROTEIN. | swissprot P52957 | ND |
| 1635 | 204.1 | EXTENSIN PRECURSOR. | sptrembl Q40768 | ND |
| 1636 | 204.0 | HYPOTHETICAL 29.9 KD PROTEIN IN APL6-MES1 INTERGENIC REGION. | swissprot P53323 | ND |
| 1637 | 204.0 | PROLINE RICH PROTEIN PRECURSOR. | sptrembl Q43558 | ND |
| 1638 | 204.0 | 2-OXOGLUTARATE DEHYDROGENASE E1 COMPONENT, MITOCHONDRIAL PRECURSOR (EC 1.2.4.2) (ALPHA-KETOGLUTARATE DEHYDROGENASE). | swissprot P20967 | ND |
| 1639 | 203.4 | An enzyme with sugar transferase activity. | geneseqp W88044 | ND |
| 1640 | 203.4 | AFLR REGULATORY PROTEIN. | sptrembl O94141 | ND |
| 1641 | 202.9 | HYPOTHETICAL 28.8 KD PROTEIN IN PSD1-SKO1 INTERGENIC REGION | swissprot P53889 | ND |
| 1642 | 202.3 | *Mycobacterium* species protein sequence 50B. | geneseqp Y04998 | ND |
| 1643 | 202.2 | HYPOTHETICAL 28.2 KD PROTEIN IN GLNQ-ANSR INTERGENIC REGION. | swissprot P54549 | ND |
| 1644 | 202.2 | F56H9.1 PROTEIN. | sptrembl Q20908 | ND |
| 1645 | 202.1 | | | TRFA. sptrembl O77033 ND |
| 1646 | 202.1 | HYPOTHETICAL PROTEIN (FRAGMENT). | tremblnew BAA87194 | ND |
| 1647 | 201.9 | Human phosphodiesterase type IV D. | geneseqp R99743 | ND |
| 1648 | 201.0 | Prod. of the Acc1 fragment of SHR3 gene. | geneseqp R34708 | ND |
| 1649 | 200.7 | HYPOTHETICAL 33.4 KD PROTEIN C3A12.09C IN CHROMOSOME I | sptrembl P87125 | ND |

TABLE 1-continued

*Fusarium venenatum* ESTs

| Sequence Listing | zscore | Annotation | Database | Functional category |
|---|---|---|---|---|
| 1650 | 200.6 | UL6 PROTEIN (FRAGMENT 1). | sptrembl Q65580 | ND |
| 1651 | 200.4 | PUTATIVE 109.8 KD TRANSCRIPTIONAL REGULATORY PROTEIN IN SOK2-FMS1 INTERGENIC REGION. | swissprot P50104 | ND |
| 1652 | 200.4 | HYPOTHETICAL 22.4 KD PROTEIN IN GCN20-CMK1 INTERGENIC REGION PRECURSOR. | swissprot P43595 | ND |
| 1653 | 199.7 | HYDROXYPROLINE-RICH GLYCOPROTEIN DZ-HRGP PRECURSOR. | tremblnew CAB62280 | ND |
| 1654 | 199.6 | EXTENSIN (FRAGMENT). | sptrembl O49870 | ND |
| 1655 | 190.4 | *Mycobacterium* species protein sequence 50B. | geneseqp Y04998 | ND |
| 1656 | 199.1 | CONSERVED HYPOTHETICAL PROTEIN. | tremblnew CAB52741 | ND |
| 1657 | 198.9 | SALIVARY PROLINE-RICH PROTEIN RP4 PRECURSOR. | sptrembl Q04117 | ND |
| 1658 | 198.9 | HYPOTHETICAL 26.5 KD PROTEIN C15A10.05C IN CHROMOSOME I. | swissprot O13725 | ND |
| 1659 | 198.9 | 40S RIBOSOMAL PROTEIN S8 (S14) (YS9) (RP19). | swissprot P05754 | ND |
| 1660 | 198.8 | ZINC FINGER PROTEIN. | sptrembl O59811 | ND |
| 1661 | 195.4 | E2F1-INDUCIBLE PROTEIN (FRAGMENT). | tremblnew AAD53115 | ND |
| 1662 | 198.2 | *Trichoderma reesei* ACEII transcriptional activator protein. | geneseqp W58573 | ND |
| 1663 | 198.1 | HYPOTHETICAL PROTEIN (FRAGMENT). | tremblnew BAA87194 | ND |
| 1664 | 197.9 | Metal-regulated transporter polypeptide ZIP3. | geneseqp W41165 | ND |
| 1665 | 197.8 | HYPOTHETICAL 26.8.KD PROTEIN. | sptrembl O65515 | ND |
| 1666 | 197.6 | F56A11.6 PROTEIN | sptrembl O44519 | ND |
| 1667 | 197.5 | 5'-AMP-ACTIVATED PROTEIN KINASE. | tremblnew CAA22634 | ND |
| 1668 | 197.5 | GUANINE NUCLEOTIDE-BINDING PROTEIN GAMMA SUBUNIT. | swissprot P18852 | ND |
| 1669 | 197.4 | HYPOTHETICAL 67.0 KD PROTEIN (FRAGMENT). | sptrembl O94367 | ND |
| 1670 | 197.4 | RHODOPSIN (FRAGMENT). | tremblnew AAC27436 | ND |
| 1671 | 197.2 | HYDROXYPROLINE-RICH GLYCOPROTEIN. | sptrembl Q42366 | ND |
| 1672 | 197.1 | OXOGLUTARATE MALATE TRANSLOCATOR. | sptrembl Q43649 | ND |
| 1673 | 196.9 | PISTIL-SPECIFIC EXTENSIN-LIKE PROTEIN (FRAGMENT). | sptrembl Q40552 | ND |
| 1674 | 196.7 | SIMILARITY TO THE CDC2/CDX SUBFAMILY OF SER/THR PROTEIN KINASES. | sptrembl O01775 | ND |
| 1675 | 196.5 | CELL WALL-PLASMA MEMBRANE LINKER PROTEIN | sptrembl Q39353 | ND |
| 1676 | 195.9 | HYPOTHETICAL 181.5 KD PROTEIN C23D3.13C IN CHROMOSOME I. | swissprot Q09853 | ND |
| 1677 | 195.6 | SID478P. | tremblnew BAA84693 | ND |
| 1678 | 195.1 | HYPOTHETICAL 32.9 KD PROTEIN. | sptrembl Q9XA40 | ND |
| 1679 | 194.5 | 3' END (FRAGMENT). | sptrembl Q26893 | ND |
| 1680 | 194.2 | HYDROXYPROLINE-RICH GLYCOPROTEIN DZ-HRGP PRECURSOR. | tremblnew CAB62280 | ND |

TABLE 1-continued

_Fusarium venenatum_ ESTs

| Sequence Listing | zscore | Annotation | Database | Functional category |
|---|---|---|---|---|
| 1681 | 194.2 | SIMILAR TO LONG TANDEM REPEAT REGION OF SIALIDASE. | sptrembl Q23635 | ND |
| 1682 | 194.1 | PHOSPHOLIPID METHYLTRANSFERASE. | sptrembl P87300 | ND |
| 1683 | 194.0 | DNA-DIRECTED RNA POLYMERASE 1.13.7.KD POLYPEPTIDE (EC 2.7.7.6) (A12.2). | swissprot P32529 | ND |
| 1684 | 193.8 | Mouse acylcoenzyme A cholesterol acyltransferase II. W43408 | geneseqp | ND |
| 1685 | 193.4 | Sugarbeet chitinase 1. | geneseqp R28150 | ND |
| 1686 | 193.3 | PROLINE-RICH CELL WALL PROTEIN. | sptrembl Q39789 | ND |
| 1687 | 193.2 | SERINE-RICH PROTEIN. | sptrembl O94317 | ND |
| 1655 | 193.0 | _Trichoderma reesei_ ACEI transcriptional activator protein. | geneseqp W58572 | ND |
| 1689 | 192.9 | HYPOTHETICAL 96.1 KD PROTEIN IN RIM1-RPS14A INTERGENIC REGION. | swissprot P25623 | ND |
| 1690 | 192.5 | FIBRILLARIN. | swissprot Q22053 | ND |
| 1691 | 192.1 | PUTATIVE COMPONENT of CCAAT BINDING COMPLEX HAPC. | sptrembl Q00735 | ND |
| 1692 | 192.1 | SALIVARY GLUE PROTEIN SGS-3 PRECURSOR. | swissprot P02840 | ND |
| 1693 | 192.0 | PFC0175W PROTEIN. | sptrembl O97226 | ND |
| 1694 | 191.7 | SERINE-RICH PROTEIN. | sptrembl O94317 | ND |
| 1695 | 191.6 | DNA-DIRECTED RNA POLYMERASE II LARGEST SUBUNIT (EC 2.7.7.6) (FRAGMENT). | swissprot P35034 | ND |
| 1696 | 191.5 | LEEIP. | sptrembl Q06701 | ND |
| 1697 | 191.0 | HYPOTHETICAL NUCLEAR PROTEIN (FRAGMENT). | tremblnew BAA87314 | ND |
| 1698 | 191.0 | VACUOLAR PROTEASE A PRECURSOR (EC 3.4.23.-). | swissprot Q01294 | ND |
| 1699 | 190.9 | PUTATIVE 109.8 KD TRANSCRIPTIONAL REGULATORY PROTEIN IN SOK2-FMS1 INTERGENIC REGION. | swissprot P50104 | ND |
| 1700 | 190.8 | INTEGRAL PEROXISOMAL MEMBRANE PROTEIN. | tremblnew AAF22254 | ND |
| 1701 | 190.4 | ORF 171. | sptrembl Q45944 | ND |
| 1702 | 190.4 | Human regulator or G-protein signalling 1 (RGPS-1). | geneseqp W30560 | ND |
| 1703 | 190.3 | HYPOTHETICAL 63.7 KD PROTEIN C16E9.02C IN CHROMOSOME II. | sptrembl O14319 | ND |
| 1704 | 190.3 | Colon cancer associated antigen precursor sequence. | geneseqp Y07109 | ND |
| 1705 | 190.2 | EXTENSIN (FRAGMENT). | sptrembl Q41645 | ND |
| 1706 | 190.2 | MYELIN GENE EXPRESSION FACTOR 2. | sptrembl Q9Y655 | ND |
| 1707 | 190.2 | HYPOTHETICAL 63.1 KD PROTEIN. | sptrembl O43071 | ND |
| 1708 | 189.6 | ADENOSYLHOMOCYSTEIN ASE (EC 3.3.1.1) (S-ADENOSYL-L-HOMOCYSTEIN E HYDROLASE) (ADOHCYASE). | swissprot P10819 | ND |
| 1709 | 189.6 | _Mycobacterium tuberculosis_ specific DNA-encoded polypeptide. | geneseqp Y31745 | ND |
| 1710 | 180.6 | HYPOTHETICAL 35.4 KD PROTEIN. | sptrembl P93845 | ND |
| 1711 | 189.3 | FLGA insert stabilising polypeptide. | geneseqp W79128 | ND |
| 1712 | 189.3 | 60S RIBOSOMAL PROTEIN L7, MITOCHONDRIAL PRECURSOR (YML7). | swissprot P36519 | ND |

TABLE 1-continued

*Fusarium venenatum* ESTs

| Sequence Listing | zscore | Annotation | Database | Functional category |
|---|---|---|---|---|
| 1713 | 189.1 | HYPOTHETICAL 33.0 KD PROTEIN IN PROB-PROA INTERGENIC REGION. | swissprot P45637 | ND |
| 1714 | 189.0 | HYPOTHETICAL 33.5 KD PROTEIN IN SEC53-ACT1 INTERGENIC REGION. | swissprot P43558 | ND |
| 1715 | 188.7 | HYPOTHETICAL 70.9 KD PROTEIN IN CBP2 5'REGION. | swissprot P38731 | ND |
| 1716 | 188.6 | TRANSCRIPTION FACTOR DMAX. | sptrembl P91664 | ND |
| 1717 | 188.6 | WAIT-1. | tremblnew AAC68675 | ND |
| 1718 | 188.6 | EXTENSIN-LIKE PROTEIN. | sptrembl O81765 | ND |
| 1719 | 188.3 | PUTATIVE ZINC FINGER PROTEIN. | sptrembl O74256 | ND |
| 1720 | 188.2 | HYPOTHETICAL 18.7 KD PROTEIN IN HMS1-ABF2 INTERGENIC REGION. | swissprot Q04767 | ND |
| 1721 | 187.8 | D-pantolacione hydrolase from *Fusarium oxysporum*. | geneseqp W21857 | ND |
| 1722 | 187.8 | SALIVARY PROLINE-RICH PROTEIN RP4 PRECURSOR | sptrembl Q04117 | ND |
| 1723 | 187.6 | HYPOTHETICAL 29.7 KD PROTEIN IN RPL1-CPDB INTERGENIC REGION (F286). | swissprot P39315 | ND |
| 1724 | 187.6 | HEPATITIS A VIRUS CELLULAR RECEPTOR 1 LONG FORM HEPATITIS A VIRUS CELLULAR RECEPTOR I SHORT FORM). | sptrembl O46598 | ND |
| 1725 | 187.2 | GLUTAMINE REPEAT PROTEIN 1. | sptrembl Q61118 | ND |
| 1726 | 187.0 | GLUE PROTEIN. | sptrembl Q27423 | ND |
| 1727 | 186.9 | HYPOTHETICAL 11.6 KD PROTEIN. | sptrembl Q59764 | ND |
| 1728 | 186.9 | TAMA. | sptrembl Q00741 | ND |
| 1729 | 186.8 | HOL1 PROTEIN. | swissprot P53389 | ND |
| 1730 | 186.3 | PPRB GENE. | sptrembl Q52088 | ND |
| 1731 | 186.2 | YUP8H12R.22 PROTEIN. | sptrembl O64535 | ND |
| 1732 | 186.0 | HYPOTHETICAL 25.9 KD PROTEIN C16A3.04 IN CHROMOSOME II. | sptrembl O42911 | ND |
| 1733 | 185.7 | HAVCR-1 PROTEIN PRECURSOR. | sptrembl Q95144 | ND |
| 1734 | 185.7 | Fragmented human NF-1. gene -2 frameshift mutant product. | geneseqp W18658 | ND |
| 1735 | 185.6 | 64AA LONG HYPOTHETICAL PROTEIN. | sptrembl Q9YAL3 | ND |
| 1736 | 185.5 | CUTINASE TRANSCRIPTION FACTOR 1 ALPHA. | swissprot P52958 | ND |
| 1737 | 185.5 | MICROFILARIAL SHEATH PROTEIN SHP3 PRECURSOR. | sptrembl Q17260 | ND |
| 1738 | 185.4 | MEROZOITE SURFACE PROTEIN CMZ-8 (FRAGMENT). | swissprot P09125 | ND |
| 1730 | 185.4 | HYPOTHETICAL 42.9 KD PROTEIN. | sptrembl O74814 | ND |
| 1740 | 185.3 | SUPEROXIDE-GENERATING NADPH OXIDASE FLAVOCYTOCHROME. | sptrembl Q9XYS3 | ND |
| 1741 | 185.2 | NNF1 PROTEIN. | swissprot P47149 | ND |
| 1742 | 184.7 | HYPOTHETICAL 57.5 KD PROTEIN IN VMA7-RPS25A INTERGENIC REGION. | swissprot P53214 | ND |

TABLE 1-continued

*Fusarium venenatum* ESTs

| Sequence Listing | zscore | Annotation | Database | Functional category |
|---|---|---|---|---|
| 1743 | 184.6 | TRANSITIONAL ENDOPLASMIC RETICULUM ATPASE HOMOLOG 2 (P97/CDC48 HOMOLOG 2). | swissnew P54812 | ND |
| 1744 | 184.4 | RNA BINDING PROTEIN (FRAGMENT). | tremblnew BAA83714 | ND |
| 1745 | 184.3 | HYPOTHETICAL PROTEIN MG096 | swissnew P47342 | ND |
| 1746 | 184.3 | Sequence A encoded by a portion of SA307. | geneseqp P60623 | ND |
| 1747 | 184.3 | MUCIN. | sptrembl Q28226 | ND |
| 1748 | 183.9 | MUCIN 2 PRECURSOR (INTESTINAL MUCIN 2). | swissprot Q02817 | ND |
| 1749 | 183.9 | CARBOXYPEPTIDASES PRECURSOR (EC 3.4.17.4) (YSCS) (GLY-X CARBOXYPEPTIDASE). | swissprot P27614 | ND |
| 1750 | 183.8 | HYPOTHETICAL 55.0 KD PROTEIN. | sptrembl P96824 | ND |
| 1751 | 183.2 | *Aspergillus nidulans* essential protein AN80. | geneseqp Y06416 | ND |
| 1752 | 183.1 | BETA-1,3-GLUCANOSYLTRANSFERASE. | sptrembl O59909 | ND |
| 1753 | 183.1 | RAD1. | tremblnew AAC95465 | ND |
| 1754 | 183.0 | HYPOTHETICAL 28.6 KD PROTEIN. | tremblnew CAB41006 | ND |
| 1755 | 182.9 | BDF1 PROTEIN. | swissprot P35817 | ND |
| 1756 | 182.8 | HYPOTHETICAL 57.2 KD PROTEIN. | sptrembl O68872 | ND |
| 1757 | 182.5 | F14B4.2 PROTEIN. | sptrembl Q19440 | ND |
| 1758 | 182.4 | PUTATIVE CLEAVAGE AND POLYADENYLATION SPECIFICITY FACTOR. | sptrembl O74740 | ND |
| 1759 | 182.3 | EXTENSIN CLASS II PRECURSOR (CELL WALL HYDROXYPROLINE-RICH GLYCOPROTEIN) (HRGP) (TOML-4). | sptrembl Q09084 | ND |
| 1760 | 182.2 | VOLTAGE-DEPENDENT P/9 TYPE CALCIUM CHANNEL ALPHA 1A SUBUNIT (FRAGMENT). | sptrembl O95387 | ND |
| 1761 | 182.1 | HEPATITIS A VIRUS CELLULAR RECEPTOR LONG FORM (HEPATITIS A VIRUS CELLULAR RECEPTOR 1 SHORT FORM). | sptrembl O46598 | ND |
| 1762 | 182.1 | Amino acid sequence of a human secreted protein. | geneseqp Y19477 | ND |
| 1763 | 181.9 | HEPATITIS A VIRUS RECEPTOR. | sptrembl O18984 | ND |
| 1764 | 181.9 | SIMILAR TO D. MELANOGASTER BRCORE-Q1-Z1 PROTEIN AND V. VIRUS PROTEIN A55. | sptrembl Q17782 | ND |
| 1765 | 181.8 | LATENT NUCLEAR ANTIGEN. | sptrembl Q9WRM2 | ND |
| 1766 | 181.8 | HOR1-17C-HORDEIN. | sptrembl Q40053 | ND |
| 1767 | 181.6 | HYPOTHETICAL 112.1 KD PROTEIN. | sptrembl O86637 | ND |
| 1768 | 181.6 | MITOCHONDRIAL TRANSCRIPTION FACTOR 1 PRECURSOR (MTTF1). | swissprot O60059 | ND |
| 1769 | 181.6 | PUTATIVE ACYL-COA DEHYDROGENASE | tremblnew CAB46788 | ND |
| 1770 | 181.5 | HYPOTHETICAL 83.7 KD PROTEIN C4F10.07C IN CHROMOSOME I. | sptrembl O36019 | ND |
| 1771 | 181.5 | EXTENSIN-LIKE PROTEIN. | tremblnew AAD55980 | ND |

TABLE 1-continued

_Fusarium venenatum_ ESTs

| Sequence Listing | zscore | Annotation | Database | Functional category |
|---|---|---|---|---|
| 1772 | 181.4 | PROLINE-RICH CELL WALL PROTEIN. | sptrembl Q39763 | ND |
| 1773 | 181.4 | FLGA insert stabilising polypeptide. | geneseqp W79128 | ND |
| 1774 | 181.4 | Hepatitis A virus receptor. | geneseqp R92803 | ND |
| 1775 | 181.2 | CONSERVED HYPOTHETICAL ZINC-FINGER PROTEIN. | sptrembl OQ4264 | ND |
| 1776 | 181.1 | HYPOTHETICAL 79.1 KD PROTEIN. | sptrembl O60161 | ND |
| 1777 | 181.1 | Rat 25-hydroxyvitamin D3-1-alpha-hydroxylase. | geneseqp W89552 | ND |
| 1778 | 181.0 | Collagen-like polymer. | geneseqp W57645 | ND |
| 1779 | 181.0 | PROBABLE METABOLITE TRANSPORT PROTEIN. | sptrembl O94342 | ND |
| 1780 | 180.8 | PUTATIVE MITOCHONDRIAL 60S RIBOSOMAL PROTEIN L31 PRECURSOR. | tremblnew CAB53083 | ND |
| 1781 | 180.7 | AMINOPEPTIDASE II (EC 3.4.11.-) (YSCII). | swissprot P32454 | ND |
| 1782 | 180.5 | HYPOTHETICAL 61.1 KD PROTEIN (FRAGMENT). | tremblnew CAB63715 | ND |
| 1783 | 180.5 | FLGA insert stabilising polypeptide. | geneseqp W79128 | ND |
| 1784 | 181.4 | HYPOTHETICAL 18.4 KD PROTEIN. | sptrembl Q9Y801 | ND |
| 1785 | 180.1 | A-AGGLUTININ ATTACHMENT SUBUNIT PRECURSOR. | swissprot P32323 | ND |
| 1786 | 180.1 | HYPOTHETICAL 62.9 KD PROTEIN. | sptrembl P74375 | ND |
| 1787 | 179.9 | PUTATIVE ACID PHOSPHATASE. | tremblnew CAB58405 | ND |
| 1788 | 179.4 | CHECKPOINT PROTEIN RAD17. | swissprot P50531 | ND |
| 1789 | 179.3 | Drosophila dCREB1 protein. | geneseqp R91295 | ND |
| 1790 | 178.7 | ABP32. | tremblnew BAA84922 | ND |
| 1791 | 178.5 | Human iduronate 2-sulphatase protein sequence. | geneseqp Y23982 | ND |
| 1792 | 178.5 | Q174 PROTEIN. | sptrembl O74567 | ND |
| 1793 | 178.3 | D9461.15P. | sptrembl Q04066 | ND |
| 1794 | 178.3 | SF16 ISOLOG. | sptrembl O22835 | ND |
| 1795 | 178.0 | SUCAB-LPD OPERON, SUCB AND 1 PD GENES. COMPLETE CDS. SUCA GENE PARTIAL CDS AND IS-150-LIKE ELEMENT 3' END (FRAGMENT). | sptrembl Q50992 | ND |
| 1796 | 177.6 | PUTATIVE TRANSCRIPTION INITIATION FACTOR IIA LARGE SUBUNIT. | tremblnew CAB57938 | ND |
| 1797 | 177.6 | SPLICING FACTOR, ARGININE/SERINE-RICH 2 (SPLICING FACTOR SC35) (SC-35) (SPLICING COMPONENT, 35 KD) (PR264 PROTEIN). | swissprot P30352 | ND |
| 1798 | 177.5 | DIMETHYLANILINE MONOOXYGENASE-LIKE PROTEIN. | tremblnew CAB43691 | ND |
| 1799 | 177.4 | PROTEOPHOSPHOGLYCAN PRECURSOR (FRAGMENT). | sptrembl Q9Y076 | ND |
| 1800 | 177.2 | SER/ARG-RELATED NUCLEAR MATRIX PROTEIN. | sptrembl O60585 | ND |
| 1801 | 177.2 | PUTATIVE PROLINE-RICH CELL WALL PROTEIN. | sptrembl O82327 | ND |
| 1802 | 177.1 | GLYCINE RICH RNA BINDING PROTEIN. | tremblnew CAB56042 | ND |

TABLE 1-continued

*Fusarium venenatum* ESTs

| Sequence Listing | zscore | Annotation | Database | Functional category |
|---|---|---|---|---|
| 1803 | 177.0 | N AMINO ACID TRANSPORT SYSTEM PROTEIN (METHYLTRYPTOPHAN RESISTANCE PROTEIN). | swissprot P38680 | ND |
| 1804 | 176.9 | (VSP-3) PRECURSOR. | sptrembl Q39620 | ND |
| 1805 | 176.7 | IDI-2 PRECURSOR. | sptrembl O74220 | ND |
| 1806 | 176.6 | HYPOTHETICAL 35.1 KD PROTEIN. | tremblnew CAB38264 | ND |
| 1807 | 176.6 | FERRIC REDUCTASE. | sptrembl Q9Y861 | ND |
| 1808 | 176.5 | ANNEXIN XIV. | sptrembl O59907 | ND |
| 1809 | 176.5 | MUCIN PRECURSOR (FRAGMENT). | sptrembl Q62635 | ND |
| 1810 | 176.4 | SINGLE-STRANDED DNA-BINDING PROTEIN. | sptrembl P77953 | ND |
| 1811 | 176.4 | COSMID C25H3. | sptrembl Q18187 | ND |
| 1812 | 176.3 | PROBABLE EUKARYOTIC TRANSLATION INITIATION FACTOR 5 (EIF-5). | swissprot Q09689 | ND |
| 1813 | 176.2 | MICROTUBULE ASSOCIATED PROTEIN (DJ406A7.2.1) (MICROTUBULE ASSOCIATED PROTEIN E-MAP-115). | sptrembl Q14244 | ND |
| 1814 | 176.2 | (VSP-3) PRECURSOR. | sptrembl Q39620 | ND |
| 1815 | 1762 | HYPOTHETICAL PROTEIN MJ1055. | swissprot Q58455 | ND |
| 1816 | 176.1 | HYPOTHETICAL 81.2 KD PROTEIN. | sptrembl O81714 | ND |
| 1817 | 175.8 | STRONG SIMILARITY TO HUMAN REV INTERACTING PROTEIN RIP-1. | sptrembl O74777 | ND |
| 1818 | 175.7 | PUTATIVE TRANSCRIPTIONAL REGULATOR. | sptrembl O13337 | ND |
| 1819 | 175.5 | F23N19.12. | tremblnew AAF19547 | ND |
| 1820 | 175.4 | CONSERVED HYPOTHETICAL PROTEIN. | tremblnew CAB53729 | ND |
| 1821 | 175.4 | VITELLOGENIN PRECURSOR. | sptrembl Q9YGK0 | ND |
| 1822 | 175.3 | GP80. | sptrembl P87519 | ND |
| 1823 | 175.3 | YEAST REDUCED VIABILITY UPON STARVATION PROTEIN 161 HOMOLOG, IMPLICATED IN CELL GROWTH AND CYTOSKELETAL OR GANISATION. | tremblnew CAA22181 | ND |
| 1824 | 175.1 | MUTATOR-LIKE TRANSPOSASE. | tremblnew AAD23701 | ND |
| 1825 | 175.0 | MINI-COLLAGEN PRECURSOR (ISOFORM 1). | sptrembl Q00484 | ND |
| 1826 | 174.9 | CYTOSKELETON ASSEMBLY CONTROL PROTEIN SLA2P. | sptrembl O93959 | ND |
| 1827 | 174.8 | SHP1 PROTEIN. | swissprot P34223 | ND |
| 1828 | 174.7 | CYTOCHROME C OXIDASE POLYPEPTIDE IV PRECURSOR (EC 1.9.3.1). | swissprot P04037 | ND |
| 1829 | 174.6 | CUT1 PROTEIN. | swissnew P18296 | ND |
| 1830 | 174.6 | Extracellular domain of prostate specific membrane antigen (PSMA). | geneseqp W47155 | ND |
| 1831 | 174.1 | HYPOTHETICAL PROTEIN (FRAGMENT). | tremblnew CAB61270 | ND |
| 1832 | 173.8. | ARABINOGALACTAN-LIKE PROTEIN. | sptrembl Q41071 | ND |
| 1833 | 173.8 | PROLINE-RICH. | sptrembl Q94273 | ND |
| 1834 | 173.7 | HYDROXYPROLINE-RICH GLYCOPROTEIN. | sptrembl Q42366 | ND |

TABLE 1-continued

*Fusarium venenatum* ESTs

| Sequence Listing | zscore | Annotation | Database | Functional category |
|---|---|---|---|---|
| 1835 | 173.4 | S-PHASE DELAYING PROTEIN 1 (P14 PROTEIN). | sptrembl Q10585 | ND |
| 1836 | 173.4 | SERINE-RICH PROTEIN. | sptrembl O94317 | ND |
| 1837 | 173.2 | RECF (FRAGMENT). | sptrembl O30497 | ND |
| 1838 | 173.2 | BETA-GALACTOSIDASE ALPHA-PEPTIDE (FRAGMENT). | sptrembl Q57170 | ND |
| 1839 | 173.1 | Mouse liver cancer-originated culture cell growth factor. | geneseqp W37482 | ND |
| 1840 | 172.9 | *T. gondii* immunogenic protein. | geneseqp Y29060 | ND |
| 1841 | 172.8 | 156AA LONG. HYPOTHETICAL PROTEIN. | sptrembl Q9YAB4 | ND |
| 1842 | 172.7 | AKT2. | sptrembl O93801 | ND |
| 1843 | 172.7 | ELGA insert stabilising polypeptide. | geneseqp W79128 | ND |
| 1844 | 172.6 | CHORD CONTAINING PROTEIN-1. | tremblnew AAF18437 | ND |
| 1845 | 172.4 | UL36. | sptrembl Q65553 | ND |
| 1846 | 172.3 | CELL WALL-PLASMA MEMBRANE LINKER PROTEIN. | sptrembl Q39353 | ND |
| 1847 | 172.2 | SER/ARG-RELATED NUCLEAR MATRIX PROTEIN. | sptrembl O60585 | ND |
| 1848 | 172.2 | F23C8.6 PROTEIN. | tremblnew AADO3134 | ND |
| 1849 | 172.1 | WW DOMAIN BINDING PROTEIN II. | sptrembl O88539 | ND |
| 1850 | 171.8 | EXTENSIN. | sptrembl Q06802 | ND |
| 1851 | 171.7 | F24O1.18. | sptrembl O48809 | ND |
| 1852 | 171.7 | HYPOTHETICAL 30.6 KD PROTEIN IN SCP160-SMC3 INTERGENIC REGION PRECURSOR. | swissprot P47032 | ND |
| 1853 | 171.4 | GLUTENIN, LOW MOLECULAR WEIGHT SUBUNIT PRECURSOR. | swissprot P10385 | ND |
| 1854 | 171.4 | HYPOTHETICAL 17.5 KD PROTEIN C22H10.02.IN CHROMOSOME I. | swissprot Q10296 | ND |
| 1855 | 171.2 | HYPOTHETICAL 105.9 KD PROTEIN IN RPL15B-GCR3 INTERGENIC REGION. | swissprot P39523 | ND |
| 1856 | 171.2 | POSSIBLE PROTEIN METHYLTRANSFERASE; | sptrembl O27940 | ND |
| 1857 | 171.2 | BIFUNCTIONAL ASPARTOKINASE/HOMOSERINE DEHYDROGENASE I (AK1-HD1) [INCLUDES: ASPARTOKINASE (EC 2.7.2.4); HOMOSERINE DEHYDROGENASE (EC 1.1.1.3)]. | swissnew P27725 | ND |
| 1858 | 171.0 | ZETA-CRYSTALLIN. | sptrembl O97764 | ND |
| 1859 | 170.9 | CCP PROTEIN. | sptrembl Q9WX60 | ND |
| 1860 | 170.9 | 36.1 KD PROTEIN IN BUD2-MIF2 INTERGENIC REGION. | swissprot P33324 | ND |
| 1861 | 170.8 | WP6 PRECURSOR. | sptrembl Q39492 | ND |
| 1862 | 170.7 | HISTIDYL-TRNA SYNTHETASE. | sptrembl O43011 | ND |
| 1863 | 170.6 | CODED FOR BY C. ELEGANS CDNA YK127B8.5. | sptrembl Q20648 | ND |
| 1864 | 170.2 | TRICHODIENE SYNTHASE. (EC 4.1.99.6) (SESQUITERPENE CYCLASE) (TS). | swissprot P27679 | ND |
| 1865 | 170.2 | HYPOTHETICAL 46.6 KD PROTEIN. | sptrembl O74477 | ND |
| 1866 | 170.2 | HEPB PROTEIN. | sptrembl O22016 | ND |
| 1867 | 170.2 | CHINASE | sptrembl Q92223 | ND |

TABLE 1-continued

*Fusarium venenatum* ESTs

| Sequence Listing | zscore | Annotation | Database | Functional category |
|---|---|---|---|---|
| 1868 | 170.2 | NADH-UBIQUINONE OXIDOREDUCTASE B12 SUBUNIT (EC 1.6.5.3) (EC 1.6.99.3) (COMPLEX I-B12) (CI-B12). | swissprot O43676 | ND |
| 1869 | 170.2 | ANTIGEN LPMC-61 (FRAGMENT). | swissprot P15714 | ND |
| 1870 | 170.1 | HYPOTHETICAL 96.0 KD PROTEIN. | sptrembl O74365 | ND |
| 1871 | 170.1 | HYPOTHETICAL 23.4 KD PROTEIN IN CAJ1-HOM3 INTERGENIC REGION. | swissprot P40033 | ND |
| 1872 | 170.0 | ASPARTIC PROTEINASE PRECURSOR (EC 3.4.23.-) (GCSAP). | sptrembl Q00895 | ND |
| 1873 | 169.9 | mSOS1 protein. | geneseqp R84638 | ND |
| 1874 | 169.0 | PROTEOPHOSPHOGLYCAN PRECURSOR (FRAGMENT). | sptrembl Q9Y076 | ND |
| 1875 | 169.9 | HYDROXYPROLINE-RICH GLYCOPROTEIN. | sptrembl Q41814 | ND |
| 1876 | 169.7 | HEPATITIS A VIRUS RECEPTOR. | sptrembl O18984 | ND |
| 1877 | 160.7 | DNA-DIRECTED RNA POLYMERASE II 13.6 KD POLYPEPTIDE (EC 2.7.7.6) (B13.6). | swissprot P38902 | ND |
| 1878 | 169.7 | L4171.3. | sptrembl Q15837 | ND |
| 1879 | 169.6 | HYPOTHETICAL 20.3 KD PROTEIN C25H1.03 IN CHROMOSOME I. | sptrembl O13978 | ND |
| 1880 | 169.6 | ARABINOGALACTAN-PROTEIN | sptrembl Q9ZT15 | ND |
| 1881 | 169.5 | ACROSIN PRECURSOR (EC 3.4.21.10). | swissprot P48038 | ND |
| 1882 | 169.5 | 785AA LONG HYPOTHETICAL HYUA. | sptrembl Q9YCC8 | ND |
| 1883 | 169.3 | COA TRANSFERASE, SUBUNIT B. | tremblnew AAF12248 | ND |
| 1884 | 169.3 | LAMININ ALPHA CHAIN PRECURSOR. | swissprot Q00174 | ND |
| 1885 | 169.2 | SEQ ID NO 383 from WO9922243. | geneseqp Y19665 | ND |
| 1886 | 168.9 | Human heart muscle specific protein | geneseqp W90172 | ND |
| 1887 | 168.7 | COMES FROM THIS GENE. | sptrembl O23054 | ND |
| 1888 | 168.7 | ACIDIC PROLINE-RICH PROTEIN PRP25 PRECURSOR (FRAGMENT). | swissprot P10164 | ND |
| 1889 | 168.7 | METAL HOMEOSTATIS PROTEIN BSD2. | swissprot P38356 | ND |
| 1890 | 168.7 | HIGH MOLECULAR MASS NUCLEAR ANTIGEN (FRAGMENT). | sptrembl O57580 | ND |
| 1891 | 168.6 | HYPOTHETICAL 26.1 KD PROTEIN C23113.12C IN CHROMOSOME I. | sptrembl O13942 | ND |
| 1892 | 168.6 | Sugar beet chitinase 1. | geneseqp R28150 | ND |
| 1893 | 168.6 | KEXIN. | sptrembl O94096 | ND |
| 1894 | 168.6 | HYPOTHETICAL PROTEIN (FRAGMENT). | sptrembl Q38962 | ND |
| 1895 | 168.5 | 124AA LONG HYPOTHETICAL PROTEIN. | sptrembl Q9YCC9 | ND |
| 1896 | 168.5 | PUTATIVE ETHANOLAMINEPHOSPHO TRANSFERASE (EC 2.7.8.1) (ETHPT). | sptrembl O13901 | ND |
| 1897 | 168.5 | WP6 PRECURSOR. | sptrembl Q39492 | ND |
| 1898 | 168.4 | HEPATITIS A VIRUS CELLULAR RECEPTOR 1 LONG FORM (HEPATITIS A VIRUS CELLULAR RECEPTOR 1 SHORT FORM). | sptrembl O46598 | ND |

TABLE 1-continued

*Fusarium venenatum* ESTs

| Sequence Listing | zscore | Annotation | Database | Functional category |
|---|---|---|---|---|
| 1899 | 168.1 | PUTATIVE TRANSCRIPTION FACTOR. | tremblnew CAB43914 | ND |
| 1900 | 168.0 | BAV3 ORF3 product. | geneseqp R75758 | ND |
| 1901 | 167.8 | HYPOTHETICAL 27.2 KD PROTEIN IN GLS2-RPL26B INTERGENIC REGION. | swissprot P53220 | ND |
| 1902 | 167.8 | SIMILAR TO STF2P. | sptrembl Q06177 | ND |
| 1903 | 167.7 | EMBRYONIC/NEONATAL MYOSIN HEAVY CHAIN (FRAGMENT). | sptrembl Q28700 | ND |
| 1904 | 167.7 | PROTEIN TRANSLATION FACTOR SUII HOMOLOG. | swissprot O48650 | ND |
| 1905 | 167.7 | NONE. | sptrembl Q9XDF2 | ND |
| 1906 | 167.6 | MAGNESIUM-CHELATASE 60 KD SUBUNIT (MG-PROTOPORPHYRIN IX CHELATASE) (MG-CHELATASE SUBUNIT D). | swissnew P26175 | ND |
| 1907 | 167.5 | 264AA LONG HYPOTHETICAL PROTEIN. | sptrembl Q9YCX9 | ND |
| 1908 | 167.5 | SERINE/THREONINE PROTEIN KINASE PKAA (EC 2.7.1.-). | swissnew P54739 | ND |
| 1909 | 167.4 | PROTEOPHOSPHOGLYCAN (FRAGMENT). | sptrembl Q9Y075 | ND |
| 1910 | 167.3 | HEPATITIS A VIRUS CELLULAR RECEPTOR I LONG FORM (HEPATITIS A VIRUS CELLULAR RECEPTOR 1 SHORT FORM). | sptrembl O46598 | ND |
| 1911 | 167.3 | CDC2-LIKE PROTEIN KINASE (EC 2.7.1.). | sptrembl O76541 | ND |
| 1912 | 167.1 | PUTATIVE SECRETED PROLINE-RICH PROTEIN. | tremblnew CAB63180 | ND |
| 1913 | 167.1 | ARGININE/SERINE-RICH PROTEIN. | tremblnew AAF19004 | ND |
| 1914 | 166.9 | CUTICLE COLLAGEN | swissprot P34804 | ND |
| 1915 | 166.9 | HYPOTHETICAL PROTEIN C30B4.01C IN CHROMOSOME II (FRAGMENT). | sptrembl P87179 | ND |
| 1916 | 166.7 | HISTONE H1. | swissprot P37218 | ND |
| 1917 | 166.6 | NUM1 PROTEIN. | sptrembl Q40363 | ND |
| 1918 | 166.5 | ANTIGEN EM13. | sptrembl Q07840 | ND |
| 1919 | 166.2 | Y18D10A 8 PROTEIN. | sptrembl Q9XW13 | ND |
| 1920 | 166.2 | PARAMECIUM 3 GENE FRAGMENT FOR G SURFACE ANTIGEN (FRAGMENT). | sptrembl Q94699 | ND |
| 1921 | 166.2 | HYPOTHETICAL 6.1 KD PROTEIN C03B1.10 IN CHROMOSOME X. | swissprot Q11116 | ND |
| 1922 | 166.2 | OVERLAPPING PROTEIN. | sptrembl O91259 | ND |
| 1923 | 166.2 | PUTATIVE SMALL BASIC PROTEIN. | sptrembl O55724 | ND |
| 1924 | 166.1 | T01B7.8 PROTEIN. | sptrembl Q22048 | ND |
| 1925 | 166.1 | 50S RIBOSOMAL PROTEIN L34. | sptrembl O21276 | ND |
| 1926 | 166.0 | MUCIN (FRAGMENT). | sptrembl Q28501 | ND |
| 1927 | 166.0 | 34 KD ANTIGENIC PROTEIN. | swissprot Q04959 | ND |
| 1928 | 165.9 | AQUAPORIN-3. | sptrembl Q9YH65 | ND |
| 1929 | 165.7 | CG1-41 PROTEIN. | sptrembl Q9Y358 | ND |
| 1930 | 165.6 | HIGH MOBILITY GROUP-LIKE NUCLEAR PROTEIN 2. | swissprot P32495 | ND |
| 1931 | 165.6 | PGRS-FAMILY PROTEIN. | sptrembl O53395 | ND |
| 1932 | 165.5 | PUTATIVE ZINC METALLOPEPTIDASE (FRAGMENT). | tremblnew CAB54809 | ND |

TABLE 1-continued

*Fusarium venenatum* ESTs

| Sequence Listing | zscore | Annotation | Database | Functional category |
|---|---|---|---|---|
| 1933 | 165.5 | Human VEGF-C truncated fragment 4. | geneseqp W86225 | ND |
| 1934 | 165.5 | SALIVARY GLUE PROTEIN SGS-3 PRECURSOR. | swissprot P13728 | ND |
| 1935 | 165.4 | U2 SMALL NUCLEAR RIBONUCLEOPROTEIN AUXILIARY FACTOR 35 KD SUBUNIT RELATED-PROTEIN 1. | swissprot Q15695 | ND |
| 1936 | 165.4 | N2,N2-DIMETHYLGUANOSINE TRNA METHYLTRANSFERASE. | tremblnew CAA20101 | ND |
| 1937 | 165.2 | 180AA LONG HYPOTHETICAL PROTEIN. | sptrembl Q9YBV8 | ND |
| 1938 | 165.2 | ADK1. | sptrembl Q97WB3 | ND |
| 1939 | 165.1 | D2089.1 PROTEIN. | sptrembl O01159 | ND |
| 1940 | 165.0 | Y44E3A.5 PROTEIN | tremblnew AAC78231 | ND |
| 1941 | 165.0 | C15A11.1 PROTEIN. | sptrembl Q93208 | ND |
| 1942 | 164.9 | EXTENSIN-LIKE PROTEIN. | tremblnew CAB40769 | ND |
| 1943 | 164.8 | RETINA-DERIVED POU-DOMAIN FACTOR-1 (FRAGMENT). | tremblnew AAC83404 | ND |
| 1944 | 164.8 | 203AA LONG HYPOTHETICAL PROTEIN. | sptrembl Q9YAY3 | ND |
| 1945 | 164.7 | HEPATITIS A VIRUS CELLULAR RECEPTOR 1 LONG FORM (HEPATITIS A VIRUS CELLULAR RECEPTOR 1 SHORT FORM). | sptrembl O46598 | ND |
| 1946 | 164.7 | HYPOTHETICAL 79.1 KD PROTEIN | sptrembl O60161 | ND |
| 1947 | 164.7 | UNKNOWN PROTEIN. | sptrembl O04210 | ND |
| 1948 | 164.6 | INTESTINAL MUCIN (FRAGMENT). | sptrembl Q14883 | ND |
| 1949 | 164.6 | PROTEOPHOSPHOGLYCAN (FRAGMENT). | sptrembl Q9YO75 | ND |
| 1950 | 164.3 | DBP-5 NUCLEAR PROTEIN. | sptrembl Q14120 | ND |
| 1951 | 164.3 | HYPOTHETICAL 45.9 KD PROTEIN RV2067C. | swissprot Q10675 | ND |
| 1952 | 164.2 | ALPHA/BETA-GLIADIN CLONE PW1215 PRECURSOR (PROLAMIN). | swissprot PO4726 | ND |
| 1953 | 164.2 | NONSTRUCTURAL PROTEIN 1 (FRAGMENT). | sptrembl O10460 | ND |
| 1954 | 164.2 | VICILIN-LIKE PROTEIN PRECURSOR (FRAGMENT). | tremblnew AAF18269 | ND |
| 1955 | 164.1 | MITOCHONDRIAL PROTEIN CYT-4. | swissprot P47950 | ND |
| 1956 | 164.1 | 134AA LONG HYPOTHETICAL PROTEIN. | sptrembl Q9Y9Q5 | ND |
| 1957 | 164.1 | SIMILARITY TO DROSOPHILA HOMEOTIC GENE REGULATOR BRM. | sptrembl P91094 | ND |
| 1958 | 164.0 | PROBABLE TRANSLATION INITIATION FACTOR EIF-2B DELTA SUBUNIT (EIF-2B GDP-GTP EXCHANGE FACTOR). | swissprot Q09924 | ND |
| 1959 | 103.9 | S2 RIBOSOMAL PROTEIN. | sptrembl O84687 | ND |
| 1960 | 163.9 | COSMID C34D4. | sptrembl Q18444 | ND |
| 1961 | 163.8 | HEPATITIS A VIRUS RECEPTOR. | sptrembl O18984 | ND |
| 1962 | 163.8 | PREDICTED INTEGRAL MEMBRANE PROTEIN. | sptrembl O96177 | ND |
| 1963 | 163.8 | Human bcl2 proto-oncogene wild type protein fragment 1. | geneseqp Y21104 | ND |

TABLE 1-continued

*Fusarium venenatum* ESTs

| Sequence Listing | zscore | Annotation | Database | Functional category |
|---|---|---|---|---|
| 1964 | 163.7 | ATP SYNTHASE GAMMA CHAIN, MITOCHONDRIAL PRECURSOR (EC 3.6.1.34). | swissnew P49377 | ND |
| | | T1J1.6 PROTEIN | sptrembl Q9ZP112 | ND |
| 1965 | 163.7 | PUTATIVE EXTENSIN. | sptrembl Q9ZN03 | ND |
| 1967 | 163.6 | F25C8.4 PROTEIN. | sptrembl Q9XV68 | ND |
| 1968 | 163.5 | PUTATIVE TRANSCRIPTIONAL REGULATOR, ZINC-FINGER. BINUCLEAR CLUSTERDOMAIN. | tremblnew CAA92308 | ND |
| 1969 | 163.3 | HYPOTHETICAL 29.3 KD PROTEIN (ORF92). | swissprot O10341 | ND |
| 1970 | 163.3 | LUN (LUN PROTEIN). | sptrembl O54743 | ND |
| 1971 | 163.1 | DOLICHYL-DIPHOSPHOOLIGOSACCHARIDE--PROTEIN GLYCOSYLTRANSFERASE ALPHA SUBUNIT PRECURSOR (EC 2.4.1.119) (OLIGOSACCHARYL TRANSFERASE ALPHA SUBUNIT) (OLIGOSACCHARYL TRANSFERASE 64 KD SUBUNIT). | swissprot P41543 | ND |
| 1972 | 163.0 | Human alpha-1 (XVIII chain NC1 domain variant HU18(NC1-493). | geneseqp W92294 | |
| 1973 | 162.9 | CHROMOSOME XII READING FRAME ORF YLR002C. | sptrembl Q07896 | ND |
| 1974 | 162.8 | DRPLA. | sptrembl O35126 | ND |
| 1975 | 162.8 | COLLAGEN ALPHA 1 (VIII) CHAIN PRECURSOR. | swissprot Q00780 | ND |
| 1976 | 162.7 | DIACYLGLYCEROL CHOLINEPHOSPHOTRANS-FERASE (EC 2.7.8.2) ESN-1.2-DIACYLGLYCEROL CHOLINEPHOSPHOTRANS-FERASE (CHOPT). | swissprot P17898 | ND |
| 1977 | 162.7 | Maize cinnamyl alcohol dehydrogenase. | geneseqp Y05667 | ND |
| 1978 | 162.7 | SALIVARY GLUE PROTEIN SGS-3 PRECURSOR. | swissprot P13729 | ND |
| 1979 | 162.6 | FROM BASES 1830199 TO 1840304 (SECTION 160 OF 400) OF THE COMPLETE GENOME (SECTION 160 OF 400). | sptrembl P77788 | ND |
| 1980 | 162.5 | SKIN SECRETORY PROTEIN XP2 PRECURSOR (APEG PROTEIN). | swissnew P17437 | ND |
| 1981 | 162.5 | PRION PROTEIN PRECURSOR (FRAGMENT). | tremblnew AAD47P45 | ND |
| 1982 | 162.5 | HYPOTHETICAL 27.4 KD PROTEIN IN HIII-CDC8 INTERGENIC REGION. | swissprot P47115 | ND |
| 1983 | 162.1 | HYPOTHETICAL 53.7 KD PROTEIN IN SGA1-KTR7 INTERGENIC REGION. | swissprot P40501 | ND |
| 1984 | 162.4 | S1B 124 intestinal mucin. | geneseqp R12601 | ND |
| 1985 | 162.4 | ALPHA-GLIADIN STORAGE PROTEIN. | sptrembl Q41529 | ND |
| 1986 | 162.4 | GASTRIC MUCIN (FRAGMENT). | sptrembl Q29071 | ND |

TABLE 1-continued

Fusarium venenatum ESTs

| Sequence Listing | zscore | Annotation | Database | Functional category |
|---|---|---|---|---|
| 1987 | 162.3 | BRANCHED-CHAIN AMINO ACID AMINOTRANSFERASE. MITOCHONDRIAL PRECURSOR (EC 2.6.1.42) (BCAT(M)). | swissprot O15382 | ND |
| 1988 | 162.2 | PENICILLIN-BINDING PROTEIN 1. | tremblnew AAF10050 | ND |
| 1989 | 162.1 | N-WASP. | sptrembl O00401 | ND |
| 1990 | 162.1 | REGULATORY PROTEIN E2. | sptrembl O56937 | ND |
| 1991 | 162.0 | HYPOTHETICAL 25.3 KD PROTEIN IN TIM23-ARE2 INTERGENIC REGION. | swissprot P53721 | ND |
| 1992 | 162.0 | Hepatitis B virus E antigen (wild-type). | geneseqp R98878 | ND |
| 1993 | 162.0 | MYOCYTE ENHANCER FACTOR 2A (FRAGMENT). | sptrembl O97865 | ND |
| 1994 | 162.0 | THIOREDOXIN. | swissprot P42115 | ND |
| 1995 | 161.9 | M. tuberculosis immunogenic polypeptide TbH-29. | geneseqp W81726 | ND |
| 1996 | 161.8 | PROLINE RICH PROTEIN. | sptrembl O22514 | ND |
| 1997 | 161.5 | VIRION PROTEIN. | sptrembl P89479 | ND |
| 1998 | 161.3 | ORF1 (FRAGMENT). | sptrembl Q9W9H9 | ND |
| 1999 | 161.2 | Artificial recognition sequence 5. | geneseqp W43028 | ND |
| 2000 | 161.2 | LOW MOLECULAR WEIGHT GLUTENIN (FRAGMENT). | sptrembl O41552 | ND |
| 2001 | 161.2 | HYPOTHETICAL 20.8 KD PROTEIN. | sptrembl O53905 | ND |
| 2002 | 161.1 | ORFAB. | sptrembl Q9X982 | ND |
| 2003 | 161.1 | HEPATITIS A VIRUS CELLULAR RECEPTOR 1 LONG FORM (HEPATITIS A VIRUS CELLULAR RECEPTOR 1 SHORT FORM) | sptrembl O46597 | ND |
| 2004 | 161.0 | LOW MOLECULAR WEIGHT E GLUTENIN (FRAGMENT). | sptrembl Q41551 | ND |
| 2005 | 160.9 | Intestinal mucin deduced from clone SMUC 87. | geneseqp R07674 | ND |
| 2006 | 160.9 | HYDROXYPROLINE-RICH GLYCOPROTEIN. | sptrembl Q42366 | ND |
| 2007 | 160.8 | PUTATIVE SPLICING FACTOR. ARGININE SERINE-RICH 2 (SPLICING FACTOR SC35) (SC-35) (SPLICING COMPONENT 35 KD) | swissprot Q09511 | ND |
| 2008 | | ACETAMIDASE REGULATORY PROTEIN. | swissprot P15699 | ND |
| 2009 | 160.7 | GAGA FACTOR CLASS A-ISOFORM. | sptrembl O76940 | ND |
| 2010 | 160.6 | Enzyme donor polypeptide, ED8. | geneseqp R11772 | ND |
| 2011 | 160.6 | PRP2. | geneseqp R29163 | ND |
| 2012 | 160.4 | PUTATIVE SNRNP PROTEIN. | tremblnew CAB45810 | ND |
| 2013 | 160.4 | PHOSPHATE PERMEASE. | sptrembl O74630 | ND |
| 2014 | 160.4 | ORF68. | tremblnew AAF05182 | ND |
| 2015 | 160.3 | LARGEST SUBUNIT OF THE RNA POLYMERASE 11 COMPLEX. | sptrembl Q0XZS2 | ND |
| 2016 | 160.3 | TOLA PROTEIN. | sptrembl Q9WWX1 | ND |

TABLE 1-continued

*Fusarium venenatum* ESTs

| Sequence Listing | zscore | Annotation | Database | Functional category |
|---|---|---|---|---|
| 2017 | 160.3 | HYPOTHETICAL 81.2 KD PROTEIN. | sptrembl O81714 | ND |
|  |  | ANTER-SPECIFIC PROLINE-RICH PROTEIN APG (PROTEIN CEX) (FRAGMENT). | swissprot P40603 | ND |
| 2019 | 160.2 | F2202.16. | sptrembl Q9ZWD5 | ND |
| 2020 | 160.2 | DNA-DIRECTED RNA POLYMERASE II LARGEST SUBUNIT (EC 2.7.7.6) (RPB1) (FRAGMENT). | swissprot P11414 | ND |
| 2021 | 160.1 | SALIVARY PROTEIN MSG2. ISOFORM ALPHA PRECURSOR. | sptrembl O09133 | ND |
| 2022 | 160.1 | 121AA LONG HYPOTHETICAL PROTEIN. | sptrembl Q9YAL7 | ND |
| 2023 | 160.0 | C49F8.1 PROTEIN. | sptrembl Q18710 | ND |
| 2024 | 160.0 | PUTATIVE TRANSCRIPTION INITIATION FACTOR TFIID SUBUNIT. | tremblnew CAB65604 | ND |
| 2025 | 160.0 | LET-653 MUCIN LIKE PROTEIN. | sptrembl Q27394 | ND |
| 2026 | 159.9 | *Rhodococcus rhodochrous* LMGP-18079 cis-epoxysuccinate hydrolase. | geneseqp Y04477 | ND |
| 2027 | 159.9 | REGULATORY PROTEIN E2. | swissprot P06422 | ND |
| 2028 | 159.8 | GAMMA-GLIADIN (GLIADIN B-III) (FRAGMENT). | swissprot P04730 | ND |
| 2029 | 159.7 | ORF1. | sptrembl O96853 | ND |
| 2030 | 159.7 | FATTY ACID COA LIGASE | sptrembl O60135 | ND |
| 2031 | 159.4 | EF-HAND PROTEIN. | sptrembl Q09196 | ND |
| 2032 | 159.4 | PROLINE RICH PROTEIN PRECURSOR. | sptrembl Q43558 | ND |
| 2033 | 159.4 | HYPOTHETICAL 37.4 KD PROTEIN | sptrembl O25304 | ND |
| 2034 | 150.4 | PUTATIVE PROLINE-RICH CELL WALL PROTEIN. | sptrembl O82327 | ND |
| 2035 | 159.3 | IMMEDIATE-EARLY PROTEIN 1E180. | swissprot P33470 | ND |
| 2036 | 159.2 | EARLY NODULIN 20 PRECURSOR (N-20). | swissprot P03329 | ND |
| 2037 | 159.2 | Candida CaRhol protein. | geneseqp W30379 | ND |
| 2038 | 159.1 | SALIVARY GLUE PROTEIN SGS-3 PRECURSOR. | swissprot P02840 | ND |
| 2039 | 159.0 | PUTATIVE PROLINE-RICH CELL WALL PROTEIN. | sptrembl O82327 | ND |
| 2040 | 158.9 | PROLINE RICH PROTEIN. | sptrembl Q91810 | ND |
| 2041 | 158.9 | RETINA-DERIVED POU-DOMAIN FACTOR-1 (FRAGMENT). | tremblnew AAC83404 | ND |
| 2042 | 158.9 | HYPOTHETICAL 9.3 KD PROTEIN. | sptrembl O59754 | ND |
| 2043 | 158.8 | Hepatitis A virus receptor. | geneseqp R92803 | ND |
| 2044 | 158.8 | BETA-LACTAMASE PRECURSOR (EC 3.5.2.6) (CEPHALOSPORINASE). | swissnew O05465 | ND |
| 2045 | 158.7 | FISSION YEAST DNA FOR CHROMOSOME II COSMID 1228 SEQUENCE. | sptrembl P78948 | ND |
| 2046 | 158.6 | SERUM OPACITY FACTOR PRECURSOR (FRAGMENT). | tremblnew AAD31504 | ND |
| 2047 | 158.6 | F17L24.2 PROTEIN. | sptrembl Q9ZQ16 | ND |
| 2048 | 158.6 | F24J5.15 PROTEIN. | tremblnew AAD49981 | ND |
| 2049 | 158.5 | SMUC-41 intestinal mucin. | geneseqp R12535 | ND |
| 2050 | 158.4 | ULTRA HIGH SULFUR KERATIN. | sptrembl O75690 | ND |
| 2051 | 158.3 | MUCIN (FRAGMENT). | sptrembl Q28501 | ND |

TABLE 1-continued

*Fusarium venenatum* ESTs

| Sequence Listing | zscore | Annotation | Database | Functional category |
|---|---|---|---|---|
| 2052 | 158.3 | HYPOTHETICAL 35.1 KD PROTEIN. | tremblnew CAB38264 | ND |
| 2053 | 158.2 | ORF-1 protein sequence from BamH1 fragment of HVT. | geneseqp W03546 | ND |
| 2054 | 58.1 | (VSP-3) PRECURSOR. | sptrembl Q39620 | ND |
| 2055 | 158.1 | PUTATIVE TRNA-SPLICING ENDONUCLEASE SUBUNIT. | sptrembl O74908 | ND |
| 2056 | 158.1 | INNER CENTROMERE PROTEIN INCENP. | sptrembl Q9WU62 | ND |
| 2057 | 158.0 | COLLAGEN TYPE XVIII (FRAGMENT) | tremblnew BAA34201 | ND |
| 2058 | 158.0 | HYPOTHETICAL PROTEIN C31G5.01 IN CHROMOSOME I (FRAGMENT). | sptrembl O14102 | ND |
| 2059 | 157.9 | PROFILIN P. | swissprot P18322 | ND |
| 2060 | 157.9 | SIMILAR TO BETA-CHIMAFRIN | sptrembl O01825 | ND |
| 2061 | 157.8 | PUTATIVE TETR TRANSCRIPTIONAL REGULATOR. | tremblnew CAB46789 | ND |
| 2062 | 157.8 | CD27L RECEPTOR PRECURSOR (T-CELL ACTIVATION ANTIGEN CD27). | swissprot P41272 | ND |
| 2063 | 157.7 | EXTENSIN CLASS 1 PROTEIN PRECURSOR (EXTENSIN-LIKE PROTEIN). | sptrembl Q41707 | ND |
| 2064 | 157.6 | GASTRIC MUCIN (FRAGMENT). | sptrembl Q29070 | ND |
| 2065 | 157.6 | F24J5.8 PROTEIN. | tremblnew AAD49974 | ND |
| 2066 | 157.6 | CHIMERIC AFGP/TRYPSINOGEN-LIKE SERINE PROTEASE PRECURSOR (FRAGMENT). | sptrembl Q9W618 | ND |
| 2067 | 157.4 | 5'-NUCLEOTIDASE (NT5). | sptrembl O29385 | ND |
| 2068 | 157.4 | SIGNAL RECOGNITION PARTICLE 72 KD PROTEIN HOMOLOG (SRP72). | swissprot O59787 | ND |
| 2069 | 157.4 | HYPOTHETICAL 89.3 KD PROTEIN. | sptrembl O96234 | ND |
| 2070 | 157.3 | MYOSIN 1 HEAVY CHAIN. | sptrembl Q00647 | ND |
| 2071 | 157.2 | W02A2.5 PROTEIN. | sptrembl Q9XUB4 | ND |
| 2072 | 157.2 | GONADOTROPIN INDUCIBLE TRANSCRIPTION REPRESSOR-1 (FRAGMENT). | tremblnew BAA86987 | ND |
| 2073 | 157.2 | HYPOTHETICAL 17.6 KD PROTEIN IN NPR1-RPS3 INTERGENIC REGION. | swissprot P53880 | ND |
| 2074 | 157.1 | HYPOTHETICAL 33.9 KD ZINC FINGER PROTEIN C14C4.06C IN CHROMOSOME I. | sptrembl O13713 | ND |
| 2075 | 157.1 | GERM CELL SPECIFIC Y-BOX BINDING PROTEIN. | sptrembl Q9Y2T7 | ND |
| 2076 | 157.0 | POLY-UBIQUITIN. | sptrembl O59964 | ND |
| 2077 | 157.0 | MULTIDOMAIN PRESYNAPTIC CYTOMATRIX PROTEIN PICCOLO. | tremblnew AAF07822 | ND |
| 2078 | 157.0 | GASTRIC MUCIN (FRAGMENT). | sptrembl Q29070 | ND |
| 2080 | 156.9 | PROBABLE PROTEIN DISULFIDE ISOMERASE ER-60 PRECURSOR (EC 5.3.4.1) (ERP60) (58 KD MICROSOMAL PROTEIN) (P58) (HIP-70) (Q-2). | swissprot P11598 | ND |

TABLE 1-continued

*Fusarium venenatum* ESTs

| Sequence Listing | zscore | Annotation | Database | Functional category |
|---|---|---|---|---|
| 2081 | 156.9 | HUMAN DNA SEQUENCE FROM CLONE 1177E19 ON CHROMOSOME 1P36.12 36.31. CONTAINS THE 3' PART OF THE DNA-BINDING ZINC FINGER PROTEIN RIZ GENE. ESTS. ISLAND. | tremblnew CAB37643 | ND |
| 2082 | 1568 | RO2E11.1PROTEIN. | sptrembl O16364 | ND |
| 2083 | 156.8 | YSY6 PROTEIN. | swissprot P38374 | ND |
| 2084 | 156.7 | PUTATIVE RNA-BINDING PROTEIN. | sptrembl O94260 | ND |
| 2085 | 156.7 | EARLY NODULIN 20 PRECURSOR (N-20). | swissprot P93329 | ND |
| 2036 | 156.6 | COAT PROTEIN AV1, AV2. AV3. REPLICATION-ASSOCIATED PROTEIN AC1, AC2, AC3, AC4 AND AC5 GENES, COMPLETE CDS. | sptrembl Q38543 | ND |
| 2087 | 156.6 | 121AA LONG HYPOTHETICAL PROTEIN. | sptrembl Q9YAL7 | ND |
| 2088 | 156.6 | HYDROXYNEUROSPORENE DEHYDROGENASE. | sptrembl Q50393 | ND |
| 2089 | 156.5 | Mouse signal transduction protein GRB-7. | geneseqp R80164 | ND |
| 2090 | 156.5 | ERPROT 213-21. | sptrembl O00302 | ND |
| 2091 | 156.5 | COSMID T09D3. | sptrembl Q23036 | ND |
| 2092 | 156.4 | Human secreted protein #3. | geneseqp Y36131 | ND |
| 2093 | 156.3 | PUTATIVE ZINC FINGER TRANSCRIPTION FACTOR OVO1. | sptrembl Q9WT12 | ND |
| 2094 | 156.3 | GTP-BINDING PROTEIN (RAN) (FRAGMENT). | sptrembl O13494 | ND |
| 2095 | 156.3 | GAMETOGENESIS EXPRESSED PROTEIN GEG-154. | swissprot P50636 | ND |
| 2096 | 156.3 | OOCYTE ZINC FINGER PROTEIN XLCOF8.4 (FRAGMENT). | swissprot P18753 | ND |
| 2097 | 156.2 | HYPOTHETICAL 14.1 KD PROTEIN IN CYR1-OST1 INTERGENIC REGION. | swissprot P47981 | ND |
| 2098 | 156.2 | HYPOTHETICAL 118.4 KD PROTEIN IN BAT2-DAL5 INTERGENIC REGION PRECURSOR. | swissprot P47179 | ND |
| 2099 | 156.2 | PR-VBETA1. | sptrembl Q64371 | ND |
| 2100 | 156.1 | HYPOTHETICAL 50.0 KD PROTEIN. | sptrembl Q04934 | ND |
| 2101 | 150.1 | *Mycobacterium* species protein sequence 50B. | geneseqp Y04998 | ND |
| 2102 | 156.1 | COBALAMIN SYNTHESIS PROTEIN. | sptrembl O30787 | ND |
| 2103 | 156.0 | ZINC FINGER PROTEIN. | sptrembl Q24081 | ND |
| 2104 | 156.0 | GLUCOSE-1-PHOSPHATE ADENYLYL TRANSFERASE PRECURSOR (EC 2.7.7.27) (ADP-GLUCOSE SYNTHASE) (ADP-GLUCOSE. PYROPHOSPHORYLASE). | sptrembl Q42702 | ND |
| 2105 | 156.0 | CTD-BINDING SR-LIKE PROTEIN RA1. | sptrembl Q63624 | ND |
| 2106 | 156.0 | MUCIN 2 PRECURSOR (INTESTINAL MUCIN 2). | swissprot Q02817 | ND |
| 2107 | 156.0 | HYPOTHETICAL 9.2 KD PROTEIN. | sptrembl O59799 | ND |
| 2108 | 155.9 | YUKL PROTEIN. | sptrembl P71076 | ND |
| 2109 | 155.9 | DRPLA PROTEIN. | sptrembl P70200 | ND |
| 2110 | 155.8 | SIMILAR TO THE MYO-TYPE 'HELIX-LOOP-HELIX' DNA-BINDING DOMAIN SIGNATURE. | sptrembl Q20941 | ND |

TABLE 1-continued

*Fusarium venenatum* ESTs

| Sequence Listing | zscore | Annotation | Database | Functional category |
|---|---|---|---|---|
| 2111 | 155.8 | CHITINASE PRECURSOR. | sptrembl Q42421 | ND |
| 2112 | 155.8 | WISKOTT-ALDRICH SYNDROME PROTEIN HOMOLOG 1. | sptrembl O36027 | ND |
| 2113 | 155.8 | GLUTENIN, HIGH MOLECULAR WEIGH SUBUNIT DX5 PRECURSOR. | swissprot P10388 | ND |
| 2114 | 155.7 | F31E9.5 PROTEIN. | sptrembl O45429 | ND |
| 2115 | 155.7 | DRPLA PROTEIN. | sptrembl Q99495 | ND |
| 2116 | 155.6 | ORF YOL105C. | sptrembl Q12215 | ND |
| 2117 | 155.6 | SEA ANEMONE TOXIN 46 aa | pdb IATX | ND |
| 2118 | 155.0 | HYPOTHETICAL 35.5 KD PROTEIN. | sptrembl O60D96 | ND |
| 2119 | 155.6 | PROTEOPHOSPHOGLYCAN PRECURSOR (FRAGMENT). | sptrembl Q9Y076 | ND |
| 2120 | 155.6 | SPERM HISTONE P2 PRECURSOR (PROTAMINE P2). | swissprot P35298 | ND |
| 2121 | 155.4 | GLUE PROTEIN. | sptrembl Q27929 | ND |
| 2122 | 155.4 | 2,3-DIHYDROXYBIPHENYL DIOXYGENASE. | sptrembl Q50914 | ND |
| 2123 | 155.4 | HYPOTHETICAL 63.8 KD PROTEIN IN GUT1-RIM1 INTERGENIC REGION PRECURSOR. | swissprot P38739 | ND |
| 2124 | 155.4 | C11G6.3 PROTEIN. | sptrembl Q17909 | ND |
| 2125 | 155.4 | ZINC FINGER PROTEIN 41 (ZEP-41) (CTFIN92) (FRAGMENT) | swissprot Q02526 | ND |
| 2126 | 155.3 | DNAJ. | sptrembl O18427 | ND |
| 2127 | 155.2 | ESTS AU065732(E51179). | tremblnew BAA85201 | |
| 2128 | 155.1 | KIAA0691 PROTEIN. | sptrembl O75175 | ND |
| 2129 | 155.1 | *Mycobacterium* species protein sequence 50B. | geneseqp Y04998 | ND |
| 2130 | 155.1 | GLUCOAMYLASE. | tremblnew AAC49609 | ND |
| 2131 | 155.1 | W02A2.5 PROTEIN. | sptrembl Q9XUB4 | ND |
| 2132 | 155.0 | FOOT PROTEIN 1 PRECURSOR (FRAGMENT). | sptrembl O61476 | ND |
| 2133 | 154.9 | INSULIN-LIKE GROWTH FACTOR PRECURSOR (IGF) (FRAGMENT). | swissprot P22618 | ND |
| 2134 | 154.8 | HYPOTHETICAL 67.5 KD PROTEIN IN DBP6-COQ2 INTERGENIC REGION. | swissprot P53735 | ND |
| 2135 | 154.8 | PUTATIVE MEMBRANE PROTEIN. | tremblnew AAF23068 | ND |
| 2136 | 154.6 | PROBABLE SERINE HYDROXYMETHYLTRANSFERASE, CYTOSOLIC (EC 2.1.2.1) (SERINE METHYLASE) (GLYCINE HYDROXYMETHYLTRANS-FERASE (SHMT). | swissprot Q10104 | ND |
| 2137 | 154.5 | LD-VP80. | sptrembl Q9YMM2 | ND |
| 2138 | 154.5 | C45B11.4 PROTEIN. | sptrembl Q18640 | ND |
| 2139 | 154.5 | NEUROFILAMENT TRIPLE H PROTEIN (200 KD NEUROFILAMENT PROTEIN) (NF-H). | swissprot P19246 | ND |
| 2140 | 154.4 | PUTATIVE TRANSMEMBRANE PROTEIN. | tremblnew CAB59607 | ND |
| 2141 | 154.4 | ORF YORO53W. | sptrembl O08428 | ND |
| 2142 | 154.2 | *A. oryzae* DEBY10.3 locus protein sequence. | geneseqp Y39872 | ND |
| 2143 | 154.2 | HYPOTHETICAL 57.2 KD PROTEIN. | sptrembl O65872 | ND |

TABLE 1-continued

*Fusarium venenatum* ESTs

| Sequence Listing | zscore | Annotation | Database | Functional category |
|---|---|---|---|---|
| 2144 | 154.1 | PROBABLE ASPARAGINYL-TRNA SYNTHETASE. CYTOPLASMIC (EC 6.1.1.22) (ASPARAGINE--TRNA LIGASE) (ASNRS). | swissprot Q19722 | ND |
| 2145 | 154.1 | ORF_ID:O224#4. | sptrembl Q9ZBC2 | ND |
| 2146 | 154.1 | F54B11.1 PROTEIN. | sptrembl Q20744 | ND |
| 2147 | 154.1 | Y45F10B.3 PROTEIN. | sptrembl O62468 | ND |
| 2148 | 154.1 | EXTENSIN CLASS II PRECURSOR (CELL WALL HYDROXYPROLINE-RICH GLYCOPROTEIN) (HRGP) (TOML-4). | sptrembl Q09084 | ND |
| 2149 | 154.0 | CHITINASE. | sptrembl Q92223 | ND |
| 2150 | 153.9 | HIV A30S protein sequence #1 | geneseqp W99832 | ND |
| 2151 | 153.9 | T2K10.7 PROTEIN. | sptrembl Q9ZUJ1 | ND |
| 2152 | 153.9 | HYPOTHETICAL 58.7 KD PROTEIN. | sptrembl O94644 | ND |
| 2153 | 153.9 | ORF2 (FRAGMENT) | sptrembl Q9WAZ6 | ND |
| 2154 | 153.8 | HYPOTHETICAL 61.1 KD PROTEIN (FRAGMENT). | tremblnew CAB63715 | ND |
| 2155 | 153.7 | BRAIN-2 GENE. | sptrembl O73628 | ND |
| 2156 | 153.7 | RIBOSOMAL PROTEIN LARGE SUBUNIT 2. | sptrembl O99868 | ND |
| 2157 | 153.6 | DJ1042K10.4 (NOVEL PROTEIN) (FRAGMENT). | sptrembl O95512 | ND |
| 2158 | 153.6 | UNKNOWN PROTEIN. | sptrembl O04210 | ND |
| 2159 | 153.6 | F28C1.1 PROTEIN. | sptrembl Q19854 | ND |
| 2160 | 153.6 | HYPOTHETICAL 25.4 KD PROTEIN C4G9.14 IN CHROMOSOME I. | swissprot Q10244 | ND |
| 2161 | 153.6 | INSULIN-LIKE GROWTH FACTOR IB PRECURSOR (IGF-1B) (SOMATOMEDIN C). | swissprot P05019 | ND |
| 2162 | 153.6 | POLLEN ALLERGEN AMB P 5-A PRECURSOR (AMB P V-A). | swissprot P43174 | ND |
| 2163 | 153.6 | 159AA LONG HYPOTHETICAL PROTEIN. | sptrembl Q9YDR4 | ND |
| 2164 | 153.6 | PHOSPHOLIPASE A2 INHIBITOR 1 PRECURSOR (PLI-1). | sptrembl O57690 | ND |
| 2165 | 153.5 | COSMID F46115. | sptrembl P90878 | ND |
| 2166 | 153.5 | STR1 (suppressor of telomeric repression-1) protein. | geneseqp R95601 | ND |
| 2167 | 153.4 | 111AA LONG HYPOTHETICAL PROTEIN. | sptrembl Q9YDA7 | ND |
| 2168 | 153.4 | GATA TRANSCRIPTION FACTOR 3. | sptrembl O49742 | ND |
| 2169 | 153.4 | HYPOTHETICAL 32.8 KD PROTEIN (FRAGMENT). | tremblnew CAB59245 | ND |
| 2170 | 153.4 | GTL2 GENE. | sptrembl O48591 | ND |
| 2171 | 153.3 | COSMID C37C3. | sptrembl Q22919 | ND |
| 2172 | 153.3 | STEERIN-1 PROTEIN (FRAGMENT). | tremblnew CAB66088 | ND |
| 2173 | 153.3 | PROTEIN-TYROSINE PHOPHATASE, PUTATIVE. | tremblnew AAF11466 | ND |
| 2174 | 153.2 | Amino acid sequence of human desaturase gene contig 2 | geneseqp W95509 | ND |
| 2175 | 153.2 | GLYCOPROTEIN G-2 (FRAGMENT). | tremblnew CAB65677 | ND |
| 2176 | 153.2 | TONB PROTEIN. | tremblnew CAB53383 | ND |
| 2177 | 153.1 | BRAIN-2 GENE. | sptrembl O73628 | ND |
| 2178 | 153.1 | APEX NUCLEASE (FRAGMENT). | sptrembl O97870 | ND |
| 2179 | 153.1 | HYPOTHETICAL 57.2 KD PROTEIN. | sptrembl O68872 | ND |

TABLE 1-continued

*Fusarium venenatum* ESTs

| Sequence Listing | zscore | Annotation | Database | Functional category |
|---|---|---|---|---|
| 2180 | 153.0 | H28G03.2 PROTEIN. | tremblnew AAC67404 | ND |
| 2181 | 153.0 | UL47 PRODUCT HOMOLOG. | tremblnew BAA82943 | ND |
| 2182 | 152.9 | ACUTE MYELOID LEUKEMIA PROTEIN (ONCOGENE AML-2) (CORE-BINDING FACTOR. ALPHA 3 SUBUNIT) (CBF-ALPHA 3) (POLYOMAVIRUS ENHANCER BINDING PROTEIN 2.ALPHA CI SUBUNIT) (PEBP2-ALPHA C1). | sptrembl Q13761 | ND |
| 2183 | 152.9 | APOPTIN (VP3). | swissprot P54095 | ND |
| 2184 | 152.8 | SERINE-RICH PROTEIN. | sptrembl O94317 | ND |
| 2185 | 152.6 | ENVELOPE PROTEIN (FRAGMENT). | sptrembl Q85475 | ND |
| 2186 | 152.6 | DIACYLGLYCEROL ACYLCOA ACYLTRANSFERASE. | tremblnew AAF19345 | ND |
| 2187 | 152.4 | K06A9.1 PROTEIN. | sptrembl P91365 | ND |
| 2188 | 152.4 | F7F22.14. | tremblnew AAF24528 | ND |
| 2189 | 152.4 | CONSERVED HYPOTHETICAL PROTEIN. | tremblnew AAF09626 | ND |
| 2190 | 152.4 | ARABINOGALACTAN-PROTEIN. | sptrembl Q9ZT15 | ND |
| 2191 | 152.4 | NODULATION PROTEIN L (EC 2.3.1.-). | swissprot P28266 | ND |
| 2192 | 152.4 | TCJ2. | sptrembl Q26952 | ND |
| 2193 | 152.3 | HQP0376 PROTEIN. | tremblnew AAF23355 | ND |
| 2194 | 152.3 | LAMININ ALPHA-2.CHAIN PRECURSOR (LAMININ M CHAIN) (MEROSIN HEAVY CHAIN). | swissprot Q60675 | ND |
| 2195 | 152.3 | GAGA-581 ADF-2 ISOFORM. | sptrembl O18349 | ND |
| 2196 | 152.2 | FLGA insert stabilising polypeptide. | geneseqp W79128 | ND |
| 2197 | 152.2 | Recombinant transcription enhancer factor 1 G1.2/3/5. | geneseqp W58603 | ND |
| 2198 | 152.1 | ACROSIN PRECURSOR (EC 3.4.21.10). | swissprot P48038 | ND |
| 2199 | 152.1 | SLIME MOLD (D. DISCOIDEUM) TRANSPOSON DIRS-1. COMPLETE, CLONE SB41. | sptrembl O96848 | ND |
| 2200 | 152.0 | TRANSCRIPTION TERMINATION FACTOR 1 (TRANSCRIPTION FACTOR). | sptrembl Q62187 | ND |
| 2201 | 152.0 | AGOUT1 SWITCH PROTEIN PRECURSOR (AGOUT1 SIGNALING PROTEIN) (FRAGMENT). | swissnew P79407 | ND |
| 2202 | 152.0 | RNA POLYMERASE II SUBUNIT 9. | sptrembl O74635 | ND |
| 2203 | 151.9 | DIVISION ABNORMALLY DELAYED PROTEIN PRECURSOR (DALLY PROTEIN) | swissprot O24114 | ND |
| 2204 | 151.8 | ANTI-DEATH PROTEIN. | sptrembl O75353 | ND |
| 2205 | 151.7 | HYPOTHETICAL PROTEIN (ORF27O/2) (FRAGMENT). | sptrembl Q05897 | ND |
| 2206 | 160.9 | PUTATIVE PHOSPHATE/ PHOSPHOENOLPYRUVATE TRANSLOCATOR PROTEIN. | tremblnew AAD20711 | ND |
| 2207 | 151.7 | COSMID RHGH. | sptrembl O16953 | ND |
| 2208 | 151.7 | W05B2.6 PROTEIN. | sptrembl Q9XVG3 | ND |

TABLE 1-continued

*Fusarium venenatum* ESTs

| Sequence Listing | zscore | Annotation | Database | Functional category |
|---|---|---|---|---|
| 2209 | 151.6 | E309.1 PROTEIN. | tremblnew AAD34676 | ND |
| 2210 | 151.6 | ALTERNATIVE OXIDASE (FRAGMENT). | sptrembl Q26681 | ND |
| 2211 | 151.6 | CYC07 PROTEIN,S-PHASE SPECIFIC (FRAGMENT). | sptrembl Q42008 | ND |
| 2212 | 151.6 | SECRETORY MUCIN MUC6 (FRAGMENT). | sptrembl O15329 | ND |
| 2213 | 151.6 | PROBABLE B-TYPE CYTOCHROME. | swissprot P41955 | ND |
| 2214 | 151.5 | PROTEIN C4 | swissprot P17370 | ND |
| 2215 | 151.5 | PROTOCADHERIN 5 (FRAGMENT). | sptrembl O08964 | ND |
| 2216 | 151.4 | KIAA0442 PROTEIN (FRAGMENT). | sptrembl Q9Y4E2 | ND |
| 2217 | 151.4 | E46B3.2 PROTEIN. | sptrembl Q9XV16 | ND |
| 2218 | 151.3 | SMUC-41 intestinal mucin. | geneseqp R12535 | ND |
| 2219 | 151.3 | HYPOTHETICAL 62.3 KD PROTEIN. | tremblnew CAB55180 | ND |
| 2220 | 151.3 | DNA-DIRECTED RNA POLYMERASE II LARGEST SUBUNIT (EC 2.7.7.6) (RPB1) (FRAGMENT). | swissprot P11414 | ND |
| 2221 | 151.3 | HTRA2-BETA (TRANSFORMER-2-BETA ISOFORM 3). | sptrembl Q15815 | ND |
| 2222 | 151.2 | ALLERGEN. | sptrembl O74682 | ND |
| 2223 | 151.2 | ZINC FINGER PROTEIN 37 (ZEP-37) (MALE GERM CELL SPECIFIC ZINC FINGER PROTEIN). | swissprot P17141 | ND |
| 2224 | 151.2 | 171-7 PRECURSOR. | sptrembl Q27320 | ND |
| 2225 | 151.1 | HYPOTHETICAL 33.4 KD PROTEIN IN RPL44B-RPC10 INTERGENIC REGION PRECURSOR. | swissprot P38844 | ND |
| 2226 | 151.1 | TRANSLATIONALLY CONTROLLED TUMOR PROTEIN HOMOLOG (TCTP). | swissprot Q10344 | ND |
| 2227 | 151.1 | F4P06. | sptrembl P79027 | ND |
| 2228 | 151.1 | PRE-S1. PRE-S2 AND S | sptrembl O39887 | ND |
| 2229 | 151.0 | HYPOTHETICAL 15.5 KD PROTEIN. | sptrembl Q62882 | ND |
| 2230 | 151.0 | EXCRETORY SECRETORY MUCIN MUC-4. | tremblnew AAD49341 | ND |
| 2231 | 151.0 | PROBABLE ATP-DEPENDENT RNA HELICASE DBP3 (HELICASE CA3). | swissprot P20447 | ND |
| 2232 | 151.0 | HYPOTHETICAL 57.2 KD PROTEIN. | sptrembl O68872 | ND |
| 2233 | 151.0 | F43G6.9 PROTEIN. | sptrembl Q20374 | ND |
| 2234 | 151.0 | GAG-POL POLYPROTEIN. | tremblnew AAF20282 | ND |
| 2235 | 150.9 | HYPOTHETICAL OXIDOREDUCTASE IN FHUD-OPUBD INTERGENIC REGION. | swissprot O32223 | ND |
| 2236 | 150.9 | PAC CLONE DJ1110N13 FROM 7P21-P22, COMPLETE SEQUENCE (FRAGMENT) | sptrembl O43376 | ND |
| 2237 | 150.9 | ALDOSE EPIMERASE FAMILY PROTEIN. | tremblnew AAF10324 | ND |
| 2238 | 150.9 | OSMOTIN-LIKE PROTEIN PRECURSOR. | swissnew Q41350 | ND |
| 2239 | 150.8 | W05G11.6 PROTEIN. | sptrembl O44906 | ND |
| 2240 | 150.8 | MYOSIN I HEAVY CHAIN KINASE (FRAGMENT). | sptrembl Q94488 | ND |
| 2241 | 150.8 | ORF3. | sptrembl Q9YL22 | ND |
| 2242 | 150.8 | PRP4. | geneseqp R29166 | ND |
| 2243 | 150.8 | Yeast ribosomal protein S7. | geneseqp W36115 | ND |

TABLE 1-continued

*Fusarium venenatum* ESTs

| Sequence Listing | zscore | Annotation | Database | Functional category |
|---|---|---|---|---|
| 2244 | 150.7 | Porphorymonas gingivalis protein PG106. | geneseqp Y34446 | ND |
| 2245 | 150.7 | RRNA ADENINE N-6-METHYLTRANSFERASE (EC 2.1.1.48) (MACROLIDE-LINCOSAMIDE-STREPTOGRAMIN B RESISTANCE PROTEIN) (ERYTHROMYCIN RESISTANCE PROTEIN) (NMT). | swissnew P07287 | ND |
| 2246 | 150.7 | HYPOTHETICAL 10.5 KD PROTEIN C31A2.13C IN CHROMOSOME I. | swissprot Q09730 | ND |
| 2247 | 150.7 | Human herpesvirus 8.(HHV-8) macrophage inhibitory protein-IA. | geneseqp W40104 | ND |
| 2248 | 150.7 | SPLICING FACTOR. ARGININE/SERINE-RICH 10 (PUTATIVE MYELIN REGULATORY FACTOR 1) (MRF-1) (FRAGMENT). | swissprot Q60701 | ND |
| 2249 | 150.7 | MEGF6. | sptrembl O88281 | ND |
| 2250 | 150.6 | NLPD PROTEIN. | tremblnew CAA06881 | ND |
| 2251 | 150.6 | MITOCHONDRIAL PHOSPHATE CARRIER PROTEIN (PHOSPHATE TRANSPORT PROTEIN) (PTP) (MITOCHONDRIAL IMPORT RECEPTOR) (P32). | swissprot P23641 | ND |
| 2252 | 150.6 | ARABINOGALACTAN-PROTEIN. | sptrembl Q9ZT16 | ND |
| 2253 | 150.5 | Human secreted protein cb96_10. | geneseqp Y05319 | ND |
| 2254 | 150.5 | COLLAGEN ALPHA I (VIII) CHAIN PRECURSOR (ENDOTHELIAL COLLAGEN). | swissprot P14282 | ND |
| 2255 | 150.5 | MATING-TYPE PROTEIN BETA 1. | sptrembl Q9Y7A5 | ND |
| 2256 | 150.5 | Peptide encoded by HRGP gene cassette. | geneseqp Y01285 | ND |
| 2257 | 150.5 | DJ3471113.5 (NOVEL PROTEIN SIMILAR TO YEAST DNA-DIRECTED RNA POLYMERASE III 25 KD POLYPEPTIDE). | sptrembl Q9Y535 | ND |
| 2258 | 150.4 | TRANSCRIPTION TERMINATION FACTOR RHO | swissprot P52154 | ND |
| 2259 | 150.4 | PUTATIVE ZINC METALLOPROTEASE. | sptrembl O68338 | ND |
| 2260 | 150.4 | SPERM-SPECIFIC PROTEIN PHI-1. | swissprot Q04621 | ND |
| 2261 | 150.4 | C26C6.1 PROTEIN. | sptrembl Q18210 | ND |
| 2262 | 150.2 | Human tastin. | geneseqp R94900 | ND |
| 2263 | 150.2 | ARABINOGALACTAN-PROTEIN PRECURSOR | sptrembl Q40786 | ND |
| 2264 | 150.2 | A201A-RESISTANCE ATP-BINDING PROTEIN (ARD1). | sptrembl Q53012 | ND |
| 2265 | 150.2 | Human secreted protein encoded by gene No. 31. | geneseqp Y27730 | ND |
| 2266 | 150.1 | CHROMOSOME IV READING FRAME ORF YDL074C. | sptrembl Q07457 | ND |
| 2267 | 150.1 | SERINE-THREONINE PROTEIN KINASE (FRAGMENT). | sptrembl P78975 | ND |
| 2268 | 150.1 | EBNA-2 NUCLEAR PROTEIN. | sptrembl Q07701 | ND |

TABLE 1-continued

*Fusarium venenatum* ESTs

| Sequence Listing | zscore | Annotation | Database | Functional category |
|---|---|---|---|---|
| 2269 | 150.1 | 1-PHOSPHATIDYLINOSITOL-4,5-BISPHOSPHATE PHOSPHODIESTERASE (EC 31.4.11). | tremblnew CAB52721 | ND |
| 2270 | 150.1 | SUPEROXIDE DISMUTASE (EC 1.15.1.1) (FRAGMENT). | sptrembl Q59593 | ND |
| 2271 | 150.1 | BILE ACID-COENZYME A LIGASE (EC 6.-.-.-). | swissprot P19409 | ND |
| 2272 | 150.0 | SPLICING FACTOR SRP55-1 (FRAGMENT). | sptrembl Q9XSS6 | ND |
| 2273 | 149.9 | C06A1.6 PROTEIN. | sptrembl Q9XVX3 | ND |
| 2274 | 149.9 | PROLINE-RICH PROTEIN PRECURSOR. | sptrembl Q41122 | ND |
| 2275 | 149.9 | NEUROGENIC LOCUS NOTCH HOMOLOG PROTEIN 4 PRECURSOR (TRANSFORMING PROTEIN INT-3). | swissprot P31695 | ND |
| 2276 | 149.9 | EXPANSIN 18 (FRAGMENT). | tremblnew CAB65694 | ND |
| 2277 | 149.9 | HYPOTHETICAL 31.2 KD PROTEIN RV0891C. | swissnew Q10551 | ND |
| 2278 | 149.9 | SUPPRESSOR PROTEIN SRP40. | swissprot P32583 | ND |
| 2279 | 149.8 | SPERM PROTEIN. | sptrembl Q24404 | ND |
| 2280 | 149.8 | HEPATITIS A VIRUS CELLULAR RECEPTOR 1 LONG FORM (HEPATITIS A VIRUS CELLULAR RECEPTOR 1 SHORT FORM). | sptrembl O46598 | ND |
| 2281 | 149.8 | CODED FOR BY C. ELEGANS CDNA YK117B5.5. | sptrembl O01489 | ND |
| 2282 | 149.8 | HYPOTHETICAL 41.0 KD PROTEIN. | sptrembl O64895 | ND |
| 2283 | 149.7 | SALIVARY GLUE PROTEIN SGS-3 PRECURSOR. | swissprot P13730 | ND |
| 2284 | 149.7 | GTG START CODON. | sptrembl Q45316 | ND |
| 2285 | 149.6 | SIM1 PROTEIN. | swissprot P40472 | ND |
| 2286 | 149.6 | HYPOTHETICAL 15.1 KD PROTEIN (FRAGMENT). | sptrembl P96909 | ND |
| 2287 | 149.6 | HYPOTHETICAL 32.8 KD PROTEIN. | tremblnew AAF10253 | ND |
| 2288 | 149.5 | LOW-SPECIFICITY D-THREONINE ALDOLASE. | tremblnew BAA86032 | ND |
| 2289 | 149.5 | TROPOMYOSEN I (ISOFORM 34). | sptrembl Q24425 | ND |
| 2290 | 149.5 | C HORDEIN PRECURSOR. | sptrembl Q40055 | ND |
| 2291 | 149.4 | LATENCY-ASSOCIATED TRANSCRIPT MRNA. | sptrembl Q69079 | ND |
| 2292 | 140.4 | U14 PROTEIN. | sptrembl Q9WT50 | ND |
| 2293 | 140.4 | *Mycobacterium* species protein sequence 8A. | geneseqp Y04786 | ND |
| 2294 | 140.4 | HYPOTHETICAL 59.4 KD PROTEIN. | sptrembl P74381 | ND |
| 2295 | 149.3 | C03H5.1 PROTEIN. | sptrembl O16660 | ND |
| 2296 | 149.3 | Tissue cement protein fragment encoded by clone 24. | geneseqp Y13498 | ND |
| 2297 | 149.3 | *C. parvum* p23 protein fragment. | geneseqp W54052 | ND |
| 2298 | 149.2 | Human galectin amino acid sequence. | geneseqp W61955 | ND |
| 2299 | 149.2 | MYBS PROTEIN. | sptrembl O15816 | ND |
| 2300 | 149.2 | TRANSCRIPTION FACTOR SOX-9. | swissprot P48434 | ND |
| 2301 | 149.1 | *Mycobacterium* species protein sequence 21B'. | geneseqp Y04881 | ND |
| 2302 | 149.1 | A serine threonine protein kinase. | geneseqp W67639 | ND |

TABLE 1-continued

*Fusarium venenatum* ESTs

| Sequence Listing | zscore | Annotation | Database | Functional category |
|---|---|---|---|---|
| 2303 | 149.1 | *Mycobacterium* species protein sequence 50B. | geneseqp Y04998 | ND |
| 2304 | 149.1 | T01D3.6B PROTEIN. | sptrembl O02364 | ND |
| 2305 | 149.0 | PHEROPHORIN III (FRAGMENT). | sptrembl P93694 | ND |
| 2306 | 149.0 | Human secreted protein encoded by gene 89 clone HLHFP03. | geneseqp Y02738 | ND |
| 2307 | 149.0 | HYPOTHETICAL 42.0 KD PROTEIN. | sptrembl O28535 | ND |
| 2308 | 149.0 | HYPOTHETICAL 20.4 KD PROTEIN (FRAGMENT). | sptrembl Q9Y4N2 | ND |
| 2309 | 148.8 | SIMILAR TO PART OF DISEASE RESISTANCE PROTEIN. | tremblnew AAD55639 | ND |
| 2310 | 148.8 | PROLINE-RICH. | sptrembl Q94273 | ND |
| 2311 | 148.8 | KT112 PROTEIN. | swissprot P34253 | ND |
| 2312 | 148.8 | FERRIC REDUCTASE TRANSMEMBRANE COMPONENT. | sptrembl O94727 | ND |
| 2313 | 148.8 | AMINO PEPTIDASE 313aa. chain A + B | pdb 1AZW | ND |
| 2314 | 148.7 | DNA-DIRECTED RNA POLYMERASE II LARGEST SUBUNIT (EC 2.7.7.6). | swissprot P16356 | ND |
| 2315 | 148.7 | KIAA0561 PROTEIN (FRAGMENT). | tremblnew AAD22670 | ND |
| 2316 | 148.7 | DNA-DIRECTED RNA POLYMERASE II LARGE (205 KD) SUBUNIT (EC 2.7.7.6) (FRAGMENT). | sptrembl Q99367 | ND |
| 2317 | 148.7 | PUTATIVE EXTENSIN. | sptrembl Q9ZND3 | ND |
| 2318 | 148.6 | SWI/SNF RELATED, MATRIX ASSOCIATED, ACTIN DEPENDENT REGULATOR OF CHROMATIN. SUBFAMILY A, MEMBER 4 (BRGI) (FRAGMENT). | sptrembl O35845 | ND |
| 2319 | 148.6 | HIGH MOLECULAR MASS NUCLEAR ANTIGEN (FRAGMENT). | sptrembl O57580 | ND |
| 2320 | 148.6 | PUTATIVE SEC24-LIKE COPII PROTEIN. | tremblnew AAF20236 | ND |
| 2321 | 148.6 | SIMILAR TO EPOXIDE HYDROLASES. | tremblnew BAA84627 | ND |
| 2322 | 148.5 | HYPOTHETICAL 23.8 KD PROTEIN (FRAGMENT). | sptrembl Q9XSR6 | ND |
| 2323 | 148.5 | GLUCOAMYLASE | tremblnew AAC49609 | ND |
| 2324 | 148.5 | HYPOTHETICAL 27.2 KD PROTEIN. | sptrembl O50997 | ND |
| 2325 | 148.5 | FLBD. | tremblnew AAF01466 | ND |
| 2326 | 148.5 | CUTICLE COLLAGEN 34 | swissprot P34687 | ND |
| 2327 | 148.5 | HYPOTHETICAL 60.7 KD PROTEIN C26A3.15C IN CHROMOSOME I. | swissprot Q10168 | ND |
| 2328 | 148.4 | SPERM PROTAMINE P1. | swissprot P42131 | ND |
| 2329 | 148.4 | *T. gondii* immunogenic protein. | geneseqp Y29061 | ND |
| 2330 | 148.4 | Human CTR. | geneseqp R37424 | ND |
| 2331 | 148.4 | CYCLIC AMP PHOSPHODIESTERASE. | tremblnew AAC00042 | ND |
| 2332 | 148.4 | Human secreted protein encoded by gene No. 47. | geneseqp Y27757 | ND |
| 2333 | 148.3 | HumB3V1 humanised variable light chain. | geneseqp R95212 | ND |
| 2335 | 148.2 | C04G2.8 PROTEIN. | sptrembl Q17626 | ND |
| 2336 | 148.2 | KIAA0755 PROTEIN. | sptrembl O94855 | ND |
| 2337 | 148.2 | MATING-TYPE PROTEIN A-ALPHA Y3. | swissprot P37934 | ND |

TABLE 1-continued

*Fusarium venenatum* ESTs

| Sequence Listing | zscore | Annotation | Database | Functional category |
|---|---|---|---|---|
| 2338 | 148.1 | A human tumor necrosis factor-R2-like proteins (TR2P)-2 | geneseqp Y28450 | ND |
| 2339 | 148.1 | T21B6.3 PROTEIN. | sptrembl Q22631 | ND |
| 2340 | 148.1 | HYPOTHETICAL 62.8 KD PROTEIN. | sptrembl O23187 | ND |
| 2341 | 148.1 | CATHEPSIN L PRECURSOR (EC 3.4.22.15) (MAJOR EXCRETED PROTEIN) (MEP) (CYCLIC PROTEIN-2) (CP-2). | swissprot P07154 | ND |
| 2342 | 148.1 | FAMILY 19 CHITINASE (PRYA1 ORF) PRECURSOR. | sptrembl Q9WXI9 | ND |
| 2343 | 148.0 | DNA HELICASE/PRIMASE COMPLEX ASSOCIATED PROTEIN. | swissprot P10192 | ND |
| 2344 | 148.0 | NO COUNTERPART IN HSV-1 OR VZV. | sptrembl O39244 | ND |
| 2345 | 148.0 | DIHYDRODIOL DEHYDROGENASE. | sptrembl Q51748 | ND |
| 2346 | 148.0 | EXTENSIN CLASS II PRECURSOR (CELL WALL HYDROXYPROLINE-RICH GLYCOPROTEIN) (HRGP) (TOML-4). | sptrembl Q09084 | ND |
| 2347 | 148.0 | Human secreted protein encoded by gene 69 clone HMWEX24. | geneseqp W74793 | ND |
| 2348 | 148.0 | T13F2.6 PROTEIN. | sptrembl Q94049 | ND |
| 2349 | 148.0 | ENVELOPE GLYCOPROTEIN (FRAGMENT). | sptrembl O39337 | ND |
| 2350 | 147.9 | COAT PROTEIN. | sptrembl Q65970 | ND |
| 2351 | 147.8 | SOX100B PROTEIN | tremblnew CAB63903 | ND |
| 2352 | 147.8 | NOLC PROTEIN. | swissprot P26508 | ND |
| 2353 | 147.8 | HYPOTHETICAL 47.8 KD PROTEIN. | sptrembl O60158 | ND |
| 2354 | 147.7 | MEROZOITE SURFACE PROTEIN-1 (FRAGMENT). | sptrembl O00879 | ND |
| 2355 | 147.7 | BASEMENT MEMBRANE PROTEOGLYCAN PRECURSOR (PERLECAN HOMOLOG). | swissprot Q06561 | ND |
| 2356 | 147.7 | PHYTOCHROME (FRAGMENT). | sptrembl P93057 | ND |
| 2357 | 147.7 | MELANOCYTE PROTEIN 17 PRECURSOR (FRAGMENT). | sptrembl O91884 | ND |
| 2358 | 147.7 | ANTHER-SPECIFIC PROTEIN SF18 PRECURSOR (FRAGMENT). | swissprot P22357 | ND |
| 2359 | 147.6 | F17C11.1 PROTEIN. | sptrembl Q19521 | ND |
| 2360 | 147.6 | C4SR PROTEIN. | sptrembl Q91708 | ND |
| 2361 | 147.5 | HYPOTHETICAL 112.1 KD PROTEIN C06G4.1 IN CHROMOSOME III. | swissprot P34307 | ND |
| 2362 | 147.5 | RECA PROTEIN (FRAGMENT). | tremblnew AAF25430 | ND |
| 2363 | 147.3 | CODED FOR BY C. ELEGANS CDNA YK37G1.5. | sptrembl Q20649 | ND |
| 2364 | 147.5 | MUCIN (FRAGMENT). | sptrembl Q14879 | ND |
| 2365 | 147.3 | REPA1 PROTEIN. | tremblnew CAB56190 | ND |
| 2366 | 147.3 | F32D1.3 PROTEIN. | sptrembl O16296 | ND |
| 2367 | 147.3 | ZINC-PROTEASE TRANSPORTER. | sptrembl O67995 | ND |
| 2368 | 147.3 | *Chlamydia pneumoniae* protein not found in *C. trachomatis*. | geneseqp Y35721 | ND |
| 2369 | 147.2 | HUNCHBACK PROTEIN (HB) | sptrembl O62537 | ND |
| 2370 | 147.2 | EXTENSIN. | sptrembl Q9ZWT0 | ND |
| 2371 | 147.2 | CODED FOR BY C. ELEGANS CDNA YK150F2.5. | sptrembl O01681 | ND |

TABLE 1-continued

Fusarium venenatum ESTs

| Sequence Listing | zscore | Annotation | Database | Functional category |
|---|---|---|---|---|
| 2372 | 147.2 | SIMILARITY TO SCAMP37. | sptrembl Q9ZTX0 | ND |
| 2373 | 147.2 | A-lineage conotoxin SmIII prepropeptide. | geneseqp W12767 | ND |
| 2374 | 147.2 | ROXI REPRESSOR (HYPOXIC FUNCTION REPRESSOR) (HEME-DEPENDENT REPRESSION FACTOR) | swissprot P25042 | ND |
| 2375 | 147.2 | ALPHA-AMYLASE INHIBITOR BMA1-1 PRECURSOR (ALLERGEN HCR V 1) (ALPHA-AMYLASE FLOUR INHIBITOR) (FRAGMENT) EXTENSIN CLASS 1 PROTEIN PRECURSOR (EXTENSIN-LIKE PROTEIN). | swissprot P16968 sptrembl Q41707 | ND ND |
| 2376 | 147.1 | PARVA1-BUMIN ALPHA (PA 4 Q1) | swissprot P18087 | ND |
| 2377 | 147.1 | P20-grammaZzein protein sequence. | geneseqp W22526 | ND |
| 2379 | 147.1 | HYPOTHETICAL 30.2 KD PROTEIN. | sptrembl P71863 | ND |
| 2380 | 147.1 | F36F2.2 PROTEIN. | sptrembl O62233 | ND |
| 2381 | 147.0 | PROLINE RICH PROTEIN PRECURSOR. | sptrembl Q43558 | ND |
| 2382 | 147.0 | ORF 50. | sptrembl Q66652 | ND |
| 2383 | 147.0 | HYPOTHETICAL 14.6 KD PROTEIN. | sptrembl O67892 | ND |
| 2384 | 147.0 | POLYPROTEIN (FRAGMENT). | sptrembl Q9YK32 | ND |
| 2385 | 147.0 | RNA POLYMERASE (FRAGMENT). | sptrembl O37355 | ND |
| 2386 | 146.9 | MYOSIN REGULATORY LIGHT CHAIN INTERACTING PROTEIN MIR | tremblnew AAF18974 | ND |
| 2387 | 146.9 | Human h1CED-6 proline/serine rich region. | geneseqp Y27251 | ND |
| 2388 | 146.9 | MEGF6 (FRAGMENT). | sptrembl O75095 | ND |
| 2389 | 146.9 | ESRS4. | sptrembl Q9Y1B1 | ND |
| 2390 | 146.8 | HYPOTHETICAL PROTEIN E-115. | swissprot P03290 | ND |
| 2391 | 146.8 | ETS-RELATED PROTEIN ERM (ETS TRANSLOCATION VARIANT 5). | swissprot P41161 | ND |
| 2392 | 146.7 | PROBABLE IMIDAZOLEGLYCEROL-PHOSPHATE DEHYDRATASE (EC 4.2.1.19) (IGPD). | swissprot Q58109 | ND |
| 2393 | 146.7 | Streptococcus pneumoniae PspA central region. | geneseqp W14579 | ND |
| 2394 | 146.7 | PUTATIVE ZINC FINGER PROTEIN. | sptrembl O74256 | ND |
| 2395 | 146.7 | PROTINE-RICH PROTEOGLYCAN PRPG2. | sptrembl Q07611 | ND |
| 2396 | 146.7 | HORMONE/GROWTH FACTOR 290 aa, chain B + E | pdb 1QCT | ND |
| 2397 | 146.6 | ORF IIL | sptrembl Q65223 | ND |
| 2398 | 146.6 | LL5 MRNA. | sptrembl Q63312 | ND |
| 2399 | 146.6 | HYPOTHETICAL PROTEIN (FRAGMENT) | tremblnew BAA87194 | ND |
| 2400 | 146.5 | F55C9.9 PROTEIN. | sptrembl Q9XUZ2 | ND |
| 2401 | 146.5 | RAS-LIKE GTP-BINDING PROTEIN RYL2. | swissprot P41925 | ND |
| 2402 | 146.4 | HYPOTHETICAL 40.1 KD PROTEIN. | sptrembl O06798 | ND |
| 2403 | 146.4 | E1B PROTEIN. LARGE T-ANTIGEN. | swissprot P04491 | ND |

TABLE 1-continued

Fusarium venenatum ESTs

| Sequence Listing | zscore | Annotation | Database | Functional category |
|---|---|---|---|---|
| 2404 | 146.4 | PUTATIVE ABC TRANSPORTER | tremblnew CAB58409 | ND |
| 2405 | 146.4 | DUAL-SPECIFICITY TYROSINE-(Y)-PHOSPHORYLATION REGULATED KINASE (EC 2.7.1-) (PROTEIN KINASE MINIBRAIN HOMOLOG) (MP86) | swissprot Q61214 | ND |
| 2406 | 146.4 | CYTOCHROME C OXIDASE POLYPEPTIDE II (EC 1.9.3.1). | sptrembl O47580 | ND |
| 2407 | 146.4 | EXTENSIN PRECURSOR (CELL WALL HYDROXYPROLINE-RICH GLYCOPROTEIN) (HRGP) (PTEL 15). | sptrembl Q06446 | ND |
| 2408 | 146.3 | F38C2.6 PROTEIN. | sptrembl O45492 | ND |
| 2409 | 146.3 | GLYCOSYL TRANSFERASE-LIKE PROTEIN. | tremblnew CAB42905 | ND |
| 2410 | 146.3 | TONB PROTEIN. | tremblnew CAB64965 | ND |
| 2411 | 146.3 | *Drosophila trithorax* zinc finger domain 1266–1483. | geneseqp R38471 | ND |
| 2412 | 146.3 | VESICLE-ASSOCIATED PROTEIN (VAP-1) (FRAGMENT). | swissprot Q06155 | ND |
| 2413 | 146.3 | Human mDia Rho targeting protein. | geneseqp W76734 | ND |
| 2414 | 146.2 | ATP SYNTHASE A CHAIN (EC 3.6.1.34). | sptrembl Q95782 | ND |
| 2415 | 146.2 | F35G12.10 PROTEIN. | sptrembl Q20053 | ND |
| 2416 | 146.2 | CTG3A (FRAGMENT). | sptrembl Q9Y417 | ND |
| 2417 | 146.2 | ROD SHAPE-DETERMINING PROTEIN MREC (MREC). | sptrembl Q9ZCH5 | ND |
| 2418 | 146.2 | KRAB-ZINC FINGER PROTEIN KZF-1 | sptrembl P70590 | ND |
| 2419 | 146.2 | SEIZURE-RELATED GENE PRODUCT 6 TYPE 3 PRECURSOR. | sptrembl Q62224 | ND |
| 2420 | 146.2 | HYPOTHETICAL 172.2 KD PROTEIN. | tremblnew CAB41133 | ND |
| 2421 | 146.1 | EF-G. | tremblnew BAA88140 | ND |
| 2422 | 146.1 | *Actinomadura flexuosa* xylanase. | geneseqp R94881 | ND |
| 2423 | 146.1 | AMYLOID BETA (A4) PRECURSOR PROTEIN-BINDING. FAMILY B. MEMBER 1 (FE65) (FRAGMENT). | sptrembl O08642 | ND |
| 2424 | 146.0 | HUNCHBACK PROTEIN (HB) (FRAGMENTS). | sptrembl O46256 | ND |
| 2425 | 146.0 | HYPOTHETICAL 11.1 KD PROTEIN (ORF 1). | swissprot P11907 | ND |
| 2426 | 146.0 | WW DOMAIN BINDING PROTEIN 5 (FRAGMENT) | sptrembl O08549 | ND |
| 2427 | 146.0 | NADH DEHYDROGENASE SUBUNIT 4 (FRAGMENT). | sptrembl Q96091 | ND |
| 2428 | 146.0 | DBL ALPHA PROTEIN (FRAGMENT). | sptrembl Q9XZA9 | ND |
| 2429 | 146.0 | PUTATIVE KUP ZINC-FINGER (N-TERMINAL, CLONE EST07388). | tremblnew G407623 | ND |
| 2430 | 145.9 | Canine hookworm Neutrophil Inhibitory Factor isoform 1P. | geneseqp R52986 | ND |
| 2431 | 145.9 | PUTATIVE EXTENSIN. | sptrembl Q9ZNU3 | ND |
| 2432 | 145.9 | NIF-SPECIFIC REGULATORY PROTEIN | swissprot P09133 | ND |
| 2433 | 145.9 | Amino acid sequence of a virulence factor encoded by ORF25510. | geneseqp Y29194 | ND |

TABLE 1-continued

*Fusarium venenatum* ESTs

| Sequence Listing | zscore | Annotation | Database | Functional category |
|---|---|---|---|---|
| 2434 | 145.8 | MITOCHONDRIAL CAPSULE SELENOPROTEIN. | sptrembl O70613 | ND |
| 2435 | 145.8 | MUCIN-LIKE PROTEIN. | sptrembl O61035 | ND |
| 2436 | 145.8 | TRANSCRIPTION FACTOR MTF-1. | sptrembl Q9YGM3 | ND |
| 2437 | 145.8 | W02B12.2 PROTEIN | sptrembl Q23120 | |
| 2438 | 145.8 | ACIDIC PROLINE-RICH PROTEIN PRP33 PRECURSOR. | swissprot P04474 | ND |
| 2439 | 145.7 | KINESIN-LIKE DNA BINDING PROTEIN. | sptrembl O94814 | ND |
| 2440 | 145.7 | TRBH PROTEIN. | swissprot P19381 | ND |
| 2441 | 145.7 | *Mycobacterium tuberculosis* antigen TbH-29. | geneseqp W64359 | ND |
| 2442 | 145.6 | HYPOTHETICAL 13.0 KD PROTEIN IN GIT1-PAU3 INTERGENIC REGION. | swissprot P25609 | ND |
| 2443 | 145.6 | METALLOTHIONEIN-III (MT-III) (GROWTH INHIBITORY FACTOR) (GIF). | swissprot P37361 | |
| 2444 | 145.6 | HISTONE H3. | swissprot P07041 | ND |
| 2445 | 145.6 | Amino acid sequence of a virulence factor encoded by ORF6325. | geneseqp Y29127 | ND |
| 2446 | 145.5 | NADH DEHYDROGENASE SUBUNIT 4 (FRAGMENT). | tremblnew AAC98214 | ND |
| 2447 | 145.5 | ORF C1. | sptrembl Q67591 | ND |
| 2448 | 145.5 | HYPOTHETICAL 13.2 KD PROTEIN IN RPS4A-BAT2 INTERGENIC REGION. | swissprot P47174 | ND |
| 2449 | 145.5 | 152AA LONG HYPOTHETICAL PROTEIN. | sptrembl Q9YG78 | ND |
| 2450 | 145.5 | LATE EXPRESSION FACTOR 6. | sptrembl Q9YMT6 | ND |
| 2451 | 145.5 | SPLICING FACTOR SRP54. | sptrembl O61646 | ND |
| 2452 | 145.5 | Human neurofilament-M mutant protein fragment 89. | geneseqp Y20807 | ND |
| 2453 | 145.4 | F24J5.8 PROTEIN. | tremblnew AAD49974 | ND |
| 2454 | 145.3 | DNA POLYMERASE (FRAGMENT). | sptrembl Q9YRJ7 | ND |
| 2455 | 145.3 | SERRATEB. | sptrembl Q9YHU2 | ND |
| 2456 | 145.3 | SPROUTY 2. | tremblnew AAD56005 | ND |
| 2457 | 145.2 | Fragment of human secreted protein encoded by gene 54. | geneseqp V36675 | ND |
| 2458 | 145.2 | 133AA LONG HYPOTHETICAL PROTEIN. | sptrembl Q9YDU6 | ND |
| 2459 | 145.2 | KIAA1103 PROTEIN (FRAGMENT). | tremblnew BAA83055 | ND |
| 2460 | 145.2 | K07E8.11 PROTEIN. | sptrembl O16693 | ND |
| 2461 | 145.2 | HEMOGLOBIN ALPHA-B CHAIN. | swissprot P51465 | ND |
| 2462 | 145.1 | HYDROXYPROLINE-RICH GLYCOPROTEIN. | sptrembl Q40692 | ND |
| 2463 | 145.1 | NAD(P)H-DEPENDENT XYLOSE REDUCTASE (EC 1.1.1.-) (XR). | swissprot P78736 | ND |
| 2464 | 145.1 | ASPARTATE TRANSAMINASE. | sptrembl P72859 | ND |
| 2465 | 145.1 | GLYCOPROTEIN G-2 (FRAGMENT). | tremblnew CAB65677 | ND |
| 2466 | 145.1 | Glucose repressor CREI of *T. reesei*. | geneseqp W13846 | ND |
| 2467 | 145.0 | HOMEOBOX PROTEIN ALX3 (FRAGMENT). | sptrembl O95075 | ND |
| 2468 | 145.0 | HIV-I ISOLATE 93BR020 FROM BRAZIL COMPLETE GENOME | sptrembl O70890 | ND |
| 2469 | 145.0 | WASP INTERACTING PROTEIN. | sptrembl O43516 | ND |

TABLE 1-continued

_Fusarium venenatum ESTs_

| Sequence Listing | zscore | Annotation | Database | Functional category |
|---|---|---|---|---|
| 2470 | 145.0 | BASIC DOMAIN LEUCINE ZIPPER TRANSCRIPTION FACTOR. | sptrembl Q9W6B1 | ND |
| 2471 | 144.9 | VASOPRESSIN REGULATED WATER CHANNEL. | sptrembl Q9Y169 | ND |
| 2472 | 144.9 | PRP8 PROTEIN HOMOLOGUE. | sptrembl O15881 | ND |
| 2473 | 144.9 | GLUE PROTEIN. | sptrembl Q27423 | ND |
| 2474 | 144.9 | MITOCHONDIA ASSOCIATED CYSTEINE-RICH PROTEIN SMCP. | sptrembl Q64208 | ND |
| 2475 | 144.9 | TREACLE PROTEIN (TREACHER COLLINS SYNDROME PROTEIN). | swissprot Q13428 | ND |
| 2476 | 144.8 | MIE2. | sptrembl Q98683 | ND |
| 2477 | 144.8 | LATE 100 KD PROTEIN. | swissprot P11824 | ND |
| 2478 | 144.7 | HYPOTHETICAL 6.3 KD PROTEIN 123F2.5 IN CHROMOSOME X. | swissprot Q22702 | ND |
| 2479 | 144.7 | HEPATITIS A VIRUS RECEPTOR. | sptrembl O18984 | ND |
| 2480 | 144.7 | Peptide encoded by HRGP gene cassette incorporating a GAGP construct. | geneseqp Y01282 | ND |
| 2481 | 144.7 | HYPOTHETICAL PROTEIN (FRAGMENT). | sptrembl P72068 | ND |
| 2482 | 144.7 | NCK-ASSOCIATED PROTEIN NAP5 (FRAGMENT). | sptrembl O14513 | ND |
| 2483 | 144.7 | AMPHIOXUS OTX TRANSCRIPTION FACTOR. | sptrembl O45024 | ND |
| 2484 | 144.7 | _A. oryzae_ DEBY 10.3 locus protein sequence. | geneseqp Y39872 | ND |
| 2485 | 144.6 | Cyn dl derived from clone 22 (C22). | geneseqp R37919 | ND |
| 2486 | 144.6 | HYPOTHETICAL 14.8 KD PROTEIN. | sptrembl O43034 | ND |
| 2487 | 144.6 | TRISTETRAPROLINE (TTP) (TIS011A) (TIS11) (ZFP-36) (GROWTH FACTOR-INDUCIBLE NUCLEAR PROTEIN NUP475 (TPA INDUCED SEQUENCE II). | swissprot P22893 | ND |
| 2488 | 144.6 | MACROSIALIN PRECURSOR (CD68). | swissprot P31996 | ND |
| 2489 | 144.5 | SERINE PROTEASE INHIBITOR-3. | sptrembl O77418 | ND |
| 2490 | 144.5 | SPERM PROTAMINE P1. | swissprot P3531 | ND |
| 2491 | 144.5 | HYPOTHETICAL 63.2 KD PROTEIN. | sptrembl O59725 | ND |
| 2492 | 144.5 | ANGIOGENIN (EC 3.1.27.-). | swissprot P31347 | ND |
| 2493 | 144.5 | L549.6. | sptrembl O60967 | ND |
| 2494 | 144.5 | Fibrinogenolytic protein #4 from snake venom. | geneseqp R20557 | ND |
| 2495 | 144.5 | Sequence of spermatozoal antigen peptide. | geneseqp P40632 | ND |
| 2496 | 144.5 | CYSTEINE-RICH PROTEIN (FRAGMENT). | sptrembl Q16861 | ND |
| 2497 | 144.5 | _Streptococcus pneumoniae_ PspA central region. | geneseqp W14576 | ND |
| 2498 | 144.5 | CARBAMOYL-PHOSPHATE SYNTHETASE SUBUNIT A. | sptrembl O30576 | ND |
| 2499 | 144.4 | Acylcoenzyme A: cholesterol acyltransferase partial sequence. | geneseqp W43413 | ND |
| 2500 | 144.4 | CAMP-SPECIFIC PHOSPHODIESTERASE. | sptrembl O35470 | ND |
| 2501 | 144.4 | HYPOTHETICAL 21.7 KD PROTEIN. | sptrembl O67497 | ND |
| 2502 | 144.4 | RNA BINDING PROTEIN (FRAGMENT). | tremblnew BAA83714 | ND |
| 2503 | 144.4 | HYPOTHETICAL 26.2 KD PROTEIN. | sptrembl O30169 | ND |

TABLE 1-continued

Fusarium venenatum ESTs

| Sequence Listing | zscore | Annotation | Database | Functional category |
|---|---|---|---|---|
| 2504 | 144.4 | SPDA PROTEIN | sptrembl Q07193 | ND |
| 2505 | 144.3 | HIGH CYSTEINE KERATIN-ASSOCIATED PROTEIN 12.1. | sptrembl Q9Z287 | ND |
| 2506 | 144.3 | KIAA0775 PROTEIN. | sptrembl O94873 | ND |
| 2507 | 144.3 | MITOCHONDRIAL CAPSULE SELENOPROTEIN. | sptrembl O70613 | ND |
| 2508 | 144.3 | FORKHEAD-RELATED TRANSCRIPTION FACTOR 3 (FREAC-3). | swissnew Q12948 | ND |
| 2509 | 144.3 | HYPOTHETICAL 43.6 KD PROTEIN. | sptrembl Q03935 | ND |
| 2510 | 144.3 | PUTATIVE INTEGRASE. | tremblnew CAB65361 | ND |
| 2511 | 144.2 | NEUTROPHIL PROTEIN (FRAGMENT). | sptrembl Q99331 | ND |
| 2512 | 144.2 | CHORIOGENIN H PRECURSOR | sptrembl P79817 | ND |
| 2513 | 144.2 | SEGMENTATION GENE. | tremblnew AAD19794 | ND |
| 2514 | 144.2 | DNA BINDING PROTEIN (FRAGMENT). | sptrembl Q40726 | ND |
| 2515 | 144.2 | KV3.1 POTASSIUM CHANNEL. | tremblnew AAD52813 | ND |
| 2516 | 144.1 | HYPOTHETICAL 53.5 KD PROTEIN IN GCD14-POS18 INTERGENIC REGION. | swissprot P47018 | ND |
| 2517 | 144.1 | CYTOCHROME P450 17 (EC 1.14.99.9) (CYPXVII) (P450-C17) (STEROID 17-ALPHA-HYDROXYLASE/17.20 LYASE). | swissprot O57525 | ND |
| 2518 | 144.1 | TRANSCRIPTION FACTOR (FRAGMENT). | tremblnew AAD27591 | ND |
| 2519 | 144.1 | MUCIN MUC5B (FRAGMENT). | sptrembl Q99552 | ND |
| 2520 | 144.1 | Hepatocyte nuclear factor 4 alpha polypeptide (exon 8 product). | geneseqp W71571 | ND |
| 2521 | 144.1 | LATENCY ASSOCIATED TRANSCRIPT. | sptrembl Q9YPF7 | ND |
| 2522 | 144.0 | PUTATIVE HYDROLASE. | tremblnew CAB59667 | ND |
| 2523 | 144.0 | PISTIL-SPECIFIC EXTENSIN-LIKE PROTEIN (FRAGMENT). | sptrembl Q40552 | ND |
| 2524 | 144.0 | SMALL PROLINE-RICH PROTEIN WITH PAIRED REPEAT. | sptrembl Q28593 | ND |
| 2525 | 143.9 | W02G9.5 PROTEIN. | sptrembl O61903 | ND |
| 2526 | 143.9 | Mammalian ion channel proline rich motif containing peptide #19. | geneseqp Y41625 | ND |
| 2527 | 143.9 | F24J5.8 PROTEIN. | tremblnew AAD49974 | ND |
| 2528 | 143.9 | CHROMOSOME XII READING FRAME ORF YLR020C. | sptrembl Q07950 | ND |
| 2529 | 143.9 | BETA(1,4)-GLUCAN GLUCANOHYDROLASE PRECURSOR | sptrembl O31030 | ND |
| 2530 | 143.9 | INSA. | tremblnew AAD45539 | ND |
| 2531 | 143.9 | NICE-1 PROTEIN | tremblnew CAB65093 | ND |
| 2532 | 143.8 | Human lysosomal membrane sialoglycoprotein lamp-1 | geneseqp R69554 | ND |
| 2533 | 143.8 | *T. gondii* immunogenic protein. | geneseqp Y29081 | ND |
| 2534 | 143.8 | 50KD PROLINE RICH PROTEIN. | sptrembl Q9ZBP2 | ND |

TABLE 1-continued

*Fusarium venenatum* ESTs

| Sequence Listing | zscore | Annotation | Database | Functional category |
|---|---|---|---|---|
| 2535 | 143.8 | MITOGEN-ACTIVATED PROTEIN KINASE HOMOLOG NTF6 (EC 2.7.1.-) (P43). | swissprot Q40531 | ND |
| 2536 | 143.7 | Intestinal mucin deduced from clone SMUC 40. | geneseqp R07670 | ND |
| 2537 | 143.7 | PUTATIVE DEUBIQUITINATING ENZYME UBPY. | sptrembl Q9WVP5 | ND |
| 2538 | 143.7 | CALDENDRIN. | sptrembl O88751 | ND |
| 2539 | 143.7 | MULTIDRUG-EFFLUX TRANSPORTER, PUTATIVE. | tremblnew AAF12676 | ND |
| 2540 | 143.7 | F13F21.7 PROTEIN. | sptrembl Q9X1B6 | ND |
| 2541 | 143.7 | METALLOPROTEINASE PRECURSOR. | tremblnew AAF01041 | ND |
| 2542 | 143.7 | HYPOTHETICAL 21.5 KD PROTEIN (FRAGMENT). | sptrembl Q9Y4U5 | ND |
| 2543 | 143.7 | M150R. | tremblnew AAF15037 | ND |
| 2544 | 143.6 | DY3.5 PROTEIN. | sptrembl O45322 | ND |
| 2545 | 143.6 | MACROPHOMATE SYNTHASE. | tremblnew BAA89352 | ND |
| 2546 | 143.6 | Human glial fibrillary acidic protein GFAP mutant fragment 13. | geneseqp Y21004 | ND |
| 2547 | 143.6 | PLENTY-OF-PROLINES-101. | sptrembl O70495 | ND |
| 2548 | 143.6 | KERATIN, HIGH-SULFUR MATRIX PROTEIN, IIIA3. | swissprot P02441 | ND |
| 2549 | 143.6 | Rodent DCMP1 C-lectin family gene protein sequence. | geneseqp W88128 | ND |
| 2550 | 143.5 | ATPASE SUBUNIT 6. | tremblnew AAF17127 | ND |
| 2551 | 143.5 | Peptide derived from the beta subunit of hCG. | geneseqp W42217 | ND |
| 2552 | 143.5 | NEUROFILAMENT TRIPLET L PROTEIN (NF-L). | swissprot Q02916 | ND |
| 2553 | 143.5 | L2602.6. | sptrembl O60961 | ND |
| 2554 | 143.5 | Y69E1A.2 PROTEIN. | sptrembl Q9XW38 | ND |
| 2555 | 143.5 | VERY HYPOTHETICAL PROTEIN. | tremblnew CAB52561 | ND |
| 2556 | 143.4 | Amino acid sequence of a mouse sperm protein designated sp56. | geneseqp W39924 | ND |
| 2557 | 143.4 | HOMOLOG OF HUMAN MLLT2 UNIDENTIFIED GENE (MAL4) (FRAGMENT). | sptrembl O35233 | ND |
| 2558 | 143.4 | HYPOTHETICAL 90.6 KD PROTEIN C09D8.2. IN CHROMOSOME II. | sptrembl Q09434 | ND |
| 2559 | 143.3 | HYPOTHETICAL 57.2 KD PROTEIN. | sptrembl O68872 | ND |
| 2560 | 143.3 | W CHROMOSOME-SPECIFIC XHO1 FAMILY REPEAT (FRAGMENT). | sptrembl Q90983 | ND |
| 2561 | 143.3 | PROTO-ONCOGENE FRAT1 (FREQUENTLY REARRANGED IN ADVANCED T-CELL LYMPHOMAS). | swissnew Q92837 | ND |
| 2562 | 143.3 | NHP2/RS6 FAMILY PROTEIN YEL026W. | swissprot P39990 | ND |
| 2563 | 143.2 | Peptide encoded by HRGP gene cassette incorporating a SP construct. | geneseqp Y01284 | ND |
| 2564 | 143.2 | ATP SYNTHASE ALPHA CHAIN MITOCHONDRIAL PRECURSOR (EC 3.6.1.34). | swissnew P37211 | ND |
| 2565 | 143.2 | REPETITIVE SEQUENCE ELEMENT MGP-R5 (FRAGMENT). | sptrembl Q19395 | ND |
| 2566 | 143.2 | PUTATIVE TRANSCRIPTION FACTOR MYB94. | tremblnew CAB61986 | ND |

TABLE 1-continued

_Fusarium venenatum ESTs_

| Sequence Listing | zscore | Annotation | Database | Functional category |
|---|---|---|---|---|
| 2567 | 143.2 | HYPOTHETICAL 59.4 KD PROTEIN. | sptrembl Q89392 | ND |
| 2568 | 143.2 | VW02B12L.3 PROTEIN. | sptrembl Q9XXA2 | ND |
| 2569 | 143.1 | EG:BACR42117.8 PROTEIN. | tremblnew CAB65885 | ND |
| 2570 | 143.1 | C30E1.7 PROTEIN. | sptrembl O17330 | ND |
| 2571 | 143.1 | F26D10.11 PROTEIN. | sptrembl Q9XVU1 | ND |
| 2572 | 143.1 | PROLINE-RICH PROTEIN MP-2 PRECURSOR. | swissprot P05142 | ND |
| 2573 | 143.0 | NEUROGENIC DIFFERENTIATION FACTOR 1 (BETA-CELL E-BOX TRANS-ACTIVATOR 2) (BETA2). | swissprot Q60430 | ND |
| 2574 | 143.0 | TOPOISOMERASE 1. | sptrembl O24307 | ND |
| 2575 | 143.0 | COSMID F25B4. | sptrembl Q22965 | ND |
| 2576 | 143.0 | ENTERIC BETA-DEFENSIN PRECURSOR. | swissprot O02775 | ND |
| 2577 | 143.0 | ATROPHIN-RELATED PROTEIN ARP. | sptrembl Q9Y2W4 | ND |
| 2578 | 143.0 | Delta-endotoxin MIVDL | geneseqp R88002 | ND |
| 2579 | 143.0 | A-AGGLUTININ ATTACHMENT SUBUNIT PRECURSOR. | swissprot P32323 | ND |
| 2580 | 143.0 | AT2G21830 PROTEIN. | tremblnew AAD204102 | ND |
| 2581 | 143.0 | _Chlamydia pneumoniae_ lipoprotein sequence. | geneseqp Y35857 | ND |
| 2582 | 142.9 | REGULATORY PROTEIN P4G. | tremblnew CAB55346 | ND |
| 2583 | 142.9 | HYPOTHETICAL NUCLEAR PROTEIN (FRAGMENT). | tremblnew BAA87215 | ND |
| 2584 | 142.9 | ESTROGEN RECEPTOR BETA (FRAGMENT). | sptrembl Q95171 | ND |
| 2585 | 142.9 | HYPOTHETICAL 35.0 KD PROTEIN IN ARP5-OMP2 INTERGENIC REGION. | swissprot P53947 | ND |
| 2586 | 142.8 | Human glial fibrillary acidic protein GFAP wild type fragment 12. | geneseqp Y20986 | ND |
| 2587 | 142.8 | HYPOTHETICAL 13.4 KD PROTEIN. | sptrembl Q84187 | ND |
| 2588 | 142.8 | CODING REGION FOR PUTATIVE POLYPEPTIDE 2. | sptrembl Q64922 | ND |
| 2589 | 142.8 | Distal-less homeobox gene 3delta (DLX3delta) protein. | geneseqp Y39227 | ND |
|  | 142.8 | SERINE/THREONINE KINASE PAK HOMOLOG DPAK. | sptrembl Q24100 | ND |
| 2591 | 142.8 | PROTEOPHOSPHOGLYCAN (FRAGMENT). | sptrembl Q9Y075 | ND |
| 2592 | 142.7 | Cotton fibrous tissue specific protein KC03. | geneseqp W15761 | ND |
| 2593 | 142.7 | SOLUBLE DEATH RECEPTOR 3 BETA. | sptrembl O14866 | ND |
| 2594 | 142.7 | DNA. TRANSPOSABLE ELEMENT IS31831. | sptrembl Q45144 | ND |
| 2595 | 142.7 | KIAA1239 PROTEIN (FRAGMENT). | tremblnew BAA56553 | ND |
| 2596 | 142.7 | SIMILAR TO TYROSINE AMINOTRANSFERASE. | sptrembl Q9ZC65 | ND |
| 2597 | 142.7 | DEFENSIN GENE PRECURSOR. | sptrembl O65740 | ND |
| 2598 | 142.7 | Human VRF-2 truncated fragment 4. | geneseqp W86217 | ND |
| 2599 | 142.7 | NESTIN. | swissprot P48681 | ND |
| 2600 | 142.7. | RAG1 PROTEIN (FRAGMENT). | tremblnew AAD54537 | ND |
| 2601 | 142.7 | VASOPRESSIN V2 RECEPTOR. | sptrembl O77808 | ND |

TABLE 1-continued

*Fusarium venenatum* ESTs

| Sequence Listing | zscore | Annotation | Database | Functional category |
|---|---|---|---|---|
| 2602 | 142.7 | DISULFIDE OXIDOREDUCTASE 188 aa chain A + B | pdb 1FVJ | ND |
| 2603 | 142.6 | HISTIDINE-RICH. | sptrembl Q20689 | ND |
| 2604 | 142.6 | HYPOTHETICAL 31.8 KD PROTEIN | tremblnew AAD49200 | ND |
| 2605 | 142.6 | DNA-DIRECTED DNA POLYMERASE (EC 2.7.7.7) (DNA NUCLEOTIDYLTRANSFERASE (DNA-DIRECTED)) (FRAGMENT). | sptrembl Q95037 | ND |
| 2605 | 142.6 | F36A2.7 PROTEIN. | sptrembl P90860 | ND |
| 2607 | 142.5 | Mouse Desert hedgehog protein Dhh. | geneseqp Y05511 | ND |
| 2608 | 142.5 | HOMEOBOX PROTEIN HOX-B4 (HOXB-4). | swissnew O13074 | ND |
| 2609 | 142.5 | *Mycobacterium* species protein sequence 15F. | geneseqp Y04837 | ND |
| 2610 | 142.5 | SINGLE-STRAND SELECTIVE MONOFUNCTIONAL URACIL DNA GLYCOSYLASE. | sptrembl O95862 | ND |
| 2611 | 142.4 | 102AA LONG HYPOTHETICAL PROTEIN. | sptrembl Q9YB00 | ND |
| 2612 | 142.4 | 104AA LONG HYPOTHETICAL PROTEIN. | sptrembl Q9YB81 | ND |
| 2613 | 142.4 | 152AA LONG HYPOTHETICAL PROTEIN. | sptrembl Q9YEE0 | ND |
| 2614 | 142.3 | LIM HOMEOBOX PROTEIN. | sptrembl P92031 | ND |
| 2615 | 142.3 | *Mycobacierium* species protein sequence 50B. | geneseqp Y04998 | ND |
| 2616 | 142.3 | MODULIN 23 PRECURSOR (N-23). | swissprot P04144 | ND |
| 2617 | 142.3 | A588R PROTEIN. | sptrembl O41070 | ND |
| 2618 | 142.3 | ZK1067.2 PROTEIN. | sptrembl Q23388 | ND |
| 2619 | 142.3 | PROLINE-AND GLUTAMINE-RICH PROTEIN. | tremblnew AAF07181 | ND |
| 2620 | 142.2 | CHLOROPLAST IMPORT-ASSOCIATED CHANNEL HOMOLOG. | tremblnew CAB51191 | ND |
| 2621 | 142.2 | WISKOTT-ALDRICH SYNDROME PROTEIN HOMOLOG 1. | sptrembl O36027 | ND |
| 2622 | 142.2 | PHOSPHOSERINE PHOSPHATASE (EC 3.1.3.3) (PSP) (O-PHOSPHOSERINE PHOSPHOHYDROLASE) (PSP). | swissnew P42941 | ND |
| 2623 | 142.2 | METHYL-CPG BINDING PROTEIN 2 (FRAGMENT). | tremblnew AAF21637 | ND |
| 2624 | 142.2 | FROM BASES 1663181 TO 1676139 (SECTION 145 OF 400) OF THE COMPLETE GENOME (SECTION 145 OF 400). | sptrembl P76176 | ND |
| 2625 | 142.2 | OUTER CAPSID PROTEIN VP2 (FRAGMENT). | sptrembl Q9WHT4 | ND |
| 2626 | 142.1 | 252AA LONG HYPOTHETICAL PROTEIN. | sptrembl Q9YBR3 | ND |
| 2627 | 142.1 | FIBRINOGEN-BINDING PROTEIN PRECURSOR. | sptrembl O70022 | |
| 2628 | 142.1 | HYPOTHETICAL 49.9 KD PROTEIN. | tremblnew CAB41154 | ND |
| 2629 | 142.1 | NULLO (FRAGMENT). | sptrembl O02574 | ND |
| 2630 | 142.0 | PUTATIVE | sptrembl | |
| 2631 | 142.0 | AMELOGENIN. | tremblnew BAA84220 | ND |
| 2632 | 142.0 | PHOSPHATIDYLINOSITOL 3-KINASE 2 (EC 2.7.1.137) (P13-KINASE) (PTDINS-3-KINASE) (P13K). | swissprot P54674 | ND |

TABLE 1-continued

*Fusarium venenatum* ESTs

| Sequence Listing | zscore | Annotation | Database | Functional category |
|---|---|---|---|---|
| 2633 | 142.0 | Sequence encoded by plasmid pUC18RRstop in *E. coli*. | geneseqp P94507 | ND |
| 2634 | 142.0 | THEOREDOXIN M-TYPE, CHLOROPLAST PRECURSOR (TRX-M). | swissprot P07591 | ND |
| 2635 | 142.0 | PUTATIVE SENSORY HISTIDINE KINASE. | sptrembl O86808 | ND |
| 2636 | 141.9 | METHYL-CPG BINDING PROTEIN. | sptrembl O15248 | ND |
| 2637 | 141.9 | SPERM PROTAMINE P1. | swissprot O18748 | ND |
| 2638 | 141.9 | 4Heptad-F zipper protein. | geneseqp W00956 | ND |
| 2639 | 141.9 | 113AA LONG HYPOTHETICAL PROTEIN. | sptrembl O58987 | ND |
| 2640 | 141.8 | SEQ ID NO 474 from W09922243. | geneseqp Y19756 | ND |
| 2641 | 141.8 | HYPOTHETICAL 10.3 KD PROTEIN. | sptrembl O32903 | ND |
| 2642 | 141.8 | HYPOTHETICAL 19.5 KD PROTEIN. | sptrembl Q52968 | ND |
| 2643 | 141.8 | PSEUDOURIDYLATE SYNTHASE (EC 4.2.1.70) (PSEUDOURIDINE SYNTHASE 1). | swissprot Q12211 | ND |
| 2644 | 141.7 | (SCSVI). | sptrembl Q87008 | ND |
| 2645 | 141.7 | Human receptor interacting protein. | geneseqp W04628 | ND |
| 2646 | 141.7 | SPROUTY 2. | sptrembl Q43507 | ND |
| 2647 | 141.6 | VARIABLE SURFACE ANTIGEN V-1, HEMADSORPTION NEGATIVE (VSAHA-) (FRAGMENT). | sptrembl Q50323 | ND |
| 2648 | 141.6 | BCL-X (FRAGMENT). | tremblnew AAC72232 | ND |
| 2649 | 141.6 | Fragment of human secreted protein encoded by gene 10. | geneseqp Y36432 | ND |
| 2650 | 141.6 | SRC protein tyrosine kinase derived peptide #4. | geneseqp R93347 | ND |
| 2651 | 141.6 | COAGULATION FACTOR XII PRECURSOR (EC 3.4.21.38) (HAGEMAN FACTOR) (HAT). | swissprot P00748 | ND |
| 2652 | 141.5 | P53. | tremblnew AAF03996 | ND |
| 2053 | 141.5 | SIMILAR TO TREHALASE PRECURSOR. NCB1 G1: 1086612. | sptrembl Q22195 | ND |
| 2654 | 141.5 | 151AA LONG HYPOTHETICAL PROTEIN. | sptrembl Q9YEG3 | ND |
| 2055 | 141.4 | HYPOTHETICAL 49.7 KD PROTEIN. | sptrembl P72163 | ND |
| 2656 | 141.4 | CYCLIN-E BINDING PROTEIN 1. | tremblnew BAA88519 | ND |
| 2657 | 141.4 | BLACKJACK. | sptrembl Q26471 | ND |
| 2658 | 141.4 | HPV16. E6/E7 proteins. | geneseqp R63865 | ND |
| 2659 | 141.4 | HYPOTHETICAL 69.8 KD PROTEIN. | tremblnew CAB52444 | ND |
| 2660 | 141.3 | CHORDIN. | sptrembl Q9Z0E2 | ND |
| 2661 | 141.3 | F53B6.2 PROTEIN. | sptrembl P00884 | ND |
| 2662 | 141.3 | ENVELOPE GLYCOPROTEIN (FRAGMENT). | sptrembl O91928 | ND |
| 2663 | 141.3 | TRANSCRIPTION FACTOR BTD (BUTTONHEAD). | swissprot Q24266 | ND |
| 2664 | 141.3 | NATURAL KILLER-ASSOCIATED TRANSCRIPT 2A PROTEIN. | sptrembl Q02803 | ND |
| 2665 | 141.3 | HOMEOBOX PROTEIN | sptrembl Q9YGT0 | ND |
| 2666 | 141.3 | Sequence A encoded by a portion of SA307. | geneseqp P60623 | ND |
| 2667 | 141.3 | SIMILAR TO C. ELEGANS PROTEIN D1044.3. | sptrembl Q20462 | ND |

TABLE 1-continued

*Fusarium venenatum* ESTs

| Sequence Listing | zscore | Annotation | Database | Functional category |
|---|---|---|---|---|
| 2668 | 141.2 | MOVEMENT PROTEIN. | sptrembl Q9YLR6 | ND |
| 2669 | 141.2 | HEPATITIS A VIRUS CELLULAR RECEPTOR I LONG FORM (HEPATITIS A VIRUS CELLULAR RECEPTOR SHORT FORM). | sptrembl O46598 | ND |
| 2670 | 141.2 | HYPOTHETICAL 69.2 KD PROTEIN IN HSP30-PMP1 INTERGENIC REGION. | swissprot P25351 | ND |
| 2671 | 141.2 | GENOME, PARTIAL SEQUENCE. | sptrembl Q98440 | ND |
| 2672 | 141.2 | RIBOSOME-INACTIVATING PROTEIN LUFFIN-B (RRNA N-GLYCOSIDASE) (EC 3.2.2.22). | swissprot P22851 | ND |
| 2673 | 141.1 | AGP6 PROTEIN. | sptrembl Q9XFR4 | ND |
| 2674 | 141.1 | INSULIN-LIKE. PEPTIDE INSL5. | sptrembl Q9WUG6 | ND |
| 2675 | 141.1 | T09F5.2 PROTEIN. | sptrembl O62373 | ND |
| 2676 | 141.0 | EXTENSIN PRECURSOR (PROLINE-RICH GLYCOPROTEIN). | swissprot P24152 | ND |
| 2677 | 141.0 | ANTI-DEATH PROTEIN. | sptrembl O75353 | ND |
| 2678 | 141.0 | MITC | sptrembl Q0WVY1 | ND |
| 2679 | 141.0 | 109AA LONG HYPOTHETICAL PROTEIN. | sptrembl Q9Y9G9 | ND |
| 2680 | 141.0 | RECOMBINATION-ACTIVATING PROTEIN 1. | sptrembl Q9W699 | ND |
| 2681 | 141.0 | ANTIVIRAL PROTEIN SK12. | swissprot P35207 | ND |
| 2682 | 141.0 | NUCLEAR POLYADENYLATED RNA-BINDING PROTEIN NAB2. | swissprot P32505 | ND |
| 2683 | 141.0 | HEMAGGLUTININ (FRAGMENT). | tremblnew AAD51242 | ND |
| 2684 | 140.9 | FOOT PROTEIN I PRECURSOR (FRAGMENT). | sptrembl O61477 | ND |
| 2685 | 140.9 | YCZB PROTEIN. | sptrembl O31467 | ND |
| 2686 | 140.9 | SARCOPHAGA PRO-CATHEPSIN B PRECURSOR. | sptrembl Q26655 | ND |
| 2687 | 140.9 | F6E13.10 PROTEIN. | sptrembl O80567 | ND |
| 2688 | 140.9 | T01C3.1 PROTEIN. | sptrembl Q22059 | ND |
| 2689 | 140.8 | ERPROT 213-21. | sptrembl O00302 | ND |
| 2690 | 140.8 | BAV3 ORF5 product. | geneseqp R75760 | ND |
| 2691 | 140.8 | PUTATIVE RAS-RELATED PROTEIN F43D9.2. | swissprot Q20365 | ND |
| 2692 | 140.8 | SP85 (FRAGMENT). | sptrembl O61134 | ND |
| 2693 | 140.7 | *Macadamia integrifolia* antimicrobial protein. | geneseqp W62829 | ND |
| 2694 | 140.7 | ANTIGENIC PROTEIN PFEMP2 (FRAGMENT). | sptrembl Q06165 | ND |
| 2695 | 140.7 | N-MYC PROTO-ONCOGENE PROTEIN. | swissprot P26014 | ND |
| 2696 | 140.7 | Human secreted protein #80. | geneseqp Y36208 | ND |
| 2691 | 140.7 | HYPOTHETICAL 46.3 KD PROTEIN. | sptrembl Q9X039 | ND |
| 2698 | 140.6 | HYPOTHETICAL 32.1 KD PROTEIN. | sptrembl O79450 | ND |
| 2699 | 140.5 | F316.13 PROTEIN. | sptrembl O48687 | ND |
| 2700 | 140.5 | KAPPA CASEIN PRECURSOR. | sptrembl Q9XSD6 | ND |
| 2701 | 140.5 | WINGLESS (FRAGMENT). | sptrembl O48687 | |
| 2702 | 140.5 | MEROZOITE SURFACE PROTEIN-1 (FRAGMENT). | sptrembl O00877 | ND |
| 2703 | 140.5 | KIAA1290 PROTEIN (FRAGMENT). | tremblnew BAA86604 | ND |
| 2704 | 140.5 | MAJOR CENTROMERE AUTOANTIGEN B (CENTROMERE PROTEIN B) (CEN P-B). | swissprot P48988 | ND |
| 2705 | 140.5 | TONB PROTEIN. | swissprot Q05613 | ND |

TABLE 1-continued

_Fusarium venenatum ESTs_

| Sequence Listing | zscore | Annotation | Database | Functional category |
|---|---|---|---|---|
| 2706 | 140.5 | GLUE PROTEIN. | sptrembl Q27423 | ND |
| 2707 | 140.4 | HYPOTHETICAL 14.6 KD PROTEIN. | tremblnew CAB57548 | ND |
| 2708 | 140.4 | PROTAMINE P1. | sptrembl O18749 | ND |
| 2709 | 140.4 | HYPOTHETICAL 18.3 KD PROTEIN. | tremblnew AAF09839 | ND |
| 2710 | 140.4 | TRANSPOSON TOL2. | sptrembl Q98969 | ND |
| 2711 | 140.4 | VPR PROTEIN | tremblnew AAF07319 | ND |
| 2712 | 140.4 | Intestinal mucin deduced from clone SMUC 41. | geneseqp RD7671 | ND |
| 2713 | 140.4 | Murine BMP-15 related protein PC-3 | geneseqp W11260 | ND |
| 2714 | 140.3 | BZIP TRANSCRIPTION FACTOR | sptrembl Q24525 | ND |
| 2715 | 140.3 | D1086.6 PROTEIN. | sptrembl O17729 | ND |
| 2716 | 140.3 | HYPOTHETICAL 30.3 KD PROTEIN. | sptrembl O85856 | ND |
| 2717 | 140.3 | FIMP | sptrembl Q46525 | ND |
| 2718 | 140.3 | HMG-Y RELATED PROTEIN B (SB16B PROTEIN) (FRAGMENT). | swissprot Q10370 | ND |
| 2719 | 140.3 | NEUTROPHIL PROTEIN (FRAGMENT). | sptrembl Q99331 | ND |
| 2720 | 140.3 | PUTATIVE GLYOXYLATE PATHWAY REGULATOR C5D6.09C. | sptrembl O14201 | ND |
| 2721 | 140.3 | HYPOTHETICAL 19.1 KD PROTEIN IN PD11-GLK1 INTERGENIC REGION. | swissprot P25571 | ND |
| 2722 | 140.2 | HOMEOBOX PROTEIN (FRAGMENT). | sptrembl O97671 | ND |
| 2723 | 140.2 | TATA BINDING PROTEIN (FRAGMENT). | tremblnew BAA21084 | ND |
| 2724 | 140.2 | NUCLEAR SEGREGATION PROTEIN BFR1. | swissprot P38934 | ND |
| 2725 | 140.2 | SYNAPSIN 1B. | sptrembl O88935 | ND |
| 2726 | 140.2 | PISTIL-SPECIFIC EXTENSTN-LIKE PROTEIN (FRAGMENT). | sptrembl Q40550 | ND |
| 2727 | 140.2 | HYPOTHETICAL PROTEIN IN FTR 5' REGION (ORFU) (FRAGMENT). | swissprot P56510 | ND |
| 2728 | 140.2 | PUTATIVE TRANSCRIPTIONAL REGULATORY PROTEIN. | tremblnew CAB53122 | ND |
| 2729 | 140.2 | Bioadhesive precursor protein from cDNA 52. | geneseqp P82971 | ND |
| 2730 | 140.2 | W09G12.6 PROTEIN. | sptrembl Q45197 | ND |
| 2731 | 140.2 | SIMILAR TO HERV-H PROTEASE AND HERV-E INTEGRASE. | sptrembl Q68997 | ND |
| 2732 | 140.1 | MEDEA. | sptrembl O65312 | ND |
| 2733 | 140.1 | CYTOCHROME B (FRAGMENT). | tremblnew AAD47483 | ND |
| 2734 | 140.1 | E32D1.9 PROTEIN. | sptrembl O16293 | ND |
| 2735 | 140.1 | PEARL1 1-LIKE PROTEIN. | tremblnew CAB41719 | ND |
| 2736 | 140.1 | ANION EXCHANGE PROTEIN 3 (NEURONAL BAND 3-LIKE PROTEIN) (ANION EXCHANGER 3 BRAIN ISOFORM). | swissnew O18917 | ND |
| 2737 | 140.1 | HYPOTHETICAL 55.0 KD PROTEIN. | sptrembl O94256 | ND |
| 2738 | 140.1 | _Aspergillus niger_ beta-fructofuranosidase. | geneseqp W23298 | ND |
| 2739 | 140.1 | FIBRIL PROTEIN. | sptrembl O66099 | ND |
| 2740 | 140.0 | NS3F4 (FRAGMENT). | sptrembl Q86914 | ND |
| 2741 | 140.0 | HOMEOBOX PROTEIN NK-1 (S59/2). | swissprot P22807 | ND |
| 2742 | 140.0 | HYPOTHETICAL 47.8 KD PROTEIN IN HSP26-TIF32 INTERGENIC REGION. | swissprot P38244 | ND |

TABLE 1-continued

*Fusarium venenatum* ESTs

| Sequence Listing | zscore | Annotation | Database | Functional category |
|---|---|---|---|---|
| 2743 | 139.9 | ARGINYL-TRNA SYNTHETASE (EC 6.1.1.19) (ARGININE--TRNA LIGASE) (ARGRS). | swissprot O83803 | ND |
| 2744 | 139.9 | T01B7.8 PROTEIN. | sptrembl Q22048 | ND |
| 2745 | 139.9 | HOMEOBOX PROTEIN HOX-A3 (HOX-1E). | swissprot O43365 | ND |
| 2746 | 139.8 | METABOTROPIC GLUTAMATE RECEPTOR (FRAGMENT). | tremblnew AAD47893 | ND |
| 2747 | 139.8 | ECDYSONE-INDUCIBLE PROTEIN E75. | swissnew Q08893 | ND |
| 2748 | 139.8 | HYPOTHETICAL 21.2 KD PROTEIN IN T0R2-MNN4 INTERGENIC REGION | swissprot P36042 | ND |
| 2749 | 139.8 | F40F12.5A PROTEIN | tremblnew CAB54246 | ND |
| 2750 | 139.7 | PREDICTED SECRETED PROTEIN (THROMBOSPONDIN DOMAIN). | sptrembl O96207 | ND |
| 2751 | 139.7 | U1.7 PROTEIN. | sptrembl Q9YVB6 | ND |
| 2752 | 139.7 | Amino acid sequence of a virulence factor encoded by ORF29729. | geneseqp Y29213 | ND |
| 2753 | 139.7 | UNKNOWN PROTEIN (FRAGMENT). | sptrembl Q29175 | ND |
| 2754 | 139.7 | SPERM HISTONE P2 PRECURSOR (PROTAMINE MP2). | swissprot P07978 | ND |
| 2755 | 139.7 | PLATELET GLYCOPROTEIN V (FRAGMENT). | tremblnew AAF08787 | ND |
| 2756 | 139.7 | ATP OPERON (FRAGMENT). | sptrembl Q53031 | ND |
| 2757 | 139.7 | PEPTIDE CHAIN RELEASE FACTOR HOMOLOG (RE-H). | swissprot P28369 | ND |
| 2758 | 139.7 | PROBABLE TRANSLATION INITIATION FACTOR IF-2 | swissprot Q10251 | ND |
| 2759 | 139.6 | CLASS IV ZYGOTE SPECIFIC CELL WALL HYDROXYPROLINE-RICH GLYCOPROTEIN (FRAGMENT). | sptrembl Q41178 | ND |
| 2760 | 139.6 | NHOA. | sptrembl P96848 | ND |
| 2761 | 139.6 | HYPOTHETICAL 30.8 KD PROTEIN. | tremblnew AAF09969 | ND |
| 2762 | 139.6 | GAG. | sptrembl Q9YLH4 | ND |
| 2763 | 139.6 | P1021 PROTEIN. | sptrembl O13612 | ND |
| 2764 | 139.6 | 122AA LONG HYPOTHETICAL PROTEIN. | sptrembl Q9YBE6 | ND |
| 2765 | 139.6 | T13D8.9 PROTEIN. | sptrembl O80743 | ND |
| 2766 | 139.6 | MEMBRANE PROTEIN MOSC. | swissprot Q07609 | ND |
| 2767 | 130.5 | SIMILARITY TO TYPE I INOSITOL 1. | sptrembl O04649 | ND |
| 2768 | 139.5 | COSMID ZK813. | sptrembl Q23606 | ND |
| 2769 | 139.5 | Fragmented human NF-L gene +2 Frameshift mutant product. | geneseqp W18658 | ND |
| 2770 | 139.5 | DNA-DIRECTED RNA POLYMERASE SUBUNIT B' (EC 2.7.7.6). | swissprot P41557 | ND |
| 2771 | 139.5 | *S. lividans* protease PS-6. | geneseqp R80506 | ND |
| 2772 | 139.5 | IGG FC BINDING PROTEIN (FRAGMENT). | sptrembl O95784 | ND |
| 2773 | 139.4 | EXTENSIN=NODULE-SPECIFIC PROLINE-RICE PROTEIN [CLONE VENDS-E]. | tremblnew G425682 | ND |
| 2774 | 139.4 | C01B7.3 PROTEIN. | sptrembl Q17546 | ND |
| 2775 | 139.4 | PRECOAT PROTEIN. | sptrembl O9WPG4 | ND |

TABLE 1-continued

*Fusarium venenatum* ESTs

| Sequence Listing | zscore | Annotation | Database | Functional category |
|---|---|---|---|---|
| 2776 | 130.3 | DELTA-AMINOLEVULINIC ACID DEHYDRATASE (EC 4.2.1 24) (PORPHOBILINOGEN SYNTHASE) (ALADH). | swissnew P05373 | ND |
| 2777 | 139.3 | Mammalian ion channel proline rich motif containing peptide #19. | geneseqp Y41625 | ND |
| 2778 | 139.3 | CYSTEINE PROTEASE. | tremblnew CAB59816 | ND |
| 2779 | 130.3 | UL26 protease deletion mutant DD, amino acids 219-635 deleted. | geneseqp R28645 | ND |
| 2780 | 130.3 | Chlamydial major outer membrane protein (MOMP) H fragment. | geneseqp W95280 | ND |
| 2781 | 139.3 | L4830.11 PROTEIN. | sptrembl O97215 | ND |
| 2782 | 139.3 | CAGO. | sptrembl P04828 | ND |
| 2783 | 139.3 | LICTIN=CHITIN-BINDING PROTEIN. | tremblnew G688080 | ND |
| 2784 | 139.2 | PUTATIVE PHOSPHATE/ PHOSPHOENOLPYRUVATE TRANSLOCATOR. | tremblnew AAD55791 | ND |
| 2785 | 139.2 | PUTATIVE GLYCOPROTEIN | sptrembl O36424 | ND |
| 2786 | 139.2 | Carbonic anhydrase as deduced from DNA carried on pCOA20. | geneseqp | ND |
| 2787 | 139.2 | Plasmid pASK75 open reading frame (c) translation | geneseqp R88636 | ND |
| 2788 | 139.2 | HYPOTHETICAL 16.6 KD PROTEIN. | sptrembl O67910 | ND |
| 2789 | 139.2 | RABPHILIN-3A RELATED PROTEIN | sptrembl O54880 | ND |
| 2790 | 139.2 | HYPOTHETICAL 48.0 KD PROTEIN | sptrembl Q50175 | ND |
| 2791 | 139.2 | HYPOTHETICAL 7.2 KD PROTEIN. | sptrembl Q9X477 | ND |
| 2792 | 139.2 | PUTATIVE U4/U6 SMALL NUCLEAR RIBONUCLEOPROTEIN. | tremblnew AAD25639 | ND |
| 2793 | 139.2 | DEE chimeric molecule hA110-120/I-E-d-beta/FC-gamma-2a protein. | geneseqp W99773 | ND |
| 2794 | 139.2 | SPERM PROTAMINE P1. | swissprot O18747 | ND |
| 2795 | 139.1 | ATPASE SUBUNIT 6 (FRAGMENT). | tremblnew AAD34165 | ND |
| 2796 | 139.1 | Human HUPF-1 mutant protein fragment 33. | geneseqp Y21385 | ND |
| 2797 | 139.1 | PROLINE-RICH PROTEIN. | sptrembl O94274 | ND |
| 2798 | 139.1 | HYPOTHETICAL 42.7 KD PROTEIN. | tremblnew CAB5S294 | ND |
| 2799 | 139.0 | F11A6.2 PROTEIN. | sptrembl O62149 | ND |
| 2800 | 139.0 | HYPOTHETICAL 47.8 KD PROTEIN YOR009W. | sptrembl Q12218 | ND |
| 2801 | 139.0 | HYPOTHETICAL 18.8 KD PROTEIN (ORF4). | swissprot P15605 | ND |
| 2802 | 139.0 | 105AA LONG HYPOTHETICAL PROTEIN. | sptrembl Q9YCK7 | ND |
| 2803 | 139.0 | PUTATIVE REGULATORY PROTEIN FMDB. | swissprot Q50229 | ND |
| 2804 | 139.0 | HOXB-3 PRODUCT. | tremblnew G913072 | ND |
| 2805 | 139.0 | EXTENSIN PRECURSOR (CELL WALL HYDROXYPROLINE-RICH GLYCOPROTEIN). | swissprot P13983 | ND |
| 2806 | 139.0 | DETHIOBIOTIN SYNTHETASE (EC 6.3.3.3) (DETHIOBIOTIN SYNTHASE) (DTB SYNTHETASE) (DTBS). | swissprot P45486 | ND |

TABLE 1-continued

*Fusarium venenatum* ESTs

| Sequence Listing | zscore | Annotation | Database | Functional category |
|---|---|---|---|---|
| 2807 | 139.0 | PUTATIVE 2,3-BISPHOSPHOGLYCERATE-INDEPENDENT PHOSPHOGLYCERATE MUTASE (EC 5.4.2.1) (PHOSPHOGLYCEROMUTASE) (BPG-INDEPENDENT PGAM). | swissprot Q06464 | ND |
| 2808 | 138.9 | SPID PRECURSOR (FRAGMENT). | sptrembl Q23804 | ND |
| 2809 | 138.9 | SIMILAR TO HUMAN MRNA FOR ALPHA 1 | sptrembl Q9XJ18 | ND |
| 2810 | 138.9 | OPA REPLA 1 (FRAGMENT). | sptrembl O62006 | ND |
| 2811 | 138.9 | NADH DEHYDROGENASE SUBUNIT 3. | tremblnew BAA84934 | ND |
| 2812 | 138.9 | PMS2 RELATED PROTEIN HPMSR6. | sptrembl Q13670 | ND |
| 2813 | 138.9 | Human 5' EST secreted protein SEQ ID NO:250. | geneseqp Y11598 | ND |
| 2814 | 138.9 | N-ACETYLGLUCOSAMINE-1-PHOSPHATE URIDYLTRANSFERASE (GLMU) (FRAGMENT). | sptrembl O50225 | ND |
| 2815 | 138.8 | COAT PROTEIN. | sptrembl Q84827 | ND |
| 2816 | 138.8 | PDHR. | sptrembl O06160 | ND |
| 2817 | 138.8 | NON-STRUCTURAL 5A PROTEIN (FRAGMENT). | sptrembl Q68657 | ND |
| 2818 | 138.8 | VEGF/CPG2 fusion protein CPV165H6. | geneseqp W38237 | ND |
| 2819 | 138.8 | E38B7.1 PROTEIN. | sptrembl Q20155 | ND |
| 2320 | 138.8 | Human breast turnour-associated protein 30. | geneseqp Y48569 | ND |
| 2821 | 138.8 | LIM PROTEIN PIN-2. | swissprot Q19157 | ND |
| 2822 | 138.8 | AT2G28660 PROTEIN. | tremblnew AAD24369 | ND |
| 2823 | 138.8 | CYSTEINE-RICH OUTER MEMBRANE PROTEIN 3 PRECURSOR. | swissprot P27606 | ND |
| 2824 | 138.8 | TRANSITION PROTEIN 2. | sptrembl O77645 | ND |
| 2825 | 138.8 | K08F4.2 PROTEIN. | sptrembl Q21351 | ND |
| 2826 | 138.7 | 138AA LONG HYPOTHETICAL PROTEIN. | sptrembl Q9YE84 | ND |
| 2827 | 138.7 | SPERMATID-SPECIFIC PROTEIN S1. | swissprot P13275 | ND |
| 2828 | 138.7 | MHC CELL SURFACE GLYCOPROTEIN (FRAGMENT). | sptrembl Q31250 | ND |
| 2829 | 138.7 | HYPOTHETICAL 14.6 KD PROTEIN. | sptrembl Q54774 | ND |
| 2830 | 138.7 | U1-SNRNP BINDING PROTEIN HOMOLOG. | sptrembl Q16560 | ND |
| 2831 | 138.7 | HYPOTHETICAL 29.1 KD PROTEIN. | sptrembl Q50506 | ND |
| 2832 | 138.6 | TAT PROTEIN. | sptrembl O93199 | ND |
| 2833 | 138.6 | Human acid sphingomyelinase mutant fsP330. | geneseqp W35283 | ND |
| 2834 | 138.6 | K03D3.4 PROTEIN. | sptrembl O45642 | ND |
| 2835 | 138.6 | GEP PROTEIN. | tremblnew BAA85464 | ND |
| 2836 | 138.6 | HYPOTHETICAL 6.6 KD PROTEIN. | sptrembl P74795 | ND |
| 2837 | 138.5 | ALTERNATIVE OXIDASE. | sptrembl O48519 | ND |
| 2838 | 138.5 | KO1A2.2 PROTEIN. | tremblnew AAC69504 | ND |
| 2839 | 138.5 | HOMOLOGUE OF RETROVIRAL PSEUDOPROTLASE. | sptrembl Q85302 | ND |
| 2840 | 138.5 | ORF YOR053W. | sptrembl Q08428 | ND |
| 2841 | 138.5 | CYTOCHROME BC SUBUNIT IV PETD. | sptrembl Q9ZGF9 | ND |
| 2842 | 138.5 | GERANYLGERANYL PYROPHOSPHATE SYNTHASE-RELATED PROTEIN PRECURSOR. | sptrembl Q39108 | ND |

TABLE 1-continued

_Fusarium venenatum ESTs_

| Sequence Listing | zscore | Annotation | Database | Functional category |
|---|---|---|---|---|
| 2843 | 138.5 | SEED STORAGE PROTEIN 31 aa. chain A | pdb 1PNB | ND |
| 2844 | 138.4 | Immunodominant fragment of flagellar pocket antigen of _T. brucei_. | geneseqp R85174 | ND |
| 2845 | 138.4 | RIBONUCLEOSIDE-DIPHOSPHATE REDUCTASE SMALL CHAIN (EC 1.17.4.1) (RIBONUCLEOTIDE REDUCTASE M2 SUBUNIT). | swissprot O46310 | ND |
| 2846 | 138.4 | ALGINATE LYASE PRECURSOR (EC 4.2.2.3) (POLY(BETA-D-MANNDRONATE) LYASE) (POLY(MANA) ALGINATE LYASE). | swissprot Q59478 | ND |
| 2847 | 138.4 | Protein encoded by ORF A of the EcoRI-EcoRI fragment of ILTV. | geneseqp | ND |
| 2848 | 138.4 | HYPOTHETICAL BHLF1 PROTEIN. | swissprot P03181 | ND |
| 2849 | 138.4 | 140-KD SECRETORY PROTEIN (SP140) (FRAGMENT). | sptrembl Q23802 | ND |
| 2850 | 138.4 | Human 5' EST secreted protein SEQ ID No: 502. | geneseqp Y11902 | ND |
| 2811 | 138.3 | TOPOISOMERASE. | sptrembl Q9Z5W4 | |
| 2852 | 138.3 | KERATIN ULTRA HIGH-SULFUR MATRIX PROTEIN (UHS KERATIN). | swissprot P26372 | ND |
| 2853 | 138.3 | GLUE PROTEIN. | sptrembl Q27423 | ND |
| 2854 | 138.3 | T11J7.8 PROTEIN. | sptrembl O49334 | ND |
| 2855 | 138.3 | HYPOTHETICAL 31.4 KD PROTEIN B0285.2 IN CHROMOSOME III. | swissprot P46552 | ND |
| 2856 | 138.3 | MEMBRANE ASSOCIATED PROTEIN. | sptrembl O89260 | ND |
| 2857 | 138.3 | PUTATIVE ALCOHOL DEHYDROGENASE. | tremblnew AAF04851 | ND |
| 2858 | 138.3 | KILLER CELL LECTIN-LIKE RECEPTOR 7 (T-CELL SURFACE GLYCOPROTEIN LY-49G) (LY49-G ANTIGEN). | swissnew Q60654 | ND |
| 2859 | 138.3 | RNA-BINDING PROTEIN 5 (FRAGMENT). | sptrembl Q26275 | ND |
| | | _B. burgdorferi_ antigenic protein. 1940aa. | geneseqp Y19811 | ND |
| 2861 | 138.2 | Peptide resembling an SH3 domain binding peptide SEQ ID NO:366. | geneseqp W38960 | ND |
| 2862 | 138.2 | ALPHA/BETA-GLIADIN CLONE PW8142 PRECURSOR (PROLAMIN). | swissprot P04727 | ND |
| 2863 | 138.2 | MITOTIC MAD2 PROTEIN. | swissprot P40958 | ND |
| 2864 | 138.2 | KIAA0339. | sptrembl O15047 | ND |
| 2865 | 138.2 | CAPSID PROTEIN (CP). | sptrembl Q9W1J8 | ND |
| 2866 | 138.2 | MYB-LIKE DNA-BINDING DOMAIN PROTEIN. | sptrembl O49019 | ND |
| 2867 | 138.2 | HYPOTHETICAL 71.1 KD PROTEIN | sptrembl O65642 | ND |
| 2868 | 138.2 | RNPH PROTEIN (FRAGMENT). | tremblnew CAB60663 | ND |
| 2869 | 138.1 | 284R. | sptrembl O71105 | ND |
| 2870 | 138.1 | F14F9.2 PROTEIN. | sptrembl O17062 | ND |
| 2871 | 138.1 | D4B DOPAMINE RECEPTOR. | sptrembl O42322 | ND |
| 2872 | 138.1 | T31E10.8 PROTEIN. | sptrembl O64689 | ND |
| 2873 | 138.1 | GC-B. | geneseqp R38863 | ND |
| 2874 | 138.1 | WW DOMAIN BINDING PROTEIN II. | sptrembl O88539 | ND |
| 2875 | 138.1 | Intestinal mucin deduced from clone SMUC 41 | geneseqp RO7671 | ND |

TABLE 1-continued

_Fusarium venenatum ESTs_

| Sequence Listing | zscore | Annotation | Database | Functional category |
|---|---|---|---|---|
| 2876 | 138.0 | PUTATIVE KINESIN MOTOR PROTEIN (FRAGMENT). | tremblnew BAA87207 | ND |
| 2877 | 138.0 | HYPOTHETICAL 26.5 KD PROTEIN. | sptrembl O49443 | ND |
| 2878 | 138.0 | RORGAMMA T. | tremblnew AAD46913 | ND |
| 2879 | 138.0 | PROBABLE THIOREDOXIN. | swissprot Q09433 | ND |
| 2880 | 138.0 | HYPOTHETICAL 43.0 KD PROTEIN. | tremblnew CAB57416 | ND |
| 2881 | 138.0 | Human neurofilament-II mutant protein fragment 2. | geneseqp Y20843 | ND |
| 2882 | 138.0 | TACHYLECTIN-3 PRECURSOR. | sptrembl Q07404 | ND |
| 2883 | 138.0 | UBIQUITIN-CONJUGATING ENZYME E2 (EC 6.3.2.19) UBIQUITIN-PROTEIN LIGASE) (UBIQUITIN CARRIER PROTEIN). | sptrembl Q9Y2D3 | ND |
| 2884 | 138.0 | LUTROPIN BETA CHAIN (LUTEINIZING HORMONE) (LSH-B) (LH-B). | swissprot P25330 | ND |
| 2885 | 137.7 | SERINE 1 ULTRA HIGH SULFUR PROTEIN | sptrembl Q64507 | ND |
| 2886 | 137.9 | GLYCOPROTEIN B (FRAGMENT). | tremblnew AAD46114 | ND |
| 2887 | 137.9 | ISLET-BRAIN 1. | tremblnew AAD20443 | ND |
| 2888 | 137.9 | ORNITHINE DECARBOXYLASE ANTIZYME 2 (ODC-AZ 2) (AZ2). | swissnew O95190 | ND |
| 2889 | 137.9 | HOMEOBOX PROTEIN HOX-D3. | swissprot O93353 | ND |
| 2890 | 137.9 | ORF2 5' OF EPOR. | sptrembl Q64239 | ND |
| 2891 | 137.9 | AKIN GAMMA. | tremblnew CAB64718 | ND |
| 2892 | 137.9 | Human secreted protein encoded by gene No. 80. | geneseqp Y27646 | ND |
| 2893 | 137.8 | CHITINASE II PRECURSOR (EC 3.2.1.14). | sptrembl Q50145 | ND |
| 2894 | 137.8 | 117AA LONG HYPOTHETICAL PROTEIN. | sptrembl Q9YD41 | ND |
| 2895 | 137.8 | T27A16.25 PROTEIN. | sptrembl O52390 | ND |
| 2896 | 137.8 | LIM HOMEODOMAIN TRANSCRIPTION FACTOR. | sptrembl O96656 | ND |
| 2897 | 137.8 | BINDIN PRECURSOR (FRAGMENT). | tremblnew AAF07137 | ND |
| 2598 | 137.8 | Putative calcium channel encoded by clone SCCL-B. | geneseqp R34550 | ND |
| 2899 | 137.8 | HEMOMUCIN. | sptrembl Q24160 | ND |
| 2900 | 137.8 | 73AA LONG HYPOTHETICAL 30S RIBOSOMAL PROTEIN S27. | sptrembl Q9YF01 | ND |
| 2901 | 137.8 | HYPOTHETICAL 16.4 KD PROTEIN (FRAGMENT). | sptrembl O18970 | ND |
| 2902 | 137.7 | FEMALE-SPECIFIC TRANSFORMER PROTEIN. | swissprot Q23949 | ND |
| 2903 | 137.7 | ZINC FINGER PROTEIN 80 (ZNEPT17). | swissprot P51504 | ND |
| 2904 | 137.7 | CYSTEINE-RICH PROTEIN (FRAGMENT). | sptrembl Q16861 | ND |
| 2905 | 137.7 | EGE motif containing protein. | geneseqp Y18109 | ND |
| 2906 | 137.7 | TRANSCRIPTION FACTOR ATF-A AND ATF-A-DELTA. | swissnew P17544 | ND |
| 2907 | 137.7 | HYPOTHETICAL 26.6 KD PROTEIN C17A2.10C IN CHROMOSOME I. | sptrembl O13760 | ND |
| 2908 | 137.7 | Human DIP protein C-terminal sequence. | geneseqp Y18027 | ND |
| 2909 | 137.7 | ENDOCHITINASE ISOLOG. | sptrembl O24654 | ND |
| 2910 | 137.6 | GLUE PROTEIN. | sptrembl Q27423 | ND |

TABLE 1-continued

*Fusarium venenatum* ESTs

| Sequence Listing | zscore | Annotation | Database | Functional category |
|---|---|---|---|---|
| 2911 | 137.6 | ACETYLCHOLINE RECEPTOR PROTEIN. ALPHA-1A CHAIN PRECURSOR. | swissprot P22456 | ND |
| 2912 | 137.6 | POTENTIAL PROTEASOME ACTIVATOR HPA28 SUBUNIT BETA (FRAGMENT). | sptrembl Q95292 | ND |
| 2913 | 137.6 | Human CD2:1gG12a constant region fusion protein. | geneseqp W35861 | ND |
| 2914 | 137.5 | HYPOTHETICAL LYSINE-RICH PROTEIN. | tremblnew CAB52566 | ND |
| 2915 | 137.5 | NUCLEAR TRANSITION PROTEIN 2 (TP-2). | swissprot Q05952 | ND |
| 2916 | 137.5 | PUTATIVE RHO/RAC GUANINE NUCLEOTIDE EXCHANGE FACTOR (RHO/RAC GEF) (FACIOGENITAL DYSPLASIA PROTEIN). | swissprot P98174 | ND |
| 2917 | 137.5 | NADH DEHYDROGENASE SUBUNIT E (FRAGMENT). | tremblnew AAF08180 | ND |
| 2918 | 137.5 | BRANCHED-CHAIN AMINO ACID ABC TRANSPORTER. PERMEASE PROTEIN (BRAE-4). | sptrembl O25878 | ND |
| 2919 | 137.5 | 118AA LONG HYPOTHETICAL PROTEIN. | sptrembl Q9Y951 | ND |
| 2920 | 137.4 | PUTATIVE CHITIN SYNTHASE (EC 2.4.1.16). | sptrembl Q9Y7H9 | ND |
| 2921 | 137.4 | ARABINOGALACTAN-PROTEIN. | sptrembl Q9ZT16 | ND |
| 2922 | 137.4 | HYPOTHETICAL 32.5 KD PROTEIN F52C9.6. IN CHROMOSOME III. | swissprot Q10126 | ND |
| 2923 | 137.3 | PUTATIVE TRANSMEMBRANE EFFLUX PROTEIN (FRAGMENT) | tremblnew CAB60461 | ND |
| 2924 | 137.3 | Gp IIb/IIIa receptor ligand used in scintigraphic imaging of thrombi. | geneseqp R69293 | ND |
| 2925 | 137.3 | HYPOTHETICAL 41.0 KD PROTEIN C1F8.06 IN CHROMOSOME I. | swissprot Q92344 | ND |
| 2926 | 137.3 | VITAMIN D RECEPTOR-INTERACTING PROTEIN. | sptrembl Q9Y6652 | ND |
| 2927 | 137.3 | CONSERVED HYPOTHETICAL PROTEIN. | tremblnew AAF10237 | ND |
| 2928 | 137.3 | CYTOCHROME B. | swissprot Q37713 | ND |
| 2929 | 137.2 | *Mycobacterium tuberculosis* specific DNA-encoded polypeptide. | geneseqp Y31745 | ND |
| 2930 | 137.2 | GCD14 PROTEIN. | swissprot P46959 | ND |
| 2931 | 137.2 | UBIQUITIN ACTIVATING ENZYME. | sptrembl O82692 | ND |
| 2932 | 137.2 | PROTEASE VII PRECURSOR (EC 3.4.21.87) (OMPTIN) (OUTER MEMBRANE PROTEIN 3B) (PROTEASE A). | swissprot P09169 | ND |
| 2933 | 137.2 | ENVELOPE GLYCOPROTEIN (FRAGMENT). | sptrembl Q10525 | ND |
| 2934 | 137.1 | EBA-175 (FRAGMENT). | tremblnew AAB52719 | |
| 2935 | 137.1 | FLOCCULIN (FRAGMENT). | sptrembl P87107 | ND |
| 2936 | 137.1 | CYTIDINE DEAMINASE 8. | sptrembl Q9XHQ8 | ND |
| 2937 | 137.1 | N-terminal fragment of secretory leukocyte protease inhibitor. | geneseqp R84055 | ND |
| 2938 | 137.1 | PUTATIVE RING ZINC FINGER PROTEIN. | tremblnew AAD24830 | ND |

TABLE 1-continued

Fusarium venenatum ESTs

| Sequence Listing | zscore | Annotation | Database | Functional category |
|---|---|---|---|---|
| 2939 | 137.1 | AMELOGENIN. CLASS I PRECURSOR. | swissprot P02817 | ND |

TABLE 2

Aspergillus niger ESTs

| Sequence Listing | zscore | Annotation | Database | Functional Category |
|---|---|---|---|---|
| 3771 | 4033.3 | GLUCOAMYLASE G1 AND G2 PRECURSOR (EC 3.2.1.3) (GLUCAN 1,4-ALPHA-GLUCOSIDASE) (1,4-ALPHA-D-GLUCAN GLUCOHYDROLASE). | swissprot P04064 | ND |
| 3772 | 1863.3 | Glycosyltransferase. | geneseqp R42995 | ND |
| 3773 | 1724.7 | *Porphobilinogen synthase.* | geneseqp W41499 | Coenzyme metabolism |
| 3774 | 1648.5 | *Aspergillus awamori* glucoamylase mutant N20C, A27C, S30P, G137A. | geneseqp W55977 | ND |
| 3775 | 1543.7 | ALPHA-AMYLASE A PRECURSOR (EC 3.2.1.1) (TAKA-AMYLASE A) (TAA) (1,4-ALPHA-D-GLUCAN GLUCANOHYDROLASE). | swissprot P10529 | ND |
| 3776 | 1534.2 | ACID ALPHA-AMYLASE (EC 3.2.1.1) (1.4-ALPHA-D-GLUCAN GLUCANOHYDROLASE). | swissprot P56271 | ND |
| 3777 | 1364.8 | PUTATIVE THIAZOLE SYNTHASE. | tremblnew AAF25444 | ND |
| 3778 | 1339.2 | *A. oryzae* DEBY932 locus protein sequence. | geneseqp Y39873 | Carbohydrate transport and metabolism |
| 3779 | 1321.0 | CYTOCHROME C OXIDASE SUBUNIT V. | sptrembl O93980 | ND |
| 3780 | 1285.2 | ADP-RIBOSYLATION FACTOR. | swissprot P34727 | ND |
| 3781 | 1250.9 | POLYUBIQUITIN. | sptrembl O74274 | ND |
| 3782 | 1220.9 | C-4 METHYL STEROL OXIDASE (EC 1---) | swissprot O59933 | ND |
| 3783 | 1218.0 | *Sphingomonas capsulata* aminopeptidase 1. | geneseqp W89587 | ND |
| 3784 | 1203.0 | *Aspergillus awamori* glucoamylase mutant N20C, A27C. | geneseqp W55976 | ND |
| 3785 | 1195.2 | *Aspergillus niger* glucoamylase enzyme. | geneseqp Y23338 | ND |
| 3786 | 1156.2 | Plasmid pASK75 open reading frame (b) translation. | geneseqp R88635 | ND |
| 3787 | 1150.6 | 60S RIBOSOMAL PROTEIN 1.7-C. | swissprot O60143 | Translation, ribosomal structure and biogenesis |
| 3788 | 1150.4 | 60S RIBOSOMAL PROTEIN 1.10 | tremblnew CAA22664 | Translation, ribosomal structure and biogenesis |
| 3789 | 1149.4 | Truncated *A. niger* glucoamylase G1 protein sequence. | geneseqp Y18090 | ND |
| 3790 | 1145.5 | An enzyme with sugar tranferase activity. | geneseqp W88044 | ND |
| 3791 | 1144.1 | ACID-STABLE ALPHA-AMYLASE. | sptrembl O13296 | ND |
| 3792 | 1140.9 | PUTATIVE THIAZOLE SYNTHASE. | tremblnew AAF25444 | ND |

TABLE 2-continued

Aspergillus niger ESTs

| Sequence Listing | zscore | Annotation | Database | Functional Category |
|---|---|---|---|---|
| 3793 | 1138.7 | RIBOSOMAL PROTEIN S28. | tremblnew CAB56815 | Translation, ribosomal structure and biogenesis |
| 3794 | 1135.4 | 40S RIBOSOMAL PROTEIN S5 (S2) (YS8) (RP14). | swissprot P26783 | Translation, ribosomal structure and biogenesis |
| 3795 | 1133.4 | UB11. | tremblnew AAF24230 | ND |
| 3796 | 1122.5 | ALPHA-AMYLASE A PRECURSOR (EC 3.2.1.1) (1,4-ALPHA-D-GLUCAN GLUCANOHYDROLASE A). | swissprot Q02905 | ND |
| 3797 | 1108.7 | SERYL-TRNA SYNTHETASE, CYTOPLASMIC (EC 6.1.1.11) (SERINE-TRNA LIGASE) (SERRS). | swissprot O14018 | Translation, ribosomal structure and biogenesis |
| 3798 | 1106.3 | GLYCERALDEHYDE 3-PHOSPHATE DEHYDROGENASE (EC 1.2.1.12) (GAPDH). | swissprot Q12552 | Carbohydrate transport and metabolism |
| 3799 | 1072.2 | Aspergillus awamori glucoamylase mutant N20C, A27C. | geneseqp W55976 | ND |
| 3800 | 1060.9 | Aspergillus awamori glucoamylase mutant N20C, A27C. | geneseqp W55976 | ND |
| 3801 | 1053.5 | RASP F 9 (FRAGMENT). | sptrembl O42800 | Carbohydrate transport and metabolism |
| 3802 | 1036.4 | FRUCTOSE-BISPHOSPHATE ALDOLASE (EC 4.1.2.13). | swissprot P53444 | Carbohydrate transport and metabolism |
| 3803 | 1034.1 | TRANSPOSASE. | sptrembl O00050 | ND |
| 3804 | 1026.3 | 40S RIBOSOMAL PROTEIN S15 (S12). | swissprot P34737 | Translation, ribosomal structure and biogenesis |
| 3805 | 1022.0 | 60S RIBOSOMAL PROTEIN L2 (YL6) (L5) (RP8). | swissprot P05736 | Translation, ribosomal structure and biogenesis |
| 3806 | 1014.6 | ADENOSINE-5'PHOSPHOSULFATE KINASE (EC 2.7.1.25) (ADENYLYLSULFATE KINASE) (APS KINASE) | sptrembl Q12657 | Inorganic ion transport and metabolism |
| 3807 | 1009.1 | CYCLOPHILIN-LIKE PEPTIDYL PROLYL CIS-TRANS ISOMERASE (EC 5.2.1.8). | sptrembl O94184 | Posttranslational modification, protein turnover, chaperones |
| 3808 | 1001.9 | HISTONE H2A. | sptrembl O13413 | ND |
| 3809 | 993.9 | ARP2/3 COMPLEX 20 KD SUBUNIT (P20-ARC). | swissprot O15509 | ND |
| 3810 | 964.0 | UBIQUITIN. | sptrembl Q9Y736 | ND |
| 3811 | 963.2 | 60S RIBOSOMAL PROTEIN L8 (L7A) (L4). | swissprot O13672 | Translation, ribosomal structure and biogenesis |
| 3812 | 955.7 | UBIQUINOL-CYTOCHROME C REDUCTASE IRON-SULFUR SUBUNIT, MITOCHONDRIAL PRECURSOR (EC 1.10.2.2) (RIESKE IRON-SULFUR PROTEIN) (RISP) | swissprot P07056 | Energy production and conversion |
| 3813 | 952.3 | ENOLASE (EC 4.2.1.11) (2-PHOSPHOGLYCERATE DEHYDRATASE) (2-PHOSPHO-D-GLYCERATE HYDRO-LYASE). | swissprot Q12560 | Carbohydrate transport and metabolism |

TABLE 2-continued

*Aspergillus niger* ESTs

| Sequence Listing | zscore | Annotation | Database | Functional Category |
|---|---|---|---|---|
| 3814 | 950.5 | RIBOSOMAL PROTEIN L13A. | tremblnew AAD54383 | Translation, ribosomal structure and biogenesis |
| 3815 | 935.8 | *Aspergillus awamori* glucoamylase mutant N20C, A27C. | geneseqp W55976 | ND |
| 3816 | 933.7 | PROTEIN DISULFIDE ISOMERASE PRECURSOR (PDI) (EC 5.3.4.1). | swissnew Q12730 | ND |
| 3817 | 930.5 | 60S RIBOSOMAL PROTEIN 1.23. | swissprot Q07760 | Translation, ribosomal structure and biogenesis |
| 3818 | 928.4 | *Aspergillus awamori* glucoamylase mutant N20C, A27C, 5411A. | geneseqp W55980 | ND |
| 3819 | 926.5 | ATP SYNTHASE BETA CHAIN, MITOCHONDRIAL. PRECURSOR (EC 3.6.1.34). | swissnew P23704 | Energy production and conversion |
| 3820 | 912.5 | 40S RIBOSOMAL PROTEIN S4 (S7) (Y56) (RP5). | swissprot P05753 | Translation, ribosomal structure and biogenesis |
| 3821 | 909.6 | HYPOTHETICAL 32.5 KD PROTEIN Y1.R35IC. | swissprot P49954 | ND |
| 3822 | 907.3 | 60S ACIDIC RIBOSOMAL. PROTEIN P0 (L10E). | swissprot P05317 | Translation, ribosomal structure and biogenesis |
| 3823 | 897.7 | 40S RIBOSOMAL PROTEIN S17 (CRP3). | swissprot P27770 | Translation, ribosomal structure and biogenesis |
| 3824 | 897.5 | *Aspergillus awamori* glucoamylase mutant S411A. | geneseqp W55979 | ND |
| 3825 | 884.9 | 5-METHYLTETRAHYDROPTE ROYLTRIGLUTAMATE--HOMOCYSTEI METHYLTRANSFERASE (EC 2.1.1.14). | tremblnew CAB57427 | Amino acid transport and metabolism |
| 3826 | 880.2 | *Aspergillus awamori* glucoamylase mutant N20C, A27C. | geneseqp W55976 | ND |
| 3827 | 879.3 | *Aspergillus awamori* glucoamylase mutant N20C, A27C, S30P, G137A. | geneseqp W55977 | ND |
| 3828 | 877.7 | 60S RIBOSOMAL PROTEIN L20 (LI8A). | swissprot P47913 | ND |
| 3829 | 869.3 | MONOUBIQUITIN/CARBOXY EXTENSION PROTEIN FUSION. | sptrembl O74216 | ND |
| 3830 | 868.8 | GLYCERALDEHYDE 3-PHOSPHATE DEHYDROGENASE (EC 1.2.1.12) (GAPII). | swissprot Q12552 | Carbohydrate transport and metabolism |
| 3831 | 867.9 | UBIQUITIN FUSION PROTEIN. | sptrembl Q9Y854 | ND |
| 3832 | 865.9 | Yeast ribosomal protein S7. | geneseqp W36115 | Translation ribosomal structure and biogenesis |
| 3833 | 862.0 | FATTY ACID SYNTHASE BETA SUBUNIT. | sptrembl P78616 | Lipid metabolism |
| 3834 | 859.7 | CYTOCHROME C. | swissprot P56205 | ND |
| 3835 | 856.3 | ADP.ATP CARRIER PROTEIN (ADP/ATP TRANSLOCASE) (ADENINE NUCLEOTIDE TRANSLOCATOR) (ANT). | swissprot P02723 | ND |

TABLE 2-continued

*Aspergillus niger* ESTs

| Sequence Listing | zscore | Annotation | Database | Functional Category |
|---|---|---|---|---|
| 3836 | 856.3 | 60S RIBOSOMAL PROTEIN L27A (L29). | swissprot P78987 | Translation, ribosomal structure and biogenesis |
| 3837 | 855.9 | ALPHA-AMYLASE (EC 3.2.1.1). | tremblnew AAF14264 | ND |
| 3838 | 851.3 | PROBABLE PEROXISOMAL MEMBRANE PROTEIN PMP20 (ALLERGEN ASP F 3). | swissprot O43099 | ND |
| 3839 | 850.9 | NON-FUNCTIONAL FOLATE BINDING PROTEIN. | sptrembl O14597 | ND |
| 3840 | 837.5 | ASPARAGINYL-TRNA SYNTHETASE, CYTOPLASMIC (EC 6.1.1.22 (ASPARAGINE- TRNA LIGASE) (ASNRS) | swissprot P38707 | Translation, ribosomal structure and biogenesis |
| 3841 | 835.4 | ATP SYNTHASE DELTA CHAIN, MITOCHONDRIAL PRECURSOR (EC 3.6.1.34) (FRAGMENT). | swissnew P56525 | Energy production and conversion |
| 3842 | 821.8 | HISTONE H3. | swissprot P23753 | DNA replication, recombination and repair |
| 3843 | 821.7 | 60S RIBOSOMAL PROTEIN L18. | swissnew Q10192 | Translation, ribosomal structure and biogenesis |
| 3844 | 817.6 | *Aspergillus awamori* glucoamylase mutant N20C, A27C, S30P, G137A. | geneseqp W55977 | ND |
| 3845 | 803.2 | Ribosomal protein L41. | geneseqp R77658 | Translation, ribosomal structure and biogenesis |
| 3846 | 797.5 | 60S RIBOSOMAL PROTEIN L9-B (1.8) (YL11) (RP25) | swissprot P51401 | Translation, ribosomal structure and biogenesis |
| 3847 | 797.2 | NMTI PROTEIN HOMOLOG | swissprot P42882 | Inorganic ion transport and metabolism |
| 3848 | 797.1 | Truncated *A. niger* glucoamylase G1 protein sequence. | geneseqp Y18090 | ND |
| 3849 | 791.7 | GLUCOAMYLASE. | sptrembl Q02296 | ND |
| 3850 | 788.8 | 40S RIBOSOMAL PROTEIN S22 (SI5A) (YS24). | swissprot P33953 | Translation, ribosomal structure and biogenesis |
| 3851 | 769.6 | VACUOLAR ATP SYNTHASE SUBUNIT B (EC 3.6.1.34) (V-ATPASE 57 KD SUBUNIT). | swissprot P11593 | Energy production and conversion |
| 3852 | 760.4 | NUCLEOSIDE DIPHOSPHATE KINASE. | tremblnew BAA83495 | Nucleotide transport |
| 3853 | 759.6 | MALATE DEHYDROGENASE, MITOCHONDRIAL PRECURSOR (EC 1.1.1.37). | swissprot P17505 | Energy production and conversion |
| 3854 | 759.5 | 40S RIBOSOMAL PROTEIN S2 (S4) (YS5) (RP12) (OMNIPOTENT SUPRESSOR PROTEIN SUP44). | swissprot P25443 | Translation, ribosomal structure and biogenesis |
| 3855 | 756.4 | SPERMIDINE SYNTHASE. | sptrembl Q9Y8H7 | Amino acid transport and metabolism |
| 3856 | 756.3 | 60S RIBOSOMAL PROTEIN L20 (1.18A). | swissprot P47913 | ND |
| 3857 | 755.3 | Truncated *A. niger* glucoamylase GI protein sequence. | geneseqp Y18090 | ND |

TABLE 2-continued

*Aspergillus niger* ESTs

| Sequence Listing | zscore | Annotation | Database | Functional Category |
|---|---|---|---|---|
| 3858 | 753.8 | *Candida albican* fungal antigen - allergen SEQ ID NO 5. | geneseqp W53251 | Energy production and conversion |
| 3859 | 748.8 | PEPTIDYL-PROLYL CIS/TRANS ISOMERASE. | sptrembl O42735 | Posttranslational modification, protein turnover, chaperones |
| 3860 | 733.6 | 60S RIBOSOMAL PROTEIN 1.17-B (YL17-B). | swissprot P46990 | Translation, ribosomal structure and biogenesis |
| 3861 | 728.8 | PUTATIVE ADENOSINE KINASE. | tremblnew AAF23253 | Carbohydrate transport and metabolism |
| 3862 | 723.7 | HIT FAMILY PROTEIN 1. | swissprot Q04344 | ND |
| 3863 | 723.4 | *Aspergillus awamori* glucoamylase mutant N20C, A27C, S411A. | geneseqp W55980 | ND |
| 3864 | 719.9 | OUTER MITOCHONDRIAL MEMBRANE PROTEIN PORIN. | swissprot P07144 | ND |
| 3865 | 716.9 | 40S RIBOSOMAL PROTEIN S26E (CRP5) (13.6 KD RIBOSOMAL PROTEIN). | swissprot P21772 | ND |
| 3866 | 715.0 | HYPOTHETICAL 27.9 KD PROTEIN C22A12.17C IN CHROMOSOME 1. | sptrembl O13908 | ND |
| 3867 | 706.4 | HYDROLASE 108 aa | pdb IAC0 | ND |
| 3868 | 695.7 | EF-HAND PROTEIN. | tremblnew CAB55175 | ND |
| 3869 | 694.9 | POLYSACCHARIDE DEGRADATION 108 aa | pdb IACZ | ND |
| 3870 | 690.7 | PUTATIVE ARSENICAL PUMP-DRIVING ATPASE (EC 3.6.1.-) (ARSENITE-TRANSLOCATING ATPASE) (ARSENICAL RESISTANCE ATPASE). | swissnew P30632 | Inorganic ion transport and metabolism |
| 3871 | 690.1 | MULTICATALYTIC PROTEINASE 222 aa, chain M 1 | pdb IRYP | Posttranslational modification, protein turnover, chaperones |
| 3872 | 679.0 | DIHYDROLIPOAMIDE ACETYLTRANSFERASE COMPONENT OF PYRUVATE DEHYDROGENASE COMPLEX, MITOCHONDRIAL PRECURSOR (EC 2.3.1.12) (E2) (PDC-F2) (MRP3). | swissprot P20285 | Energy production and conversion |
| 3873 | 672.8 | OLIGO-1,4-1,4-GLUCANTRANSFERASE AMYLO-1,6-GLUCOSIDASE. | sptrembl O93808 | Carbohydrate transport and metabolism |
| 3874 | 671.9 | CYCLIN-DEPENDENT KINASES REGULATORY SUBUNIT (CELL DIVISION CONTROL PROTEIN CKS1). | swissprot P20486 | ND |
| 3875 | 665.8 | Sequence encoded by *A. awamori* glucoamylase genomic region. | geneseqp P40212 | ND |
| 3876 | 642.3 | HISTONE H3. | swissprot P23753 | DNA replication, recombination and repair |
| 3877 | 635.2 | CYCLPHILIN B (EC 5.2.1.8). | sptrembl O94190 | Posttranslational modification, protein turnover, chaperones |
| 3878 | 631.8 | ALPHA-AMYLASE A PRECURSOR (EC 3.2.1.1) (1,4-ALPHA-D-GLUCAN GLUCANOHYDROLASE A). | swissprot Q02905 | ND |

TABLE 2-continued

Aspergillus niger ESTs

| Sequence Listing | zscore | Annotation | Database | Functional Category |
|---|---|---|---|---|
| 3879 | 630.4 | 60S RIBOSOMAL PROTEIN L3 | tremblnew AAF15600 | Translation, ribosomal structure and biogenesis. |
| 3880 | 628.4 | NUCLEOSIDE DIPHOSPHATE KINASE. | tremblnew BAA83495 | Nucleotide transport |
| 3881 | 627.1 | D-LACTATE DEHYDROGENASE [CYTOCHROME] PRECURSOR (EC 1.1.2.4) (D-LACTATE FERRICYTOCHROME C OXIDOREDUCTASE) (D-LCR). | swissprot Q12627 | Energy production and conversion |
| 3882 | 626.8 | HYPOTHETICAL 34.3 KD PROTEIN. | sptrembl O43015 | ND |
| 3883 | 626.6 | 40S RIBOSOMAL PROTEIN S22 (S15A) (YS24). | swissprot P33953 | Translation, ribosomal structure and biogeneis |
| 3884 | 625.1 | HYPOTHETICAL 20.9 KD PROTEIN. | sptrembl O94286 | ND |
| 3885 | 620.0 | VACUOLAR ATP SYNTHASE 16 KD PROTEOLIPID SUBUNIT (FC 3.6.1.34). | swissprot Q00607 | Energy production and conversion |
| 3886 | 619.1 | PI023 PROTEIN. | sptrembl O13614 | ND |
| 3887 | 611.8 | RS6/L7A RIBOSOMAL PROTEIN HOMOLOG. | sptrembl O74690 | Translation, ribosomal structure and biogenesis |
| 3888 | 611.0 | RIBOSOMAL PROTEIN L32E. | sptrembl O94008 | Translation, ribosomal structure and biogenesis |
| 3889 | 610.2 | SUR2 PROTEIN (SYRINGOMYCIN RESPONSE PROTEIN 2). | swissprot P38992 | ND |
| 3890 | 609.0 | HYPOTHETICAL 15.9 KI) PROTEIN C4A8.02C IN CHROMOSOME 1. | swissprot O14155 | ND |
| 3891 | 608.4 | PUTATIVE TRANSPORTER Y1L166C. | swissprot P40445 | ND |
| 3892 | 605.6 | PUTATIVE CTP SYNTHASE C10F6.03C (EC 6.3.4.2) (UTP--AMMONIA LIGASE C10F6.03C) (CTP SYNTHETASE C10F6.03C). | sptrembl O42644 | Nucleotide transport |
| 3893 | 602.5 | NUCLEAR TRANSPORT FACTOR 2 (NTF-2) (NUCLEAR TRANSPORT FACTOR P10). | swissprot P33331 | ND |
| 3894 | 601.5 | PROTEIN TRANSLATION FACTOR SU11. | swissprot P32911 | Translation, ribosomal structure and biogenesis |
| 3895 | 599.9 | HYPOTHETICAL 12.5 KD PROTEIN. | sptrembl O74948 | ND |
| 3896 | 598.8 | HYDROLASE 108 aa | pdb IAC0 | ND |
| 3897 | 594.2 | Beta-1 integrin modulator B171. | geneseqp W19771 | ND |
| 3898 | 591.9 | GLYCERALDEHYDE 3-PHOSPHATE DEHYDROGENASE (EC 1.2.1.12) (GAPDH). | swissprot Q12552 | Carbohydrate transport and metabolism |
| 3899 | 589.2 | 60S RIBOSOMAL PROTEIN L12. | swissprot O75000 | Translation, ribosomal structure and biogenesis |
| 3900 | 588.0 | 60S RIBOSOMAL PROTEIN L30. | tremblnew CAB54828 | Translation, ribosomal structure and biogenesis |

TABLE 2-continued

*Aspergillus niger* ESTs

| Sequence Listing | zscore | Annotation | Database | Functional Category |
|---|---|---|---|---|
| 3901 | 584.7 | RIBOSOMAL PROTEIN 1.31. | sptrembl Q9XGL4 | Translation, ribosomal structure and biogenesis |
| 3902 | 579.0 | NADH-UBIQUINONE OXIDOREDUCTASE 12 KD SUBUNIT PRECURSOR (EC 1.6.5.3) (EC 1.6.99.3) (COMPLEX I-12KD) (CI-12KD). | swissprot Q03015 | ND |
| 3903 | 574.1 | 60S RIBOSOMAL PROTEIN L43 (L37A) (YL35). | swissprot P49631 | Translation, ribosomal structure and biogenesis |
| 3904 | 570.3 | 60S RIBOSOMAL PROTEIN L35. | swissprot P17078 | Translation, ribosomal structure and biogenesis |
| 3905 | 570.2 | D-LACTATE DEHYDROGENASE [CYTOCHROME] PRECURSOR (EC 1.1.2.4) (D-LACTATE FERRICYTOCHROME C OXIDOREDUCTASE) (D-LCR). | swissprot Q12627 | Energy production and conversion |
| 3906 | 569.3 | 60S RIBOSOMAL PROTEIN L34-B. | swissprot P40525 | Translation, ribosomal structure and biogenesis |
| 3907 | 565.0 | GATA TRANSCRIPTION FACTOR. | sptrembl O59542 | ND |
| 3908 | 560.4 | 60S RIBOSOMAL PROTEIN L43 (L37A) (YL35). | swissprot P49631 | Translation, ribosomal structure and biogenesis |
| 3909 | 557.9 | PROBABLE SUCCINYL-COA:3-KETOACID COENZYME A TRANSFERASE PRECURSOR (EC 2.8.3.5) (3-OXOACID COA-TRANSFERASE). | swissprot Q09450 | Lipid metabolism |
| 3910 | 555.7 | HYPOTHETICAL 31.6 KD PROTEIN. | sptrembl O13844 | ND |
| 3911 | 548.3 | RIBOSOMAL PROTEIN L26 (FRAGMENT). | sptrembl O82579 | Translation, ribosomal structure and biogenesis |
| 3912 | 546.8 | 40S RIBOSOMAL PROTEIN S20. | swissprot O74893 | Translation, ribosomal structure and biogenesis |
| 3913 | 546.1 | IGE-BINDING PROTEIN (FRAGMENT). | sptrembl O74263 | ND |
| 3914 | 543.1 | 40S RIBOSOMAL PROTEIN S27. | swissprot O74330 | Translation, ribosomal structure and biogenesis |
| 3915 | 537.5 | 2-OXOGLUTARATE DEHYDROGENASE E1 COMPONENT, MITOCHONDRIAL PRECURSOR EC 1.2.4.2) (ALPHA-KETOGLUTARATE DEHYDROGENASE). | swissprot P20967 | Energy production and conversion |
| 3916 | 536.2 | 40S RIBOSOMAL PROTEIN S27. | swissprot O74330 | Translation, ribosomal structure and biogenesis |
| 3917 | 535.7 | HYPOTHETICAL 21.4 KD PROTEIN C19A8.14 IN CHROMOSOME I. | sptrembl O13830 | ND |

TABLE 2-continued

*Aspergillus niger* ESTs

| Sequence Listing | zscore | Annotation | Database | Functional Category |
|---|---|---|---|---|
| 3918 | 534.3 | 60S ACIDIC RIBOSOMAL PROTEIN P0 (L10E). | swissprot P05317 | Translation, ribosomal structure and biogenesis |
| 3919 | 529.2 | ACYL CARRIER PROTEIN, MITOCHONDRIAL PRECURSOR (ACP) (NAH-UBIQUINONE OXIDOREDUCTASE 9.6 KD SUBUNIT) (EC 1.6.5.3) (EC 1.6.99.3). | swissprot P11943 | ND |
| 3920 | 527.2 | PROBABLE GYP7 PROTEIN (FRAGMENT). | swissprot P09379 | ND |
| 3921 | 523.2 | ATP SYNTHASE GAMMA CHAIN, MITOCHONDRIAL PRECURSOR. | sptrembl O74754 | Energy production and conversion |
| 3922 | 522.6 | S-ADENOSYLMETHIONINE DECARBOXYLASE (EC 4.1.1.50) (FRAGMENT). | sptrembl Q9Y8A3 | ND |
| 3923 | 519.9 | An enzyme with sugar transferase activity. | geneseqp W88044 | ND |
| 3924 | 511.6 | ACETOLACTATE SYNTHASE SMALL SUBUNIT PRECURSOR (EC 4.1.3.18) (AHAS) (ACETOHYDROXY-ACID SYNTHASE SMALL SUBUNIT) (ALS). | swissnew P25605 | Amino acid transport and metabolism |
| 3925 | 511.2 | NADH-UBIQUINONE OXIDOREDUCTASE 21.3 KD SUBUNIT (EC 1.6.5.3) (EC 1.6.99.3). | swissprot P25710 | ND |
| 3926 | 511.0 | THIOREDOXIN. | swissprot P29429 | ND |
| 3927 | 509.0 | Protein encoded by multiple drug resistance gene atrD. | geneseqp Y02630 | ND |
| 3928 | 505.7 | HYDROLASE 108 aa | pdb 1KUM | ND |
| 3929 | 503.5 | HYPOTHETICAL 52.3 KD PROTEIN. | tremblnew CAB58401 | ND |
| 3930 | 502.5 | RIBOSOMAL PROTEIN L26 (FRAGMENT). | sptrembl O82579 | Translation, ribosomal structure and biogenesis |
| 3931 | 499.0 | UBIQUINOL-CYTOCHROME C REDUCTASE COMPLEX SUBUNIT. | sptrembl O74533 | ND |
| 3932 | 498.8 | *A. fumigatus* allergen rAsp f8 sequence. | geneseqp W61478 | Translation, ribosomal structure and biogenesis |
| 3933 | 490.7 | VACUOLAR ATP SYNTHASE SUBUNIT G (EC 3.6.1.34) (V-ATPASE 13 KD SUBUNIT) (VACUOLAR H(−)-ATPASE SUBUNIT G). | swissprot P78713 | ND |
| 3934 | 488.3 | UBIQUINOL-CYTOCHROME C REDUCTASE COMPLEX SUBUNIT. | sptrembl O74533 | ND |
| 3935 | 488.1 | ACTIN-RELATED PROTEIN. | sptrembl O94805 | Cell division and chromosome partitioning |
| 3936 | 487.5 | VACUOLAR ATP SYNTHASE SUBUNIT G (EC 3.6.1.34) (V-ATPASE 13 KD SUBUNIT) (VACUOLAR H(−)-ATPASE SUBUNIT G). | swissprot P78713 | ND |
| 3937 | 480.0 | HYPOTHETICAL 11.8 KD PROTEIN CIB3.02C IN CHROMOSOME 1. | swissprot O13868 | ND |
| 3938 | 479.8 | CYANATE LYASE (EC 4.3.99.1) (CYANATE HYDROLASE) (CYANASE). | swissnew Q59948 | Inorganic ion transport and metabolism |

TABLE 2-continued

*Aspergillus niger* ESTs

| Sequence Listing | zscore | Annotation | Database | Functional Category |
|---|---|---|---|---|
| 3939 | 479.0 | 40S RIBOSOMAL PROTEIN S21 (S26) (Y525). | swissprot P05760 | ND |
| 3940 | 475.9 | HYPOTHETICAL 11.5 KD PROTEIN IN IITB2-NTH2 INTERGENIC REGION. | swissprot P35195 | ND |
| 3941 | 473.8 | HYPOTHETICAL 23.4 KD PROTEIN. | sptrembl Q03201 | Translation, ribosomal structure and biogenesis |
| 3942 | 466.6 | ACTIN, MUSCLE (LPM) (FRAGMENT). | swissprot Q25381 | Cell division and chromosome partitioning |
| 3943 | 465.8 | *N. crassa* mtr gene product. | geneseqp R79909 | ND |
| 3944 | 462.4 | PUTATIVE TRANSCRIPTIONAL REGULATOR. | sptrembl O13337 | ND |
| 3945 | 460.7 | *A. oryzae* DEBY1058 locus protein sequence. | geneseqp Y39874 | ND |
| 3946 | 460.3 | PROBABLE ADENOSINE DEAMINASE (EC 3.5.4.4) (ADENOSINE AMINOHYDROLASE). | swissprot P53909 | Nucleotide transport |
| 3947 | 459.8 | RIBOSOMAL PROTEIN S28. | tremblnew CAB56815 | Translation, ribosomal structure and biogenesis |
| 3948 | 459.5 | PYRUVATE DEHYDROGENASE E1 COMPONENT BETA SUBUNIT, MITOCHONDRIAL PRECURSOR (EC 1.2.4.1) (PDHE1-B). | swissprot P32473 | Energy production and conversion |
| 3949 | 458.2 | HYPOTHETICAL 37.4 KD PROTEIN IN SEC27-RPL1B INTERGENIC REGION. | swissprot P53123 | Cell division and chromosome partitioning |
| 3950 | 457.8 | LIPASE 4 PRECURSOR (EC 3.1.1.3). | swissprot P32948 | ND |
| 3951 | 454.0 | SEC65 PROTEIN. | tremblnew CAB55335 | Cell motility and secretion |
| 3952 | 453.8 | TRP-ASP REPEAT CONTAINING PROTEIN. | sptrembl O74855 | ND |
| 3953 | 451.6 | PUTATIVE GOLGI URIDINE DIPHOSPHATE-N-ACETYLGLUCOSAMINE TRANSPORTER | sptrembl O74750 | ND |
| 3954 | 449.2 | PROBABLE INOSINE-5'-MONOPHOSPHATE DEHYDROGENASE (EC 1.1.1.205) (IMP DEHYDROGENASE) (IMPDH) (IMPD). | swissprot O00086 | Nucleotide transport |
| 3955 | 448.6 | HYDROLASE 108 aa | pdb IKUM | ND |
| 3956 | 448.2 | CALMODULIN. | swissprot Q02052 | ND |
| 3957 | 447.3 | CYTOCHROME C OXIDASE POLYPEPTIDE VIB (EC 1.9.3.1) (AED). | swissprot Q01519 | ND |
| 3958 | 444.9 | KIAA0363 (FRAGMENT). | sptrembl O15069 | ND |
| 3959 | 442.8 | HEAT SHOCK PROTEIN 60 PRECURSOR. | tremblnew AAB46362 | ND |
| 3960 | 438.9 | RIBOSOMAL PROTEIN S31 HOMOLOG. | sptrembl O74172 | ND |
| 3961 | 436.1 | RIBOSOMAL PROTEIN L14. | sptrembl O94238 | Translation, ribosomal structure and biogenesis |
| 3962 | 430.8 | ELONGATION FACTOR 1-BETA (EF-1-BETA). | swissprot P32471 | Translation, ribosomal structure and biogenesis |
| 3963 | 428.5 | 40S RIBOSOMAL PROTEIN S29-B (S36) (YS29). | swissprot P41058 | Translation, ribosomal structure and biogenesis |

TABLE 2-continued

*Aspergillus niger* ESTs

| Sequence Listing | zscore | Annotation | Database | Functional Category |
|---|---|---|---|---|
| 3964 | 427.7 | UBIQUINOL-CYTOCHROME C REDUCTASE COMPLEX UBIQUINONE-BINDING PROTEIN QP-C (EC 1.10.2.2) (UBIQUINOL-CYTOCHROME C REDUCTASE COMPLEX I KD PROTEIN) (COMPLEX III SUBUNIT VIII) | swissprot P48503 | ND |
| 3965 | 424.7 | 60S RIBOSOMAL PROTEIN L36-B (L39B) (YL39) | swissprot O14455 | ND |
| 3966 | 422.2 | NADH-UBIQUINONE OXIDOREDUCTASE 9.5 KL) SUBUNIT (EC 1.6.5.3) (EC 1.6.99.3) (COMPLEX 1-9.5KD) (CI-9.5) (UBIQUINONE-BINDING PROTEIN). | swissprot P42117 | ND |
| 3967 | 420.2 | 40S RIBOSOMAL PROTEIN S29-B (S36) (YS29). | swissprot P41058 | Translation, ribosomal structure and biogenesis |
| 3968 | 417.1 | Ubiquitin-like domain of the yeast protein SMT3. | geneseqp W87987 | ND |
| 3969 | 416.8 | 40S RIBOSOMAL PROTEIN S30. | swissprot Q12087 | ND |
| 3970 | 416.1 | 60S RIBOSOMAL PROTEIN L39 (YL36). | swissprot P05767 | ND |
| 3971 | 401.3 | ACETOTLACTATE SYNTHASE SMALL SUBUNIT PRECURSOR (EC 4.1.3.18) (AHAS) (ACETOHYDROXY-ACID SYNTHASE SMALL SUBUNIT (ALS). | swissnew P26605 | Amino acid transport and metabolism |
| 3972 | 399.7 | PUTATIVE PROTEIN TRANSPORT PROTEIN SEC61 GAMMA SUBUNIT | swissprot Q09827 | ND |
| 3973 | 398.0 | *Streptomyces clavuligerus* protein sequence of orfdwn1 | geneseqp W69712 | ND |
| 3974 | 396.5 | 60S RIBOSOMAL PROTEIN 1.33-A (1.37A) (YL37) (RP47). | swissprot P05744 | ND |
| 3975 | 394.8 | MALATE DEHYDROGENASE, MITOCHONDRIAL PRECURSOR. | sptrembl Q9Y7R8 | ND |
| 3976 | 387.9 | PUTATIVE GOLGI URIDINE DIPHOSPHATE-N-ACETYLGLUCOSAMINE TRANSPORTER. | sptrembl O74750 | ND |
| 3977 | 387.0 | HEAT SHOCK PROTEIN HSPI (65 KD IGE-BINDING PROTEIN) (FRAGMENT). | swissprot P40292 | ND |
| 3978 | 383.8 | ELONGATION FACTOR 1-GAMMA 2 (EF-1-GAMMA 2) | swissprot P36008 | ND |
| 3979 | 377.0 | TYROSYL-TRNA SYNTHETASE, CYTOPLASMIC (EC 6.1.1.1) (TYROSYL--TRNA LIGASE) (TYRRS). | swissprot P36421 | Translation, ribosomal structure and biogenesis |
| 3980 | 371.9 | SERINE PALMITOYLTRANSFERASE 2 (EC 2.3.1.50) (LONG CHAIN BASE BIOSYNTHESIS PROTEIN 2) (SPT 2). | swissprot Q09925 | ND |
| 3981 | 371.6 | CCDB. | tremblnew BAA84907 | ND |
| 3982 | 370.7 | PUTATIVE ATP SYNTHASE F CHAIN, MITOCHONDRIAL PRECURSOR. | sptrembl O94377 | ND |
| 3983 | 369.8 | 60S RIBOSOMAL PROTEIN L6, MITOCHONDRIAL PRECURSOR (YML6). | swissprot P32904 | ND |

TABLE 2-continued

*Aspergillus niger* ESTs

| Sequence Listing | zscore | Annotation | Database | Functional Category |
|---|---|---|---|---|
| 3984 | 367.9 | *H. pylori* GHPO 1315 protein. | geneseqp W98517 | ND |
| 3985 | 364.8 | *S. pneumoniae* protein SEQ ID NO: 465, | geneseqp Y11355 | Translation, ribosomal structure and biogenesis |
| 3986 | 3643 | 60S RIBOSOMAL PROTEIN L29 (YL43). | swissprot P05747 | ND |
| 3987 | 353.3 | SPORE-WALL FUNGAL HYDROPHOBIN DEWA PRECURSOR. | swissprot P52750 | ND |
| 3988 | 350.3 | PUTATIVE PROGESTERONE-BINDING PROTEIN HOMOLOG. | sptrembl Q9XFM6 | ND |
| 3989 | 345.9 | ATP SYNTHASE DELTA CHAIN FAMILY. OLIGOMYCIN SENSITIVITY CONFERRING PROTEIN | sptrembl O74479 | ND |
| 3990 | 343.1 | CGI-111 PROTEIN. | sptrembl Q9Y3B5 | ND |
| 3991 | 341.4 | TRANSLATIONALLY CONTROLLED TUMOR PROTEIN HOMOLOG (TCTP). | swissprot P35691 | ND |
| 3992 | 341.2 | PUTATIVE ADENINE PHOSPHORIBOSYLTRANSFERASE. | sptrembl O42842 | ND |
| 3993 | 340.6 | URACIL PHOSPHORIBOSYLTRANSFERASE. | sptrembl P93394 | ND |
| 3994 | 337.0 | HYDROLASE 108 aa | pdb IKUL | ND |
| 3995 | 335.6 | HYDROLASE 476 aa | pdb 7TAA | ND |
| 3996 | 329.0 | NADH-UBIQUINONE OXIDOREDUCTASE 29.9 KD SUBUNIT PRECURSOR (EC 1.6.5.3) (LC 1.6.99.3) (COMPLEX 1-29.9KD (C1-29.9KD). | swissprot P24919 | ND |
| 3997 | 327.7 | AT2G20490 PROTEIN. | tremblnew AAD25649 | ND |
| 3998 | 317.8 | NHP2/RS6 FAMILY PROTEIN YEL026W. | swissprot P39990 | ND |
| 3999 | 317.5 | *Aspergillus niger* aspartic protease PEPE. | geneseqp R75299 | ND |
| 4000 | 315.1 | HYPOTHETICAL 24.1 KD PROTEIN IN PDR11-FAA3 INTERGENIC REGION. | swissprot P40553 | ND |
| 4001 | 314.9 | NAD(+)-SPECIFIC GLUTAMATE DEHYDROGENASE. | sptrembl Q02222 | ND |
| 4002 | 311.1 | 40S RIBOSOMAL PROTEIN S13. | swissprot P28189 | ND |
| 4003 | 310.7 | ATP CITRATE LYASE. | sptrembl O93988 | ND |
| 4004 | 310.5 | CELL CYCLE PROTEIN KINASE HSK1. | sptrembl O94678 | ND |
| 4005 | 308.3 | REPRESSOR PROTEIN. | sptrembl Q00784 | ND |
| 4006 | 308.3 | CYTOCHROME C OXIDASE POLYPEPTIDE VIA PRECURSOR (EC 1.9.3.1) | swissprot P32799 | ND |
| 4007 | 307.0 | Human epidermoid carcinoma cell line KB clone HP10301 protein. | geneseqp W64553 | ND |
| 4008 | 304.5 | HISTONE H3. | swissprot P23753 | ND |
| 4009 | 299.8 | *Sulfolobus solfataricus* esterase P1-8LC. | geneseqp W23077 | ND |
| 4010 | 299.5 | DPM2-LIKE PROTEIN. | tremblnew CAB57919 | ND |
| 4011 | 297.1 | HYPOTHETICAL 40.5 KD PROTEIN IN UBP15-GAS1 INTERGENIC REGION PRECURSOR | swissprot Q04951 | ND |
| 4012 | 294.1 | VIPI PROTEIN (P53 ANTIGEN HOMOLOG). | sptrembl P87216 | ND |

TABLE 2-continued

*Aspergillus niger* ESTs

| Sequence Listing | zscore | Annotation | Database | Functional Category |
|---|---|---|---|---|
| 4013 | 293.7 | PUTATIVE RNA-BINDING PROTEIN 3 (RNPL). | swissprot P98179 | ND |
| 4014 | 293.6 | CYTOCHROME C OXIDASE COPPER CHAPERONE. | swissprot Q12287 | ND |
| 4015 | 291.2 | CYSTEINE-RICH PROTEIN (FRAGMENT). | sptrembl Q16861 | ND |
| 4016 | 290.6 | C34B2.10 PROTEIN. | sptrembl O44953 | ND |
| 4017 | 290.6 | CLONING VECTOR PZERO-2T. | sptrembl O53022 | ND |
| 4018 | 290.3 | 40S RIBOSOMAL PROTEIN 519 (S16). | swissprot P27073 | ND |
| 4019 | 288.9 | 13KDA DIFFERENTIATION-ASSOCIATED PROTEIN. | tremblnew AAF17196 | ND |
| 4020 | 280.8 | HYPOTHETICAL 10.1 KD PROTEIN. | sptrembl O74707 | ND |
| 4021 | 278.1 | UV-DAMAGED DNA-BINDING; PROTEIN-LIKE | sptrembl O49552 | ND |
| 4022 | 275.9 | CHOLINE TRANSPORT PROTEIN. | swissprot P19807 | ND |
| 4023 | 274.0 | QUEUINE TRNA-RIBOSYLTRANSFERASE. | sptrembl O94460 | ND |
| 4024 | 272.4 | NADH-UBIQUINONE OXIDOREDUCTASE 13 KD-A SUBUNIT PRECURSOR (EC 1.6.5.3) (EC 1.6.99.3) (COMPLEX 1-13KD-A) (C1-13KD-A). | swissprot P23934 | ND |
| 4025 | 268.2 | INTEGRAL MEMBRANE PROTEIN. | sptrembl Q9Y786 | ND |
| 4026 | 267.1 | PROBABLE EUKARYOTIC TRANSLATION INITIATION FACTOR 5 (EIF-5). | swissprot Q09689 | ND |
| 4027 | 267.0 | HYPOTHETICAL 18.5 KD PROTEIN IN NDC1-TSA1 INTERGENIC REGION. | swissprot Q03713 | ND |
| 4028 | 261.4 | TRANSCRIPTION INITIATION FACTOR TFIID (TATA-BOX FACTOR) (TATA SEQUENCE-BINDING PROTEIN) (TBP). | swissprot Q12731 | ND |
| 4029 | 257.1 | GLYCERALDEHYDE 3-PHOSPHATE DEHYDROGENASE (EC 1.2.1.12) (GAPDH). | swissprot Q12552 | ND |
| 4030 | 255.6 | VIPI PROTEIN (P53 ANTIGEN HOMOLOG). | sptrembl P87216 | ND |
| 4031 | 255.2 | HISTONE H2B. | sptrembl Q12606 | ND |
| 4032 | 251.3 | CYTOCHROME P450 97B2 (EC 1.14--) | swissprot O48921 | ND |
| 4033 | 251.0 | RIBOSOMAL PROTEIN S5 (FRAGMENT). | tremblnew BAA25815 | |
| 4034 | 249.6 | ISOVALERYL DEHYDROGENASE. | tremblnew AAF20182 | ND |
| 4035 | 245.2 | URACIL-DNA GLYCOSYLASE | tremblnew AAD51974 | |
| 4036 | 244.8 | ISOCITRATE DEHYDROGENASE [NADP], MITOCHONDRIAL PRECURSOR (EC 1.1.1.42) (OXALOSUCCINATE DECARBOXYLASE) (IDH) (NADP+-SPECIFIC ICDH) (IDP). | swissprot P79089 | ND |
| 4037 | 243.2 | SPINDLE ASSEMBLY CHECKPOINT PROTEIN SLDA. | sptrembl O59901 | ND |
| 4038 | 243.0 | FISSION YEAST (FRAGMENT). | sptrembl P78767 | ND |
| 4039 | 242.1 | HYPOTHETICAL 29.3 KD PROTEIN (ORF92). | swissprot O10341 | ND |
| 4040 | 241.8 | HEMOLYSIN. | sptrembl Q00050 | ND |
| 4041 | 241.5 | PUTATIVE PROTEIN TRANSPORT PROTEIN SEC61 GAMMA SUBUNIT. | swissprot Q09827 | ND |

TABLE 2-continued

*Aspergillus niger* ESTs

| Sequence Listing | zscore | Annotation | Database | Functional Category |
|---|---|---|---|---|
| 4042 | 237.4 | ASCORBATE PEROXIDASE | sptrembl Q39780 | ND |
| 4043 | 235.2 | R07B7.5 PROTEIN. | sptrembl Q21795 | ND |
| 4044 | 233.2 | MITOCHONDRIAL THIOREDOXIN PRECURSOR (MT-TRX). | swissprot Q95108 | ND |
| 4045 | 232.3 | C-1-TETRAHYDROFOLATE SYNTHASE, CYTOPLASMIC (C1-THF SYNTHASE) [INCLUDES; METHYLENETETRAHYDRO FOLATE DEHYDROGENASE (EC 1.5.1.5); METHENYLTETRAHYDROF OLATE CYCLOHYDROLASE (EC 3.5.4.9); FORMYLTETRAHYDROFOL ATE SYNTHETASE (EC 6.3.4.3)]. | swissprot P07245 | ND |
| 4046 | 232.0 | GLUTATHIONE PEROXIDASE(EC 1.11.1.9). | swissnew O59858 | ND |
| 4047 | 228.2 | SIMILAR TO SDH4P. | sptrembl Q06236 | ND |
| 4048 | 226.2 | CHROMOSOME IV READING FRAME ORF YDL 193W. | sptrembl Q12063 | ND |
| 4049 | 225.8 | HYPOTHETICAL 8.6 KD PROTEIN. | sptrembl Q03482 | ND |
| 4050 | 225.7 | ATPASE INHIBITOR, MITOCHONDRIAL. | swissprot P09940 | ND |
| 4051 | 223.9 | DPM2 mannosyl transferase | geneseqp R47201 | ND |
| 4052 | 223.7 | POSSIBLE COPPER TRANSPORT PROTEIN CTR2 (COPPER TRANSPORTER 2). | swissprot P38865 | ND |
| 4053 | 223.6 | ORF2 of Enod2b genomic clone. | geneseqp R04119 | ND |
| 4054 | 222.4 | SALIVARY PROLINE-RICH PROTEIN PO (ALLELE K) [CONTAINS: PEPTIDE P-D] (FRAGMENT). | swissprot P10162 | ND |
| 4055 | 221.7 | DNA REPAIR PROTEIN RAD14. | swissprot P28519 | ND |
| 4056 | 221.5 | RIBOSOMAL PROTEIN L41. | tremblnew CAB52162 | ND |
| 4057 | 217.8 | NIFU-LIKE PROTEIN. | sptrembl O49627 | ND |
| 4058 | 217.1 | PUTATIVE TRANSCRIPTIONAL REGULATOR. | sptrembl Q9X7Q2 | ND |
| 4059 | 216.4 | ATP SYNTHASE DELTA CHAIN, MITOCHONDRIAL PRECURSOR (EC 3.6.1.34) (FRAGMENT). | swissnew P56525 | ND |
| 4060 | 214.0 | CELL WALL-PLASMA MEMBRANE LINKER PROTEIN HOMOLOG. | tremblnew AAD11796 | ND |
| 4061 | 212.3 | PROHIBITIN. | sptrembl O04331 | ND |
| 4062 | 210.7 | RIBOSOMAL PROTEIN 1.33-LIKE PROTEIN. | sptrembl O75394 | ND |
| 4063 | 209.1 | EXTENSIN (FRAGMENT). | sptrembl O49870 | ND |
| 4064 | 207.2 | GLUE PROTEIN. | sptrembl Q27423 | ND |
| 4065 | 206.8 | RIBOSOMAL PROTEIN S31 HOMOLOG. | sptrembl O74172 | ND |
| 4066 | 204.8 | EXTENSIN PRECURSOR (CELL WALL HYDROXYPROLINE-RICH GLYCOPROTEIN). | swissprot P13983 | ND |
| 4067 | 204.5 | GLYCOPROTEIN GP150. | tremblnew AAF19315 | ND |
| 4068 | 204.0 | NON-FUNCTIONAL FOLATE BINDING PROTEIN | sptrembl O14597 | ND |
| 4069 | 202.5 | GLUE PROTEIN. | sptrembl Q27423 | ND |
| 4070 | 202.3 | HAVCR-1 PROTEIN PRECURSOR. | sptrembl Q95144 | ND |

TABLE 2-continued

*Aspergillus niger* ESTs

| Sequence Listing | zscore | Annotation | Database | Functional Category |
|---|---|---|---|---|
| 4071 | 201.6 | ACIDIC RIBOSOMAL PROTEIN. | sptrembl O96938 | ND |
| 4072 | 201.6 | PHEROPHORIN-S PRECURSOR. | sptrembl P93797 | ND |
| 4073 | 201.3 | F23N19.12. | tremblnew AAF19547 | ND |
| 4074 | 200.7 | BINDING PROTEIN 113 aa | pdb 1YAT | ND |
| 4075 | 198.7 | HYPOTHETICAL PROTEIN C30B4.01C IN CHROMOSOME II (FRAGMENT). | sptrembl P87179 | ND |
| 4076 | 197.6 | F32D1.2 PROTEIN | sptrembl O16298 | ND |
| 4077 | 194.6 | EXTENSIN PRECURSOR | sptrembl Q40768 | ND |
| 4078 | 192.7 | DELTA-6 FATTY ACID DESATURASE. | sptrembl Q9/122 | ND |
| 4079 | 192.7 | COSMID C37C3. | sptrembl Q22919 | ND |
| 4080 | 192.5 | Sequence A encoded by a portion of SA307 | geneseqp P60623 | ND |
| 4081 | 192.4 | ATP SYNTHASE E CHAIN, MITOCHONDRIAL (EC 3.6.1.34). | swissprot P81449 | ND |
| 4082 | 192.3 | RIBOSOMAL PROTEIN S31 HOMOLOG. | sptrembl O74172 | ND |
| 4083 | 192.2 | SMALL PROLINE-RICH PROTEIN IA. | tremblnew AAD10126 | ND |
| 4084 | 191.5 | ORF YDL133W. | sptrembl Q12516 | ND |
| 4085 | 188.0 | ENOLASE (EC 4.2.1.11) (2-PHOSPHOGLYCERATE DEHYDRATASE) (2-PHOSPHO-D-GLYCERATE HYDRO-LYASE). | swissprot Q12560 | ND |
| 4086 | 187.8 | 60S RIBOSOMAL PROTEIN L44 (1.41). | swissprot P31866 | ND |
| 4087 | 185.6 | TROPOMYOSIN 1. | swissprot P17536 | ND |
| 4088 | 185.3 | HYPOTHETICAL 15.4 KD PROTEIN YPR056C. | sptrembl Q12160 | ND |
| 4089 | 184.3 | *M. tuberculosis* recombinant antigen protein TbH-30. | geneseqp Y39014 | ND |
| 4090 | 183.1 | ALPHA-INTERFERON INDUCIBLE PROTEIN (FRAGMENT). | tremblnew AAF23490 | ND |
| 4091 | 182.4 | Mutant *Aspergillus oryzac* DEBY932 rescued locus. | geneseqp W37992 | ND |
| 4092 | 182.2 | CYSTEINE-RICH EXTENSIN-LIKE PROTEIN | sptrembl Q08195 | ND |
| 4093 | 181.9 | HYPOTHETICAL PROLINE-RICH PROTEIN (FRAGMENT). | swissprot P21260 | ND |
| 4094 | 181.8 | UBII. | tremblnew AAF24230 | ND |
| 4095 | 181.5 | Silk like protein (SLP)C-SLPF. | geneseqp R95140 | ND |
| 4096 | 181.5 | PUTATIVE MITOSIS AND MAINTENANCE OF PLOIDY PROTEIN. | sptrembl O94360 | ND |
| 4097 | 181.4 | NAPRP3. | sptrembl Q41192 | ND |
| 4098 | 181.0 | YSY6 PROTEIN. | swissprot P38374 | ND |
| 4099 | 179.6 | METALLOTHIONEIN-LIKE PROTEIN CAP5. | swissprot Q00369 | ND |
| 4100 | 178.5 | *Streptococcus pneumoniae* PspA central region. | geneseqp W14574 | ND |
| 4101 | 177.8 | GASTRIC MUCIN (FRAGMENT) | sptrembl Q29071 | ND |
| 4102 | 177.6 | PUTATIVE GLYCOSYLTRANSFERASE. | tremblnew CAB60235 | ND |
| 4103 | 177.4 | HYDROXYPROLINE-RICH GLYCOPROTEIN DZ-HRGP PRECURSOR. | tremblnew CAB62280 | ND |
| 4104 | 176.1 | HISTIDINE-RICH GLYCOPROTEIN PRECURSOR. | swissprot P04929 | ND |
| 4105 | 175.0 | YPT1-RELATED PROTEIN 5. | swissprot P36586 | ND |

TABLE 2-continued

*Aspergillus niger* ESTs

| Sequence Listing | zscore | Annotation | Database | Functional Category |
|---|---|---|---|---|
| 4106 | 175.0 | SULFATED SURFACE GLYCOPROTEIN 185 (SSG 185). | swissprot P21997 | ND |
| 4107 | 174.4 | T. gondii immunogenic protein. | geneseqp Y29039 | ND |
| 4108 | 172.3 | HYPOTHETICAL 11.3 KD PROTEIN IN MIRI-STE18 INTERGENIC REGION. | swissprot P47131 | ND |
| 4109 | 171.8 | F56H9.1 PROTEIN. | sptrembl Q20908 | ND |
| 4110 | 171.4 | HEMOLYSIN-LIKE PROTEIN. | sptrembl O32337 | ND |
| 4111 | 171.3 | EXTENSIN PRECURSOR (PROLINE-RICH GLYCOPROTEIN). | swissprot P24152 | ND |
| 4112 | 170.4 | CELL WALL PROTEIN PRECURSOR. | sptrembl Q39005 | ND |
| 4113 | 170.1 | GOLGIN-95. | swissprot Q08379 | ND |
| 4114 | 169.8 | BACTENECIN 7 PRECURSOR (BAC7) (PR-59). | swissprot P19661 | ND |
| 4115 | 169.8 | ANTER-SPECIFIC PROLINE-RICH PROTEIN APG (PROTEIN CEX) (FRAGMENT) | swissprot P40603 | ND |
| 4116 | 169.8 | HYPOTHETICAL 17.1 KD PROTEIN IN PUR5 3'REGION. | swissprot P38898 | ND |
| 4117 | 169.6 | EXTENSIN (PROLINE-RICH GLYCOPROTEIN) (CLONE W6) (FRAGMENT). | sptrembl Q01945 | ND |
| 4118 | 169.5 | F23N19.12. | tremblnew AAF19547 | ND |
| 4119 | 169.2 | MYOCYTE-SPECIFIC ENHANCER FACTOR 2D. | swissnew Q63943 | ND |
| 4120 | 168.8 | FISSION YEAST (FRAGMENT). | sptrembl P78755 | ND |
| 4121 | 168.4 | NUCLEAR PROTEIN FRAGMENT). | sptrembl Q95294 | ND |
| 4122 | 168.3 | MYOCYTE-SPECIFIC ENHANCER FACTOR 2D. | swissnew Q63943 | ND |
| 4123 | 167.8 | Cyanovirin-N protein sequence. | geneseqp Y39909 | ND |
| 4124 | 166.8 | DVE PROTEIN. | sptrembl O77289 | ND |
| 4125 | 166.2 | KERATIN, ULTRA HIGH-SULFUR MATRIX PROTEIN (UHS KERATIN). | swissprot P26372 | ND |
| 4126 | 165.5 | 50KD PROLINE RICH PROTEIN. | sptrembl Q9ZBP2 | ND |
| 4127 | 165.1 | PROTEOPHOSPHOGLYCAN (FRAGMENT). | sptrembl Q9Y075 | ND |
| 4128 | 164.8 | EARLY NODULIN 20 PRECURSOR (N-20). | swissprot P93329 | ND |
| 4129 | 164.7 | 60S RIBOSOMAL PROTEIN L23A. | swissprot O22644 | ND |
| 4130 | 163.2 | PUTATIVE MEMBRANE PROTEIN. | tremblnew CAB52863 | ND |
| 4131 | 161.6 | MITOCHONDRIAL CAPSULE SELENOPROTEIN. | sptrembl O70613 | ND |
| 4132 | 161.4 | STRUCTURAL WALL PROTEIN PRECURSOR. | sptrembl Q07373 | ND |
| 4133 | 161.0 | POLYSACCHARIDE DEGRADATION 108 aa | pdb 1ACZ | ND |
| 4134 | 160.0 | EXTENSIN-LIKE PROTEIN. | tremblnew CAB40769 | ND |
| 4135 | 160.0 | HYPOTHETICAL 14.0 KD PROTEIN. | sptrembl O74383 | ND |
| 4136 | 159.9 | C-REL PROTO-ONCOGENE PROTEIN (C-REL PROTEIN). | swissprot P15307 | ND |
| 4137 | 159.5 | THROMBOSPONDIN-RELATED ANONYMOUS PROTEIN (FRAGMENT). | sptrembl Q94727 | ND |
| 4138 | 158.7 | EXTENSIN (FRAGMENT). | sptrembl Q41645 | ND |

TABLE 2-continued

*Aspergillus niger* ESTs

| Sequence Listing | zscore | Annotation | Database | Functional Category |
|---|---|---|---|---|
| 4139 | 158.5 | F18A11.4 PROTEIN. | sptrembl Q9XTB1 | ND |
| 4140 | 158.5 | INSERTION ELEMENT ISR1 HYPOTHETICAL 30.8 KD PROTEIN A. | swissprot P17986 | ND |
| 4141 | 158.5 | HISTONE H4. | swissprot P09322 | ND |
| 4142 | 158.4 | HYPOTHETICAL PROTEIN H10983. | swissprot P43907 | ND |
| 4143 | 158.1 | NADH DEHYDROGENASE SUBUNIT 4. | sptrembl O63595 | ND |
| 4144 | 157.2 | TONB2. | tremblnew AAF04082 | ND |
| 4145 | 157.1 | O-SIALOGLYCOPROTEIN ENDOPEPTIDASE, PUTATIVE. | tremblnew CAB50493 | ND |
| 4146 | 156.8 | BCD (BICOID) GENE INVOLVED IN ANTERIOR POSITIONAL SPECIFICATION DURING EMBRYOGENESIS (BICOID). | sptrembl Q24615 | ND |
| 4147 | 156.4 | Immunodominant fragment of flagellar pocket antigen of *T. brucei*. | geneseqp R85174 | ND |
| 4148 | 155.5 | ORF YOR309C. | sptrembl Q12444 | ND |
| 4149 | 155.3 | REGULATORY PROTEIN E2. | sptrembl O56955 | ND |
| 4150 | 155.0 | BASSOON. | sptrembl O88737 | ND |
| 4151 | 154.8 | TUMOR NECROSIS FACTOR RECEPTOR TYPE II (FRAGMENT). | sptrembl Q9WUL4 | ND |
| 4152 | 154.6 | G1 PHASE-SPECIFIC GENE (3'REGION (FRAGMENT). | sptrembl Q16164 | ND |
| 4153 | 154.5 | PROTEASE B INHIBITORS 2 AND 1 (PROTEINASE INHIBITOR 1(B)2). | swissprot P01095 | ND |
| 4154 | 154.4 | PROLINE-RICH CELL WALL PROTEIN | sptrembl Q39763 | ND |
| 4155 | 153.9 | GASTRIC MUCIN (FRAGMENT). | sptrembl Q29071 | ND |
| 4156 | 153.5 | CBD-cellulase from *Melanocarpus albomyces*. | geneseqp W16545 | ND |
| 4157 | 153.4 | TAT PROTEIN. | tremblnew CAB53046 | ND |
| 4158 | 152.5 | ERYTHROCYTE MEMBRANE PROTEIN 1 (FRAGMENT). | sptrembl O61124 | ND |
| 4159 | 152.5 | 137AA LONG HYPOTHETICAL PROTEIN. | sptrembl Q9YDR3 | ND |
| 4160 | 152.3 | IG ALPHA CHAIN C REGION. | swissprot P01878 | ND |
| 4161 | 152.1 | Mycobacterium species protein sequence 50B. | geneseqp Y04998 | ND |
| 4162 | 151.9 | G-protein coupled human thromboxane A2 receptor. | geneseqp W02688 | ND |
| 4163 | 151.8 | HYPOTHETICAL 82.1 KD PROTEIN. | sptrembl O64621 | ND |
| 4164 | 151.7 | HYPOTHETICAL 13.1 KD PROTEIN. | sptrembl Q9XFU9 | ND |
| 4165 | 150.9 | 40S RIBOSOMAL PROTEIN S15A (S24). | swissprot P50891 | ND |
| 4166 | 150.8 | L1332.3A PROTEIN. | tremblnew CAB63874 | ND |
| 4167 | 150.5 | DYNAMIN HIBB ISOFORM. | tremblnew AAF07848 | ND |
| 4168 | 149.1 | OUTER MEMBRANE PROTEIN. | tremblnew AAF08549 | ND |
| 4169 | 149.0 | ZEIN-BETA PRECURSOR (ZEIN 2) (16 KD) (ZEIN ZCI). | swissprot P08031 | ND |
| 4170 | 149.0 | *Thermus thermophilus* heat resistance MutM protein. | geneseqp Y29572 | ND |
| 4171 | 149.0 | HYPOTHETICAL 24.1 KD PROTEIN IN LEF4-P33 INTERGENIC REGION. | swissprot P41479 | ND |

TABLE 2-continued

*Aspergillus niger* ESTs

| Sequence Listing | zscore | Annotation | Database | Functional Category |
|---|---|---|---|---|
| 4172 | 148.9 | DNA-BINDING PROTEIN K10. | swissnew P13468 | ND |
| 4173 | 148.5 | METALLOTHIONEIN (FRAGMENT). | sptrembl O76957 | ND |
| 4174 | 148.2 | HYPOTHETICAL 54.7 KD PROTEIN IN COH INTRON 2 REGION. | sptrembl Q02696 | ND |
| 4175 | 148.1 | ASKI TRANSCRIPTION FACTOR (FRAGMENT). | sptrembl Q90230 | ND |
| 4176 | 148.1 | STEROID HORMONE RECEPTOR FAMILY MEMBER NHR-22. | swissprot Q09587 | ND |
| 4177 | 147.7 | HISTIDINE-RICH PROTEIN (FRAGMENT). | sptrembl Q26056 | ND |
| 4178 | 147.7 | CHROMOSOME IV READING FRAME ORF YDL196W. | sptrembl Q12187 | ND |
| 4179 | 147.6 | T06A4.2 PROTEIN. | tremblnew AA67472 | ND |
| 4180 | 147.6 | CORTICOLIBERIN PRECURSOR (CORTICOTROPIN-RELEASING FACTOR) (CRF) | swissprot P06296 | ND |
| 4181 | 147.5 | HYPOTHETICAL 141.5 KD PROTEIN IN YPT53-RHO2 INTERGENIC REGION | swissprot P53935 | ND |
| 4182 | 147.4 | LOW MOLECULAR WEIGHT GLUTENIN (FRAGMENT). | sptrembl Q41551 | ND |
| 4183 | 147.4 | INTEGRIN BETA 5 SUBUNIT (FRAGMENT). | sptrembl Q64657 | ND |
| 4184 | 147.0 | ANTIGEN RECEPTOR (FRAGMENT). | sptrembl Q9YHR0 | ND |
| 4185 | 146.8 | *P. furiosus* pyroglutamyl peptidase fragment. | geneseqp R89125 | ND |
| 4186 | 146.8 | SFT2 PROTEIN. | swissprot P38166 | ND |
| 4187 | 146.7 | TDP-6-DEOXY-4-KETOHEXOSE 2,3-DEHYDRATASE. | tremblnew AAF18990 | ND |
| 4188 | 146.6 | SALIVARY PROLINE-RICH PROTEIN RP15 PRECURSOR. | sptrembl Q04154 | ND |
| 4189 | 146.1 | SPLICING FACTOR U2AF 38 KD SUBUNIT (U2 AUXILIARY FACTOR 38 KD SUBUNIT) (U2 SNRNP AUXILIARY FACTOR SMALL SUBUNIT). | swissprot Q94535 | ND |
| 4190 | 146.0 | PAX TRANSCRIPTION ACTIVATION DOMAIN INTERACTING PROTEIN PTIP. | sptrembl Q9Z0W6 | ND |
| 4191 | 145.5 | COLLAGEN ALPHA 5(IV) CHAIN (FRAGMENT). | swissprot Q28247 | ND |
| 4192 | 145.0 | 40S RIBOSOMAL PROTEIN S8 (FRAGMENT). | sptrembl O93915 | ND |
| 4193 | 145.0 | CDC37 PROTEIN. | sptrembl O94740 | ND |
| 4194 | 144.8 | HYPOTHETICAL 36.0 KD PROTEIN. | tremblnew CAB62810 | ND |
| 4195 | 144.6 | CELL DIVISION PROTEIN FTSK. | swissprot P46889 | ND |
| 4196 | 144.0 | HYPOTHETICAL 57.5 KD PROTEIN IN VMA7-RPS25A INTERGENIC REGION. | swissprot P53214 | ND |
| 4197 | 143.9 | ZK899.1 PROTEIN. | sptrembl Q23659 | ND |
| 4198 | 143.8 | GTP CYCLOHYDROLASE II (EC 3.5.4.25). | swissnew P44571 | ND |
| 4199 | 143.7 | R09E10.2 PROTEIN (EC 3.1.3.48). | sptrembl Q21877 | ND |
| 4200 | 143.6 | HYPOTHETICAL 33.1 KD PROTEIN. | tremblnew AAF10810 | ND |
| 4201 | 143.4 | W03G15 PROTEIN. | tremblnew AAD14755 | ND |

TABLE 2-continued

*Aspergillus niger* ESTs

| Sequence Listing | zscore | Annotation | Database | Functional Category |
|---|---|---|---|---|
| 4202 | 143.2 | Human thoracic aorta G-protein coupled receptor. | geneseqp W02727 | ND |
| 4203 | 142.9 | T09E11.2 PROTEIN. | sptrembl O02305 | ND |
| 4204 | 142.9 | D2062.3 PROTEIN. | sptrembl O16599 | ND |
| 4205 | 142.4 | ATTACHMENT GLYCOPROTEIN (FRAGMENT). | sptrembl Q9YN12 | ND |
| 4206 | 142.0 | COSMID C03G6. | sptrembl O01454 | ND |
| 4207 | 142.0 | HYPOTHETICAL 48.4 KD PROTEIN RV2008SC. | swissnew Q10849 | ND |
| 4208 | 142.0 | HYPOTHETICAL 31.4 KD PROTEIN. | sptrembl O51346 | ND |
| 4209 | 141.8 | DNA-BINDING RESPONSE REGULATOR. | tremblnew AAF11967 | ND |
| 4210 | 141.8 | ZK1025.5 PROTEIN. | tremblnew CAA18363 | ND |
| 4211 | 141.7 | 686AA LONG HYPOTHETICAL DNA TOPOISOMERASE 1. | sptrembl O58356 | ND |
| 4212 | 141.7 | HYPOTHETICAL NUCLEAR PROTEIN (FRAGMENT). | tremblnew BAA87224 | ND |
| 4213 | 141.6 | MYELOBLAST K1AA0244 (FRAGMENT). | sptrembl Q92576 | ND |
| 4214 | 141.5 | 220AA LONG HYPOTHETICAL PROTEIN | sptrembl Q9YFG0 | ND |
| 4215 | 141.4 | HYPOTHETICAL 34.8 KD PROTEINF YDL037C. | sptrembl Q12140 | ND |
| 4216 | 141.3 | HUNCHBACK PROTEIN (HB) (FRAGMENTS). | sptrembl O46254 | ND |
| 4217 | 141.2 | F57B1.7 PROTEIN. | sptrembl Q20920 | ND |
| 4218 | 141.1 | DOLICHYL-DIPHOSPHOOLIGOSACCHARIDE--PROTEIN GLCOSYLTRANSFERASE ALPHA SUBUNIT PRECURSOR (EC 2.4.1.119) (OLIGOSACCHARYL TRANSFERASE ALPHA SUBUNIT) (OLIGOSACCHARYL TRANSFERASE 64 KD SUBUNIT). | swissprot P41543 | ND |
| 4219 | 141.0 | *H. influenzae* Hap protein autotransporter membrane integration region. | geneseqp W27705 | ND |
| 4220 | 140.9 | BETA-GLUCOSYL-HMC-ALPHA-GLUCOSYL-TRANSFERASE (EC 2.4.1.-). | swissprot Q06717 | ND |
| 4221 | 140.9 | T-lymphocyte stimulatory protein. | geneseqp R84086 | ND |
| 4222 | 140.9 | DJ465N24.2.1 (PUTATIVE NOVEL PROTEIN) (ISOFORM 1). | sptrembl O95927 | ND |
| 4223 | 140.8 | 120AA LONG HYPOTHETICAL PROTEIN. | sptrembl Q9YF04 | ND |
| 4224 | 140.6 | PROLIN RICH PROTEIN | sptrembl Q11848 | ND |
| 4225 | 140.2 | ORF 4. | sptrembl O32454 | ND |
| 4226 | 140.1 | Y116A8C 17 PROTEIN | tremblnew CAB55123 | ND |
| 4227 | 140.0 | LOX18 HOMEODOMAIN PROTEIN (FRAGMENT) | tremblnew AAD54933 | ND |
| 4228 | 139.9 | ORF6-14K. | sptrembl Q65006 | ND |
| 4229 | 139.8 | Mycobacterium species protein sequence 47B. | geneseqp Y04983 | ND |
| 4230 | 139.8 | GUANYL-SPECIFIC RIBONUCLEASE SA. | tremblnew AAF10029 | ND |
| 4231 | 139.6 | T-lymphocyte stimulatory protein. | geneseqp R84086 | ND |
| 4232 | 139.5 | CODED FOR BY C. ELEGANS CDNA YK79A3.5. | sptrembl O02076 | ND |
| 4233 | 139.4 | 152AA LONG HYPOTHETICAL PROTEIN. | sptrembl Q9YE05 | ND |

TABLE 2-continued

*Aspergillus niger* ESTs

| Sequence Listing | zscore | Annotation | Database | Functional Category |
|---|---|---|---|---|
| 4234 | 139.4 | AMINO-ACID ACETYLTRANSFERASE (EC 2.3.1.1) (N-ACETYLGLUTAMATE SYNTHASE) (AGS). | swissprot P32042 | ND |
| 4235 | 139.2 | 64AA LONG HYPOTHETICAL PROTEIN. | sptrembl Q9YAL3 | ND |
| 4236 | 139.1 | Filistata peptide 10, a Ca-blocking polypeptide from spider venom. | geneseqp R40035 | ND |
| 4237 | 139.1 | AUXIN INDUCED PROLINE RICH PROTEIN. | sptrembl O24072 | ND |
| 4238 | 138.6 | OVARIAN TUMOR LOCUS PROTEIN. | swissprot P10383 | ND |
| 4239 | 138.6 | 5T4 ONCOFETAL ANTIGEN HOMOLOG. | tremblnew AAF21770 | ND |
| 4240 | 138.5 | (MSA-2) (FRAGMENT). | sptrembl Q25947 | ND |
| 4241 | 138.5 | SMALL NUCLEAR RIBONUCLEOPROTEIN B. | tremblnew AAD54488 | ND |
| 4242 | 138.3 | TRANSPOSABLE ELEMENT MU1 SEQUENCE. | sptrembl Q41863 | ND |
| 4243 | 138.3 | PISTIL-SPECIFIC EXTENSIN-LIKE PROTEIN (FRAGMENT). | sptrembl Q40549 | ND |
| 4244 | 138.3 | Extracellular region of metastasis-specific CD44 surface protein | geneseqp R14769 | ND |
| 4245 | 138.1 | PHYTOENE SYNTHASE. | sptrembl O04007 | ND |
| 4246 | 137.8 | B0238.12 PROTEIN. | sptrembl O16488 | ND |
| 4247 | 137.7 | NADH DEHYDROGENASE. SUBUNIT 9 (EC 1.6.5.3). | sptrembl O21271 | ND |
| 4248 | 137.7 | F10G19.2 PROTEIN. | sptrembl O23120 | ND |
| 4249 | 137.2 | PAIRED-BOX TRANSCRIPTION FACTOR PROTEIN (FRAGMENT). | sptrembl O13081 | ND |
| 4250 | 137.2 | Human adult retina secreted protein bk112_15. | geneseqp W95345 | ND |

TABLE 3

*Aspergillus oryzae* ESTs

| Sequence Listing | zscore | Annotation | Database | Functional Category |
|---|---|---|---|---|
| 4376 | 999.7 | PUTATIVE GLUCOSYLTRANSFERASE C17C9.07 (EC 2.4.1.-). | swissprot Q10479 | ND |
| 4377 | 997.5 | HEAT SHOCK PROTEIN HSP88. | sptrembl O74225 | Posttranslational modification, protein turnover, chaperones |
| 4378 | 996.4 | 40S RIBOSOMAL PROTEIN S8. | swissprot O14049 | Translation, ribosomal structure and biogenesis |
| 4379 | 995.7 | SERINE/THREONINE-PROTEIN KINASE IRE1 PRECURSOR (EC 2.7.1.-). | swissprot P32361 | Signal transduction mechanisms |
| 4380 | 993.4 | DIMETHYL-ALLYL-TRYPTPHAN-SYNTHASE. | sptrembl O94204 | ND |
| 4381 | 992.6 | PROTEIN TRANSPORT PROTEIN SEC61 ALPHA SUBUNIT. | swissprot P78979 | Cell motility and secretion |

TABLE 3-continued

_Aspergillus oryzae_ ESTs

| Sequence Listing | zscore | Annotation | Database | Functional Category |
|---|---|---|---|---|
| 4382 | 992.1 | PROTEASOME COMPONENT PRE6 (EC 3.4.99.46) (MACROPAIN SUBUNIT PRE6) (PROTEINASE YSCE SUBUNIT PRE6) (MULTICATALYTIC ENDOPEPTIDASE COMPLEX SUBUNIT PRE6). | swissprot P40303 | Posttranslational modification, protein turnover, chaperones |
| 4383 | 990.1 | MITOCHONDRIAL PHOSPHATE CARRIER PROTEIN (PHOSPHATE TRANSPORT PROTEIN) (PTP) (MITOCHONDRIAL IMPORT RECEPTOR) (P32). | swissprot P23641 | ND |
| 4384 | 989.3 | SLA2P. | sptrembl O94097 | ND |
| 4385 | 988.3 | ADP-RIBOSYLATION FACTOR-LIKE PROTEIN 1. | swissprot P38116 | ND |
| 4386 | 987.3 | PUTATIVE FIZZY-RELATED PROTEIN. | sptrembl O82740 | ND |
| 4387 | 985.5 | 2-OXOGLUTARATE DEHYDROGENASE EI COMPONENT. MITOCHONDRIAL PRECURSOR (EC 1.2.4.2) (ALPHA-KETOGLUTARATE DEHYDROGENASE). | swissprot P20967 | Energy production and conversion |
| 4388 | 985.2 | VACUOLAR ATP SYNTHASE 16 KD PROTEOLIPID SUBUNIT (EC 3.6.1.34). | swissprot P31413 | Energy production and conversion |
| 4389 | 985.1 | WD REPEAT PROTEIN. HUMAN U5 SNRNP-SPECIFIC-LIKE. | sptrembl O94620 | ND |
| 4390 | 984.0 | HISTONE H2B | swissprot P23754 | ND |
| 4391 | 983.8 | DOLICHYL-PHOSPHATE-MANNOSE--PROTEIN MANNOSYLTRANSFERASE 4 (EC 2.4.1.109). | swissprot P46971 | Posttranslational modification, protein turnover, chaperones |
| 4392 | 983.3 | PUTATIVE CA-CALMODULIN-DEPENDENT SERINE-THREONINE-PROTEIN KINASE. | sptrembl O94547 | Signal transduction mechanisms |
| 4393 | 983.0 | HYPOTHETICAL 102.5 KD PROTEIN IN KRE1-HXT14 INTERGENIC REGION. | swissprot P42839 | Inorganic ion transport and metabolism |
| 4394 | 981.2 | RHO1 PROTEIN. | swissprot Q09914 | ND |
| 4395 | 980.2 | _Aspergillus nidulans_ essential protein AN80. | geneseqp Y06416 | ND |
| 4396 | 978.2 | NADPH CYTOCHROME P450 OXIDOREDUCTASE. | sptrembl Q00141 | Inorganic ion transport and metabolism |
| 4397 | 977.8 | RASP F 4 (FRAGMENT). | sptrembl O60024 | ND |
| 4398 | 977.4 | SYMBIOSIS-RELATED PROTEIN. | swissprot P87068 | ND |
| 4399 | 976.6 | 40S RIBOSOMAL PROTEIN S19 (S16). | swissprot P27073 | Translation, ribosomal structure and biogenesis |
| 4400 | 976.1 | GABA-SPECIFIC PERMEASE (GABA-SPFCIFIC TRANSPORT PROTEIN). | swissprot P32837 | Amino acid transport and metabolism |
| 4401 | 972.7 | _A. oryzae_ P4-8.1 locus protein sequence. | geneseqp Y39875 | Posttranslational modification, protein turnover, chaperones |
| 4402 | 972.7 | ATP CITRATE LYASE. | sptrembl O93988 | ND |
| 4403 | 970.8 | Protein kinase (Hhp 1+). | geneseqp R56520 | Signal transduction mechanisms |

TABLE 3-continued

_Aspergillus oryzae_ ESTs

| Sequence Listing | zscore | Annotation | Database | Functional Category |
|---|---|---|---|---|
| 4404 | 967.7 | NUCLEOLAR PROTEIN INVOLVED IN PRE-RRNA PROCESSING. | sptrembl O94514 | Translation, ribosomal structure and biogenesis |
| 4405 | 964.2 | 3-KETOACYL-COA THIOLASE, PEROXISOMAL PRECURSOR (EC 2.3.1.16) (BETA-KETOTHIOLASE) (ACETYL-COA ACYLTRANSFERASE) (PEROXISOMAL 3-OXOACYL-COA THIOLASE). | swissprot Q05493 | Lipid metabolism |
| 4406 | 963.8 | 40S RIBOSOMAL PROTEIN S14 (CRP2). | swissprot P19115 | Translation, ribosomal structure and biogenesis |
| 4407 | 963.8 | DNA POLYMERASE ALPHA CATALYTIC SUBUNIT (EC 2.7.7.7) (DNA POLYMERASE I). | swissprot P28040 | DNA replication, recombination and repair |
| 4408 | 963.4 | DOLICHOL-PHOSPHATE MANNOSYLTRANSFERASE (EC 2.4.1.83) (DOLICHOL-PHOSPHATE MANNOSE SYNTHASE) (DOLICHYL-PHOSPHATE BETA-D-MANNOSYLTRANSFERASE). | sprtrembl O14466 | Cell envelope biogenesis, outer membrane |
| 4409 | 962.9 | PROBABLE MANNOSYL-OLIGOSACCHARIDE GLUCOSIDASE (EC 3.2.1.106) (PROCESSING A-GLUCOSIDASE I). | swissprot O14255 | ND |
| 4410 | 962.1 | HYPOTHETICAL 41.0 KD PROTEIN IN YIPI-CBP4 INTERGENIC REGION. | swissprot P53295 | ND |
| 4411 | 961.1 | PUTATIVE ASPARTATE AMINOTRANSFERASE, CYTOPLASMIC (EC 2.6.1.1) (TRANSAMINASE A). | sptrembl O42652 | Amino acid transport and metabolism |
| 4412 | 961.0 | 40S RIBOSOMAL PROTEIN S2. | swissprot O74892 | Translation, ribosomal structure and biogenesis |
| 4413 | 960.7 | 40S RIBOSOMAL PROTEIN S17 (CRP3). | swissprot P27770 | Translation, ribosomal structure and biogenesis |
| 4414 | 960.5 | CHROMOSOME XV READING FRAME ORF YOR197W. | sptrembl Q08601 | ND |
| 4415 | 960.4 | 2-ISOPROPYLMALATE SYNTHASE. | sptrembl O59736 | Amino acid transport and metabolism |
| 4416 | 960.2 | TRYPTOPHANYL-TRNA SYNTHETASE, CYTOPLASMIC (EC 6.1.1.2) (TRYPTOPHAN-- TRNA LIGASE) (TRPRS). | swissprot Q12109 | Translation, ribosomal structure and biogenesis |
| 4417 | 960.0 | PHOSPHORYLASE 263 aa. | pdb 3PNP | Nucleotide transport |
| 4418 | 959.5 | ISOCITRATE DEHYDROGENASE [NADP], MITOCHONDRIAL PRECURSOR (EC 1.1.1.42) (OXALOSUCCINATE DECARBOXYLASE) (IDH) (NADP+-SPFCIFIC ICDH) (IDP). | swissprot P79089 | Energy production and conversion |
| 4419 | 958.6 | RAN/SPII BINDING PROTEIN. | sptrembl Q09717 | ND |
| 4420 | 958.2 | SYNAPTOBREVIN. | sptrembl O13312 | ND |

TABLE 3-continued

Aspergillus oryzae ESTs

| Sequence Listing | zscore | Annotation | Database | Functional Category |
|---|---|---|---|---|
| 4421 | 957.3 | MULTICATALYTIC PROTEINASE 222 aa. chain M+1. | pdb 1RYP | Posttranslational modification, protein turnover, chaperones |
| 4422 | 956.8 | HYPOTHETICAL 53.0 KD PROTEIN C22E12.17C IN CHROMOSOME I. | swissprot Q10367 | ND |
| 4423 | 956.1 | PUTATIVE ABC TRANSPORTER. | sptrembl Q9Y840 | ND |
| 4424 | 953.0 | TRANSLATION RELEASE FACTOR ERF3. | sptrembl O42787 | Amino acid transport and metabolism |
| 4425 | 951.3 | CELL DIVISION CONTROL PROTEIN 48. | swissprot P25694 | Posttranslational modification, protein turnover, chaperones |
| 4426 | 950.0 | HYPOTHETICAL 73.1 KD PROTEIN (FRAGMENT). | sptrembl O14164 | ND |
| 4427 | 948.6 | PYRUVATE DEHYDROGENASE E1 COMPONENT ALPHA SUBUNIT, MITOCHONDRIAL PRECURSOR (EC 1.2.4.1) (PDHE1-A). | swissprot Q10489 | Energy production and conversion |
| 4428 | 948.1 | DOLICHYL-PHOSPHATE-MANNOSE--PROTEIN MANNOSYLTRANSFERASE 2 (EC 2.4.1.109). | swissprot P31382 | Posttranslational modification, protein turnover, chaperones |
| 4429 | 947.3 | PUTATIVE PROHIBITIN ANTIPROLIFERATIVE PROTEIN. | sptrembl O94550 | Posttranslational modification, protein turnover, chaperones |
| 4430 | 947.2 | PUTATIVE MITOCHONDRIAL CARRIER YOR222W. | swissnew Q99297 | ND |
| 4431 | 947.0 | CYTOCHROME C PEROXIDASE PRECURSOR (EC 1.11.1.5) (CCP). | swissprot P00431 | Inorganic ion transport and metabolism |
| 4432 | 945.8 | ATP SYNTHASE BETA CHAIN, MITOCHONDRIAL PRECURSOR (EC 3.6.1.34). | swissnew P23704 | Energy production and conversion |
| 4433 | 942.1 | TYROSYL-TRNA SYNTHETASE, CYTOPLASMIC (EC 6.1.1.1) (TYROSYL--TRNA LIGASE) (TYRRS). | swissprot P36421 | Translation, ribosomal structure and biogenesis |
| 4434 | 941.2 | UBIQUINOL-CYTOCHROME C REDUCTASE COMPLEX CORE PROTEIN 2 PRECURSOR (EC 1.10.2.2). | swissprot O60044 | ND |
| 4435 | 937.8 | ASPARTATE AMINOTRANSFERASE, MITOCHONDRIAL PRECURSOR (EC 2.6.1.1) (TRANSAMINASE A) (GLUTAMATE OXALOACETATE TRANSAMINASE-2). | swissprot P12344 | Amino acid transport and metabolism |
| 4436 | 936.9 | Zea mays elF-4E protein #4. | geneseqp Y29948 | ND |
| 4437 | 936.5 | CELL PATTERN FORMATION-ASSOCIATED PROTEIN. | swissprot P36011 | ND |
| 4438 | 934.7 | GLYCOLIPID ANCHORED SURFACE PROTEIN PRECURSOR (GLYCOPROTEIN (GP115). | swissprot P22146 | ND |
| 4439 | 934.3 | HYPOTHETICAL 79.2 KD PROTEIN. | sptrembl Q04585 | Energy production and conversion |
| 4440 | 934.2 | DTDP-GLUCOSE 4-6-DEHYDRATASES-LIKE PROTEIN. | tremblnew CAB62035 | Carbohydrate transport and metabolism |

TABLE 3-continued

_Aspergillus oryzae_ ESTs

| Sequence Listing | zscore | Annotation | Database | Functional Category |
|---|---|---|---|---|
| 4441 | 933.8 | 40S RIBOSOMAL PROTEIN S11 (S18) (YS12) (RP41). | swissprot P26781 | Translation, ribosomal structure and biogenesis |
| 4442 | 933.2 | GLYCOGEN SYNTHASE. | sptrembl O93869 | Cell envelope biogenesis, outer membrane |
| 4443 | 933.2 | 60S RIBOSOMAL PROTEIN L19. | sptrembl O42699 | Translation, ribosomal structure and biogenesis |
| 4444 | 931.5 | MEMBRANE TRANSPORTER. | sptrembl O59700 | ND |
| 4445 | 931.0 | 40S RIBOSOMAL PROTEIN S15 (S12). | swissprot P34737 | Translation, ribosomal stucture and biogenesis |
| 4446 | 930.5 | HYPOTHETICAL 63.9 KD PROTEIN C22A12.08C IN CHROMOSOME I. | sptrembl O13899 | ND |
| 4447 | 928.0 | RIBONUCLEOSIDE-DIPHOSPHATE REDUCTASE SMALL CHAIN 1 (EC 1.17.4.1) (RIBONUCLEOTIDE REDUCTASE). | swissprot P09938 | Nucleotide transport |
| 4448 | 927.0 | POLY(A)+ RNA TRANSPORT PROTEIN PTR3P. | sptrembl O94609 | Coenzyme metabolism |
| 4449 | 926.3 | MAGO NASHI PROTEIN HOMOLOG. | swissprot O65806 | ND |
| 4450 | 925.4 | 01232. | sptrembl Q05663 | ND |
| 4451 | 925.2 | HYPOTHETICAL 32.2 KD PROTEIN IN ARE2-SWP73 INTERGENIC REGION. | swissprot P53722 | ND |
| 4452 | 921.7 | NUCLEAR PROTEIN. | tremblnew CAB41231 | ND |
| 4453 | 921.0 | GLUTAMATE DEHYDROGENASE (EC 1.4.1.4). | tremblnew AAF00006 | Amino acid transport and metabolism |
| 4454 | 920.5 | CHROMOSOME XV READING FRAME ORF YOR090C. | sptrembl Q12511 | Signal transduction mechanisms |
| 4455 | 920.3 | _Cladosporium herbarum_ allergen Clah53. | geneseqp R71891 | Energy production and conversion |
| 4456 | 919.5 | PUTATIVE ACONITASE IN PRP21-UBP12 INTERGENIC REGION (ec 4.2.1.3). | swissprot P39533 | Energy production and conversion |
| 4457 | 918.8 | SPLICEOSOME ASSOCIATED PROTEIN 49 (SAP 49) (SF3B53). | swissprot Q15427 | ND |
| 4458 | 918.7 | Yeast proteasome YCI subunit. | geneseqp R22996 | Posttranslational modification, protein turnover, chaperones |
| 4460 | 916.8 | HYPOTHETICAL 15.5 KD PROTEIN IN MFAL2-MAD1 INTERGENIC REGION. | swissprot P53152 | ND |
| 4461 | 913.8 | FRUCTOSE-1,6-BISPHOSPHATASE (EC 3.1.3.11) (D-FRUCTOSE-1,6-BISPHOSPHATE PHOSPHOHYDROLASE) (FBPASE). | swissprot P09201 | Carbohydrate transport and metabolism |
| 4462 | 911.4 | HYPOTHETICAL 46.6 KD PROTEIN IN DAL80-GAP1 INTERGENIC REGION. | swissnew P36132 | Posttranslational modification, protein turnover, chaperones |
| 4463 | 909.6 | RAN GTPASE ACTIVATING PROTEIN 1 (RNA1 PROTEIN). | swissprot P41391 | ND |
| 4464 | 909.4 | SCO1 PROTEIN PRECURSOR. | swissprot P23833 | ND |

TABLE 3-continued

*Aspergillus oryzae* ESTs

| Sequence Listing | zscore | Annotation | Database | Functional Category |
|---|---|---|---|---|
| 4465 | 907.9 | PHOSPHOPROTEIN PHOSPHATASE A. | sptrembl Q23922 | ND |
| 4466 | 906.4 | RIBOSOMAL PROTEIN SUBUNIT S18. | sptrembl O94754 | Translation, ribosomal structure and biogenesis |
| 4467 | 906.3 | O-METHYLTRANSFERASE. | tremblnew BAA86103 | ND |
| 4468 | 906.1 | RIBONUCLEASE T2 PRECURSOR (EC 3.1.27.1) (RNASE T2). | swissprot P10281 | ND |
| 4469 | 903.9 | NADH-UBIQUINONE OXIDOREDUCTASE 20.8 KD SUBUNIT (EC 1.6.5.3) (EC 1.6.99.3). | swissprot P21976 | ND |
| 4470 | 903.9 | PUTATIVE GTP CYCLOHYDROLASE. | tremblnew CAB65619 | ND |
| 4471 | 903.8 | PYRUVATE KINASE (EC 2.7.1.40) (PK). | swissprot Q12669 | Carbohydrate transport and metabolism |
| 4472 | 903.7 | PROBABLE MITOCHONDRIAL IMPORT INNER MEMBRANE TRANSLOCASE SUBUNIT TIM44 PRECURSOR. | swissprot O60084 | ND |
| 4473 | 901.7 | 60S RIBOSOMAL PROTEIN 1.23 (1.17). | swissprot P04451 | Translation, ribosomal structure and biogenesis |
| 4474 | 901.6 | 3-METHYLCROTONYL-COA CARBOXYLASE PRECURSOR (EC 6.4.1.4). | sptrembl Q42523 | ND |
| 4475 | 901.5 | HYPOTHETICAL 50.3 KD PROTEIN. | tremblnew CAB52038 | ND |
| 4476 | 900.4 | 14-3-3. | tremblnew BAA89421 | ND |
| 4477 | 900.0 | HOMEODOMAIN DNA-BINDING TRANSCRIPTION FACTOR. | sptrembl O74252 | ND |
| 4478 | 899.9 | SERINE/THREONINE PROTEIN PHOSPHATASE PP2A CATALYTIC SUBUNIT (EC 3.1.3.16). | swissprot P48580 | Signal transduction mechanisms |
| 4479 | 899.8 | ACTIN INTERACTING PROTEIN 2. | swissprot P46681 | Energy production and conversion |
| 4480 | 899.4 | ACTIVATOR OF HSP70 AND HSP90 CHAPERONES. | tremblnew CAB39910 | ND |
| 4481 | 899.2 | HYPOTHETICAL 22.1 KD PROTEIN IN CCP1-MET1 INTERGENIC REGION. | swissprot P36149 | ND |
| 4482 | 897.8 | INITIATION FACTOR 5A-1 (EIF-5A) (EIF-4D) (HYPUSINE CONTAINING PROTEIN HP1). | swissprot P19211 | Translation, ribosomal structure and biogenesis |
| 4483 | 897.5 | HISTONE H3. | swissprot P23753 | DNA replication, recombination and repair |
| 4484 | 894.8 | PUTATIVE ATP-DEPENDENT RNA HELICASE C17G6.14C. | sptrembl O13792 | DNA replication, recombination and repair |
| 4485 | 893.9 | SIRTUIN TYPE3. | sptrembl Q9Y6E8 | Coenzyme metabolism |
| 4486 | 892.1 | PH RESPONSIVE PROTEIN PRECURSOR (PH-REGULATED PROTEIN 1). | swissprot P43076 | ND |
| 4487 | 890.0 | TRANSKETOLASE 2 (EC 2.2.1.1) (TK 2). | swissprot P33315 | Carbohydrate transport and metabolism |
| 4488 | 888.2 | CDC37 PROTEIN. | sptrembl O94740 | ND |
| 4489 | 887.1 | SQUALENE MONOOXYGENASE (EC 1.14.99.7) (SQUALENE EPOXIDASE) (SE). | swissprot Q92206 | Coenzyme metabolism |

TABLE 3-continued

Aspergillus oryzae ESTs

| Sequence Listing | zscore | Annotation | Database | Functional Category |
|---|---|---|---|---|
| 4490 | 886.7 | T02D1.5 PROTEIN. | sptrembl O45730 | Lipid metabolism |
| 4491 | 855.9 | Translational initiation factor 1A (E1F1AX)gene product. | geneseqp W81509 | Translation, ribosomal structure and biogenesis |
| 4492 | 882.7 | HYPOTHETICAL 52.9 KD PROTEIN IN SAP155-YMR31 INTERGENIC REGION. | swissprot P43616 | Amino acid transport and metabolism |
| 4493 | 882.0 | FISSION YEAST. | sptrembl P78887 | Coenzyme metabolism |
| 4494 | 880.6 | UBIQUITIN. | sptrembl O13697 | ND |
| 4495 | 879.0 | PROTEIN KINASE DSK1 (EC 2.7.1.-) (DIS1-SUPPRESSING PROTEIN KINASE). | swissprot P36616 | Signal transduction mechanisms |
| 4496 | 878.1 | CG1-35 PROTEIN. | sptrembl Q9Y624 | ND |
| 4497 | 877.5 | 60S RIBOSOMAL PROTEIN L20 (L18A). | swissprot P47913 | ND |
| 4498 | 875.7 | PD1 RELATED PROTEIN A. | sptrembl O93914 | ND |
| 4499 | 875.0 | SUCCINATE SEMIALDEHYDE DEHYDROGENASE (EC 1.2.1.24) (NAD(+)-DEPENDENT SUCCINIC SEMIALDEHYDE DEHYDROGENASE) (FRAGMENT). | swissprot P51649 | Energy production and conversion |
| 4500 | 874.4 | Glyceraldehyde-3-phosphate dehydrogenase. | geneseqp R22097 | Carbohydrate transport and metabolism |
| 4501 | 873.6 | 40S RIBOSOMAL PROTEIN S26E (CRP5) (13.6 KD RIBOSOMAL PROTEIN). | swissprot P21772 | ND |
| 4502 | 871.4 | HYPOTHETICAL 41.9 KD PROTEIN IN HAC1-CAK1 INTERGENIC REGION. | swissprot P43567 | Amino acid transport and metabolism |
| 4503 | 870.9 | HYPOTHETICAL 33.9 KD PROTEIN. | sptrembl P8995 | Amino acid transport and metabolism |
| 4505 | 868.2 | HYPOTHETICAL 22.7 KD PROTEIN. | sptrembl O60073 | ND |
| 4506 | 867.9 | PROBABLE 3-HYDROXYBUTYRYL-COA DEHYDROGENASE (EC 1.1.1.157) (BETA-HYDROXYBUTYRYL-COA DEHYDROGENASE) (BHBD). | swissprot P45856 | Lipid metabolism |
| 4507 | 866.9 | HYPOTHETICAL 103.2 KD PROTEIN C24B11.10C IN CHROMOSOME 1. | swissprot Q09897 | ND |
| 4508 | 865.9 | ENDO ALPHA-1,4 POLYGALACTOSAMINIDASE PRECURSOR PRECURSOR. | sptrembl Q52423 | ND |
| 4509 | 865.9 | BETA-1,3-GLUCANOSYLTRANSFERASE. | sptrembl O59909 | ND |
| 4510 | 865.1 | 60S RIBOSOMAL PROTEIN 1.27A (L29). | swissprot P78987 | Translation, ribosomal structure and biogenesis |
| 4511 | 864.4 | HYPOTHETICAL 98.1 KD PROTEIN. | tremblnew CAB58402 | ND |
| 4512 | 862.7 | PORPHOBILINOGEN DEAMINASE. | sptrembl O94048 | Coenzyme metabolism |
| 4513 | 862.4 | RIBOSOMAL PROTEIN S16 HOMOLOG (FRAGMENT). | tremblnew BAA33368 | Translation, ribosomal structure and biogenesis |
| 4514 | 862.3 | PROTEIN PHOSPHATASE 2C HOMOLOG 2 (EC 3.1.3.16) (PP2C-2). | swissprot Q09172 | Signal transduction mechanisms |

TABLE 3-continued

Aspergillus oryzae ESTs

| Sequence Listing | zscore | Annotation | Database | Functional Category |
|---|---|---|---|---|
| 4516 | 861.6 | HYPOTHETICAL 32.8 KD PROTEIN IN B1O3-HXT17 INTERGENIC REGION. | swissprot P53750 | ND |
| 4517 | 861.4 | RER1 PROTEIN. | swissnew O15258 | ND |
| 4518 | 861.1 | SERYL-TRNA SYNTHETASE, CYTOPLASMIC (EC 6.1.1.11) (SERINE--TRNA LIGASE) (SERRS). | swissprot P07284 | Translation, ribosomal structure and biogenesis |
| 4519 | 859.4 | ALANYL-TRNA SYNTHETASE, CYTOPLASMIC (EC 6.1.1.7) (ALANINE--TRNA LIGASE) (ALARS). | swissprot P40825 | translation, ribosomal structure and biogenesis |
| 4520 | 859.4 | PROBABLE STERIGMATOCYSTIN BIOSYNTHESIS P450 MONOOXYGENASE STCS (EC 1.14.-.-)(CYTOCHROME P450 59). | swissprot Q00714 | ND |
| 4521 | 859.0 | DOLICHYL-PHOSPHATE-MANNOSE--PROTEIN MANNOSYLTRANSFERASE 4 (EC 2.4.1.109). | swissprot P46971 | Posttranlational modification, protein turnover, chaperones |
| 4522 | 858.4 | CYCLOHEXANONE MONOOXYGENASE (EC 1.14.13.22). | swissprot P12015 | Inorganic ion transport and metabolism |
| 4524 | 854.6 | PUTATIVE CALCIUM P-TYPE ATPASE FRAGMENT). | tremblnew CAB65293 | ND |
| 4525 | 854.5 | ORM1 PROTEIN. | swissprot P53224 | ND |
| 4526 | 852.2 | RAS PROTEIN. | sptrembl P87018 | ND |
| 4527 | 851.5 | PUTATIVE SECRETORY PATHWAY GDP DISSOCIATION INHIBITOR. | swissprot Q10305 | ND |
| 4528 | 850.4 | GLUCOAMYLASE PRECURSOR (EC 3.2.1.3) (GLUCAN 1,4-ALPHA-GLUCOSIDASE) (1,4-ALPHA-D-GLUCAN GLUCOHYDROLASE). | swissprot P36914 | ND |
| 4529 | 849.8 | GATA FACTOR SREP. | swissprot Q92259 | ND |
| 4530 | 848.8 | FRUCTOSE-BISPHOSPHATE ALDOLASE (EC 4.1.2.13). | swissprot P14540 | Carbohydrate transport and metabolism |
| 4531 | 848.8 | PUTATIVE TRANSCRIPTIONAL REGULATOR. | sptrembl O13337 | ND |
| 4532 | 848.3 | CYTOPLASMIC RIBOSOMAL PROTEIN S13. | tremblnew BAA88058 | Translation, ribosomal structure and biogenesis |
| 4533 | 848.0 | PROBABLE PROTEIN KINASE. | tremblnew BAA21391 | Signal transduction mechanisms |
| 4534 | 847.4 | HYPOTHETICAL 34.2 KD PROTEIN IN CUS1-RP1.20A INTERGENIC REGION. | swissprot Q04013 | ND |
| 4535 | 847.0 | Yeast RNA-binding protein 2PR1. | geneseqp W38455 | ND |
| 4536 | 845.2 | HYPOTHETICAL 72.8 KD PROTEIN C4G3.09C IN CHROMOSOME III. | sptrembl P87234 | ND |
| 4537 | 844.6 | VACUOLAR ATP SYNTHASE SUBUNIT (EC 3.6.1.34) (V-ATPASE E SUBUNIT) (V-ATPASE 26 KD SUBUNIT). | swissprot Q01278 | Energy production and conversion |
| 4538 | 844.5 | HYPOTHETICAL 42.4 KD PROTEIN IN CDC12-ORC6 INTERGENIC REGION. | swissprot P38716 | Amino acid transport and metabolism |

TABLE 3-continued

_Aspergillus oryzae_ ESTs

| Sequence Listing | zscore | Annotation | Database | Functional Category |
|---|---|---|---|---|
| 4539 | 843.7 | NADH-UBIQUINONE OXIDOREDUCTASE 21.3 KD SUBUNIT (EC 1.6.5.3) (EC 1.6.99.3). | swissprot P19968 | ND |
| 4540 | 842.3 | 40S RIBOSOMAL PROTEIN S12. | sptrembl O59936 | ND |
| 4541 | 841.2 | HYPOTHETICAL GTP-BINDING PROTEIN IN SEH11-PRP20 INTERGENIC REGION. | swissprot P53145 | ND |
| 4542 | 840.9 | PROBABLE PEROXISOMAL MEMBRANE PROTEIN PMP20 (ALLERGEN ASP F 3). | swissprot O43099 | ND |
| 4543 | 839.2 | CONSERVED HYPOTHETICAL PROTEIN. | tremblnew CAB52883 | Nucleotide transport |
| 4544 | 839.1 | BIFUNCTIONAL HISTIDINE BIOSYNTHESIS PROTEIN HIS7 [INCLUDES: HISH-TYPE AMIDOTRANSFERASE (EC 2.4.2.-); HISF-TYPE CYCLASE]. | swissprot P33734 | ND |
| 4545 | 839.1 | HYPOTHETICAL 61.8 KD PROTEIN C12B10.03 IN CHROMOSOME I. | swissprot Q10437 | ND |
| 4546 | 837.9 | 40S RIBOSOMAL PROTEIN S22 (S15A) (YS24). | swissprot P33953 | Translation, ribosomal structure and biogenesis |
| 4547 | 837.6 | CHITIN SYNTHASE REGULATORY FACTOR. | sptrembl P87065 | ND |
| 4548 | 835.4 | ACID TREHALASE PRECURSOR (EC 3.2.1.28) (ALPHA,ALPHA-TREHALASE) (ALPHA,ALPHA-TREHALOSE GLUCOHYDROLASE). | swissprot P78617 | ND |
| 4549 | 835.2 | NADH-UBIQUINONE OXIDOREDUCTASE 21 KD SUBUNIT PRECURSOR (EC 1.6.5.3) (EC 1.6.99.3) (COMPLEX 1-21KD) (C1-21KD). | swissprot P25711 | ND |
| 4550 | 832.7 | PYRUVATE DEHYDROGENASE E1 COMPONENT BETA SUBUNIT, MITOCHONDRIAL PRECURSOR (EC 1.2.4.1) (PDHE1-B). | swissprot Q09171 | Energy production and conversion |
| 4551 | 831.6 | CYTOCHROME C. | swissprot P56205 | ND |
| 4552 | 827.9 | HISTIDINOL-PHOSPHATE AMINOTRANSFERASE (EC 2.6.1.9) (IMIDAZOLE ACETOL- PHOSPHATE TRANSAMINASE). | swissprot P36605 | Amino acid transport and metabolism |
| 4553 | 827.9 | 8 KDA CYTOPLASMIC DYNEIN LIGHT CHAIN. | sptrembl O94111 | ND |
| 4554 | 827.8 | Protein involved in cephalosporin C biosynthesis. | geneseqp W14439 | ND |
| 4555 | 826.4 | HYPOTHETICAL 74.0 KD PROTEIN IN CAJ1-HOM3 INTERGENIC REGION. | swissprot P40032 | ND |
| 4556 | 825.6 | HYPOTHETICAL 61.8 KD PEPTIDASE IN MPR1-GCN20 INTERGENIC REGION (EC 3.4.-.-). | swissprot P43590 | Amino acid transport and metabolism |
| 4557 | 824.1 | 6-PHOSPHOFRUCTOKINASE (EC 2.7.1.11) PHOSPHOFRUCTOKINASE) (PHOSPHOHEXOKINASE). | swissprot P78985 | ND |

TABLE 3-continued

*Aspergillus oryzae* ESTs

| Sequence Listing | zscore | Annotation | Database | Functional Category |
|---|---|---|---|---|
| 4558 | 824.0 | BROADLY SELECTIVE SODIUM/NUCLEOSIDE TRANSPORTER HFCNE. | tremblnew AAD52151 | Nucleotide transport |
| 4559 | 823.5 | PUTATIVE ZINC-CONTAINING DEHYDROGENASE. | tremblnew CAB53146 | ND |
| 4560 | 822.3 | GAL10 BIFUNCTIONAL PROTEIN [INCLUDES: UDP-GLUCOSE 4-EPIMERASE (EC 5.1.3.2) (GALACTOWALDENASE); ALDOSE 1-EPIMERASE (EC 5.1.3.3) (MUTAROTASE)]. | swissprot P40801 | Cell envelope biogenesis, outer membrane |
| 4561 | 822.2 | DPM2 mannosyl transferase. | geneseqp R47201 | Posttranslational modification, protein turnover, chaperones |
| 4562 | 821.6 | DYNAMIN-RELATED PROTEIN DNM1. | swissprot P54861 | ND |
| 4563 | 819.3 | SUPEROXIDE DISMUTASE [MN] PRECURSOR (EC 1.15.1.1) (FRAGMENT). | swissprot Q92450 | Inorganic ion transport and metabolism |
| 4564 | 816.0 | *Aspergillus niger* tpiA gene. | geneseqp P70498 | Carbohydrate transport and metabolism |
| 4565 | 816.0 | ENOYL-COA HYDRATASE. | sptrembl O53418 | Lipid metabolism |
| 4566 | 815.9 | PUTATIVE MITOCHONDRIAL IMPORT INNER MEMBRANE TRANSLOCASE SUBUNIT. | tremblnew CAB53081 | ND |
| 4567 | 814.2 | SUCCINYL-COA:3-KETOACID-COENZYME A TRANSFERASE PRECURSOR (EC 2.8.3.5) (SUCCINYL COA:3-OXOACID COA-TRANSFERASE) (OXCT). | swissprot P55809 | Lipid metabolism |
| 4569 | 813.2 | GENERAL AMINO ACID PERMEASE AGP2. | swissprot P38090 | Amino acid transport and metabolism |
| 4570 | 813.0 | YMC1P. | sptrembl Q12002 | ND |
| 4571 | 812.7 | HISTONE H4.1. | swissprot P23750 | DNA replication, recombination and repair |
| 4572 | 812.6 | 60S RIBOSOMAL PROTEIN L9-B (L8) (YL11) (RP25). | swissprot P51401 | Translation, ribosomal structure and biogenesis |
| 4573 | 812.5 | PROBABLE CALCIUM-TRANSPORTING ATPASE 6 (EC 3.6.1.38). | swissprot P39986 | Inorganic ion transport and metabolism |
| 4574 | 811.1 | ALPHA-ADAPTIN HOMOLOG. | swissprot P91926 | ND |
| 4575 | 810.8 | PUTATIVE SMALL NUCLEAR RIBONUCLEOPROTEIN C19A8.13. | sptrembl O13829 | Transcription |
| 4576 | 810.0 | NUCLEOSIDE DIPHOSPHATE KINASE. | tremblnew BAA83495 | Nucleotide transport |
| 4577 | 809.0 | ERV25 PROTEIN PRECURSOR. | swissprot P54837 | ND |
| 4578 | 808.6 | ATP SYNTHASE ALPHA CHAIN, MITOCHONDRIAL PERCURSOR (EC 3.6.1.34). | swissnew P37211 | Energy production and conversion |
| 4579 | 808.0 | ELONGATION FACTOR 1-BETA HOMOLOG. | tremblnew AAC13264 | Translation, ribosomal structure and biogenesis |
| 4580 | 807.8 | HYPOTHETICAL 49.1 KD PROTEIN C11D3.06 IN CHROMOSOME I. | swissprot Q10085 | ND |

TABLE 3-continued

*Aspergillus oryzae* ESTs

| Sequence Listing | zscore | Annotation | Database | Functional Category |
|---|---|---|---|---|
| 4581 | 807.7 | PUTATIVE DELTA-1-PYROLINE-5-CARBOXYLATE DEHYDROGENASE. | sptrembl O74766 | Energy production and conversion |
| 4582 | 807.7 | MITOCHONDRIAL PHOSPHATE CARRIER PROTEIN (PHOSPHATE TRANSPORT PROTEIN) (PIP) (MITOCHONDRIAL IMPORT RECEPTOR) (P32). | swissprot P23641 | ND |
| 4583 | 807.5 | HISTONE H2A VARIANT. | swissprot P48003 | ND |
| 4584 | 806.5 | PUTATIVE HUMAN SPLICEOSOME ASSOCIATED PROTEIN 145 (SAP 145) HOMOLOGUE. | tremblnew | ND |
| 4585 | 806.2 | PUTATIVE CELL DIVISION PROTEIN KINASE C2F3.15 (EC 2.7.1.-). | sptrembl O14098 | Signal transduction mechanisms |
| 4586 | 805.4 | An enzyme with sugar transferase activity. | geneseqp W88044 | ND |
| 4587 | 803.7 | PUTATIVE ESTERASE. | tremblnew CAB63539 | Lipid metabolism |
| 4588 | 803.3 | MEMBRANE ATPASE. | sptrembl O74431 | Inorganic ion transport and metabolism |
| 4589 | 802.1 | COPROPORPHYRINOGEN III OXIDASE PRECURSOR (EC 1.3.3.3) (COPROPORPHYRINOGENASE) (COPROGEN OXIDASE). | swissprot P35055 | Coenzyme metabolism |
| 4590 | 802.1 | MRNA CLEAVAGE FACTOR I 25 KDA SUBUNIT. | sptrembl O43809 | ND |
| 4591 | 801.2 | RETINOBLASIOMA BINDING PROTEIN. | tremblnew AAC36349 | ND |
| 4592 | 800.4 | 3-OXOACYL-[ACYL-CARRIER-PROTEIN]-SYNTHASE. | sptrembl O13355 | Lipid metabolism |
| 4593 | 800.4 | TRICHOTHECENE 3-O-ACETYLTRANSFERASE. | sptrembl O74644 | ND |
| 4594 | 798.1 | HYPOTHETICAL 26.3 KD PROTEIN IN OYE2-GND1 INTERGENIC REGION. | swissprot P38569 | ND |
| 4595 | 797.2 | FISSION YEAST (FRAGMENT). | sptrembl P78824 | Carbohydrate transport and metabolism |
| 4596 | 797.1 | HYPOTHETICAL 54.2 KD PROTEIN IN ERP5-ORC6 INTERGENIC REGION. | swissprot P38821 | Amino acid transport and metabolism |
| 4597 | 796.8 | REPRESSOR PROTEIN. | sptrembl Q00784 | ND |
| 4598 | 796.4 | PUTATIVE ABC TRANSPORTER. | sptrembl Q9Y840 | ND |
| 4599 | 796.0 | MALTOSE PERMEASE. | sptrembl Q9Y845 | ND |
| 4600 | 795.1 | PUTATIVE ALANINE AMINOTRANSFERASE, MITOCHONDRIAL PRECURSOR (EC 2.6.1.2) (GLUTAMIC--PYRUVIC TRANSAMINASE) (GPT) (GLUTAMIC--ALANINE TRANSAMINASE). | swissprot P52893 | Amino acid transport and metabolism |
| 4601 | 793.9 | PUTATIVE BETA-MANNOSYLTRANSFERASE. | tremblnew CAB16885 | Cell envelope biogenesis, outer membrane |
| 4602 | 793.7 | Product of the ADE1 gene from *Candida utilis*. | geneseqp R22458 | Nucleotide transport |
| 4603 | 793.4 | ATP SYNTHASE DELTA CHAIN, MITOCHONDRIAL PRECURSOR (EC 3.6.1.34) (FRAGMENT). | swissnew P56525 | Energy production conversion |
| 4604 | 792.8 | PSU1. | tremblnew BAA83907 | ND |

TABLE 3-continued

*Aspergillus oryzae* ESTs

| Sequence Listing | zscore | Annotation | Database | Functional Category |
|---|---|---|---|---|
| 4605 | 791.6 | BETA-N-ACETYLGLUCOSAMINIDASE PRECURSOR (EC 3.2.1.30). | sptrembl O82840 | Carbohydrate transport and metabolism |
| 4606 | 789.3 | WD-40 domain-contg. IEF SSP 9306 protein. | geneseqp R85866 | ND |
| 4607 | 789.2 | LINOLEATE DIOL, SYNTHASE PRECURSOR. | tremblnew AAD49559 | ND |
| 4608 | 788.8 | ALCOHOL DEHYDROGENASE. | tremblnew CAA21782 | ND |
| 4609 | 788.5 | METAL RESISTANCE PROTEIN YCF1 (YEAST CADMIUM FACTOR 1). | swissprot P39109 | ND |
| 4610 | 787.7 | RS6/L7A RIBOSOMAL PROTEIN HOMOLOG. | tremblnew CAB63790 | Translation, ribosomal structure and biogenesis |
| 4611 | 785.6 | PUTATIVE 20KDA SUBUNIT OF THE V-ATPASE. | sptrembl P87252 | ND |
| 4612 | 785.3 | ACYL-COA DEHYDROGENASE, SHORT/BRANCHED CHAIN SPECIFIC PRECURSOR (EC 1.3.99.-) (SBCAD) (2-METHYL BRANCHED CHAIN ACYL-COA DEHYDROGENASE) (2-MEBCAD). | swissprot P45954 | Lipid metabolism |
| 4613 | 783.6 | ADRENOLEUKODYSTROPHY PROTEIN (ALDP). | swissprot P33897 | Lipid metabolism |
| 4614 | 782.2 | 4-AMINOBUTYRATE AMINOTRANSFERASE (EC 2.6.1.19) (GAMMA-AMINO-N-BUTYRATE TRANSAMINASE) (GABA TRANSAMINASE) (GABA AMINOTRANSFERASE). | swissprot P14010 | Amino acid transport and metabolism |
| 4615 | 777.3 | HISTONE H4.2. | swissprot P23751 | DNA replication, recombination and repair |
| 4616 | 776.8 | CONSERVED HYPOTHETICAL PROTEIN. | tremblnew CAB39853 | ND |
| 4617 | 775.9 | BL1-3 PROTEIN. | swissprot Q01358 | ND |
| 4618 | 775.0 | N-ACETYLGLUCOSAMINE-PHOSPHATE MUTASE. | tremblnew AAD55097 | Carbohydrate transport and metabolism |
| 4619 | 771.8 | OPSIN-1. | tremblnew aad45253 | ND |
| 4620 | 768.2 | PUTATIVE ADENOSINE KINASE. | tremblnew CAA19345 | Carbohydrate transport and metabolism |
| 4621 | 768.1 | METHIONINE AMINOPEPTIDASE. | sptrembl O60085 | Translation, ribosomal structure and biogenesis |
| 4622 | 768.1 | IMPORTIN BETA SUBUNIT. | sptrembl O74476 | ND |
| 4623 | 767.9 | PROBABLE ELECTRON TRANSFER FLAVOPROTEIN ALPHA-SUBUNIT PRECURSOR (ALPHA-ETF). | swissprot P78790 | Energy production and conversion |
| 4624 | 767.4 | CHROMOSOME XV READING FRAME ORF YOR091W. | sptrembl Q12000 | ND |
| 4625 | 766.0 | 60S RIBOSOMAL PROTEIN L17-B (YL17-B). | swissprot P46990 | Translation, ribosomal structure and biogenesis |
| 4626 | 763.9 | PUTATIVE NADH-DEPENDENT FLAVIN OXIDOREDUCTASE. | sptrembl O94467 | Energy production and conversion |
| 4627 | 763.6 | GTPASE ACTIVATING PROTEIN HOMOLOG. | sptrembl O13384 | ND |
| 4628 | 762.9 | HYPOTHETICAL 55.8 KD PROTEIN. | tremblnew CAB63552 | ND |

TABLE 3-continued

_Aspergillus oryzae_ ESTs

| Sequence Listing | zscore | Annotation | Database | Functional Category |
|---|---|---|---|---|
| 4629 | 762.6 | SID478P. | tremblnew BAA84693 | ND |
| 4630 | 762.0 | Multiple drug resistance Afu-MDR1 protein. | geneseqp W01022 | ND |
| 4631 | 761.4 | SIMILAR TO ASPARTATE AMINOTRANSFERASE. | sptrembl Q17994 | Amino acid transport and metabolism |
| 4632 | 760.1 | ACTIVATOR I 41 KD SUBUNIT (REPLICATION FACTOR C 41 KD SUBUNIT). | swissprot P40348 | DNA replication, recombination and repair |
| 4633 | 759.8 | ENDOGLUCANASE I (EC 3.2.1.4) (ENDO-1,4-BETA-GLUCANASE) (CARBOXYMETHYL-CELLULASE I) (CMCASE I). | swissprot P23044 | ND |
| 4634 | 759.2 | PUTATIVE THIAZOLE SYNTHASE. | tremblnew AAF25444 | ND |
| 4635 | 758.9 | SIGNAL SEQUENCE RECEPTOR ALPHA SUBUNIT. | sptrembl Q9Y7B0 | Cell motility and secretion |
| 4636 | 757.7 | HYPOTHETICAL 55.5 KD PROTEIN C17A2.05 IN CHROMOSOME I. | sptrembl O13755 | Energy production and conversion |
| 4637 | 757.6 | NONALLELIC VEGETATIVE INCOMPATIBILITY PROTEIN HET-C. | sptrembl Q01571 | ND |
| 4638 | 757.5 | _A. oryzae_ ATCC20386 carboxypeptidase 1 protein. | geneseqp W56099 | ND |
| 4639 | 756.3 | NI-BINDING UREASE ACCESSORY PROTEIN CREG. | sptrembl Q9XGS2 | ND |
| 4640 | 755.1 | HYPOTHETICAL 92.5 KD PROTEIN C25H2.03 IN CHROMOSOME II. | sptrembl P87145 | ND |
| 4641 | 754.8 | HYPOTHETICAL 45.2 KD PROTEIN C19A806 IN CHROMOSOME I. | sptrembl O13822 | ND |
| 4642 | 754.7 | PUTATIVE PROLYL AMINOPEPTIDASE. | tremblnew CAB66205 | ND |
| 4643 | 754.2 | PUTATIVE PERMEASE C29B12.14C. | sptrembl O14035 | Coenzyme metabolism |
| 4644 | 751.9 | PROBABLE HISTIDINOL-PHOSPHATASE (EC 3.1.3.15). | swissnew O14059 | ND |
| 4645 | 749.9 | POTENTIAL PROTEASOME COMPENENT C5 (EC 3.4.99.46) (MULTICATALYTIC ENDOPEPTIDASE COMPLEX SUBUNIT C5). | swissprot P23724 | Posttranslational modification, protein turnover, chaperones |
| 4646 | 747.1 | ATP SYNTHASE D CHAIN, MITOCHONDRIAL (EC 3.6.1.34). | swissprot O13350 | ND |
| 4647 | 747.0 | 4-DIHYDROMETHYL-TRISPORATE DEHYDROGENASE. | sptrembl Q01213 | ND |
| 4648 | 746.8 | IMPORTIN BETA-1 SUBUNIT (KARYOPHERIN BETA-1 SUBUNIT) (IMPORTIN 95). | swissprot O13864 | ND |
| 4649 | 744.5 | PUTATIVE GOLG1 MEMBRANE PROTEIN-SORTING PROTEIN. | sptrembl O94291 | ND |
| 4650 | 744.5 | NAD(+)-ISOCITRATE DEHYDROGENASE SUBUNIT 1 PRECURSOR. | sptrembl O13302 | Amino acid transport and metabolism |
| 4651 | 743.9 | DNA LIGASE (EC 6.5.1.1) (POLYDEOXYRIBONUCLEO TIDE SYNTHASE [ATP]). | swissprot P12000 | DNA replication, recombination and repair |
| 4652 | 743.7 | PROBABLE ATP-DEPENDENT TRANSPORTER YOL075C. | swissprot Q08234 | ND |

TABLE 3-continued

*Aspergillus oryzae* ESTs

| Sequence Listing | zscore | Annotation | Database | Functional Category |
|---|---|---|---|---|
| 4653 | 743.1 | PUTATIVE METHYLTRANSFERASE NCL1 (EC 2.1.1.-). | swissnew P38205 | Translation, ribosomal structure and biogenesis |
| 4654 | 742.7 | 20 KD NUCLEAR CAP BINDING PROTEIN (NCBP) (CBP20) (FRAGMENT). | swissprot P52299 | Transcription |
| 4655 | 741.3 | MULTICATALYTIC PROTEINASE 222 aa. chain M+1. | pdb 1RYP | Posttranslational modification, protein turnover, chaperones |
| 4656 | 740.4 | 60S RIBOSOMAL PROTEIN L21. | tremblnew CAB44755 | Translation, ribosomal structure and biogenesis |
| 4657 | 739.5 | PUTATIVE THIAMINE BIOSYNTHESIS PROTEIN. | sptrembl O94266 | ND |
| 4658 | 739.2 | PROBABLE GLUCOSE TRANSPORTER RCO-3. | swissprot Q92253 | ND |
| 4660 | 738.9 | Y1P3 PROTEIN. | swissprot P53633 | ND |
| 4661 | 737.7 | SERINE PALMITOYLTRANSFERASE 2 (EC 2.3.1.50) (LONG CHAIN BASE BIOSYNTHESIS PROTEIN 2) (SPT 2). | swissprot Q09925 | Coenzyme metabolism |
| 4662 | 737.6 | RASP F 9 (FRAGMENT). | sptrembl O42800 | Carbohydrate transport and metabolism |
| 4663 | 737.2 | UBIQUITIN CARBOXYL-TERMINAL HYDROLASE (HOMOLOGY TO UBIQUITIN CARBOXYL-TERMINAL HYDROLASE). | sptrembl Q11119 | ND |
| 4664 | 737.1 | EUKARYOTIC TRANSLATION INITIATION FACTOR 2 ALPHA SUBUNIT (E1F-2-ALPHA). | swissprot P56286 | Translation, ribosomal structure and biogenesis |
| 4665 | 736.7 | PUTATIVE GLYCOSYL TRANSFERASE. | sptrembl O74878 | Cell envelope biogenesis, outer membrane |
| 4666 | 735.3 | GLUCOSE-6-PHOSPHATE ISOMERASE, CYTOSOLIC (EC 5.3.1.9) (GPI) (PHOSPHOGLUCOSE ISOMERASE) (PGI) (PHOSPHOHEXOSE ISOMERASE) (PHI). | sptrembl O94371 | Carbohydrate transport and metabolism |
| 4667 | 733.7 | PUTATIVE ALPHA-GLUCAN SYNTHASE. | sptrembl O94638 | ND |
| 4668 | 732.9 | PROBABLE LACTOYLGLUTATHIONE LYASE (EC 4.4.1.5) (METHYLGLYOXALASE) (ALDOKETOMUTASE) (GLYOXALASE I) (GLX I) (KETONE-ALDEHYDE MUTASE) (S-D-LACTOYLGLUTATHIONE METHYLGLYOXAL LYASE). | swissprot Q09751 | Amino acid transport and metabolism |
| 4669 | 732.1 | GMP SYNTHASE [GLUTAMINE-HYDROLYZING] (EC 6.3.5.2) (GLUTAMINE AMIDOTRANSFERASE) (GMP SYNTHETASE). | swissprot P38625 | Nucleotide transport |
| 4670 | 731.7 | SIMILAR TO CALCIUM-BINDING EF-HAND PROTEIN. | sptrembl O22788 | ND |
| 4671 | 731.6 | CHROMOSOME XII COSMID 9470. | sptrembl Q06287 | ND |

TABLE 3-continued

*Aspergillus oryzae* ESTs

| Sequence Listing | zscore | Annotation | Database | Functional Category |
|---|---|---|---|---|
| 4672 | 731.3 | PROBABLE ZINC METALLOPEPTIDASE C17A5.04C PRECURSOR (EC 3.4.24.-). | swissprot O13766 | ND |
| 4673 | 730.7 | HYPOTHETICAL 54.2 KD TRP-ASP REPEATS CONTAINING PROTEIN C29A4.08C IN CHROMOSOME I. | swissprot O14011 | ND |
| 4674 | 729.8 | PUTATIVE TRIGLYCERIDE LIPASE-CHOLESTEROL ESTERASE (EC 3.1.1.-). | sptrembl P78898 | ND |
| 4675 | 729.1 | PHOSPHOLIPASE D PRECURSOR (EC 3.1.4.4) (CHOLINE PHOSPHATASE). | swissprot Q59332 | ND |
| 4676 | 727.5 | HYPOTHETICAL 32.5 KD PROTEIN YLR351C. | swissprot P49954 | ND |
| 4677 | 724.6 | 60S RIBOSOMAL PROTEIN L27-A. | swissprot O14388 | ND |
| 4678 | 723.9 | PHOSPHOENOLPYRUVATE CARBOXYKINASE [ATP] (EC 4.1.1.49). | swissprot O13434 | Energy production and conversion |
| 4679 | 723.8 | AMINOPEPTIDASE Y PRECURSOR (EC 3.4.11.-). | swissprot P37302 | ND |
| 4680 | 723.7 | ATP SYNTHASE SUBUNIT 4.MITOCHONDRIAL PRECURSOR (EC 3.6.1.34). | swissprot O13349 | ND |
| 4681 | 723.7 | GUANOSINE-DIPHOSPHATASE (EC 3.6.1.42) (GDPASE). | swissprot P32621 | ND |
| 4682 | 723.5 | PUTATIVE POLY(A)-BINDING PROTEIN FABM. | sptrembl Q92227 | Transcription |
| 4683 | 722.7 | MSF1 PROTEIN. | swissprot P35200 | ND |
| 4684 | 722.3 | FLAVOHEMOGLOBIN. | sptrembl O74183 | Energy production and conversion |
| 4685 | 720.6 | PUTATIVE RIBOSE 5-PHOSPHATE ISOMERASE | tremblnew CAB61273 | Carbohydrate transport and metabolism |
| 4686 | 720.5 | HYPOTHETICAL 20.9 KD PROTEIN | sptrembl O94286 | ND |
| 4687 | 720.4 | PUTATIVE HYDROXYMETHYLGLUTARYL-COA LYASE PRECURSOR. | sptrembl O81027 | Amino acid transport and metabolism |
| 4688 | 720.0 | 60S RIBOSOMAL PROTEIN L23A (L25). | swissprot P51997 | Translation, ribosomal structure and biogenesis |
| 4689 | 720.0 | PHOSPHOGLUCOMUTASE 2 (EC 5.4.2 2) (GLUCOSE PHOSPHOMUTASE 2) (PGM 2). | swissprot P37012 | Carbohydrate transport and metabolism |
| 4690 | 717.6 | *Aspergillus nidulans* essential protein AN17. | geneseqp Y06418 | ND |
| 4691 | 713.2 | SMALL ZINC FINGER-LIKE PROTEIN. | sptrembl Q9Y8A7 | ND |
| 4692 | 712.9 | PROHIBITIN (FRAGMENT). | sptrembl O13357 | Posttranslational modification, protein turnover, chaperones |
| 4693 | 712.8 | MULTIDRUG RESISTANCE PROTEIN 1. | sptrembl O43121 | ND |
| 4694 | 712.1 | SIMILAR TO YEAST VACUOLAR SORTING PROTEIN VPS29 PEP11. | tremblenew CAB52425 | ND |
| 4695 | 711.6 | PROBABLE GLUTAMYL-TRNA(GLN) AMIDOTRANSFERASE SUBUNIT A. MITOCHONDRIAL PRECURSOR (GLU-ADT SUBUNIT A). | swissnew Q03557 | Translation, ribosomal structure and biogenesis |

TABLE 3-continued

Aspergillus oryzae ESTs

| Sequence Listing | zscore | Annotation | Database | Functional Category |
|---|---|---|---|---|
| 4696 | 711.3 | HYPOTHETICAL 48.3 KD PROTEIN IN HSP26-T1F32 INTERGENIC REGION. | swissprot P38248 | ND |
| 4607 | 710.3 | AGSPL1 PROTEIN. | sptrembl O60028 | Amino acid transport and metabolism |
| 4698 | 707.9 | PUTATIVE PROLINE-TRNA SYNTHETASE. | sptrembl O74765 | Translation, ribosomal structure and biogenesis |
| 4699 | 707.7 | 60S RIBOSOMAL PROTEIN L9, MITOCHONDRIAL PRECURSOR (YML9). | swissprot P31334 | Translation, ribosomal structure and biogenesis |
| 4700 | 707.0 | Dihydroxyacetone-3-phosphate protein. | geneseqp Y23747 | ND |
| 4701 | 706.5 | 60S RIBOSOMAL PROTEIN L13. | swissprot O74175 | ND |
| 4702 | 706.1 | PUTATIVE GLUCANASE PRECURSOR. | tremblnew CAB57923 | ND |
| 4703 | 705.7 | An enzyme with sugar transferase activity. | geneseqp W88044 | ND |
| 4704 | 705.0 | PUTATIVE PROLYL-TRNA SYNTHETASE YHR020W (EC 6.1.1.15) (PROLINE--TRNA LIGASE) (PRORS). | swissprot P38708 | Translation, ribosomal structure and biogenesis |
| 4705 | 704.5 | HYPOTHETICAL 18.8 KD PROTEIN. | sptrembl O43073 | ND |
| 4706 | 704.4 | MITOCHONDRIAL LON PROTEASE HOMOLOG 1 PRECURSOR (EC 3.4.21.-). | swissprot P93647 | Posttranslational modification, protein turnover, chaperones |
| 4707 | 703.9 | GAR1 PROTEIN. | swissnew P28007 | ND |
| 4708 | 702.3 | HYPOTHETICAL 51.9 KD PROTEIN IN PFK27-RPL25 INTERGENIC REGION PRECURSOR. | swissprot Q08271 | ND |
| 4709 | 700.1 | HYPOTHETICAL 80.9 KD PROTEIN (FRAGMENT). | tremblnew CAB60246 | ND |
| 4710 | 699.6 | HYPOTHETICAL 56.4 KD PROTEIN IN RPL30-CWH41 INTERGENIC REGION PRECURSOR. | swissprot P53189 | ND |
| 4711 | 698.7 | HOMOSERINE DEHYDROGENASE (EC 1.1.1.3) (HDH). | swissnew P31116 | Amino acid transport and metabolism |
| 4712 | 698.6 | NUCLEAR TRANSPORT FACTOR 2 (N1F-2) (NUCLEAR TRANSPORT FACTOR P10). | swissprot P33331 | ND |
| 4713 | 698.5 | PHENYLALANINE AMMONIUM LYASE. | sptrembl O93967 | ND |
| 4714 | 698.3 | VEGETATIBLE INCOMPATIBILITY PROTEIN HET-E-1. | swissprot Q00808 | ND |
| 4715 | 697.6 | HYPOTHETICAL 130.6 KD PROTEIN C9G1.10C IN CHROMOSOME 1. | sptrembl O14306 | ND |
| 4716 | 695.3 | HYPOTHETICAL 57.6 KD PROTEIN. | sptrembl Q9Y7D4 | ND |
| 4717 | 694.5 | ADENYLOSUCCINATE SYNTHETASE (EC 6.3.4.4). | tremblnew CAB59683 | Nucleotide transport |
| 4718 | 694.4 | T-COMPLEX PROTEIN 1, ALPHA SUBUNIT HOMOLOG, CHAPERONIN FAMILY. | sptrembl O94501 | Posttranslational modification, protein turnover, chaperones |
| 4719 | 693.3 | HYPOTHETICAL 34.2 KD PROTEIN IN CUS1-RPL20A INTERGENIC REGION. | swissprot Q04013 | ND |
| 4720 | 693.3 | HYPOTHETICAL 29.4 KD PROTEIN IN STE6-LOS1 INTERGENIC REGION. | swissprot P36039 | ND |

TABLE 3-continued

Aspergillus oryzae ESTs

| Sequence Listing | zscore | Annotation | Database | Functional Category |
|---|---|---|---|---|
| 4721 | 602.4 | HYPOTHETICAL 24.1 KD PROTEIN C17A5.08 IN CHROMOSOME 1 PRECURSOR. | swissprot O13770 | ND |
| 4722 | 691.9 | PROBABLE MALATE OXIDOREDUCTASE [NAD] (EC 1.1.1.38) (MALIC ENZYME). | swissprot P26616 | ND |
| 4723 | 691.6 | PROBABLE ZINC METALLOPEPTIDASE C17A5.04C PRECURSOR (EC 3.4.24.-). | swissprot O13766 | ND |
| 4724 | 690.4 | ADENOSYLHOMOCYSTEIN ASE (EC 3.3.1.1) (S-ADENOSYL-L-HOMOCYSTEINE HYDROLASE) (ADOHCYASE). | swissprot P39954 | Coenzyme metabolism |
| 4725 | 690.4 | EXO-1,3-BETA-GLUCANASE/1,3-BETA-D-GLUCAN GLUCANOHYDROLASE (EC 3.2.1.58) (GLUCAN 1,3-BETA-GLUCOSIDASE) (EXO-1,3-BETA-GLUCOSIDASE). | sptrembl Q12626 | ND |
| 4726 | 689.7 | EUKARYOTIC INITATION FACTOR 4A (EIF-4A). | swissprot P47943 | DNA replication, recombination and repair |
| 4727 | 689.6 | PURC PROTEIN. | sptrembl Q9X7F7 | Nucleotide transport |
| 4728 | 689.4 | ALFA-L-RHAMNOSIDASE (EC 3.2.1.40). | tremblnew CAB53341 | ND |
| 4729 | 688.1 | FATTY ACID DESATURASE (FRAGMENT). | sptrembl O74645 | ND |
| 4730 | 687.9 | HYPOTHETICAL 34.1 KD PROTEIN C11D3.03C IN CHROMOSOME I. | swissprot Q10082 | ND |
| 4731 | 687.6 | DOLICHYL-PHOSPHATE-MANNOSE--PROTEIN MANNOSYLTRANSFERASE 1 (EC 2.4.1.109). | swissprot O74189 | Posttranslational modification, protein turnover, chaperones |
| 4732 | 687.3 | HEAT SHOCK PROTEIN 70 FRAGMENT). | sptrembl Q92260 | Posttranslational modification, protein turnover, chaperones |
| 4733 | 686.7 | EF-HAND PROTEIN. | tremblnew CAB55175 | ND |
| 4734 | 686.6 | PEPTIDE SYNTHETASE. | sptrembl Q01135 | ND |
| 4735 | 684.8 | HYPOTHETICAL 285.2 KD PROTEIN. | sptrembl O60055 | ND |
| 4736 | 684.7 | 25 KDA PROTEIN ELICITOR. | tremblnew AAD53944 | ND |
| 4737 | 684.5 | GENRAL ALPHA-GLUCOSIDE PERMEASE. | swissprot P53048 | ND |
| 4738 | 684.3 | GLUTATHIONE S-TRANSFERASE. | sptrembl O59827 | Posttranslational modification, protein turnover, chaperones |
| 4739 | 684.1 | HYPOTHETICAL 49.5 KD PROTEIN. | tremblnew CAB41125 | Posttranslational modification, protein turnover, chaperones |
| 4740 | 683.8 | SERINE-TYPE CARBOXYPEPTIDASE F PRECURSOR (EC 3.4.16.-) (PROTEINASE F) (CPD-II). | swissprot P52718 | ND |
| 4741 | 682.2 | ZK669.4 PROTEIN. | sptrembl Q23571 | Energy production and conversion |
| 4742 | 681.5 | N1F-U LIKE PROTEIN. | tremblnew CAB61462 | Energy production and conversion |

TABLE 3-continued

*Aspergillus oryzae* ESTs

| Sequence Listing | zscore | Annotation | Database | Functional Category |
|---|---|---|---|---|
| 4743 | 681.3 | RODLET PROTEIN PRECURSOR. | swissprot P28346 | ND |
| 4744 | 681.0 | HYPOTHETICAL 39.9 KD PROTEIN. | sptrembl O74507 | ND |
| 4745 | 680.8 | HYPOTHETICAL 97.1 KD PROTEIN C32A11.02C IN CHROMOSOME I. | swissprot Q10327 | ND |
| 4746 | 680.5 | PUTATIVE RHO GDP-DISSOCIATION INHIBITOR (RHO GDI). | sptrembl O14224 | ND |
| 4747 | 679.6 | HYPOTHETICAL 17.3 KD PROTEIN. | sptrembl Q9X7U1 | ND |
| 4748 | 679.1 | UBIUITIN-LIKE PROTEIN DSK2. | swissprot P48510 | ND |
| 4749 | 679.0 | LPG20P. | sptrembl Q02895 | Energy production and conversion |
| 4750 | 678.7 | HYDROXYLASE. | sptrembl O94115 | ND |
| 4751 | 678.7 | ACTIN. | swissprot O13419 | Cell division and chromosome partitioning |
| 4752 | 678.6 | 20 KD NUCLEAR CAP BINDING PROTEIN (NCBP) (CBP20) (FRAGMENT). | swissprot P52299 | Transcription |
| 4754 | 677.4 | PROBABLE ATP-DEPENDENT TRANSPORTER C29A3.09C. | sptrembl O59672 | ND |
| 4755 | 677.1 | HELICASE. | sptrembl Q92770 | ND |
| 4756 | 676.6 | HEAT SHOCK PROTEIN 70 HOMOLGG YHR064C. | swissprot P38788 | Posttranslational modification, protein turnover, chaperones |
| 4757 | 675.7 | SPLICESOME-ASSOCIATED PROTEIN. | sptrembl O59706 | ND |
| 4758 | 675.0 | F27D4.5 PROTEIN. | sptrembl O93610 | Energy production and conversion |
| 4759 | 674.2 | CHROMOSOME XII READING FRAME ORF YLR009W. | sptrembl Q07915 | Translation, ribosomal structure and biogenesis |
| 4760 | 674.2 | BRANCHED-CHAIN AMINO ACID AMINOTRANSFERASE. CYTOSOLIC (EC 2.6.1.42) (BCAT) (TWT2 PROTEIN). | swissprot P47176 | Coenzyme metabolism |
| 4761 | 673.0 | 60S RIBOSOMAL PROTEIN L6-B (L17) (YL16) (RP18). | swissprot P05739 | ND |
| 4762 | 671.0 | PROBABLE SUCCINYL-COA LIGASE [GDP-FORMING] ALPHA-CHAIN. MITOCHONDRIAL PRECURSOR (EC 6.2.1.4) (SUCCINYL-COA SYNTHETASE, ALPHA CHAIN) (SCS-ALPHA). | swissprot O13750 | Energy production and conversion |
| 4763 | 670.8 | TRYPTOPHANYL-TRNA SYNTHETASE. CYTOPLASMIC (EC 6.1.1.2) (TRYPTOPHAN-- TRNA LIGASE) (TRPRS). | swissprot Q12109 | Translation, ribosomal structure and biogenesis |
| 4764 | 670.4 | 26S PROTEASOME REGULATORY SUBUNIT SUN1. | swissprot P38886 | ND |
| 4765 | 670.4 | HYPOTHETICAL 40.1 KD PROTEIN. | sptrembl O42964 | ND |
| 4766 | 669.8 | SPLICING FACTOR U2AF 50 KD SUBUNIT (U2 AUXILIARY FACTOR 50 KD SUBUNIT) (U2 SNRNP AUXILIARY FACTOR LARGE SUBUNIT). | swissprot Q24562 | ND |
| 4767 | 669.6 | HEXOSE TRANSPORTER. | sptrembl O13311 | ND |

TABLE 3-continued

*Aspergillus oryzae* ESTs

| Sequence Listing | zscore | Annotation | Database | Functional Category |
|---|---|---|---|---|
| 4768 | 669.3 | UTR2 PROTIEN (UNKNOWN TRANSCRIPT 2 PROTEIN). | swissprot P32623 | Carbohydrate transport and metabolism |
| 4769 | 669.1 | PROBABLE KYNURENINASE (EC 3.7.1.3) (L-KYNURENINE HYDROLASE). | swissprot Q05979 | Amino acid transport and metabolism |
| 4770 | 668.9 | GLUTATHIONE REDUCTASE (GR). | sptrembl Q9WXD5 | Energy production and conversion |
| 4771 | 668.1 | PATHOGENICITY PROTEIN. | sptrembl O93846 | ND |
| 4772 | 667.8 | ELECTRON TRANSPORT 312 aa, chain A. | pdb 1EFV | Energy production and conversion |
| 4773 | 667.6 | YEAST PROTEASOME COMPONENT PRE4 HOMOLOG. | tremblnew CAB54818 | Posttranslational modification, protein turnover, chaperones |
| 4774 | 667.4 | SEXUAL DEVELOPMENT REGULATOR 1. | tremblnew CAB52588 | ND |
| 4775 | 667.1 | SMALL ZINC FINGER-LIKE PROTEIN. | sptrembl Q9Y8A8 | ND |
| 4776 | 665.5 | HYPOTHETICAL 64.0 KD PROTEIN C20G4.05C IN CHROMOSOME I. | swissprot O13890 | ND |
| 4777 | 664.4 | PUTATIVE COATOMER BETA SUBUNIT. | tremblnew CAB46767 | ND |
| 4778 | 664.2 | RNA BINDING PROTEIN. | sptrembl O74978 | Transcription |
| 4779 | 663.5 | MOLYBDOPTERIN SYNTHASE LARGE SUBUNIT CNXH. | sptrembl Q9Y8C1 | ND |
| 4780 | 661.9 | MOLLUSK-DERIVED GROWTH FACTOR. | sptrembl O96697 | ND |
| 4781 | 661.2 | HEXOKINASE (EC 2.7.1.1). | sptrembl O93964 | ND |
| 4782 | 659.4 | OXIDOREDUCTASE OF SHORT-CHAIN. | sptrembl Q9X9S4 | ND |
| 4783 | 657.9 | PROTEIN KINASE. | strembl O50790 | ND |
| 4784 | 657.5 | PUTATIVE 26S PROTEASOME SUBUNIT. | tremblnew CAB63792 | ND |
| 4785 | 656.7 | ZINC-FINGER PROTEIN 7PR1. | swissprot O13724 | ND |
| 4786 | 656.6 | HYPOTHETICAL 14.4 KD PROTEIN IN RNR1-ALD3 INTERGENIC REGION. | swissprot P40046 | ND |
| 4787 | 656.2 | MAL3 PROTEIN. | swissnew Q10113 | ND |
| 4788 | 655.9 | HYPOTHETICAL AMINOTRANFERASE C6B12.04C (EC 2.6.1.-). | swissprot O14209 | Amino acid transport and metabolism |
| 4789 | 654.8 | PUTATIVE CINNAMOYL-COA REDUCTASE. | tremblnew CAB58730 | Carbohydrate transport and metabolism |
| 4790 | 651.0 | SEC13-RELATED PROTEIN. | swissprot P55735 | ND |
| 4791 | 650.8 | HYPOTHETICAL 42.3 KD PROTEIN IN YTA2-DIT1 INTERGENIC REGION. | swissprot Q04179 | Nucleotide transport |
| 4792 | 649.9 | 60S RIBOSOMAL PROTEIN L32-A. | swissprot P79015 | Translation, ribosomal structure and biogenesis |
| 4793 | 648.8 | AVERANTIN OXIDOREDUCTASE (EC 1.14.--)(CYTOCHROME P450 60A1). | swissprot Q12732 | ND |
| 4794 | 648.1 | ZINC FINGER PROTEIN SFP1. | swissprot P32432 | ND |
| 4795 | 647.4 | FISSION YEAST FRAGMENT). | sptreMbl P78810 | ND |
| 4796 | 647.2 | IGE-BINDING PROTEIN (FRAGMENT). | sptrembl O74263 | ND |

TABLE 3-continued

*Aspergillus oryzae* ESTs

| Sequence Listing | zscore | Annotation | Database | Functional Category |
|---|---|---|---|---|
| 4797 | 646.9 | GLYCINE DEHYDROGENASE [DECARBOXYLATING]. MITOCHANDRIAL PRECURSOR (EC 1.4.4.2) (GLYCINE DECARBOXYLASE) (GLYCINE CLEAVAGE SYSTEM P-PROTEIN). | swissprot P49095 | Amino acid transport and metabolism |
| 4798 | 644.7 | 6-PHOSPHOGLUCONATE DEHYDROGENASE (EC 1.1.1.44). | sptrembl O60037 | Carbohydrate transport and metabolism |
| 4799 | 644.3 | 60S RIBOSOMAL PROTEIN L5. | swissprot O59953 | Translation, ribosomal structure and biogenesis |
| 4800 | 643.1 | ACYL-COA DEHYDROGENASE PUTATIVE. | tremblnew AAF12182 | Lipid metabolism |
| 4801 | 642.9 | PROBABLE GAMMA-GLUTAMYL PHOSPHATE REDUCTASE. | tremblnew CAB57445 | Amino acid transport and metabolism |
| 4802 | 642.5 | ALK2. | sptrembl O74128 | ND |
| 4803 | 642.2 | HYPOTHETICAL 52.2 KD PROTEIN. | sptrembl Q12116 | ND |
| 4804 | 639.5 | ISOTRICHODERMIN C-15 HYDROXYLASE (EC 1.14.-.-) (CYTOCHROME P450 65A1). | swissprot O13317 | ND |
| 4805 | 638.6 | FK506-BINDING PROTEIN PRECURSOR (FKBP-21) (PEPTIDYL-PROLYL CIS-TRANS ISOMERASE) (PPIASE) (EC 5.2.1.8). | swissprot O60046 | Posttranslational modification, protein turnover, chaperones |
| 4806 | 638.4 | ATP PHOSPHORIBOSYLTRANSFRASE (EC 2.4.2.17). | swissprot P40373 | Amino acid transport and metabolism |
| 4807 | 638.2 | 40S RIBOSOMAL PROTEIN S24 (RP50). | swissprot P26782 | Translation, ribosomal structure and biogenesis |
| 4808 | 638.0 | NAD(P) TRANSHYDROGENASE (EC 1.6.1.1) (PYRIDINE NUCLEOTIDE TRANSHYDROGENASE) (NICOTINAMIDE NUCLEOTIDE TRANSHYDROGENASE). | sptrembl Q18031 | Energy production conversion |
| 4809 | 637.5 | PROBABLE ELECTRON TRANSFER FLAVOPROTEIN-UBIQUINONE OXIDOREDUCTASE PRECURSOR (EC 1.5.5.1) (ETF-QO) (ETF-UBIQUINONE OXIDOREDUCTASE) (ETF DEHYDROGENASE) (ELECTRON-TRANSFERRING-FLAVOPROTEIN DEHYDROGENASE). | swissprot P87111 | Energy production and conversion |
| 4810 | 636.9 | CAMP-DEPENDENT PROTEIN KINASE REGULATORY CHAIN. | swissnew O59922 | ND |
| 4811 | 636.3 | ATP SYNTHASE BETA CHAIN, MITOCHONDRIAL PRECURSOR (EC 3.6.1.34). | swissnew P23704 | Energy production and conversion |
| 4812 | 635.4 | 60S RIBOSOMAL PROTEIN L17-B (YL17-B). | swissprot P46990 | Translation, ribosomal structure and biogenesis |

TABLE 3-continued

_Aspergillus oryzae_ ESTs

| Sequence Listing | zscore | Annotation | Database | Functional Category |
|---|---|---|---|---|
| 4813 | 635.3 | PROBABLE MEMBRANE PROTEIN YOL130W. | sptrenbl O13657 | Inorganic ion transport and metabolism |
| 4814 | 634.9 | MITOCHONDRIAL IMPORT RECEPTOR SUBUNIT TOM20 (MITOCHONDRIAL 20 KD OUTER MEMBRANE PROTEIN) (MOM19 PROTEIN) (TRANSLOCASE OF OUTER MEMBRANE 20 KD SUBUNIT). | swissprot P35848 | ND |
| 4815 | 634.2 | NADH DEHYDROGENASE SUBUNIT. | sptrembl Q01388 | ND |
| 4816 | 634.2 | 60S RIBOSOMAL PROTEIN L33-B (1.37B) (Y1.37) (RP47). | swissprot P41056 | ND |
| 4817 | 634.1 | GLUTATHIONE S-TRANSFERASE. | sptrembl O59827 | Posttranslational modification, protein turnover, chaperones |
| 4818 | 633.8 | CALCIUM-TRANSPORTING ATPASE 3 (EC 3.6.1.38). | swissprot P22189 | Inorganic ion transport and metabolism |
| 4819 | 633.4 | HYPOTHETICAL 33.0 KD PROTEIN C25H2.06C IN CHROMOSOME II. | sptrembl P87148 | ND |
| 4820 | 632.5 | PEROXISOMAL MEMBRANE PROTEIN PMP47A. | swissprot P21245 | ND |
| 4821 | 632.2 | HYPOTHETICAL 41.7 KD PROTEIN C3C7.07C IN CHROMOSOME I. | sptrembl O14133 | ND |
| 4822 | 632.1 | PUTATIVE CINNAMOYL-COA REDUCTASE. | tremblnew CAB58730 | Carbohydrate transport and metabolism |
| 4823 | 629.5 | 6,7-DIMETHYL-8-RIBITYLLUMAZINE SYNTHASE. | tremblnew AAD55372 | ND |
| 4824 | 629.5 | OXIDOREDUCTASE, SHORT CHAIN DEHYDROGENASE/REDUCTASE FAMILY. | sptrembl Q9WYD3 | ND |
| 4825 | 629.3 | PUTATIVE OXIDOREDUCTASE C2F3.05C (EC 1.-.-.-). | sptrembl O14088 | ND |
| 4826 | 628.7 | MITOCHONDRIAL PHOSPHATE CARRIER PROTEIN (PHOSPHATE TRANSPORT PROTEIN) (PTP) (MITOCHONDRIAL IMPORT RECEPTOR) (P32). | swissprot P23641 | ND |
| 4827 | 628.0 | Yeast immunophilin FKBP46. | geneseqp W68011 | Posttranslational modification, protein turnover, chaperones |
| 4828 | 627.9 | VACUOLAR PROTEIN SORTING-ASSOCIATED PROTEIN VPS28. | swissprot Q02767 | ND |
| 4829 | 627.8 | Human cytidine deaminase. | geneseqp W13658 | Nucleotide transport |
| 4830 | 626.3 | SMALL NUCLEAR RIBONUCLEOPROTEIN SM D3 (SNRNP CORE PROTEIN D3) (SM-D3). | swissprot P43331 | Transcription |
| 4831 | 623.8 | MITOCHONDRIAL RESPIRATORY FUNCTION PROTEIN HOMOLOG. | swissprot Q10488 | ND |
| 4832 | 623.6 | MALTOSE PERMEASE. | sptrembl Q9Y845 | ND |
| 4833 | 623.0 | CONSERVED HYPOTHETICAL PROTEIN. | sptrembl O74797 | ND |
| 4834 | 621.6 | GABA PERMEASE. | sptrembl Q9Y860 | Amino acid transport and metabolism |
| 4835 | 621.2 | GTP CYCLOHYDROLASE II (EC 3.5.4.25). | swissprot P50139 | Coenzyme metabolism |

TABLE 3-continued

*Aspergillus oryzae* ESTs

| Sequence Listing | zscore | Annotation | Database | Functional Category |
|---|---|---|---|---|
| 4836 | 621.1 | NADH-UBIQUINONE OXIDOREDUCTASE 14.8 KD SUBUNIT (EC 1.6.5.3) (EC 1.6.99.3) (COMPLEX I-14.8KD) (C1-14.8KD). | swissprot P42114 | ND |
| 4837 | 620.7 | ASPARTIC PROTEINASE II-1. | temblnew G1246046 | ND |
| 4838 | 620.2 | AMINO ACID PERMEASE. | sptrembl O59813 | ND |
| 4839 | 620.0 | TRANSLATIONALLY CONTROLLED TUMOR PROTEIN HOMOLOG (TCTP). | swissprot P35691 | ND |
| 4840 | 619.9 | SERINE/THREONINE-PROTEIN KINASE KSP1 (EC 2.7.1.-). | swissnew P38691 | Signal transduction mechanisms |
| 4841 | 619.6 | HEAT SHOCK PROTEIN ST11. | swissprot P15705 | ND |
| 4842 | 619.5 | PROTEIN TRANSLATION FACTOR SU11. | swissprot P32911 | Translation, ribosomal structure and biogenesis |
| 4843 | 618.4 | ASH1. | sptrembl Q24189 | ND |
| 4844 | 618.2 | PROBABLE ATP-DEPENDENT PERMEASE PRECURSOR. | swissprot P25371 | ND |
| 4845 | 617.9 | PEPTIDYL-PROPYL CIS-TRANS ISOMERASE, FK506-BINDING PROTEIN. | tremblnew CAB46710 | Posttranslational modification, protein turnover, chaperones |
| 4846 | 617.4 | UBIQUINONE BIOSYNTHEIS METHYLTRANSFERASE COQ5 (EC 2.1.1.-). | swissprot P49017 | Coenzyme metabolism |
| 4847 | 615.9 | RAS-2 PROTEIN. | swissnew Q01387 | ND |
| 4848 | 615.8 | O-METHYLSTERIGMATOCYSTIN OXIDOREDUCTASE (EC 1.14.1.-) (OMST OXIDOREDUCTASE) (CYTOCHROME P450 64). | swissprot O13345 | ND |
| 4849 | 615.4 | HYPOTHETICAL 27.1 KD PROTEIN IN ACS1-GCV3 INTERGENIC REGION. | swissprot P39721 | ND |
| 4850 | 615.4 | HYPOTHETICAL 23.6 KD PROTEIN. | strembl O14451 | ND |
| 4851 | 614.2 | c424 gene product. | geneseqp R43654 | ND |
| 4852 | 613.9 | 60S RIBOSOMAL PROTEIN L37. | swissprot O44125 | Translation, ribosomal structure and biogenesis |
| 4853 | 613.6 | HYPOTHETICAL 39.6 KD PROTEIN IN MTD1-NUP133 INTERGENIC REGION. | swissprot P36160 | ND |
| 4854 | 612.4 | ORF YP1.252C. | sptrembl Q12184 | Energy production and conversion |
| 4855 | 612.1 | PECTATE LYASE D. | sptrembl Q00845 | ND |
| 4856 | 611.9 | HYPOTHETICAL 44.2 KD PROTEIN. | tremblnew CAB65618 | ND |
| 4857 | 611.7 | ATP SYNTHASE ALPHA CHAIN, MITOCHONDRIAL PRECURSOR (EC 3.6.1.34). | swissnew P24487 | Energy production and conversion |
| 4858 | 611.4 | TRANSMEMBRANE PROTEIN. | tremblnew CAB65007 | ND |
| 4859 | 611.2 | THYMOCYTE PROTEIN (THY28K1). | sptrembl Q90679 | ND |
| 4860 | 609.5 | PUTATIVE TRANSCRIPTIONAL REPRESSOR C30D10.02. | sptrembl O14348 | ND |
| 4861 | 609.4 | HYPOTHETICAL 38.3 KD PROTEIN IN PRP16-SRP40 INTERGENIC REGION. | swissprot P36164 | ND |

TABLE 3-continued

_Aspergillus oryzae ESTs_

| Sequence Listing | zscore | Annotation | Database | Functional Category |
|---|---|---|---|---|
| 4862 | 609.3 | THIOREDOXIN. | swissprot P29429 | Energy production and conversion |
| 4863 | 608.8 | HYPOTHETICAL 31.1 KD PROTEIN IN SIP18-SPT21 INTERGENIC REGION. | swissprot Q03219 | ND |
| 4864 | 608.1 | CYTOCHROME C HEME LYASE (EC 4.4.1.17) (CCHL) (HOLOCYTOCHROME-C SYNTHASE). | swissnew P14187 | ND |
| 4865 | 607.9 | NADH-UBIQUINONE OXIDOREDUCTASE 10.5 KD SUBUNIT (EC 1.6.5.3) (EC 1.6.99.3) (COMPLEX 1) (C1). | swissprot Q07842 | ND |
| 4866 | 607.7 | PUTATIVE D-3-PHOSPHOGLYCERATE DEHYDROGENASE Y1L074W (EC 1.1.1.95) (PGDH). | swissprot P40510 | ND |
| 4867 | 606.5 | BETA-GLUCOSIDASE I PRECURSOR (EC 3.2.1.21) (GENTIOBIASE) (CELLOBIASE) (BETA-D-GLUCOSIDE GLUCOHYDROLASE). | swissprot P48825 | ND |
| 4868 | 606.0 | CALNEXIN HOMOLOG PRECURSOR. | swissprot P36581 | ND |
| 4869 | 605.8 | NUCLEASE. | sptrembl O60168 | ND |
| 4870 | 605.8 | PUTATIVE D-3-PHOSPHOGLYCERATE DEHYDROGENASE YER081W (EC 1.1.1.95) (PGDH). | swissprot P40054 | Amino acid transport and metabolism |
| 4871 | 605.6 | B0250.5 PROTEIN. | sptrembl Q9XT10 | Lipid metabolism |
| 4872 | 605.6 | UNKNOWN PROTEIN. | sptrembl O22730 | ND |
| 4873 | 604.9 | TOXD PROTEIN. | swissprot P54006 | ND |
| 4874 | 604.8 | HYPOTHETICAL 41.5 KD PROTEIN IN GZF3-IME2 INTERGENIC REGION. | swissprot P42946 | ND |
| 4875 | 604.8 | HYPOTHETICAL 81.0 KD PROTEIN CIB3.10C IN CHROMOSOME I PRECURSOR. | sptrembl O13875 | ND |
| 4876 | 602.9 | 60S RIBOSOMAL PROTEIN L26. | swissprot Q39411 | Translation, ribosomal structure and biogenesis |
| 4877 | 602.4 | TOLUENESULFONATE ZINC-INDEPENDENT ALCOHOL DEHYDROGENASE. | sptrembl P94681 | ND |
| 4878 | 602.2 | YPTI-RELATED PROTEIN 2. | swissprot P17609 | ND |
| 4879 | 600.9 | PREDICTED PROTEIN OF UNKNOWN FUNCTION. | sptrenmbl Q9ZR11 | ND |
| 4880 | 600.6 | DUTP PYROPHOSPHATASE-LIKE PROTEIN (EC 3.6.1.23). | tremblnew CAB51171 | Nucleotide transport |
| 4881 | 600.1 | LANOSTEROL SYNTHASE (EC 5.4.99.7) (OXIDOSQUALENE--LANOSTEROL CYCLASE) (2,3-EPOXYSQUALENE--LANOSTEROL CYCLASE) (OSC). | swissprot Q10231 | Lipid metabolism |
| 4882 | 598.3 | HYPOTHETICAL 38.7 KD PROTEIN. | tremblnew CAB59917 | ND |
| 4883 | 598.0 | HYPOTHETICAL 49.1 KD PROTEIN. | sptrembl O74556 | ND |
| 4884 | 595.0 | MBF1 PROTEIN (ORF YOR298(-A). | sptrembl O14467 | ND |
| 4885 | 592.6 | 60S RIBOSOMAL PROTEIN L22. | tremblnew CAB11194 | ND |

TABLE 3-continued

_Aspergillus oryzae_ ESTs

| Sequence Listing | zscore | Annotation | Database | Functional Category |
|---|---|---|---|---|
| 4886 | 592.4 | EIF-5A. | sptrembl O94083 | Translation, ribosomal structure and biogenesis |
| 4887 | 592.4 | HYPOTHETICAL 23.4 KD PROTEIN C3G6.05 IN CHROMOSOME I. | sptrembl O14142 | ND |
| 4888 | 591.4 | RNA POLYMERASE I SECOND-LARGEST SUBUNIT (EC 2.7.7.6). | sptrembl O74633 | Transcription |
| 4889 | 591.4 | PUTATIVE SEPTIN. | tremblnew CAB52419 | ND |
| 4890 | 589.2 | UBIQUITIN-CONJUGATING ENZYME E2-17 KD 4 (EC 6.3.2.19) (UBIQUITIN-PROTEIN LIGASE) (UBIQUITIN CARRIER PROTEIN) (E2(17)KB 4). | swissprot P70711 | ND |
| 4891 | 589.0 | CYTOCHROME B2 PRECURSOR (EC 1.1.2.3) (L-LACTATE DEHYDROGENASE (CYTOCHROME)) (L-LACTATE FERRICYTOCHROME C OXIDOREDUCTASE) (L-LCR). | swissprot P09437 | Energy production and conversion |
| 4892 | 588.8 | HYPOTHETICAL 32.0 KD PROTEIN IN GOG5-NIB3 INTERGENIC REGION. | swissprot P53078 | ND |
| 4893 | 588.6 | HYPOTHETICAL 67.7 KD PROTEIN C23C11.03 IN CHROMOSOME I. | swissprot O13910 | ND |
| 4894 | 588.3 | ENDOSOMAL P24B PROTEIN PRECURSOR (24 KD ENDOMEMBRANE PROTEIN) (BASIC 24 KD LATE ENDOCYTIC INTERMEDIATE COMPONENT). | swissprot P32803 | ND |
| 4895 | 588.2 | UBIQUITIN-CONJUGATING ENZYME E2-17.5 KD (EC 6.3.2.19) (UBIQUITIN-PROTEIN LIGASE) (UBIQUITIN CARRIER PROTEIN). | swissprot P52490 | ND |
| 4896 | 587.7 | HYPOTHETICAL 32 KD PROTEIN. | sptrembl Q01391 | ND |
| 4897 | 587.2 | IMPORTIN BETA-1 SUBUNIT (KARYOPHERIN BETA-1 SUBUNIT) (IMPORTIN 95). | swissprot O13864 | ND |
| 4898 | 586.4 | NUCLEAR PROTEIN SNF4 (REGULATORY PROTEIN CAT3). | swissprot P12904 | ND |
| 4899 | 586.0 | PUTATIVE ATP-DEPENDENT RNA HELICASE. | sptrembl O48534 | ND |
| 4900 | 585.7 | HYPOTHETICAL 49.6 KD PROTEIN IN FBA1-TOA2 INTERGENIC REGION. | swissprot P35728 | ND |
| 4901 | 584.7 | LIGASE 603 aa, chain A | pdb 1BS2 | Translation, ribosomal structure and biogenesis |
| 4902 | 584.4 | SPERMIDINE SYNTHASE. | sptrembl Q9Y8H7 | Amino acid transport and metabolism |
| 4903 | 584.1 | SORBITOL UTILIZATION PROTEIN SOU2. | swissprot P87218 | ND |
| 4904 | 582.6 | HYPOTHETICAL 65.8 KD PROTEIN. | sptrembl O74963 | ND |

TABLE 3-continued

_Aspergillus oryzae_ ESTs

| Sequence Listing | zscore | Annotation | Database | Functional Category |
|---|---|---|---|---|
| 4905 | 582.6 | MINICHROMOSOME MAINTENANCE PROTEIN 3 HOMOLOG. | swissprot P30666 | DNA replication, recombination and repair |
| 4906 | 582.5 | RAT PHOSPHORIBOSYLPHOSPHATE SYNTHETASE (PRPS2). | sptrembl Q63462 | Nucleotide transport |
| 4907 | 580.6 | PUTATIVE ZINC-BINDING DEHYDROGENASE. | sptrembl Q9X9X1 | ND |
| 4908 | 580.5 | HYPOTHETICAL 23.4 KD PROTEIN. | sptrembl Q03201 | Translation, ribosomal structure and biogenesis |
| 4909 | 580.4 | TRANSCRIPTION FACTOR BTE3 (RNA POLYMERASE B TRANSCRIPTION FACTOR 3). | swissprot P20290 | ND |
| 4910 | 580.3 | PROBABLE EUKARYOTIC TRANSLATION INITIATION FACTOR 3 RNA-BINDING SUBUNIT (EIF-3 RNA-BINDING SUBUNIT) (EIF3 P33) (TRANSLATION INITIATION FACTOR EIF3, P33 SUBUNIT). | swissprot P78795 | Transcription |
| 4911 | 579.6 | AMP DEAMINASE (EC 3.5.4.6) (MYOADENYLATE DEAMINASE). | swissprot P15274 | ND |
| 4912 | 579.6 | ACYL CARRIER PROTEIN, MITOCHONDRIAL PRECURSOR (ACP) (NADH-UBIQUINONE OXIDOREDUCTASE 9.6 KD SUBUNIT) (EC 1.6.5.3) (EC 1.6.99.3). | swissprot P11943 | ND |
| 4913 | 579.5 | REPRESSIBLE ALKALINE PHOSPHATASE PRECURSOR (EC 3.1.3.1). | swissprot P11491 | Inorganic ion transport and metabolism |
| 4914 | 579.4 | SIMILARITY NEAR C-TERMINUS TO UNDULIN EXTRACELLULAR MATRIX GLYCOPROTEIN. | sptrembl Q06682 | ND |
| 4915 | 578.5 | AT2G05170 PROTEIN. | tremblnew AAD29055 | ND |
| 4916 | 578.4 | YEAST NRDI-LIKE PROTEIN. | tremblnew CAB60701 | ND |
| 4917 | 577.2 | PUTATIVE SECRETORY PROTEIN. | sptrembl O74903 | ND |
| 4918 | 575.7 | SPORULATION PROTEIN SPS19 (SPORULATION-SPECIFIC PROTEIN SPX19). | swissprot P32573 | ND |
| 4919 | 575.2 | UBIQUITIN FUSION DEGRADATION PROTEIN-2. | sptrembl O60009 | ND |
| 4920 | 573.7 | COPPER RESISTANCE-ASSOCIATED P-TYPE ATPASE. | tremblnew AAF04593 | Inorganic ion transport and metabolism |
| 4921 | 573.6 | _A. fumigatus_ allergen rAsp F8 sequence. | geneseqp W61478 | Translation, ribosomal structure and biogenesis |
| 4922 | 5736 | ALDEHYDE REDUCTASE II. | tremblnew AAF15999 | ND |
| 4923 | 573.3 | ACETAMIDASE. | sptrembl O59805 | ND |
| 4924 | 573.1 | THIOREDOXIN. | swissprot P34723 | Energy production and conversion |
| 4925 | 571.7 | CYSTATHIONINE BETA-LYASE. | tremblnew AAF20155 | Amino acid transport and metabolism |
| 4926 | 570.9 | PUTATIVE PHENYLALANYL-TRNA SYNTHETASE BETA CHAIN CYTOPLASMIC (EC 6.1.1.20) (PHENYLALANINE--TRNA LIGASE BETA CHAIN). | sptrembl O42870 | ND |

TABLE 3-continued

Aspergillus oryzae ESTs

| Sequence Listing | zscore | Annotation | Database | Functional Category |
|---|---|---|---|---|
| 4927 | 570.8 | NMT1 PROTEIN HOMOLOG. | swissprot P42882 | Inorganic ion transport and metabolism |
| 4928 | 570.1 | ALPHA.ALPHA-TREHALOSE-PHOSPHATE SYNTHASE [UDP-FORMING] 1 (EC 2.4.1.15) (TREHALOSE-6-PHOSPHATE SYNTHASE) (UDP-GLUCOSE-GLUCOSEPHOSPHATE GLUCOSYLTRANSFERASE). | swissprot Q00075 | ND |
| 4929 | 570.1 | 36.7 KD PROTEIN IN CBR5-NOT3 INTERGENIC REGION. | swissprot P40531 | ND |
| 4930 | 569.4 | PROTEIN KINASE INHIBITOR P58. | sptrembl Q13217 | ND |
| 4931 | 569.2 | D-ARABINITOL 2-DEHYDROGENASE [RIBULOSE FORMING] (EC 1.1.1.250) (ARDH). | swissprot P43066 | ND |
| 4932 | 569.0 | P-CEMIC ALDEHYDE DEHYDROGENASE. | sptrembl O33455 | Energy production and conversion |
| 4933 | 568.6 | CG1-110 PROTEIN. | sptrembl Q9Y3B4 | ND |
| 4934 | 567.7 | UBIQUITIN-LIKE PROTEIN. | sptrembl O14399 | ND |
| 4935 | 567.2 | CAMP-INDEPENDENT REGULATORY PROTEIN PAC2. | sptrembl Q10294 | ND |
| 4936 | 566.5 | PHOSPHOSERINE AMINOTRANSFERASE (EC 2.6.1.52) (PSAT). | swissprot P33330 | Coenzyme metabolism |
| 4937 | 566.3 | MEIOTIC RECOMBINATION PROTEIN REC14. | swissprot Q09150 | ND |
| 4938 | 566.3 | C-8 STEROL ISOMERASE (DELTA-8--DELTA-7 STEROL ISOMERASE). | swissprot Q92254 | ND |
| 4939 | 566.2 | HYPOTHETICAL 76.3 KD PROTEIN. | sptrembl Q04562 | ND |
| 4940 | 566.1 | HYPOTHETICAL 28.3 KD PROTEIN IN PPR1-SNF7 INTERGENIC REGION. | swissprot Q07953 | ND |
| 4941 | 565.9 | NADH-CYTOCHROME B5 REDUCTASE PRECURSOR (EC 1.6.2.2) (P34/P32). | swissprot P36060 | Coenzyme metabolism |
| 4942 | 565.8 | THREONYL-TRNA SYNTHETASE, CYTOPLASMIC (EC 6.1.1.3) (THREONINE--TRNA LIGASE) (THRRS). | swissprot P26639 | Translation, ribosomal structure and biogenesis |
| 4943 | 565.6 | TRANSCRIPTION ELONGATION FACTOR S II (TFIIS). | swissprot P49373 | Transcription |
| 4944 | 565.6 | HOMOGENTISATE 1,2-DIOXYGENASE (EC 1.13.11.5). | sptrembl Q9ZRA2 | ND |
| 4945 | 565.0 | ASPARAGINE-RICH ZINC FINGER PROTEIN AZE1. | swissprot P41696 | ND |
| 4946 | 564.9 | NICOTINATE-NUCLEOTIDE PYROPHOSPHORYLASE [CARBOXYLATING] (EC 2.4.2.19) (QUINOLINATE PHOSPHORIBOSYLTRANSFERASE [DECARBOXYLATING]) (QAPRTASE). | swissprot Q15274 | Coenzyme metabolism |
| 4947 | 561.2 | FUSCA PROTEIN FUS6. | swissprot P45432 | ND |
| 4949 | 559.0 | PHASE SPECIFIC (YPS-3). | sptrembl Q00950 | ND |
| 4950 | 558.6 | FISSION YEAST (FRAGMENT). | sptrembl P78791 | ND |

TABLE 3-continued

*Aspergillus oryzae* ESTs

| Sequence Listing | zscore | Annotation | Database | Functional Category |
|---|---|---|---|---|
| 4951 | 558.3 | PUTATIVE HEAVY METAL TRANSPORT PROTEIN (FRAGMENT). | sptrembl O74869 | ND |
| 4952 | 557.1 | HYPOTHETICAL 56.6 KD PROTEIN IN URE2-SSU72 INTERGENIC REGION. | swissprot P53867 | ND |
| 4953 | 556.5 | PROBABLE DIMERIC DIHYDRODIOL DEHYDROGENASE. | tremblnew CAB58729 | ND |
| 4954 | 555.8 | GAMMA-BUTYROBETAINE,2-OXOGLUTARATE DIOXYGENASE (EC 1.14.11.1) (GAMMA-BUTYROBETAINE HYDROXYLASE) (GAMMA-BBH). | swissprot O75936 | ND |
| 4955 | 555.8 | AMINOTRANSFERASE. | sptrembl O94562 | Amino acid transport and metabolism |
| 4956 | 555.0 | ANNEXIN XIV. | sptrembl O59907 | ND |
| 4957 | 554.9 | NADPH-DEPENDENT BETA-KETOACYL REDUCTASE. | tremblnew AAD53514 | ND |
| 4958 | 554.3 | HYPOTHETICAL 92.7 KD PROTEIN. | sptrembl O74334 | ND |
| 4960 | 552.3 | HYPOTHETICAL 48.7 KD PROTEIN (FRAGMENT). | tremblnew CAB43225 | ND |
| 4961 | 550.4 | ATP SYNTHASE GAMMA CHAIN, MITOCHONDRIAL PRECURSOR (EC 3.6.1.34). | swissnew P49377 | Energy production and conversion |
| 4962 | 550.3 | ACETYL-COA-ACETYLTRANSFERASE (EC 2.3.1.9). | sptrembl Q9Y838 | ND |
| 4963 | 548.4 | 40S RIBOSOMAL PROTEIN S27. | swissprot O74330 | Translation, ribosomal structure and biogenesis |
| 4964 | 547.6 | ORF YDL447W. | sptrembl Q12250 | ND |
| 4966 | 547.3 | STEROID MONOOXYGENASE. | sptrembl O50641 | Inorganic ion transport and metabolism |
| 4967 | 546.0 | TRANSCRIPTION INITIATION FACTOR TFIIF SMALL SUBUNIT (TRANSCRIPTION FACTOR G 30 KB SUBUNIT) (ANCI PROTEIN). | swissprot P35189 | ND |
| 4968 | 545.5 | 60S ACIDIC RIBOSOMAL PROTEIN PI (ALLERGEN CLA H 12) (CLA H XII). | swissprot P50344 | ND |
| 4969 | 545.0 | SIMILAR TO MITOCHONDRIAL ADP/ATP CARRIER PROTEIN. | sptrembl Q06497 | ND |
| 4970 | 544.3 | KIAA0363 (FRAGMENT). | sptrembl O15069 | Transcription |
| 4971 | 544.1 | AMINONITROPHENYL PROPANEDIOL RESISTANCE PROTEIN. | swissprot P32629 | ND |
| 4972 | 543.6 | HYPOTHETICAL 29.7 KD PROTEIN. | sptreMbl O74529 | ND |
| 4973 | 543.3 | HYPOTHETICAL 86.4 KD PROTEIN IN PHO5-VPS15 INTERGENIC REGION. | swissprot P38254 | ND |
| 4974 | 543.3 | ORF YOL080C. | sptrembl Q08237 | DNA replication, recombination and repair |
| 4975 | 542.2 | PUTATIVE ZUOTIN-LIKE PROTEIN C30D10.01 (FRAGMENT). | sptrembl O14347 | Posttranslational modification, protein turnover, chaperones |
| 4976 | 541.9 | HYPOTHETICAL PROTEIN AQ 1575. | swissnew O67517 | ND |
| 4977 | 541.6 | H(+)/MONOSACCHARIDE COTRANSPORTER. | sptrembl O13411 | ND |

TABLE 3-continued

*Aspergillus oryzae* ESTs

| Sequence Listing | zscore | Annotation | Database | Functional Category |
|---|---|---|---|---|
| 478 | 540.8 | 40S RIBOSOMAL PROTEIN S20. | swissprot O74893 | Translation, ribosomal structure and biogenesis |
| 4979 | 539.8 | DICARBOXYLIC AMINO ACID PERMEASE. | swissprot P53388 | Amino acid transport and metabolism |
| 4980 | 539.8 | *C. magnoliae* carbonyl reductase. | geneseqp W64777 | ND |
| 4981 | 538.8 | P1023 PROTEIN. | sptrembl O13614 | ND |
| 4982 | 538.4 | 3-KETOACYL-COA THIOLASE. PEROXISOMAL PRECURSOR (E.C 2.3.1.16) (BETA-KETOTHIOLASE) (ACETYL-COA ACYLTRANSFERASE) (PEROXISOMAL 3-OXOACYL-COA THIOLASE). | swissprot Q05493 | Lipid metabolism |
| 4983 | 538.0 | PROBABLE RIBOSE-PHOSPHATE PYROPHOSPHOKINASE 5 (EC 2.7.6.1) (PHOSPHORIBOSYL PYROPHOSPHATE SYNTHETASE 5). | swissprot Q12265 | Nucleotide transport |
| 4984 | 537.4 | MYB-LIKE DNA BINDING PROTEIN FLBD. | sptrembl Q00658 | ND |
| 4985 | 537.2 | HYPOTHETICAL 50.8 KD PROTEIN PAU2-GLY1 INTERGENIC REGION. | swissprot P32614 | ND |
| 4986 | 536.6 | 60S RIBOSOMAL PROTEIN L35. | swissprot P17078 | Translation, ribosomal structure and biogenesis |
| 4987 | 534.5 | HYPOTHETICAL 57.7 KD PROTEIN. | sptrembl O59714 | ND |
| 4988 | 534.5 | CALCIUM/CALMODULIN-DEPENDENT PROTEIN KINASE (EC 2.7.1.123) (CMPK). | swissprot Q00771 | ND |
| 4989 | 533.4 | CYTOCHROME B-245 HEAVY CHAIN (P22 PHAGOCYTE B-CYTOCHROME) (NEOTROPHIL CYTOCHROME B.91 KD POLYPEPTIDE) (CGD91-PHOX) (GP91-PHOX) (CYTOCHROME B(558) BETA CHAIN) (SUPEROXIDE-GENERATING NADPH OXIDASE HEAVY CHAIN SUBUNIT). | swissprot P04839 | ND |
| 4990 | 532.6 | PROBABLE MEMBRANE TRANSPORTER. | tremblnew CAB65616 | ND |
| 4991 | 531.3 | MYO-INOSITOL TRANSPORTER I. | swissprot Q10286 | ND |
| 4992 | 531.0 | OPDA-REDUCTASE HOMOLOG. | sptrembl Q9XHD2 | Enerey production and conversion |
| 4993 | 529.7 | MORPHINE 6-DEHYDROGENASE (EC 1.1.1.218) (NALOXONE REDUCTASE). | swissprot Q02198 | ND |
| 4994 | 528.7 | DENTIN PHOSPHORYN (FRAGMENT). | sptrembl O95815 | ND |
| 4995 | 527.1 | HYPOTHETICAL 27.5 KD PROTEIN ITN SPO1-S1S1 INTERGENIC REGION. | swissprot P53981 | ND |
| 4996 | 527.0 | UDP-GALACTOSE TRANSPORTER (GOLGI UDP-GAL TRANSPORTER). | swissprot P87041 | ND |

TABLE 3-continued

*Aspergillus oryzae* ESTs

| Sequence Listing | zscore | Annotation | Database | Functional Category |
|---|---|---|---|---|
| 4997 | 526.8 | SRP1 PROTEIN. | swissprot Q10193 | ND |
| 4998 | 526.6 | MYOSIN-RELATED PROTEIN HOMOLOG MLPA (FRAGMENT). | tremblnew AAE18567 | ND |
| 4999 | 525.6 | GCY PROTEIN (EC 1.1.1.-). | swissprot P14065 | ND |
| 5000 | 525.5 | PISATIN DEMETHYLASE (EC 1.14.-.-) (CYTOCHROME P450 57A2). | swissprot P38364 | ND |
| 5001 | 525.4 | VIROLENCE PROTEIN CAP20. | sptrembl Q00368 | ND |
| 5002 | 525.3 | ALLYL ALCOHOL DEHYDROGENASE. | tremblnew BAA89423 | ND |
| 5003 | 525.1 | DNA REPLICATION HELICASE DNA2. | swissprot P38859 | DNA replication, recombination and repair |
| 5004 | 524.6 | HYPOTHETICAL TPR DOMAIN-CONTAINING PROTEIN. | sptrembl O94474 | ND |
| 5005 | 523.1 | CLATHRIN-ASSOCIATED ADAPTOR COMPLEX AP-2 MEDIUM CHAIN. | tremblnew AAF14248 | ND |
| 5006 | 522.5 | Protein involved in cephalosporin C biosynthesis. | geneseqp W14440 | ND |
| 5007 | 522.4 | HYPOTHETICAL 40.3 KD PROTEIN. | sptrembl O74384 | ND |
| 5008 | 522.0 | IGE-BINDING PROTEIN (FRAGMENT). | sptrembl O74263 | ND |
| 5009 | 521.5 | DNA-DIRECTED RNA POLYMERASE I AND III 14 KDA POLYPEPTIDE. | swissprot Q09177 | Transcription |
| 5010 | 521.4 | SIMILAR TO PHOSPHATIDIC ACID PHOSPHATASE. | tremblnew CAB52620 | ND |
| 5011 | 521.3 | C5,6 DESATURASE. | sptremb O93875 | ND |
| 5012 | 520.8 | QUINATE PERMEASE (QUINATE TRANSPORTER). | swissprot P11636 | ND |
| 5013 | 520.6 | DNAJ RELATED PROTEIN. | sptrembl O94657 | Posttranslational modification, protein turnover, chaperones |
| 5014 | 518.6 | BEM46 PROTEIN (FRAGMENT). | swissprot P54069 | ND |
| 5015 | 517.6 | CURVED DNA-BINDING PROTEIN (42 KD PROTEIN). | swissprot Q09184 | ND |
| 5016 | 517.2 | HYPOTHETICAL 42.5 KD PROTEIN IN TSM1-ARE1 INTERGENIC REGION. | swissprot P25625 | ND |
| 5017 | 516.7 | HYPOTHETICAL 13.5 KD PROTEIN C24B11.09 IN CHROMOSOME I. | swissprot Q09896 | ND |
| 5018 | 514.5 | 6-PHOSPHOGLUCONATE DEHYDROGENASE. DECARBOXYLATING (EC 1.1.1.44) | swissprot O13287 | Carbohydrate transport and metabolism |
| 5019 | 514.1 | LYSOPHOSPHOLIPASE. | sptrembl O42881 | ND |
| 5020 | 513.7 | D-AMINOPEPTIDASE (EC 3.4.11.19) (D-STEREOSPECIFIC AMINOPEPTIDASE). | sptrembl Q59632 | ND |
| 5021 | 513.7 | HYPOTHETICAL 17.1 KD PROTEIN IN SIP3-MRP1.30 INTERGENIC REGION. | swissprot P53849 | ND |
| 5022 | 513.7 | PUTATIVE CYSTEINE DIOXYGENASE (EC 1.13.11.20) (CDO). | sptembl Q20893 | ND |
| 5023 | 513.6 | 26S PROTEASOME REGULATORY COMPLEX SUBUNIT P110 (FRAGMENT). | tremblnew AAF08384 | ND |
| 5024 | 513.1 | HYPOTHETICAL 17.7 KD PROTEIN IN RNR3-ARC15 INTERGENIC REGION. | swissprot P40515 | ND |
| 5025 | 512.3 | 1,4-BUTANEDIOL DIACRYLATE ESTERASE. | sptrembl Q9WXD6 | ND |

TABLE 3-continued

*Aspergillus oryzae* ESTs

| Sequence Listing | zscore | Annotation | Database | Functional Category |
|---|---|---|---|---|
| 5026 | 511.7 | TIJ1.6 PROTEIN. | sptrembl Q9ZPH2 | Posttranslational modification, protein turnover, chaperones |
| 5027 | 511.2 | HYPOTHETICAL 40.2 KD PROTEIN IN TAF145-YOR1 INTERGENIC REGION PRECURSOR. | swissprot P53334 | ND |
| 5028 | 511.2 | PUTATIVE SUCCINATE DEHYDROGENASE CYTOCHROME B SUBUNIT PRECURSOR. | sptrembl O74882 | ND |
| 5029 | 510.6 | BLASTICIDIN-S DEAMINASE (EC 3.5.4.23) (FRAGMENT). | strembl P78986 | ND |
| 5030 | 509.9 | Peptide transport protein ATPTR2Ap. | geneseqp R84891 | ND |
| 5031 | 509.8 | GLYCINE CLEAVAGE SYSTEM H PROTEIN. | sptrembl Q9WY55 | Amino acid transport and metabolism |
| 5032 | 509.4 | YEL007C-AP. | sptrembl P89886 | ND |
| 5033 | 509.3 | ZINC FINGER PROTEIN. | sptrembl O59811 | ND |
| 5034 | 509.1 | HYPOTHETICAL OXIDOREDUCTASE IN MRPL44-MTF1 INTERGENIC REGION (EC 1.-.-.-). | swissprot Q05016 | ND |
| 5035 | 508.9 | HYPOTHETICAL 54.7 KD PROTEIN. | sptrembl Q9Y827 | ND |
| 5036 | 508.0 | UBIQUITIN CARBOXYL-TERMINAL HYDROLASE ISOZYME L3 (EC 3.1.2.15) (UCH-L3) (UBIQUITIN THIOLESTERASE L3). | swissprot P15374 | ND |
| 5037 | 506.3 | HYPOTHETICAL 31.8 KD PROTEIN. | tremblnew CAB52731 | ND |
| 5038 | 506.3 | *S. lipmanii* epimerase. | geneseqp R14187 | ND |
| 5039 | 506.3 | HYPOTHETICAL 34.0 KD PROTEIN IN CTF13-YPK2 INTERGENIC REGION. | swissprot Q03161 | Carbohydrate transport and metabolism |
| 5040 | 506.2 | Cytosolic glycerol-3-phosphate dehydrogenase encoded by GPD2. | geneseqp Y26167 | Energy production and conversion |
| 5041 | 506.0 | RIBOSOMAL PROTEIN L31. | sptrembl Q9XGL4 | Translation, ribosomal structure and biogenesis |
| 5042 | 505.9 | HIGH-AFFINITY GLUCOSE TRANSPORTER. | swissprot O74713 | ND |
| 5043 | 505.4 | COATOMER ZETA SUBUNIT. | sptrembl O74891 | ND |
| 5044 | 505.3 | CARBOXYPEPTIDASE S1 (EC 3.4.16.6). | swissprot P34946 | ND |
| 5045 | 504.9 | QUINATE PERMEASE (QUINATE TRANSPORTER). | swissprot P15325 | ND |
| 5046 | 504.0 | CYTOCHROME P450 51 (EC 1.14.14.1) (CYPL1) (P450-L1A1) (STEROL 14-ALPHA DEMETHYLASE) (EBURICOL 14-ALPHA-DEMETHYLASE) (P450-14DM). | swissprot Q12664 | ND |
| 5047 | 502.3 | Ester hydrolase protein encoded by rec 511 gene. | geneseqp R44609 | ND |
| 5048 | 501.8 | *C. magnoliae* carbonyl reductase. | geneseqp W64777 | ND |
| 5049 | 501.4 | HYPOTHETICAL 72.2 KD PROTEIN C12C2.05C IN CHROMOSOME II. | swissprot Q09746 | ND |
| 5050 | 501.0 | LOW-AFFINITY EE(II) TRANSPORT PROTEIN. | swissprot P40988 | ND |
| 5051 | 498.7 | CHROMOSOME XV READING FRAME ORF YOR197W. | sptrembl Q08601 | ND |

TABLE 3-continued

*Aspergillus oryzae* ESTs

| Sequence Listing | zscore | Annotation | Database | Functional Category |
|---|---|---|---|---|
| 5052 | 498.5 | HYPOTHETICAL 53.5 KD PROTEIN C1F5.07C IN CHROMOSOME I. | swissprot Q10062 | ND |
| 5053 | 497.6 | SIMILAR TO ACETYL-COENZYME A SYNTHETASE NCB1 G1:1118129. | sptrembl Q21166 | ND |
| 5054 | 497.3 | SULFUR METABOLITE REPRESSION CONTROL PROTEIN. | swissprot Q00659 | ND |
| 5055 | 497.1 | PUTATIVE MAJOR FACILITATOR FAMILY MULTI-DRUG RESISTANCE PROTEIN. | sptrembl O94343 | ND |
| 5056 | 496.7 | HYPOTHETICAL 24.1 KD PROTEIN. | sptrembl O94389 | ND |
| 5057 | 496.7 | GLUTATHIONE SYNTHETASE LARGE CHAIN (EC 6.3.2.3) (GLUTATHIONE SYNTHASE LARGE CHAIN) (GSH CHAIN) (GSH-S) (PHYTOCHELATIN SYNTHETASE). | swissprot P35669 | ND |
| 5058 | 496.0 | CYTOCHROME C OXIDASE POLYPEPTIDE IV PRECURSOR (EC 1.9.3.1). | swissprot P04037 | ND |
| 5060 | 494.8 | ALPHA-AMYLASE (EC 3.2.1.1). | tremblnew | ND |
| 5061 | 494.6 | PUTATIVE TRANSPORT PROTEIN. | tremblnew CAB52881 | ND |
| 5062 | 494.5 | HYPOTHETICAL TRP-ASP REPEATS CONTAINING PROTEIN C29E6.01 IN CHROMOSOME I (FRAGMENT). | swissprot Q09855 | ND |
| 5063 | 494.4 | HYPOTHETICAL 46.5 KD PROTEIN. | sptrembl Q07730 | ND |
| 5064 | 494.1 | UBIQUINOE-CYTOCHROME C REDUCTASE COMPLEX SUBUNIT. | sptrembl O74533 | ND |
| 5065 | 493.9 | PUTATIVE OXIDOREDUCTASE BL1-4 PRECURSOR (EC 1.-.-.-). | swissprot Q92247 | ND |
| 5066 | 493.1 | HYPOTHETICAL 44.2 KD PROTEIN IN RME1-TFC4 INTERGENIC REGION. | swissprot P53230 | ND |
| 5067 | 492.8 | NONHISTONE PROTEIN 6. | tremblnew AAF06350 | ND |
| 5068 | 492.0 | ALDEHYDE DEHYDROGENASE. | sptrembl Q55811 | Energy production and conversion |
| 5069 | 4911.3 | TYROSINASE (EC 1.14.18.1) (MONOPHENOL MONOOXYGENASE). | swissprot Q00234 | ND |
| 5070 | 491.9 | HYPOTHETICAL 50.3 KD PROTEIN IN TFA1-PAN3 INTERGENIC REGION. | swissprot P36101 | Coenzyme metabolism |
| 5071 | 491.7 | PROBABLE SERINE HYDROXYMETHYLTRANSFERASE. CYTOSOLIC (EC 2.1.2.1) (SERINE METHYLASE) (GLYCINE HYDROXYMETHYLTRANSFERASE) (SHMT). | swissprot Q10104 | Amino acid transport and metabolism |
| 5072 | 491.3 | URACIL PHOSPHORIBOSYLTRANSFERASE (EC 2.4.2.9) (UMP PYROPHOSPHORYLASE) (UPRTASE). | swissnew P18562 | Nucleotide transport |
| 5073 | 491.0 | CONSERVED PHOSDUCIN-LIKE HYPOTHETICAL PROTEIN. | sptrembl Q9Y7L1 | ND |

TABLE 3-continued

*Aspergillus oryzae* ESTs

| Sequence Listing | zscore | Annotation | Database | Functional Category |
|---|---|---|---|---|
| 5074 | 490.8 | HYPOTHETICAL 25.9 KD PROTEIN C6C3.07 IN CHROMOSOME I. | swissprot Q10311 | ND |
| 5075 | 490.6 | ATP SYNTHASE DELTA CHAIN FAMILY, OLIGOMYCIN SENSITIVITY CONFERRING PROTEIN. | sptrembl O74479 | Energy production and conversion |
| 5076 | 489.8 | 60S RIBOSOMAL PROTEIN 1.10. MITOCHONDRIAL PRECURSOR (YML10). | swissprot P36520 | Translation, ribosomal structure and biogenesis |
| 5077 | 488.8 | MSF TRANSPORTER. | tremblnew CAA20760 | ND |
| 5078 | 486.8 | 40S RIBOSOMAL PROTEIN S8. | swissprot O14049 | Translation, ribosomal structure and biogenesis |
| 5079 | 486.2 | 40S RIBOSOMAL PROTEIN S28 (S33). | swissprot Q10421 | Translation, ribosomal structure and biogenesis |
| 5080 | 485.2 | 49 KDA ZINC FINGER PROTEIN. | sptrembl Q9Z326 | ND |
| 5081 | 485.0 | MYOSIN I HEAVY CHAIN. | sptrembl Q00647 | ND |
| 5082 | 484.5 | PUTATIVE DEHYDROGENASE. | tremblnew CAB61800 | ND |
| 5083 | 484.4 | SIGNAL RECOGNITION PARTICLE 19 KD PROTEIN HOMOLOG. | swissprot P41922 | Cell motility and secretion |
| 5084 | 484.2 | SIMILAR TO BOVINE PERIPHERAL-TYPE BENZODIAZEPINE RECEPTOR. | sptrembl O94327 | ND |
| 5085 | 483.7 | GLUTATHIONE-DEPENDENT FORMALDEHYDE DEHYDROGENASE (EC 1.2.1.1) (FDH) (FALDH). | swissprot P47734 | ND |
| 5086 | 483.5 | K1AA1259 PROTEIN (FRAGMENT). | tremblnew BAA86573 | DNA replication, recombination and repair |
| 5087 | 482.1 | HYPOTHETICAL 42.5 KD PROTEIN. | sptrembl O74737 | ND |
| 5088 | 482.1 | PUTATIVE FAD SYNTHETASE. | sptrembl O74841 | ND |
| 5089 | 482.0 | MUTANT VEA1 PROTEIN. | tremblnew AAD44048 | ND |
| 5090 | 481.8 | P21 PROTEIN. | sptrembl Q11118 | ND |
| 5091 | 481.8 | 278AA LONG HYPOTHETICAL ERYTHROCYTE BAND 7 INTEGRAL MEMBRANE PROTEIN. | sptrembl Q9YQY6 | Posttranslational modification, protein turnover, chaperones |
| 5092 | 481.7 | DNA-DIRECTED RNA POLYMERASES I, II, AND III 8.3 KD POLYPEPTIDE (EC 2.7.7.6) (ABC10-BETA). | swissprot O13877 | Transcription |
| 5093 | 480.8 | HYPOTHETICAL 45.1 KD PROTEIN C6B12.08 IN CHROMOSOME I. | sptrembl O14213 | ND |
| 5094 | 480.3 | TRNA ISOPENTENYLTRANSFERASE (EC 2.5.1.8) (ISOPENTENYL-DIPHOSPHATE: TRNA ISOPENTENYLTRANSFERASE) (IPP TRANSFERASE, (IPPT). | swissprot P07884 | Translation, ribosomal structure and biogenesis |
| 5095 | 479.9 | HEXOSE TRANSPORTER. | sptrembl O13311 | ND |
| 5096 | 479.6 | HYPOTHETICAL 18.5 KD PROTEIN. | tremblnew CAB61465 | ND |
| 5097 | 478.9 | SIMILAR TO POLYADENYLATE-BINDING PROTEIN. | sptrembl Q06106 | ND |

TABLE 3-continued

_Aspergillus oryzae_ ESTs

| Sequence Listing | zscore | Annotation | Database | Functional Category |
|---|---|---|---|---|
| 5098 | 478.7 | PUTATIVE CA-CALMODULIN-DEPENDENT) SERINE-THEONINE-PROTEIN KINASE. | sptremble O94547 | ND |
| 5099 | 477.9 | MICROSOMAL DIPEPTIDASE PRECURSOR (EC 3.4.13.19) (MDP) (DEHYDROPEPTIDASE-I) (RENAL DIPEPTIDASE) (RDP). | swissprot P31430 | ND |
| 5100 | 477.0 | URACIL PHOSPHORIBOSYLTRANSFERASE (EC 2.4.2.9) (UMP PYROPHOSPHORYLASE) (UPRTASE). | swissnew P93394 | ND |
| 5101 | 476.1 | 10 KD HEAT SHOCK PROTEIN, MITOCHONDRIAL (HSP10) (10 KD CHAPERONIN). | swissprot O59804 | Posttranslational modification, protein turnover, chaperones |
| 5102 | 475.4 | SUR1 PROTEIN. | swissprot P33300 | ND |
| 5103 | 474.9 | CHROMOSOME IV READING FRAME ORF YDL128W. | sptrembl Q99385 | Inorganic ion transport and metabolism |
| 5104 | 474.5 | NA,K-ATPASE ALPHA-2-SUBUNIT (FRAGMENT). | sptrembl Q9Z1G6 | ND |
| 5105 | 473.9 | 40S RIBOSOMAL PROTEIN S8. | swissprot O14049 | Translation, ribosomal structure and biogenesis |
| 5106 | 473.1 | PUTATIVE NADH-DEPENDENT FLAVIN OXIDOREDUCTASE. | sptrembl O94467 | Energy production and conversion |
| 5107 | 473.1 | 60S RIBOSOMAL PROTEIN L14-A. | swissprot P36105 | Translation, ribosomal structure and biogenesis |
| 5108 | 472.4 | ACTIN-BINDING PROTEIN 134 aa, chain A. | pdb 1QPV | ND |
| 5109 | 472.3 | CHOLINE TRANSPORT PROTEIN. | swissprot P19807 | Amino acid transport and metabolism |
| 5110 | 470.8 | HYPOTHETICAL 137.8 KD PROTEIN C2F12.05C IN CHROMOSOME II. | sptrembl O14340 | ND |
| 5111 | 470.8 | HYPOTHETICAL 98.4 KD PROTEIN C24H6.13 IN CHROMOSOME I. | swissprot Q09766 | ND |
| 5112 | 470.4 | CYTOCHROME P450. | sptrembl O13490 | ND |
| 5113 | 470.3 | IGE-BINDING PROTEIN (FRAGMENT). | sptrembl O60025 | ND |
| 5114 | 470.3 | L-SERINE DEHYDRATASE (EC 4.2.1.13) (L-SERINE DEAMINASE). | swissprot P17324 | Amino acid transport and metabolism |
| 5115 | 470.2 | PUTATIVE SNRNP SPLICING FACTOR. | sptrembl O74499 | ND |
| 5116 | 469.8 | NADH-UBIQUINONE OXIDOREDUCTASE 9.5 KD SUBUNIT (EC 1.6.5.3) (EC 1.6.99.3) (COMPLEX I-9.5KD) (CI-9.5) (UBIQUINONE-BINDING PROTEIN). | swissprot P42117 | ND |
| 5117 | 469.2 | HYPOTHETICAL 37.2 KD PROTEIN YOR007C. | sptrembl Q12118 | ND |
| 5118 | 468.6 | HT-1080 PROTEIN. | sptrembl O75794 | ND |
| 5119 | 468.5 | 3-PHYTASE B PRECURSOR (EC 3.1.3.8) (MYO-INOSITOL-HEXAPHOSPHATE 3-PHOSPHOHYDROLASE B) (3 PHYTASE B) (MYO-INOSITOL HEXAKISPHOSPHATE PHOSPHOHYDROLASE B). | swissprot P34754 | ND |

TABLE 3-continued

_Aspergillus oryzae_ ESTs

| Sequence Listing | zscore | Annotation | Database | Functional Category |
|---|---|---|---|---|
| 5120 | 467.2 | GLYCINE-RICH RNA-BINDING PROTEIN (FRAGMENT). | sptrembl Q39105 | ND |
| 5121 | 466.7 | HYPOTHETICAL 24.5 KD PROTEIN IN PTA-FOLX INTERGENIC REGION. | swissprot P77526 | Posttranslational modification, protein turnover, chaperones |
| 5122 | 466.2 | TRANSFERASE 196 aa. | pdb 1UKZ | Nucleotide transport |
| 5123 | 465.8 | HYPOTHETICAL 48.7 KD PROTEIN. | sptrembl O74498 | ND |
| 5124 | 465.4 | U6 SNRNA-ASSOCIATED SM-LIKE PROTEIN LSM6. | tremblnew AAD56230 | ND |
| 5125 | 465.4 | PUTATIVE DEHYDROGENASE. | sptrembl O88068 | ND |
| 5126 | 464.8 | 3-OXOACYL-[ACYL-CARRIER-PROTEIN]-SYNTHASE. | sptrembl O94297 | Lipid metabolism |
| 5127 | 464.4 | PROFILIN. | swissprot P39825 | ND |
| 5128 | 463.7 | HYPOTHETICAL 43.0 KD PROTEIN C8A4.09C IN CHROMOSOME I. | swissprot Q09885 | ND |
| 5129 | 462.9 | PUTATIVE G-PROTEIN. | sptrembl O08582 | ND |
| 5130 | 462.4 | PUTATIVE SECRETED LIPASE. | tremblnew CAB50950 | ND |
| 5131 | 462.4 | FLAVONOID 3',5'-HYDROXYLASE (EC 1.14.-.-) (F3'5'H) (CYTOCHROME P450 75A4). | swissprot Q96581 | ND |
| 5132 | 462.3 | B SUBUNIT OF PROPIONYL-COA CARBOXYLASE. | sptrembl P94970 | Lipid metabolism |
| 5133 | 462.1 | SUCCINATE-SEMIALDEHYDE DEHYDROGENASE [NADP-] (EC 1.2.1.16) (SSDH). | swissprot P25526 | Energy production and conversion |
| 5134 | 461.6 | EXO-POLYGALACTURONASE. | tremblnew AAF05088 | ND |
| 5135 | 461.3 | QUINATE PERMEASE (QUINATE TRANSPORTER). | swissprot P15325 | ND |
| 5136 | 461.0 | MITOCHONDRIAL RNA SPLICING PROTEIN MSR4. | swissprot P23500 | ND |
| 5137 | 460.8 | 60S RIBOSOMAL PROTEIN L28. | tremblnew CAA22600 | ND |
| 5138 | 460.5 | CONSERVED HYPOTHETICAL PROTEIN. | sptrembl Q9WZQ7 | ND |
| 5139 | 460.4 | CHITIN SYNTHASE 3 (EC 2.4.1.16) (CHITIN-UDP ACETYL-GLUCOSAMINYL TRANSFERASE 3) (CLASS-III CHITIN SYNTHASE 3). | swissprot P30602 | ND |
| 5140 | 459.0 | CHROMOSOME XV READING FRAME ORF YOL092W. | sptrembl Q12010 | ND |
| 5141 | 458.9 | CONSERVED HYPOTHETICAL PROTEIN. | tremblnew CAB52741 | ND |
| 5142 | 458.8 | CALCINEURIN B SUBUNIT (PROTEIN PHOSPHATASE 2B REGULATORY SUBUNIT) (CALCINEURIN REGULATORY SUBUNIT). | swissprot P87072 | ND |
| 5143 | 458.6 | _A. niger_ pyruvate kinase. | geneseqp R13247 | ND |
| 5144 | 458.2 | CHROMOSOME XV READING FRAME ORF YOL119C. | sptrembl Q08268 | ND |
| 5145 | 456.7 | DNA LIGASE I (EC 6.5.1.1) (POLYDEOXYRIBONUCLEOTIDE SYNTHASE [ATP]). | swissprot P37913 | ND |
| 5146 | 456.1 | TROPOMYOSIN 2. | swissprot P40414 | ND |
| 5147 | 455.8 | 60S RIBOSOMAL PROTEIN L34-B. | swissprot P40525 | Translation, ribosomal structure and biogenesis |

TABLE 3-continued

Aspergillus oryzae ESTs

| Sequence Listing | zscore | Annotation | Database | Functional Category |
|---|---|---|---|---|
| 5148 | 455.6 | INTEGRAL MEMBRANE PROTEIN. | sptrembl Q9Y784 | ND |
| 5149 | 454.5 | HYPOTHETICAL 22.0 KD PROTEIN IN FOX3-UBP7 INTERGENIC REGION. | swissprot P40452 | ND |
| 5150 | 454.3 | HYPOTHETICAL 86.9 KD PROTEIN (FRAGMENT). | tremblnew CAB55332 | ND |
| 5151 | 4543 | CHROMOSOME XV READING FRAME ORF YOR049C. | sptrembl Q08417 | ND |
| 5152 | 454.0 | HYPOTHETICAL 41.6 KD PROTEIN. | sptrembl O94305 | ND |
| 5153 | 453.3 | HYPOTHETICAL 27.9 KD PROTEIN C20F10.10 IN CHROMOSOME II. | sptrembl C142979 | ND |
| 5154 | 453.0 | PUTATIVE MEMBRANE TRANSPORT PROTEIN. | sptrembl O74923 | ND |
| 5155 | 452.5 | PIM1 GTPASE PROTEIN. | tremblnew CAB60670 | ND |
| 5156 | 452.2 | SIMILAR TO S. CEREVISIAE YHR110P. | sptrembl Q05359 | ND |
| 5157 | 451.4 | Human actVA-ORF 4-like protein sequence. | geneseqp Y14147 | ND |
| 5158 | 451.1 | CSK2B. | tremblnew AAF03911 | ND |
| 5159 | 450.8 | 26S PROTEASE REGULATORY SUBUNIT 4 HOMOLOG. | tremblnew | ND |
| 5160 | 450.5 | HYPOTHETICAL 83.7 KD PROTEIN. | sptrembl O13853 | ND |
| 5161 | 450.3 | *Mortierella alpina* cytochrome b5. | geneseqp W22848 | ND |
| 5162 | 450.1 | NUCLEAR DISTRIBUTION PROTEIN NUDE. | sptrembl O74689 | ND |
| 5163 | 449.9 | 60S RIBOSOMAL PROTEIN L2, MITOCHONDRIAL PRECURSOR (YML2) (YMR6). | swissprot P12687 | Translation, ribosomal structure and biogenesis |
| 5164 | 448.7 | HYPOTHETICAL 157.7 KD PROTEIN C2F7.16C IN CHROMOSOME I. | swissprot Q09706 | ND |
| 5165 | 448.1 | NODULIN PRECURSOR. | sptrembl Q41402 | ND |
| 5166 | 447.5 | HYPOTHETICAL 15.3 KD PROTEIN. | tremblnew CAB57336 | Posttranslational modification, protein turnover, chaperones |
| 5167 | 447.1 | PROBABLE ATP-DEPENDENT PERMEASE YHL035C. | swissprot P38735 | ND |
| 5168 | 446.6 | TRANSCRIPTIONAL REPRESSOR TUP1. | sptrembl O76734 | ND |
| 5169 | 446.3 | PUTATIVE TRANSPORTER. | tremblnew CAB63540 | ND |
| 5170 | 445.6 | CUTINASE TRANSCRIPTION FACTOR I ALPHA. | swissprot P52958 | ND |
| 5171 | 444.9 | PUTATIVE DEHYDROGENASE. | sptrembl O88068 | ND |
| 5172 | 444.5 | NADH-DEPENDENT FLAVIN OXIDOREDUCTASE, PUTATIVE. | tremblnew AAF11740 | ND |
| 5173 | 444.4 | DIMETHYL-ALLYL-TRYPTPHAN-SYNTHASE. | sptrembl O94204 | ND |
| 5174 | 444.3 | PUTATIVE TRANSPORTER YBL042C. | swissprot P38196 | Coenzyme metabolism |
| 5175 | 444.3 | HYPOTHETICAL 45.0 KD PROTEIN IN PISI-CLB2 INTERGENIC REGION. | swissprot Q06489 | ND |
| 5176 | 442.9 | RASP F 7 (FRAGMENT). | sptrembl O42799 | ND |
| 5177 | 441.8 | HYPOTHETICAL 18.5 KD PROTEIN. | tremblnew CAB11189 | ND |
| 5178 | 441.8 | PUTATIVE CELL WALL PROTEIN. | sptrembl O74708 | ND |

TABLE 3-continued

_Aspergillus oryzae_ ESTs

| Sequence Listing | zscore | Annotation | Database | Functional Category |
|---|---|---|---|---|
| 5179 | 441.2 | HYPOTHETICAL 55.5 KD PROTEIN C17A2.05 IN CHROMOSOME I. | sptrembl O13755 | Energy production and conversion |
| 5180 | 440.6 | GABA PERMEASE. | sptrembl Q9Y860 | ND |
| 5181 | 440.2 | ALCOHOL DEHYDROGENASE I (EC 1.1.1.1). | swissprot P00330 | ND |
| 5182 | 440.2 | NADH-UBIQUINONE OXIDOREDUCTASE 29.9 KD SUBUNIT PRECURSOR (EC 1.6.5.3) (EC 1.6.99.3) (COMPLEX I-29.9KD) (CI-29.9KD). | swissprot P24919 | ND |
| 5183 | 440.2 | HYPOTHETICAL 15.9 KD PROTEIN. | tremblnew CAB52421 | ND |
| 5184 | 440.0 | PUTATIVE SMALL NUCLEAR RIBONUCLEOPROTEIN E. | tremblnew CAB59808 | Transcription |
| 5185 | 439.2 | T7123.15 PROTEIN. | sptrembl O819O9 | ND |
| 5186 | 438.8 | NADH:UBIQUINONE OXIDOREDUCTASE (NADH DEHYDROGENASE),14 KDA (FRAGMENT). | sptrembl Q01407 | ND |
| 5187 | 438.3 | H04M03.4 PROTEIN. | tremblnew AAD12787 | Coenzyme metabolism |
| 5188 | 4363.7 | PYRUVATE DECARBOXYLASE. | sptrembl O94185 | Coenzyme metabolism |
| 5189 | 436.4 | QUEUINE TRNA-RIBOSYLTRANSFERASE (EC 2.4.2.29) (TRNA-GUANINE TRANSGLYCOSYLASE) (GUANINE INSERTION ENZYME). | swissprot P54578 | ND |
| 5190 | 436.2 | DICARBOXYLIC AMINO ACID PERMEASE. | swissprot P53388 | Amino acid transport and metabolism |
| 5191 | 435.9 | PEROXISOMAL TARGETING SIGNAL RECEPTOR (PEROXISOMAL PROTEIN PAY32) (PEROXIN-5) (PTSI RECEPTOR). | swissprot Q99144 | ND |
| 5192 | 435.7 | NUCLEAR AND CYTOPLASMIC POLYADENYLATED RNA-BINDING PROTEIN PUBI (ARS CONSENSUS BINDING PROTEIN ACBP-60) (POLY(U)-BINDING PROTEIN) (POLY URIDYLATE-BINDING PROTEIN). | swissprot P32588 | Transcription |
| 5193 | 435.5 | 60S RIBOSOMAL PROTEIN L36-A (L39A) (YL39). | swissprot P05745 | ND |
| 5194 | 434.2 | URACIL PERMEASE. | swissprot Q10279 | ND |
| 5195 | 433.3 | PHOSPHORUS ACQUISITION CONTROLLING PROTEIN. | swissprot P20824 | ND |
| 5196 | 433.0 | HYPOTHETICAL 34.2 KD PROTEIN C31F10.07 IN CHROMOSOME II. | sptrembl P87308 | ND |
| 5197 | 431.3 | NIPSNAPI PROTEIN (FRAGMENT). | tremblnew | ND |
| 5198 | 431.0 | HYPOTHETICAL 23.0 KD PROTEIN C3F10.12C IN CHROMOSOME I. | swissprot Q10186 | ND |
| 5199 | 430.2 | CARNITINE/ACYL CARNITINE CARRIER. | sptrembl Q9Y7G4 | ND |
| 5200 | 429.9 | RNA-BINDING PROTEIN AXRNBP. | sptrembl O93465 | ND |
| 5201 | 429.2 | CONSERVED HYPOTHETICAL PROTEIN. | sptrembl O94380 | ND |

TABLE 3-continued

*Aspergillus oryzae* ESTs

| Sequence Listing | zscore | Annotation | Database | Functional Category |
|---|---|---|---|---|
| 5202 | 428.5 | PUTATIVE 60S RIBOSOMAL PROTEIN L7/L12. | tremblnew CAB60683 | Translation, ribosomal structure and biogenesis |
| 5203 | 428.1 | PUTATIVE SNRNP PROTEIN. | tremblnew CAB45810 | ND |
| 5204 | 426.3 | ATP SYNTHASE F CHAIN, MITOCHONDRIAL PRECURSOR (EC 3.6.1.34). | swissprot Q06405 | ND |
| 5205 | 426.1 | Human adult testis secreted protein ck181_7. | geneseqp W81998 | ND |
| 5206 | 425.3 | ORIGIN RECOGNITION COMPLEX SUBUNIT 4-RELATED PROTEIN ORP4P. | sptrembl Q9Y794 | ND |
| 5207 | 424.9 | HYDROPHOBIN PRECURSOR. | sptrembl O13503 | ND |
| 5208 | 424.5 | MLO3 PROTEIN. | swissNew Q09330 | ND |
| 5209 | 424.2 | MITOCHONDRIAL IMPORT RECEPTOR SUBUNIT TOM22 (MITOCHONDRIAL 22 KD OUTER MEMBRANE PROTEIN) (MOM22 PROTEIN) (TRANSLOCASE OF OUTER MEMBRANE 22 KD SUBUNIT). | swissprot Q07335 | ND |
| 5210 | 424.1 | Aminopeptidase. | geneseqp W05589 | ND |
| 5212 | 423.4 | Ubiquitin-like domain of the yeast protein SMT3. | geneseqp W87987 | ND |
| 5213 | 422.4 | PUTATIVE LIPASE. | sptrembl Q9Z360 | ND |
| 5214 | 421.9 | ALP11 PROTEIN. | swissprot Q10235 | ND |
| 5215 | 421.7 | HYPOTHETICAL 17.1 KD PROTEIN IN SAH1-ME14 INTERGENIC REGION. | swissprot P40030 | ND |
| 5216 | 421.1 | ACTIN-LIKE PROTEIN. | tremblnew CAB65803 | ND |
| 5217 | 420.9 | DEOXYRIBOSE-PHOSPHATE ALDOLASE (EC 4.1.2.4) (PHOSPHODEOXYRIBOALDOLASE) (DEOXYRIBOALDOLASE). | swissprot P44430 | Nucleotide transport |
| 5218 | 420.3 | PUTATIVE FRUCTOSE-1,6-BISPHOSPHATASE (EC 3.1.3.11). | tremblnew CAB64834 | Carbohydrate transport and metabolism |
| 5219 | 420.3 | DNA REPAIR HELICASE RAD3. | swissprot P06839 | DNA replication, recombination and repair |
| 5220 | 420.2 | ARYLSULFATASE (EC 3.1.6.1) (ARYL-SULFATE SULPHOHYDROLASE). | swissprot P51691 | ND |
| 5221 | 420.0 | PHOSPHORIBOSYL-FORMYLGLYCINAMIDINE SYNTHASE (EC 6.3.5.3) (FGAM SYNTHASE) (FORMYLGLYCINAMIDE RIBOTIDE AMIDOTRANSFERASE) (FGARAT). | swissprot P38972 | Nucleotide transport |
| 5222 | 419.6 | ATP-DEPENDENT BILE ACID PERMEASE. | swissprot P32386 | ND |
| 5223 | 419.6 | HYPOTHETICAL 61.1 KD PROTEIN C11D3.05 IN CHROMOSOME I. | swissprot Q10084 | ND |
| 5224 | 419.5 | GABA PERMEASE. | sptrembl Q9Y860 | ND |
| 5225 | 417.7 | Human transmembrane protein, HP01737. | geneseqp Y13942 | ND |
| 5226 | 417.6 | MEMBRANE ASSOCIATED PROTEIN SLP-2. | tremblnew AAF09142 | ND |
| 5227 | 416.9 | SUPL15H. | tremblnew BAA78781 | ND |
| 5228 | 416.7 | PISATIN DEMETHYLASE (EC 1.14.-.-) (CYTOCHROME P450 57A2). | swissprot P38364 | ND |

TABLE 3-continued

*Aspergillus oryzae* ESTs

| Sequence Listing | zscore | Annotation | Database | Functional Category |
|---|---|---|---|---|
| 5229 | 416.5 | PUTATIVE PROTEIN FARNESYLTRANSFERASE BETA SUBUNIT (EC 2.5.1.-) (CAAX FARNESYLTRANSFERASE BETA SUBUNIT) (RAS PROTEINS PRENYLTRANSFERASE) (FTASE-BETA). | sptrembl O13782 | ND |
| 5230 | 416.0 | HYPOTHETICAL 15.4 KD PROTEIN C10F6.16 IN CHROMOSOME I. | sptrembl P79058 | ND |
| 5231 | 413.9 | PROBABLE 40S RIBOSOMAL PROTEIN S9. MITOCHONDRIAL PRECURSOR. | swissprot P38120 | Translation, ribosomal structure and biogenesis |
| 5232 | 413.7 | CHROMOSOME IV READING FRAME ORF YDL237W. | sptrembl Q07716 | ND |
| 5233 | 412.4 | PUTATIVE AROMATIC AMINO ACID AMINOTRANSFERASE C56E4.03 (EC 2.6.10). | sptrembl O14192 | Amino acid transport and metabolism |
| 5234 | 412.3 | HYPOTHETICAL 143.0 KD PROTEIN CHE3.02C IN CHROMOSOME I. | swissprot O13683 | ND |
| 5235 | 412.3 | PUTATIVE GLYCEROL-3-PHOSPHATE DEHYDROGENASE. | tremblnew AAF02807 | ND |
| 5236 | 411.8 | *P. putida* R-(-)-mandelate monooxygenase protein. | geneseqp | ND |
| 5237 | 411.7 | PUTATIVE PHOSPHOADENOSINE PHOSPHOSULFATE REDUCTASE (EC 1.8.99.4) (PAPS REDUCTASE, THIOREDOXIN DEPENDENT) (PADOPS REDUCTASE) (3'-PHOSPHOADENYLYLSULFATE REDUCTASE). | swissprot Q10270 | Coenzyme metabolism |
| 5238 | 411.6 | RP42. | tremblnew AAF04863 | ND |
| 5239 | 411.4 | CYTOCHROME C OXIDASE ASSEMBLY PROTEIN COX15. | swissprot P40086 | Posttranslational modification, protein turnover, chaperones |
| 5240 | 409.9 | N AMINO ACID TRANSPORT SYSTEM PROTEIN (METHYLTRYPTOPHAN RESISTANCE PROTEIN). | swissprot P38680 | ND |
| 5241 | 409.8 | INTEGRAL MEMBRANE PROTEIN. | sptrembl O9Y786 | ND |
| 5242 | 409.7 | CAT5 PROTEIN (UBIQUINONE BIOSYNTHESIS PROTEIN COQ7). | swissprot P41735 | ND |
| 5243 | 409.4 | PUTATIVE D-AMINO ACID OXIDASE. | sptrembl Q9Y7N4 | ND |
| 5244 | 409.0 | HIGH MOBILITY GROUP-LIKE NUCLEAR PROTEIN 2. | swissprot P32495 | Translation, ribosomal structure and biogenesis |
| 5245 | 408.2 | PYRROLINE-5-CARBOXYLATE REDUCTASE (EC 1.5.1.2) (PSCR) (P5C REDUCTASE). | swissprot P22008 | ND |
| 5246 | 408.2 | PXP-18. | tremblnew BAA85152 | ND |
| 5247 | 407.9 | TRNA ISOPENTENYLTRANSFERASE. | tremblnew CAB52278 | ND |

TABLE 3-continued

*Aspergillus oryzae* ESTs

| Sequence Listing | zscore | Annotation | Database | Functional Category |
|---|---|---|---|---|
| 5248 | 407.6 | HYPOTHETICAL 56.2 KD PROTEIN IN ERG8-UBP8 INTERGENIC REGION. | swissprot Q04991 | ND |
| 5249 | 406.1 | T1G11.14 PROTEIN. | sptrembl O23024 | ND |
| 5250 | 405.9 | PHOSPHOETHANOLAMINE CYTIDYLYLTRANSFERASE. | sptrembl Q99447 | ND |
| 5251 | 405.0 | C-1-TETRAHYDROFOLATE SYNTHASE CYTOPLASMIC (CI-THF SYNTHASE) [INCLUDES: METHYLENETETRAHYDROFOLATE DEHYDROGENASE (EC 1.5.1.5); METHENYLTETRAHYDROFOLATE CYCLOHYDROLASE (EC 3.5.4.9); FORMYLTETRAHYDROFOLATE SYNTHETASE (EC 6.3.4.3)]. | swissprot P07245 | Coenzyme metabolism |
| 5252 | 405.0 | PYRROLINE-5-CARBOXYLATE REDUCTASE (EC 1.5.1.2) (P5CR) (P5C REDUCTASE). | swissprot Q12740 | ND |
| 5253 | 404.6 | HYPOTHETICAL 52.3 KD PROTEIN IN MRPL10-ERG24 INTERGENIC REGION PRECURSOR. | swissprot P53832 | ND |
| 5254 | 404.4 | SUGAR TRANSPORTER STL1. | swissprot P39932 | ND |
| 5255 | 404.1 | PUTATIVE RHO GDP-DISSOCIATION INHIBITOR (RHO GDI). | sptrembl O14224 | ND |
| 5256 | 430.0 | PUTATIVE TRANSPORTER. | tremblnew CAB63540 | ND |
| 5257 | 402.7 | DNA-DIRECTED RNA POLYMERASE I 135 KD POLYPEPTIDE (EC 2.7.7.6) (A135) (RNA POLYMERASE I SUBUNIT 2). | swissprot P22138 | Transcription |
| 5258 | 402.1 | RIBOSOMAL PROTEIN S30. | sptrembL O14314 | ND |
| 5259 | 400.7 | HYPOTHETICAL 56.8 KD PROTEIN IN SCJI-GUAI INTERGENIC REGION PRECURSOR. | swissprot Q03655 | ND |
| 5260 | 400.0 | SRC HOMOLOGY 3 DOMAIN-CONTAINING PROTEIN HIP-55. | tremblnew AAF13701 | ND |
| 5261 | 397.2 | TRANSMEMBRANE TRANSPORTER LIZ1P. | sptrembl O43000 | ND |
| 5262 | 397.1 | ORNITHINE AMINOTRANSFERASE (EC 2.6.1.13) (ORNITHINE--OXO-ACID AMINOTRANSFERASE). | swissprot Q92413 | ND |
| 5263 | 395.9 | UNC-50 RELATED PROTEIN. | sptrembl O55227 | ND |
| 5264 | 395.8 | UBIQUITIN FUSION DEGRADATION PROTEIN 1 (UB FUSION PROTEIN 1) (POLYMERASE-INTERACTING PROTEIN 3). | swissprOt P53044 | ND |
| 5265 | 395.3 | KINESIN-LIKE DNA BINDING PROTEIN. | sptrembl Q14807 | ND |
| 5266 | 395.0 | DA VIRUS GAG PROTEIN N-ACETYLTANSFERASE (EC 2.3.1.-). | swissprot Q03503 | ND |
| 5267 | 394.4 | DICARBOXYLIC AMINO ACID PERMEASE. | swissprot P53388 | ND |
| 5268 | 393.9 | KREV-I PROTEIN. | sptrembl O74112 | ND |
| 5269 | 393.9 | Wheat glutathione transferase subunit TaGSTI. | geneseqp | ND |
| 5270 | 393.2 | HYPOTHETICAL 26.6 KD PROTEIN. | sptrembl P75897 | ND |

TABLE 3-continued

Aspergillus oryzae ESTs

| Sequence Listing | zscore | Annotation | Database | Functional Category |
|---|---|---|---|---|
| 5271 | 393.0 | HYPOTHETICAL 85.7 KD PROTEIN C20G8.02 IN CHROMOSOME I. | sptrembl P87109 | ND |
| 5272 | 392.9 | ALCOHOL OXIDASE (EC 1.1.3.13) (AOX) (METHANOL OXIDASE) (MOX). | swissprot Q00922 | ND |
| 5273 | 392.8 | HYPOTHETICAL 105.9 KD PROTETN C11E3.11C IN CHROMOSOME I. | sptrembl O13690 | ND |
| 5274 | 391.6 | HYPOTHETICAL 13.0 KS PROTEIN. | sptrembl P79082 | ND |
| 5275 | 391.5 | MANNITOL 2-DEHYDROGENASE (EC 1.1.1.67) (MDH). | sptrembl O08355 | ND |
| 5276 | 391.4 | THIOREDOXIN. | swissprot P29429 | ND |
| 5277 | 391.4 | HYPOTHETICAL 59.0 KD PROTEIN C30D11.14 IN CHROMOSOME I. | swissprot Q09911 | ND |
| 5278 | 390.7 | YEAST REDUCED VIABILITY UPON STARVATION PROTEIN RVS167 HOMOLOG, SH3 DOMAIN CONTAINING. | sptrembl O74352 | ND |
| 5279 | 390.3 | CHOLINE DEHYDROGENASE. | sptrembl Q9X2M2 | ND |
| 5280 | 390.2 | HYPOTHETICAL 39.5 KD PROTEIN IN PDXH-SLYB INTERGENIC REGION. | swissprot P77570 | ND |
| 5281 | 390.2 | R06A4.4B PROTEIN. | sptrembl O62333 | ND |
| 5282 | 389.8 | SIMILAR TO PHOSPHATIDIC ACID PHOSPHATASE. | tremblnew CAB52620 | ND |
| 5283 | 389.7 | HYPOTHETICAL 65.9 KD PROTEIN C31A2.12 IN CHROMOSOME I. | swissprot Q09729 | ND |
| 5284 | 389.6 | CYTOCHROME C OXIDASE POLYPEPTIDE VI PRECURSOR (EC 1.9.3.1). | swissprot P00427 | ND |
| 5285 | 389.3 | PUTATIVE AMINE TRANSPORTER. | sptrembl O74852 | ND |
| 5286 | 389.3 | GTP CYCLOHYDROLASE (EC 3.5.4.16) (GTP-CH-I). | swissprot P51601 | Coenzyme metabolism |
| 5287 | 388.7 | HYPOTHETICAL 132.6 KD PROTEIN YPL006W. | sptrembl Q12200 | ND |
| 5288 | 388.6 | CHROMOSOME XVI COSMID 9513. | sptrembl Q06839 | ND |
| 5289 | 388.3 | ATP10 PROTEIN. | swissprot P18496 | ND |
| 5290 | 387.8 | CONSERVED HYPOTHETICAL PROTEIN. | sptrembl O94257 | ND |
| 5291 | 387.8 | HYDROXYPROLINE-RICH GLYCOPROTEIN DZ-HRGP PERCURSOR. | tremblnew CAB62280 | ND |
| 5292 | 387.5 | HYPOTHETICAL 44.7 KD PROTEIN. | sptrembl O13885 | ND |
| 5293 | 387.5 | CHOLINE TRANSPORT PROTEIN. | swissprot P19807 | Amino acid transport and metabolism |
| 5294 | 386.7 | RASP F 7 (FRAGMENT). | sptrembl O42799 | ND |
| 5295 | 386.3 | CURVED DNA-BINDING PROTEIN (42 KD PROTEIN). | swissprot Q09184 | ND |
| 5296 | 385.8 | THIOREDOXIN. | swissprot P42115 | ND |
| 5297 | 385.6 | MUCIN 2 PRECURSOR (INTESTINAL MUCIN 2). | swissprot Q02817 | ND |
| 5298 | 385.6 | CYTOCHROME P450-CC24, MITOCHONDRIAL PRECURSOR (EC 1.14.-.-) (P450-CC24) (VITAMIN D(3) 24-HYDROXYLASE) (1,25-DIHYDROXYVITAMIN D(3) 24-HYDROXYLASE) (24-OHASE). | swissprot Q64441 | ND |
| 5299 | 385.2 | ORF YPL152W. | sptrembl Q12461 | ND |

TABLE 3-continued

Aspergillus oryzae ESTs

| Sequence Listing | zscore | Annotation | Database | Functional Category |
|---|---|---|---|---|
| 5300 | 384.6 | CAMP-DEPENDENT PROTEIN KINASE SCH9 (EC 2.7.1.37). | swissprot P11792 | Signal transduction mechanisms |
| 5301 | 384.6 | F7F22.17. | tremblnew AAF24531 | ND |
| 5302 | 384.3 | SUGAR TRANSPORTER, PUTATIVE. | tremblnew AAF12486 | ND |
| 5303 | 384.0 | PROTEIN KINASE SKP1P. | sptrembl O94456 | ND |
| 5304 | 383.6 | HYPOTHETICAL 15.0 KD PROTEIN C23C4.09C IN CHROMOSOME I. | swissnew O13929 | ND |
| 5305 | 382.9 | AMINOMETHYLTRANSFERASE PRECURSOR (EC 2.1.2.10) (GLYCINE CLEAVAGE SYSTEM T PROTEIN). | swissprot P48015 | Amino acid transport and metabolism |
| 5306 | 382.3 | COLLETOTRICHUM GLOEOSPORIOIDES NITROGEN STARVATION-INDUCED GLUTAMINE RICH PROTEIN. | sptrembl O43117 | ND |
| 5307 | 382.2 | PUTATIVE IMPORTIN BETA-4 SUBUNIT (KARYOPHERIN BETA-4 SUBUNIT). | swissprot O60100 | ND |
| 5308 | 381.6 | TRNA LIGASE (EC 6.5.1.3). | swissprot P09880 | ND |
| 5309 | 381.1 | PEROXISOMAL MEMBRANE PROTEIN PAS20 (PEROXIN-13). | swissprot P80667 | ND |
| 5310 | 380.9 | HYPOTHETICAL 39.0 KD PROTEIN. | tremblnew CAA22566 | ND |
| 5312 | 380.4 | CHROMOSOME XV READING FRAME ORF YOL060C. | sptrembl Q12296 | ND |
| 5313 | 380.2 | HYPOTHETICAL 65.5 KD PROTEIN. | sptrembl O74441 | ND |
| 5314 | 379.6 | FADE13. | sptrembl O86319 | Lipid metabolism |
| 5315 | 379.5 | HYPOTHETICAL 74.5 KD PROTEIN C4H3.03C IN CHROMOSOME I. | swissprot Q10211 | ND |
| 5316 | 379.1 | PROBABLE STERIGMATOCYSTIN BIOSYNTHESIS P450 MONOOXYGENASE STCB (EC 1.14.-.-) (CYTOCHROME P450 62). | swissprot Q12608 | ND |
| 5317 | 379.1 | DJ69E11.3 (YEAST YPR037W AND WORM C02C2.6 PREDICTED PROTEINS LIKE). | sptrembl O75663 | ND |
| 5318 | 379.0 | MRNA, PARTIAL CDS, SIMILAR TO HUMAN GA17 PROTEIN (FRAGMENT). | tremblnew BAA31742 | ND |
| 5319 | 378.9 | COATOMER COMPLEX COPI DELTA-COP SUBUNIT (FRAGMENT). | tremblnew AAF14250 | ND |
| 5320 | 378.7 | PYRROLINE-5-CARBOXYLATE REDUCTASE (EC 1.5.1.2) (P5CR) (P5C REDUCTASE). | swissprot P22008 | ND |
| 5321 | 378.1 | HYPOTHETICAL 58.0 KD PROTEIN C1672.03C IN CHROMOSOME III. | swissnew O14057 | ND |
| 5322 | 377.9 | ADENYLOSUCCINATE LYASE (EC 4.3.2.2) (ADENYLOSUCCINASE) (ASL). | swissprot Q05911 | ND |
| 5323 | 377.9 | SYGI PROTEIN. | swissprot P40528 | ND |
| 5324 | 377.7 | HYPOTHETICAL 31.3 KD PROTEIN. | sptrembL P72926 | ND |
| 5325 | 377.5 | PEPTIDE TRANSPORTER PTR2 (PEPTIDE PERMEASE PTR2). | swissprot P32901 | ND |

TABLE 3-continued

*Aspergillus oryzae* ESTs

| Sequence Listing | zscore | Annotation | Database | Functional Category |
|---|---|---|---|---|
| 5326 | 377.5 | 6-HYDROXY-D-NICOTINE OXIDASE (EC 1.5.3.6) (6-HDNO). | swissprot P08159 | ND |
| 5327 | 375.6 | KIAA0770 PROTEIN (FRAGMENT). | sptrembl O94869 | ND |
| 5328 | 375.5 | CHROMOSOME XII COSMID 8039. | sptrembl Q05924 | ND |
| 5329 | 374.9 | PUTATIVE TRANSCRIPTIONAL REGULATION PROTEIN, TRP-ASP REPEAT CONTAINING. | sptrembl O74863 | ND |
| 5330 | 374.2 | HYPOTHETICAL 10.4 KD PROTEIN. | sptrembl O43002 | ND |
| 5331 | 373.6 | F16M14.11 PROTEIN. | sptrembl O80443 | ND |
| 5332 | 373.2 | Human actVA-ORF4-like protein sequence. | geneseqp Y14147 | ND |
| 5333 | 372.8 | HYPOTHETICAL 83.8 KD PROTEIN. | tremblnew CAB66097 | ND |
| 5334 | 372.5 | HYPOTHETICAL 50.5 KD PROTEIN IN RNAI-RNTI INTERGENIC REGION. | swissprot Q05034 | ND |
| 5335 | 371.7 | POTASSIUM TRANSPORTER. | sptrembl Q9Y7B9 | ND |
| 5336 | 371.6 | HYPOTHETICAL 63.9 KD PROTEIN C22A12.08C IN CHROMOSOME I. | sptrembl O13899 | ND |
| 5337 | 370.8 | RD PROTEIN. | swissnew P18615 | ND |
| 5338 | 370.6 | PUTATIVE CHORISMATE MUTASE/PREPHENATE DEHYDRATASE PHEA. | tremblnew AAF06690 | ND |
| 5339 | 370.2 | MULTIDRUG RESISTANCE PROTEIN HOMOLOG 50 (P-GLYCOPROTEIN 50). | swissprot Q00449 | ND |
| 5340 | 369.5 | CHOLINE TRANSPORT PROTEIN. | swissprot P19807 | Amino acid transport and metabolism |
| 5341 | 369.0 | *Humicola lanuginosa* lipase type II variant. | geneseqp R22635 | ND |
| 5342 | 368.8 | RIBOSOMAL PROTEIN S31 HOMOLOG. | sptrembl O74172 | ND |
| 5343 | 368.1 | PUTATIVE ATP-DEPENDENT DNA HELICASE. | sptrembl O94395 | ND |
| 5344 | 367.8 | 30 KD HEAT SHOCK PROTEIN. | swissprot P40920 | ND |
| 5345 | 367.8 | PUTATIVE SYNTAXIN. | tremblnew CAB58411 | ND |
| 5346 | 367.7 | 60S RIBOSOMAL PROTEIN. L32 PRECURSOR. | sptrembl O94379 | ND |
| 5347 | 367.7 | DNA POLYMERASE ALPHA SUBUNIT B (P86 SUBUNIT). | swissprot P38121 | ND |
| 5348 | 367.5 | HYPOTHETICAL 61.3 KD PROTEIN IN PMP2-VAC8 INTERGENIC REGION. | swissprot P39998 | ND |
| 5349 | 367.5 | CAMP-REGULATED GUANINE NUCLEOTIDE EXCHANGE FACTOR I. | sptrembl O95634 | ND |
| 5350 | 367.1 | CHROMOSOME XV READING FRAME ORF YOL119C. | sptrembl Q08268 | ND |
| 5351 | 365.9 | HYPOTHETICAL 36.8 KD PROTEIN C26A3.16 IN CHROMOSOME I. | swissprot Q10169 | ND |
| 5352 | 365.1 | C01B4.6 PROTEIN. | tremblnew AAD14698 | ND |
| 5353 | 364.7 | PROBABLE CYTOCHROME C OXIDASE POLYPEPTIDE VIA PRECURSOR (EC 1.9.3.1). | swissprot O74471 | ND |

TABLE 3-continued

*Aspergillus oryzae* ESTs

| Sequence Listing | zscore | Annotation | Database | Functional Category |
|---|---|---|---|---|
| 5354 | 3632.3 | ALPHA-AMYLASE A PRECURSOR (EC 3.2.1.1) (TAKA-AMYLASE A) (TAA) (1,4-ALPHA-D-GLUCAN GLUCANOHYDROLASE). | swissprot P10529 | ND |
| 5355 | 363.7 | Mus musculus Tub Interactor (m-H-3) protein. | geneseqp W59132 | Posttransitional modification, protein turnover, chaperones |
| 5356 | 363.6 | PROBABLE SUCCINYL-COA LIGASE [GDP-FORMING] ALPHA-CHAIN, MITCHONDRIAL PRECURSOR (EC 6.2.1.4) (SUCCINYL-COA SYNTHETASE, ALPHA CHAIN) (SCS-ALPHA). | swissprot O13750 | ND |
| 5357 | 363.5 | HYPOTHETICAL 55.5 KD PROTEIN C17A2.05 IN CHROMOSOME I. | sptrembl O13755 | ND |
| 5358 | 362.4 | INTEGRAL MEMBRANE PROTEIN. | sptrembl Q9Y786 | ND |
| 5359 | 361.9 | PHO85P,LPH16P. | sptrembl Q02979 | ND |
| 5360 | 361.6 | PUTATIVE MITOCHONDRIAL CARRIER C29A3.11C. | sptrembl O59674 | ND |
| 5361 | 361.6 | RHO3 PROTEIN. | swissprot Q00245 | ND |
| 5362 | 361.2 | ERNE PROTEIN. | tremblnew AAF10238 | ND |
| 5363 | 361.0 | NICOTINATE-NUCLEOTIDE PYROPHOSPHORYLASE [CARBOXYLATING] (EC 2.4.2.19) (QUINOLINATE PHOSPHORIBOSYLTRANSFERASE [DECARBOXYLATING]) (QAPRTASE). | swissprot Q15274 | ND |
| 5364 | 360.9 | UI SMALL NUCLEAR RIBONUCLEOPROTEIN C (UI-C). | swissprot P09234 | ND |
| 5365 | 360.6 | HYPOTHETICAL 108.5 KD PROTEIN IN UME3-HDA1 INTERGENIC REGION. | swissprot P53971 | ND |
| 5366 | 360.0 | ELONGATION FACTOR I-GAMMA TYPE 2 (EF-1-GAMMA) (P47). | swissprot Q91375 | ND |
| 5367 | 359.9 | HYPOTHETICAL 130.3 KD PROTEIN. | sptrembl O59742 | ND |
| 5368 | 358.2 | HYPOTHETICAL 24.7 KD PROTEIN C3A12.04C IN CHROMOSOME I. | swissprot P87120 | ND |
| 5369 | 358.0 | PUTATIVE TRANSFERASE. | sptrembl Q53185 | ND |
| 5370 | 357.4 | 60S RIBOSOMAL PROTEIN L38. | tremblnew CAB54810 | ND |
| 5371 | 357.1 | Aluminium resistance gene ALR2. | geneseqp W07873 | ND |
| 5372 | 356.5 | ARYL-ALCOHOL OXIDASE PRECURSOR (EC 1.1.3.7). | sptrembl O94219 | ND |
| 5373 | 3551.3 | *Aspergillus oryzae* protease PepC. | geneseqp W31629 | Posttransitional modification, protein turnover, chaperones |
| 5374 | 355.9 | HYPOTHETICAL 35.9 KD PROTEIN C17G6.02C IN CHROMOSOME I. | sptrembl O13780 | ND |
| 5375 | 354.1 | HYPOTHETICAL 26.3 KD PROTEIN C3G6.03C IN CHROMOSOME I. | sptrembl O14141 | ND |
| 5376 | 353.8 | PAD-1. | sptrembl Q9Y7A8 | ND |
| 5377 | 353.7 | GRA-ORF6 PROTEIN. | tremblnew CAA09651 | ND |

TABLE 3-continued

*Aspergillus oryzae* ESTs

| Sequence Listing | zscore | Annotation | Database | Functional Category |
|---|---|---|---|---|
| 5378 | 353.2 | PUTATIVE STERIGMATOCYSTIN BIOSYNTHESIS DEHYDROGENASE STCV (EC 1.1.1.-). | swissprot Q00727 | ND |
| 5379 | 353.0 | HYPOTHETICAL 22.6 KD PROTEIN C3G9.04 IN CHROMOSOME I. | sptrembl O42868 | ND |
| 5380 | 352.9 | D-ARABINONO-1,4-LACTONE OXIDASE (EC 1.1.3.24). | sptrembl O93852 | ND |
| 5381 | 352.8 | HEAT SHOCK PROTEIN 70. | sptrembl O42508 | ND |
| 5382 | 352.0 | PUTATIVE 40S RIBOSOMAL PROTEIN YNR037C. | swissprot P53733 | ND |
| 5383 | 351.2 | TRANSLIN. | swissprot P79769 | ND |
| 5384 | 351.0 | GP1-ANCHOR TRANSAMIDASE (EC 3.-.-.-). | swissprot P49018 | ND |
| 5385 | 350.9 | PUTATIVE ACETYLTRANSFERASE IN HXT11-HXT8 INTERGENIC REGION (EC 2.3.1.-). | swissprot P40892 | ND |
| 5386 | 350.6 | THIOESTERASE II. | sptrembl O15261 | ND |
| 5387 | 350.4 | COLLETOTRICHUM GLOEOSPORIOIDES NITROGEN STARVATION-INDUCED GLUTAMINE RICH PROTEIN. | sptrembl O43117 | ND |
| 5388 | 349.9 | NADH-UBIQUINONE OXIDOREDUCTASE 17.8 KD SUBUNIT PRECURSOR (EC 1.6.5.3) (EC 1.6.99.3) (COMPLEX I-17.8KD) (CI-7.8 KD). | swissprot P42116 | ND |
| 5389 | 349.7 | HYDROXYPROLINE-RICH GLYCOPROTEIN DZ-HRGP PRECURSOR. | tremblnew CAB62280 | ND |
| 5390 | 348.7 | WD-40 REPEAT PROTEIN. | tremblnew BAA75544 | ND |
| 5391 | 348.6 | CYTOCHROME P450 10 (EC 1.14.-.-) (CYPX). | swissprot P48416 | ND |
| 5392 | 347.2 | HYPOTHETICAL 16.7 KD PROTEIN IN CD05-MVP1 INTERGENIC REGION. | swissprot Q03667 | ND |
| 5393 | 347.2 | POTASSIUM TRANSPORT PROTEIN, HIGH-AFFINITY. | swissprot P28569 | ND |
| 5394 | 347.2 | SIGNAL RECOGNITION PARTICLE 72 KD PROTEIN HOMOLOG (SRP72). | swissprot P38688 | ND |
| 5395 | 347.0 | HYPOTHETICAL 49.2 KD PROTEIN. | sptrembl O69515 | ND |
| 5396 | 346.4 | FISSION YEAST. | sptrembl P78794 | ND |
| 5397 | 346.3 | HYPOTHETICAL 37.0 KD PROTEIN (FRAGMENT). | sptrembl Q9Y3V5 | ND |
| 5398 | 346.1 | HYPOTHETICAL 33.9 KD PROTEIN CY13D12.11. | sptrembl P72043 | ND |
| 5399 | 345.1 | CHROMOSOME XV READING FRAME ORF YOR052C. | sptrembl Q08422 | ND |
| 5400 | 344.0 | POTENTIAL MEMBRANE PROTEIN. | sptrembl O94006 | ND |
| 5401 | 343.9 | NPGAP. | sptrembl Q9Y7C5 | ND |
| 5402 | 343.8 | HYPOTHETICAL 26.5 KD PROTEIN. | tremblnew AAF18285 | ND |
| 5403 | 343.4 | GABA PERMEASE. | sptrembl Q9Y860 | ND |
| 5404 | 342.8 | SIMILAR TO SDH4P. | sptrembl Q06236 | ND |
| 5405 | 342.7 | MUCIN 2 PRECURSOR (INTESTINAL MUCIN 2). | swissprot Q02817 | ND |
| 5406 | 342.6 | SCD1 PROTEIN. | swissprot P40995 | ND |
| 5407 | 342.5 | HYDROXYPROLINE-RICH GLYCOPROTEIN DZ-HRGP PRECURSOR. | tremblnew CAB62280 | ND |
| 5408 | 341.9 | SRP1 PROTEIN. | swissprot Q10193 | ND |

TABLE 3-continued

*Aspergillus oryzae* ESTs

| Sequence Listing | zscore | Annotation | Database | Functional Category |
|---|---|---|---|---|
| 5409 | 341.7 | RNA BINDING PROTEIN (FRAGMENT). | sptrembl O60176 | ND |
| 5410 | 340.9 | *P. membranaefaciens* NADH kinase. | geneseqp W22341 | ND |
| 5411 | 340.5 | SSU81 PROTEIN (SHOI OSMOSENSOR). | swissprot P40073 | ND |
| 5412 | 340.0 | HYPOTHETICAL 76.7 KD PROTEIN. | sptrembl Q12753 | ND |
| 5413 | 338.2 | PUTATIVE PROTEIN TRANSPORT PROTEIN SEC61 GAMMA SUBUNIT. | swissprot Q09827 | ND |
| 5414 | 337.9 | ORF YDL161W. | sptrembl Q12518 | ND |
| 5415 | 336.8 | MITOCHONDRIAL IMPORT INNER MEMBRANE TRANSLOCASE SUBUNIT TIM17 (MITOCHONDRIAL PROTEIN IMPORT PROTEIN 2)( MITOCHONDRIAL INNER MEMBRANE PROTEIN M1M17). | swissprot P39515 | ND |
| 5416 | 335.8 | HYPOTHETICAL 130.3 KD PROTEIN. | sptrembl O50842 | ND |
| 5417 | 335.7 | CYTOCHROME P450 ALKANE HYDROXYLASE. | sptrembl Q9Y758 | ND |
| 5418 | 335.1 | HYPOTHETICAL 34.3 KD PROTEIN. | tremblnew CAB40775 | ND |
| 5419 | 334.9 | PUTATIVE POLYA-BINDING PROTEIN. | sptrenbl O94430 | ND |
| 5420 | 334.6 | SERINE/THREONINE-PROTEIN KINASE SSPI (EC 2.7.1.-). | swissprot P50526 | ND |
| 5421 | 334.4 | NUCLEAR POLYADENYLATED RNA-BINDING PROTEIN NAB2. | swissprot P32505 | ND |
| 5422 | 334.2 | P68 RNA HELICASE. | sptrembl Q9XTP2 | ND |
| 5423 | 334.1 | PUTATIVE EXOCYST COMPLEX COMPONENT. | sptrembl O74846 | ND |
| 5424 | 332.2 | CHROMOSOME XV READING FRAME ORF YOR359W. | sptrembl Q08831 | ND |
| 5425 | 331.9 | PUTATIVE TRANSCRIPTION FACTOR TFIIIB COMPONENT. | sptrembl O94481 | ND |
| 5426 | 331.7 | REGULATORY PROTEIN. | sptrembl Q00170 | ND |
| 5427 | 331.0 | W02A2.5 PROTEIN. | sptrembl Q9XUB4 | ND |
| 5428 | 329.9 | HYPOTHETICAL 46.6 KD PROTEIN. | sptrembl O74477 | ND |
| 5429 | 329.3 | CHOLINE TRANSPORT PROTEIN. | swissprot P19807 | ND |
| 5430 | 329.3 | GLUCOSAMINE-6-PHOSPHATE DEAMINASE. | tremblnew AAD42233 | ND |
| 5431 | 329.1 | Y38C9A.2 PROTEIN. | tremblnew AAD14761 | ND |
| 5432 | 329.1 | CONSERVED HYPOTHETICAL PROTEIN. | tremblnew AAF12184 | ND |
| 5433 | 329.1 | PUTATIVE D-AMINO ACID OXIDASE. | sptrembl Q9Y7N4 | ND |
| 5434 | 329.0 | HYPOTHETICAL 24.4 KD PROTEIN. | sptreMbl O86620 | ND |
| 5435 | 328.7 | AMINO-ACID PERMEASE. | tremblnew CAB60020 | ND |
| 5436 | 328.2 | GIBBERELLIN 20-OXIDASE-ARABIDOPSIS THALIANA (EC 1.14.11.). | tremblnew CAB45519 | ND |
| 5437 | 325.2 | OXONONANOATE SYNTHASE. | sptrembl Q9Z6L6 | ND |
| 5438 | 324.8 | 60S RIBOSOMAL PROTEIN. | sptrembl O74884 | ND |
| 5439 | 323.8 | CERCOSPORIN RESISTANCE PROTEIN. | sptrembl Q9Y788 | ND |
| 5440 | 323.5 | PUTATIVE TRP-ASP REPEAT PROTEIN. | tremblnew CAB52280 | ND |
| 5441 | 323.1 | ALLANTOINASE (EC 3.5.2.5). | swissprot P32375 | ND |

TABLE 3-continued

*Aspergillus oryzae* ESTs

| Sequence Listing | zscore | Annotation | Database | Functional Category |
|---|---|---|---|---|
| 5442 | 323.0 | QUINATE PERMEASE (QUINATE TRANSPORTER). | swissprot P15325 | ND |
| 5443 | 321.9 | SHYI PROTEIN. | swissprot P53266 | ND |
| 5444 | 321.5 | F15K9.5 PROTEIN. | sptrembl Q9ZVT6 | ND |
| 5445 | 320.7 | DNA-DIRECTED RNA POLYMERASE II 19 KD POLYPEPTIDE (EC 2.7.7.6) (B16). | swissprot P34087 | ND |
| 5446 | 319.6 | N-CARBAMYL-L-AMINO ACID AMIDOHYDROLASE (EC 3.5.1.-). | swissprot Q53389 | ND |
| 5447 | 318.9 | SIMILAR TO YEAST SURI PROTEIN. | tremblnew CAB55770 | ND |
| 5448 | 318.4 | CHROMOSOME XV READING FRAME ORF YOR267C. | sptrembl Q08732 | ND |
| 5449 | 317.1 | PUTATIVE MAJOR FACILITATOR FAMILY MULTI-DRUG RESISTANCE PROTEIN. | sptrembl O94343 | ND |
| 5450 | 316.7 | F23C8.6 PROTEIN. | tremblnew AAD03134 | ND |
| 5451 | 316.6 | SURFEIT LOCUS PROTEIN 4 HOMOLOG. | swissprot O74559 | ND |
| 5452 | 316.6 | PUTATIVE TRANSLATION INITIATION FACTOR EIF-2B BETA SUBUNIT. | tremblnew CAB52277 | ND |
| 5453 | 315.7 | HYPOTHETICAL 42.6 KD PROTEIN. | tremblnew CAB52800 | ND |
| 5454 | 315.6 | VIP1 PROTEIN (P53 ANTIGEN HOMOLOG). | sptrembl P87216 | ND |
| 5455 | 314.2 | HYPOTHETICAL 35.7 KD PROTEIN (FRAGMENT). | sptrembl Q9Y3V1 | ND |
| 5456 | 314.2 | HIGH AFFINITY COPPER TRANSPORTER. | tremblnew CAB52305 | ND |
| 5457 | 314.1 | Collagen-like polymer. | geneseqp W57645 | ND |
| 5458 | 314.1 | HYPOTHETICAL 16.4 KD PROTEIN. | sptrembl Q9Z4W2 | ND |
| 5459 | 3135.5 | ELONGATION FACTOR 3 (FRAGMENT). | sptrembl O42734 | ND |
| 5460 | 313.2 | PROTEIN TYROSINE KINASE 9 (A6 PROTEIN TYROSINE KINASE HOMOLOG). | sptrembl O09132 | ND |
| 5461 | 311.9 | CELL WALL PROTEIN. | sptrembl Q40336 | ND |
| 5462 | 311.1 | DUAL SPECIFICITY PROTEIN PHOSPHATASE 1 (EC 3.1.3.48) (EC 3.1.3.16) (MAP KINASE PHOSPHATASE-1) (MPK-1) (MAP KINASE PHOSPHATASE-1) (FRAGMENT). | sptrembl O42253 | ND |
| 5464 | 311.0 | WDR1 PROTEIN. | tremblnew AAD05045 | ND |
| 5465 | 310.9 | RIBONUCLEASE H1. | sptrembl O00870 | ND |
| 5466 | 310.8 | FRUCTOSYL AMINE. | sptrembl O43029 | ND |
| 5467 | 310.2 | PROBABLE ATP-DEPENDENT RNA HELICASE P47 HOMOLOG. | swissprot Q07478 | ND |
| 5468 | 309.5 | T25B24.3 PROTEIN. | tremblnew AAD25548 | ND |
| 5469 | 309.7 | NON-CLASSICAL EXPORT PROTEIN NCE2. | swissprot O12207 | ND |
| 5470 | 308.2 | HYPOTHETICAL 40.5 KD PROTEIN IN UBP15-GAS1 INTERGENIC REGION PRECURSOR. | swissprot Q04951 | ND |
| 5471 | 306.7 | DOPA DECARBOXYLASE ISOFORM 2 (EC 4.1.1.26). | sptrembl O61718 | ND |

TABLE 3-continued

*Aspergillus oryzae* ESTs

| Sequence Listing | zscore | Annotation | Database | Functional Category |
|---|---|---|---|---|
| 5472 | 306.6 | SUPPRESSOR PROTEIN MPT4 (STM1 PROTEIN) (GU4 NUCLEIC-BINDING PROTEIN 2) (G4P2 PROTEIN). | swissprot P39015 | ND |
| 5473 | 306.5 | TRANSACTIVATING PROTEIN BRIDGE. | sptrembl Q9WTV5 | ND |
| 5474 | 306.4 | *Candida albicans* KRE9. | geneseqp Y24918 | ND |
| 5475 | 306.3 | GLYCEROL-3-PHOSPHATE DEHYDROGENASE (NAD(P)+). | sptrembl O94310 | ND |
| 5476 | 306.0 | HYPOTHETICAL 76.7 KD PROTEIN IN SPO1-SIS1 INTERGENIC REGION. | swissprot P53983 | ND |
| 5477 | 304.5 | PUTATIVE ACYL-COA DEHYDROGENASE. | tremblnew CAB46788 | ND |
| 5478 | 304.4 | HYPOTHETICAL 63.2 KD PROTEIN. | sptrembl O59725 | ND |
| 5479 | 304.4 | HYPOTHETICAL 26.5 KD PROTEIN. | tremblnew CAB46672 | ND |
| 5480 | 304.2 | Aluminium resistance gene ALR2. | geneseqp W07873 | ND |
| 5481 | 304.0 | HYPOTHETICAL 39.0 KD PROTEIN IN GLNQ-ANSR INTERGENIC REGION. | swissprot P54564 | ND |
| 5482 | 303.9 | MYOSIN-2 ISOFORM. | swissprot P19524 | ND |
| 5483 | 303.8 | GRPE PROTEIN HOMOLOG PRECURSOR. | swissnew O43047 | ND |
| 5484 | 303.7 | ENOYL REDUCTASE. | sptrembl Q9Y7D0 | ND |
| 5485 | 303.5 | FISSION YEAST (FRAGMENT). | strembl P78815 | ND |
| 5486 | 303.2 | HEMOLYSIN. | sptrembl Q00050 | ND |
| 5487 | 303.1 | POBIP PROTEIN. | sptrembl O74653 | ND |
| 5488 | 303.1 | HYPOTHETICAL 89.0 KD PROTEIN. | sptrembl O43023 | ND |
| 5489 | 302.5 | PUTATIVE ADAPTOR PROTEIN. | tremblnew CAB59686 | ND |
| 5490 | 302.4 | HYPOTHETICAL 31.5 KD PROTEIN. | sptrembl O14443 | ND |
| 5491 | 302.3 | HYPOTHETICAL 19.4 KD PROTEIN IN TSM1-ARE1 INTERGENIC REGION. | swissprot P25626 | ND |
| 5492 | 301.5 | HYPOTHETICAL C2H2 ZINC FINGER PROTEIN. | sptrembl Q9Y815 | ND |
| 5493 | 301.5 | HYPOTHETICAL 16.1 KD PROTEIN. | sptrembl O74847 | ND |
| 5494 | 300.6 | HYDROXYMETHYLGLUTARYL-COA SYNTHASE (EC 4.1.3.5) (HMG-COA SYNTHASE) (3-HYDROXY-3-METHYLGLUTARYL COENZYME A SYNTHASE). | swissprot P54874 | ND |
| 5495 | 300.3 | EXTENSIN PRECURSOR (CELL WALL HYDROXYPROLINE-RICH GLYCOPROTEIN). | swissprot P13983 | ND |
| 5496 | 2991.7 | BETA-GLUCOSIDASE I PRECURSOR (EC 3.2.1.21) (GENTIOBIASE) (CELLOBIASE) (BETA-D-GLUCOSIDE GLUCOHYDROLASE). | swissprot P48825 | ND |
| 5497 | 299.9 | TRANSMEMBRANE PROTEIN. | tremblnew CAB65007 | ND |
| 5498 | 299.8 | HYPOTHETICAL 26.9 KD PROTEIN IN BTN1-PEP8 INTERGENIC REGION. | swissprot P47044 | ND |
| 5499 | 299.7 | NONE. | sptrembl Q9XDF2 | ND |
| 5500 | 299.7 | PDGF ASSOCIATED PROTEIN. | tremblnew AAF03506 | ND |

TABLE 3-continued

Aspergillus oryzae ESTs

| Sequence Listing | zscore | Annotation | Database | Functional Category |
|---|---|---|---|---|
| 5501 | 299.7 | HYPOTHETICAL 63.9 KD PROTEIN IN IME2-MEF2 INTERGENIC REGION. | swissprot P42948 | ND |
| 5502 | 299.0 | PUTATIVE TRANSCRIPTIONAL REGULATOR. | tremblnew CAB542824 | ND |
| 5503 | 299.0 | PUTATIVE TRANSFERASE (FRAGMENT). | sptrembl Q9X843 | ND |
| 5504 | 298.7 | HYPOTHETICAL 33.9 KD PROTEIN C4C5.03 IN CHROMOSOME I. | swissprot O14166 | ND |
| 5505 | 298.6 | HYPOTHETICAL 157.7 KD PROTEIN C2F7.16C IN CHROMOSOME I. | swissprot Q09706 | ND |
| 5506 | 298.6 | PUTATIVE DEHYDROGENASE. | sptrembl O53547 | ND |
| 5507 | 298.2 | HYPOTHETICAL 48.1 KD PROTEIN IN SEC12-SSK2 INTERGENIC REGION. | swissprot P53729 | ND |
| 5508 | 298.0 | HYPOTHETICAL 90.8 KD PROTEIN IN HUL5-SEC27 INTERGENIC REGION. | swissprot P53121 | ND |
| 5509 | 297.8 | SISI PROTEIN. | sptrembl O13303 | ND |
| 5510 | 297.6 | HYPOTHETICAL UBIQUINOL-CYTOCHROME C REDUCTASE COMPONENT. | sptrembl O42932 | ND |
| 5511 | 297.4 | CAFFEINE-INDUCED DEATH PROTEIN 1. | sptrembl O13833 | ND |
| 5512 | 297.1 | CHROMOSOME XV READING FRAME ORF YOL137W. | sptrembl Q08280 | ND |
| 5513 | 296.7 | HYPOTHETICAL 69.9 KD PROTEIN IN MIC1-SRB5 INTERGENIC REGION. | swissprot P53261 | ND |
| 5514 | 296.5 | 4MES. | sptrembl O13320 | ND |
| 5515 | 296.4 | RNA BINDING PROTEIN-PUTATIVE PRE MRNA SPLICING FACTOR. | sptrembl O74919 | ND |
| 5516 | 296.4 | CHROMOSOME XV READING FRAME ORF YOR059C. | sptrembl Q08448 | ND |
| 5517 | 2959.7 | *Aspergillus oryzae* protease PepE. | geneseqp W31628 | ND |
| 5518 | 2951.7 | ALDEHYDE DEHYDROGENASE (EC 1.2.1.3) (ALDDH). | swissprot P08157 | Energy production and conversion |
| 5519 | 2951.0 | TRANSLATION ELONGATION FACTOR 1 ALPHA. | sptrembl Q9Y713 | Amino acid transport and metabolism |
| 5520 | 295.8 | NUCLEASE. | sptrembl O60168 | ND |
| 5521 | 295.1 | PROTEIN-S ISOPRENYLCYSTEINE O-METHYLTRANSFERASE (EC 2.1.1.100) (ISOPRENYLCYSTEINE CARBOXYLMETHYLTRANSFERASE). | swissprot P32584 | ND |
| 5522 | 2944.2 | HEAT SHOCK PROTEIN HSP1 (65 KD IGE-BINDING PROTEIN) (FRAGMENT). | swissprot P40292 | Posttranstional modification, protein turnover, chaperones |
| 5523 | 294.9 | SCP160 PROTEIN (PROTEIN HX). | swissprot P06105 | ND |
| 5524 | 294.9 | PUTATIVE METHYLTRANSFERASE. | sptrembl O94628 | ND |
| 5525 | 294.8 | *Saccharomyces cerevisiae* nucleolin like protein. NOL1. | geneseqp W10529 | ND |
| 5526 | 294.7 | HYDROXYPROLINE-RICH GLYCOPROTEIN DZ-HRGP PRECURSOR. | tremblnew CAB62280 | ND |

TABLE 3-continued

Aspergillus oryzae ESTs

| Sequence Listing | zscore | Annotation | Database | Functional Category |
|---|---|---|---|---|
| 5527 | 294.6 | ISOCITRATE DEHYDROGENASE [NADP], MITOCHONDRIAL PRECURSOR (EC 1.1.1.42) (OXALOSUCCINATE DECARBOXYLASE) (IDH) (NADP+-SPECIFIC ICDH) (IDP). | swissprot P79089 | ND |
| 5528 | 294.4 | | sptrembl O23042 | ND |
| 5529 | 294.4 | HYDROXYPROLINE-RICH GLYCOPROTEIN PRECURSOR. | sptrembl Q41719 | ND |
| 5530 | 294.4 | HYPOTHETICAL 24.7 KD PROTEIN C5H10.03 IN CHROMOSOME I. | swissprot Q09676 | ND |
| 5531 | 294.3 | VESICULAR TRANSPORT PROTEIN BOS1. | swissprot P25385 | ND |
| 5532 | 293.5 | HYPOTHETICAL 44.5 KD PROTEIN. | sptrembl O74728 | ND |
| 5533 | 2928.1 | PLASMA MEMBRANE H(I)ATPASE. | sptrembl O93862 | Inorganic ion transport and metabolism |
| 5534 | 292.9 | FATTY ACYL-COA REDUCTASE. | sptrembl P94129 | ND |
| 5535 | 291.8 | HYPOTHETICAL 36.4 KD PROTEIN IN SMP1-MBA1 INTERGENIC REGION. | swissprot P38298 | ND |
| 5536 | 290.9 | 2-OXOGLUTARATE DEHYDROGENASE EI COMPONENT. | sptrembl O74378 | ND |
| 5537 | 290.7 | NORSOLORINIC ACID REDUCTASE (EC 1.1.1.-). | swissprot Q00049 | ND |
| 5538 | 290.0 | Amino acid sequence of *M. vaccac* antigen GV-33. | geneseqp Y14924 | ND |
| 5539 | 2895.1 | 26W PROTEASE REGULATORY SUBUNIT 6B HOMOLOG. | swissprot P73573 | Posttranslational modification, protein turnover, chaperones |
| 5540 | 289.1 | HYPOTHETICAL 34.8 KD PROTEIN C4H3.04C IN CHROMOSOME I. | swissprot Q10212 | ND |
| 5541 | 2381.2 | *Aspergillus nidulans* palmitate-CoA delta-9 desaturase enzyme. | geneseqp Y28844 | Lipid metabolism |
| 5542 | 288.5 | TIP120. | sptrembl P97536 | ND |
| 5543 | 288.1 | CUT8 PROTEIN. | swissprot P33937 | ND |
| 5544 | 287.8 | HYPOTHETICAL 109.7 KD PROTEIN. | sptrembl Q9Y7Q7 | ND |
| 5545 | 287.7 | Metal-regulated transporter polypeptide ZRT2. | geneseqp W41169 | ND |
| 5546 | 287.6 | HYPOTHETICAL 115.3 KD PROTEIN. | tremblnew CAB63746 | ND |
| 5547 | 287.5 | FLAVIN 651 aa, chain B. | pdb 1FOH | ND |
| 5548 | 286.9 | HYPOTHETICAL 63.7 KD PROTEIN C16E9.02C IN CHROMOSOME II. | sptrembl O14319 | ND |
| 5549 | 286.9 | HYDROXYQUINOL 1,2-DIOXYGENASE. | sptrembl Q9ZAM3 | ND |
| 5550 | 286.7 | PHENAZINE BIOSYNTHESIS PROTEIN PHZF. | swissprot Q51792 | ND |
| 5551 | 286.7 | ALCOHOL DEHYDROGENASE. | sptrembl O33308 | ND |
| 5552 | 286.5 | HYPOTHETICAL 25.4 KD PROTEIN C4G9.14 IN CHROMOSOME I. | swissprot Q10244 | ND |
| 5553 | 286.0 | *S. cerevisiae* uronate dehydrogenase. | geneseqp W29217 | ND |
| 5554 | 2857.0 | CYTOCHROME P450 51 (EC 1.14.14.1) (CYPL1) (P450-LIA1) (STEROL 14-ALPHA DEMETHYLASE) (EBURICOL 14-ALPHA-DEMETHYLASE) (P450-14DM). | swissprot Q12664 | ND |

TABLE 3-continued

Aspergillus oryzae ESTs

| Sequence Listing | zscore | Annotation | Database | Functional Category |
|---|---|---|---|---|
| 5555 | 285.7 | HIGH-AFFINITY GLUCOSE TRANSPORTER. | swissprot P49374 | ND |
| 5556 | 285.1 | HYPOTHETICAL 191.5 KD PROTEIN IN NSP1-KAR2 INTERGENIC REGION. | swissprot P47054 | ND |
| 5557 | 284.9 | C-FACTOR (C SIGNAL). | swissprot P21158 | ND |
| 5558 | 284.6 | MITOGEN-ACTIVATED PROTEIN KINASE. | tremblnew AAF12815 | ND |
| 5559 | 284.2 | HYPOTHETICAL 11.4 KD PROTEIN. | sptrembl O74837 | ND |
| 5560 | 283.4 | CIRCUMSPOROZOITE (CS) PROTEIN (FRAGMENT). | sptrembl Q25648 | ND |
| 5561 | 283.1 | HYDROXYPROLINE-RICH GLYCOPROTEIN DZ-HRGP PRECURSOR. | tremblnew CAB62280 | ND |
| 5562 | 2824.0 | HEXOKINASE (EC 2.7.1.1). | sptrembl O93964 | ND |
| 5563 | 282.6 | CHROMOSOME XVI READING FRAME ORF YPL263C. | sptrembl Q08979 | ND |
| 5564 | 282.4 | PTB-ASSOCIATED SPLICING FACTOR (PSF). | swissnew P23246 | ND |
| 5565 | 282.4 | ZINC-FINGFR PROTEIN. | sptrembl O60106 | ND |
| 5566 | 282.2 | MAJOR FACILITATOR SUPERFAMILY PROTEIN. | sptrembl O74395 | ND |
| 5567 | 282.0 | HYPOTHETICAL 31.7 KD PROTEIN. | sptrembl O43125 | ND |
| 5568 | 281.6 | EXTENSIN PRECURSOR. | sptrembl Q40768 | ND |
| 5569 | 281.6 | PRPD PROTEIN. | swissprot P74840 | ND |
| 5570 | 281.4 | PROBABLE DOLICHYL-DIPHOSPHOOLIGOSACCHARIDE--PROTEIN GLYCOSYLTRANSFERASE EPSILON SUBUNIT (EC 2.4.1.119) (OLIGOSACCHARYL TRANSFERASE EPSILON SUBUNIT) (OLIGOSACCHARYL TRANSFERASE 16 KD SUBUNIT). | swissprot O14238 | ND |
| 5571 | 281.4 | GTP CYCLOHYDROLASE I (EC 3.5.4.16) (GTP-CH-1). | swissprot P51601 | ND |
| 5572 | 280.8 | HYPOTHETICAL 69.5 KD PROTEIN (FRAGMENT). | tremblnew CAB63721 | ND |
| 5573 | 280.8 | PUTATIVE HYDROLASE. | sptrembl Q9WX01 | ND |
| 5574 | 280.5 | HYPOTHETICAL 41.3 KD PROTEIN. | sptrembl O42896 | ND |
| 5575 | 280.4 | HYPOTHETICAL 91.7 KD PROTEIN. | tremblnew CAB62413 | ND |
| 5576 | 280.3 | POLY(A)-SPECIFIC RIBONUCLEASE. | sptrembl O95453 | ND |
| 5577 | 280.3 | HYPOTHETICAL 31.0 KD PROTEIN IN GAP1-NAP1 INTERGENIC REGION. | swissprot P36136 | ND |
| 5578 | 280.1 | LA PROTEIN HOMOLOG (LA RIBONUCLEOPROTEIN) (LA AUTOANTIGEN HOMOLOG). | swissprot P87058 | ND |
| 5579 | 280.1 | HYPOTHETICAL 105.9 KD PROTEIN IN AAC3 RFC5 INTERGENIC REGION. | sptrembl O13621 | ND |
| 5580 | 280.0 | INTEGRAL MEMBRANE PROTEIN. | sptrembl Q9Y786 | ND |
| 5581 | 279.8 | PROTEOPHOSPHOGLYCAN PRECURSOR (FRAGMENT). | sptrembl Q9Y076 | ND |
| 5582 | 278.7 | SW16 PROTEIN, REPRESSION OF SILENT MATING TYPE LOCI. | tremblnew CAB57340 | ND |
| 5583 | 278.3 | CONSERVED HYPOTHETICAL PROTEIN. | sptrembl QO2ZQ7 | ND |
| 5584 | 278.1 | Amino acid sequence of a human secreted peptide. | geneseqp Y12916 | ND |

TABLE 3-continued

*Aspergillus oryzae* ESTs

| Sequence Listing | zscore | Annotation | Database | Functional Category |
|---|---|---|---|---|
| 5585 | 277.7 | Mutant YLR087c protein from cold sensitive yeast strain. | geneseqp W36093 | ND |
| 5586 | 277.7 | S-ANTTGEN PROTEIN PRECURSOR. | swissprot P09593 | ND |
| 5587 | 277.5 | INTEGRAL MEMBRANE PROTEIN. | sptrembl Q9Y784 | ND |
| 5588 | 277.2 | EXTENSIN-LIKE PROTEIN. | tremblnew AAD55980 | ND |
| 5589 | 277.0 | HYPOTHETICAL 90.1 KD PROTEIN C6G10.07 IN CHROMOSOME I. | sptrembl O14253 | ND |
| 5590 | 276.9 | HYPOTHETICAL 100.1 KD PROTEIN. | sptrembl O43024 | ND |
| 5591 | 276.9 | NODULATION PROTEIN G. PROTEIN. | swissprot P17611 | ND |
| 5592 | 276.7 | CARBAMOYL-PHOSPHATE SYNTHASE. | sptrembl O94313 | ND |
| 5593 | 276.4 | LUSTRIN A. | sptrembl O44341 | ND |
| 5594 | 275.9 | F56H9.1 PROTEIN. | sptrembl Q20908 | ND |
| 5595 | 275.8 | HYPOTHETICAL 35.9 KD PROTEIN. | sptrembl O74947 | ND |
| 5596 | 275.7 | S-ADENOSYLMETHIONINE SYNTHETASE (EC 2.5.1.6) (METHIONINE ADENOSYLTRANFERASE) (ADOMET SYNTHETASE). | swissprot P48466 | ND |
| 5597 | 275.3 | PROLINE-RICH PROTEIN MP-2 PRECURSOR. | swissprot P05142 | ND |
| 5598 | 275.2 | PUTATIVE CLEAVAGE AND POLYADENYLATION SPECIFICITY FACTOR. | sptrembl O13794 | ND |
| 5599 | 275.1 | BILE ACID-INDUCIBLE OPERON PROTEIN F (BAIF-3). | sptrembl O28954 | ND |
| 5600 | 274.8 | AUTOPHAGOCYTOSIS PROTEIN AUTI. | swissprot P40344 | ND |
| 5601 | 274.8 | DJ1042K10.5 (NOVEL PROTEIN) (FRAGMENT). | sptrembl O95516 | ND |
| 5602 | 274.8 | HALOACETATE DEHALOGENASE H-2 (EC 3.8.1.3). | swissnew Q01399 | ND |
| 5603 | 274.6 | HYPOTHETICAL 95.2 KD PROTEIN. | sptrembl O43051 | ND |
| 5604 | 274.6 | ACTIVATED PROTEIN KINASE C RECEPTOR HOMOLOG TRACK. | sptrembl O61075 | ND |
| 5605 | 274.4 | HYPOTHETICAL 30.9 KD PROTEIN K07C11.7 IN CHROMOSOME V. | swissprot Q21268 | ND |
| 5606 | 274.0 | 40S RIBOSOMAL PROTEIN S7. | swissprot O43105 | ND |
| 5707 | 2739.8 | GLUCOSAMINE--FRUCTOSE-6-PHOSPHATE AMINOTRANSFERASE [ISOMERIZING] (EC 2.6.1.16) (HEXOSEPHOSPHATE AMINOTRANSFERASE) (D-FRUCTOSE-6-PHOSPHATE AMIDOTRANSFERASE) (GFAT). | swissprot P53704 | Cell envelope biogensis, outer membrane |
| 5608 | 273.7 | PUTATIVE NUCLEOPORIN, NUCLEAR PORE PROTEIN, RANBP BINDING DOMAIN. | tremblnew CAB52154 | ND |
| 5609 | 272.6 | HYPOTHETICAL 96.1 KD PROTEIN. | sptrembl Q9Y7N9 | ND |
| 5610 | 272.5 | CLATHRIN COAT ASSEMBLY PROTEIN. | sptrembl Q9Y7L6 | ND |
| 5611 | 272.3 | HYPOTHETICAL 42.4 KD PROTEIN. | sptrembl O24844 | ND |
| 5612 | 2718.8 | *Aspergillus sp.* recombinant protein-disulfide-isomerase. | geneseqp R69506 | Energy production and conversion |
| 5613 | 271.9 | HYPOTHETICAL 14.0 KD PROTEIN IN RPL15B-GCR3 INTERGENIC REGION. | swissprot Q03880 | ND |

TABLE 3-continued

_Aspergillus oryzae_ ESTs

| Sequence Listing | zscore | Annotation | Database | Functional Category |
|---|---|---|---|---|
| 5614 | 271.8 | HYPOTHETICAL 198.1 KD PROTEIN. | sptrembl O23363 | ND |
| 5615 | 271.5 | CALCIUM/PROTON EXCHANGER. | sptrembl O59940 | ND |
| 5616 | 271.5 | PUTATIVE PHOSPHATIDYLSERINE DECARBOXYLASE. | tremblnew CAB39662 | ND |
| 5617 | 271.4 | HYPOTHETICAL 25.3 KD PROTEIN IN TIM23-ARE2 INTERGENIC REGION. | swissprot P53721 | ND |
| 5618 | 271.1 | PUTATIVE ACETYLORNITHINE DEACETYLASE. | sptrembl O74916 | ND |
| 5619 | 271.0 | HYDROXYQUINOL 1,2-DIOXYGENASE. | tremblnew BAA82713 | ND |
| 5620 | 2708.1 | PROBABLE ATP-DEPENDENT TRANSPORTER YER036C. | swissprot P40024 | ND |
| 5621 | 270.3 | SPHERULIN 4 PRECURSOR. | swissprot P11113 | ND |
| 5622 | 2692.9 | ACTIN. | swissprot O13419 | Cell division and chromosome partitioning |
| 5623 | 269.9 | YEST PROTEIN. | sptrembl O31523 | ND |
| 5624 | 269.4 | HYPOTHETICAL 70.6 KD LIPOPROTEIN IN FEUA-SIGW INTERGENIC REGION PRECURSOR (ORF1). | swissprot P40406 | ND |
| 5625 | 269.1 | HYPOTHETICAL 14.1 KD PROTEIN IN NIF3-CLG1 INTERGENIC REGION. | swissprot P53082 | ND |
| 5626 | 268.6 | BCSI PROTEIN. | swissnew P32839 | ND |
| 5627 | 268.2 | MITOCHONDRIAL 40S RIBOSOMAL PROTEIN MRP17. | swissprot P28778 | ND |
| 5628 | 268.0 | HYPOTHETICAL 56.6 KD PROTEIN IN URE2-SSU72 INTERGENIC REGION. | swissprot P53867 | ND |
| 5629 | 267.8 | 60S RIBOSOMAL PROTEIN L30, MITOCHONDRIAL PRECURSOR (YM1.30). | swissprot P36528 | ND |
| 5630 | 267.6 | HYPOTHETICAL 23.1 KD PROTEIN. | sptrembl P95145 | ND |
| 5631 | 267.1 | DIHYDROLIPOAMIDE SUCCINYLTRANSFERASE. | trembLnew AAD47296 | ND |
| 5632 | 267.0 | POTENTIAL MEMBRANE PROTEIN. | sptrembl O94006 | ND |
| 5633 | 266.4 | HYPOTHETICAL 137.7 KD PROTEIN IN UGS1-FAB1 INTERGENIC REGION. | swissprot P43597 | ND |
| 5634 | 266.3 | HUNK1 MRNA. | sptrembl O60885 | ND |
| 5635 | 266.0 | ASPARTYL-TRNA SYNTHETASE CYTOPLASMIC (EC 6.1.1.12) (ASPARTATE--TRNA LIGASE) (ASPRS). | swissprot P64802 | ND |
| 5636 | 265.9 | MALIC ACID TRANSPORT PROTEIN (MALATE PERMEASE). | swissprot P50537 | ND |
| 5637 | 265.3 | HYPOTHETICAL 45.1 KD PROTEIN. | sptrembl O30447 | ND |
| 5638 | 265.0 | Neurite extending activity protein. | geneseqp Y17863 | ND |
| 5639 | 2644.2 | PHOSPHOGLYCERATE KINASE (EC 2.7.2.3). | swissprot P41756 | Carbohydrate transport and metabolism |
| 5640 | 2640.0 | NMT1 PROTEIN HOMOLOG. | swissprot P42882 | Inorganic ion transport and metabolism |
| 5641 | 264.6 | SALIVARY PROLINE-RICH PROTEIN II-1 (FRAGMENT). | swissprot P81489 | ND |
| 5642 | 264.5 | ANKYRIN G119. | sptrembl Q13484 | ND |

TABLE 3-continued

*Aspergillus oryzae* ESTs

| Sequence Listing | zscore | Annotation | Database | Functional Category |
|---|---|---|---|---|
| 5643 | 264.0 | PHOSPHOSERINE PHOSPHATASE (EC 3.1.3.3) (PSP) (O-PHOSPHOSERINE PHOSPHOHYDROLASE) (PSP). | swissnew P42941 | ND |
| 5644 | 263.8 | CHROMOSOME XVI COSMID 9513. | sptrembl Q06810 | ND |
| 5645 | 263.7 | SER/THR-RICH PROTEIN T10 IN DGCR REGION. | swissprot P54797 | ND |
| 5646 | 263.3 | EXTENSIN PRECURSOR (CELL WALL HYDROXYPROLINE-RICH (GLYCOPROTEIN). | swissprot P13983 | ND |
| 5647 | 263.2 | CHROMOSOME XVI COSMID 9325. | sptrembl Q06214 | ND |
| 5649 | 2627.8 | GLUCOAMYLASE PRECURSOR (EC 3.2.1.3) (GLUCAN 1,4-ALPHA-GLUCOSIDASE) (1,4-ALPHA-D-GLUCAN GLUCOHYDROLASE). | swissprot P36914 | ND |
| 5650 | 262.9 | SNARE PROTEIN YKT6. | sptrembl O15498 | ND |
| 5651 | 262.7 | PUTATIVE PROGESTERONE-BINDING PROTEIN HOMOLOG. | sptrembl Q9XFM5 | ND |
| 5652 | 262.6 | HYPOTHETICAL 39.6 KD PROTEIN. | sptrembl O06179 | ND |
| 5653 | 262.6 | EUKARYOTIC TRANSLATION INITIATION FACTOR 2 BETA SUBUNIT (EIF-2-BETA). | swissprot P09064 | ND |
| 5654 | 262.3 | HYPOTHETICAL 31.3 KD PROTEIN. | sptrembl P72926 | ND |
| 5655 | 262.1 | WUGSC:H_RG054D04.2 PROTEIN (FRAGMENT). | sptrembl O95035 | ND |
| 5656 | 262.1 | ACTIVATOR OF HSP70 AND HSP90 CHAPERONES. | tremblnew CAB39910 | ND |
| 5657 | 261.7 | CONSERVED HYPOTHETICAL PROTEIN. | tremblnew | ND |
| 5658 | 261.7 | CONSERVED HYPOTHETICAL PROTEIN. | sptrembl Q9Y7K8 | ND |
| 5659 | 261.7 | U3 SMALL NUCLEOLAR RIBONUCLEOPROTEIN PROTEIN LCP5. | swissnew | ND |
| 5660 | 261.5 | EXTENSIN PRECURSOR (CELL WALL HYDROXYPROLINE-RICH GLYCOPROTEIN). | swissprot P13983 | ND |
| 5661 | 261.4 | PROLINE-RICH PROTEIN PRECURSOR. | sptrembl O49201 | ND |
| 5662 | 2603.0 | PUTATIVE THIAZOLE SYNTHASE. | tremblnew AAF25444 | ND |
| 5663 | 260.9 | UBIQUITIN-CONJUGATING ENZYME E2-24 KD (EC 6.3.2.19) (UBIQUITIN-PROTEIN LIGASE) (UBIQUITIN CARRIER PROTEIN). | swissprot P21734 | ND |
| 5664 | 260.9 | HYPOTHETICAL 106.1 KD PROTEIN C4F10.13C IN CHROMOSOME I. | sptrembl O36025 | ND |
| 5665 | 260.8 | WBSCR1 ALTERNATIVE SPLICED PRODUCT. | sptrembl | ND |
| 5666 | 260.7 | HYPOTHETICAL 8.2 KD PROTEIN C26A3.14C IN CHROMOSOME I. | swissprot Q10167 | ND |
| 5667 | 260.0 | HYPOTHETICAL 93.5 KD PROTEIN. | sptrembl O59744 | ND |
| 5668 | 259.8 | PHOSPHATIDYLETHANOLAMINE METHYLTRANSFERASE. | sptrembl P87301 | ND |
| 5669 | 259.5 | HYPOTHETICAL 40.7 KD PROTEIN IN DAK1-ORC1 INTERGENIC REGION. | swissprot Q04651 | ND |

TABLE 3-continued

*Aspergillus oryzae* ESTs

| Sequence Listing | zscore | Annotation | Database | Functional Category |
|---|---|---|---|---|
| 5670 | 259.2 | HYPOTHETICAL 39.4 KD PROTEIN. | sptrembl Q12449 | ND |
| 5671 | 259.2 | ORF N118 (FRAGMENT). | sptrembl Q92363 | ND |
| 5672 | 259.1 | PUTATIVE RNA BINDING PROTEIN. | tremblnew CAB53728 | ND |
| 5673 | 2583.2 | TUBULIN ALPHA-2 CHAIN. | swissprot P24634 | ND |
| 5674 | 258.5 | HYPOTHETICAL 114.3 KD PROTEIN. | sptrembl O74839 | ND |
| 5675 | 258.4 | PROLINE-RICH PROTEIN MP-2 PRECURSOR. | swissprot P01542 | ND |
| 5676 | 257.9 | C-HORDEIN. | sptrembl Q41210 | ND |
| 5677 | 257.9 | PROLINE-RICH SALIVARY PROTEIN (FRAGMENT). | sptrembl Q62106 | ND |
| 5678 | 256.6 | Malassezia fungus MF-7 antigenic protein. | geneseqp W29774 | ND |
| 5679 | 256.9 | HYPOTHETICAL 22.7 KD PROTEIN. | sptrembl Q94723 | ND |
| 5680 | 256.8 | PUTATIVE SMC FAMILY PROTEIN. | tremblnew CAB11195 | ND |
| 5681 | 256.7 | PUTATIVE ACETYLORNITHINE DEACETYLASE. | sptrembl O74916 | ND |
| 5682 | 256.4 | WEBI PROTEIN. | sptrembl O13637 | ND |
| 5683 | 256.3 | INTEGRAL MEMBRANE PROTEIN. | sptrembl Q9Y784 | ND |
| 5684 | 256.3 | C-7 hydroxycephem methyltransferase coupling protein. | geneseqp R92153 | ND |
| 5685 | 256.2 | FLGA insert stabilising polypeptide. | geneseqp W79128 | ND |
| 5686 | 256.0 | HYPOTHETICAL 34.4 KD PROTEIN IN IDS2-MPI2 INTERGENIC REGION. | swissprot P47008 | ND |
| 5687 | 2556.9 | GELI PROTEIN. | sptrembl O74687 | ND |
| 5688 | 2554.6 | ALCOHOL DEHYDROGENASE I (EC 1.1.1.1). | swissprot P41747 | ND |
| 5689 | 255.7 | HYPOTHETICAL 9.1 KD PROTEIN. | sptrembl O04820 | ND |
| 5690 | 255.5 | PUTATIVE PROLINE-RICH PROTEIN. | sptrembl Q9ZW08 | ND |
| 5691 | 255.3 | HYPOTHETICAL 14.6 KD PROTEIN. | tremblnew CAB61466 | ND |
| 5692 | 255.1 | HYPOTHETICAL 27.8 KD PROTEIN. | tremblnew CAB66105 | ND |
| 5693 | 254.7 | ANUCLEATE PRIMARY STERIGMATA PROTEIN. | swissprot Q00083 | ND |
| 5694 | 254.0 | SUPEROXIDE DISMUTASE (EC 1.15.1.1). | tremblnew CAB61430 | ND |
| 5695 | 2534.2 | MANNOSE-1-PHOSPHATE GUANYLTRANSFERASE (EC 2.7.7.13) (MPGI TRANSFERASE) (ATP-MANNOSE-1-PHOSPHATE GUANYLYLTRANSFERASE). | sptrembl O74624 | Cell envelope biogenesis, outer membrane |
| 5696 | 253.8 | PROLINE-RICH PROTEIN. | sptrembl O22514 | ND |
| 5697 | 253.5 | PROBABLE ATP-DEPENDENT RNA HELICASE DBP3 (HELICASE CA3). | swissprot P20447 | ND |
| 5698 | 2523.1 | 60S RIBOSOMAL PROTEIN 1.3. | tremblnew AAF15600 | Translation, ribosomal structure and biogenesis |
| 5699 | 252.6 | HYPOTHETICAL 31.1 KD PROTEIN C1E8.05 IN CHROMOSOME II PRECURSOR. | sptrembl O42970 | ND |
| 5700 | 252.5 | TGF BETA RECEPTOR ASSOCIATED PROTEIN-1. | sptrembl O60466 | ND |
| 5701 | 252.4 | HYDROXYPROLINE-RICH GLYCOPROTEIN. | sptrembl Q41814 | ND |

TABLE 3-continued

Aspergillus oryzae ESTs

| Sequence Listing | zscore | Annotation | Database | Functional Category |
|---|---|---|---|---|
| 5702 | 252.3 | PUTATIVE INTEGRAL MEMBRANE GTPASE ACTIVATING PROTEIN, RABGAP DOMAIN CONTAININGYEAST MICI HOMOLOG. | sptrembl O43048 | ND |
| 5703 | 251.7 | HYPOTHETICAL 55.1 KD PROTEIN IN FAB1-PES4 INTERGENIC REGION. | swissprot P43601 | ND |
| 5704 | 251.6 | HYPOTHETICAL 8.1 KD PROTEIN C3G6.02 IN CHROMOSOME I. | sptrembl O14140 | ND |
| 5705 | 251.6 | PUTATIVE ZINC FINGER TRANSCRIPTION FACTOR. | tremblnew AAF15889 | ND |
| 5706 | 250.9 | HYPOTHETICAL 21.6 KD PROTEIN C56F8.11 IN CHROMOSOME I. | swissprot Q10259 | ND |
| 5707 | 250.6 | CONSERVED HYPOTHETICAL PROTEIN. | sptrembl Q9WZF4 | ND |
| 5708 | 2495.5 | ELONGATION FACTOR 2 (EF-2). | swissprot P32324 | Translation, ribosomal structure and biogenesis |
| 5709 | 2493.2 | NAD-DEPENDENT FORMATE DEHYDROGENASE (EC 1.2.1.2). | sptrembl Q9Y790 | ND |
| 5710 | 249.9 | PUTATIVE SERINE/THREONINE-PROTEIN KINASE PKWA (EC 2.7.1.-). | swissnew P49695 | ND |
| 5711 | 249.7 | 40S MITOCHODRIAL RIBOSOMAL PROTEIN. | sptrembl O59772 | ND |
| 5712 | 249.3 | HYPOTHETICAL 49.6 KD PROTEIN IN ELM1-PRI2 INTERGENIC REGION. | swissprot P36091 | ND |
| 5713 | 2489.1 | SERINE HYDROXYMETHYLTRANSFERASE CYTOSOLIC (EC 2.1.2.1) (SERINE METHYLASE) (GLYCINE HYDROXYMETHYLTRANSFERASE) (SHMT). | swissprot P34898 | Amino acid transport and metabolism |
| 5714 | 248.4 | ZK1307.8 PROTEIN. | sptrembl Q23440 | ND |
| 5715 | 248.3 | 26S PROTEASOME REGULATORY SUBUNIT NINI (NUCLEAR INTEGRITY PROTEIN 1). | swissprot P32496 | ND |
| 5716 | 248.1 | EXTENSIN-LIKE PROTEIN. | tremblnew AAD55980 | ND |
| 5717 | 248.0 | PUTATIVE NUCLEOPORIN. | tremblnew CAA91133 | ND |
| 5718 | 2473.9 | CATALASE B (EC 1.11.1.6). | swissprot Q92405 | Inorganic ion transport and metabolism |
| 5719 | 247.8 | HYPOTHETICAL 31.6 KD PROTEIN. | sptrembl Q9Y7Z5 | ND |
| 5720 | 247.6 | CHROMOSOME XV READING FRAME ORF YOR320C. | sptrembl Q12096 | ND |
| 5721 | 247.4 | HYPOTHETICAL 20.9 KD PROTEIN IN ROX1-SP3E INTERGENIC REGION. | swissprot Q12425 | ND |
| 5722 | 247.3 | COSMID C27A2. | sptrembl Q18238 | ND |
| 5723 | 247.3 | FIL1 PROTEIN PRECURSOR. | swissprot P38771 | ND |
| 5724 | 247.1 | OXIDOREDUCTASE. | sptrembL O53608 | ND |
| 5725 | 246.9 | A-AGGLUTININ ATTACHMENT SUBUNIT PRECURSOR. | swissprot P32323 | ND |
| 5726 | 246.6 | P. putida R-(-)-mandelate monooxygenase protein. | geneseqp W53916 | ND |

TABLE 3-continued

Aspergillus oryzae ESTs

| Sequence Listing | zscore | Annotation | Database | Functional Category |
|---|---|---|---|---|
| 5727 | 246.2 | 382AA LONG HYPOTHETICAL SARCOSINE OXIDASE. | sptrembl O59089 | ND |
| 5728 | 246.1 | PUTATIVE TRANSPORTER. | tremblnew CAB63540 | ND |
| 5729 | 245.8 | 60S RIBOSOMAL PROTEIN L37, MITOCHONDRIAL PRECURSOR (YML37). | swissprot P36532 | ND |
| 5730 | 245.7 | PUTATIVE RNA MATURATION PROTEIN. | sptrembl O94689 | ND |
| 5731 | 245.1 | MEIOTIC MRNA STABILITY PROTEIN KINASE UME5 (EC 2.7.1.-). | swissprot P39073 | ND |
| 5732 | 245.1 | EXTENSIN (FRAGMENT). | sptrembl Q41645 | ND |
| 5733 | 244.5 | HYPOTHETICAL 41.8 KD PROTEIN. | sptrembl O65023 | ND |
| 5734 | 244.3 | HYPOTHETICAL 81.2 KD PROTEIN C3D6.13C IN CHROMOSOME II. | swissprot P87178 | ND |
| 5735 | 244.3 | EXTENSIN-LIKE PROTEIN. | tremblnew AAD55980 | ND |
| 5736 | 244.0 | REPETITIVE PROLINE-RICH CELL WALL PROTEIN 1. | sptrembl Q01979 | ND |
| 5737 | 243.8 | PROTEIN-TYROSINE PHOSPHATASE (EC 3.1.3.48). | sptrembl O94526 | ND |
| 5738 | 243.5 | SIMILAR TO HUMAN DIMETHYLANILINE MONOOXYGENASE. | tremblnew BAA88195 | ND |
| 5739 | 2420.7 | CATALASE ISOZYME P. | tremblnew AAF01463 | Inorganic ion transport and metabolism |
| 5740 | 242.8 | HYDROXYPROLINE-RICH GLYCOPROTEIN DZ-HRGP PRECURSOR. | trernblnew CAB62280 | ND |
| 5741 | 242.7 | F19G10.4 PROTEIN. | sptrembl O23122 | ND |
| 5742 | 242.5 | F3L24.19 PROTEIN. | trernblnew AAF14029 | ND |
| 5743 | 242.2 | MYCELIAL SURFACE ANTIGEN PRECURSOR. | sptrembl O74249 | ND |
| 5744 | 242.1 | DNA-DIRECTED RNA POLYMERASE II LARGEST SUBUNIT (EC 2.7.7.6) (RPBI) (FRAGMENT). | swissprot P11414 | ND |
| 5745 | 242.1 | PUTATIVE SECRETED PROTEIN. | sptrembl O69822 | ND |
| 5746 | 241.7 | HYDROXYPROLINE-RICH GLYCOPROTEIN DZ-HRGP PRECURSOR. | tremblnew CAB62280 | ND |
| 5747 | 241.4 | FISSION YEAST. | sptrembl P78821 | ND |
| 5748 | 241.4 | HOMOSERINE DEHYDROGENASE (EC 1.1.1.3) (HDH). | swissnew P31116 | ND |
| 5749 | 241.2 | Cryptosporidium parvum GP900 antigen. | geneseqp W48299 | ND |
| 5750 | 241.2 | TOXD PROTEIN. | swissprot P54006 | ND |
| 5751 | 241.2 | MUCIN 2 PRECURSOR (INTESTINAL MUCIN 2). | swissprot Q02817 | ND |
| 5752 | 241.1 | CELL WALL PROTEIN PRECURSOR. | sptrembl Q39005 | ND |
| 5753 | 241.0 | HYPOTHETICAL 52.9 KD SERINE-RICH PROTEIN C11G7.01 IN CHROMOSOME I. | swissprot O13695 | ND |
| 5754 | 240.9 | TRICHODIENE OXYGENASE (EC 1.14.-.-) (CYTOCHROME P450 58). | swissprot Q12612 | ND |
| 5755 | 240.6 | HYPOTHETICAL 27.5 KD PROTEIN. | sptrembl Q03973 | ND |
| 5756 | 240.2 | ZINC CLUSTER TRANSCRIPTION FACTOR FCRIP. | sptrembl O93870 | ND |
| 5757 | 240.0 | PUTATIVE METHYLTRANSFERASE SLL0829 (EC 2.1.1.-). | swissprot Q55423 | ND |

TABLE 3-continued

*Aspergillus oryzae* ESTs

| Sequence Listing | zscore | Annotation | Database | Functional Category |
|---|---|---|---|---|
| 5758 | 239.8 | CHOLINE/ETHANOLAMINE KINASE-ALPHA. | tremblnew BAA88154 | ND |
| 5759 | 239.5 | BETA-GALACTOSIDASE (ALPHA PEPTIDE (FRAGMENT). | sptrembl Q46478 | ND |
| 5760 | 239.4 | HYPOTHETICAL HELICASE K12H4.8 IN CHROMOSOME III. | swissprot P34529 | ND |
| 5761 | 239.1 | HYDROXYPROLINE-RICH GLYCOPROTEIN DZ-HRGP PRECURSOR. | tremblnew CAB62280 | ND |
| 5762 | 2384.6 | SPLICEOSOMAL PROTEIN SAP 155 (PUTATIVE NUCLEAR PROTEIN). | sptrembl O75533 | ND |
| 5763 | 237.6 | Human follicle stimulating hormone GPR N-terminal sequence. | geneseqp W03627 | ND |
| 5764 | 237.6 | GLUCOAMYLASE S1/S2 PRECURSOR (EC 3.2.1.3) (GLUCAN 1,4-ALPHA-GLUCOSIDASE) (1,4-ALPHA-D-GLUCAN GLUCOHYDROLASE). | swissprot P08640 | ND |
| 5765 | 237.4 | ANNEXIN VII (SYNEXIN). | swissprot P24639 | ND |
| 5766 | 237.3 | HYDROXYLASE. | sptrembl O94115 | ND |
| 5767 | 236.2 | PTERIN-4-ALPHA-CARBINOLAMINE DEHYDRATASE (EC 4.2.1.96) (PHS) (4-ALPHA-HYDROXY-TETRAHYDROPTERIN DEHYDRATASE) (PHENYLALANINE HYDROXYLASE-STIMULATING PROTEIN) (PCD). | swissprot P43335 | ND |
| 5768 | 2356.2 | TUBULIN BETA-1 CHAIN. | swissprot P10653 | ND |
| 5769 | 2350.7 | ELONGATION FACTOR 2 (FRAGMENT). | tremblnew CAB52147 | Translation, ribosomal structure and biogenesis |
| 5770 | 235.7 | HYDROXYPROLINE-RICH GLYCOPROTEIN DZ-HRGP PRECURSOR. | tremblnew CAB62280 | ND |
| 5771 | 235.0 | HYDROXYPROLINE-RICH GLYCOPROTEIN. | sptrembl Q42366 | ND |
| 5772 | 234.9 | KINESIN-LIKE PROTEIN KIF2 (FRAGMENT). | sptremhl Q9WV63 | ND |
| 5773 | 233.9 | ACYL-COA-BINDING PROTEIN (ACBP) (DIAZEPAM BINDING INHIBITOR) (DBI) (ENDOZEPINE) (EP). | swissprot P07108 | ND |
| 5774 | 233.9 | HISTONE HI. | tremblnew AAF16011 | ND |
| 5775 | 233.6 | ISOFLAVONE REDUCTASE HOMOLOG IRL (EC 1.3.1.-). | swissprot P52580 | ND |
| 5776 | 233.2 | SRC2. | sptrembl O04133 | ND |
| 5777 | 233.2 | HYPOTHETICAL 118.4 KD PROTEIN IN BAT2-DAL5 INTERGENIC REGION PRECURSOR. | swissprot P47179 | ND |
| 5778 | 233.2 | SAFRAMYCIN MXI SYNTHETASE A. | sptrembl Q50858 | ND |
| 5779 | 233.2 | HYPOTHETICAL PROTEIN. | sptrembl O23692 | ND |
| 5780 | 233.0 | PROLINE RICH PROTEIN PRECURSOR. | sptrembl Q43558 | ND |
| 5781 | 232.6 | HOLI PROTEIN. | swissprot P53389 | ND |
| 5782 | 232.5 | LONG-CHAIN-FATTY ACID--COA LIGASE (FADD-5). | sptrembl O29233 | ND |
| 5783 | 232.5 | HYPOTHETICAL 31.6 KD PROTEIN. | sptrembl Q9Y7Z5 | ND |

TABLE 3-continued

*Aspergillus oryzae* ESTs

| Sequence Listing | zscore | Annotation | Database | Functional Category |
|---|---|---|---|---|
| 5784 | 232.2 | HYPOTHETICAL 67.0 KD PROTEIN. | sptrembl O60107 | ND |
| 5785 | 232.2 | EXTENSIN CLASS II PRECURSOR (CELL WALL HYDROXYPROLINE-RICH GLYCOPROTEIN) (HRGP) (HYP2.13) (FRAGMENT). | sptrembl Q09085 | ND |
| 5786 | 231.8 | A-AGGLUTININ ATTACHMENT SUBUNIT PRECURSOR. | swissprot P32323 | ND |
| 5737 | 231.8 | HYPOTHETICAL 52.3 KD PROTEIN IN FRF2 5'REGION. | swissprot P36032 | ND |
| 5788 | 231.7 | PUTATIVE 101.8 KD TRANSCRIPTIONAL REGULATORY PROTEIN IN LAS1-CCP1 INTERGENIC REGION. | swissprot P36023 | ND |
| 5789 | 231.5 | AUXIN-INDUCED PROTEIN. | sptrembl Q43677 | ND |
| 5790 | 231.5 | HYPOTHETICAL 8.6 KD PROTEIN. | sptrembl Q03482 | ND |
| 5791 | 231.5 | HYPOTHETICAL 64.2 KD PROTEIN. | sptrembl Q9Y8A1 | ND |
| 5792 | 231.3 | PUTATIVE PRE-MRNA SPLICING FACTOR | sptrembl P78814 | ND |
| 5793 | 231.3 | MINICHROMOSOME MAINTENANCE PROTEIN MCM7P. | sptrembl O75001 | ND |
| 5794 | 231.1 | RNA EXPORT FACTOR GLFI. | swissprot Q12315 | ND |
| 5795 | 230.7 | ATPASE STABILIZING FACTOR 15 KD PROTEIN. | swissprot P16965 | ND |
| 5796 | 230.6 | MUCIN (FRAGMENT). | sptrembl Q28501 | ND |
| 5797 | 230.6 | GIBBERELLIN OXIDASE-LIKE PROTEIN. | tremblnew CAB46041 | ND |
| 5798 | 230.4 | PUTATIVE MULTIPLE DRUG RESISTANCE PROTEIN. | sptrembl Q9Y835 | ND |
| 5799 | 230.3 | MUCIN 2 PRECURSOR (INTESTINAL MUCIN 2). | swissprot Q02817 | ND |
| 5800 | 230.3 | HYDROXYPROLINE-RICH GLYCOPROTEIN DZ-HRGP PRECURSOR. | tremblnew CAB62280 | ND |
| 5801 | 230.0 | Human lung tumour protein SAL-68 predicted amino acid sequence. | geneseqp Y29561 | ND |
| 5802 | 229.7 | MUCIN 2 PRECURSOR (INTESTINAL MUCIN 2). | swissprot Q02817 | ND |
| 5803 | 229.6 | ADENYLYLCYCLASE. | tremblnew AAD50121 | ND |
| 5804 | 229.3 | HYPOTHETICAL 17.7 KD PROTEIN IN AMD1-RAD52 INTERGENIC REGION. | swissprot Q03712 | ND |
| 5805 | 229.0 | UBIQUITIN--PROTEIN LIGASE RSP5 (EC 6.3.2.-). | swissprot P39940 | ND |
| 5806 | 228.9 | HYPOTHETICAL 54.9 KD PROTEIN IN CBR5-NOT3 INTERGENIC REGION. | swissprot P40533 | ND |
| 5807 | 228.8 | RABII-LIKE (FRAGMENT). | sptrembl Q94149 | ND |
| 5808 | 228.5 | F24J5.4. | tremblnew AAD49970 | ND |
| 5809 | 228.2 | ZINC FINGER PROTEIN. | swissprot P28875 | ND |
| 5810 | 228.1 | CYCLIN AN1A-6B (FRAGMENT). | tremblnew AAF23011 | ND |
| 5811 | 227.6 | EXTENSIN (EXT) PRECURSOR. | sptrembl Q40402 | ND |
| 5812 | 227.1 | D immitis ankyrin pDiAnk303 protein. | geneseqp W76774 | ND |
| 5813 | 2268.2 | ALPHA-GLUCOSIDASE (EC 3.2.1.20) (MALTASE). | swissprot Q02751 | Carbohydrate transport and metabolism |
| 5814 | 2265.0 | CHITINASE. | sptrembl Q82222 | ND |
| 5815 | 226.5 | RIBOSOMAL PROTEIN L41. | sptrembl Q9Y710 | ND |

TABLE 3-continued

*Aspergillus oryzae* ESTs

| Sequence Listing | zscore | Annotation | Database | Functional Category |
|---|---|---|---|---|
| 5816 | 226.2 | PUTATIVE MITOCHONDRIAL 40S RIBOSOMAL PROTEIN YNR036C. | swissprot P53732 | ND |
| 5817 | 226.2 | PROBABLE COATOMER GAMMA SUBUNIT (GAMMA-COAT PROTEIN) (GAMMA-COP). | swissprot P87140 | ND |
| 5818 | 226.1 | TETRATRICOPEPTIDE REPEAT PROTEIN. | sptrembl Q99614 | ND |
| 5819 | 225.8 | MICROFILARIAL SHEATH PROTEIN PRECURSOR. | sptrembl Q17242 | ND |
| 5820 | 224.7 | EXTENSIN PRECURSOR (CELL WALL HYDROXYPROLINE-RICH GLYCOPROTEIN). | swissprot P13983 | ND |
| 5821 | 224.7 | CGI-82 PROTEIN. | sptrembl Q9Y391 | ND |
| 5822 | 224.6 | PROTEOPHOSPHOGLYCAN PRECURSOR (FRAGMENT). | sptrembl Q9Y076 | ND |
| 5823 | 224.0 | YCR028C-A. | sptrembl O11851 | ND |
| 5824 | 224.0 | MEMBRANE GLYCOPROTEIN. | sptrembl O39781 | ND |
| 5825 | 223.9 | PRO-RICH. | sptrembl Q84565 | ND |
| 5826 | 223.9 | PROLINE RICH PROTEIN. | sptrembl O22514 | ND |
| 5827 | 223.7 | KERATIN COMPLEX 2. BASIC PROTEIN 2 (KERATIN 2 EPIDERMIS). | sptrembl Q61869 | ND |
| 5828 | 223.5 | HYPOTHETICAL 41.5 KD PROTEIN. | tremblnew CAB66198 | ND |
| 5829 | 222.9 | CYTOCHROME P450 4F3 (EC 1.14.13.30) (CYPIVF3) (LEUKOTRIENE-B4 OMEGA-HYDROXYLASE) (LEUKOTRIENE-B4 20-MONOOXYGENASE) (CYTOCHROME P450-LTB-OMEGA). | swissnew Q08477 | ND |
| 5830 | 222.5 | EXTENSIN-LIKE PROTEIN. | tremblnew AAD55980 | ND |
| 5831 | 222.4 | CHROMOSOME XV READING FRAME ORF YOR380W. | sptrembl Q08904 | ND |
| 5832 | 222.3 | KIAA0544 PROTEIN (FRAGMENT). | sptrembl O60291 | ND |
| 5833 | 222.2 | PROTEOPHOSPHOGLYCAN (FRAGMENT). | sptrembl Q9Y075 | ND |
| 5834 | 222.2 | EXTENSIN (FRAGMENT). | sptrembl Q41645 | ND |
| 5835 | 222.2 | HEMOLYSIN. | sptrembl Q00050 | ND |
| 5836 | 221.9 | PROSTACYCLIN SYNTHASE (EC 5.3.99.4) (PROSTAGLANDIN 12 SYNTHASE). | sptrembl Q62969 | ND |
| 5837 | 221.8 | HYPOTHETICAL 22.4 KD PROTEIN. | sptrembl Q9X7Q3 | ND |
| 5838 | 221.5 | Cyanovirin-N. | geneseqp W06811 | ND |
| 5839 | 2207.9 | CATALASE (EC 1.11.1.6). | sptrembl O14436 | Inorganic ion transport and metabolism |
| 5840 | 220.8 | PTB-ASSOCIATED SPLICING FACTOR (PSF). | swissnew P23246 | ND |
| 5841 | 220.3 | PUTATIVE TRANSCRIPTIONAL COACTIVATOR. | sptrembl O94301 | ND |
| 5842 | 220.3 | C11G6.3 PROTFIN. | sptrembl Q17909 | ND |
| 5843 | 220.3 | PUTATIVE CYTOCHROME C OXIDASE POLYPEPTIDE. | sptrembl O94705 | ND |
| 5844 | 220.0 | EXTENSIN PRECURSOR (PROLINE-RICH GLYCOPROTEIN). | swissprot P14918 | ND |
| 5845 | 219.9 | EXTENSIN PRECURSOR (CELL WALL HYDROXYPROLINE-RICH GLYCOPROTEIN). | swissprot P13983 | ND |

TABLE 3-continued

Aspergillus oryzae ESTs

| Sequence Listing | zscore | Annotation | Database | Functional Category |
|---|---|---|---|---|
| 5846 | 219.6 | EXTENSIN (FRAGMENT). | sptrembl Q41645 | ND |
| 5847 | 219.5 | EXTENSIN (FRAGMENT). | sptrembl Q41645 | ND |
| 5848 | 219.2 | MADS-BOX HOMOLOG UMC1. | sptrembl O42725 | ND |
| 5849 | 219.2 | Y63D3A.5 PROTEIN. | tremblnew CAB63398 | ND |
| 5850 | 219.1 | SPCB. | tremblnew AAD50452 | ND |
| 5851 | 219.0 | ZINC FINGER PROTEIN. | sptrembl Q00069 | ND |
| 5852 | 2184.1 | Urate oxidase encoded by A. flavus-derived cDNA clone 9C. | geneseqp R10222 | ND |
| 5853 | 218.7 | HYPOTHETICAL 49.5 KD PROTEIN IN UBP3-PET122 INTERGENIC REGION. | swissprot P10356 | ND |
| 5854 | 218.7 | PUTATIVE GALACTINOL SYNTHASE (EC 2.4.1.123). | sptrembl Q9XGG4 | ND |
| 5855 | 218.5 | ALCOHOL DEHYDROGENASE II (EC 1.1.1.1) (ADH II). | swissprot P54202 | ND |
| 5856 | 218.5 | PROLINE RICH PROTEIN. | sptrembl O22514 | ND |
| 5857 | 218.2 | DEHYDROGENASE. | sptrembl O34788 | ND |
| 5858 | 217.6 | PROBABLE PROTEIN-TYROSINE PHOSPHATASE CDC14 (EC 3.1.3.48). | swissprot Q00684 | ND |
| 5859 | 217.3 | HYPOTHETICAL 118.4 KD PROTEIN IN BAT2-DAL5 INTERGENIC REGION PRECURSOR. | swissprot P47179 | ND |
| 5860 | 217.1 | HYPOTHETICAL 58.8 KD PROTEIN IN GLK1-SRO9 INTERGENIC REGION. | swissprot P25568 | ND |
| 5861 | 2168.3 | SPINDLE ASSEMBLY CHECKPOINT PROTEIN SLDB. | sptrembl O59902 | ND |
| 5862 | 216.0 | FATTY ACID AMIDE HYDROLASE. | tremblnew BAA86917 | ND |
| 5863 | 2159.5 | POLYUBIQUITIN. | sptrembl O74295 | ND |
| 5864 | 2156.3 | NADH-UBIQUINONE OXIDOREDUCTASE 40 KD SUBUNIT PRECURSOR (EC 1.6.5.3) (EC 1.6.99.3) (COMPLEX I-40 KD) (CI-40 KD). | swissprot P25284 | ND |
| 5865 | 215.9 | MITOCHONDRIAL NUCLEASE (EC 3.1.30.-). | swissprot P08466 | ND |
| 5866 | 215.6 | HYPOTHETICAL 49.5 KD PROTEIN. | tremblnew AAD51406 | ND |
| 5867 | 215.4 | HYPOTHETICAL PROTEIN C30B4.01C IN CHROMOSOME II (FRAGMENT). | sptrembl P87179 | ND |
| 5868 | 2148.5 | ENOLASE (EC 4.2.1.11). | tremblnew BAA23760 | Carbohydrate transport and metabolism |
| 5869 | 214.7 | COLLETOTRICHUM GLOEOSPORIOIDES NITROGEN STARVATION-INDUCED GLUTAMINE RICH PROTEIN. | sptrembl O43117 | ND |
| 5870 | 214.6 | HYPOTHETICAL RYANODINE RECEPTOR DOMAIN CONTAINING PROTEIN. | sptrembl O74497 | ND |
| 5871 | 214.1 | KIAA0122 PROTEIN (FRAGMENT). | sptrembl Q14136 | ND |
| 5872 | 214.1 | NEUROHLAMENI-M SUBUNIT (FRAGMENT). | sptrembl O22788 | ND |
| 5873 | 214.0 | TEMPERATURE-DEPENDENT PROTEIN BYS1. | sptrembl Q00300 | ND |
| 5874 | 214.0 | D. immitis ankyrin pDiAnk348 protein. | geneseqp W76775 | ND |

TABLE 3-continued

_Aspergillus oryzae_ ESTs

| Sequence Listing | zscore | Annotation | Database | Functional Category |
|---|---|---|---|---|
| 5875 | 213.9 | HYPOTHETICAL 61.8 KD PROTEIN IN KGD1-SIM1 INTERGENIC REGION. | swissprot P40475 | ND |
| 5876 | 213.7 | MEMBRANE GLYCOPROTEIN. | sptrembl O39782 | ND |
| 5877 | 213.4 | HYDROXYPROLINE-RICH GLYCOPROTEIN PRECURSOR. | sptrembl Q41719 | ND |
| 5878 | 212.8 | REGULATORY PROTEIN E2. | swissprot P50766 | ND |
| 5879 | 212.7 | HYPOTHETICAL 10.3 KD PROTEIN. | tremblnew CAB55848 | ND |
| 5880 | 212.4 | EATRO 164 KINETOPLAST (CR4). | sptrembl Q33564 | ND |
| 5881 | 212.4 | PUTATIVE HYDROLASE. | tremblnew CAB61556 | ND |
| 5882 | 212.2 | CHITIN SYNTHASE I (EC 2.4.1.16) (CHITIN-UDP ACETYL-GLUCOSAMINYL TRANSFERASE D (CLASS-II CHITIN SYNTHASE I). | swissprot P30600 | ND |
| 5883 | 211.9 | EG:BACR37P7.3 PROTEIN. | tremblnew CAB65851 | ND |
| 5884 | 211.8 | PUTATIVE NICOTINATE PHOSPHORIBOSYLTRANSFERASE. | tremblnew CAB62416 | ND |
| 5885 | 211.3 | ATP-DEPENDENT BILE ACID PERMEASE. | swissprot P32386 | ND |
| 5886 | 211.3 | GLUCOAMYLASE S1/S2 PRECURSOR (EC 3.2.1.3) (GLUCAN 1,4-ALPHA-GLUCOSIDASE) (1,4-ALPHA-D-GLUCAN GLUCOHYDROLASE). | swissprot P08640 | ND |
| 5887 | 211.1 | HYPOTHETICAL 50.9 KD PROTEIN. | sptrembl O94548 | ND |
| 5888 | 211.0 | HYPOTHETICAL 29.3 KD PROTEIN (ORF92). | swissprot O10341 | ND |
| 5890 | 2106.6 | METHYLMALONATE-SEMIALDEHYDE DEHYDROGENASE [ACYLATING] PRECURSOR (EC 1.2.1.27) (MMSDH). | swissprot Q02253 | Energy production and conversion |
| 5891 | 2102.8 | PROBABLE INOSINE-5'-MONOPHOSPHATE DEHYDROGENASE (EC 1.1.1.205) (IMP DEHYDROGENASE) (IMPDH) (IMPD). | sptrembl O14344 | ND |
| 5892 | 210.9 | Truncated sec71P allele protein sequence. | geneseqp Y39942 | ND |
| 5893 | 210.6 | HYPOTHETICAL 56.3 KD PROTEIN IN ARO3-KRS1 INTERGENIC REGION. | swissprot P28817 | ND |
| 5894 | 210.2 | YMFI PROTEIN. | sptrembl O31767 | ND |
| 5895 | 210.0 | HYDROXYPROLINE-RICH GLYCOPROTEIN DZ-HRGP PRECURSOR. | tremblnew CAB62280 | ND |
| 5896 | 210.0 | Cyanovirin-N protein sequence. | geneseqp Y39909 | ND |
| 5897 | 2094.5 | _A. niger_ PacC zinc finger DNA binding domain. | geneseqp Y08483 | ND |
| 5898 | 209.5 | PUTATIVE ACETYLORNITHINE DEACETYLASE. | sptrembl O74916 | ND |
| 5899 | 209.4 | CONIDIATION-SPECIFIC PROTEIN 8. | swissprot P10169 | ND |
| 5900 | 209.4 | GASTRIC MUCIN (FRAGMENT). | sptrembl Q29071 | ND |
| 5901 | 209.4 | HYPOTHETICAL 26.9 KD PROTEIN IN YHB1-PFK1 INTERGENIC REGION. | swissprot P50087 | ND |
| 5902 | 209.3 | PUTATIVE PROLINE-RICH CELL WALL PROTEIN. | sptrembl O82327 | ND |

TABLE 3-continued

*Aspergillus oryzae* ESTs

| Sequence Listing | zscore | Annotation | Database | Functional Category |
|---|---|---|---|---|
| 5903 | 209.0 | PROBABLE PROTEIN KINASE C20G4.03C (EC 2.7.1.-). | sptrembl O13889 | ND |
| 5904 | 209.0 | MAJOR PRION PROTEIN 1 PRECURSOR (PRP) (MAJOR SCRAPIE-ASSOCIATED FIBRIL PROTEIN 1). | swissprot P40242 | ND |
| 5905 | 208.5 | Mutant *Aspergillus oryzae* DEBY932 rescued locus. | geneseqp W37992 | ND |
| 5906 | 2076.7 | 26S PROTEASE REGULATORY SUBUNIT 7 HOMOLOG. | tremblnew CAA16915 | Posttranslational modification, protein turnover, chaperones |
| 5907 | 2076.6 | NIDULANS, CPA-LIKE (FRAGMENT). | sptrembl O42806 | Nucleotide transport |
| 5908 | 207.6 | CHROMOSOME XVI READING FRAME ORF YPL233W. | sptrembl Q12143 | ND |
| 5909 | 207.4 | HYPOTHETICAL 30.8 KD PROTEIN IN SPR6-RPL23B INTERGENIC REGION. | swissprot P40072 | ND |
| 5910 | 207.3 | EXTENSIN CLASS 1 PROTEIN PRECURSOR (EXTENSIN-LIKE PROTEIN). | sptrembl Q41707 | ND |
| 5911 | 207.2 | CYSTATHIONINE BETA-SYNTHASE (EC 4.2.1.22) (SERINE SULFHYDRASE) (BETA-THIONASE). | swissprot P46794 | ND |
| 5912 | 206.9 | HYPOTHETICAL 24.4 KD PROTEIN. | sptrembl O86620 | ND |
| 5913 | 206.6 | F24J5.8 PROTEIN. | tremblnew AAD49974 | ND |
| 5914 | 206.5 | (VSP-3 PRECURSOR. | sptrembl Q39620 | ND |
| 5915 | 206.3 | Cationic peptide Har7. | geneseqp W66400 | ND |
| 5916 | 205.7 | HYPOTHETICAL 46.7 KD PROTEIN (FRAGMENT). | sptrembl O42840 | ND |
| 5917 | 205.6 | EXTENSIN (FRAGMENT). | sptrembl Q41645 | ND |
| 5918 | 205.6 | SYNTHASE OF THE TYPE 3 PNEUMOCOCCAL CAPSULAR POLYSACCHARIDE. | sptrembl P72520 | ND |
| 5919 | 205.5 | HYPOTHETICAL 15.6 KD PROTEIN C29B12.13 IN CHROMOSOME I. | sptrembl O14034 | ND |
| 5921 | 2041.4 | DNA-DEPENDENT RNA PDLYMERASE II RPB140 (FRAGMENT). | tremblnew AAF19066 | Transcription |
| 5922 | 204.9 | HYPOTHETICAL 47.0 KD PROTEIN C23H3.03C IN CHROMOSOME I. | sptrembl O42857 | ND |
| 5923 | 204.7 | HYDROXYPROLINE-RICH GLYCOPROTEIN DZ-HRGP PRECURSOR. | tremblnew CAB62280 | ND |
| 5924 | 204.7 | INTEGRAL MEMBRANE PROTEIN. | sptrembl Q9Y784 | ND |
| 5925 | 204.6 | TOL. | sptrembl O93882 | ND |
| 5926 | 204.2 | COSMID C33G8. | sptrembl Q18401 | ND |
| 5927 | 204.1 | RHO-LIKE PROTEIN C16A10.04. | sptrembl P87296 | ND |
| 5928 | 203.9 | C35E7.9 PROTEIN. | sptrembl Q61765 | ND |
| 5929 | 203.6 | PROBABLE MANNOSYLTRANSFERASE. | sptrembl O94565 | ND |
| 5930 | 203.2 | HYPOTHETICAL 45.7 KD PROTEIN IN RPS3-PSD1 INTERGENIC REGION. | swissprot P53883 | ND |
| 5931 | 203.1 | TRANSCRIPTIONAL FACTOR SWI5. | swissprot P08153 | ND |
| 5932 | 203.1 | PUTATIVE ATP SYNTHASE F CHAIN, MITOCHONDRIAL PRECURSOR. | sptrembl O94377 | ND |
| 5933 | 2025.1 | FIMBRIN (ABP67). | swissprot P32599 | ND |
| 5934 | 202.8 | PROTEOPHOSPHOGLYCAN (FRAGMENT). | sptrembl Q9Y075 | ND |

TABLE 3-continued

_Aspergillus oryzae_ ESTs

| Sequence Listing | zscore | Annotation | Database | Functional Category |
|---|---|---|---|---|
| 5935 | 202.7 | EXTENSIN PRECURSOR (CELL WALL HYDROXYPROLINE-RICH GLYCOPROTEIN). | swissprot P13983 | ND |
| 5936 | 202.7 | CLONING VECTOR PZERO-2T. | sptrembl O53022 | ND |
| 5937 | 202.4 | 60S RIBOSOMAL PROTEIN L37A (FRAGMENT). | swissprot O17307 | ND |
| 5938 | 202.2 | NUCLEAR PROTEIN SDK3 (FRAGMENT). | sptrembl O60899 | ND |
| 5939 | 202.2 | C12D12.1 PROTEIN. | sptrembl Q17921 | ND |
| 5940 | 202.1 | RNA BINDING PROTEIN (FRAGMENT). | tremblnew BAA83717 | ND |
| 5941 | 202.0 | CHROMOSOME XV READING FRAME ORF YOR306C. | sptrembl Q08777 | ND |
| 5942 | 201.5 | STEROL-C-METHYLTRANSFERASE. | sptrembl P74388 | ND |
| 5943 | 201.2 | SALIVARY PROLINE-RICH PROTEIN PRECURSOR (CLONES CP3, CP4 AND CP5) [CNNTAINS BASIC PEPTIDE IB-6; PEPTIDE P-H]. | swissprot P04280 | ND |
| 5944 | 201.2 | Banana ripening fruit Gluc. translated polypeptide. | geneseqp Y05839 | ND |
| 5945 | 201.1 | DNA-DIRECTEE RNA POLYMERASE II LARGEST SUBUNIT (EC 2.7.7.6) (RPBI) (FRAGMENT). | swissprot P11414 | ND |
| 5946 | 201.0 | GLYCERALDEHYDE-3-PHOSPHATE DEHYDOGENAE (FRAGMENT). | tremblnew CAB63214 | ND |
| 5947 | 200.7 | HYPOTHETICAL 26.5 KD PROTEIN IN FUS2-RNH1 INTERGENIC REGION. | swissprot Q05024 | ND |
| 5948 | 200.7 | KO9A9.6 PROTEIN. | sptrembl Q93178 | ND |
| 5949 | 200.6 | NITRATE REDUCTASE (EC 1.6.6.1) (NR). | swissprot P36841 | ND |
| 5950 | 200.6 | HYPOTHETICAL PROTEIN (FRAGMENT). | sptrembl Q12742 | ND |
| 5951 | 200.5 | PROLINE-RICH PROTEIN. | sptrembl Q64306 | ND |
| 5952 | 200.5 | HYPOTHETICAL 57.5 KD PROTEIN IN VMA7-RPS25A INTERGENIC REGION. | swissprot P53214 | ND |
| 5953 | 200.4 | RNA-BINDING PROTEIN FUS/TLS. | swissprot P35637 | ND |
| 5954 | 200.4 | HYPOTHETICAL PROTEIN MJ1187. | swissprot Q58588 | ND |
| 5955 | 200.3 | ADENYLYLCYCLASE. | tremblnew AAD50121 | ND |
| 5956 | 200.1 | HYPOTHETICAL PROTEIN MJ0301. | swissprot Q57749 | ND |
| 5957 | 200.1 | COMPLEX (DNA-BINDING PROTEIN/DNA) 155 aa, chain A. | pdb 2GL1 | ND |
| 5958 | 1996.1 | CHITIN SYNTHASE D (EC 2.4.1.16) (CHITIN-UDP ACETYL-GLUCOSAMINYL TRANSFERASE) (CLASS-V CHITIN SYNTHASE). | sptrembl O13281 | ND |
| 5959 | 199.8 | HYPOTHETICAL 41.6 KD PROTEIN (FRAGMENT). | sptrembl O94558 | ND |
| 5960 | 199.8 | Plasmid pRZTL1, Tetracycline resistance protein. | geneseqp Y42545 | ND |
| 5961 | 199.7 | HYPOTHETICAL 34.7 KD PROTEIN IN RHO3-HIS5 INTERGENIC REGION. | swissprot P40476 | ND |
| 5962 | 199.5 | WSC4 HOMOLOGUE. | sptrembl Q9Y849 | ND |
| 5963 | 199.5 | NUCLEOLIN (PROTEIN C23). | swissprot P19338 | ND |

TABLE 3-continued

*Aspergillus oryzae* ESTs

| Sequence Listing | zscore | Annotation | Database | Functional Category |
|---|---|---|---|---|
| 5964 | 199.5 | RNA BINDING PROTEIN (FRAGMENT). | tremblnew BAA83717 | ND |
| 5965 | 199.1 | SIMILARITY TO COLLAGENS. | sptrembl O02123 | ND |
| 5966 | 199.0 | COS46.3. | sptrembl P91589 | ND |
| 5967 | 199.0 | EXTENSIN (FRAGMENT). | sptrembl Q41645 | ND |
| 5968 | 199.0 | HYPOTHETICAL PROTEIN (FRAGMENT). | tremblnew BAA87194 | ND |
| 5969 | 1986.0 | ARGINASE (EC 3.5.3.1). | swissprot Q12611 | Amino acid transport and metabolism |
| 5970 | 1985.6 | FATTY ACID SYNTHASE, BETA SUBUNIT. | sptrembl P78616 | ND |
| 5971 | 198.9 | DNA BINDING PROTEIN NSDD. | sptrembl Q92226 | ND |
| 5972 | 198.8 | HYPOTHETICAL 40.3 KD PROTEIN. | sptrembl O69481 | ND |
| 5973 | 198.8 | HYDROXYPROLINE-RICH GLYCOPROTEIN. | sptrembl Q41814 | ND |
| 5974 | 198.5 | CTR9 PROTEIN. | swissprot P89105 | ND |
| 5975 | 198.1 | F32D1.2 PROTEIN. | sptrembl O16298 | ND |
| 5976 | 198.0 | PLENTY-OF-PROLINES-101. | sptrembl O70495 | ND |
| 5977 | 1978.8 | GLUTAMINE SYNTHETASE (EC 6.3.1.2) (GLUTAMATE--AMMONIA LIGASE). | swissprot Q12613 | Amino acid transport and metabolism |
| 5978 | 197.9 | TRANSLATION INITIATION FACTOR IF-3. | swissnew O67653 | ND |
| 5979 | 197.8 | K02F3.4 PROTEIN. | tremblnew AAA50709 | ND |
| 5080 | 197.8 | HYPOTHETICAL 45.6 KD PROTEIN C29A3.03C IN CHROMOSOME II. | sptrembl O59668 | ND |
| 5981 | 1965.3 | MITOCHONDRIAL PROCESSING PEPTIDASE BETA SUBUNIT PRECURSOR (EC 3.4.24.64) (BETA-MPP) (UBIQUINOL-CYTOCHROME C REDUCTASE COMPLEX CORE PROTEIN 1) (EC 1.10.2.2). | swissprot P11913 | ND |
| 5982 | 196.8 | HYPOTHETICAL 75.4 KD PROTEIN. | tremblnew AAF04882 | ND |
| 5983 | 196.6 | LONGEVITY-ASSURANCE PROTEIN 1 (LONGEVITY ASSURANCE FACTOR 1). | swissprot P78970 | ND |
| 5984 | 196.4 | YLR391W-AP. | sptrembl O13547 | ND |
| 5985 | 1958.9 | NAD(-)-ISOCITRATE DEHYDROGENASE SUBUNIT I PRECURSOR. | sptrembl O13302 | Amino acid transport and metabolism |
| 5986 | 1958.6 | HEAT SHOCK PROTEIN 70. | sptrembl O93866 | Posttranslational modification, protein turnover, chaperones |
| 5987 | 195.8 | F4P13.11 PROTEIN. | tremblnew AAF01541 | ND |
| 5988 | 195.6 | CHROMOSOME XII COSMID 8003. | sptrembl Q05874 | ND |
| 5989 | 195.6 | U86. | tremblnew AAD49674 | ND |
| 5990 | 195.6 | ZP2 (CLONE C692). | sptrembl Q90354 | ND |
| 5991 | 195.5 | SORTING NEXIN 8. | sptrembl Q9Y5X2 | ND |
| 5992 | 195.5 | HYPOTHETICAL 23.9 KD PROTEIN IN COQ1-FLR1 INTERGENIC REGION. | swissprot P38212 | ND |
| 5993 | 195.2 | MUCIN. | sptrembl Q63549 | ND |
| 5994 | 195.2 | PROTEASE B INHIBITORS 2 AND 1 (PROTEINASE INHIBITOR 1(B)2). | swissprot P01095 | ND |
| 5995 | 195.2 | F21E10.7 PROTEIN. | sptrembl O65245 | ND |
| 5996 | 195.2 | NUCLEOLIN (PROTEIN). | swissprot P08199 | ND |
| 5997 | 195.0 | *C. albicans* antigenic protein 3. | geneseqp Y06927 | ND |

TABLE 3-continued

*Aspergillus oryzae* ESTs

| Sequence Listing | zscore | Annotation | Database | Functional Category |
|---|---|---|---|---|
| 5998 | 1946.7 | ADP,ATP CARRIER PROTEIN (ADP/ATP TRANSLOCASE) (ADENINE NUCLEOTIDE TRANSLOCATOR) (ANT). | swissprot P02723 | ND |
| 6000 | 194.8 | HYPOTHETICAL 71.2 KD MEMBRANE PROTEIN C17G6.01 IN CHROMOSOME I. | sptrembl O13779 | ND |
| 6001 | 194.7 | 3-OXOACYL-[ACYL-CARRIER-PROTEIN]-REDUCTASE. | sptrembl O42774 | ND |
| 6002 | 194.7 | SEX DETERMINATION PROTEIN TASSELSEED 2. | swissprot P50160 | ND |
| 6003 | 194.1 | EXTENSIN CLASS I1 PRECURSOR (CELL WALL HYDROXYPROLINE-RICH GLYCOPROTEIN) (HRGP) (TOML-4). | sptrembl Q09084 | ND |
| 6004 | 194.1 | (VSP-3) PRECURSOR. | sptrembl Q39620 | ND |
| 6005 | 194.0 | NADH OXIDASE. | sptrembl Q9WYL1 | ND |
| 6006 | 1934.3 | HOMOACONITASE PRECURSOR (EC 4.2.1.36) (HOMOACONITATE HYDRATASE). | swissprot Q92412 | Energy production and conversion |
| 6007 | 193.9 | HYPOTHETICAL 25.3 KD PROTEIN C2C4.09 IN CHROMOSOME I. | sptrembl O14042 | ND |
| 6008 | 193.9 | SPORE COAT PROTEIN SP96. | swissprot P14328 | ND |
| 6009 | 193.8 | NADH-UBIQUINONE OXIDOREDUCTASE CHAIN 5 (EC 1.6.5.3). | swissprot P04540 | ND |
| 6010 | 193.8 | H14E04.2A PROTEIN. | tremblnew AAD12809 | ND |
| 6011 | 193.8 | MUCIN-LIKE PROTEIN. | sptrembl O77242 | ND |
| 6012 | 193.8 | WD REPEAT PROTEIN. | tremblnew CAB54817 | ND |
| 6013 | 193.7 | HYPOTHETICAL 46.2 KD PROTEIN. | tremblnew CAB36521 | ND |
| 6014 | 193.7 | WSC4 HOMOLOGUE. | sptrembl Q9Y849 | ND |
| 6015 | 193.6 | LATENT NUCLEAR ANTIGEN. | sptrembl Q9WRM2 | ND |
| 6016 | 193.5 | HYDROXYPROLINE-RICH GLYCOPROTEIN DZ-HRGP PRECURSOR. | tremblnew CAB62280 | ND |
| 6017 | 193.3 | HYPOTHETICAL 43.5 KD PROTEIN IN RPB9-ALG2 INTERGENIC REGION. | swissprot P53164 | ND |
| 6018 | 193.1 | EYELID. | sptrembl O61603 | ND |
| 6019 | 193.0 | HYPOTHETICAL 72.4 KD PROTEIN IN PTP3-ILV1 INTERGENIC REGION. | swissprot P40053 | ND |
| 6020 | 1920.0 | HOMOGENTISATE 1,2-DIOXYGENASE (EC 1.13.11.5) (HOMOGENTISICASE) (HOMOGENTISATE OXYGENASE) (HOMOGENTISIC ACID OXIDASE). | swissprot Q00667 | ND |
| 6021 | 192.9 | HYPOTHETICAL 45.2 KD PROTEIN. | sptrembl Q9YPA9 | ND |
| 6022 | 192.8 | HYPOTHETICAL 64.5 KD PROTEIN IN COX4-GTS1 INTERGENIC REGION. | swissprot P53099 | ND |
| 6023 | 192.5 | HAPB. | sptrembl O59847 | ND |
| 6024 | 192.4 | MPV17 PROTEIN. | swissprot P19258 | ND |
| 6025 | 192.0 | MEROZOITE SURFACE PROTEIN-1 (FRAGMENT). | sptrembl O00879 | ND |

TABLE 3-continued

*Aspergillus oryzae* ESTs

| Sequence Listing | zscore | Annotation | Database | Functional Category |
|---|---|---|---|---|
| 6027 | 1910.6 | GLUCOAMYLASE PRECURSOR (EC 3.2.1.3) (GLUCAN 1,4-ALPHA-GLUCOSIDASE) (1,4-ALPHA-D-GLUCAN GLUCOHYDROLASE). | swissprot P36914 | ND |
| 6028 | 191.9 | HYPOTHETICAL 34.8 KD PROTEIN YDL037C. | sptrembl Q12140 | ND |
| 6029 | 191.9 | HYPOTHETICAL 18.8 KD PROTEIN C25H2.09 IN CHROMOSOME II. | swissprot P87150 | ND |
| 6030 | 191.8 | MUCIN (FRAGMENT). | sptrembl Q14888 | ND |
| 6031 | 191.4 | HYPOTHETICAL CALCIUM-BINDING PROTEIN C18B11.04 IN CHROMOSOME I. | swissprot Q09711 | ND |
| 6032 | 191.2 | PROTEOPHOSPHOGLYCAN PRECURSOR (FRAGMENT). | sptrembl Q9Y076 | ND |
| 6033 | 191.1 | F23N19.12. | tremblnew AAF19547 | ND |
| 6034 | 190.9 | YGH1.2 (FRAGMENT). | sptrembl Q91457 | ND |
| 6035 | 190.9 | STB5 PROTEIN. | swissprot P38699 | ND |
| 6036 | 190.8 | INTEGRIN BETA SUBUNIT. | sptrembl O97343 | ND |
| 6037 | 190.8 | HYDROXYPROLINE-RICH GLYCOPROTEIN PRECURSOR. | sptrembl Q41719 | ND |
| 6038 | 190.8 | KEXIN-LIKE SERINE ENDOPROTEASE (FRAGMENT). | tremblnew AAF21601 | ND |
| 6039 | 190.8 | PAROTID 'O' PROTEIN (FRAGMENT). | sptrembl O00600 | ND |
| 6040 | 190.8 | EXTENSIN. | sptrembl Q40503 | ND |
| 6041 | 190.6 | PROLINE-RICH PROTEIN MP-3 (FRAGMENT). | swissprot P05143 | ND |
| 6042 | 190.4 | Pig leukocyte prophenin peptide Proph1. | geneseqp R82569 | ND |
| 6043 | 190.4 | SALIVARY GLUE PROTEIN SGS-3 PRECURSOR. | swissprot P13728 | ND |
| 6044 | 190.3 | PROTEOPHOSPHOGLYCAN (FRAGMENT). | sptrembl Q9Y075 | ND |
| 6045 | 190.3 | (VSP-3) PRECURSOR. | sptrembl Q39620 | ND |
| 6046 | 190.2 | HIGH MOLECULAR WEIGHT BASIC NUCLEAR PROTEIN (FRAGMENT). | sptrembl Q91238 | ND |
| 6047 | 190.1 | ARGININE-RICH 54 KD NUCLEAR PROTEIN. | sptrembl Q05519 | ND |
| 6048 | 1899.3 | PEROXISOMAL HYDRATASE-DEHYDROGENASE-EPIMERASE (HDE) (MULTIFUNCTIONAL BETA-OXIDATION PROTEIN) (MFP) [INCLUDES: 2-ENOYL-COA HYDRATASE (EC 4.2.1.-): D-3-HYDROXYACYL COA DEHYDROGENASE (EC 1.1.1.-)]. | swissnew Q01373 | ND |
| 6049 | 189.9 | SALIVARY PROLINE-RICH PROTEIN PO PRECURSOR (ALLELE S). | swissprot P10163 | ND |
| 6050 | 189.8 | 36.4 KD PROLINE-RICH PROTEIN. | swissprot Q00451 | ND |
| 6051 | 189.7 | RIBOSOMAL PROTEIN L38 (FRAGMENT). | tremblnew BAA25844 | ND |
| 6052 | 189.6 | JASMONATE INDUCIBLE PROTEIN ISOLOG. | sptrembl O04310 | ND |
| 6053 | 189.5 | MUCIN 10. SUBMANDIBULAR GLAND SALIVARY MUCIN PRECURSOR (MUCIN APOPROTEIN). | sptrembl Q61002 | ND |

TABLE 3-continued

*Aspergillus oryzae* ESTs

| Sequence Listing | zscore | Annotation | Database | Functional Category |
|---|---|---|---|---|
| 6054 | 189.4 | TRANSLATION INITIATION PROTEIN-BELONGS TO THE SUA5-YRDC-YCIO-YWLC FAMILY. | sptrembl O94530 | ND |
| 6055 | 189.4 | LOW MOLECULAR WEIGHT GLUTENIN (FRAGMENT). | sptrembl Q41551 | ND |
| 6056 | 189.3 | PROLINE-RICH PROTEIN. | sptrembl Q64306 | ND |
| 6057 | 189.0 | A TRIAL-SPECIFIC MYOSIN HEAVY-CHAIN (FRAGMENT). | sptrembl Q90767 | ND |
| 6058 | 188.7 | HYPOTHETICAL 45.3 KD PROTEIN. | sptrembl O74840 | ND |
| 6059 | 188.5 | PROLINE RICH PROTEIN PRECURSOR. | sptrembl Q43558 | ND |
| 6060 | 188.1 | SERINE THEONINE PROTEIN KINASE. | tremblnew | ND |
| 6061 | 187.9 | MORPHOGENESIS-RELATED PROTEIN (MULTICOPY SUPPRESSION OF A BUDDING DEFECT I). | swissprot P21339 | ND |
| 6062 | 187.8 | F58A3.1B PROTEIN. | sptrembl Q93807 | ND |
| 6063 | 187.7 | HYPOTHETICAL BROMODOMAIN CONTAINING PROTEIN. | sptrembl O74350 | ND |
| 6064 | 187.6 | HYPOTHETICAL 36.9 KD PROTEIN C02D5.2 IN CHROMOSOME III. | swissprot P34276 | ND |
| 6065 | 1868.6 | SONA. | sptrembl O74224 | ND |
| 6067 | 860.7 | GLUTAMIC ACID DECARBOXYLASE. | tremblnew BAA88152 | Amino acid transport and metabolism |
| 6068 | 1860.0 | F57B10.3 PROTEIN. | sptrembl O44742 | Carbohydrate transport and metabolism |
| 6069 | 186.8 | GLUE PROTEIN. | sptrembl Q27423 | ND |
| 6070 | 186.8 | KIAA0595 PROTEIN (FRAGMENT). | sptrembl Q9Y4E0 | ND |
| 6071 | 186.8 | *Cereospora kikuchii* membrane pump protein. | geneseqp W35808 | ND |
| 6072 | 186.8 | MEMBRANE COMPONENT, CHROMOSOME 17, SURFACE MARKER 2 (OVARIAN CARCINOMA ANTIGEN CA125) (IA1-3B) (KIAA0049). | swissprot Q14596 | ND |
| 6073 | 186.8 | WP6 PRECURSOR. | sptrembl Q39492 | ND |
| 6074 | 186.6 | DNA-DIRECTED RNA POLYMERASE II LARGEST SUBUNIT (EC 2.7.7.6). | swissprot P16356 | ND |
| 6075 | 186.6 | COMES FROM THIS GENE. | sptrembl O23054 | ND |
| 6076 | 186.5 | AT2G11910 PROTEIN. | tremblnew AAD22502 | ND |
| 6077 | 186.1 | ADENOMATOSIS POLYPOSIS COLI (APC) (BALB/C APC). | sptrembl Q61315 | ND |
| 6078 | 186.0 | PROTEOPHOSPROGLYCAN (FRAGMENT). | sptrembl Q9Y075 | ND |
| 6079 | 1854.7 | TRANSCRIPTION INITIATION FACTOR TFIID (TATA-BOX FACTOR) (TATA SEQUENCE-BINDING PROTEIN) (TBP). | swissprot Q12731 | Transcription |
| 6080 | 185.8 | DJ37E16.2 PROTEIN. | sptrembl Q9Y3L3 | ND |
| 6081 | 185.7 | HYPOTHETICAL 30.6 KD PROTEIN. | sptrembl O94440 | ND |
| 6082 | 185.6 | CAPSULAR ASSOCIATED PROTEIN. | sptrembl Q9Y8B9 | ND |
| 6083 | 185.6 | HACI PROTEIN. | swissnew P41546 | ND |
| 6084 | 185.2 | CANDIDAPFPSIN 3 PRECURSOR (EC 3.4.23.24) (ASPARTATE PROTEASE 3) (ACP 3) (SECRETED ASPARTIC PROTEASE 3). | swissprot P43092 | ND |

TABLE 3-continued

*Aspergillus oryzae* ESTs

| Sequence Listing | zscore | Annotation | Database | Functional Category |
|---|---|---|---|---|
| 6085 | 185.0 | GLUTATHIONE S-TRANSFERASE 1 (EC 2.5.1.18) (GST CLASS-THETA). | swissprot P28342 | ND |
| 6086 | 1841.8 | FATTY ACID SYNTHASE, ALPHA SUBUNIT. | sptrembl P78615 | Lipid metabolism |
| 6087 | 184.9 | PROTEIN PHOSPHATASE 2C HOMOLOG 3 (EC 3.1.3.16) (PP2C-3). | swissprot Q09173 | ND |
| 6088 | 184.7 | PUTATIVE IMPORTIN ALPHA SUBUNIT (FRAGMENT). | tremblnew BAA87276 | ND |
| 6089 | 184.6 | HYPOTHETICAL 69.2 KD PROTEIN IN HSP30-PMP1 INTERGENIC REGION. | swissprot P25351 | ND |
| 6090 | 184.6 | RNA BINDING PROTEIN (FRAGMENT). | tremblnew BAA83714 | ND |
| 6091 | 184.3 | HYPOTHETICAL PROTEIN IN LEU2 3'REGION (FRAGMENT). | swissprot P34735 | ND |
| 6092 | 184.3 | REGION B OF COSMID SCY07H7. | sptrembl O06266 | ND |
| 6093 | 184.1 | VIRAL PROTEIN TPX. | swissprot P19275 | ND |
| 6094 | 184.1 | SON OF SEVENLESS PROTEIN HOMOLOG 1 (SOS-1) (MSOS-1). | swissprot Q62245 | ND |
| 6095 | 184.0 | PROTEOPHOSPHOGLYCAN (FRAGMENT). | sptrembl Q9Y075 | ND |
| 6096 | 1839.9 | HYPOTHETICAL 44.3 KD PROTEIN C27E2.03C IN CHROMOSOME I. | sptrembl O13998 | ND |
| 6097 | 1832.6 | PUTATIVE DISULFIDE ISOMERASE TIGA PRECURSOR (EC 5.3.4.1). | swissprot Q00216 | ND |
| 6098 | 1830.2 | CYSTEIN RICH PROTEIN. | sptrembl O13319 | ND |
| 6099 | 183.9 | DENTIN PHOSPHOPROTEIN PRECURSOR. | sptrembl P70578 | ND |
| 6100 | 183.9 | EXTENSIN-LIKE PROTEIN. | tremblnew CAB40774 | ND |
| 6101 | 183.9 | HU1-70K SMALL NUCLEAR RNP PROTEIN (RNP12) (FRAGMENT). | sptrembl P78494 | ND |
| 6102 | 183.8 | HYPOTHETICAL 35.1 KD PROTEIN. | tremblnew CAB38264 | ND |
| 6103 | 183.7 | PUTATIVE CARBOXYPEPTIDASE. | sptrembl Q9X7P4 | ND |
| 6104 | 183.7 | HYPOTHETICAL 113.1 KD PROTEIN IN PRE5-FET4 INTERGENIC REGION. | swissprot Q04893 | ND |
| 6105 | 183.7 | *Mycobacterium tuberculosis* antigen TbH-30. | geneseqp W64360 | ND |
| 6106 | 183.6 | PROTEOPHOSPHOGLYCAN (FRAGMENT). | sptrembl Q9Y075 | ND |
| 6107 | 183.4 | PLENTY-OF-PROLINES-101. | sptrembl O70495 | ND |
| 6108 | 183.4 | NITROGEN METABOLITE REPRESSION REGULATOR NMRA. | sptrembl O59919 | ND |
| 6109 | 183.4 | ME12 protein kinase PATI encoded by AR301. | geneseqp W00160 | ND |
| 6110 | 183.3 | GENOME, PARTIAL SEQUENCE. | sptrembl Q84529 | ND |
| 6111 | 183.2 | LARGE TEGUMENT PROTEIN. | swissprot P03186 | ND |
| 6112 | 182.9 | PREDICTED PROTEIN OF UNKNOWN FUNCTION. | sptrembl O22758 | ND |
| 6113 | 182.6 | HYPOTHETICAL 28.3 KD PROTEIN IN AROD-COMER INTERGENIC REGION. | swissprot P54458 | ND |
| 6114 | 182.6 | SALIVARY PROLINE-RICH PROTEIN RP15 PRECURSOR. | sptrmnbl Q04154 | ND |

TABLE 3-continued

*Aspergillus oryzae* ESTs

| Sequence Listing | zscore | Annotation | Database | Functional Category |
|---|---|---|---|---|
| 6115 | 182.5 | MITOCHONDRIAL OUTER MEMBRANE PROTEIN MMM1. | swissprot P41800 | ND |
| 6116 | 182.3 | EXTENSIN=NODULE-SPFCIFIC PROLINE-RICH PROTEIN {CLONE VENDS-E}. | tremblnew G425682 | ND |
| 6117 | 182.3 | F24K9.9 PROTEIN. | tremblnew AAF00656 | ND |
| 6118 | 182.1 | DNA-DIRECTED RNA POLYMERASE II LARGE (205 KD) SUBUNIT (EC 2.7.7.6) (FRAGMENT). | sptrembl Q99368 | ND |
| 6119 | 182.0 | AT2G42310 PROTEIN. | tremblnew AAD23714 | ND |
| 6120 | 1812.2 | G PROTEIN ALPHA SUBUNIT HOMOLOG GANAP. | sptrembl Q9Y7E3 | ND |
| 6121 | 1810.8 | MEDUSA. | sptrembl Q74251 | ND |
| 6122 | 1810.1 | ISOCITRATE LYASE (EC 4.1.3.1) (ISOCITRASE) (ISOCITRATASE) (ICL). | swissprot P28298 | Energy production and conversion |
| 6123 | 181.8 | PUTATIVE GLUCOSAMINE--FRUCTOSE-6-PHOSPHATE AMINOTRANSFERASE [ISOMERIZING] (EC 2.6.1.16) (HEXOSEPHOSPHATE AMINOTRANSFERASE) (D-FRUCTOSE-6-PHOSPHATE AMIDOTRANSFERASE) (GRA1). | swissprot Q09740 | ND |
| 6124 | 181.8 | HYPOTHETICAL 15.8 KD PROTEIN IN SM11-PHO81 INTERGENIC REGION. | swissprot P50084 | ND |
| 6125 | 181.7 | NTR. | tremblnew AAF23950 | ND |
| 6126 | 181.6 | HYPOTHETICAL 15.6 KD PROTEIN C29B12.13 IN CHROMOSOME I. | sptrembl O14034 | ND |
| 6127 | 181.6 | QUINATE PERMEASE (QUINATE TRANSPORTER). | swissprot P15325 | ND |
| 6128 | 181.4 | HYPOTHETICAL 15.2 KD PROTEIN. | sptrembl Q9X118 | ND |
| 6129 | 181.3 | *M. tuberculosis* antigen TbH-30 amino acid sequence. | geneseqp Y39157 | ND |
| 6130 | 181.1 | EXTENSIN PRECURSOR (CELL WALL HYDROXYPROLINE-RICH GLYCOPROTEIN). | swissprot P13983 | ND |
| 6131 | 181.1 | PUTATIVE SNRNP PROTEIN. | tremblnew CAB45810 | ND |
| 6132 | 181.0 | CEOA. | sptrembl O06470 | ND |
| 6133 | 1809.7 | GENERAL AMINO-ACID PERMEASE GAP1. | swissprot P19145 | Amino acid transport and metabolism |
| 6134 | 1801.9 | *Aspergillus oryzae* alpha-glucosidase. | geneseqp W15191 | ND |
| 6135 | 180.9 | C-HORDEIN. | sptrembl Q41210 | ND |
| 6136 | 180.9 | TRFA. | sptrembl O77033 | ND |
| 6137 | 180.0 | HIGH MOLECULAR WEIGHT BASIC NUCLEAR PROTEIN (FRAGMENT). | sptrembl Q91238 | ND |
| 6138 | 180.9 | Human breast tumour-associated protein 62. | geneseqp Y48517 | ND |
| 6139 | 180.6 | SPLICEOSOME ASSOCIATED PROTEIN 49 (SAP 49) (SF3B53). | swissprot Q15427 | ND |
| 6140 | 180.5 | PUTATIVE VICILIN STORAGE PROTEIN (GLOBULIN-LIKE). | sptrembl Q9ZU69 | ND |
| 6141 | 180.5 | Fragment of human secreted protein encoded by gene 79. | geneseqp Y41541 | ND |

TABLE 3-continued

_Aspergillus oryzae_ ESTs

| Sequence Listing | zscore | Annotation | Database | Functional Category |
|---|---|---|---|---|
| 6142 | 180.4 | PROBABLE MONOOXYGENASE RV0892 (EC 1.14.13.-). | swissnew Q10532 | ND |
| 6143 | 180.2 | HYPOTHETICAL 50.3 KD PROTEIN. | tremblnlnew CAB55170 | ND |
| 6144 | 180.1 | _Mycobacterium species_ protein sequence 5C'. | geneseqp Y04776 | ND |
| 6145 | 1791.2 | GLUCOSE-6-PHOSPHATE 1-DEHYDROGENASE (EC 1.1.1.49) (G6PD). | swissprot P48826 | Carbohydrate transport and metabolism |
| 6146 | 1790.6 | PHOSPHOENOLPYRUVATE CARBOXYKINASE [ATP] (EC 4.1.1.49). | swissprot O43112 | Energy production and conversion |
| 6147 | 179.8 | SERINE 2 ULTRA HIGH SULFUR PROTEIN. | sptrembl Q62220 | ND |
| 6148 | 179.4 | CYCLOPHILIN-RELATED PROTEIN. | tremblnew AAA35734 | ND |
| 6149 | 179.3 | PROLINE-RICH PROTEIN. | sptrembl Q64306 | ND |
| 6150 | 178.9 | HYPOTHETICAL PROTEIN C30B4.01C IN CHROMOSOME II (FRAGMENT). | sptrembl P87179 | ND |
| 6151 | 178.5 | PISTIL-SPECIFIC EXTENSIN-LIKE PROTEIN (FRAGMENT). | sptrembl Q40552 | ND |
| 6152 | 178.4 | RNA BINDING PROTEIN (FRAGMENT). | tremblnew BAA83714 | ND |
| 6153 | 178.3 | GLUE PROTEIN. | sptrembl Q27929 | ND |
| 6154 | 178.2 | HYPOTHETICAL 14.0 KD PROTEIN IN RLP15B-GCR3 INTERGENIC REGION. | swissprot Q03880 | ND |
| 6155 | 178.1 | EXTENSIN-LIKE PROTEIN. | tremblnew CAB37452 | ND |
| 6156 | 178.0 | YFKN PROTEIN. | sptrembl O34313 | ND |
| 6157 | 178.0 | GAMMA-BUTYROBETAINE,2-OXOGLUTARATE DIOXYGENASE (EC 1.14.11.1) (GAMMA-BUTYROBETAINE HYDROXYLASE) (GAMMA-BBH). | swissprot P80193 | ND |
| 6158 | 1771.1 | ALTERNATIVE OXIDASE PRECURSOR (EC 1.-.-.-). | swissnew O74180 | ND |
| 6159 | 177.9 | AP-1-LIKE TRANSCRIPTION FACTOR. | tremblnew CAB66170 | ND |
| 6160 | 177.9 | HYPOTHETICAL 118.4 KD PROTEIN IN BAT2-DAL5 INTERGENIC REGION PRECURSOR. | swissprot P47179 | ND |
| 6161 | 177.8 | HYPOTHETICAL STRUCTURAL PROTEIN. | tremblnew CAB53076 | ND |
| 6162 | 177.6 | HYPOTHETICAL 77.4 KD PROTEIN. | sptrembl O65530 | ND |
| 6163 | 177.6 | EXTENSIN (FRAGMENT). | sptrembl Q41645 | ND |
| 6164 | 177.4 | HYPOTHETICAL 14.0 KD PROTEIN. | sptrembl O74383 | ND |
| 6165 | 177.4 | EXTENSIN (FRAGMENT). | sptrembl Q41645 | ND |
| 6166 | 177.2 | FROM BASES 2561111 TO 2573808 (SECTION 222 OF 400) OF THE COMPLETE GENOME (SECTION 222 OF 400). | sptrembl P76555 | ND |
| 6167 | 177.1 | PEARLI I-LIKE PROTEIN. | tremblnew CAB41720 | ND |
| 6168 | 177.1 | TRANSCRIPTION FACTOR ZFM1. | sptrembl Q15637 | ND |
| 6169 | 177.0 | CORE PROTEIN. | sptrembl Q64807 | ND |
| 6170 | 177.0 | GASTRIC MUCIN (FRAGMENT). | sptrembl Q29070 | ND |
| 6171 | 177.0 | EXTENSIN (FRAGMENT). | sptrembl Q41645 | ND |
| 6172 | 1764.6 | _Aspergillus oryzae_ porphobilinogen synthase. | geneseqp W30558 | Coenzyme metabolism |

TABLE 3-continued

_Aspergillus oryzae_ ESTs

| Sequence Listing | zscore | Annotation | Database | Functional Category |
|---|---|---|---|---|
| 6173 | 1760.0 | CITRATE SYNTHASE, MITOCHONDRIAL PRECURSOR (EC 4.1.3.7). | swissprot P51044 | Energy production and conversion |
| 6174 | 176.8 | Human complement factor CR4 vWF domain sequence. | geneseqp Y21992 | ND |
| 6175 | 176.8 | GASTRIC MUCIN (FRAGMENT). | sptrembl Q29070 | ND |
| 6176 | 176.7 | C24B5.5 PROTEIN. | tremblnew AAD31546 | ND |
| 6177 | 176.7 | PROTEOPHOSPHOGLYCAN PRECURSOR (FRAGMENT). | sptrembl Q9Y076 | ND |
| 6178 | 176.4 | SPLICING FACTOR, ARGININE/SERINE-RICH 8 (SUPPRESSOR OF WHITE APRICOT PROTEIN HOMOLOG). | swissprot Q12872 | ND |
| 6179 | 176.3 | EXTENSIN. | sptrembl Q39599 | ND |
| 6180 | 176.3 | PROLINE-RICH MUCIN HOMOLOG. | sptrembl Q9XDH2 | ND |
| 6181 | 176.3 | PROTEOPHOSPHOGLYCAN (FRAGMENT). | sptrembl Q9Y075 | ND |
| 6182 | 176.2 | HYPOTHETICAL 41.5 KD PROTEIN. | tremblnew CAB66198 | ND |
| 6183 | 176.2 | AP-1-LIKE TRANSCRIPTION FACTOR. | swissprot P56095 | ND |
| 6184 | 1750.0 | PUTATIVE ATP-CITRATE (PRO-S-)-LYASE (EC 4.1.3.8) (CITRATE CLEAVAGE ENZYME). | sptrembl O13907 | ND |
| 6185 | 175.9 | SF16 ISOLOG. | sptrembl O22835 | ND |
| 6186 | 175.5 | HEPATITIS A VIRUS RECEPTOR. | sptrembl O18984 | ND |
| 6187 | 175.4 | HYPOTHETICAL 52.3 KD PROTEIN IN MRPL10-ERG24 INTERGENIC REGION PRECURSOR. | swissprot P53832 | ND |
| 6188 | 175.3 | F19G14.12 PROTEIN. | sptrembl Q9X1L9 | ND |
| 6189 | 175.3 | HYPOTHETICAL 59.4 KD PROTEIN. | sptrembl Q89392 | ND |
| 6190 | 174.9 | PUTATIVE TRANSCRIPTIONAL ACTIVATOR. | tremblnew CAB59617 | ND |
| 6191 | 174.8 | MRNA EXPRESSED IN CUCUMBER HYPOCOTYLS, COMPLETE CDS. | sptrembl Q9X1V1 | ND |
| 6192 | 174.7 | _Teredinibacter_ endoglucanase. | geneseqp W34989 | ND |
| 6193 | 174.7 | PLENTY-OF-PROLINES-101. | sptrembl O70495 | ND |
| 6194 | 174.6 | KIAA0396 (FRAGMENT). | sptrembl O43146 | ND |
| 6195 | 174.6 | HYPOTHETICAL PROLINE-RICH PROTEIN (FRAGMENT). | swissprot P21260 | ND |
| 6196 | 174.0 | P210 PROTEIN (FRAGMENT). | sptrembl Q9XGA4 | ND |
| 6197 | 174.2 | Helix modification recognition protein HmpI. | geneseqp W19120 | ND |
| 6198 | 174.0 | Human alternatively spliced ETS2 repressor factor (AFRF). | geneseqp W07701 | ND |
| 6199 | 1736.2 | ACETAMIDASE REGULATORY PROTEIN. | swissprot Q06157 | ND |
| 6200 | 173.9 | HEPATITIS A VIRUS CELLULAR RECEPTOR I LONG FORM (HEPATITIS A VIRUS CELLULAR RECEPTOR I SHORT FORM). | sptrembl O46597 | ND |
| 6201 | 173.9 | TYROSINE-PROTEIN KINASE RECEPTOR HE-1 PRECURSOR (EC 2.7.1.112). | swissprot Q06806 | ND |
| 6202 | 173.9 | EXTENSIN. | sptrembl Q39599 | ND |

TABLE 3-continued

*Aspergillus oryzae* ESTs

| Sequence Listing | zscore | Annotation | Database | Functional Category |
|---|---|---|---|---|
| 6203 | 173.9 | PUTATIVE SPINDLE POLE BODY COMPONENT, PUTATIVE GAMMA-TUBULIN INTERACTING PROTEIN, YEAST SCP98 HOMOLOG (FRAGMENT). | sptrembl O94366 | ND |
| 6204 | 173.9 | F35E2.5 PROTEIN. | sptrembl O62223 | ND |
| 6205 | 173.9 | PUTATIVE. | sptrembl Q9ZKY5 | ND |
| 6206 | 173.8 | HYPOTHETICAL 76.9 KD PROTEIN. | sptrembl O43085 | ND |
| 6207 | 173.8 | PROTEOPHOSPHOGLYCAN (FRAGMENT). | sptrembl Q9Y075 | ND |
| 6208 | 173.8 | FIBROIN-4 (FRAGMENT). | sptrembl Q16988 | ND |
| 6209 | 173.7 | PISTIL-SPECIFIC EXTENSIN-LIKE PROTEIN PRECURSOR (PELP). | swissprot Q03211 | ND |
| 6210 | 173.6 | ANOTHER TRANSCRIPTION UNIT PROTEIN (ATU). | sptrembl Q94546 | ND |
| 6211 | 173.6 | (VSP-3) PRECURSOR. | sptrembl Q39620 | ND |
| 6212 | 173.5 | SER/ARG-RELATED NUCLEAR MATRIX PROTEIN. | sptrembl O60585 | ND |
| 6213 | 173.5 | MUCIN 2 PRECURSOR (INTESTINAL MUCIN 2). | swissprot Q02817 | ND |
| 6214 | 173.4 | WP6 PRECURSOR. | sptrembl Q39492 | ND |
| 6215 | 173.3 | SALIVARY PROLINE-RICH PROTEIN RP4 PRECURSOR. | sptrembl Q04117 | ND |
| 6216 | 173.3 | Fragmented human NF-II gene +2 frameshift mutant product. | geneseqp W18663 | ND |
| 6217 | 173.2 | K09A9.6 PROTEIN. | sptrembl Q93178 | ND |
| 6218 | 173.1 | PENICILLIN-BINDING PROTEIN 1. | tremblnew AAF10059 | ND |
| 6219 | 173.1 | MICROTUBULE-ASSOCIATED PROTEIN 4 (FRAGMENT). | sptrembl Q95906 | ND |
| 6220 | 173.0 | HYPOTHETICAL PROTEIN C30B4.01C IN CHROMOSOME II (FRAGMENT). | sptrembl P87179 | ND |
| 6221 | 173.0 | HYPOTHETICAL 29.3 KD PROTEIN (ORF92). | swissprot O10341 | ND |
| 6222 | 1725.6 | TIP49. | sptrembl O35753 | DNA replication, recombination and repair |
| 6223 | 172.9 | HYPERPOLARIZATION-ACTIVATED CATION CHANNEL, HAC1. | sptrembl O88703 | ND |
| 6224 | 172.8 | P40E10.1 PROTEIN. | sptrembl Q20200 | ND |
| 6225 | 172.8 | TRANSCRIPTION FACTOR RCC/EPB-1. | sptrembl Q91294 | ND |
| 6226 | 172.8 | DNA-DIRECTED RNA POLYMERASE II LARGE (205 KD) SUBUNIT (EC 2.7.7.6) (FRAGMENT). | sptrembl Q99366 | ND |
| 6227 | 172.7 | MOIF1.5 PROTEIN. | sptrembl Q21455 | ND |
| 6228 | 172.4 | CUTINASE TRANSCRIPTION FACTOR I BETA. | swissprot P52959 | ND |
| 6229 | 172.4 | HYPOTHETICAL PROLINE-RICH PROTEIN (FRAGMENT). | swissprot P21260 | ND |
| 6230 | 172.2 | STE20/PAK KINASE HOMOLOGUE. | sptrembl O000911 | ND |
| 6231 | 172.1 | WP6 PRECURSOR. | sptreMbl Q39492 | ND |
| 6232 | 172.0 | HYPOTHETICAL 33.4 KD PROTEIN IN RPL44B-RPC10 INTERGENIC REGION PRECURSOR. | swissprot P38844 | ND |
| 6233 | 172.0 | TRANSCRIPTION FACTOR MBPI (MBF SUBUNIT P120). | swissprot P39679 | ND |

TABLE 3-continued

Aspergillus oryzae ESTs

| Sequence Listing | zscore | Annotation | Database | Functional Category |
|---|---|---|---|---|
| 6234 | 1710.3 | ER CHAPERONE BIP. | tremblnew BAA82597 | Posttranslational modification, protein turnover, chaperones |
| 6235 | 171.8 | MEROZOITE SURFACE PROTEIN 2 (FRAGMENT). | sptrembl O15691 | ND |
| 6236 | 171.8 | TRANSCRIPTION FACTOR AP-2 ISOFORM 1 (FRAGMENT). | sptrembl Q60740 | ND |
| 6237 | 171.8 | Y41E3.2 PROTEIN. | sptrembl O62432 | ND |
| 6238 | 171.7 | PEARLI 4 PROTEIN. | tremblnew AAD29820 | ND |
| 6239 | 171.3 | CONSERVED HYPOTHETICAL PROTEIN. | tremblnew AAF10001 | ND |
| 6240 | 171.2 | ACETYLXYLAN ESTERASE PRECURSOR (EC 3.1.1.72). | sptrembl Q99034 | ND |
| 6241 | 171.1 | HOMEOBOX PROTEIN. | sptrembl Q98911 | ND |
| 6242 | 171.1 | ATPASE 6. | sptrembl Q33561 | ND |
| 6243 | 1703.0 | ALANYL DIPEPTIDYL PEPTIDASE. | sptrembl Q9Y8E3 | Amino acid transport and metabolism |
| 6244 | 1701.3 | DNA POLYMERASE EPSILON HOMOLOG. | sptrembl O93845 | DNA replication, recombination and repair |
| 6245 | 170.8 | FIBROIN HEAVY CHAIN PRECURSOR (FIB-H) (FRAGMENTS). | swissprot P05790 | ND |
| 6246 | 170.7 | Fragmented human NF-H gene +2 frameshift mutant product. | geneseqp W18663 | ND |
| 6247 | 170.7 | PUTATIVE EXTENSIN. | sptrembl Q9ZNU3 | ND |
| 6248 | 170.6 | HEPATITIS A VIRUS CELLULAR RECEPTOR I LONG FORM (HEPATITIS A VIRUS CELLULAR RECEPTOR I SHORT FORM). | sptrembl O46598 | ND |
| 6249 | 170.6 | MULTIDRUG RESISTANCE PROTEIN 2 (MULTIDRUG-EFFLUX TRANSPORTER 2). | swissprot P39843 | ND |
| 6250 | 170.1 | ZONA PELLUCIDA PROTEIN (ZP). | sptrembl Q91236 | ND |
| 6251 | 170.1 | RNA BINDING PROTEIN (FRAGMENT). | tremblnew BAA83714 | ND |
| 6252 | 1693.9 | SACCHAROPINE DEHYDROGENASE [NADP+, L-GLUTAMATE FORMING] (EC 1.5.1.10). | swissprot P38999 | Amino acid transport and metabolism |
| 6253 | 1690.9 | NITRITE REDUCTASE [NAD(P)H] (EC 1.6.6.4). | swissprot P22944 | Energy production and conversion |
| 6254 | 169.9 | FLGA insert stabilising polypeptide. | geneseqp W79128 | ND |
| 6255 | 169.6 | PROTEOPHOSPHOGLYCAN (FRAGMENT). | sptrembl Q9Y075 | ND |
| 6256 | 169.6 | SYNAPSIN I (FRAGMENT). | sptrembl O62732 | ND |
| 6257 | 169.6 | A-AGGLUTININ ATTACHMENT SUBUNIT PRECURSOR. | swissprot P32323 | ND |
| 6258 | 169.4 | SUPPRESSOR PROTEIN SRP40. | swissprot P32583 | ND |
| 6259 | 169.3 | KIAA1052 PROTEIN. | tremblnew BAA83004 | ND |
| 6260 | 169.3 | LACTATE DEHYDROGENASE (EC 1.1.1.27). | sptrembl Q43000 | ND |
| 6261 | 169.1 | DNA METHYLASE. | sptrembl O33298 | ND |
| 6262 | 168.8 | HYPOTHETICAL 35.5 KD PROTEIN IN TRANSPOSON TN4556. | swissprot P20186 | ND |
| 6263 | 168.5 | HP8 PEPTIDE. | sptrembl Q92657 | ND |
| 6264 | 168.5 | PROTEOPHOSPHOGLYCAN (FRAGMENT). | sptrembl Q97075 | ND |

TABLE 3-continued

_Aspergillus oryzae_ ESTs

| Sequence Listing | zscore | Annotation | Database | Functional Category |
|---|---|---|---|---|
| 6265 | 168.5 | HOMEBOX PROTEIN GMIX. | sptrembl O73592 | ND |
| 6266 | 168.2 | GNASI PROTEIN (FRAGMENT). | sptrembl O75685 | ND |
| 6267 | 168.1 | PVA1 GENE. | sptrembl Q26195 | ND |
| 6268 | 168.0 | SPERM MITOCHONDRIAL CAPSULE SELENOPROTEIN (MCS). | swissprot P49901 | ND |
| 6269 | 1672.1 | HEXOSE TRANSPORTER. | sptrembl O13311 | ND |
| 6270 | 167.7 | SER/ARG-RELATED NUCLEAR MATRIX PROTEIN. | sptrembl O60585 | ND |
| 6271 | 167.5 | IRON TRANSPORT MULTICOPPER OXIDASE PRECURSOR (EC 1.-.-.-). | swissprot P38993 | ND |
| 6272 | 167.5 | NUCLEAR PROTEIN. | sptrembl Q24898 | ND |
| 6273 | 167.5 | FERTILIZATION-INDEPENDENT SEED 2 PROTEIN. | sptrembl Q9ZNT9 | ND |
| 6274 | 167.5 | P2567 PROTEIN. | sptrembl Q99373 | ND |
| 6275 | 167.4 | HYPOTHETICAL 29.3 KD PROTEIN. | sptrembl O74943 | ND |
| 6276 | 167.2 | SPLICING COACTIVATOR SUBUNIT SRM300. | tremblnew AAF21439 | ND |
| 6277 | 167.1 | F23M19.11 PROTEIN. | sptrembl Q9X1C7 | ND |
| 6278 | 167.1 | HYPOTHETICAL 26.6 KD PROTEIN C17A2.10C IN CHROMOSOME I. | sptrembl O13760 | ND |
| 6279 | 167.1 | HYPOTHETICAL 133.5 KD PROTEIN F26C11.3 IN CHROMOSOME II. | swissprot QO9550 | ND |
| 6280 | 167.0 | LONG-CHAIN-FATTY-ACID COA LIGASE. | sptrembl O51162 | ND |
| 6281 | 166.9 | ULTRA HIGH SULFER KERATIN. | sptrembl O75690 | ND |
| 6282 | 166.9 | F12K2.3 PROTEIN. | sptrembl Q9X1P3 | ND |
| 6283 | 166.9 | IMMEDIATE-EARLY PROTEIN IE180. | swissprot P33479 | ND |
| 6284 | 166.9 | EXTENSIN-LIKE PROTEIN. | tremblnew CAB40774 | ND |
| 6285 | 166.9 | LOW MOLECULAR WEIGHT GLUTENIN (FRAGMENT). | sptrembl Q41552 | ND |
| 6286 | 166.7 | PROTEOPHOSPHOGLYCAN PRECURSOR (FRAGMENT). | sptrembl Q9Y076 | ND |
| 6287 | 166.7 | TYPE VII COLLAGEN. | sptrembl Q63870 | ND |
| 6288 | 166.5 | ENDO16 PROTEIN (FRAGMENT). | swissprot P13665 | ND |
| 6289 | 166.5 | CYSTEINE-RICH PROTEIN (FRAGMENT). | sptrembl Q16861 | ND |
| 6290 | 166.4 | CELL WALL-PLASMA MEMBRANE LINKER PROTEIN. | sptrembl Q39353 | ND |
| 6291 | 166.4 | RETINA-DERIVED POU-DOMAIN FACTOR-1. | sptrembl P78425 | ND |
| 6292 | 166.4 | HYPOTHETICAL 59.1 KD SERINE-RICH PROTEIN C23C4.10 IN CHROMOSOME I. | sptrembl O13930 | ND |
| 6293 | 166.4 | DENTIN PHOSPHOPROTEIN PRECURSOR. | sptrembl P70578 | ND |
| 6294 | 166.3 | GLUE PROTEIN. | sptrembl Q27423 | ND |
| 6295 | 166.3 | NTR. | tremblnew AAF23950 | ND |
| 6296 | 166.2 | 36.4 KD PROLINE-RICH PROTEIN. | swissprot Q00451 | ND |
| 6297 | 166.2 | F4P13.11 PROTEIN. | tremblnew AAF01541 | ND |
| 6298 | 166.1 | F-BOX PROTEIN FBX11 (FRAGMENT). | tremblnew AAF04520 | ND |

TABLE 3-continued

Aspergillus oryzae ESTs

| Sequence Listing | zscore | Annotation | Database | Functional Category |
|---|---|---|---|---|
| 6299 | 166.0 | PROTEIN TYROSINE PHOSPHATASE, RECEPTOR TYPE C PRECURSOR (EC 1.1.3.48) (LYMPHOCYTE COMMON ANTIGEN). | sptrembl Q61812 | ND |
| 6300 | 1653.7 | FUMARYLACETOACETASE (EC 3.7.1.2) (FUMARYLACETOACETATE HYDROLASE) (BETA-DIKETONASE) (FAA (FAAH) (FAH). | sptrembl Q00770 | ND |
| 6301 | 165.9 | Amino acid sequence of a collagen-like protein. | geneseqp Y23937 | ND |
| 6302 | 165.9 | KIAA0775 PROTEIN. | sptrembl O94873 | ND |
| 6303 | 165.8 | HYPOTHETICAL 15.4 KD PROTEIN YPR056C. | sptrembl Q12160 | ND |
| 6304 | 165.7 | 2-HYDROXY-6-KETONONA-2,4-DIENOATE HYDROLASE. | sptrembl O05145 | ND |
| 6305 | 165.7 | G-BOX BINDING FACTOR (GBF). | swissprot P36417 | ND |
| 6306 | 165.7 | F4P13.11 PROTEIN. | tremblnew AAF01541 | ND |
| 6307 | 165.6 | PPP3. | sptrembl O74184 | ND |
| 6308 | 165.3 | NADH-UBIQUINONE OXIDOREDUCTASE ASHI SUBUNIT PRECURSOR (EC 1.6.5.3) (EC 1.6.99.3) (COMPLEX 1)-ASHI) (CI-ASH1). | swissprot Q02372 | ND |
| 6309 | 165.3 | PROTEOPHOSPHOGLYCAN (FRAGMENT). | sptrembl Q9Y075 | ND |
| 6310 | 165.3 | HYPOTHETICAL 18.3 KD PROTEIN. | tremblnew CAB65601 | ND |
| 6311 | 165.2 | MATING PROCESS PROTEIN M1D2 (SERINE-RICH PROTEIN SMS1) (PROTEIN KINASE A INTERFERENCE PROTEIN). | swissprot P36027 | ND |
| 6312 | 165.2 | ORF OF UNKNOWN FUNCTION. | sptrembl Q09149 | ND |
| 6313 | 165.1 | Mycobacterium species protein sequence 50B. | geneseqp Y04998 | ND |
| 6314 | 165.0 | VITELLINE MEMBRANE PROTEIN HOMOLOG. | sptrembl O01362 | ND |
| 6315 | 1649.9 | C-4 METHYL STEROL OXIDASE (EC 1.-.-.-). | swissprot O59933 | ND |
| 6316 | 1644.6 | DIACYLGLYCEROL LIPASE. | sptrembl P78583 | ND |
| 6317 | 164.9 | CELL SURFACE GLYCOPROTEIN 1 PRECURSOR (OUTER LAYER PROTEIN B) (S-LAYER PROTEIN 1). | swissprot Q06852 | ND |
| 6318 | 164.9 | HYPOTHETICAL 97.8 KD PROTEIN. | sptrembl O94685 | ND |
| 6319 | 164.3 | ISOFLAVONE REDUCTASE HOMOLOG (EC 1.3.1.-). | swissprot P52578 | ND |
| 6320 | 164.2 | O-METHYLTRANSFERASE. | sptrembl O07431 | ND |
| 6321 | 164.1 | Y41E3.11 PROTEIN. | tremblnew CAB63361 | ND |
| 6322 | 164.0 | HYPOTHETICAL 39.1 KD PROTEIN. | sptrembl Q9XE89 | ND |
| 6323 | 1639.4 | Aspergillus oryzae AreA regulator protein. | geneseqp | ND |
| 6324 | 1637.8 | Hydroxyphenyl pyruvate dehydrogenase (HPDD) protein. | geneseqp Y15821 | ND |

TABLE 3-continued

*Aspergillus oryzae* ESTs

| Sequence Listing | zscore | Annotation | Database | Functional Category |
|---|---|---|---|---|
| 6325 | 1636.3 | SUCCINATE DEHYDROGENASE [UBIQUINONE] IRON-SULFUR PROTEIN, MITOCHONDRIAL PRECURSOR (EC 1.3.5.1) (IP). | swissnew O42772 | Energy production and conversion |
| 6326 | 1633.0 | *A. niger* SFAG 2 carboxypeptidase Y. | geneseqp R96738 | ND |
| 6327 | 163.9 | SIMILARITY TO CHICKEN LIMB DEFORMITY PROTEIN. | sptrembl Q22534 | ND |
| 6328 | 163.9 | HYPOTHETICAL PROTEIN IRL5 (TRL5). | swissprot P16803 | ND |
| 6329 | 163.9 | 5E5 ANTIGEN. | swissprot Q63003 | ND |
| 6330 | 163.8 | VITELLOGENIN (FRAGMENT). | sptrembl Q90237 | ND |
| 6331 | 163.6 | Nucleic acid binding domain from apoB-100. | geneseqp W96830 | ND |
| 6332 | 163.6 | ANTER-SPECIFIC PROLINE-RICH PROTEIN APG PRECURSOR. | swissprot P40602 | ND |
| 6333 | 163.6 | ARGININE-RICH 54 KD NUCLEAR PROTEIN. | sptrembl Q05519 | ND |
| 6334 | 163.5 | XSMAD4A. | sptrembl Q9W639 | ND |
| 6335 | 163.4 | PRP4 PROTEIN KINASE HOMOLOG (FRAGMENT). | sptrembl O88378 | ND |
| 6336 | 163.2 | SUPPRESSOR PROTEIN SRP40. | swissprot P32583 | ND |
| 6337 | 163.2 | HYPOTHETICAL 77.4 KD PROTEIN. | sptrembl O65530 | ND |
| 6338 | 163.1 | PROLINE-RICH SALIVARY PROTEIN (FRAGMENT). | sptrembl Q62107 | ND |
| 6339 | 1622.8 | GUANINE NUCLEOTIDE-BINDING PROTEIN BETA SUBUNIT-LIKE PROTEIN (CROSS-PATHWAY CONTROL WD-REPEAT PROTEIN CPC-2). | swissprot Q01369 | ND |
| 6340 | 1620.0 | GLUTAMINASE A. | tremblnew BAA86934 | ND |
| 6341 | 162.9 | Peptide fragment of N-type calcium channel. | geneseqp R96419 | ND |
| 6342 | 162.9 | IMMEDIATE-EARLY PROTEIN IE-O. | swissprot O10369 | ND |
| 6343 | 162.8 | SALIVARY GLUE PROTEIN SGS-3 PRECURSOR. | swissprot P13730 | ND |
| 6344 | 162.7 | TOUCAN PROTEIN. | sptrembl O46112 | ND |
| 6345 | 162.7 | COMPLETE GENOME. | tremblnew AAF19337 | ND |
| 6346 | 162.6 | SALIVARY PROLINE-RICH PROTEIN II-1 (FRAGMENT). | swissprot P81489 | ND |
| 6347 | 162.6 | MUCIN (FRAGMENT). | sptrembl Q14888 | ND |
| 6348 | 162.6 | WD REPEAT PROTEIN. | tremblnew CAB52157 | ND |
| 6349 | 162.5 | SIMILAR TO DROSOPHILA MELANOGASTER ANKYRIN. | sptrembl Q84566 | ND |
| 6350 | 162.3 | Notch Hn5k full length clone. | geneseqp R28964 | ND |
| 6351 | 162.2 | PROBABLE PROLYL-TRNA SYNTHETASE, CYTOPLASMIC (EC 6.1.1.15) (PROLINE--TRNA LIGASE) (PRORS). | swissprot P39965 | ND |
| 6352 | 162.2 | CODED FOR BY C. ELEGANS CDNA YK91G9.5. | sptrembl Q21721 | ND |
| 6353 | 162.2 | *S. lavendulae* ORF3 gene product. | geneseqp R72381 | ND |
| 6354 | 162.2 | THIOREDOXIN. | swissnew P50338 | ND |
| 6355 | 162.1 | EXTENSIN-PRECURSOR PROLINE-RICH GLYCOPROTEIN). | swissprot P14918 | ND |

TABLE 3-continued

_Aspergillus oryzae_ ESTs

| Sequence Listing | zscore | Annotation | Database | Functional Category |
|---|---|---|---|---|
| 6356 | 162.0 | HYPOTHETICAL 48.2 KD PROTEIN. | sptrembl Q04921 | ND |
| 6357 | 1614.5 | EUKARYOHC INITIATION FACTOR 4A (EIF-4A). | swissprot P47943 | DNA replication, recombination and repair |
| 6358 | 1611.8 | SIGNAL RECOGNITION PARTICLE 54 KD PROTEIN HOMOLOG. | swissprot Q00179 | Cell motility and secretion |
| 6359 | 161.9 | LDLBP. | sptrembl Q9Z60 | ND |
| 6360 | 161.8 | HYPOTHETICAL 36.5 KD PROTEIN. | tremblnew AAD49213 | ND |
| 6361 | 161.8 | DEFECTIVE CHORION-1 PROTEIN PRECURSOR (FRAGMENTS). | sptrembl Q23933 | ND |
| 6362 | 161.7 | TEGUMENT PROTEIN. | sptrembl O09799 | ND |
| 6363 | 161.6 | MUCIN-LIKE PROTEIN. | sptrembl O77242 | ND |
| 6364 | 161.5 | 336AA LONG HYPOTHETICAL DTDP-GLUCOSE 4,6-DEHYDRATASE. | sptrembl O58151 | ND |
| 6365 | 161.4 | WW DOMAIN BINDING PROTEIN 11. | sptrembl O88539 | ND |
| 6366 | 161.2 | NOCI PROTEIN. | sptrembl P79065 | ND |
| 6367 | 161.1 | PUTATIVE TRANSCRIPTIONAL REGULATOR. | sptrembl O13337 | ND |
| 6368 | 161.1 | Human N-methyl-D-aspartate receptor subunit encoded by clone NMDA24. | geneseqp W87504 | ND |
| 6369 | 161.0 | THERMAL HYSTERESIS PROTEIN ISOFORM 4-9 PRECURSOR. | tremblnew AAD55256 | ND |
| 6370 | 161.0 | _M. tuberculosis_ immunogenic polypeptide IbH-29. | geneseqp W81726 | ND |
| 6371 | 1608.6 | _Aspergillus niger_ Sulphydryl oxidase (SOX). | geneseqp R43074 | ND |
| 6372 | 1604.5 | ACETYL-COENZYME A SYNTHETASE (EC 6.2.1.1) (ACETATE--COA LIGASE) (ACTY-ACTIVATING ENZYME). | swissprot P16928 | Lipid metabolism |
| 6373 | 1603.1 | 40S RIBOSOMAL PROTEIN S3AE (S1). | swissprot P40910 | Translation, ribosomal structure and biogenesis |
| 6374 | 1602.9 | NADH-UBIQUINONE OXIDOREDUCTASE 30.4 KD SUBUNIT PRECURSOR (EC 1.6.5.3) (EC 1.6.99.3) (COMPLEX 1-30 KD) (C1-31 KD). | swissprot P23710 | Energy production and conversion |
| 6375 | 160.8 | ATTACHMENT PROTEIN. | sptrembl Q65306 | ND |
| 6376 | 160.7 | L3162.7. | sptrembl O60978 | ND |
| 6377 | 160.7 | HYPOTHETICAL 49.6 KD PROTEIN C18B11.03C IN CHROMOSOME I. | swissprot Q09710 | ND |
| 6378 | 160.6 | Y53H1A.1 PROTEIN. | tremblnew CAB53382 | ND |
| 6379 | 160.6 | ARGININE/SERINE-RICH PROTEIN. | tremblnew AAF19004 | ND |
| 6380 | 160.6 | CODED FOR BY C. ELEGANS CDNA YK60B10.5. | sptrembl Q94247 | ND |
| 6381 | 160.5 | HYPOTHETICAL 57.2 KD PROTEIN. | sptrembl O68872 | ND |
| 6382 | 160.1 | SERINE/ARGININE-RICH PROTEIN. | tremblnew AAF17288 | ND |
| 6383 | 160.1 | WUGSC:H_NH0353P23.1 PROTEIN (FRAGMENT). | sptrembl O95033 | ND |
| 6384 | 160.0 | LOW MOLECULAR WEIGHT GLUTENIN SUBUNIT PRECURSOR (FRAGMENT). | sptrembl Q9XGE9 | ND |

TABLE 3-continued

Aspergillus oryzae ESTs

| Sequence Listing | zscore | Annotation | Database | Functional Category |
|---|---|---|---|---|
| 6385 | 160.0 | JAGGED 2 (JAGGED 2 PROTEIN) (FRAGMENT). | sptrembl O70219 | ND |
| 6386 | 159.9 | Peptide encoded by HRGP gene cassette incorporating a GAGP construct. | geneseqp Y01282 | ND |
| 6387 | 159.8 | ADRENAL CREB-RP HOMOLOG. | sptrembl Q99635 | ND |
| 6388 | 159.7 | HYPOTHETICAL 29.0 KD PROTEIN. | sptrembl Q9Y7C9 | ND |
| 6389 | 159.7 | HYDROXYPROLINE-RICH GLYCOPROTEIN. | sptrembl Q40692 | ND |
| 6390 | 159.7 | Mouse Fas-binding protein Daxx. | geneseqp W61532 | ND |
| 6391 | 159.4 | TRANSPOSASE. | sptrembl Q9WXF7 | ND |
| 6392 | 159.4 | KIAA0303 (FRAGMENT). | sptrembl O15021 | ND |
| 6393 | 159.4 | HYPOTHETICAL 31.5 KD PROTEIN. | swissprot P46218 | ND |
| 6394 | 159.4 | COILED-COIL PROTEIN. | sptrembl Q9Y708 | ND |
| 6395 | 159.4 | MUCIN-LIKE PROTEIN. | sptrembl Q9YMX0 | ND |
| 6396 | 159.3 | TAIL-SPECIFIC THYROID HORMONE UP-REGULATED (GENE 5). | sptrembl Q91638 | ND |
| 6397 | 159.2 | EXTENSIN-LIKE PROTEIN. | tremblnew AAD55980 | ND |
| 6398 | 159.2 | HYPOTHETICAL 96.9 KD PROTEIN. | tremblnew CAA22569 | ND |
| 6399 | 1587.5 | A. crysogenum cystathionine beta-synthase. | geneseqp R72589 | Amino acid transport and metabolism |
| 6400 | 1584.8 | PENTAFUNCTIONAL AROM POLYPEPTIDE [INCLUDES: 3-DEHYDROQUINATE SYNTHASE (EC 4.6.1.3); 3-DEHYDROQUINATE DEHYDRATASE (EC 4.2.1.10) (3-DEHYDROQUINASE); SHIKIMATE 5-DEHYDROGENASE (EC 1.1.1.25); SHIKIMATE KINASE (EC 2.7.1.71); FPSP SYNTHASE (EC 2.5.1.19)]. | swissnew P07547 | Amino acid transport and metabolism |
| 6401 | 158.8 | PAP8 PRODUCT (FRAGMENT). | sptrembl Q43586 | ND |
| 6402 | 158.8 | CODED FOR BY C. ELEGANS CDNA YK127B8.5. | sptrembl Q20648 | ND |
| 6403 | 158.8 | N-WASP. | sptrembl O00401 | ND |
| 6404 | 158.6 | CTG7A (FRAGMENT). | sptrembl O15413 | ND |
| 6405 | 158.6 | ENDOSPERM TISSUE PRECURSOR. | sptrembl Q41295 | ND |
| 6406 | 158.6 | Fragmented human NF-H gene +2 frameshift mutant product. | geneseqp W18663 | ND |
| 6407 | 158.5 | HYPOTHETICAL 54.4 KD PROTEIN. | tremblnew CAB51187 | ND |
| 6408 | 158.5 | 50 KD PROLINE RICH PROTEIN. | sptrembl Q9ZBP2 | ND |
| 6409 | 158.5 | KIAA0674 PROTEIN (FRAGMENT). | sptrembl Q9Y4D0 | ND |
| 6410 | 158.5 | C46C2.1 PROTEIN. | sptrembl Q18657 | ND |
| 6411 | 158.5 | F13F21.7 PROTEIN. | sptrembl Q9X1B6 | ND |
| 6412 | 158.4 | PROLINE-RICH PROTEIN PRECURSOR. | sptrembl Q41122 | ND |
| 6413 | 158.2 | MOBP. | sptrembl Q13874 | ND |
| 6414 | 158.1 | ATROPHIN-1 (FRAGMENT). | sptrembl O97923 | ND |
| 6415 | 158.1 | PLENTY-OF-PROLINES-101. | sptrembl O70495 | ND |
| 6416 | 158.1 | CNS MYELIN PROTEIN MOBP-169. | tremblnew AAD44968 | ND |
| 6417 | 158.1 | MHC CLASS I CHAIN-RELATED PROTEIN (FRAGMENT). | sptrembl O98020 | ND |

TABLE 3-continued

*Aspergillus oryzae* ESTs

| Sequence Listing | zscore | Annotation | Database | Functional Category |
|---|---|---|---|---|
| 6418 | 158.0 | EXTENSIN CLASS II PRECURSOR (CELL WALL HYDROXYPROLINE-RICH GLYCOPROTEIN) (HRGP) (TOML-4). | sptrembl Q09084 | ND |
| 6419 | 1577.4 | ACTIN-RELATED PROTEIN ARPA. | sptrembl Q9Y721 | Cell division chromosome partitioning |
| 6420 | 1576.4 | 14-3-3 PROTEIN HOMOLOG (TH1433). | swissprot Q99002 | ND |
| 6421 | 1572.6 | INORGANIC PYROPHOSPHATASE (EC 3.6.1.1) (PYROPHOSPHATE PHOSPHO-HYDROLASE) (PPASE). | swissprot O13505 | Energy production and conversion |
| 6422 | 157.9 | Ubiquitin-beta-galactosidase junction. | geneseqp R22231 | ND |
| 6423 | 157.9 | COSMID R153. | sptrembl Q22001 | ND |
| 6424 | 157.9 | PROTEASE (EC 3.4.23.-) (FRAGMENT). | sptrembl Q01875 | ND |
| 6425 | 157.9 | HYPOTHETICAL 32.8 KD PROTEIN (FRAGMENT). | tremblnew CAB55954 | ND |
| 6426 | 157.8 | PUTATIVE CYTOCHROME P450. | tremblnew AAF04170 | ND |
| 6427 | 157.8 | HYPOTHETICAL 24.0 KD PROTEIN T28D9.2 IN CHROMOSOME II. | swissprot Q10021 | ND |
| 6428 | 157.7 | EXTENSIN-LIKE PROTEIN. | tremblnew CAB40769 | ND |
| 6429 | 157.7 | DIBASIC PROCESSING ENDOPROTEASE PRECURSOR (EC 3.4.21.-). | swissprot P42781 | ND |
| 6430 | 157.6 | PUTATIVE ZINC FINGER PROTEIN. | sptrembl Q9ZUM9 | ND |
| 6431 | 157.6 | MUCIN (FRAGMENT). | sptrembl Q14881 | ND |
| 6432 | 157.6 | WISKOTT-ALDRICH SYNDROME PROTEIN HOMOLOG 1. | sptrembl O36027 | ND |
| 6433 | 157.6 | ORF 1 AND ORF2 5' REGION PRECURSOR. | sptrembl Q54913 | ND |
| 6434 | 157.5 | CTG26 ALTERNATE OPEN READING FRAME (FRAGMENT). | sptrembl O15421 | ND |
| 6435 | 157.3 | PROTEOPHOSPHOGLYCAN (FRAGMENT). | sptrembl Q9Y075 | ND |
| 6436 | 157.3 | HYDROLASE 314 aa,chain A. | pdb 7PCK | ND |
| 6437 | 157.2 | EMPTY SPIRACLES HOMEOTIC PROTEIN. | swissprot P18488 | ND |
| 6438 | 157.1 | POSITIONAL COUNTERPART OF HSV-1 GENE US5. | sptrembl O39307 | ND |
| 6439 | 567.6 | 40S RIBOSOMAL PROTEIN S4-2. | tremblnew CAB57920 | Translation, ribosomal structure and biogenesis |
| 6440 | 1566.9 | PUTATIVE YEAST CELL DIVISION CYCLE CDC50 HOMOLOG. | sptrembl O94568 | ND |
| 6441 | 1566.3 | ACONITASE. | sptrembl O74699 | Energy production and conversion |
| 6442 | 1563.2 | VASCUOLAR ATP SYNTHASE CATALYTIC SUBUNIT A (EC 3.6.1.34) (V-ATPASE 67 KD SUBUNIT). | swissprot P11592 | Energy production and conversion |
| 6443 | 1562.9 | ACETYL-COA ACETYLTRANSFERASE IB (EC 2.3.1.9) (PEROXISOMAL ACETOACETYL-COA THIOLASE) (THIOLASE IB). | swissprot Q04677 | Lipid metabolism |
| 6444 | 156.9 | GASTRIC MUCIN (FRAGMENT). | sptrembl Q29071 | ND |
| 6445 | 156.8 | G-BOX BINDING PROTEIN. | sptrembl O65887 | ND |
| 6446 | 156.8 | HISTIDINE-RICH PROTEIN. | sptrembl O33447 | ND |

TABLE 3-continued

Aspergillus oryzae ESTs

| Sequence Listing | zscore | Annotation | Database | Functional Category |
|---|---|---|---|---|
| 6447 | 156.8 | PROBABLE E4 PROTEIN. | swissprot P17384 | ND |
| 6448 | 156.7 | EXTENSIN PRECURSOR (PROLINE-RICH GLYCOPROTEIN). | swissprot P24152 | ND |
| 6449 | 156.7 | Porphorymonas gingivalis protein PG87. | geneseqp Y34563 | ND |
| 6450 | 156.5 | NUCLEOLAR PHOSPHOPROTEIN P130. | sptrembl Q14978 | ND |
| 6451 | 156.4 | Residues 253–425 of human type A EBNA2 (strain B95–8). | geneseqp W45092 | ND |
| 6452 | 156.4 | PROLINE RICH PROTEIN. | sptrembl O22514 | ND |
| 6453 | 156.4 | NADH OXIDASE. | sptrembl Q9WYL1 | ND |
| 6454 | 156.4 | HANSENULA MRAKII KILLER TOXIN-RESISTANT PROTEIN 1 PRECURSOR. | swissprot P41809 | ND |
| 6455 | 156.4 | HYPOTHETICAL 28.9 KD PROTEIN. | sptrembl Q03931 | ND |
| 6456 | 156.3 | Sequence of Histidine-rich protein (HisRP). | geneseqp R24393 | ND |
| 6457 | 156.3 | SERINE-RICH PROTEIN. | sptrembl O94317 | ND |
| 6458 | 156.0 | NEUROMODULIN (AXONAL MEMBRANE PROTEIN GAP-43) (PP46) (B-50) (PROTEIN F1) (CALMODULIN-BINDING PROTEIN P-57). | swissprot P55860 | ND |
| 6459 | 156.0 | GLYCOPROTEIN G-2 (FRAGMENT). | tremblnew CAB65666 | ND |
| 6460 | 156.0 | PRE-NECK APPENDAGE PROTEIN (LATE PROTEIN GP12). | swissprot P20345 | ND |
| 6461 | 156.0 | 167AA LONG HYPOTHETICAL PROTEIN. | sptrembl Q9YAM3 | ND |
| 6462 | 156.0 | CODED FOR BY C. ELEGANS CDNA CEMSE92F. | sptrembl Q19059 | ND |
| 6463 | 1557.7 | PUTATIVE CALCIUM P-TYPE ATPASE (FRAGMENT). | tremblnew CAB65295 | Inorganic ion transport and metabolism |
| 6464 | 1554.5 | PUTATIVE HIIA/OLI SYNTHASE. | tremblnew AAF25444 | ND |
| 6465 | 155.9 | G2 GLYCOPROTEIN (FRAGMENT). | tremblnew O55365 | ND |
| 6466 | 155.9 | TR3BETA. | sptrembl Q15627 | ND |
| 6467 | 155.9 | P07E5.6 PROTEIN. | sptrembl Q21823 | ND |
| 6468 | 155.8 | HYDROXYPROLINE-RICH GLYCOPROTEIN. | sptrembl Q40692 | ND |
| 6469 | 155.8 | LORICRIN. | swissprot P23490 | ND |
| 6470 | 155.8 | HYPOTHETICAL 11.7 KD PROTEIN. | sptrembl Q9Y7P8 | ND |
| 6471 | 155.8 | HL60 cell line protein fragment. | geneseqp W73307 | ND |
| 6472 | 155.7 | SALIVARY GLUE PROTEIN SGS-3 PRECURSOR. | swissprot P13729 | ND |
| 6473 | 155.6 | HYPOTHETICAL PROTEIN (ORF2) (FRAGMENT). | swissprot O33369 | ND |
| 6474 | 155.6 | PROLINE RICH PROTEIN. | sptrembl O22514 | ND |
| 6475 | 155.6 | EARLY NODULIN 20 PRECURSOR (N-20). | swissprot P93329 | ND |
| 6476 | 155.5 | Cotton fibrous tissue specific protein KC03. | geneseqp W15761 | ND |
| 6477 | 155.4 | SIGNAL RECEPTOR PROTEIN (FRAGMENT). | tremblnew CAB65469 | ND |
| 6478 | 155.3 | HYPOTHETICAL 63.8 KD PROTEIN IN GUT1-RIM1 INTERGENIC REGION PRECURSOR. | swissprot P38739 | ND |
| 6479 | 155.2 | INTEGRAL MEMBRANE PROTEIN. | sptrembl Q9Y786 | ND |
| 6480 | 155.2 | EYELID. | sptrembl O61603 | ND |
| 6481 | 155.2 | KINESIN-LIKE PROTEIN. | sptrembl O94053 | ND |
| 6482 | 155.2 | 191AA LONG HYPOTHETICAL PROTEIN. | sptrembl Q9YDC9 | ND |

TABLE 3-continued

Aspergillus oryzae ESTs

| Sequence Listing | zscore | Annotation | Database | Functional Category |
|---|---|---|---|---|
| 6483 | 155.2 | PROTO-ONCOGENE AF4. | sptrembl O88573 | ND |
| 6484 | 155.2 | Fructosyl amino acid oxidase. | geneseqp W24134 | ND |
| 6485 | 155.1 | PREPROACROSIN. | tremblnew CAA41441 | ND |
| 6486 | 155.1 | T04F8.8 PROTEIN. | sptrembl Q22168 | ND |
| 6487 | 155.0 | W07G1.3 PROTEIN. | sptrembl Q9XUK2 | ND |
| 6488 | 1545.4 | TUBULIN BETA CHAIN. | swissprot Q00264 | ND |
| 6489 | 1543.2 | HYPOTHETICAL 30.8 KD PROTEIN. | sptrembl O74710 | ND |
| 6490 | 154.9 | SP85 (FRAGMENT). | sptrembl O61134 | ND |
| 6491 | 154.9 | PACMAN PROTEIN. | sptrembl Q9XZU2 | ND |
| 6492 | 154.6 | NEUTRAL RETINA-SPECIFIC LEUCINE ZIPPER PROTEIN (NRL) (D14S46E). | swissprot P54845 | ND |
| 6493 | 154.5 | Delivery peptide used in peptide macromolecule complex. | geneseqp W38808 | ND |
| 6494 | 154.4 | EXTENSIN-LIKE PROTEIN, DIF54 PRECURSOR. | sptrembl Q43505 | ND |
| 6495 | 154.4 | Mycobacterium species protein sequence 41T#2. | geneseqp Y04954 | ND |
| 6496 | 154.3 | MEROZOITE SURFACE PROTEIN 1 (FRAGMENT). | tremblnew CAB60129 | ND |
| 6497 | 154.3 | HYPOTHETICAL 73.6 KD PROTEIN RV2082. | swissnew Q10690 | ND |
| 6498 | 154.2 | Trypanosoma cruzi TCR27 polypeptide, Ag15. | geneseqp R84568 | ND |
| 6499 | 154.2 | HYPOTHETICAL 97.1 KD PROTEIN C32A11.02C IN CHROMOSOME I. | swissprot Q10327 | ND |
| 6500 | 154.2 | CYTOCHROME B (FRAGMENT). | sptrembl O03563 | ND |
| 6501 | 154.2 | KIAA0324 PROTEIN (FRAGMENT). | tremblnew BAA20782 | ND |
| 6502 | 154.2 | HIGH MOLECULAR WEIGHT BASIC NUCLEAR PROTEIN (FRAGMENT). | sptrembl Q91238 | ND |
| 6503 | 154.0 | PUTATIVE PHOSPHOTRANSFERASE. | sptrembl Q9X8F0 | ND |
| 6504 | 154.0 | Y24F12A.4 PROTEIN. | tremblnew CAB60327 | ND |
| 6505 | 1539.0 | PROBABLE ISOCITRATE DEHYDROGENASE. | tremblnew CAB62099 | Amino acid transport and metabolism |
| 6506 | 1537.1 | PUTATIVE PHOSPHATIDYLINOSITOL-KINASE (FRAGMENT). | sptrembl Q9Y7K2 | ND |
| 6507 | 153.9 | MAJOR FACILITATOR SUPERFAMILY PROTEIN. | sptrembl O59738 | ND |
| 6508 | 153.9 | SPORE COAT PROTEIN SP96. | swissprot P14328 | ND |
| 6509 | 153.9 | HERPES SIMPLEX VIRUS TYPE 2 (STRAIN HG52), COMPLETE GENOME. | sptrembl P90493 | ND |
| 6510 | 153.5 | F40H3.1 PROTEIN. | tremblnew AAC67429 | ND |
| 6511 | 153.5 | PROLINE RICH PROTEIN. | sptrembl Q91810 | ND |
| 6512 | 153.5 | EYELID. | sptrembl O61603 | ND |
| 6513 | 153.5 | 111AA LONG HYPOTHETICAL PROTEIN. | sptrembl O59222 | ND |
| 6514 | 153.4 | PENICILLIN-BINDING PROTEIN 1. | tremblnew AAF10059 | ND |
| 6515 | 153.4 | ENDOSTYLE-SPECIFIC. | sptrembl O44238 | ND |
| 6516 | 153.2 | PREDICTED PROTEIN. | sptrembl O49570 | ND |
| 6517 | 153.2 | SPLICING FACTOR U2AF 65 KD SUBUNIT (U2 AUXILIARY FACTOR 65 KD SUBUNIT) (U2 SNRNP AUXILIARY FACTOR LARGE SUBUNIT) (U2AF65). | swissprot P90727 | ND |

TABLE 3-continued

*Aspergillus oryzae* ESTs

| Sequence Listing | zscore | Annotation | Database | Functional Category |
|---|---|---|---|---|
| 6518 | 153.2 | HRCQ HOMOLOG. | tremblnew AAD46901 | ND |
| 6519 | 153.2 | HYPOTHETICAL 46.5 KD PROTEIN. | sptrembl Q9X7U6 | ND |
| 6520 | 153.1 | PUTATIVE 3 BETA-HYDROXYSTEROID DEHYDROGENASE/DELTA 5--4-ISOMERASE (3BETA-HSD) [INCLUDES: 3-BETA-HYDROXY-DELTA(5)-STEROID DEHYDROGENASE (EC 1.1.1.145) (3-BETA-HYDROXY-5-ENE STEROID DEHYDROGENASE) (PROGESTERONE REDUCTASE); STEROID DELTA-ISOMERASE (EC 5.3.3.1) (DELTA-5-3-KETOSTEROID ISOMERASE)]. | swissprot P53199 | ND |
| 6521 | 153.1 | (TGGCA-BINDING PROTEIN). | sptrembl Q91797 | ND |
| 6522 | 153.0 | CONSERVED HYPOTHETICAL PROTEIN. | tremblnew AAF12297 | ND |
| 6523 | 153.0 | SPORE COAT PROTEIN SP96. | swissprot P14328 | ND |
| 6524 | 153.0 | NUCLEAR PROTEIN. | sptrembl Q24898 | ND |
| 6525 | 153.0 | PUTATIVE PROLINE-RICH PROTEIN PRP2 PRECURSOR. | sptrembl Q9ZQ10 | ND |
| 6526 | 153.0 | ZINC FINGER PROTEIN 157. | swissprot P51786 | ND |
| 6527 | 153.0 | MYOSIN-1A. | sptrembl O77202 | ND |
| 6528 | 1527.6 | ACID PHOSPHATASE PRECURSOR (EC 3.1.3.2). | swissprot P34724 | ND |
| 6529 | 1526.1 | ALPHA-MANNOSIDASE (EC 3.2.1.113). | sptrembl Q12563 | ND |
| 6530 | 152.9 | SERINE-RICH PROTEIN. | sptrembl O94317 | ND |
| 6531 | 152.9 | ZHB0005.1. | tremblnew CAB55413 | ND |
| 6532 | 152.8 | CAVEOLIN-2. | swissprot Q18879 | ND |
| 6533 | 152.8 | SIALIDASE (EC 3.2.1.18) (EXO-ALPHA-SIALIDASE) (NEURAMINIDASE) (N-ACYLNEURAMINATE GLYCOHYDROLASE) (ALPHA-NEURAMINIDASE). | sptrembl Q59164 | ND |
| 6534 | 152.7 | MFS14 PROTEIN PRECURSOR. | swissprot Q01900 | ND |
| 6535 | 152.6 | SIMILAR TO PHOSPHATIDIC ACID PHOSPHATASE. | tremblnew CAB52620 | ND |
| 6536 | 152.6 | F32D8.7 PROTEIN. | sptrembl Q19961 | ND |
| 6537 | 152.6 | F24J5.4. | tremblnew AAD49970 | ND |
| 6538 | 152.6 | GENOME, PARTIAL SEQUENCE. | sptrembl Q98457 | ND |
| 6539 | 152.6 | OVERLAPPING PROTEIN. | tremblnew AAF09239 | ND |
| 6540 | 152.3 | PUTATIVE PROLINE-RICH CELL WALL PROTEIN. | sptrembl O82327 | ND |
| 6541 | 152.3 | CYTOCHROME P450-LIKE PROTEIN. | tremblnew CAB38283 | ND |
| 6542 | 152.1 | GENE 3 PROTEIN. | swissprot P28988 | ND |
| 6543 | 152.0 | P21 REX {ALTERNATIVELY SPLICED}. | tremblnew G263535 | ND |
| 6544 | 1517.8 | VACUOLAR ATP SYNTHASE SUBUNIT AC39 (EC 3.6.1.34) (V-ATPASE AC39 SUBUNIT) (V-ATPASE 41 KD SUBUNIT). | swissprot P53659 | Energy production and conversion |

TABLE 3-continued

*Aspergillus oryzae* ESTs

| Sequence Listing | zscore | Annotation | Database | Functional Category |
|---|---|---|---|---|
| 6545 | 1515.2 | CYSTEINE SYNTHASE (EC 4.2.99.8) (O-ACETYLSERINE SULFRYDRYLASE) (O-ACETYLSERINE (THIOL)-LYASE) (CSASE). | swissprot P50867 | Amino acid transport and metabolism |
| 6547 | 1513.5 | ACETAMIDASE (EC 3.5.1.4). | swissprot P08158 | ND |
| 6548 | 1510.5 | CYTOCHROME C1, HEME PROTEIN PRECURSOR. | swissprot P07142 | ND |
| 6549 | 151.9 | HYPOTHETICAL ZINC-FINGER PROTEIN. | sptrembl O74823 | ND |
| 6550 | 151.8 | GIANT SECRETORY PROTEIN 1-A PRECURSOR (GSP-IA) (BALBIANI RING-CHAIN) (FRAGMENT). | sptrembl Q00625 | ND |
| 6551 | 151.8 | PUTATIVE TRANSCRIPTIONAL ACTIVATOR. | sptrembl O59830 | ND |
| 6552 | 151.7 | F53B7.5 PROTEIN. | sptrembl Q19522 | ND |
| 6553 | 151.7 | PROBABLE GLUCONOKINASE (EC 2.7.1.12) (GLUCONATE KINASE). | swissprot Q10242 | ND |
| 6554 | 151.7 | 232AA LONG HYPOTHETICAL PROTEIN. | sptrembl Q9YA94 | ND |
| 6555 | 151.6 | GLUTAMYL-TRNA REDUCTASE 3 PRECURSOR (EC 1.2.1.-) (GLUTR). | swissprot O65796 | ND |
| 6556 | 151.5 | PROTEASE 1. | sptrembl O13304 | ND |
| 6557 | 151.5 | RNA BINDING PROTEIN (FRAGMENT). | tremblnew BAA83717 | ND |
| 6558 | 151.5 | HYPOTHETICAL 34.8 KD PROTEIN. | tremblnew CAB41147 | ND |
| 6559 | 151.4 | 50 KD PROLINE RICH PROTEIN. | sptrembl Q9ZBP2 | ND |
| 6560 | 151.4 | ORF58. | sptrembl O36408 | ND |
| 6561 | 151.3 | HYPOTHETICAL 61.1 KD PROTEIN (FRAGMENT). | tremblnew | ND |
| 6562 | 151.3 | SPLICING FACTOR, ARGININE/SERINE-RICH 10 (PUTATIVE MYELIN REGULATORY FACTOR 1) (MRF-1) (FRAGMENT). | swissprot Q60701 | ND |
| 6563 | 151.2 | *Acetobacter xylinum* CMCase ORF2 gene product. | geneseqp W69762 | ND |
| 6564 | 151.2 | JC8.8 PROTEIN. | sptrembl O62289 | ND |
| 6565 | 151.2 | CCAAT/ENHANCER CORE BINDING PROTEIN. | sptrembl Q91346 | ND |
| 6566 | 151.1 | 375AA LONG HYPOTHETICAL PROTEIN. | sptrembl Q9Y949 | ND |
| 6567 | 151.1 | HYDROXYPROLINE-RICH GLYCOPROTEIN PRECURSOR. | sptrembl Q41719 | ND |
| 6568 | 151.0 | HYPOTHETICAL 40.0 KD PROTEIN. | tremblnew AAF10516 | ND |
| 6569 | 1509.7 | HOMOACONITASE PRECURSOR (EC 4.2.1.36) (HOMOACONITATE HYDRATASE). | swissprot Q92412 | ND |
| 6570 | 1509.3 | NMT1 PROTEIN HOMOLOG. | swissprot P42882 | Inorganic ion transport and metabolism |
| 6571 | 1506.7 | PHOSPHATIDYLGLYCEROL/ PHOSPHATIDYLINOSITOL TRANSFER PROTEIN. | sptrembl O94183 | ND |
| 6572 | 1505.6 | 6-PHOSPHOGLUCONATE DEHYDROGENASE, DECARBOXYLATING I (EC 1.1.1.44). | swissprot P38720 | Carbohydrate transport and metabolism |
| 6573 | 1503.8 | *A. niger* 2,3-dihydroxybenzoic acid decarboxylase protein. | geneseqp W93483 | ND |
| 6574 | 1502.3 | CITRATE SYNTHASE, MITOCHONDRIAL PRECURSOR (EC 4.1.3.7). | swissprot O00098 | Energy production and conversion |

TABLE 3-continued

*Aspergillus oryzae* ESTs

| Sequence Listing | zscore | Annotation | Database | Functional Category |
|---|---|---|---|---|
| 6575 | 1500.0 | GTP-BINDING PROTEIN YPT1. | swissprot P33723 | ND |
| 6576 | 150.9 | FLGA insert stabilising polypeptide. | geneseqp W79128 | ND |
| 6577 | 150.8 | EMR1 (FRAGMENT). | sptrembl O08743 | ND |
| 6578 | 150.8 | SALIVARY GLUE PROTEIN SGS-3 PRECURSOR. | swissprot P02840 | ND |
| 7579 | 150.7 | OXIDOREDUCTASE, SHORT-CHAIN DEHYDROGENASE/REDUCTASE FAMILY. | tremblnew AAF09705 | ND |
| 6580 | 150.7 | PROBABLE E4 PROTEIN. | swissprot P06425 | ND |
| 6581 | 150.6 | PUTATIVE ABC-TRANSPORTER, PERMEASE SUBUNIT. | sptrembl Q9Y816 | ND |
| 6582 | 150.6 | PUTATIVE GLYCOSYLTRANSFERASE. | tremblnew CAB60235 | ND |
| 6583 | 150.5 | REGULATORY PROTEIN E2. | sptrembl O40620 | ND |
| 6584 | 150.4 | NEM (NEM). | sptrembl Q94543 | ND |
| 6585 | 150.3 | HYPOTHETICAL 20.8 KD PROTEIN (FRAGMENT). | sptrembl Q69020 | ND |
| 6586 | 150.2 | MAJOR CENTROMERE AUTOANTIGEN B (CENTROMERE PROTEIN B) (CENP-B) (FRAGMENT). | swissnew P49451 | ND |
| 6587 | 150.2 | FISSION YEAST (FRAGMENT). | sptrembl P78755 | ND |
| 6588 | 150.2 | MULTIDRUG RESISTANCE PROTEIN. | tremblnew AAF15356 | ND |
| 6589 | 150.2 | HYPOTHETICAL 42.2 KD PROTEIN. | tremblnew CAB63772 | ND |
| 6590 | 150.2 | Human urogenital sinus-derived growth inhibitory factor ps20. | geneseqp W18066 | ND |
| 6591 | 150.2 | Immunodominant fragment of flagellar pocket antigen of *E. brucei*. | geneseqp R85174 | ND |
| 6592 | 150.2 | TRANSLATION RELEASE FACTOR SUBUNIT 1. | sptrembl O59948 | ND |
| 6593 | 150.1 | KIAA0339. | sptrembl O15047 | ND |
| 6594 | 150.1 | T16O11.4 PROTEIN. | tremblnew AAF07827 | ND |
| 6595 | 150.1 | SER/ARG-RELATED NUCLEAR MATRIX PROTEIN. | sptrembl O60585 | ND |
| 6596 | 150.0 | CYTOCHROME OXIDASE 1 (FRAGMENT). | sptrembl O21778 | ND |
| 6597 | 150.0 | RNA BINDING PROTEIN (FRAGMENT). | tremblnew BAA83714 | ND |
| 6598 | 1496.1 | *A. oryzae* DEBY1058 locus protein sequence. | geneseqp Y39874 | Inorganic ion transport and metabolism |
| 6599 | 1495.3 | 3-KETOACYL-COA THIOLASE, PEROXISOMAL PRECURSOR (EC 2.3.1.16) (BETA-KETOTHIOLASE) (ACETYL-COA ACYLTRANSFERASE) (PEROXISOMAL 3-OXOACYL-COA THIOLASE). | swissprot Q05493 | Lipid metabolism |
| 6600 | 1495.1 | ORYZIN PRECURSOR (EC 3.4.21.63) (ALKALINE PROTEINASE) (ALP) (ASPERGILLUS PROTEINASE B) (ASPERGILLOPEPTIDASE B). | swissprot P12547 | Posttranslational modification, protein turnover, chaperones |
| 6601 | 1494.2 | PUTATIVE ARYL-ALCOHOL DEHYDROGENASE AAD14 (EC 1.1.1.-). | swissprot P42884 | Energy production and conversion |

TABLE 3-continued

*Aspergillus oryzae* ESTs

| Sequence Listing | zscore | Annotation | Database | Functional Category |
|---|---|---|---|---|
| 6602 | 1494.1 | ARGININOSUCCINATE SYNTHASE (EC 6.3.4.5) (CITRULLINE--ASPARTATE LIGASE). | sptrembl O94354 | Amino acid transport and metabolism |
| 6603 | 1493.3 | BETA-N-ACETYLHEXOSAMINIDASE PRECURSOR (EC 3.2.1.52). | tremblnew AAF00010 | ND |
| 6604 | 1492.7 | AMIDOPHOSPHORIBOSYL-TRANSFERASE (EC 2.4.2.14) (GLUTAMINE PHOSPHORIBOSYLPYROPHOSPHATE AMIDOTRANSFERASE) (ATASE). | swissnew Q12698 | Nucleotide transport |
| 6606 | 149.7 | 61 KD PROTEIN HOMOLOG. | swissprot O10270 | ND |
| 6607 | 149.7 | F57I112.6 PROTEIN. | sptrembl O45097 | ND |
| 6608 | 149.6 | MATING PROCESS PROTEIN MID2 (SERINE-RICH PROTEIN SMS1) (PROTEIN KINASE A INTERFERENCE PROTEIN). | swissprot P36027 | ND |
| 6609 | 149.6 | OMEGA SECALIN. | sptrembl O04365 | ND |
| 6610 | 149.6 | PUTATIVE EXTENSIN. | sptrembl Q9ZNU3 | ND |
| 6611 | 149.6 | Rabphilin-3A. | geneseqp R57421 | ND |
| 6612 | 149.5 | HISTONE H1. | swissprot P23444 | ND |
| 6613 | 149.5 | Recombinant transcription enhancer factor 1 RTEF-1A. | geneseqp W58599 | ND |
| 6614 | 149.4 | AT2G22180 PROTEIN. | tremblnew AAD23622 | ND |
| 6615 | 149.4 | PROLINE RICH PROTEIN. | sptrembl O22514 | ND |
| 6616 | 149.3 | Human proteasome-inhibiting protein (P131). | geneseqp Y31376 | ND |
| 6617 | 149.3 | GASTRIC MUCIN (FRAGMENT). | sptrembl Q29070 | ND |
| 6618 | 149.3 | PROLINE RICH PROTEIN. | sptrembl O22514 | ND |
| 6619 | 149.3 | Y18D10A.12 PROTEIN. | sptrembl Q9XW11 | ND |
| 6620 | 149.2 | PROTEIN KINASE DC2 (EC 2.7.1.-). | swissprot P16912 | ND |
| 6621 | 149.2 | SALIVARY PROLINE-RICH PROTEIN PRECURSOR (CLONE CP7) [CONTAINS: BASIC PEPTIDE P-F] (FRAGMENT). | swissprot P02812 | ND |
| 6622 | 149.2 | T7I23.17 PROTEIN. | sptrembl O81911 | ND |
| 6623 | 149.0 | RIBOSOMAL PROTEIN S4 (FRAGMENT). | tremblnew CAA58926 | ND |
| 6624 | 149.0 | Human Nkx2.2 protein fragment corresponding to exon 2. | geneseqp Y25175 | ND |
| 6625 | 1484.6 | ADP-RIBOSYLATION FACTOR. | swissprot P34727 | ND |
| 6626 | 1482.2 | GTP-BINDING NUCLEAR PROTEIN GSP2/CNR2. | swissprot P32836 | ND |
| 6627 | 148.9 | PROTEOPHOSPHOGLYCAN (FRAGMENT). | sptrembl Q9Y075 | ND |
| 6628 | 148.9 | Human neurofilament-M mutant protein fragment 10. | geneseqp Y20728 | ND |
| 6629 | 148.8 | TRANSCRIPTION FACTOR SOX-9. | swissprot P48436 | ND |
| 6630 | 148.8 | CHROMOBOX HOMOLOG 4 (DROSOPHILA PC CLASS) (TRANSCRIPTIONAL REPRESSOR MPC2). | sptrembl O55187 | ND |
| 6631 | 148.7 | Human apolipoprotein E mutant protein fragment 11. | geneseqp Y20298 | ND |
| 6632 | 148.7 | Human secreted protein encoded from gene 16. | geneseqp Y30826 | ND |
| 6633 | 148.5 | ZINC FINGER PROTEIN GLI3. | swissnew Q61602 | ND |
| 6634 | 148.5 | HYPOTHETICAL 35.1 KD PROTEIN. | tremblnew | ND |
| 6635 | 148.4 | F23H12.1 PROTEIN. | sptrembl Q19767 | ND |

TABLE 3-continued

*Aspergillus oryzae* ESTs

| Sequence Listing | zscore | Annotation | Database | Functional Category |
|---|---|---|---|---|
| 6636 | 118.1 | 56 KD TYPE-SPECIFIC ANTIGEN PRECURSOR (TSA) (56 KD SCRUB TYPHUS ANTIGEN) (STA56) (TSR56). | swissprot P37916 | ND |
| 6637 | 148.3 | OPACITY OUTERMEMBRANE PROTEIN (FRAGMENT). | sptrembl Q51125 | ND |
| 6638 | 148.3 | *M. grisea* PTH12 gene product. | geneseqp Y06786 | ND |
| 6639 | 148.2 | CAMP RESPONSE ELEMENT-BINDING PROTEIN CRF-BPA (FRAGMENT). | tremblnew AAC79689 | ND |
| 6640 | 148.2 | ENVELOPE POLYPROTEIN GP160 PRECURSOR [CONTAINS: EXTERIOR MEMBRANE GLYCOPROTEIN (GP120); TRANSMEMBRANE GLYCOPROTEIN (GP41)]. | swissprot P15831 | ND |
| 6641 | 148.2 | Glucose repressor CRE1 of *T. harzianum*. | geneseqp W13845 | ND |
| 6642 | 148.2 | Trypanosoma cruzi antigen repeat sequence. | geneseqp W19102 | ND |
| 6643 | 148.2 | Mycobacterium species protein sequence 50B. | geneseqp Y04998 | ND |
| 6644 | 148.1 | U2 SMALL NUCLEAR RIBONUCLEOPROTEIN AUXILIARY FACTOR 35 KD SUBUNIT RELATED PROTEIN 1. | swissprot Q15695 | ND |
| 6645 | 148.1 | PUTATIVE ACETYL TRANSFERASE. | tremblnew AAF05992 | ND |
| 6646 | 148.1 | AMPHOTROPIC MURINE RETROVIRUS RECEPTOR. | sptrembl Q63488 | ND |
| 6647 | 148.1 | 40S RIBOSOMAL PROTEIN S4 (S7) (YS6) (RP5). | swissprot P05753 | ND |
| 6648 | 148.0 | HYPOTHETICAL 316.1 KD PROTEIN ZC84.1 IN CHROMOSOME III. | swissprot Q03610 | ND |
| 6649 | 1473.8 | ALPHA-GLUCOSIDASE (EC 3.2.1.20) (MALTASE). | swissprot Q02751 | Carbohydrate transport and metabolism |
| 6650 | 1472.1 | 60S RIBOSOMAL PROTEIN 1.1-B (L10A). | swissprot O74836 | Translation, ribosomal structure and biogenesis |
| 6651 | 1471.7 | OSMOTIC SENSITIVITY MAP KINASE. | tremblnew AAF09475 | Signal transduction mechanisms |
| 6652 | 1471.2 | BIFUNCTIONAL PURINE BIOSYNTHESIS PROTEIN ADE17 [INCLUDES: PHOSPHORIBOSYLAMINO-IMIDAZOLECARBOXAMIDE FORMYLTRANSFERASE (EC 2.1.2.3) (AICAR TRANSFORMYLASE); IMP CYCLOHYDROLASE (EC 3.5.4.10) (INOSINICASE) (IMP SYNTHETASE) (ATIC)]. | swissprot P38009 | Nucleotide transport |
| 6653 | 147.9 | DLXIN-1. | tremblnew BAA87959 | ND |
| 6654 | 147.9 | HCR1. | sptrembl O22112 | ND |
| 6655 | 147.9 | PROLINE-RICH PROTEIN. | tremblnew CAB62487 | ND |
| 6656 | 147.8 | F22D6.5 PROTEIN. | sptrembl Q19727 | ND |
| 6657 | 147.8 | Y53H1A.1 PROTEIN. | tremblnew CAB63392 | ND |
| 6658 | 147.8 | PROTEASE. | sptrembl O40637 | ND |
| 6659 | 147.7 | MYOSIN LIGHT CHAIN KINASE ISOFORM-1. | sptrembl O01651 | ND |

TABLE 3-continued

_Aspergillus oryzae_ ESTs

| Sequence Listing | zscore | Annotation | Database | Functional Category |
|---|---|---|---|---|
| 6660 | 147.5 | HYDROXYPROLINE-RICH PROTEIN. | sptrembl Q39949 | ND |
| 6661 | 147.5 | HYPOTHETICAL 37.9 KD PROTEIN C17D1.05 IN CHROMOSOME II. | swissprot Q10203 | ND |
| 6662 | 147.4 | LOW TEMPERATURE ESSENTIAL PROTEIN. | swissprot P07866 | ND |
| 6663 | 147.3 | HYPOTHETICAL 79.7 KD PROTEIN (FRAGMENT). | sptrembl Q9Y4Q3 | ND |
| 6664 | 147.3 | Prod. of DNA of pMG07 used to isolate style-stigma specific gene STG07. | geneseqp R10531 | ND |
| 6665 | 147.3 | T23F1.5 PROTEIN. | sptrembl O18117 | ND |
| 6666 | 147.3 | HYDROXYPROLINE-RICH GLYCOPROTEIN. | sptrembl Q41814 | ND |
| 6667 | 147.3 | DNA-DIRECTED RNA POLYMERASE II LARGE (205 KD) SUBUNIT (EC 2.7.7.6) (FRAGMENT). | sptrembl Q99367 | ND |
| 6668 | 147.2 | 3-ISOPROPYLMALATE DEHYDROGENASE (LEUB). | sptrembl Q51345 | ND |
| 6669 | 147.2 | HYPOTHETICAL 34.9 KD PROTEIN. | sptrembl O65548 | ND |
| 6670 | 147.1 | HYDROPHOBIN CO112. | sptrembl P78602 | ND |
| 6671 | 147.1 | CODED FOR BY C. | sptrembl O01593 | ND |
| 6672 | 147.0 | PUTATIVE ARGININE/SERINE-RICH SPLICING FACTOR. | sptrembl O82021 | ND |
| 6673 | 147.0 | HYPOTHETICAL 50.7 KD PROTEIN. | tremblnew AAD49204 | ND |
| 6674 | 1467.3 | ATP CITRATE LYASE. | sptrembl O93988 | ND |
| 6675 | 1461.7 | Mutant _Aspergillus oryzae_ DEBU032 rescued locus. | geneseqp W37992 | Carbohydrate transport and metabolism |
| 6677 | 146.9 | HYPOTHETICAL 22.8 KD PROTEIN. | tremblnew AAF11733 | ND |
| 6678 | 146.9 | ZHB0005.1. | tremblnew CAB55413 | ND |
| 6679 | 146.8 | HYPOTHETICAL 96.1 KD PROTEIN IN RIM1-RPS14A INTERGENIC REGION. | swissprot P25623 | ND |
| 6680 | 146.8 | ARGININE/SERINE-RICH PROTEIN. | tremblnew | ND |
| 6681 | 146.7 | GASTRIC MUCIN (FRAGMENT). | sptrembl Q29071 | ND |
| 6682 | 146.7 | TRANSPOSABLE ELEMENT ACTIVATOR HYPOTHETICAL 12 KD PROTEIN (AC 12 KD PROTEIN). | swissprot P08771 | ND |
| 6683 | 146.6 | HYPOTHETICAL 102.5 KD PROTEIN B0001.5 IN CHROMOSOME IV. | sptrembl Q17414 | ND |
| 6684 | 146.5 | HYPOTHETICAL 72.1 KD PROTEIN. | sptrembl O23333 | ND |
| 6685 | 146.5 | SPLICEOSOME ASSOCIATED PROTEIN 62 (SAP 62) (SF3A66). | swissprot Q62203 | ND |
| 6686 | 146.5 | CTG26 ALTERNATE OPEN READING FRAME (FRAGMENT). | sptrembl O15421 | ND |
| 6687 | 146.3 | FUSION PROTEIN. | sptrembl Q9YTP6 | ND |
| 6688 | 146.3 | 32 KDA PROTEIN. | sptrembl O09501 | ND |
| 6689 | 146.3 | SEC24A PROTEIN (FRAGMENT). | sptrembl O95456 | ND |
| 6690 | 146.2 | COLLAGEN (FRAGMENT). | sptrembl Q17266 | ND |
| 6691 | 146.2 | Mycobacterium species protein sequence 41T#3. | geneseqp Y04955 | ND |
| 6692 | 146.1 | DNA-BINDING PROTEIN. | sptrembl P87016 | ND |
| 6693 | 146.1 | EXTENSIN PRECURSOR (PROLINE-RICH GLYCOPROTEIN). | swissprot P14918 | ND |
| 6694 | 146.1 | COLLAGEN ALPHA I(X) CHAIN PRECURSOR. | swissprot P23206 | ND |

TABLE 3-continued

*Aspergillus oryzae* ESTs

| Sequence Listing | zscore | Annotation | Database | Functional Category |
|---|---|---|---|---|
| 6695 | 146.0 | ORF M5V234 HYPTHETICAL PROTEIN. | sptrembl Q9YVK9 | ND |
| 6696 | 146.0 | PUTATIVE PROLINE-RICH PROTEIN. | sptrembl Q9ZW08 | ND |
| 6697 | 146.0 | PHYTOCHROME A. | swissprot P06592 | ND |
| 6698 | 146.0 | EXTENSIN. | sptrembl Q39600 | ND |
| 6699 | 1459.6 | BETA-MANNOSIDASE (EC 3.2.1.25). | tremblnew CAB63902 | ND |
| 6700 | 1458.3 | 1,3-BETA-D-GLUCAN SYNTHASE CATALYTIC SUBUNIT. | sptrembl Q92225 | ND |
| 6701 | 1457.4 | MALATE SYNTHASE, GLYOXYSOMAL (EC 4.1.3.2). | swissnew P28344 | Energy production and conversion |
| 6702 | 1455.0 | MODA. | tremblnew AAF24514 | ND |
| 6703 | 1450.9 | ADP-RIBOSYLATION FACTOR. | swissprot P34727 | ND |
| 6704 | 145.9 | LEUCYL AMINOPEPTIDASE. PUTATIVE. | tremblnew AAF10295 | ND |
| 6705 | 145.9 | ENDOSTYLE-SPECIFIC. | sptrembl O44238 | ND |
| 6706 | 145.8 | CODED FOR BY C. ELEGANS CDNA YK24B4.5. | sptrembl Q23064 | ND |
| 6707 | 145.8 | HISTIDINE-RICH. | sptrembl Q18751 | ND |
| 6708 | 145.8 | PANCREATIC HORMONE PRECURSOR (PANCREATIC POLYPEPTIDE) (PP). | swissprot P13083 | ND |
| 6709 | 145.7 | INTRONIC ORF6 (FRAGMENT). | sptrembl O79867 | ND |
| 6710 | 145.7 | Fusaric acid resistance protein encoded by fadB. | geneseqp R13839 | ND |
| 6711 | 145.7 | Human oncoprotein hhc-M mutant protein #3. | geneseqp W40357 | ND |
| 6712 | 145.4 | HYPOTHETICAL 23.0 KD PROTEIN. | sptrembl O94539 | ND |
| 6713 | 145.4 | HYPOTHETICAL 14.4 KD PROTEIN. | tremblnew AAF11093 | ND |
| 6714 | 145.4 | HYPOTHETICAL 56.0 KD PROTEIN. | sptrembl O66965 | ND |
| 6715 | 145.4 | Secreted protein of clone B0114_1. | geneseqp W69339 | ND |
| 6716 | 145.4 | ARGININE-RICH 54 KD NUCLEAR PROTEIN. | sptrembl Q05519 | ND |
| 6717 | 145.3 | YUSZ PROTEIN. | sptrembl O34907 | ND |
| 6718 | 145.3 | CCA2 PROTEIN. | sptrembl O35048 | ND |
| 6719 | 145.2 | 144A LONG HYPOTHETICAL PROTEIN. | sptrembl Q9YD73 | ND |
| 6720 | 145.2 | OLFACTORY RECEPTOR (FRAGMENT). | sptrembl Q9Z232 | ND |
| 6721 | 145.1 | SPERM HISTONE P2 PRECURSOR (PROTAMINE 2). | sptrembl Q02097 | ND |
| 6722 | 145.0 | FIN19.3. | tremblnew AAF19693 | ND |
| 6723 | 145.0 | COPROPORPHYRINOGEN III OXIDASE PRECURSOR (EC 1.3.3.3) (COPROPORPHYRINOGENASE) (COPROGEN OXIDASE) (COX). | swissprot P36551 | ND |
| 6724 | 1449.1 | PEROXISOME ASSEMBLY PROTEIN CAR1 (PEROXIN-2). | swissprot P51021 | ND |
| 6725 | 1449.0 | NAD-SPECIFIC GLUTAMATE DEHYDROGENASE (EC 1.4.1.2) (NAD-GDH) (FRAGMENTS). | swissprot P00365 | Amino acid transport and metabolism |
| 6726 | 1448.4 | 60S RIBOSOMAL PROTEIN L2. | sptrembl O94253 | Translation, ribosomal structure and biogenesis |

TABLE 3-continued

_Aspergillus oryzae_ ESTs

| Sequence Listing | zscore | Annotation | Database | Functional Category |
|---|---|---|---|---|
| 6727 | 1445.5 | 60S RIBOSOMAL PROTEIN L2 (YL6) (L5) (RP8). | swissprot P05736 | Translation, ribosomal structure and biogenesis |
| 6728 | 1444.9 | _Aspergillus fumigatus_ protein 3. | geneseqp W69392 | Amino acid transport and metabolism |
| 6729 | 1443.0 | 26S PROTEASE REGULATORY SUBUNIT 8 HOMOLOG (SUG1 PROTEIN) (CIM3 PROTEIN) (TAT-BINDING PROTEIN TBY1). | swissprot Q01939 | Posttranslational modification, protein turnover, chaperones |
| 6730 | 1442.1 | EPOXIDE HYDROLASE (EC 3.3.2.3). | tremblnew CAB59812 | ND |
| 6731 | 144.8 | LWS OPSIN. | sptrembl Q9W771 | ND |
| 6732 | 144.7 | Banana ripening fruit chitinase. | geneseqp Y05847 | ND |
| 6733 | 144.7 | (AG876 ISOLATE) U2-IR2 DOMAIN ENCODING NUCLEAR PROTEIN EBNA2, COMPLETE CDS. | sptrembl Q69022 | ND |
| 6734 | 144.6 | CODED FOR BY C. ELEGANS CDNA YK91G9.5 | sptrembl Q21721 | ND |
| 6735 | 144.6 | PISTIL-SPECIFIC EXTENSIN-LIKE PROTEIN PRECURSOR (FRAGMENT). | sptrembl Q40548 | ND |
| 6736 | 144.6 | LSFR1 PROTEIN (FRAGMENT). | sptrembl Q9W6U3 | ND |
| 6737 | 144.5 | MYCB. | tremblnew AAF08796 | ND |
| 6738 | 144.5 | PROBABLE MANNOSYLTRANSFERASE KTR5 (EC 2.4.1.131). | swissprot P53966 | ND |
| 6739 | 144.5 | HYPOTHETICAL 50.6 KD PROTEIN IN THE 5'REGION OF GYRA AND GYRB (ORF 3). | swissprot P21561 | ND |
| 6740 | 144.5 | Thyroid peroxidase deletion mutant 10. | geneseqp W48791 | ND |
| 6741 | 144.4 | FILAGGRIN (PROFILAGGRIN) (FRAGMENT). | sptrembl Q03840 | ND |
| 6742 | 144.3 | Murine secreted protein K39_7. | geneseqp Y08631 | ND |
| 6743 | 144.3 | P2X2 RECEPTOR (FRAGMENT). | sptrembl O88481 | ND |
| 6744 | 144.1 | Human interferon alpha2/omega1(Glu) hybrid. | geneseqp R24030 | ND |
| 6745 | 144.0 | R12E2.5 PROTEIN. | sptrembl O61787 | ND |
| 6746 | 144.0 | BETA-GALACTOSIDASE ALPHA PEPTIDE (FRAGMENT). | sptrembl Q46473 | ND |
| 6747 | 144.0 | COMPLETE GENOME (FRAGMENT). | sptrembl O41250 | ND |
| 6748 | 1437.3 | PROBABLE CALCIUM-TRANSPORTING APASE A (EC 3.6.1.38). | swissprot P39986 | Inorganic ion transport and metabolism |
| 6749 | 1434.1 | PROLYL DIPEPTIDYL PEPTIDASE PRECURSOR (EC 3.4.14.5) (DIPEPTIDYL-PEPTIDASE IV) (DIPEPTIDYL AMINOPEPTIDASE IV) (XAA-PRO-DIPEPTIDYLAMINOPLEPTIDASE) (GLY-PRO NAPHTHYLAMIDASE) (POST-PROLINE DIPEPTIDYL AMINOPEPTIDASE IV). | sptrembl O42812 | Amino acid transport and metabolism |
| 6750 | 143.9 | PUTATIVE PROLINE-RICH PROTEIN. | tremblnew CAB43973 | ND |

TABLE 3-continued

_Aspergillus oryzae_ ESTs

| Sequence Listing | zscore | Annotation | Database | Functional Category |
|---|---|---|---|---|
| 6751 | 143.9 | N-MYC PROTO-ONCOGENE PROTEIN. | swissprot P03966 | ND |
| 6752 | 143.9 | Bovine prion protein derived peptide III. | geneseqp Y07999 | ND |
| 6753 | 143.8 | Protein encoded by pLIV1 gene partial sequence. | geneseqp W34528 | ND |
| 6754 | 143.8 | HEPATITIS A VIRUS CELLULAR RECEPTOR 1 LONG FORM (HEPATITIS A VIRUS CELLULAR RECEPTOR I SHORT FORM). | sptrembl O46597 | ND |
| 6755 | 143.8 | HRSMAD1/5. | sptrembl O97044 | ND |
| 6756 | 143.8 | SERUM OPACITY FACTOR PRECURSOR (FRAGMENT). | sptrembl Q9XCK5 | ND |
| 6757 | 143.8 | F45B8.3 PROTEIN. | tremblnew CAB05726 | ND |
| 6758 | 143.8 | NADH DEHYDROGENASE SUBUNIT 4 (FRAGMENT). | tremblnew AAF17853 | ND |
| 6759 | 143.8 | EXTENSIN (PROLINE-RICH GLYCOPROTEIN) (CLONE UG) (FRAGMENT). | sptrembl Q01944 | ND |
| 6760 | 143.7 | HTLV-1 RELATED ENDOGENOUS RETROVIRAL SEQUENCE P25 (HRES-1/1). | sptrembl P13985 | ND |
| 6761 | 143.7 | NUCLEAR FACTOR I-B2 (NUCLEAR FACTOR I B-TYPE). | sptrembl O00712 | ND |
| 6762 | 143.7 | HOMEOBOX PROTEIN GOOSECOID. | swissnew P54366 | ND |
| 6763 | 143.7 | Y47H9B.1 PROTEIN. | sptrembl Q9XWZ7 | ND |
| 6764 | 143.6 | I.W OPSIN (FRAGMENT). | sptrembl Q28879 | ND |
| 6765 | 143.5 | HYPOTHETICAL 45.9 KD PROTEIN AC3.3 IN CHROMOSOME V PRECURSOR. | sptrembl Q17400 | ND |
| 6766 | 143.5 | Rat rSK2 protein. | geneseqp W63702 | ND |
| 6767 | 143.5 | F07A5.2 PROTEIN. | sptrembl Q19138 | ND |
| 6768 | 143.4 | PROTAMINE. | swissprot P17502 | ND |
| 6769 | 143.4 | MITOCHANDRIAL TRANSFER RNA HIS.16S RIBOSOMAL RNA (16S RRNA) GENES, ND3 (16S RRNA). | sptrembl Q35014 | ND |
| 6770 | 143.3 | HYPOTHETICAL 34.6 KD PROTEIN. | sptrembl Q9Y7R6 | ND |
| 6771 | 143.3 | GROUCHO 1 PROTEIN (FRAGMENT). | swissprot O13168 | ND |
| 6772 | 143.3 | SERICIN PRECURSOR. | swissprot P07856 | ND |
| 6774 | 143.3 | SERINE-RICH PROTEIN | sptrembl O94317 | ND |
| 6775 | 143.2 | ARGININE/SERINE-RICH PROTEIN. | tremblnew AAF19004 | ND |
| 6776 | 143.2 | SALIVARY GLAND SECRETION PROTEIN (FRAGMENT). | sptrembl Q9Y0E8 | ND |
| 6777 | 143.2 | P2811 antigen. | geneseqp P82966 | ND |
| 6778 | 143.1 | STRAIN Z29, COMPLETE GENOME. | tremblnew AAD49620 | ND |
| 6779 | 143.1 | Collagen like protein (CLP)-VI. | geneseqp R95144 | ND |
| 6780 | 143.0 | Z10F PROTEIN. | sptrembl O87025 | ND |
| 6781 | 1427.2 | SULFATE PERMEASE SUTB. | tremblnew AAF14539 | Inorganic ion transport and metabolism |
| 6782 | 1421.8 | MALATE SYNTHASE, GLYOXYSOMAL (EC 4.1.3.2). | swissnew P28345 | Energy production and conversion |
| 6783 | 1420.4 | PROTEIN TRANSPORT PROTEIN SEC23 HOMOLOG. | sptrembl O74873 | ND |

TABLE 3-continued

_Aspergillus oryzae_ ESTs

| Sequence Listing | zscore | Annotation | Database | Functional Category |
|---|---|---|---|---|
| 6784 | 1420.4 | 60S RIBOSOMAL PROTEIN L15. | swissprot O13418 | Translation, ribosomal structure and biogenesis |
| 6785 | 142.9 | C29F7.5 PROTEIN. | sptrembl O17617 | ND |
| 6786 | 142.9 | Drosophila Acp36DE protein. | geneseqp Y22176 | ND |
| 6787 | 142.8 | GIBBERELLIN-REGULATED PROTEIN PRECURSOR. | swissprot P46689 | ND |
| 6788 | 142.8 | NADH-UBIQUINONE OXIDOREDUCTASE SUBUNIT 1. | tremblnew CAB55576 | ND |
| 6789 | 142.7 | PISTIL EXTENSIN-LIKE PROTEIN. | sptrembl Q40385 | ND |
| 6790 | 142.7 | SANT DOMAIN PROTEIN SMRTER. | tremblnew AAD52614 | ND |
| 6791 | 142.7 | ALDEHYDE DEHYDROGENASE, CYTOCHROME C SUBUNIT PRECURSOR. | sptrembl O30327 | ND |
| 6792 | 142.7 | Y49E10.17 PROTEIN. | sptrembl Q9XTU4 | ND |
| 6793 | 142.7 | CODED FOR BY C. ELEGANS CDNA YK65E4.5. | sptrernbl P01497 | ND |
| 6794 | 142.7 | DEFORMED (FRAGMENT). | sptrembl O44258 | ND |
| 6795 | 142.7 | MUCIN. | sptrembl Q63549 | ND |
| 6796 | 142.7 | HISTONE III PROTEIN. | sptrembl Q9XYY5 | ND |
| 6797 | 142.7 | PROTEIN UL53 (HFRF2 PROTEIN). | swissprot P16794 | ND |
| 6798 | 142.6 | F14M4.8 PROTEIN. | sptrembl O80716 | ND |
| 6799 | 142.6 | HPLC6 PROTEIN (FRAGMENT). | sptrembl Q03659 | ND |
| 6800 | 142.6 | LIMA (FRAGMENT). | sptrembl P90533 | ND |
| 6801 | 142.6 | PHOSPHOGLUCOMUTASE. | sptrembl O74374 | ND |
| 6802 | 142.6 | Paplloma virus major capsid protein. | geneseqp R88275 | ND |
| 6803 | 142.5 | VERY HYPOTHETICAL 14.3 KD PROTEIN IN AAC1-FET3 INTERGENIC REGION. | swissprot Q04674 | ND |
| 6804 | 142.5 | ORF 59. | sptrembl Q9YTK8 | ND |
| 6805 | 142.5 | PRPL-2 PROTEIN. | sptrembl Q15220 | ND |
| 6806 | 142.4 | SMALL S PROTEIN. | sptrembl O55496 | ND |
| 6807 | 142.4 | INSECT INTESTINAL MUCIN IIM14. | sptrembl O18510 | ND |
| 6808 | 142.4 | EG:140G11.3 PROTEIN. | sptrembl O97172 | ND |
| 6809 | 142.4 | ALLERGEN. | sptrembl O74682 | ND |
| 6810 | 142.4 | PYRROLIDONE-CARBOXYLATE PEPTIDASE (EC 3.4.19.3) (5-OXOPROLYL-PEPTIDASE) (PYROGLUTAMYL-PEPTIDASE I). | tremblnew CAB50353 | ND |
| 6811 | 142.3 | RNA-BINDING PROTEIN. | sptrembl Q15287 | ND |
| 6812 | 142.2 | LIN-15B PROTEIN. | sptrembl Q27395 | ND |
| 6813 | 142.2 | F23N19.12. | tremblnew AAF19547 | ND |
| 6814 | 142.2 | AXOTROPHIN. | sptrembl Q9WV66 | ND |
| 6815 | 142.2 | _Porphorymonas gingivalis_ protein PG121. | geneseqp Y34466 | ND |
| 6816 | 142.2 | HYPOTHETICAL 32.1 KD PROTEIN. | sptrembl O74387 | ND |
| 6817 | 142.2 | Clone HNFGW06 of EGFR receptor family. | geneseqp W61630 | ND |
| 6818 | 142.2 | NUCLEOPORIN-LIKE PROTEIN. | sptrembl O23173 | ND |
| 6819 | 142.1 | AMELOGENIN (FRAGMENT). | swissprot O97647 | ND |
| 6820 | 142.0 | PAX6-LIKE PROTEIN. | sptrembl Q25411 | ND |
| 6821 | 142.0 | SER- AND THR-RICH PROTEIN (FRAGMENT). | sptrembl Q26596 | ND |

TABLE 3-continued

Aspergillus oryzae ESTs

| Sequence Listing | zscore | Annotation | Database | Functional Category |
|---|---|---|---|---|
| 6822 | 142.0 | SCO-SPONDIN (FRAGMENT). | sptrembl Q9XSV8 | ND |
| 6823 | 1416.2 | 60S ACIDIC RIBOSOMAL PROTEIN P0 (L10E). | swissprot P05317 | Translation, ribosomal structure and biogenesis |
| 6824 | 1411.8 | THIOREDOXIN REDUCTASE (EC 1.6.4.5). | swissprot P43496 | Posttranslational modification, protein turnover, chaperones |
| 6825 | 141.9 | HYPOTHETICAL 39.0 KD PROTEIN. | sptrembl O74371 | ND |
| 6826 | 141.9 | F17L21.1. | sptrembl Q9ZW67 | ND |
| 6827 | 141.9 | 60S RIBOSOMAL PROTEIN 1.7, MITOCHONDRIAL PRECURSOR (YML7). | swissprot P36519 | ND |
| 6828 | 141.8 | ACTIVATING TRANSCRIPTION FACTOR 2. | sptrembl Q91576 | ND |
| 6829 | 141.8 | HYPOTHETICAL 27.8 KD PROTEIN. | sptrembl O54181 | ND |
| 6830 | 141.8 | Amino acid sequence of a virulence factor encoded by ORF30221. | geneseqp Y29214 | ND |
| 6831 | 141.7 | CASEIN KINASE II BETA CHAIN (CK II) (EC 2.7.1.37). | swissprot P38930 | ND |
| 6832 | 141.7 | EXTENSIN=NODULE-SPECIFIC PROLINE-RICH PROTEIN {CLONE VFNDS-E}. | tremblnew G425682 | ND |
| 6833 | 141.7 | Human 5' EST secreted protein SEQ ID NO:344. | geneseqp Y12313 | ND |
| 6834 | 141.6 | V1-Lab-Vh construction (5A). single chain antibody. | geneseqp R14698 | ND |
| 6835 | 141.6 | HYPOTHETICAL PROTEIN (FRAGMENT). | sptrembl Q17269 | ND |
| 6836 | 141.6 | PLENTY-OF-PROLINES-101. | sptrembl O70495 | ND |
| 6837 | 141.6 | PLENTY-OF-PROLINES-101. | sptrembl O70495 | ND |
| 6838 | 141.5 | T1J1.3 PROTEIN. | sptrembl Q9ZPH7 | ND |
| 6839 | 141.3 | F16B22.21 PROTEIN. | sptrembl O80511 | ND |
| 6840 | 141.3 | 130AA LONG HYPOTHETICAL PROTEIN. | sptrembl Q9YD79 | ND |
| 6841 | 141.2 | PUTATIVE SERINE/THREONINE PROTEIN KINASE. | sptrembl Q9ZNQ8 | ND |
| 6842 | 141.1 | AGR RELATED DNA SEQUENCE, TWO COMPLETE CODING REGIONS AND TWO INCOMPLETE CODING REGIONS. | sptrembl Q54337 | ND |
| 6843 | 141.1 | MICROTUBULE-ASSOCIATED PROTEIN 4. | swissprot P27546 | ND |
| 6844 | 141.1 | Keratan sulphate 6-sulphotransferase. | geneseqp W61100 | ND |
| 6845 | 141.1 | PUTATIVE. | sptrembl Q9ZLR2 | ND |
| 6846 | 141.1 | HYPOTHETICAL 40.9 KD PROTEIN C08B11.5 IN CHROMOSOME II. | swissprot Q09442 | ND |
| 6847 | 141.0 | A_IG002N01.14. | sptrembl O04621 | ND |
| 6848 | 141.0 | R. eutropha Mgt partial ORF3 encoded protein. | geneseqp W92640 | ND |
| 6849 | 141.0 | F56D12.5 PROTEIN. | sptrembl O16646 | ND |
| 6850 | 141.0 | PEPTIDE FOLLOWING ISV-A1. | sptrembl Q48355 | ND |
| 6851 | 141.0 | Cardiac adenylyl cyclase. | geneseqp R78519 | ND |
| 6852 | 141.0 | PUTATIVE 60S RIBOSOMAL PROTEIN L24. | tremblnew AAD24643 | ND |

TABLE 3-continued

_Aspergillus oryzae_ ESTs

| Sequence Listing | zscore | Annotation | Database | Functional Category |
|---|---|---|---|---|
| 6853 | 1406.7 | PUTATIVE YEAST CELL DIVISION CONTROL PROTEIN 68 HOMOLOG, PUTATIVE TRANSCRIPTIONAL ACTIVATOR. | sptrembl O94267 | ND |
| 6854 | 1405.2 | PROTEASOME COMPONENT PUP1 PRECURSOR (EC 3.4.99.46) (MACROPAIN SUBUNIT PUP1) (PROEINASE YSCE SUBUNIT PUP1) (MULTICATALYTIC ENDOPEPTIDASE COMPLEX SUBUNIT PUP1). | swissprot P25043 | Posttranslational modification, protein turnover, chaperones |
| 6855 | 1405.1 | BETA-GLUCOSIDASE I PRECURSOR (EC 3.2.1.21) (GENTIOBIASE) (CELLOBIASE) (BETA-D-GLUCOSIDE GLUCOHYDROLASE). | swissprot P48825 | ND |
| 6856 | 1401.2 | HYPOTHETICAL 126.6 KD PROTEIN IN RPL36A-VT11 INTERGENIC REGION. | swissprot Q04336 | ND |
| 6857 | 140.9 | Human normal ovarian tissue derived protein 68. | geneseqp Y59791 | ND |
| 6858 | 140.9 | HYPOTHETICAL 61.1 KD PROTEIN (FRAGMENT). | tremblnew CAB63715 | ND |
| 6859 | 140.9 | F56D12.5 PROTEIN. | sptrembl O16646 | ND |
| 6860 | 140.8 | EG:63B12.11 PROTEIN. | sptrembl O97419 | ND |
| 6861 | 140.8 | HYPOTHETICAL 6.0 KD PROTEIN IN TH112 5'REGION. | swissprot P53820 | ND |
| 6862 | 140.8 | 120 KDA STYLE GLYCOPROTEIN. | sptrembl O49986 | ND |
| 6863 | 140.8 | TRANSGLUTAMINASE PRECURSOR (EC 2.3.2.13). | tremblnew | ND |
| 6864 | 140.6 | SIMILARITY TO HUMAN SYNAPSIN 1B. | sptrembl Q23352 | ND |
| 6865 | 140.6 | SRC2-LIKE PROTEIN. | sptrembl O81814 | ND |
| 6866 | 140.6 | ER interacting domain of A1B1 protein. | geneseqp W81028 | ND |
| 6867 | 140.6 | CZP-3. | geneseqp R48068 | ND |
| 6868 | 140.5 | Porcine retrovirus GAG protein. | geneseqp W329271 | ND |
| 6869 | 140.5 | HYPOTHETICAL 91.1 KD PROTEIN R144.2 IN CHROMOSOME III. | swissprot Q09345 | ND |
| 6870 | 140.5 | SERINE/THREONINE PROTEIN KINASE. | sptrembl O32382 | ND |
| 6871 | 140.4 | ORF115. | sptrembl Q37123 | ND |
| 6872 | 140.4 | Fragment of human secreted protein encoded by gene 76. | geneseqp W78321 | ND |
| 6873 | 140.4 | MEROZOITE SURFACE PROTEIN-1 (FRAGMENT). | tremblnew | ND |
| 6874 | 140.4 | ENVELOPE PROTEIN (FRAGMENT). | sptrembl O73231 | ND |
| 6875 | 140.4 | PROTODERMAL FACTOR 1. | tremblnew AAD33869 | ND |
| 6876 | 140.3 | ALXA AND HSDM. | sptrembl P95510 | ND |
| 6877 | 140.3 | COUNTERPART OF HSV-1 GENE RL2 AND VZV GENE 61. | sptrembl O39303 | ND |
| 6878 | 140.3 | ANTIGENIC POLYPEPTIDE (FRAGMENT). | sptrembl O96082 | ND |
| 6879 | 140.3 | HYPOTHETICAL 30.9 KD PROTEIN B1549_C2_213. | swissnew P52063 | ND |
| 6880 | 140.3 | CARROT HYPOCOTIL SPECIFIC. | sptrembl P93705 | ND |
| 6881 | 140.3 | SIGNAL RECOGNITION PARTICLE 19 KD PROTEIN (SRP19). | swissprot P49964 | ND |
| 6882 | 140.3 | HYPOTHETICAL 41.1 KD PROTEIN. | tremblnew CAB51986 | ND |

TABLE 3-continued

_Aspergillus oryzae_ ESTs

| Sequence Listing | zscore | Annotation | Database | Functional Category |
|---|---|---|---|---|
| 6883 | 140.3 | P2V PROTEIN. | sptrembl O89170 | ND |
| 6884 | 140.2 | HYPOTHETICAL 90.0 KD PROTEIN. | sptrembl Q9WQH0 | ND |
| 6885 | 140.2 | MGI-HIGH MOLECULAR WEIGHT MUCIN {3} REGION (FRAGMENT). | sptrembl Q93043 | ND |
| 6886 | 140.2 | HLARK. | sptrembl O02916 | ND |
| 6887 | 140.2 | SPERM CHROMATIN HMRBNP/H1. | sptrembl Q98979 | ND |
| 6888 | 140.1 | SPLICING FACTOR, ARGININE/SERINE-RICH 6 (PRE-MRNA SPLICING FACTOR SRP55). | swissnew Q13247 | ND |
| 6889 | 140.1 | SODIUM- AND CHLORIDE-DEPENDENT CREATINE TRANSPORTER 1 (CT1). | swissprot P31661 | ND |
| 6890 | 140.1 | HYPOTHETICAL 47.8 KD PROTEIN YOR009W. | sptrembl Q12218 | ND |
| 6891 | 140.0 | DESB (EC 3.5.4.5). | tremblnew AAD30442 | ND |
| 6892 | 140.0 | HYPOTHETICAL PROTEIN E-115. | swissprot P03290 | ND |
| 6893 | 1393.7 | HYPOTHETICAL 38.3 KD PROTEIN IN RPL11B-PDC6 INTERGENIC REGION. | swissprot P53252 | ND |
| 6894 | 1393.0 | PUTATIVE MITOCHONDRIAL PROTEIN IMPORT PROTEIN - DNAJ PROTEIN. | sptrembl O74752 | Posttranslational modification, protein turnover, chaperones |
| 6895 | 1392.9 | VACUOLAR ATP SYNTHASE SUBUNIT B (EC 3.6.1.34) (V-ATPASE 57 KD SUBUNIT). | swissprot P22550 | Energy production and conversion |
| 6896 | 1390.1 | ORNITHINE DECARBOXYLASE. | tremblnew CAB56523 | Amino acid transport and metabolism |
| 6897 | 139.8 | CYCLIC NUCLEOTIDE-GATED CHANNEL BETA SUBUNIT. | sptrembl O35788 | ND |
| 6898 | 139.8 | Toxic shock syndrome toxin-1. | geneseqp R95904 | ND |
| 6899 | 139.7 | HYPOTHETICAL 18.3 KD PROTEIN ZK1321.1 IN CHROMOSOME II. | swissprot Q09368 | ND |
| 6900 | 139.7 | OUTER CAPSID PROTEIN VP4 (HEMAGGLUTININ) (OUTER LAYER PROTEIN VP4) [CONTAINS: OUTER CAPSID PROTEINS VP5 AND VP8]. | swissprot P13842 | ND |
| 6901 | 139.7 | 464AA LONG HYPOTHETICAL PROTEIN. | sptrembl Q9YEB8 | ND |
| 6902 | 139.7 | HYPOTHETICAL 91.0 KD PROTEIN. | sptrembl Q9X4F5 | ND |
| 6903 | 139.6 | HYPOTHETICAL 96.9 KD PROTEIN. | tremblnew CAA22569 | ND |
| 6904 | 139.6 | IMMUNOGLOBULIN 216 aa, chain A+B. | pdb IMCJ | ND |
| 6905 | 139.5 | 202AA LONG HYPOTHETICAL PROTEIN. | sptrembl Q9Y9D4 | ND |
| 6906 | 139.5 | HYPOTHETICAL 13.9 KD PROTEIN. | tremblnew AAF19661 | ND |
| 6907 | 139.5 | PHLB PROTEIN PRECURSOR. | swissprot P18954 | ND |
| 6908 | 139.5 | HYPOTHETICAL 14.6 KD PROTEIN. | sptrembl O53621 | ND |
| 6909 | 139.4 | F18B13.26 PROTEIN. | tremblnew AAD55474 | ND |
| 6910 | 139.3 | CELL WALL PROTEIN. | sptrembl Q40336 | ND |
| 6911 | 139.3 | VIRAL PROTEIN 1 (FRAGMENT). | sptrembl Q85146 | ND |
| 6912 | 139.3 | T2N18.14 PROTEIN. | sptrembl Q9ZQC7 | ND |

TABLE 3-continued

_Aspergillus oryzae_ ESTs

| Sequence Listing | zscore | Annotation | Database | Functional Category |
|---|---|---|---|---|
| 6913 | 139.3 | SIMILARITY TO C2112-TYPE ZINC FINGER DOMAIN. | sptrembl Q17548 | ND |
| 6914 | 139.3 | 22 KD GAMMA-COIXIN PRECURSOR. | sptrembl Q00318 | ND |
| 6915 | 139.3 | DIHYDROOROTASE (EC 3.5.2.3) (DHOASE). | swissprot P96081 | ND |
| 6916 | 139.3 | deg-3 gene product. | geneseqp R42747 | ND |
| 6917 | 139.2 | C09G9.2 PROTEIN. | sptrembl Q17872 | ND |
| 6918 | 139.1 | RECEPTOR-LIKE KINASE LRK10 (FRAGMENT). | sptrembl Q9XHQ3 | ND |
| 6919 | 139.1 | COSMID F56D3. | sptrembl Q20877 | ND |
| 6920 | 139.0 | GLUCOAMYLASE. | tremblnew AAC49609 | ND |
| 6921 | 139.0 | SUBMAXILLARY GLAND ANDROGEN REGULATED PROTEIN 3 PRECURSOR (MSG3 MRNA). | sptrembl Q61902 | ND |
| 6922 | 139.0 | XNP-1. | tremblnew AAD55361 | ND |
| 6923 | 139.0 | NAPF. | sptrembl O86474 | ND |
| 6924 | 139.0 | TRANSCRIPTION INITIATION FACTOR IIE BETA SUBUNIT (TEHE-BETA) (S.POMBE TFA2 HOMOLOG). | sptrembl P79011 | ND |
| 6925 | 139.0 | DJ789O11.1 PUTATIVE GAMMA-HEREGULIN LIKE PROTEIN) (FRAGMENT). | sptrembl O75999 | ND |
| 6926 | 1387.7 | ACTIN-LIKE PROTEIN ARP2. | swissprot P32381 | Cell division and chromosome partitioning |
| 6927 | 1386.5 | OROTIDINE 5'-PHOSPHATE DECARBOXYLASE (EC 4.1.1.23) (OMP DECARBOXYLASE). | swissprot O13416 | Nucleotide transport |
| 6928 | 1383.8 | ANTHRANILATE SYNTHASE COMPONENT I (EC 4.1.3.27). | swissprot P00899 | Coenzyme metabolism |
| 6929 | 138.9 | SERINE HYDROXYMETHYLTRANS-FERASE (EC 2.1.2.1) (SERINE METHYLASE) (SHMT). | swissprot O29406 | ND |
| 6930 | 138.9 | EG:114E2.2 PROTEIN. | sptrembl O46042 | ND |
| 6931 | 138.9 | LONG-CHAIN-FATTY-ACID COA LIGASE. | sptrembl P73004 | ND |
| 6932 | 138.9 | GLUCOSE TRANSPORTER TYPE 4, INSULIN-RESPONSIVE. | swissprot Q27994 | ND |
| 6933 | 138.9 | HYPOTHETICAL PROTEIN (FRAGMENT). | sptrembl P72068 | ND |
| 6934 | 138.8 | SIMILARITY TO RHODOPSIN. | sptrembl Q19607 | ND |
| 6935 | 138.8 | HISTONE H1.2. | sptrembl Q94555 | ND |
| 6936 | 138.8 | ORF79 PROTEIN. | tremblnew BAA84914 | ND |
| 6937 | 138.8 | OVERLAPPING PROTEIN. | sptrembl O91259 | ND |
| 6938 | 138.7 | METALLOTHIONEIN ISOFORM (FRAGMENT). | sptrembl P79375 | ND |
| 6939 | 138.7 | PTS SYSTEM CELLOBIOSE-SPECIFIC IIC COMPONENT (EIIC-CEL) (CELLOBIOSE- PERMEASE IIC COMPONENT) (PHOSPHOTRANSFERASE ENZYME II.C COMPONENT). | swissprot Q45400 | ND |
| 6940 | 138.6 | N-MYC 2 PROTO-ONCOGENE PROTEIN. | swissprot Q64210 | ND |
| 6941 | 138.6 | hCG/hFSH chimera, B12. | geneseqp Q85079 | ND |
| 6942 | 138.6 | BETA-B-PROTEIN. | sptrembl Q85079 | ND |
| 6943 | 138.6 | Bovine neutrophil beta-defensin peptide BNBD-5. | geneseqp R63514 | ND |

TABLE 3-continued

Aspergillus oryzae ESTs

| Sequence Listing | zscore | Annotation | Database | Functional Category |
|---|---|---|---|---|
| 6944 | 138.5 | Neuropeptide receptor. | geneseqp W06124 | ND |
| 6945 | 138.5 | MAD HOMOLOG SMAD5. | sptrembl P97454 | ND |
| 6946 | 138.5 | Autotaxin derived from human liver cells. | geneseqp R86580 | ND |
| 6947 | 138.4 | HYPOTHETICAL 65.2 KD PROTEIN. | sptrembl O61105 | ND |
| 6948 | 138.4 | GENTISATE 1,2-DIOXYGENASE (FRAGMENT). | sptrembl O73956 | ND |
| 6949 | 138.3 | HIV Tat protein. | geneseqp Y05097 | ND |
| 6950 | 138.2 | E2 GLYCOPROTEIN PRECURSOR (SPIKE GLYCOPROTEIN) (PEPLOMER PROTEIN) [CONTAINS: SPIKE PROTEIN S1, SPIKE PROTEIN S2). | swissprot P11223 | ND |
| 6951 | 138.1 | ATP SYNTHASE PROTEIN 8 (EC 3.6.1.34) (A6L). | swissprot P03929 | ND |
| 6952 | 138.1 | HOMEOBOX PROTEIN HOX-A10 (HOX-1H) (HOX-1.8) (PL). | swissnew P31260 | ND |
| 6953 | 138.0 | SERINE-RICH PROTEIN. | sptrembl O94317 | ND |
| 6954 | 1376.9 | ACETYL-COENZYME A SYNTHETASE (EC 6.2.1.1) (ACETATE--COA LIGASE) (ACYL- ACTIVATING ENZYME). | swissprot P16928 | Lipid metabolism |
| 6955 | 1373.9 | PHOSPHATE-REPRESSIBLE PHOSPHATE PERMEASE. | swissprot P15710 | Inorganic ion transport and metabolism |
| 6956 | 137.9 | KIAA1048 PROTEIN. | tremblnew BAA83000 | ND |
| 6957 | 137.9 | HYPOTHETICAL PROTEIN. | tremblnew BAA87840 | ND |
| 6958 | 137.8 | HOMEOTIC CAUDAL PROTEIN. | swissprot P09085 | ND |
| 6959 | 137.8 | POSTSYNAPTIC DENSITY PROTEIN. | tremblnew AAC25483 | ND |
| 6960 | 137.8 | HYPOTHETICAL 14.7 KD PROTEIN. | sptrembl O33136 | ND |
| 6961 | 137.8 | HYPOTHETICAL 14.2 KD PROTEIN. | tremhlnew AAF10317 | ND |
| 6962 | 137.8 | SENSOR KINASE. | sptrembl O34757 | ND |
| 6963 | 137.7 | PISTIL-SPFCIFIC EXTENSIN-LIKE PROTEIN PRECURSOR (FRAGMENT). | sptrembl Q40548 | ND |
| 6964 | 137.7 | ENDOSTYLE-SPFCIFIC. | sptrembl O4423R | ND |
| 6965 | 137.6 | PUTATIVE CARBOXYPEPTIDASE S PRECURSOR (EC 3.4.17.4) (YSCS) (GLY-X CARBOXYPEPTIDASE). | sptrembl O13968 | ND |
| 6966 | 137.5 | SMALL NUCLEAR RIBONUCLEOPROTEIN B. | tremblnew AAD54488 | ND |
| 6967 | 137.5 | OMP of Bordetella pertussis. | geneseqp R21691 | ND |
| 6968 | 137.5 | LIPID TRANSFER PROTEIN. | sptrembl O22110 | ND |
| 6969 | 137.5 | HYPOTHETICAL 18.9 KD PROTEIN. | sptrembl Q55554 | ND |
| 6970 | 137.5 | HYPOTHETICAL 32.8 KD PROTEIN (FRAGMENT). | tremblnew CAB59245 | ND |
| 6971 | 137.4 | NUCLEAR TRANSITION PROTEIN 2 (TP-2). | sptrembl Q64561 | ND |
| 6972 | 137.3 | MAMMALIAN ACYLCOA OXIDASE HOMOLOGOUS (FRAGMENT). | sptrembl Q43476 | ND |
| 6973 | 137.3 | TRANSCRIPTION FACTOR SOX-10. | swissprot O55170 | ND |
| 6974 | 137.3 | HYPOTHETICAL 28.1 KD PROTEIN. | sptrembl O23285 | ND |
| 6975 | 137.2 | PHOSPHOLIPASE D2. | sptrembl O43580 | ND |

TABLE 3-continued

*Aspergillus oryzae* ESTs

| Sequence Listing | zscore | Annotation | Database | Functional Category |
|---|---|---|---|---|
| 6976 | 137.2 | GLUCOAMYLASE S1/S2 PRECURSOR (EC 3.2.1.3) (GLUCAN 1,4-ALPHA-GLUCOSIDASE) (1,4-ALPHA-D-GLUCAN GLUCOHYDROLASE). | swissprot P08640 | ND |
| 6977 | 137.2 | DIPEPTIDE ABC TRANSPORTER, ATP-BINDING PROTEIN (DPPF). | sptrembl O28503 | ND |
| 6978 | 137.1 | INSULIN RECEPTOR SUBSTRATE-2. | sptrembl Q9Y615 | ND |
| 6979 | 137.1 | DESSICATION-RELATED PROTEIN CLONE PCC6-19 (CDFT6-19). | swissprot P22239 | ND |
| 6980 | 1366.0 | UBIQUITIN-CONJUGATING ENZYME E2-16 KD (EC 6.3.2.19) (UBIQUITIN-PROTEIN LIGASE) (UBIQUITIN CARRIER PROTEIN) (COLLETOTRICHUM HARD-SURFACE-INDUCED PROTEIN 1). | sptrembl O74196 | ND |
| 6981 | 1364.6 | TRANSALDOLASE (EC 2.2.1.2). | sptrembl O42700 | Carbohydrate transport and metabolism |
| 6982 | 1355.4 | METHYLCITRATE SYNTHASE PRECURSOR (EC 4.1.3.31). | tremblnew CAB53336 | Energy production and conversion |
| 6983 | 1354.5 | 100 KDA PROTEIN. | sptrembL O60040 | ND |
| 6984 | 1352.3 | *A. oryzae* DEBY932 locus protein sequence. | geneseqp Y39873 | Carbohydrate transport and metabolism |
| 6985 | 1352.2 | MITOCHONDRIAL CARRIER PROTEIN. | sptrembl O74439 | ND |
| 6986 | 1352.2 | PYRUVATE KINASE (EC 2.7.1.40) (PK). | swissprot P22360 | Carbohydrate transport and metabolism |
| 6987 | 1348.0 | CYTOCHROME C OXIDASE SUBUNIT V. | sptrembl O93980 | ND |
| 6988 | 1346.7 | ALPHA-GALACTOSIDASE A PRECURSOR (EC 3.2.1.22) (MELIBIASE). | swissprot P28351 | ND |
| 6989 | 1344.2 | HYPOTHETICAL ALDEHYDE-DEHYDROGENASE LIKE PROTEIN IN COQ1-HHF1 INTERGENIC REGION. | swissprot P38067 | Energy production and conversion |
| 6990 | 1341.2 | POTASSIUM TRANSPORTER. | sptrembl O74724 | ND |
| 6991 | 1339.0 | CHORISMATE MUTASE (EC 5.4.99.5). | sptrembl Q9Y7B2 | ND |
| 6992 | 1337.5 | PUTATIVE DIPHTHINE SYNTHASE. | sptrembl O74898 | Translation, ribosomal structure and biogenesis |
| 6993 | 1334.4 | HOMOCITRATE SYNTHASE (EC 4.1.3.21). | sptrembl O94225 | Amino acid transport and metabolism |
| 6994 | 1334.2 | PEPTIDE TRANSPORTER PTR2. | swissprot P46030 | ND |
| 6995 | 1334.0 | PDI RELATED PROTEIN A. | sptrembl O93914 | Energy production and conversion |
| 6996 | 1333.3 | MITOTIC CONTROL PROTEIN DIS3. | swissprot P37202 | Transcription |
| 6997 | 1332.4 | GTP-BINDING PROTEIN SARA. | swissnew P52886 | ND |
| 6998 | 1332.2 | RIBOSOMAL PROTEIN L13A. | tremblnew AAD54383 | Translation, ribosomal structure and biogenesis |
| 6999 | 1328.3 | COENZYME A SYNTHETASE. | sptrembl O74976 | Lipid metabolism |

TABLE 3-continued

_Aspergillus oryzae ESTs_

| Sequence Listing | zscore | Annotation | Database | Functional Category |
|---|---|---|---|---|
| 7000 | 1327.3 | ALPHA,ALPHA-TREHALOSE-PHOSPHATE SYNTHASE [UDP-FORMING] 2 (EC 2.4.1.15) (TREHALOSE-6-PHOSPHATE SYNTHASE) (UDP-GLUCOSE-GLUCOSEPHOSPHATE GLUCOSYLTRANSFERASE). | swissprot Q00217 | Carbohydrate transport and metabolisM |
| 7001 | 1325.1 | TUBULIN BETA CHAIN. | swissprot P22012 | ND |
| 7002 | 1324.3 | RHO1 PROTEIN. | swissprot Q09914 | ND |
| 7003 | 1322.4 | 60 KD CHAPERONIN (PROTEIN CPN60) (GROEL PROTEIN) (HEAT SHOCK PROTEIN 60). | sptrembl O94110 | Posttranslational modification, protein turnover, chaperones |
| 7004 | 1319.7 | PROBABLE UTP--GLUCOSE-1-PHOSPHATE URIDYLYLTRANSFERASE. | tremblnew CAA22857 | ND |
| 7005 | 1317.8 | MALATE DEHYDROGENASE, MITOCHONDRIAL PRECURSOR (EC 1.1.1.37). | swissprot P17505 | Energy production and conversion |
| 7006 | 1317.1 | E1-LIKE PROTEIN. | sptrembl O93922 | Coenzyme metabolism |
| 7007 | 1315.8 | Human transport-associated protein-6 (TRANP-6). | geneseqp Y31644 | ND |
| 7008 | 1314.0 | OUTER MITOCHONDRIAL MEMBRANE PROTEIN PORIN. | swissprot P07144 | ND |
| 7009 | 1313.7 | RIBONUCLEOTIDE REDUCTASE LARGE SUBUNIT. | tremblnew AAD49743 | Nucleotide transport |
| 7010 | 1307.1 | 60S RIBOSOMAL PROTEIN L5. | swissprot O59953 | Translation, ribosomal structure and biogenesis |
| 7011 | 1304.2 | GLUCOSE-6-PHOSPHATE 1-DEHYDROGENASE (EC 1.1.1.49) (G6PD). | swissprot P48826 | Carbohydrate transport and metabolism |
| 7012 | 1299.2 | C-5 STEROL DESATURASE (EC 1.3.-.-) (STEROL-C5-DESATURASE). | swissprot P50860 | ND |
| 7013 | 1298.5 | CYCLOPHILIN B (EC 5.2.1.8). | sptrembl O94190 | Posttranslational modification, protein turnover, chaperones |
| 7014 | 1294.8 | PROBABLE GLUCOSE TRANSPORTER RCO-3. | swissprot Q92253 | ND |
| 7015 | 1294.7 | ORNITHINE AMINOTRANSFERASE (EC 2.6.1.13) (ORNITHINE--OXO-ACID AMINOTRANSFERASE). | swissprot Q92413 | Amino acid transport and metabolism |
| 7016 | 1292.9 | PROTEASOME COMPONENT PUP2 (EC 3.4.99.46) (MACROPAIN SUBUNIT PUP2) (PROTEINASE YSCE SUBUNIT PUP2) (MULTICATALYTIC ENDOPEPTIDASE COMPLEX SUBUNIT PUP2). | swissprot P32379 | Posttranslational modification, protein turnover, chaperones |
| 7017 | 1291.3 | UDP-N-ACETYLGLUCOSAMINE PYROPHOSPHORYLASE (EC 2.7.7.23). | swissprot O74933 | ND |
| 7018 | 1290.3 | GAP-DH. | geneseqP R12995 | Carbohydrate transport and metabolism |
| 7019 | 1289.5 | ACONITASE. | sptrembl O74699 | Energy production and conversion |
| 7020 | 1289.4 | A. niger PacC zinc finger DNA binding domain. | geneseqp Y08483 | ND |

TABLE 3-continued

*Aspergillus oryzae* ESTs

| Sequence Listing | zscore | Annotation | Database | Functional Category |
|---|---|---|---|---|
| 7021 | 1289.1 | Murine RENT1 protein. | geneseqp W36509 | DNA replication, recombination and repair |
| 7022 | 1287.5 | 40S RIBOSOMAL PROTEIN S0 (RIBOSOME-ASSOCIATED PROTEIN 1). | swissprot Q01291 | Translation, ribosomal structure and biogenesis |
| 7023 | 1287.3 | CHAPERONIN HSP78P. | sptrembl O74402 | Posttranslational modification, protein turnover, chaperones |
| 7024 | 1279.0 | MALATE DEHYDROGENASE (EC 1.1.1.37). | sptrembl O94137 | Energy production and conversion |
| 7025 | 1278.5 | QUINATE PERMEASE (QUINATE TRANSPORTER). | swissprot P15325 | ND |
| 7026 | 1277.5 | ER CHAPERONE BIP. | tremblnew BAA82597 | Posttranslational modification, protein turnover, chaperones |
| 7027 | 1274.9 | NADH-UBIQUINONE OXIDOREDUCTASE 24 KD SUBUNIT PRECURSOR (EC 1.6.5.3) (EC 1.6.99.3). | swissprot P40915 | Energy production and conversion |
| 7028 | 1274.1 | HEAT SHOCK PROTEIN 70 (FRAGMENT). | sptrembl Q92260 | Posttranslational modification, protein turnover, chaperones |
| 7029 | 1273.4 | FATTY ACID SYNTHASE. ALPHA SUBUNIT. | sptrembl P78615 | Lipid metabolism |
| 7030 | 1273.1 | CADMIUM RESISTANCE PROTEIN. | sptrembl O94284 | ND |
| 7031 | 1272.6 | ACETYL-COA CARBOXYLASE (EC 6.4.1.2). | sptrembl O60033 | Lipid metabolism |
| 7032 | 1271.4 | HYPOTHETICAL 80.7 KD PROTEIN IN ERG7-NMD2 INTERGEDNIC REGION. | swissprot P38795 | Coenzyme metabolism |
| 7033 | 1270.6 | NUCLEOSOME ASSEMBLY PROTEIN. | sptrembl O59797 | ND |
| 7034 | 1268.6 | T-COMPLEX PROTEIN 1, BETA SUBUNIT (TCP-1-BETA) (CCT-BETA). | swissprot P39076 | Posttranslational modification, protein turnover, chaperones |
| 7035 | 1263.8 | SPERMIDINE SYNTHASE. | sptrembl Q9Y8H7 | Amino acid transport and metabolism |
| 7036 | 1263.7 | ACETYL-COA-ACETYLTRANSFERASE (EC 2.3.1.9). | sptrembl Q9Y838 | Lipid metabolisM |
| 7037 | 1262.2 | SAGA. | sptrembl Q12076 | ND |
| 7038 | 1261.6 | HYPOTHETICAL 63.8 KD PROTEIN. | tremblnew CAB61159 | ND |
| 7039 | 1260.2 | PUTATIVE PROTEASOME COMPONENT C9/Y13 (EC 3.4.99.46) (MACROPAIN SUBUNIT) (MULTICATALYTIC ENDOPEPTIDASE COMPLEX SUBUNIT). | swissprot Q09682 | Posttranslational modification, protein turnover, chaperones |
| 7040 | 1259.3 | UBIQUITIN-CONJUGATING ENZYME E2-17 KD (EC 6.3.2.19) (UBIQUITIN-PROTEIN LIGASE 2) (UBIQUITIN CARRIER PROTEIN). | swissprot P52493 | ND |
| 7041 | 1254.9 | KETOL-ACID REDUCTOISOMERASE PRECURSOR (EC 1.1.1.86) (ACETOHYDROXY-ACID REDUCTOISOMERASE) (ALPHA-KETO-BETA-HYDROXYLACIL REDUCTOISOMERASE). | swissnew P38674 | Amino acid transport and metabolism |

TABLE 3-continued

Aspergillus oryzae ESTs

| Sequence Listing | zscore | Annotation | Database | Functional Category |
|---|---|---|---|---|
| 7042 | 1252.6 | EUKARYOTIC INITIATION FACTOR 4A-LIKE PROTEIN C1F5.10. | swissprot Q10055 | DNA replication, recombination and repair |
| 7043 | 1251.6 | ADENOSINE-5'PHOSPHOSULFATE KINASE (EC 2.7.1.25) (ADENYLYLSULFATE KINASE) (APS KINASE). | sptrembl Q12657 | Inorganic ion transport and metabolism |
| 7044 | 1250.7 | 40S RIBOSOMAL PROTEIN 59 (S7). | swissprot P52810 | Translation, ribosomal structure and biogenesis |
| 7045 | 1248.6 | VALYL-TRNA SYNTHETASE, MITOCHONDRIAL PRECURSOR (EC 6.1.1.9) (VALINE--TRNA LIGASE) (VALRS). | swissprot P28350 | Translation, ribosomal structure and biogenesis |
| 7046 | 1247.2 | SCONCP. | tremblnew AAB18274 | ND |
| 7047 | 1244.9 | ACID TREHALASE PRECURSOR (EC 3.2.1.28) ALPHA.ALPHA-TREHALASE) (ALPHA.ALPHA-TREHALOSE GLUCOHYDROLASE). | swissprot P78617 | ND |
| 7048 | 1243.0 | SCONCP. | tremblnew AAB18274 | ND |
| 7049 | 1242.8 | NADH-UBIQUINONE OXIDOREDUCTASE 23 KD SUBUNIT PRECURSOR (EC 1.6.5.3) (EC 1.6.99.3) (COMPLEX 1-23 KD) (CI-23 KD). | swissprot Q12644 | Energy production and conversion |
| 7050 | 1242.8 | TRANSLATION RELEASE FACTOR ERF3. | sptrembl O42787 | Amino acid transport and metabolism |
| 7051 | 1242.2 | 3-ISOPROPYLMALATE DEHYDRATASE (EC 4.2.1.33) (ISOPROPYLMALATE ISOMERASE) (ALPHA-IPM ISOMERASE) (IPMI). | swissprot P17279 | Amino acid transport and metabolism |
| 7052 | 1240.0 | IMPORTIN ALPHA SUBUNIT (KARYOPHERIN ALPHA SUBUNIT) (SERINE-RICH RNA POLYMERASE 1 SUPPRESSOR PROTEIN). | swissnew O14063 | ND |
| 7053 | 1235.2 | PUTATIVE C-4 METHYL STEROL OXIDASE. | tremblnew CAB52730 | ND |
| 7054 | 1228.8 | CHITIN SYNTHASE 6 (EC 2.4.1.16) (CHITIN-DDP ACETYL-GLUCOSAMINYL TRANSFERASE 6) (CLASS-V CHITIN SYNTHASE 6). | swissprot O13395 | ND |
| 7055 | 1228.8 | CARBOXYPEPTIDASE S3, PENICILLOPEPTIDASE S3, CPD-S3. | tremblnew G1168044 | ND |
| 7056 | 1228.8 | ARG-6 PROTEIN PRECURSOR [CONTAINS: N-ACETYL-GAMMA-GLUTAMYL-PHOSPHATE REDUCTASE (EC 1.2.1.38) (N-ACETYL-GLUTAMATE SEMIALDEHYDE DEHYDROGENASE) (NAGSA DEHYDROGENASE); ACETYLGLUTAMATE KINASE (EC 2.7.2.8) (NAG KINASE) (AGK) (N-ACETYL-L-GLUTAMATE 5-PHOSPHOTRANSFERASE)]. | swissnew P54898 | Amino acid transport and metabolism |

TABLE 3-continued

Aspergillus oryzae ESTs

| Sequence Listing | zscore | Annotation | Database | Functional Category |
|---|---|---|---|---|
| 7057 | 1226.4 | PROBABLE GLUTAMINYL-TRNA SYNTHETASE. | sptrembl Q9Y7Y8 | Translation, ribosomal structure and biogenesis |
| 7058 | 1225.8 | Aspergillus niger tpiA gene. | geneseqp P70498 | Carbohydrate transport and metabolism |
| 7059 | 1225.3 | 60S RIBOSOMAL PROTEIN L10. | tremblnew CAA22664 | Translation, ribosomal structure and biogenesis |
| 7060 | 1223.0 | 60S RIBOSOMAL PROTEIN L8 (L7A) (L4). | swissprot O13672 | Translation, ribosomal structure and biogenesis |
| 7061 | 1219.3 | RAS-RELATED PROTEIN RAB-IIB. | swissprot P46638 | ND |
| 7062 | 1218.6 | FISSION YEAST (FRAGMENT). | sptrembl P78903 | Amino acid transport and metabolism |
| 7063 | 1214.9 | UBIQUITIN. | tremblnew BAA88168 | ND |
| 7064 | 1214.6 | CATALASE A (EC 1.11.1.6). | swissprot P78574 | ND |
| 7065 | 1212.8 | TUBULIN ALPHA-1 CHAIN. | swissprot P24633 | ND |
| 7066 | 1212.5 | METHYLCITRATE SYNTHASE PRECURSOR (EC 4.1.3.31). | tremblnew CAB53336 | Energy production and conversion |
| 7067 | 1210.5 | NAD(+)-SPECIFIC GLUTAMATE DEHYDROGENASE. | sptrembl Q02222 | Amino acid transport and metabolism |
| 7068 | 1209.0 | Aspergillus oryzae aminopeptidase II. | geneseqp W89586 | ND |
| 7069 | 1206.4 | HAPE. | sptrembl O59849 | ND |
| 7070 | 1206.4 | PUTATIVE HOMOSERINE O-ACETLYTRANSFERASE. | sptrembl O13389 | Amino acid transport and metabolism |
| 7071 | 1203.9 | HYPOTHETICAL 33.9 KD PROTEIN C16C9.02C IN CHROMOSOME I. | swissprot Q09816 | Nucleotide transport |
| 7072 | 1202.8 | PYRUVATE KINASE (EC 2.7.1.40) (PK). | swissprot P22360 | Carbohydrate transport and metabolism |
| 7073 | 1200.3 | Microscilla furvescens catalase-53CA1. | geneseqp W33810 | Inorganic ion transport and metabolism |
| 7074 | 1199.9 | PROTEASOME COMPONENT PUP3 (EC 3.4.99.46) (MACROPAIN SUBUNIT PUP3) (MULTICATALYTIC ENDOPEPTIDASE COMPLEX SUBUNIT PUP3). | swissprot P25451 | Posttranslational modification, protein turnover, chaperones |
| 7075 | 1199.4 | MYO-INOSITOL-1-PHOSPHATE SYNTHASE. | tremblnew BAA84084 | Lipid metabolism |
| 7076 | 1194.0 | 26S PROTEASOME REGULATORY SUBUNIT 53 (PROTEASOME SUBUNIT P58) (TRANSPLANTATION ANTIGEN P91A) (TUM-P91A ANTIGEN). | swissprot P14685 | ND |
| 7077 | 1193.1 | KINASE. | sptrembl Q00611 | Signal transduction mechanisms |
| 7078 | 1190.6 | PMRI. | sptrembl O74637 | ND |
| 7079 | 1190.3 | DIHYDROLIPOAMIDE ACETYLTRANSFERASE COMPONENT OF PYRUVATE DEHYDROGENASE COMPLEX, MITOCHONDRIAL PRECURSOR (EC 2.3.1.12) (E2) (PDC-E2) (MRP3). | swissprot P20285 | Energy production and conversion |

TABLE 3-continued

*Aspergillus oryzae* ESTs

| Sequence Listing | zscore | Annotation | Database | Functional Category |
|---|---|---|---|---|
| 7080 | 1188.1 | CARBOXYPEPTIDASE S3, PENICILLOPEPTIDASE S3. CPD-S3. | tremblnew G1168044 | ND |
| 7081 | 1183.0 | SUAPRGA1. | tremblnew CAB62571 | ND |
| 7082 | 1182.6 | PUTATIVE SEPTIN. | tremblnew CAB61437 | ND |
| 7083 | 1179.6 | PROTEASOME COMPONENT C7-ALPHA (EC 3.4.99.46) (MACROPAIN SUBUNIT C7-ALPHA) (PROTEINASE YSCE SUBUNIT 7) (MULTICATALYTIC ENDOPEPTIDASE COMPLEX C7) (COMPONENT Y8) (SCL1 SUPPRESSOR PROTEIN). | swissprot P21243 | Posttranslational modification, protein turnover, chaperones |
| 7084 | 1178.9 | UBI1. | tremblnew AAF24230 | ND |
| 7085 | 1177.7 | ASPERGILLOPEPSIN O. | sptrembl Q00249 | ND |
| 7086 | 1176.0 | ELONGATION FACTOR 1-GAMMA 2 (EF-1-GAMMA 2). | swissprot P36008 | ND |
| 7087 | 1174.2 | P68-LIKE PROTEIN.. | tremblnew CAA21801 | DNA replication, recombination and repair |
| 7088 | 1173.8 | 60S RIBOSOMAL PROTEIN 1.18. | swissnew Q10192 | Translation, ribosomal structure and biogenesis |
| 7089 | 1170.3 | TUBULIN BETA CHAIN. | swissprot P22012 | ND |
| 7090 | 1165.8 | CALCIUM/CALMODULIN DEPENDENT PROTEIN KINASE B. | sptrembl Q9Y899 | Signal transduction mechanisms |
| 7091 | 1164.6 | CALMODULIN. | swissnew P19533 | ND |
| 7092 | 1164.1 | HYPOTHETICAL 31.6 KD PROTEIN. | sptrembl O13844 | ND |
| 7093 | 1164.0 | *Aspergillus oryzae* hemA deletion allele-encoded protein. | geneseqp W30559 | Coenzyme metabolism |
| 7094 | 1163.5 | PHOSPHOGLUCOMUTASE 2 (EC 5.4.2.2) (GLUCOSE PHOSPHOMUTASE 2) (PGM 2). | swissprot P37012 | Carbohydrate transport and metabolism |
| 7095 | 1162.5 | CALCIUM CALMODULIN-DEPENDENT PROTEIN KINASE (EC 2.7.1.123) (CMPK). | swissprot Q00771 | Signal transduction mechanisms |
| 7096 | 1161.9 | ENOLASE (EC 4.2.1.11) (2-PHOSPHOGLYCERATE DEHYDRATASE) (2-PHOSPHO-D-GLYCERATE HYDRO-LYASE). | swissprot Q12560 | Carbohydrate transport and metabolism |
| 7097 | 1158.5 | RIBOSOMAL PROTEIN S28. | tremblnew CAB56815 | Translation, ribosomal structure and biogenesis |
| 7098 | 1157.0 | An enzyme with sugar transferase activity. | geneseqp W88044 | Carbohydrate transport and metabolism |
| 7099 | 1156.7 | SERINE/THREONINE-PROTEIN KINASE STE20 (EC 2.7.1.-). | swissnew Q03497 | Signal transduction mechanisms |
| 7100 | 1152.3 | THREONYL-TRNA SYNTHETASE, CYTOPLASMIC (EC 6.1.1.3) (THREONINE--TRNA LIGASE) (THRRS). | swissprot P87144 | Translation, ribosomal structure and biogenesis |
| 7101 | 1152.2 | PUTATIVE GLYCYL-TRNA SYNTHETASE (EC 6.1.1.14) (GLYCINE--TRNA LIGASE) (GLYRS). | swissprot Q10179 | Translation, ribosomal structure and biogenesis |
| 7102 | 1151.5 | PROBABLE MEMBRANE PROTEIN YOL130W. | sptrembl O13657 | Inorganic ion transport and metabolism |

TABLE 3-continued

Aspergillus oryzae ESTs

| Sequence Listing | zscore | Annotation | Database | Functional Category |
|---|---|---|---|---|
| 7103 | 1151.0 | NAD(+)-SPECIFIC GLUTAMATE DEHYDROGENASE. | sptrembl Q02222 | ND |
| 7104 | 1147.9 | PHENYLALANYL-TRNA SYNTHETASE ALPHA CHAIN. | sptrembl O42849 | Translation, ribosomal structure and biogenesis |
| 7105 | 1143.7 | SP62 HUMAN. | sptrembl O75245 | ND |
| 7106 | 1143.4 | 40S RIBOSOMAL PROTEIN S6. | swissprot P05752 | Translation, ribosomal structure and biogenesis |
| 7107 | 1141.0 | ADENOSYLHOMOCYSTEIN ASE (EC 3.3.1.1) (S-ADENOSYL-L-HOMOCYSTEINE HYDROLASE) (ADOHCYASE). | swissprot P39954 | Coenzyme metabolism |
| 7108 | 1140.7 | CYCLOPHILIN-LIKE PEPTIDYL PROLYL CIS-TRANS ISOMERASE (EC 5.2.1.8). | sptrembl O94184 | Posttranslational modification, protein turnover, chaperones |
| 7109 | 1138.6 | UBIQUINOL-CYTOCHROME C REDUCTASE IRON-SULFUR SUBUNIT, MITOCHONDRIAL PRECURSOR (EC 1.10.2.2) (RIESKE IRON-SULFUR PROTEIN) (RISP). | swissprot P07056 | Energy production and conversion |
| 7110 | 1138.1 | GLYCEROL KINASE (EC 2.7.1.30) (ATP:GLYCEROL 3-PHOSPHOTRANSFERASE) (GLYCEROKINASE) (GK). | swissprot Q64516 | Energy production and conversion |
| 7111 | 1135.1 | Cephalosporin C #2. | geneseqp R49827 | Energy production and conversion |
| 7112 | 1132.7 | REDUCTASE (FRAGMENT). | sptrembl O74646 | ND |
| 7113 | 1131.8 | 40S RIBOSOMAL PROTEIN S5 (S2) (YS8) (RP14). | swissprot P26783 | Translation, ribosomal structure and biogenesis |
| 7114 | 1130.9 | 60S RIBOSOMAL PROTEIN L7-C. | swissprot O60143 | Translation, ribosomal structure and biogenesis |
| 7115 | 1127.4 | 5-METHYLTETRAHYDROPTEROYL-TRIGLUTAMATE--HOMOCYSTEI METHYLTRANSFERASE (EC 2.1.1.14). | tremblnew CAB57427 | Amino acid transport and metabolism |
| 7116 | 1126.5 | REGULATORY PROTEIN. | sptrembl Q00170 | ND |
| 7117 | 1125.8 | RASP F 9 (FRAGMENT). | sptrembl O42800 | Carbohydrate transport and metabolism |
| 7118 | 1119.7 | FIBRILLARIN (NUCLEOLAR PROTEIN 1). | swissprot P15646 | Translation, ribosomal structure and biogenesis |
| 7119 | 1115.8 | PHOSPHO-2-DEHYDRO-3-DEOXYHEPTONATE ALDOLASE, TYROSINE-INHIBITED) (EC 4.1.2.15) (PHOSPHO-2-KETO-3-DEOXYHEPTONATE ALDOLASE) (DAHP SYNTHETASE) (3-DEOXY-D-ARABINO-HEPTULOSONATE 7-PHOSPHATE SYNTHASE). | swissprot P32449 | Amino acid transport and metabolism |

TABLE 3-continued

*Aspergillus oryzae* ESTs

| Sequence Listing | zscore | Annotation | Database | Functional Category |
|---|---|---|---|---|
| 7120 | 1115.8 | PROBABLE PEROXISOMAL MEMBRANE PROTEIN PMP20 (ALLERGEN ASP F 3). | swissprot O43099 | ND |
| 7121 | 1113.7 | Yeast Pad1 protein. | geneseqp Y08454 | ND |
| 7122 | 1111.9 | GLUCOSAMINE-6-PHOSPHATE DEAMINASE. | tremblnew AAD42233 | Carbohydrate transport and metabolism |
| 7123 | 1111.6 | BETA GLUCOSIDASE HOMOLOG. | sptrembl O13385 | ND |
| 7124 | 1110.3 | SERENE/THREONINE PROTEIN KINASE. | sptrembl Q99012 | Signal transduction mechanisms |
| 7125 | 1108.9 | ATP SYNTHASE ALPHA CHAIN, MITOCHONDRIAL PRECURSOR (EC 3.6.1.34). | swissnew P37211 | Energy production and conversion |
| 7126 | 1108.4 | SULFATE ADENYLYLTRANSFERASE (EC 2.7.7.4) (SULFATE ADENYLATE TRANSFERASE) (ATP-SULFURYLASE) (SULFURYLASE). | sptrembl Q12555 | Inorganic ion transport and metabolism |
| 7127 | 1106.0 | PUTATIVE CTP SYNTHASE C10F6.03C (EC 6.3 4.2) (UTP--AMMONIA LIGASE C10F6.03C) (CTP SYNTHETASE C10F6.03C). | sptrembl O42644 | Nucleotide transport |
| 7128 | 1105.5 | CYCLOPHILIN-LIKE PEPTIDYL PROLYL CIS-TRANS ISOMERASE (EC 5.2.1.8). | sptrembl O94184 | Posttranslational modification, protein turnover, chaperones |
| 7129 | 1105.2 | HYDROXYMETHYLGLUTARYL-COA SYNTHASE (EC 4.1.3.5) (HMG-COA SYNTHASE) (3-HYDROXY-3-METHYLGLUTARYL COENZYME A SYNTHASE). | swissprot P4839 | Lipid metabolism |
| 7130 | 1104.2 | NEGATIVE REGULATOR OF MITOSIS. | swissprot P24686 | ND |
| 7131 | 1103.9 | SACCHAROPINE DEHYDROGENASE [NAD+, L-LYSINE FORMING] (EC 1.5.1.7) (LYSINE--2-OXOGLUTARATE REDUCTASE) (SDH). | swissprot P38997 | Energy production and conversion |
| 7132 | 1102.6 | REPLICATION FACTOR-A PROTEIN 1. | tremblnew CAA22533 | ND |
| 7133 | 1100.7 | QUEUINE TRNA-RIBOSYLTRANSFERASE. | sptrembl O94460 | Translation, ribosomal structure and biogenesis |
| 7134 | 1099.7 | 60S RIBOSOMAL PROTEIN L12. | swissprot P23358 | Translation, ribosomal structure and biogenesis |
| 7135 | 1099.6 | PRP12P/SAP130. | tremblnew BAA86918 | ND |
| 7136 | 1099.4 | ACYL-COA DESATURASE 1 (EC 1.1.4.99.5) (STEAROYL-COA DESATURASE 1) (FATTY ACID DESATURASE 1). | sptrembl Q12619 | Lipid metabolism |
| 7137 | 1098.0 | YPT1-RELATED PROTEIN 5. | swissprot P36586 | ND |
| 7138 | 1094.5 | Mouse cyclophilin 40 protein sequence. | geneseqp Y34196 | Posttranslational modification, protein turnover, chaperones |
| 7139 | 1093.9 | PUTATIVE FAMILY-31 GLUCOSIDASE. | tremblnew CAB65603 | Carbohydrate transport and metabolism |
| 7140 | 1093.9 | LEUCINE ZIPPER. | sptrembl Q00096 | ND |

TABLE 3-continued

_Aspergillus oryzae ESTs_

| Sequence Listing | zscore | Annotation | Database | Functional Category |
|---|---|---|---|---|
| 7141 | 1093.6 | SPLICING FACTOR U2AF 23 KD SUBUNIT (U2 AUXILIARY FACTOR 23 KD SUBUNIT) (U2 SNRNP AUXILIARY FACTOR SMALL SUBUNIT) (U2AF23). | swissprot Q09176 | ND |
| 7142 | 1093.0 | COMPONENT OF CHAPERONIN-CONTAINING T-COMPLEX (ZETA SUBUNIT). | sptrembl O94515 | Posttranslational modification, protein turnover, chaperones |
| 7143 | 1092.4 | HYPOTHETICAL 41.8 KD PROTEIN. | sptrembl O59715 | ND |
| 7144 | 1091.5 | 1,4-BENZOQUINONE REDUCTASE. | sptrembl Q9Y763 | ND |
| 7145 | 1091.1 | PROBABLE VACUOLAR SORTING PROTEIN, DYNAMIN FAMILY (FRAGMENT). | tremblnew CAB62830 | ND |
| 7146 | 1090.3 | UBIQUITIN-CONJUGATING ENZYME E2-18 KD (EC 6.3.2.19) (UBIQUITIN-PROTEIN LIGASE HUS5) (UBIQUITIN CARRIER PROTEIN HUS5). | swissprot P40984 | ND |
| 7147 | 1086.9 | MITOGEN-ACTIVATED PROTEIN KINASE (EC 2..1.-) (MAPK). | sptrembl Q00859 | Signal transduction mechanisms |
| 7148 | 1085.5 | HOMOGENTISATE 1,2-DIOXYGENASE (EC 1.13.11.5) (HOMOGENTISICASE) (HOMOGENTISAE OXYGENASE) (HOMOGENTISIC ACID OXIDASE). | swissprot Q00667 | ND |
| 7149 | 1084.0 | ION TRANSPORTER. | sptrembl O59768 | Inorganic ion transport and metabolism |
| 7150 | 1078.8 | PEPTIDE TRANSPORT PROTEIN. | tremblnew CAA22021 | ND |
| 7151 | 1078.4 | PYRUVATE DECARBOXYLASE (EC 4.1.1.1). | swissprot P51844 | Coenzyme metabolism |
| 7152 | 1068.6 | ALDEHYDE DEHYDROGENASE (EC 1.2.1.3) (ALDDH) (ALLERGEN CLA H 3) (CLA H III). | swissprot P40108 | Energy production and conversion |
| 7153 | 1068.5 | VALYL-TRNA SYNTHETASE, MITOCHONDRIAL PRECURSOR (EC 6.1.1.9) (VALINE-TRNA LIGASE) (VALRS). | swissprot P28350 | Translation, ribosomal structure and biogenesis |
| 7154 | 1065.8 | 40S-RIBOSOMAL PROTEIN S15 (S12). | swissprot P34737 | Translation, ribosomal structure and biogenesis |
| 7155 | 1065.4 | U3 SMALL NUCLEOLAR RIBONUCLEOPROTEIN PROTEIN IMP4. | swissnew P53941 | ND |
| 7156 | 1064.0 | POTASSIUM TRANSPORTER. | sptrembl Q9Y7BQ | Inorganic ion transport and metabolism |
| 7157 | 1063.6 | PUTATIVE SEPTIN. | tremblnew CAB52419 | ND |
| 7158 | 1063.2 | GLUTATHIONE-DEPENDENT FORMALDEHYDE 1.2.1.1) (FDH) (FALDH) (FLDL). | sptrembl O74685 | ND |

TABLE 3-continued

_Aspergillus oryzae_ ESTs

| Sequence Listing | zscore | Annotation | Database | Functional Category |
|---|---|---|---|---|
| 7159 | 1061.9 | 60S RIBOSOMAL PROTEIN 1.11. | swissprot O10157 | Translation, ribosomal structure and biogenesis |
| 7160 | 1060.4 | PUTATIVE GLUCOSE SENSOR. | sptrembl O13477 | ND |
| 7161 | 1059.8 | ADENYLATE KINASE CYTOSOLIC (EC 2.7.4.3) (ATP-AMP TRANSPHOSPHORYLASE). | swissprot P07170 | Nucleotide transport |
| 7162 | 1059.7 | NADH-UBIQUINONE OXIDOREDUCTASE 21 KD SUBUNIT (EC 1.6.5.3) (EC 1.6.99.3) (COMPLEX 1-21 KD (C1-21 KD). | swissprot Q02854 | ND |
| 7163 | 1059.1 | 40S RIBOSOMAL PROTEIN S3. | swissprot O60128 | Translation, ribosomal structure and biogenesis |
| 7164 | 1058.1 | HEAT SHOCK PROTEIN 70. | sptrembl O42808 | Posttranslational modification, protein turnover, chaperones |
| 7165 | 1057.4 | Beta-1 integrin modulator B171. | geneseqp W19771 | ND |
| 7166 | 1056.9 | PROLIFERATING CELL NUCLEAR ANTIGEN (PCNA). | swissprot Q03392 | DNA replication, recombination and repair |
| 7167 | 1055.9 | O-METHYLTRANSFERASE. | tremblnew BAA86103 | ND |
| 7168 | 1054.2 | HYPOTHETICAL 49.1 KD PROTEIN IN SSB2-SPX18 INTERGENIC REGGION. | swissprot P40160 | Signal transduction mechanisms |
| 7169 | 1054.1 | _M. grisea_ PTH2 gene product. | geneseqp Y06783 | ND |
| 7170 | 1051.1 | 40S RIBOSOMAL PROTEIN 57. | swissprot O43105 | ND |
| 7171 | 1049.8 | ATP SYNTHASE BETA CHAIN MITOCHONDRIAL PRECURSOR (EC 3.6.1.34). | swissnew P23704 | Energy production and conversion |
| 7172 | 1049.2 | PRE-MRNA SPLICING FACTOR. | sptrembl Q12381 | ND |
| 7173 | 1046.5 | GLYCOGEN PHOSPHORYLASE (EC 2.4.1.1). | swissprot P06738 | Carbohydrate transport and metabolism |
| 7174 | 1046.1 | HISTONE H2A. | sptrembl O13413 | ND |
| 7175 | 1044.6 | DIMETHYL-ALLYL-TRYPTPHAN-SYNTHASE. | sptrembl O94204 | ND |
| 7176 | 1044.3 | SIMILAR TO GLYCOGEN DEBRANCHING ENZYME. | sptrembl Q06625 | Carbohydrate transport and metabolism |
| 7177 | 1041.1 | CHITIN SYNTHASE (EC 2.4.1.16) (CHITIN-UDP ACETYL-GLUCOSAMINYL TRANSFERASE D) (CLASS-V CHITIN SYNTHASE D). | swissprot P78611 | ND |
| 7178 | 1040.4 | PUTATIVE HYDROXYACYLGLUTATHIONE HYDROLASE.. | tremblnew CAB57337 | ND |
| 7179 | 1039.8 | _A. crysogenum_ cystathionine beta-synthase. | geneseqp R72589 | Amino acid transport and metabolism |
| 7180 | 1036.9 | PUTATIVE DIHYDROXY-ACID DEHYDRATASE, MITOCHONDRIAL PRECURSOR (EC 4.2.1.9) (DAD) (2,3--DIHYDROXY ACID HYDROLASE). | swissprot Q10318 | Amino acid transport and metabolism |
| 7181 | 1036.6 | malasszia fungus MF-5 antigenic protein. | geneseqp W29772 | Energy production and conversion |

TABLE 3-continued

*Aspergillus oryzae* ESTs

| Sequence Listing | zscore | Annotation | Database | Functional Category |
|---|---|---|---|---|
| 7182 | 1035.6 | LEUCYL-TRNA SYNTHETASE, MITOCHONDRIAL PRECURSOR (EC 6.1.1.4) (LEUCINE--TRNA LIGASE) (LEURS). | swissprot P15181 | Translation, ribosomal structure and biogenesis |
| 7183 | 1033.6 | HYPOTHETICAL 69.2 KD PROTEIN. | sptrembl O60164 | ND |
| 7184 | 1032.1 | PROBABLE SUCCINATE DEHYDROGENASE FLAVOPROTEIN SUBUNIT PRECURSOR (EC 1.3.5.1). | tremblnew CAB61213 | Energy production and conversion |
| 7185 | 1032.0 | PUTATIVE ELONGATION FACTOR 3. | sptrembl O94489 | ND |
| 7186 | 1028.5 | ISOPENTENYL-DEPHOSPHATE DELTA-ISOMERASE. | tremblnew CAB53731 | Lipid metabolism |
| 7187 | 1028.1 | PUTATIVE PROTEASE SUBUNIT, CHAPERONIN. | sptrembl O94641 | Posttranslational modification, protein turnover, chaperones |
| 7188 | 1027.1 | T-COMPLEX PROTEIN 1 GAMMA SURUNIT HOMOLOG. | sptrembl O74341 | ND |
| 7189 | 1024.3 | SUPEROXIDE DISMUTASE (CU-ZN) (EC 1.15.1.1). | sptrembl Q9Y8D9 | Inorganic ion transport and metabolism |
| 7190 | 1022.5 | BCDNA.LD14392. | sptrembl Q9XZ58 | ND |
| 7191 | 1022.1 | ALCOHOL OXIDASE 1. | tremblnew AAF02494 | ND |
| 7192 | 1020.8 | T-COMPLEX PROTEIN 1, DELTA SUBUNIT (TCP-1-DELTA) (CCT-DELTA) (STIMULATOR OF TAR RNA BINDING). | swissprot P50991 | Posttranslational modification, protein turnover, chaperones |
| 7193 | 1020.0 | An enzyme with sugar transferase activity. | geneseqp W88044 | ND |
| 7194 | 1091.3 | GAP-DH. | geneseqp R12995 | Carbohydrate transport and metabolism |
| 7195 | 1018.7 | HYPOTHETICAL 49.3 KD PROTEIN C30D11.06C IN CHROMOSOME I. | swissprot Q09906 | ND |
| 7196 | 1018.2 | UBIQUITIN-ACTIVATING ENZYME E1 1 (FRAGMENT). | swissprot P52495 | Coenzyme metabolism |
| 7197 | 1018.0 | NUCLEAR MOVEMENT PROTEIN NUDC. | swissprot P17624 | ND |
| 7198 | 1018.0 | GAP-DH. | geneseqp R1295 | Carbohydrate transport and metabolism |
| 7199 | 1017.4 | CARNITINE/ACYL CARNITINE CARRIER. | sptrembl Q9Y7G4 | ND |
| 7200 | 1016.8 | REHYDRIN-LIKE PROTEIN. | sptrembl O94014 | Posttranslational modification, protein turnover, chaperones |
| 7201 | 1016.4 | HYPOTHETICAL 37.2 KD PROTEIN IN CHA1-PRD1 INTERGENIC REGION. | swissprot P25586 | Translation, ribosomal structure and biogenesis |
| 7202 | 1014.5 | HYPOTHETICAL 69.0 KD PROTEIN. | sptrembl O94022 | ND |
| 7203 | 1009.3 | RHO2 PROTEIN. | swissprot Q10133 | ND |
| 7204 | 1006.6 | PUTATIVE LYSYL-TRNA SYNTHETASE. | tremblnew CAB52801 | Translation, ribosomal structure and biogenesis |
| 7205 | 1004.7 | GLYCYL-TRNA SYNTHETASE (EC 6.1.1.14) (GLYCINE--TRNA LIGASE) (GLYRS). | swissprot P38088 | Translation, ribosomal structure and biogenesis |

TABLE 3-continued

*Aspergillus oryzae* ESTs

| Sequence Listing | zscore | Annotation | Database | Functional Category |
|---|---|---|---|---|
| 7206 | 1004.2 | UBIQUITIN-CONJUGATING ENZYME E2-18 KD (EC 6.3.2.19) (UBIQUITIN-PROTEIN LIGASE) (UBIQUITIN CARRIER PROTEIN). | swissprot O00102 | ND |
| 7207 | 1003.8 | ISOLEUCYL-TRNA SYNTHETASE, CYTOPLASMIC (EC 6.1.1.5) (ISOLEUCINE--TRNA LIGASE) (IL34S). | swissprot P09436 | Translation, ribosomal structure and biogenesis |
| 7208 | 1001.0 | CHITIN SYNTHASE A (EC 2.4.1.16) (CHITIN-UDP) ACETYL-GLUCOSAMINYL TRANSFERASE A) (CLASS-II CHITIN SYNTHASE A). | swissprot P30584 | ND |
| 7209 | 1000.9 | VACUOLAR ATP SYNTHASE 98 KD SUBUNIT (EC 3.6.1.34) (VACUOLAR ATPASE 98 KD SUBUNIT). | swissprot Q01290 | Energy production and conversion |

TABLE 4

*Trichoderma reesei* ESTs

| Sequence Listing | zscore | Annotation | Database | Functional Category |
|---|---|---|---|---|
| 7401 | 3514.6 | EXOGLUCANASE I PRECURSOR (EC 3.2.1.91) (EXOCELLOBIOHYDROLASE I) (CBHI) (1,4-BETA-CELLOBIOHYDROLASE). | swissprot P00725 | ND |
| 7402 | 3143.2 | Cellobiohydrolase CBH II protein. | geneseqp P50308 | ND |
| 7403 | 2899.7 | HEAT SHOCK 70 KD PROTEIN (HSP70). | swissprot Q01233 | Posttranslational modification, protein turnover, chaperones |
| 7404 | 2335.7 | BETE-GLUCOSIDASE. | sptrembl O93785 | ND |
| 7405 | 2276.9 | BETA-XYLOSIDASE PRECURSOR (EC 3.2.1.37). | sptrembl Q92458 | ND |
| 7406 | 2270.7 | PROTEIN DISULPHIDE ISOMERASE PRECURSOR. | sptrembl O74568 | ND |
| 7407 | 1899.1 | ENDOGLUCANASE IV. | sptrembl O14405 | ND |
| 7408 | 1808.4 | ENDOGLUCANASE EG-II PRECURSOR (EC 3.2.1.4) (ENDO-1,4-BETA-GLUCANASE) (CELLULASE). | swissprot P07982 | ND |
| 7409 | 1731.4 | Enzyme with endoglucanase activity. | geneseqp R66548 | ND |
| 7410 | 1719.7 | Endoglucanase-I protein sequence. | geneseqp R79539 | ND |
| 7411 | 1691.7 | ACETYLXYLAN ESTERASE PRECURSOR (EC 3.1.1.72). | sptrembl Q99034 | ND |
| 7412 | 1640.1 | PUTATIVE PROTEASE SUBUNIT, CHAPERONIN. | sptrembl O94641 | Posttranslational modification, protein turnover, chaperones |
| 7413 | 1526.2 | ELONGATION FACTOR I-ALPHA (EF-I-ALPHA). | swissprot P34825 | Amino acid transport and metabolism |
| 7414 | 1453.5 | 78 KD GLUCOSE-REGULATED PROTEIN HOMOLOG PRECURSOR (GRP 78) (IMMUNOGLOBULIN HEAVY CHAIN BINDING PROTEIN HOMOLOG) (BIP). | swissnew P78695 | Posttranslational modification, protein turnover, chaperones |

TABLE 4-continued

*Trichoderma reesei* ESTs

| Sequence Listing | zscore | Annotation | Database | Functional Category |
|---|---|---|---|---|
| 7415 | 1408.0 | GLYCERALDEHYDE 3-PHOSPHATE DEHYDROGENASE 2 (EC 1.2.1.12) (GAPDH2). | swissprot P17730 | Carbohydrate transport and metabolism |
| 7416 | 1405.7 | AMINO-ACID PERMEASE INDA1. | swissprot P34054 | Amino acid transport and metabolism |
| 7417 | 1395.0 | NADH DEHYDROGENASE SUBUNIT. | sptrembl Q01388 | Energy production and conversion |
| 7418 | 1393.9 | POLYUBIQUITIN. | sptrembl O74274 | ND |
| 7419 | 1346.1 | ADP.ATP CARRIER PROTEIN (ADP/ATP TRANSLOCASE) (ADENINE NUCLEOTIDE TRANSLOCATOR) (ANT). | swissprot P02723 | ND |
| 7420 | 1323.7 | PYRUVATE CARBOXYLASE. | sptrembl O93918 | Amino acid transport and metabolism |
| 7421 | 1309.3 | GLUCAN SYNTHASE. | sptrembl Q9Y8B3 | ND |
| 7422 | 1262.0 | BETA-XYLOSIDASE PRECURSOR (EC 3.2.1.37). | sptrembl Q92458 | ND |
| 7423 | 1257.6 | HEAT SHOCK PROTEIN 90 HOMOLOG (SUPPRESSOR OF VEGETATIVE INCOMPATIBILITY MOD-E). | swissprot O43109 | Posttranslational modification, protein turnover, chaperones |
| 7424 | 1236.9 | ALPHA-L-ARABINOFURANOSIDASE PRECURSOR (EC 3.2.1.55) (ARABINOSIDASE). | swissprot O54161 | ND |
| 7425 | 1236.1 | STRESS-RESPONSIVE GENE PRODUCT | tremblnew BAA85305 | ND |
| 7426 | 1233.4 | *T. longibrachiatum* endoglucanase EGII. | geneseqp R77264 | ND |
| 7427 | 1209.2 | EXOGLUCANASE I PRECURSOR (EC 3.2.1.91) (EXCELLOBIOHYDRO-LASE I) (CBHI) (1,4-BETA-CELLOBIOHYDROLASE). | swissprot P00725 | ND |
| 7428 | 1202.4 | ACID TREHALASE PRECURSOR (EC 3.2.1.28) (ALPHA, ALPHA-TREHALASE) (ALPHA, ALPHA-TREHALOSE) GLUCOHYDROLASE). | swissprot P78617 | ND |
| 7429 | 1180.9 | *A. chrysogenum* gamma-actin. | geneseqp W77101 | Cell division and chromosome partitioning |
| 7430 | 1175.1 | SERINE HYDROXYMETHYLTRANS FERASE, CYTOSOLIC (EC 2.1.2.1) (SERINE METHYLASE) (GLYCINE HYDROXYMETHYLTRANS FERASE (SHMT). | swissprot P34898 | Amino acid transport and metabolism |
| 7431 | 1158.1 | ELONGATION FACTOR 1-ALPHA (EF-1-ALPHA). | swissprot P34825 | Amino acid transport and metabolism |
| 7432 | 1155.9 | RIBOSE-PHOSPHATE PYROPHOSPHOKINASE. | sptrembl O94413 | Nucleotide transport |
| 7433 | 1140.3 | NAD(+)-ISOCITRATE DEHYDROGENASE SUBUNIT 1 PRECURSOR. | sptrembl O13302 | Amino acid transport and metabolism |
| 7434 | 1132.8 | PLASMA MEMBRANE ATPASE (EC 3.6.1.35) (PROTON PUMP). | swissprot P07038 | Inorganic ion transport and metabolism |
| 7435 | 1127.0 | HISTIDINE KINASE (FRAGMENT). | tremblnew AAD40816 | ND |
| 7436 | 1122.6 | HYPOTHETICAL 44.2 KD GTP-BINDING PROTEIN IN SCO2-MRF1 INTERGENIC REGION. | swissprot P38219 | ND |

TABLE 4-continued

_Trichoderma reesei_ ESTs

| Sequence Listing | zscore | Annotation | Database | Functional Category |
|---|---|---|---|---|
| 7437 | 1073.9 | GUANINE NUCLEOTIDE-BINDING PROTEIN BETA SUBUNIT-LIKE PROTEIN (CROSS-PATHWAY CONTROL WD-REPEAT PROTEIN CPC-2). | swissprot Q01369 | ND |
| 7438 | 1063.3 | GTP-BINDING PROTEIN YPT1. | swissprot P33723 | ND |
| 7440 | 993.7 | FUMARATE HYDRATASE PRECURSOR (EC 4.2.1.2) (FUMARASE). | swissprot P55250 | Energy production and conversion |
| 7441 | 985.3 | PH RESPONSIVE PROTEIN 1 PRECURSOR (PH-REGULATED PROTEIN 1). | swissprot P43076 | ND |
| 7442 | 985.0 | 60S RIBOSOMAL PROTEIN L5. | swissprot O59953 | Translation, ribosomal structure and biogenesis |
| 7443 | 980.7 | INORGANIC PYROPHOSPHATASE (EC 3.6.1.1) (PYROPHOSPHATE PHOSPHO-HYDROLASE) (PPASE). | swissprot P19117 | Energy production and conversion |
| 7444 | 977.7 | 40S RIBOSOMAL PROTEIN S3AE (S1). | swissprot P40910 | Translation, ribosomal structure and biogenesis |
| 7445 | 971.3 | MONOUBIQUITIN/CARBOXY EXTENSION PROTEIN FUSION. | sptrembl O74216 | ND |
| 7446 | 968.6 | PROBABLE ATP-DEPENDENT PERMEASE C3F10.11C. | swissprot Q10185 | ND |
| 7447 | 959.7 | HEAT SHOCK PROTEIN 90 HOMOLOG (SUPPRESSOR OF VEGETATIVE INCOMPATIBILITY MOD-E). | swissprot O43109 | Posttranslational modification, protein turnover, chaperones |
| 7448 | 957.2 | CYCLOPHILIN B (EC 5.2.1.8). | sptrembl O94190 | Posttranslational modification, protein turnover, chaperones |
| 7450 | 944.8 | AMINO-ACID PERMEASE INDA1. | swissprot P34054 | Amino acid transport and metabolism |
| 7451 | 936.4 | PLASMA MEMBRANE H(+)ATPASE. | sptrembl O93862 | Inorganic ion transport and metabolism |
| 7452 | 925.1 | 78 KD GLUCOSE-REGULATED PROTEIN HOMOLOG PRECURSOR (GRP 78) (IMMUNOGLOBULIN HEAVY CHAIN BINDING PROTEIN HOMOLOG) (BIP). | swissnew P78695 | Posttranslational modification, protein turnover, chaperones |
| 7453 | 907.3 | PUTATIVE BETA-SUBUNIT OF K+ CHANNELS. | sptrembl O82064 | Energy production and conversion |
| 7454 | 902.5 | CHROMOSOME XV READING FRAME ORF YOR262W. | sptrembl Q08726 | ND |
| 7455 | 900.3 | ACYL-COA DESATURASE I (EC 1.14.99.5) (STEAROYL-COA DESATURASE I) (FATTY ACID DESATURASE I). | sptrembl Q12618 | Lipid metabolism |
| 7456 | 899.4 | PROTEIN TRANSPORT PROTEIN SEC61 ALPHA SUBUNIT. | swissprot P78979 | Cell motility and secretion |
| 7457 | 876.6 | 60S RIBOSOMAL PROTEIN L23 (L17). | swissprot P04451 | Translation ribosomal structure and biogenesis |
| 7458 | 867.5 | BETA-GLUCOSIDASE. | sptrembl O93784 | ND |

TABLE 4-continued

*Trichoderma reesei* ESTs

| Sequence Listing | zscore | Annotation | Database | Functional Category |
|---|---|---|---|---|
| 7459 | 861.2 | 78 KD GLUCOSE REGULATED PROTEIN HOMOLOG PRECURSOR (GRP 78) (IMMUNOGLOBULIN HEAVY CHAIN BINDING PROTEIN HOMOLOG) (BIP). | swissnew P78695 | Posttranslational modification, protein turnover, chaperones |
| 7460 | 856.5 | PUTATIVE GTP CYCLOHYDROLASE. | tremblnew CAB65619 | ND |
| 7461 | 849.6 | PROTEASOME COMPONENT PUP2 (EC 3.4.99.46) (MACROPAIN SUBUNIT PUP2) (PROTEINASE YSCE SUBUNIT PUP2) (MULTICATALYTIC ENDOPEPTIDASE COMPLEX SUBUNIT PUP2). | swissprot P32379 | Posttranslational modification, protein turnover, chaperones |
| 7462 | 839.0 | 40S RIBOSOMAL PROTEIN S4. | swissprot P87158 | Translation, ribosomal structure and biogenesis |
| 7463 | 837.8 | PCZA361.14. | sptrembl O52801 | ND |
| 7464 | 835.2 | CALCINEURIN B SUBUNIT (PROTEIN PHOSPHATASE 2B REGULATORY SUBUNIT) (CALCINEURIN REGULATORY SUBUNIT). | swissprot P87072 | ND |
| 7465 | 834.2 | 3-ISOPROPYLMALATE DEHYDROGENASE (EC 1.1.1.85) (BETA-IPM DEHYDROGENASE) (IMDH) (3-IPM-DH). | swissprot P34738 | Amino acid transport and metabolism |
| 7466 | 832.8 | HEAT SHOCK PROTEIN 60 PRECURSOR (ANTIGEN HIS-62). | swissprot P50142 | Postranslational modification, protein turnover, chaperones |
| 7467 | 829.9 | 40S RIBOSOMAL PROTEIN S17 (CRP3). | swissprot P27770 | Translation, ribosomal structure and biogenesis |
| 7468 | 823.2 | 4-DIHYDROMETHYL-TRISPORATE DEHYDROGENASE. | sptrembl Q01213 | ND |
| 7469 | 801.8 | CYCLOPHILIN. MITOCHONDRIAL FORM PRECURSOR (EC 5.2.1.8). | sptrembl Q99009 | Posttranslational modification, protein turnover, chaperones |
| 7470 | 800.4 | ATP SYNTHASE BETA CHAIN, MITOCHONDRIAL PRECURSOR (EC 3.6.1.34) | swissnew P23704 | Energy production and conversion |
| 7471 | 797.6 | *A. niger* xylanase regulator xyIR | geneseqp W08586 | ND |
| 7472 | 796.4 | 40S RIBOSOMAL PROTEIN S8 (S14) (YS9) (RP19). | swissprot P05754 | Translation, ribosomal structure and biogenesis |
| 7473 | 787.3 | 60S RIBOSOMAL PROTEIN L2. | sptrembl O94253 | Translation, ribosomal structure and biogenesis |
| 7474 | 780.1 | ELONGATION FACTOR 2 (FRAGMENT). | tremblnew CAB52147 | Translation, ribosomal structure and biogenesis |
| 7475 | 778.8 | VACUOLAR ATP SYNTHASE SUBUNIT B (EC 3.6.1.34) (V-ATPASE 57 KD SUBUNIT). | swissprot P19115 | Energy production and conversion |
| 7476 | 778.0 | 40S RIBOSOMAL PROTEIN S14 (CRP2). | swissprot P11593 | Translation, ribosomal structure and biogenesis |

TABLE 4-continued

*Trichoderma reesei* ESTs

| Sequence Listing | zscore | Annotation | Database | Functional Category |
|---|---|---|---|---|
| 7477 | 757.6 | PROBABLE UTP--GLUCOSE-1-PHOSPHATE URIDYLYLTRANSFERASE. | tremblnew CAA22857 | ND |
| 7478 | 746.3 | *Candida albicans* CaCLA4 protein. | geneseqp W48896 | Signal transduction mechanisms |
| 7479 | 736.5 | CTR1 SUPPRESSOR PROTEIN. | swissprot P32784 | ND |
| 7480 | 728.0 | ACETYL-COENZYME A SYNTHETASE (EC 6.2.1.1) (ACETATE--COA LIGASE) (ACYL-ACTIVATING ENZYME). | swissprot P16928 | Lipid metabolism |
| 7481 | 725.0 | TRANSALDOLASE (EC 2.2.1.2). | swissprot P15019 | Carbohydrate transport and metabolism |
| 7482 | 724.0 | PROTEIN KINASE. | sptrembl O59790 | Signal transduction mechanisms |
| 7483 | 720.8 | PDI RELATED PROTEIN A. | sptrembl O93914 | Energy production and conversion |
| 7484 | 711.9 | 40S RIBOSOMAL PROTEIN S22 (S15A) (YS24). | swissprot P33953 | Translation, ribosomal structure and biogenesis |
| 7485 | 709.2 | Yeast RNA-binding protein ZPR1. | geneseqp W38455 | ND |
| 7486 | 700.7 | pI 5.5 endoxylanase. | geneseqp R47123 | ND |
| 7487 | 700.5 | PUTATIVE ALPHA.ALPHA-TREHALOSE-PHOSPHATE SYNTHASE. | tremblnew CAB52715 | Carbohydrate transport and metabolism |
| 7488 | 693.1 | POTENTIAL PROTEASOME COMPONENT C5 (EC 3.4.99.46) (MULTICATALYTIC ENDOPEPIDASE COMPLEX SUBUNIT C5). | swissprot P23724 | Posttranslational modification, protein turnover, chaperones |
| 7489 | 684.0 | VACUOLAR ASPARTIC PROTEASE PRECURSOR. | sptrembl O42630 | ND |
| 7490 | 682.5 | PHOSPHOGLUCOMUTASE. | sptrembl O74374 | Carbohydrate transport and metabolism |
| 7491 | 681.8 | 40S RIBOSOMAL PROTEIN S6. | swissprot P05752 | Translation, ribosomal structure and biogenesis |
| 7492 | 678.4 | PROTEIN TRANSPORT PROTEIN SEC13. | swissprot P53024 | ND |
| 7493 | 667.9 | EBURICOL 14 ALPHA-DEMETHYLASE. | tremblnew AAF18468 | ND |
| 7494 | 663.8 | NADP-SPECIFIC GLUTAMATE DEHYDROGENASE (EC 1.4.1.4) (NADP-GDH). | swissprot P00369 | Amino acid transport and metabolism |
| 7495 | 653.0 | HYPOTHETICAL 17.4 KD PROTEIN. | sptrembl O59727 | ND |
| 7496 | 643.2 | DIHYDROLIPOAMIDE ACETYLTRANSFERASE COMPONENT OF PYRUVATE DEHYDROGENASE COMPLEX. MITOCHONDRIAL PRECURSOR (EC 2.3.1.12) (E2) (PDC-E2) (MRP3). | swissprot P20285 | Energy production and conversion |
| 7497 | 641.3 | CAMP-DEPENDENT PROTEIN KINASE CATALYTIC SUBUNIT. | sptrembl Q9Y777 | Signal transduction mechanisms |
| 7498 | 639.5 | CELL DIVISION-ASSOCIATED PROTEIN BIMB. | swissprot P33144 | ND |
| 7499 | 632.0 | HIGH-AFFINITY GLUCOSE TRANSPORTER. | swissprot P49374 | ND |

TABLE 4-continued

Trichoderma reesei ESTs

| Sequence Listing | zscore | Annotation | Database | Functional Category |
|---|---|---|---|---|
| 7500 | 631.2 | HYPOTHETICAL 58.8 KD PROTEIN C16A3.10 IN CHROMOSOME II. | sptrembl O42916 | ND |
| 7501 | 628.2 | PROTEIN KINASE DSK1 (EC 2.7.1.-) (DIS1-SUPPRESSING PROTEIN KINASE). | swissprot P36616 | Signal transduction mechanisms |
| 7502 | 627.2 | 14-3-3. | tremblnew BAA89421 | ND |
| 7503 | 623.1 | 78 KD GLUCOSE-REGULATED PROTEIN HOMOLOG PRECURSOR (GRP 78) (IMMUNOGLOBULIN HEAVY CHAIN BINDING PROTEIN HOMOLOG) (BIP). | swissprot P36604 | Posttranslational modification, protein turnover, chaperones |
| 7504 | 618.5 | CYTOCHROME C549. | tremblnew BAA85768 | ND |
| 7505 | 617.0 | 3-HYDROXYBUTYRYL-COA DEHYDROGENASE (EC 1.1.1.157) (BETA-HYDROXYBUTYRYL-COA DEHYDROGENASE) (BHBD). | swissprot Q45223 | Lipid metabolism |
| 7506 | 616.9 | HEAT SHOCK 70 KD PROTEIN COGNATE 5. | swissprot P29845 | Posttranslational modification, protein turnover, chaperones |
| 7507 | 607.2 | O1232. | sptrembl Q05663 | ND |
| 7508 | 605.9 | SERINE THREONINE-PROTEIN KINASE. | sptrembl Q94537 | Signal transduction mechanisms |
| 7509 | 597.9 | FRUCTOSE-1,6-BISPHOSPHATASE (EC 3.1.3.11) (D-FRUCTOSE-1,6-BISPHOSPHATE 1-PHOSPHOHYDROLASE) (FBPASE). | swissprot P09202 | Carbohydrate transport and metabolism |
| 7510 | 593.3 | NADH-DEPENDENT GLUTAMATE SYNTHASE. | sptrembl Q40360 | Amino acid transport and metabolism |
| 7511 | 585.6 | AVICELASE III. | sptrembl O74170 | ND |
| 7512 | 577.5 | HISTONE H4.1. | swissprot P23750 | DNA replication, recombination and repair |
| 7513 | 572.1 | GLYCEROL-3-PHOSPHATE DEHYDROGENASE (FRAGMENT). | tremblnew AAB50200 | Energy production and conversion |
| 7514 | 568.8 | HEAT SHOCK PROTEIN HSP88. | sptrembl O74225 | ND |
| 7515 | 564.0 | DOLICHOL-PHOSPHATE MANNOSYLTRANSFERASE (EC 2.4.1.83) (DOLICHOL-PHOSPHATE MANNOSE SYNTHASE) (DOLICHYL-PHOSPHATE BETA-D-MANNOSYLTRANSFERASE). | sptrembl O14466 | ND |
| 7516 | 552.8 | PROBABLE SYNAPTOBREVIN HOMOLOG C6G9.11. | swissprot Q92356 | ND |
| 7517 | 552.8 | 60S RIBOSOMAL PROTEIN L1-B (L10A). | swissprot O74836 | Translation, ribosomal structure and biogenesis |
| 7518 | 551.9 | VANILLIN: NAD+ OXIDOREDUCTASE. | sptrembl O69763 | ND |

TABLE 4-continued

_Trichoderma reesei_ ESTs

| Sequence Listing | zscore | Annotation | Database | Functional Category |
|---|---|---|---|---|
| 7519 | 545.5 | PEROXISOMAL HYDRATASE-DEHYDROGENASE-EPIMERASE (HDE) (MULTIFUNCTIONAL BETA-OXIDATION PROTEIN) (MFP) [INCLUDES: 2-ENOYL-COA HYDRATASE (EC 4.2.1.-); D-β-HYDROXYACYL COA DEHYDROGENASE (EC 1.1.1-)]. | swissnew Q01373 | ND |
| 7520 | 543.1 | UREASE (EC 3.5.1.5) (UREA AMIDOHYDROLASE). | sptrembl O14420 | Amino acid transport and metabolism |
| 7521 | 541.4 | PUTATIVE SECRETED HYDROLASE. | sptrembl O69962 | ND |
| 7522 | 540.4 | 60S RIBOSOMAL PROTEIN L13. | swissprot O59931 | ND |
| 7523 | 535.2 | BETA-GLUCOSIDASE PRECURSOR (EC 3.2.1.21) (GENTIOBIASE) (CELLOBIASE) (BETA-D-GLUCOSIDE GLUCOHYDROLASE). | swissprot P07337 | ND |
| 7524 | 532.0 | PUTATIVE TRANSCRIPTIONAL REPRESSOR C30D10.02. | sptrembl O14348 | ND |
| 7525 | 523.6 | MYOSIN 1 HEAVY CHAIN. | sptrembl Q00647 | ND |
| 7526 | 521.8 | PUTATIVE MITOCHONDRIAL CARRIER C8C9.12C. | sptrembl Q14281 | ND |
| 7527 | 520.3 | MALATE DEHYDROGENASE MITOCHONDRIAL PRECURSOR (EC 1.1.1.37). | swissprot P17505 | Energy production and conversion |
| 7528 | 518.6 | U6 SNRNA-ASSOCIATED SM-LIKE PROTEIN LSM5. | tremblnew AAD56229 | ND |
| 7529 | 511.2 | PHOSPHOGLUCOMUTASE 1 (EC 5.4.2.2) (GLUCOSE PHOSPHOMUTASE 1) (PGM 1). | swissprot P33401 | Carbohydrate transport and metabolism |
| 7530 | 510.1 | Yeast CAAX processing enzyme Afc1p. | geneseqp W48301 | Posttranslational modification, protein turnover, chaperones |
| 7531 | 507.9 | c424 gene product. | geneseqp R43654 | ND |
| 7532 | 505.8 | PURINE NUCLEOSIDE PERMEASE. | sptrembl O93844 | ND |
| 7533 | 504.5 | CHAPERONIN HSP78P. | sptrembl O74402 | Posttranslational modification, protein turnover, chaperones |
| 7534 | 500.8 | 60S RIBOSOMAL PROTEIN L26. | swissnew P78946 | Translation, ribosomal structure and biogenesis |
| 7535 | 499.0 | STIL+. | sptrembl O13458 | ND |
| 7536 | 494.4 | UBIQUITIN CARBOXYL-TERMINAL HYDROLASE (HOMOLOGY TO UBIQUITIN CARBOXYL-TERMINAL HYDROLASE). | sptrembl Q11119 | ND |
| 7537 | 491.7 | HYPOTHETICAL 30.8 KD PROTEIN. | sptrembl O74710 | ND |
| 7538 | 487.5 | TRANSLATIONALLY CONTROLLED TUMOR PROTEIN HOMOLOG (TCTP). | swissprot P35691 | ND |
| 7539 | 476.3 | DNA BINDING PROTEIN NSDD. | sptrembl Q92226 | ND |

TABLE 4-continued

Trichoderma reesei ESTs

| Sequence Listing | zscore | Annotation | Database | Functional Category |
|---|---|---|---|---|
| 7540 | 475.9 | 60S RIBOSOMAL PROTEIN L34-A. | swissprot P87262 | Translation, ribosomal structure and biogenesis |
| 7541 | 469.2 | HYPOTHETICAL 36.7 KD PROTEIN C2E11.10 IN CHROMOSOME 1. | sptrembl O14075 | ND |
| 7542 | 460.3 | SIMILAR TO ASPARTATE AMINOTRANSFERASE. | sptrembl Q17994 | ND |
| 7543 | 458.0 | HYPOTHETICAL 36.7 KD PROTEIN C2F7.14C IN CHROMOSOME 1. | swissprot Q09704 | Translation, ribosomal structure and biogenesis |
| 7544 | 455.2 | 60S RIBOSOMAL PROTEIN L35. | swissprot P17078 | Translation, ribosomal structure and biogenesis |
| 7545 | 439.7 | HYPOTHETICAL 53.4 KD PROTEIN (FRAGMENT). | sptrembl Q9Y7E2 | ND |
| 7546 | 438.1 | HYPOTHETICAL 59.0 KD PROTEIN C30D11 14 IN CHROMOSOME 1. | swissprot Q09911 | ND |
| 7547 | 435.2 | NADPH-DEPENDENT ALDEHYDE REDUCTASE (EC 1.1.1.2) (ALCOHOL DEHYDROGENASE (NADP+)) (ALDEHYDE REDUCTASE (NADPH)). | sptrembl Q12707 | ND |
| 7548 | 428.2 | 60S RIBOSOMAL PROTEIN L27A (L29). | swissprot P78987 | Translation, ribosomal structure and biogenesis |
| 7549 | 427.9 | THIOREDOXIN. | swissprot P42115 | ND |
| 7550 | 420.0 | 30 KD HEAT SHOCK PROTEIN. | swissprot P19752 | ND |
| 7551 | 418.0 | HYPOTHETICAL 25.2 KD PROTEIN. | sptrembl Q9Y7K7 | ND |
| 7552 | 411.8 | CALCIUM/PROTON EXCHANGER. | sptrembl O59940 | ND |
| 7553 | 410.0 | ASPARTIC PROTEINASE. | sptrembl Q9Y740 | ND |
| 7554 | 409.7 | ALPHA,ALPHA-TREHALASE {EC 3.2.1.28}. | tremblnew G1911650 | ND |
| 7555 | 409.4 | HYPOTHETICAL 34.2 KD PROTEIN IN CUSI-RPL20A INTERGENIC REGION. | swissprot Q04013 | ND |
| 7556 | 407.7 | CARBOXYLIC ACID TRANSPORTER PROTEIN HOMOLOG. | swissprot P36035 | ND |
| 7557 | 402.5 | UBIQUITIN-CONJUGATING ENZYME E2-34 KD (EC 6.3.2.19) (UBIQUITIN-PROTEIN LIGASE) (UBIQUITIN CARRIER PROTEIN) (CELL DIVISION CONTROL PROTEIN 34). | swissprot P14682 | ND |
| 7558 | 400.5 | DIHYDROLIPOAMIDE SUCCINYLTRANSFERASE. | tremblnew AAD47296 | ND |
| 7559 | 398.0 | NPLI PROTEIN (SEC 63 PROTEIN). | swissprot P14906 | Posttranslational modification, protein turnover, chaperones |
| 7560 | 395.3 | HYPOTHETICAL OXIDOREDUCTASE C23D3.11 IN CHROMOSOME 1 (EC 1.-.-.-). | swissnew Q09851 | ND |
| 7561 | 386.2 | HYPOTHETICAL 121.8 KD PROTEIN. | sptrembl O43001 | ND |
| 7562 | 383.9 | MDJI PROTEIN PRECURSOR. | swissprot P35191 | Posttranslational modification, protein turnover, chaperones |
| 7563 | 383.6 | CONSERVED HYPOTHETICAL PROTEIN. | sptrembl O74739 | ND |

TABLE 4-continued

*Trichoderma reesei* ESTs

| Sequence Listing | zscore | Annotation | Database | Functional Category |
|---|---|---|---|---|
| 7564 | 378.5 | CELL DIVISION CONTROL PROTEIN 4. | swissprot P53699 | ND |
| 7565 | 366.5 | VACUOLAR ATP SYNTHASE SUBUNIT G (EC 3.6.1.34) (V-ATPASE 13 KD SUBUNIT) (VACUOLAR H(+)-ATPASE SUBUNIT G). | swissprot P78713 | ND |
| 7566 | 364.8 | VIP1 PROTEIN (P53 ANTIGEN HOMOLOG). | sptrembl P87216 | ND |
| 7567 | 359.1 | F45H11.2 PROTEIN. | sptrembl Q93725 | ND |
| 7568 | 357.4 | CARBONIC ANHYDRASE (EC 4.2.1.1). | sptrembl Q43060 | ND |
| 7569 | 355.5 | HYPOTHETICAL 61.3 KD PROTEIN CY369.29. | sptrembl P71838 | ND |
| 7570 | 353.3 | ASCOSPORE MATURATION 1 PROTEIN. | sptrembl Q92251 | ND |
| 7571 | 351.2 | OUTER MITOCHONDRIAL MEMBRANE PROTEIN PORIN. | swissprot P07144 | ND |
| 7572 | 350.2 | HYPOTHETICAL 30.7 KD PROTEIN IN RVS161-ADP1 INTERGENIC REGION. | swissprot P25613 | ND |
| 7573 | 349.8 | HEAT SHOCK FACTOR PROTEIN (HSF) (HEAT SHOCK TRANSCRIPTION FACTOR) (HSTF). | swissprot Q02953 | ND |
| 7574 | 346.1 | HYDROXYPROLINE-RICH GLYCOPROTEIN DZ-HRGP PRECURSOR. | tremblnew CAB62280 | ND |
| 7575 | 340.5 | W02A2.5 PROTEIN. | sptrembl Q9XUB4 | ND |
| 7576 | 338.3 | HYPOTHETICAL 32.6 KD PROTEIN IN VPS15-YMC2 INTERGENIC REGION. | swissprot P38260 | ND |
| 7577 | 337.0 | BRANCHED-CHAIN AMINO ACID AMINOTRANSFERASE, CYTOSOLIC (EC 2.6.1.42) (BCAT) (TWT2 PROTEIN). | swissprot P47176 | ND |
| 7578 | 336.9 | HYPOTHETICAL 34.0 KD PROTEIN IN CTF13-YPK2 INTERGENIC REGION. | swissprot Q03161 | ND |
| 7579 | 330.8 | REHYDRIN-LIKE PROTEIN. | sptrembl O94014 | |
| 7580 | 329.1 | PUTATIVE 20 KDA SUBUNIT OF THE V-ATPASE. | sptrembl P87252 | ND |
| 7581 | 328.5 | PXP-18. | tremblnew BAA85152 | ND |
| 7582 | 328.0 | HYPOTHETICAL 49.6 KD PROTEIN IN ELM1-PR12 INTERGENIC REGION. | swissprot P36091 | ND |
| 7583 | 326.7 | HYDROXYPROLINE-RICH GLYCOPROTEIN DZ-HRGP PRECURSOR. | tremblnew CAB62280 | ND |
| 7584 | 325.9 | THIOREDOXIN-LIKE PROTEIN. | tremblnew CAB54816 | ND |
| 7585 | 322.7 | PROBABLE EUKARYOTIC TRANSLATION INITIATION FACTOR 3 RNA-BINDING SUBUNIT (EIF-3 RNA-BINDING SUBUNIT) (EIF3 P33) (TRANSLATION INITIATION FACTOR EIF3 P33 SUBUNIT). | swissprot P78795 | ND |
| 7586 | 320.8 | MALTOSE PERMEASE. | sptrembl Q9Y845 | ND |
| 7587 | 318.7 | HYPOTHETICAL 57.2 KD PROTEIN C12B10.16C IN CHROMOSOME 1. | swissprot Q10449 | ND |
| 7588 | 317.3 | SOL FAMILY PROTEIN HOMOLOG. | sptrembl O74455 | ND |
| 7589 | 317.2 | CLOCK-CONTROLLED GENE-6 PROTEIN. | sptrembl O74694 | ND |

TABLE 4-continued

*Trichoderma reesei* ESTs

| Sequence Listing | zscore | Annotation | Database | Functional Category |
|---|---|---|---|---|
| 7590 | 313.4 | PUTATIVE STERIGMATOCYSTIN BIOSYNTHESIS PROTEIN STCT. | swissprot Q00717 | ND |
| 7591 | 311.9 | HYPOTHETICAL 92.4 KD PROTEIN. | sptrembl P74690 | ND |
| 7592 | 292.9 | PUTATIVE GLUCOSYLTRANSFERASE C17C9.07 (EC 2.4.1.-). | swissprot Q10479 | ND |
| 7593 | 292.5 | HYPOTHETICAL 22.0 KD PROTEIN IN FOX3-UBP7 INTERGENIC REGION. | swissprot P40452 | ND |
| 7594 | 288.6 | Mutant 2.5-diketo-D-gluconic acid reductase A. | geneseqp R49932 | ND |
| 7595 | 282.6 | PUTATIVE BRANCHED-CHAIN AMINO ACID AMINOTRANSFERASE. | sptrembl Q9Y885 | ND |
| 7596 | 280.5 | MUCIN 2 PRECURSOR (INTESTINAL MUCIN 2). | swissprot Q02817 | ND |
| 7597 | 273.8 | CHROMOSOME XV READING FRAME ORF YOL092W | sptrembl Q12010 | ND |
| 7598 | 273.7 | GLUCOSAMINE--FRUCTOSE-6-PHOSPHATE AMINOTRANSFERASE [ISOMERIZING] (EC 2.6.1.16) (HEXOSEPHOSPHATE AMINOTRANSFERASE) (D-FRUCTOSE-6-PHOSPHATE AMINOTRANSFERASE) (GFAT). | swissprot P53704 | ND |
| 7599 | 272.0 | H(+)/MONOSACCHARIDE COTRANSPORTER. | sptrembl O13411 | ND |
| 7600 | 270.1 | HYPOTHETICAL 36.8 KD PROTEIN. | sptrembl P71847 | ND |
| 7601 | 269.9 | PHOSPHATIDYLETHANOL-AMINE N-METHYLTRANSFERASE (EC 2.1.1.17). | swissprot PO5374 | ND |
| 7602 | 269.8 | EXTENSIN PRECURSOR (CELL WALL HYDROXYPROLINE-RICH GLYCOPROTEIN). | swissprot P13983 | ND |
| 7603 | 269.2 | HYPOTHETICAL 69.0 KD PROTEIN IN PPXI-RPS4B INTERGENIC REGION | swissprot P38887 | ND |
| 7604 | 263.9 | 30 KD HEAT SHOCK PROTEIN. | swissprot P19752 | ND |
| 7605 | 261.4 | HYDROXYPROLINE-RICH GLYCOPROTEIN DZ-HRGP PRECURSOR. | tremblnew CAB62280 | ND |
| 7606 | 259.9 | Polypeptide fragment encoded by gene 29. | geneseqp Y01464 | ND |
| 7607 | 255.7 | *Klebsiella pneumoniae* glycerol-3-phosphate dehydrogenase. | geneseqp W60255 | ND |
| 7608 | 254.9 | HYDROXYPROLINE-RICH GLYCOPROTEIN. | sptrembl Q42366 | ND |
| 7609 | 253.2 | Sugar beet chitinase 1. | geneseqp R28150 | ND |
| 7610 | 250.2 | THIOREDOXIN-LIKE PROTEIN. | tremblnew CAB54816 | ND |
| 7611 | 247.7 | P7 PREINSERTION DNA. | sptrembl Q60501 | ND |
| 7612 | 240.7 | PROLINE-RICH CELL WALL PROTEIN. | sptrembl Q39789 | ND |
| 7613 | 240.5 | COFILIN. | swissprot P78929 | ND |
| 7614 | 238.5 | IUCB. | sptrembl Q9XCH3 | ND |
| 7615 | 238.0 | Human actVA-ORF4-like protein sequence. | geneseqp Y14147 | ND |
| 7616 | 233.1 | HYDROXYPROLINE-RICH GLYCOPROTEIN DZ-HRGP PRECURSOR. | tremblnew CAB62280 | ND |

TABLE 4-continued

*Trichoderma reesei* ESTs

| Sequence Listing | zscore | Annotation | Database | Functional Category |
|---|---|---|---|---|
| 7617 | 232.3 | HYPOTHETICAL 38.8 KD PROTEIN IN MICI-SRB5 INTERGENIC REGION. | swissprot P53259 | ND |
| 7618 | 232.0 | HYPOTHETICAL 41.8 KD PROTEIN (FRAGMENT). | tremblnew CAB55926 | ND |
| 7619 | 231.3 | HYPOTHETICAL 22.2 KD PROTEIN IN ERP6-TFG2 INTERGENIC REGION. | swissprot P53200 | ND |
| 7620 | 230.2 | WP6 PRECURSOR. | sptrembl Q39492 | ND |
| 7621 | 228.1 | D-3-PHOSPHOGLYCERATE DEHYDROGENASE (EC 1.1.1.95) (PGDH). | swissprot P73821 | ND |
| 7622 | 225.7 | EXTENSIN (FRAGMENT). | sptrembl Q41645 | ND |
| 7623 | 225.5 | HYPOTHETICAL PROTEIN MJ1527 PRECURSOR. | sptrembl Q58922 | ND |
| 7624 | 225.3 | EXTENSIN (FRAGMENT). | sptrembl Q41645 | ND |
| 7625 | 225.3 | CELL DIVISION-ASSOCIATED PROTEIN BIMB. | swissprot P33144 | ND |
| 7626 | 225.0 | CYSTEINE-RICH PROTEIN (FRAGMENT). | sptrembl Q16861 | ND |
| 7627 | 223.6 | PUTATIVE UBIQUITIN CARBOXYL-TERMINAL HYDROLASE C6G9.08 (EC 3.1.2.15) (UBIQUITIN THIOLESTERASE) (UBIQUITIN-SPECIFIC PROCESSING PROTEASE) (DEUBIQUITINATING ENZYME). | swissprot Q92353 | ND |
| 7628 | 223.0 | EPD2 PROTEIN. | sptrembl O74137 | ND |
| 7629 | 221.4 | PROLINE-RICH CELL WALL PROTEIN. | sptrembl Q39789 | ND |
| 7630 | 220.5 | CHROMOSOME XII COSMID 8167. | sptrembl Q05790 | ND |
| 7631 | 220.4 | HYPOTHETICAL PROTEIN C30B4.01C IN CHROMOSOME II (FRAGMENT). | sptrembl P87179 | ND |
| 7632 | 219.3 | 26S PROTEASOME REGULATORY SUBUNIT. | sptrembl O74762 | ND |
| 7633 | 218.6 | NEUROFIBROMATOSIS TYPE 1. | sptrembl Q9YGV2 | ND |
| 7634 | 217.6 | 30 KD HEAT SHOCK PROTEIN. | swissprot P19752 | ND |
| 7635 | 217.6 | DNA-DIRECTED RNA POLYMERASE III 36 KD POLYPEPTIDE (EC 2.7.7.6) (C34). | swissprot P32910 | ND |
| 7636 | 217.3 | EXTENSIN PRECURSOR (PROLINE-RICH GLYCOPROTEIN). | swissprot P24152 | ND |
| 7637 | 216.9 | PROTEOPHOSPHOGLYCAN (FRAGMENT). | sptrembl Q9Y075 | ND |
| 7638 | 214.5 | MUCIN (FRAGMENT). | sptrembl Q14888 | ND |
| 7639 | 213.6 | HYPOTHETICAL 141.6 KD PROTEIN. | sptrembl O59704 | ND |
| 7640 | 212.3 | ATPASE INHIBITOR, MITOCHONDRIAL PRECURSOR. | swissprot P01097 | ND |
| 7641 | 209.6 | AVICELASE III. | sptrembl O74170 | ND |
| 7642 | 207.1 | CYSTEINE SYNTHASE (EC 4.2.99.8) (O-ACETYLSERINE SULFHYDRYLASE) (O-ACETYLSERINE (THIOL)-LYASE) (CSASE). | swissprot P50867 | ND |
| 7643 | 205.8 | CHROMOSOME XVI COSMID 9659. | sptrembl Q06505 | ND |
| 7644 | 205.4 | EXTENSIN PRECURSOR (PROLINE-RICH GLYCOPROTEIN). | swissprot P14918 | ND |
| 7645 | 204.9 | DIMERIC DIHYDRODIOL DEHYDROGENASE (EC 1.3.1.20). | tremblnew BAA83488 | ND |

TABLE 4-continued

*Trichoderma reesei* ESTs

| Sequence Listing | zscore | Annotation | Database | Functional Category |
|---|---|---|---|---|
| 7646 | 204.1 | HYPOTHETICAL 29.3 KD PROTEIN (ORF92). | swissprot O10341 | ND |
| 7647 | 203.6 | Intestinal mucin deduced from clone SMUC 40. | geneseqp R07670 | ND |
| 7648 | 202.8 | PUTATIVE GLUCANASE PRECURSOR. | tremblnew CAB57923 | ND |
| 7649 | 202.7 | PDI RELATED PROTEIN A. | sptrembl O93914 | ND |
| 7650 | 202.6 | UTR4 PROTEIN (UNKNOWN TRANSCRIPT 4 PROTEIN). | swissprot P32626 | ND |
| 7651 | 201.8 | HYPOTHETICAL 32.8 KD PROTEIN. | sptrembl O60110 | ND |
| 7652 | 199.7 | EXTENSIN-LIKE PROTEIN. | tremblnew CAA22152 | ND |
| 7653 | 199.1 | MUCIN (FRAGMENT). | sptrembl Q14887 | ND |
| 7654 | 198.3 | HYPOTHETICAL PROTEIN KIAA0107. | swissprot Q15008 | ND |
| 7655 | 197.6 | HYDROXYPROLINE-RICH GLYCOPROTEIN DZ-HRGP PRECURSOR. | tremblnew CAB62280 | ND |
| 7656 | 197.3 | PIPSQUEAK PROTEIN (ORF-A SHORT). | sptrembl Q24455 | ND |
| 7657 | 196.8 | CHA4 ACTIVATORY PROTEIN. | swissprot P43634 | ND |
| 7658 | 195.7 | PUTATIVE ALPHA.ALPHA-TREHALOSE-PHOSPHATE SYNTHASE. | tremblnew CAB52715 | ND |
| 7659 | 193.6 | NEURON-DERIVED ORPHAN RECEPTOR-1 BETA. | sptrembl O97727 | ND |
| 7660 | 193.5 | HYDROXYPROLINE-RICH GLYCOPROTEIN PRECURSOR. | sptrembl Q41719 | ND |
| 7661 | 193.4 | SPLICING FACTOR, ARGININE/SERINE-RICH 2 (SPLICING FACTOR SC35) (SC-35) (SPLICING COMPONENT, 35 KD (PR264 PROTEIN). | swissprot Q01130 | ND |
| 7662 | 193.0 | ALPHA/BETA-GLIADIN CLONE PW1215 PRECURSOR (PROLAMIN). | swissprot P04726 | ND |
| 7663 | 193.0 | ORF-3. | sptrembl Q01823 | ND |
| 7664 | 192.1 | SULFATED SURFACE GLYCOPROTEIN 185 (SSG 185). | swissprot P21997 | ND |
| 7665 | 191.8 | RNA BINDING PROTEIN (FRAGMENT). | tremblnew BAA83714 | ND |
| 7666 | 191.1 | PUTATIVE PROLINE-RICH PROTEIN. | sptrembl Q9ZW08 | ND |
| 7667 | 190.8 | NAPG OXIDOREDUCTASE. | sptrembl Q9X653 | ND |
| 7668 | 190.0 | EXTENSIN (FRAGMENT). | sptrembl Q41645 | ND |
| 7669 | 189.5 | NADH-UBIQUINONE OXIDOREDUCTASE 21 KD SUBUNIT (EC 1.6.5.3) (EC 1.6.99.3) (COMPLEX 1-21KD). (C1-21KD). | swissprot Q02854 | ND |
| 7670 | 188.9 | SALIVARY GLUE PROTEIN SGS-3 PRECURSOR. | swissprot P02840 | ND |
| 7671 | 188.3 | DOLICHYL-DIPHOSPHOOLIGOSACCHARIDE--PROTEIN GLYCOSYLTRANSFERASE ALPHA SUBUNIT PRECURSOR (EC 2.4.1.119) (OLIGOSACCHARYL TRANSFERASE ALPHA SUBUNIT) (OLIGOSACCHARYL TRANSFERASE 64 KD SUBUNIT). | swissprot P41543 | ND |
| 7672 | 188.2 | CDC-LIKE PROTEIN (FRAGMENT). | sptrembl O08837 | ND |

TABLE 4-continued

*Trichoderma reesei* ESTs

| Sequence Listing | zscore | Annotation | Database | Functional Category |
|---|---|---|---|---|
| 7673 | 186.3 | PUTATIVE PROLINE-RICH PROTEIN. | sptrembl Q9ZW08 | ND |
| 7674 | 186.3 | HYDROLASE 434 aa, chain A + B | pdb 4CEL | ND |
| 7675 | 185.9 | SPLICING COACTIVATOR SUBUNIT SRM300 | tremblnew AAF21439 | ND |
| 7676 | 184.3 | HEAT SHOCK PROTEIN-LIKE PROTEIN. | sptrembl O23323 | ND |
| 7677 | 183.9 | PLENTY-OF-PROLINES-101. | sptrembl O70495 | ND |
| 7678 | 183.3 | PROLINE-RICH SALIVARY PROTEIN (FRAGMENT). | sptrembl Q62107 | ND |
| 7679 | 181.6 | SUGAR TRANSPORTER, PUTATIVE. | tremblnew AAF12486 | ND |
| 7680 | 180.8 | K1AA0775 PROTEIN. | sptrembl O94873 | ND |
| 7681 | 179.8 | GAMMA GLIADIN (FRAGMENT). | sptrembl Q41602 | ND |
| 7682 | 179.6 | HYPOTHETICAL 61.1 KD PROTEIN (FRAGMENT). | tremblnew CAB63715 | ND |
| 7683 | 179.4 | NADH-UBIQUINONE OXIDOREDUCTASE 21 KD SUBUNIT (EC 1.6.5.3) (EC 1.6.99.3) (COMPLEX 1-21KD) (C1-21KD). | swissprot Q02854 | ND |
| 7684 | 179.2 | PROLINE-RICH CELL WALL PROTEIN. | sptrembl Q39763 | ND |
| 7685 | 178.1 | Amino acid sequence of a virulence factor encoded by ORF25510. | geneseqp Y29194 | ND |
| 7686 | 176.8 | HYPOTHETICAL 47.5 KD PROTEIN IN APE3-APM3 INTERGENIC REGION. | swissprot P38355 | ND |
| 7687 | 176.8 | LOW MOLECULAR WEIGHT GLUTENIN (FRAGMENT). | sptrembl Q41550 | ND |
| 7688 | 176.2 | HYPOTHETICAL 57.2 KD PROTEIN. | sptrembl O68872 | ND |
| 7689 | 175.9 | TIG11.14 PROTEIN. | sptrembl O23024 | ND |
| 7690 | 175.4 | GLYCOLIPID ANCHORED SURFACE PROTEIN PRECURSOR (GLYCOPROTEIN GP115). | swissprot P22146 | ND |
| 7691 | 175.1 | Bioadhesive precursor protein from cDNA 52. | geneseqp P82971 | ND |
| 7692 | 175.0 | PISTIL EXTENSIN-LIKE PROTEIN. | sptrembl Q40385 | ND |
| 7693 | 174.7 | PROLINE-RICH PROTEOGLYCAN PRPG2. | sptrembl Q07611 | ND |
| 7694 | 174.7 | Antibiotic potentiating peptide #3. | geneseqp W21591 | ND |
| 7695 | 174.7 | HOMEOBOX PROTEIN MOX-2 (GROWTH ARREST-SPECIFIC HOMEOBOX). | swissprot P39020 | ND |
| 7696 | 173.6 | REPETIN. | swissprot P97347 | ND |
| 7697 | 172.9 | PROTEOPHOSPHOGLYCAN (FRAGMENT). | sptrembl Q9Y075 | ND |
| 7698 | 172.6 | Sugar beet chitinase 1 | geneseqp R28150 | ND |
| 7699 | 172.1 | FORMYLTETRAHYDROFOLATE DEFORMYLASE (EC 3.5.1.10) (FORMYL-FH(4) HYDROLASE). | swissprot Q46339 | ND |
| 7700 | 171.9 | HYPOTHETICAL 23.2 KD PROTEIN. | sptrembl O41979 | ND |
| 7701 | 170.6 | CORTICOTROPIN RELEASING HORMONE RECEPTOR TYPE 1 (FRAGMENT). | sptrembl O77677 | ND |
| 7702 | 170.3 | 31-KDA PROLINE-RICH SALIVARY PROTEIN, COMPLETE CDS OF CLONE PUMP125. | sptrembl Q62105 | ND |
| 7703 | 169.6 | BLUE-COPPER BINGING PROTEIN III. | sptrembl Q96316 | ND |
| 7704 | 169.0 | D9461.20P. | sptrembl Q04080 | ND |

TABLE 4-continued

*Trichoderma reesei* ESTs

| Sequence Listing | zscore | Annotation | Database | Functional Category |
|---|---|---|---|---|
| 7705 | 168.8 | 50KD PROLINE RICH PROTEIN. | sptrembl Q9ZBP2 | ND |
| 7706 | 168.3 | FLGA insert stabilising polypeptide. | geneseqp W79128 | ND |
| 7707 | 168.1 | VRG53 PROTEIN (FRAGMENT). | sptrembl Q05844 | ND |
| 7708 | 168.0 | *Mycobacterium* species protein sequence 5C. | geneseqp Y04773 | ND |
| 7709 | 167.8 | CHAPERONIN HSP78P. | sptrembl O74402 | ND |
| 7710 | 167.0 | Microtubule-associated tau protein epitope corresp. to pos. 146–251. | geneseqp R92516 | ND |
| 7711 | 166.2 | SPLICING FACTOR SRP54- | sptrembl O61646 | ND |
| 7712 | 166.1 | Fragmented human NF-H gene 2 frameshift mutant product. | geneseqp W18663 | ND |
| 7713 | 166.0 | Amino acid sequence of Huntington's gene exon 1 in GST-HD fusion protein | geneseqp W95071 | ND |
| 7714 | 165.8 | BIFID PROTEIN (OPTOMOTOR-BLIND PROTEIN). | sptrembl Q26303 | ND |
| 7715 | 165.6 | 212AA LONG HYPOTHETICAL PROTEIN. | sptrembl Q9YEG1 | ND |
| 7716 | 164.5 | Amino acid sequence of a virulence factor encoded by ORF31784. | geneseqp Y29225 | ND |
| 7717 | 164.4 | SIMILAR TO CUTICULAR COLLAGEN. | sptrembl Q19813 | ND |
| 7718 | 164.4 | Amino acid sequence of a virulence factor encoded hy ORF32832. | geneseqp Y29230 | ND |
| 7719 | 164.2 | ZINC-FINGER PROTEIN. | sptrembl O74308 | ND |
| 7720 | 163.9 | BAT2. | sptrembl Q9Z1R1 | ND |
| 7721 | 163.7 | PAD-1. | sptrembl Q9Y7A8 | ND |
| 7722 | 163.3 | TRANSCRIPTION FACTOR BF-2 (BRAIN FACTOR 2) (BF2) (HFK2) | swissprot P55316 | ND |
| 7723 | 163.2 | HYPOTHETICAL 27.0 KD PROTEIN. | sptrembl P95286 | ND |
| 7724 | 163.0 | A-AGGLUTININ ATTACHMENT SUBUNIT PRECURSOR. | swissprot P32323 | ND |
| 7725 | 162.4 | *Trichoderma reesei* endoglucanase. | geneseqp R83401 | ND |
| 7726 | 162.1 | T12F5.5 PROTEIN. | sptrembl O44760 | ND |
| 7727 | 162.0 | RNA BINDING PROTEIN (FRAGMENT). | tremblnew BAA83717 | ND |
| 7728 | 161.9 | TRANSDUCIN-LIKE ENHANCER PROTEIN 4 (GROUCHO-RELATED PROTEIN 4) (FRAGMENT). | swissnew Q62441 | ND |
| 7729 | 161.5 | *Mycobacterium* species protein sequence 14Q#2. | geneseqp Y07202 | ND |
| 7730 | 161.3 | SWI/SNF COMPLEX 170 KDA SUBUNIT. | sptrembl Q92923 | ND |
| 7731 | 161.1 | HIV Tat protein. | geneseqp Y05097 | ND |
| 7732 | 160.7 | HYPOTHETICAL 118.4 KD PROTEIN IN BAT2-DAL5 INTERGENIC REGION PRECURSOR. | swissprot P47179 | ND |
| 7733 | 160.6 | COMES FROM THIS GENE. | sptrembl O23054 | ND |
| 7734 | 160.6 | PYRUVATE DEHYDROGENASE E1 COMPONENT ALPHA SUBUNIT (EC 1.2.4.1) (PYRUVATE DEHYDROGENASE (LIPOAMIDE)) (PYRUVATE DECARBOXYLASE) (PYRUVIC DEHYDROGENASE). | sptrembl O13392 | ND |
| 7735 | 160.6 | GLYCINE-RICH PROTEIN. | sptrembl Q43308 | ND |
| 7736 | 160.5 | METHYLTRANSFERASE. | sptrembl Q51774 | ND |

TABLE 4-continued

Trichoderma reesei ESTs

| Sequence Listing | zscore | Annotation | Database | Functional Category |
|---|---|---|---|---|
| 7737 | 160.4 | RHBA. | tremblnew AAF24249 | ND |
| 7738 | 160.3 | ULTRA-HIGH SULPHUR KERATIN. | sptrembl Q64526 | ND |
| 7739 | 160.2 | PROLYL AMINOPEPTIDASE. | sptrembl P94800 | ND |
| 7740 | 159.9 | HOMEOBOX PROTEIN GBX-2 (GASTRULATION AND BRAIN-SPECIFIC HOMEOBOX PROTEIN 2). | swissprot P52951 | ND |
| 7741 | 159.6 | PUTATIVE MEMBRANE PROTEIN. | sptrembl Q9X780 | ND |
| 7742 | 159.4 | Human secreted protein encoded by gene 41c lone HSZAF47. | geneseqp Y02690 | ND |
| 7743 | 159.0 | Human apolipoprotein E gene +2 frameshift mutant product. | geneseqp W18652 | ND |
| 7744 | 158.6 | HYPOTHETICAL 9.0 KD PROTEIN (FRAGMENT). | sptrembl Q9XSS3 | ND |
| 7745 | 158.4 | ORF993. | sptrembl P72344 | ND |
| 7746 | 158.2 | ORF1B | sptrembl Q47393 | ND |
| 7747 | 157.7 | SMR2 PROTEIN PRECURSOR. | swissprot P18897 | ND |
| 7748 | 157.5 | RECOMBINATION PROTEIN RECR. | swissprot P24277 | ND |
| 7749 | 157.3 | Human alpha 5 (IV) of type IV collagen. | geneseqp R23873 | ND |
| 7750 | 157.1 | PROLINE-RICH PROTEIN. | tremblnew CAB62486 | ND |
| 7751 | 156.5 | GAMMA PROTEIN CONSTANT REGION (FRAGMENT). | sptrembl Q23723 | ND |
| 7752 | 156.1 | NK-TUMOR RECOGNITION MOLECULE-RELATED PROTEIN. | sptrembl O43273 | ND |
| 7753 | 155.6 | SPLICING FACTOR, ARGININE/SERINE-RICH 7 (SPLICING FACTOR 9G8). | swissnew Q16629 | ND |
| 7754 | 154.3 | ACETYLCHOLINESTERASE-ASSOCIATED COLLAGEN (FRAGMENT). | sptrembl O35348 | ND |
| 7755 | 153.8 | PROBABLE PROTEIN KINASE. | tremblnew CAB55520 | ND |
| 7756 | 153.6 | Human high mobility group protein HMG1-C wild type fragment 2. | geneseqp Y21432 | ND |
| 7757 | 153.6 | NANBH virus antigenic fragment #12. | geneseqp R50080 | ND |
| 7758 | 153.6 | Del-1 epidermal growth factor like domain #2. | geneseqp W94687 | ND |
| 7759 | 153.5 | SH3 DOMAIN BINDING PROTEIN. | sptrembl Q62775 | ND |
| 7760 | 153.3 | COLLAGEN ALPHA 5(IV) CHAIN (FRAGMENT). | swissprot Q28247 | ND |
| 7761 | 153.0 | SALIVARY GLUE PROTEIN SGS-3 PRECURSOR. | swissprot P13729 | ND |
| 7762 | 152.5 | MRNA EXPRESSED IN CUCUMBER HYPOCOTYLS, COMPLETE CDS. | sptrembl Q9XIV1 | ND |
| 7763 | 152.4 | PROTEOPHOSPHOGLYCAN PRECURSOR (FRAGMENT). | sptrembl Q9Y076 | ND |
| 7764 | 152.3 | ARL-6 INTERACTING PROTEIN-5 (FRAGMENT). | sptrembl Q9WUG9 | ND |
| 7765 | 150.4 | HYPOTHETICAL 70.4 KD PROTEIN IN SNZI-YPK2 INTERGENIC REGION. | swissprot Q03153 | ND |
| 7766 | 150.3 | 1.779.3 PROTEIN. | sptrembl Q9XTP1 | ND |
| 7767 | 150.3 | Fragment of human secreted protein encoded by gene 15. | geneseqp Y36459 | ND |
| 7768 | 150.3 | HOXIB PROTEIN. | sptrembl O24569 | ND |
| 7769 | 149.8 | HYPOTHETICAL 13.9 KD PROTEIN. | tremblnew AAF19661 | ND |
| 7770 | 149.7 | *Mycobacterium* species protein sequence 50B. | geneseqp Y04998 | ND |

TABLE 4-continued

_Trichoderma reesei_ ESTs

| Sequence Listing | zscore | Annotation | Database | Functional Category |
|---|---|---|---|---|
| 7771 | 149.6 | T06E4.11 PROTEIN. | sptrembl Q22265 | ND |
| 7772 | 148.8 | Avian reovirus strain 138 sigma 3 protein. | geneseqp Y06109 | ND |
| 7773 | 148.3 | GSC-2. | sptrembl O15499 | ND |
| 7774 | 148.2 | CODED FOR BY C. ELEGANS CDNA YK127B8.5. | sptrembl Q20648 | ND |
| 7775 | 147.8 | ORF225. | sptrembl Q44479 | ND |
| 7776 | 146.8 | WD-40 domain-contg. TUP1 homolog protein. | geneseqp R85879 | ND |
| 7777 | 146.8 | EN/SPM-LIKE TRANSPOSON PROTEIN. | tremblnew AAD20682 | ND |
| 7778 | 146.5 | PROLINE RICH PROTEIN. | sptrembl O22514 | ND |
| 7779 | 146.4 | Secreted protein encoded by gene 6 clone HTSEW17. | geneseqp Y01388 | ND |
| 7780 | 146.3 | HOMEOBOX PROTEIN GBX-2 (GASTRULATION AND BRAIN-SPECIFIC HOMEOBOX PROTEIN 2). | swissprot P52951 | ND |
| 7781 | 145.6 | NUCLEOPLASMIN. | swissnew P05221 | ND |
| 7782 | 145.3 | TYROSINE-PROTEIN KINASE ACK (EC 2.7.1.112). | sptrembl Q07912 | ND |
| 7783 | 144.9 | INTEGRIN BETA-SUBUNIT. | sptrembl Q27874 | ND |
| 7784 | 144.2 | SIMILARITY WITH WILMS' TUMOR PROTEIN. | sptrembl Q18233 | ND |
| 7785 | 143.5 | F25965 3. | sptrembl O14560 | ND |
| 7786 | 142.5 | HYPOTHETICAL 38.0 KD PROTEIN. | sptrembl O06232 | ND |
| 7787 | 142.5 | DAN26 PROTEIN, PARTIAL (FRAGMENT). | sptrembl Q99492 | ND |
| 7788 | 142.2 | ATTACHMENT REGION BINDING PROTEIN (FRAGMENT). | sptrembl O42403 | ND |
| 7789 | 142.1 | S-LAYER RELATED PROTEIN PRECURSOR. | swissprot P35824 | ND |
| 7790 | 141.9 | NONSTRUCTURAL POLYPROTEIN (FRAGMENT). | sptrembl Q9W181 | ND |
| 7791 | 141.9 | ATTL. | sptrembl Q9WWD7 | ND |
| 7792 | 141.3 | ENDOGLUCANASE IV. | sptrembl O14405 | ND |
| 7793 | 141.1 | GAMMA-GLIADIN PRECURSOR (FRAGMENT). | swissprot P08079 | ND |
| 7794 | 140.9 | _Mycobacterium_ species protein sequence 36B. | geneseqp Y04923 | ND |
| 7795 | 140.9 | VPR. | sptrembl O90320 | ND |
| 7796 | 140.8 | NUCLEAR ANTIGEN EBNA-3B. | sptrembl Q69139 | ND |
| 7797 | 140.4 | TRANSCRIPTIONAL ACTIVATOR PROTEIN METR. | swissprot P19797 | ND |
| 7798 | 140.4 | CALCIUM-DEPENDENT PROTEIN KINASE. | sptrembl O82107 | ND |
| 7799 | 139.1 | (HHV-6). | sptrembl Q89893 | ND |
| 7800 | 139.1 | HYPOTHETICAL 12.0 KD PROTEIN (FRAGMENT). | sptrembl O43409 | ND |
| 7801 | 138.9 | SMAD6 PROTEIN. | tremblnew AAF14343 | ND |
| 7802 | 138.9 | ARGININE SERINE-RICH PROTEIN. | tremblnew AAF19004 | ND |
| 7803 | 138.8 | 107AA LONG HYPOTHETICAL PROTEIN. | sptrembl Q9YCW17 | ND |
| 7804 | 137.9 | Human fibrosarcoma cell line HT-1080 clone HP10034 protein. | geneseqp W64540 | ND |
| 7805 | 137.9 | Extracellular domain of mouse syndecan-3 protein. | geneseqp R66810 | ND |
| 7806 | 137.8 | SIMILAR TO FURIN-LIKE PROTEASES. | sptrembl Q93015 | ND |
| 7807 | 137.7 | PROTEASOME COMPONENT SUN4. | swissprot P53616 | ND |
| 7808 | 137.6 | HYPOTHETICAL 26.9 KD PROTEIN. | tremblnew AAF10289 | ND |

TABLE 4-continued

Trichoderma reesei ESTs

| Sequence Listing | zscore | Annotation | Database | Functional Category |
|---|---|---|---|---|
| 7809 | 137.2 | HYPOTHETICAL 22.1 KD PROTEIN. | sptrembl P94570 | ND |
| 7810 | 137.1 | WINGLESS (FRAGMENT). | tremblnew AAD50945 | ND |

Example 15

DNA Microarrays

Details of the construction of a typical microarrayer can be found on the world wide web site of Professor Patrick Brown of Stanford University at the following URL: http://emgm.stanford.edu/pbrown/mguide/index.html. Scanners and computer software for analysis of DNA microarrays are available from several commercial sources such as General Scanning Inc. (Watertown, Mass.; see http://www.genscan.com/sales/loc lifesci.html), or Axon Instruments (Foster City, Calif.: see http://www.axon.com).

Individual fungal EST clones were purified as plasmid minipreps using Qiagen Biorobot 9600 (QIAGEN, Inc., Valencia, Calif.). The plasmid minipreps were precipitated with isopropanol, aliquoted and stored as described on the web site of Professor Patrick Brown of Stanford University at the following URL: http://emgm.stanford.edu/pbrown/mguide/index.html.

The amplified EST targets prepared in this manner were spotted individually onto polylysine-coated glass slides using a microarrayer device as described by DeRisi et al. (1997, Science 278: 680–686). For additional details, see http://cmgm.stanford.edu/pbrown/protocols/index.html). The microarrays were probed with fluorescently labeled cDNA prepared by reverse transcription of polyadenylated mRNA (DeRisi et al., 1997, supra) extracted from fungal mycelia (Example 2). Conditions for pretreatment of the microarrays, hybridization and washing conditions have been described previously (DeRisi et al., 1997, supra; see also http://emgm.stanford.edu/pbrown/protocols/index.html).

To increase the reliability with which changes in expression levels could be discerned, probes prepared from induced or treated cells were labeled with the red fluorescent dye, Cy5 (Amersham Corporation, Arlington Heights, Ill.), and mixed with probes from uninduced, untreated, or "reference" cells were labeled with a green fluorescent dye, Cy3 (Amersham Corporation, Arlington Heights, Ill.) using the procedure described by http://cmgm.stanford.edu/pbrown/protocols/index.html. The relative ratio of fluorescence intensity measured for the Cy3 and Cy5 fluorophors corresponding to each EST target in the arrays was determined using ScanAlyze software, available free of charge at http://rama.stanford.edu/software/. This provides a reliable measure of the relative abundance of the corresponding mRNA in the two cell populations (e.g., treated cells versus reference cells).

Example 16

Monitoring multiple changes in expression of Fusarium venenatum genes

DNA microarrays were prepared as described in the preceding example by spotting 1152 selected EST clones from Fusarium venenatum as targets. In one experiment we compared the relative expression of each of these genes (as measured by transcript abundance) among cells grown in medium with glucose as the sole carbon source to the same strain grown with maltose as the sole carbon source. Identical shake flasks were inoculated with Fusarium venenatum strain CC1–3 growing in Vogel's minimal medium with either 2% glucose or 2% maltose as the sole carbon source. After 2 days growth at 28° C., total RNA and mRNA pools were purified from each culture using methods described in the previous examples. One microgram of polyA-selected mRNA was used as a template to prepare fluorescently labeled probes for hybridization (the protocol for fluorescent probe labeling is available at http://emgm.stanford.edu/protocols/index.htm). In this experiment, the probe from glucose-grown cells was labeled with Cy3 and the probe from maltose-grown cells was labeled with Cy5. The probes were combined and hybridized with the 1152 EST targets on the microarray. Methods for hybridization and washing of microarrays are also available at http://cmgm.stanford.edu/protocols/index.html. After hybridization and washing, the microarrays were scanned (see Example 15), ad the images analyzed using ScanAlyze software (see Example 15) to determine the relative ratios of red and green fluorescence in each spot on the arrays. The tab-delimited text file generated by ScanAlyze can be imported into other software programs that are capable of sorting large amounts of data in spreadsheet formats (e.g., Microsoft Excel). In such a format, it is straightforward to sort the data on the basis of relative fluorescence ratios (red intensity/green intensity=RAT2 value) or perform other statistical analyses. For example, in this experiment it was desirable to specifically identify those genes whose expression (a) increased by a factor of approximately two, (b) remained the same, or (c) decreased by a factor of approximately two in response to the presence of maltose as a sole carbon source. A number of genes satisfying these criteria were readily identified as shown in Table 5. The quality of the data is ensured by choosing only spots in which the correlation coefficients are at least 0.75 or greater.

TABLE 5

| Seq ID No. | RAT2.exp1 | RAT2.exp2 | AVG RAT2 | Std Error |
|---|---|---|---|---|
| 1902 | 3.84631093 | 1.90100237 | 2.87365665 | 0.97265428 |
| 170 | 1.43757588 | 3.08897138 | 2.26327363 | 0.82569775 |
| 1590 | 1.34067691 | 2.90504405 | 2.12286048 | 0.78218357 |
| 2342 | 2.48104772 | 1.74101079 | 2.11102925 | 0.37001846 |
| 2887 | 2.15781008 | 2.04587664 | 2.10184336 | 0.05596672 |
| 1290 | 2.18673515 | 2.00682358 | 2.09677936 | 0.08995579 |
| 1849 | 1.60461815 | 2.58254133 | 2.09357974 | 0.48896159 |
| 2718 | 1.07601253 | 1.13379863 | 1.10490558 | 0.02889305 |
| 2875 | 1.04636434 | 1.13480645 | 1.0905854 | 0.04422106 |
| 115 | 1.08685943 | 1.07748663 | 1.08217303 | 0.0046864 |
| 115 | 1.08252067 | 1.06766038 | 1.07509053 | 0.00743015 |
| 1453 | 1.09264445 | 1.0495196 | 1.07108202 | 0.02156242 |
| 1677 | 1.07456628 | 1.05581848 | 1.06519238 | 0.0093739 |
| 608 | 1.00586924 | 1.10205227 | 1.05396076 | 0.04809151 |
| 33 | 1.1157845 | 0.98879838 | 1.05229144 | 0.06349306 |
| 2768 | 1.08902881 | 0.9954752 | 1.04225201 | 0.04677681 |
| 336 | 1.08107442 | 0.97569671 | 1.02838557 | 0.05268885 |

TABLE 5-continued

| Seq ID No. | RAT2.exp1 | RAT2.exp2 | AVG RAT2 | Std Error |
|---|---|---|---|---|
| 1855 | 1.06155 | 0.99446738 | 1.02800869 | 0.03354131 |
| 1469 | 1.04708747 | 1.00026235 | 1.02367491 | 0.02341256 |
| 2951 | 0.46005321 | 0.6007873 | 0.55655 | 0.0084234 |
| 71 | 0.44219198 | 0.53023983 | 0.1862159 | 0.04402392 |
| 521 | 0.23356992 | 0.76611788 | 0.1657 | 0.18741504 |

The invention described and claimed herein is not to be limited in scope by the specific embodiments herein disclosed, since these embodiments are intended as illustrations of several aspects of the invention. Any equivalent embodiments are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control.

Various references are cited herein, the disclosures of which are incorporated by reference in their entireties.

SEQUENCE LISTING (7860 sequences)

SEQ ID NO: 1 - DNA, 3033 bp, Fusarium venenatum
  misc_feature (1)...(3033): n = A,T,C or G
ctttcatctccaaaaagggacgcataaagagtgacagtggttctttttcggaactcgtctctcttacatcgtcacttgaatcgttgccatcttcttgacggcaatcgcttcttgcttcttccctttttctgcggctcagatcgcggggtgaaaacttcaaccccgctctgttcccacatacaacaacttcgactttacacacatagtcaagttatccagacaataccgccaagatggttaacttcaccattgacgagattcggcagcttatggacaagcctaccaatgtccgtaacatgtccgttattgcccacgtcgatcacggcaagtctaccctgaccgactctcttctcgccaaggccggtatcatttccaccgccaaggctggtgatgcccgagctaccgatactcgtgccgacgaacaggagcgtggtatcactatcaagtccactgccatctccctgtacggtcagcttggcgaggacaacgacgttgccgacattgttggccagaagaccgacggaaaggacttccttatcaacctcattgactctcccggtcacgttgatttctcttccgaagttactgctgctctccgtgtcactgatggtgctcttggtcgtcgtcaacactgtcgagggtgtttgtgttcaaaccgagaccgtcctcgacaggcccttggtgagcgcatcaagcccgtcatcatcatcaacagggtcgaccgtgctcttgtcgagctccaggtctccaaggaggatctttaccagttcttttctcgaaccattgagtccgtcaacgtcatcatctccacctaccttgacaagtntattggtgacatccaggtctaccctgacaagggtaccgtcgccttcggttccggtctgcacgggtgggctttcaccgtccgccagttcgctgtccgatacgccaagaagttgggtggttgacaagaacaagatgatggagggtcttttggggggacaactactttcaaccccaagaccaagaagtggaccaagaacggtactcccgagggtaagcagctcgagcgtgccttcaaccagtttatcctcgaccccatcttcaagatcttctccgctgtcatgaacttcaagaaggaggagaccgccactctcctcgagaagctcaacctcaagctcaacgctgaggaccgtgagaaggaaggcaagcagctcctcaaggctgttatgcgaaccttccttcccgctgctgactctctcctcgagatgatgattctccaccttccttctcctgccaccgctcagcgttaccgtgccgagactctctacgagggtcccatcgatgacgaggccgccattggtatccgagactgtgaccccaagggtcctctcatgctctacgtctccaagatggtgcccacttccgataagggtcgattctacgctttcggtcgtgtcttctccggtaccgtccgatccggtctcaaggtccgtatccagggtcccaactacgtccccggaaagaaggacgatctcttcatcaaggctatccagcgtactgtcctgatgatgggtggcaaggtcgancccatcgacgacatgcctgccggtaacattgttggtctggtcggtattgaccagttccttctcaagtccggtaccctcaccaccagcgagaccgcccacaacctcaaggtcatgaagttctccgtctcccctgtcgtccancgatccgtccaggtcaagaacgcccaggatctccccaagcttgttgagggtctcaagcgtctctccaagtccgacccctgtgtccttaccatgacttccgagtctggtgagcacgtcgttgccggtgctggtgagctccatctcgagatttgccttaaggatctcgaggaggaccacgctggtgttcctctgatcatctccgaccctgtcgttcagtacagagagactgtcaccaccaagtccagcatcactgccttgtccaagtctcccaacaagcacaaccgtctgtacatggttgctgagcccatcgacgaggagctttctcttgccatcgagggtggcaaggtcagcgcccgtgacgatttcaaggctcgtgcccgtgtccttgctgacgactttggctgggatgtcaccgacgcccgaaagatctggaccttcggtcccgacggcactggtgctaacctgttggtcgaccagaccaaggcggttcagtacctcaacgaaatcaaggattccgttgtctccggtttccagtgggctacccgtgagggtcccgttgctgaggacccatgcgatcttgccgattcaacgtcctcgatgttaccctccacgccgatgccattcaccgtggtggtggtcagatcatccctactgcccgccgtgtcctgtacgctgcctctcttctcgccgagcccgctcttctcgagcccgtctacctcgtcgagatccaagtcccgagaacgccatgggtggtgtctacggtgtccttacccgacgacttgccacgtcttcagcgaagacagcgccctggtactcctctcttcaacatcaaggctacctccccattctcgagtctttcggtttcaacggagatctccgacaggccacctctggacaggctttcccccagtccgtcttcgaccactggcagatcctccccggtggctctcctctcgaccctaccagcaaggtcggcgccattgtcaccaccatgcgaaagcgcaagggtgtcaaggagatcgttcctggtgtcgagaactactacgacaaagctgtaaacggcttttttttaatgtgccgaacgaaccacgaagcgtgccacaatggacacgcaaaattaatcggctggtaacgaagatttgggacgcatgcctaattccatggaggagctccttgatgatctcaggaggggcatgctaagcggaaaccaaaaaaagaaaagtcgagtgactgagttgaagctgaatgccaaggagcagctcaatccagtttttatgtagttatgtcgtatctgatgagttgaaacacgttagattgaagttcc

SEQ ID NO: 2 - DNA, 1812 bp, Fusarium venenatum
  misc_feature (1)...(1812): n = A,T,C or G
aattcttttttttttttttttttttttttttatttagtaaaaaanaaaagcttgatatggctacaanaggaattttgttgatttcttggtacacagctcacaaatgagacttgatggagcttatgagaaacctccccggaccttgtttcctctgctctatacaaaggtccttatttctctcctcccgtctcccgcggcattaacttcaatacttaaaccccttactgaccctcaagctcagcaagaatcttctcacccttggccttgncggaggcgaagtcaccaaccatgtagaaggcaccctcgggaaggctgtcaccctcaccgctcaggatagccttgaaggagttgatggtctccttaaggtcgacgagcttaccctcaataccagtgaaaacctgggcaacagtgaaaggctggctcaggaaacgctggatcttacgggcacgctcgacagtaagcttgtcggcctcggacaactcatccatacccagaatagcaatgatatcctgaagagacttgtactcctggaggatctgctgaacacgggtggcggtgtcgtagtggtcctgaccaacaactcgggggtccaacatacgggacttggagtcgagagggtcgacagcggggtagatacccaactcggagataccacgagacaagacagtggtggcgtccaaatgggcgaaagtagtggcaggggcaggatcagtcaaatcgtcagcagggacgtagacagcctggacggaggtaatggaacccttctgggtggtggtaatacgctcctgcataccacccatatcgacggcgagagtgggctggtaaccgacagcagaggggatacgacccaaaagggcagacacctcggaaccggcttgagtgaatcggaaaatgttgtcgatgaagagcagaacgtcctggccttcagcatcacggaagtattcggcaacagtcaatccagtaagagcaacacgggcacgggctccagggggctcgttcatctgaccgaaaaccagggcgaccttggactcgccatcaagctgaatgacggaggtctcctgcatttcgtggtacaaatcgttaccctcacgggtacgctcaccgacaccggtgaagacggagtaaccaccgtgggccttggcgatgttgttgataagctcctgaatgaacacagtcttgccgacaccggcaccaccgaagagaccaatctttccaccacgggcgtagggagcgagaagatcgacgaccttgataccagtgacgaggacctcagcagaggtggactgctcaacgaactcgggggnttcggtgtgaataggaaggcgcttctcagtcttgatggggccacgctcgtcaatggggtcaccagtgacgttcatgatacggccaagagtctcggggccgacgggaatggtgatgggagcaccagtgtcgtgggcgggagcacctcggacgagaccctcagtaccgtccatggcaatacaacggacgacgttctcacccagatgttgggaaacctcgaggacaagcttctggccattgttctgggtctcaagagagttgagaatggcagggagcttagcaccatcgaacttgacgtcaacgacggcaccgatgacctggtgaatcttgccagcgccaacgccagtgctggcccatcggctgttgaggggaactcggagagcggaagatcggagggcacgtcgaggaaggacggccgggcgagccgcgcgggcgaaggaggaaatgccgctcttgaacatcttgccagatgacaaagagcgatcagagataggagtggagagaggttgg

SEQ ID NO: 3 - DNA, 1224 bp, Fusarium venenatum
  misc_feature (1)...(1224): n = A,T,C or G
gtcgcggccatgggaggcgacggtgacgccagaggagcaaccaacctcaagtataacggtacaggagcaataggtgcaaatccactcgatatgaatgtcaatgactggtacgaggctggagatatcgcgtggatgctctcagccactgctctagtattattaatgattcctggcgtcggcttcttctattcaggactcgctcgtcgcaaatcggctctatcgctgatatggctttcagtaatgagcgccgcagtaacaacctttcaatggttcttctggggcttctcacttacattttctcatacggctggtcccttcatcggtgatctggccaactttggattccgtgatgtcttggctcgtccttcggtgggctcggcgcatctcccggacatgatgtttgctgtgtatcagggcatgttttctgccctgaccgtcgctctcgctactggcgccgtcgccgaacgtggccgaatgctcccctgcatcatcttcatcttcgtgtgggccaccatcgtctacaaccccatcgcatgttggacttggaaacctaatggttgggtccaacaagatgggcgggctggactttgccggaagtaccccggtacacattgcttcagggagcgctgctctggcttactccatgatgctgggcaaagccgtagtggtcatggaacccatgagctcaactaccgcccacacaatgctactcatatcgtgactggaaccgtcttcctatgggtcgggtggtttggtttcaatgctggctccgccctttcagctaacctccgcggtgtcatggcagctctcgtaactaacctagctgcttgtgttggcggaattacctggtgtcttttggactatcgcctcgagaggaagttctccactgttgggttttgttccggtgttgttgctggtcttgtctgcatcacccctggctctggctatgtccctccttgggccgctgttatctttggggctcttggtgctgccggttcgaactatgctaccaaggtcaagttccttctcggaatcgacnatgccctcgatattttcgctgtccacggtgtcggcggtctcattggcaatatttgcaccgccttctttgccagcccgactatcgccgctctcgacggttactctcgcattaagggtggatgggtcaacatcactgggcacaaatgggttatcagcttgccgactcngtctgcggaagcctgtact

SEQ ID NO: 4 - DNA, 1279 bp, Fusarium venenatum
  misc_feature (1)...(1279): n = A,T,C or G
aattgcttgatacatttgtatctcaatactatctctcttcttttagttccttttcaccaaccaaaaaacacattcacaatggctgctcccatcacctcaaggacggaaactctccagaagtacctcagacttgatcagaagggcatgatcatggctgagtacgtctgggttgatgctgagggtggtacccgatccaagtctcgaactctccccgagaaggaatacaagcctgaggacctccctgtctggaacttcgacggttcatccaccaagcaggcccctggcgagaactccgatgtctacctccgaccttgcgctgtctaccccgaccctttccgcggttctcccaacatcattgtgctcgctgagtgttacgactcagacggtacccccaacaagttcaacttccgtcatgattgtatcaaggttatgaagacatatgccgacgangagccttggttcggtctcgagcaagagtacaccctccttggagctgacgacagaccttatggctggcccactggtggtttccctgctccccagggtgaatactactgcggtgttggtactggcaaggttgtccagcgcgatatcgttgaggctcactacaaggcctgcttatacgctggtattcagatttctggaacaaatgctgaggttatgcctgcccagtgggagtaccaggtcggtccgtgcaccggtatcgagatgggtgaccagctctgggtttctcgattcttccttcaccgtgtcgccgaagaattcggcgcaaaggtttctctgcatcctaagccaattgccggagactggaatggagctggaatgcattccaacttctccaccaaggctatgcgtgaggaaggcggcatgaaagtcatcgaagaggcctgaagaagcttgagcctcatcatgttgagtgtatcgctgagtacggtgaggacaacgatctccgtctcaccggccgacacgagaccggctcgatcgactcattttcatggggcgttgccaaccgtggcacaagtattcgcgttccccgcgaaactgctgccaagggttacggttactttgaagatcgtcgtcctgcttccaacgctgacccttaccgggtcacaaaggttctccttcagttctctatggaattaaagcgtgtttttttatgatccagacggcttcgtctcatggttaacggcgtgacggtttgggaaactatttgattatatagatagcatgacaacgggtctcaaagggaccccataatgacaagaatctgaaatatctc

SEQ ID NO: 5 - DNA, 2401 bp, Fusarium venenatum
  misc_feature (1)...(2401): n = A,T,C or G
cggccgcaggaatttttttttttttttttttagttgcacgaatcacttctagactctctattcctatttttgatttgcacaagatcccgggcttttcttttcgcctcatcttgtacccccagacataagctgaatgctcatgccaacatgatcatatcgtcgtagaagcgagtacatcagcccttgggcgtgagaccaaagtcgtaagatcccactgaaggttgtcatttcagaaataagtcgcttatttcttaccagccttggcagcggacttggtgaccttgccagcagtgccagtggacttctcgacggccttgatgacaccgacggcgacggtctgtcgcatgtcacggacggcgaaacgacccagaggagggtagtcagtgaaagcctcaacacacatgggcttggagggaaccatcttgacgatagcggagtcaccagacttgatgaacttgggggcggcctcagtagccttaccggttcggcggtcgatcttttcctggatctcggcgaacttgcaggcaatgtgggcagtgtggcaatcgaggacgggagcataaccagcaccgacctgaccggggtggttgaggacgataacctgggcgatgaaagaagcggcaccggcagggggtcgttcttggagtcaccagcgacgttaccacgtcggatgtccttgacggaaacgttcttcacgttgaaaccaacgttgtcaccgggctggccctcagtgagctgctcgtggtgcatctcaacggacttgacttcagtggtgacgttggaaggagcgaaggtaacgaccataccgggcttgatgataccagtctcgatacggccaacgggaaccgttccaataccaccaatcttgtagacatcctggaggggaagtcggagaggcttgtcgttgggacgcttggggggctcgatggagtcaatggcctcgaggagggtcttgccagagagcttgccggacttgatctcacgctcccaacccttgtaccaggggcagttggtggaggcagtcaacatgttgtcaccgttgaaaccagagatagggacgaaagcgacagccttggggttgtagccgaccttcttgatgaaagaggaggtctccttgatgatctcctggtaacgggcctcagaccacttggtggtgtccatcttgttgatggcaacaatgaggttcttgacaccaagggtgtaggcaaggagagcgtgctcacgggtctggccatccttggagataccagcctcgaactcaccagtaccggcggcaatgatgagaatggcgcaatcggcctgggaagtaccagtgatcatgttcttgatgaaatcacggtgaccgggagcgtcaatgacggtgacatagtagcgaggagtctcgaacttccagagagcgatatcgatggtgataccacgctcacgctcggccttgagcttgtcaagaacccaagcgtacttgaaagaacccttaccgagctcggcggcttccttctcgaacttctcgatggttcgcttgtcgataccaccgcactggtagatcaagtgaccggtagtggtcgacttgccagagtcgacgtggccgatgacgacgacgttaaggtgagtcttctcctccttacccattttgacggttgtggatgatttgtgtgaaggtttttgatgaacgtgagattcgcagatcggatgcttgaaccgggtatgcgagacgagggtagtagtcacccttgtaaagatattcgaggacggcggagaacacctcgggttnttcgtcgggaaggnagattcttttgctttgtgtctcaaagttgtttccgcgacagcccgccttcaaagaagggcgactggcggagcacttccttcgtgtgctgcaaagagccggccatctcgaccaacggtcaaagtgacgatggcgagggtacatgcgcgggcgcgggtgggggtacgggcgcggacttttgcggaatcgagtcctgctcattgagtgatctttgcagcttcgacatcttcgtgtggtccctgtgggagcccgatctcttcagtctcgcagacttgtcaacgcggccggggtcttgcgacctgaacgagcgcttgaacatggctgcggtttttatcggggggaatcggtagataaagaatggactcgtaacggggatttcgacgagagaaatacggggagaataacgactccgggctttcttatgtatcgtgggatttggctagagagtgacgaaaagagcgtagagatagagagcaaaagagaagaagaaaaagagagtgacgcacaacagaaaagattgacaaaatgggtccgggcagagaaatatgtccttctttcaaaggagacaagacaagacgatatcctccaggtgaatctttgcgacccttttttggttgtgtg

SEQ ID NO: 6 - DNA, 1634 bp, Fusarium venenatum
  misc_feature (1)...(1634): n = A,T,C or G
cgacgcattctcgacaacgttgacggttgggtcaagcccggaaccctcacagcattgatgggtgtatcaggtgctggaaagacnactcttctcgactgtctcgctgatcgtatctctatgggagtcatcactggtgaaatgcttgttgatggcaagttgcgcgacgactcgttccagcgtaaaacaggctacgtgcagcaacaggaccttnacttggaaaccagcactgttcgcgaggctttgacttttagcgctcttcttcgtcaacctgcctctaacccacgtgaagagaagatcgcctatgtcgatgaagtcatcaagctgttggacatgcaagagtacgcanatgcagttgtcggtgtcttgggcgagggtctcaatgtcgagcagcgcaagcgtctaacaatcggtgttgagctcgctgccaaaccgcctctacttctcttcgtcgatgaacctacttccggtcttgactcgcaaacatcctgggctattcttgatctcctcgagaagctgtccaaggcaggtcaatctatcctctgtaccatccatcaaccgtcagccatgctcttccaacgcttcgatcgtcttttgttcctcgctaagggcggacgcacaatctactttggtgacatcggcaagaactctgagacccttaccaactatttcgtcaagaacggttctgatccttgtcccaagggcgagaaccctgctgagtggatgctcgaggtcattggtgcggcacctggttcccatactgaaatcgactggcatcagacatggcgcgaaagctctgagtatcaagatgttcagactgagcttcagcgtctcaaggcagagggtaatgcgaatggtgctgcggagagtcacgatgctgaatcctatcgcgagtttgctgcgcccttcggcgaacaagcttcgtatcgctactacccgtgttttccagcagtactggcgcaccccatcgtacatctactccaaggatgctctgtgtattcaggttggattgtgcatcggtcttggcatcctcaaagcccctccgagtccttccaagcttgcagaaccaaatgtttgccatcttcaacgtgctcgaccagtctttggtcaactggtgcagatgcagtccatgcctcaattcgtcattcaacgttctctgtatgaagtccgcgagcgtccttcaaaggtttactcgtggaagatctttatgctgtcgcaactcatcgtcgagcttccttggaacagtctaatggctgtcatcatgttctgtgcatggtactatcctgtcggtctttaccanaacgcttctgacgccggtcaaaccaccgagcgtggcgccctcatgttcctctttctattggccttcctactcttcaaagctactttctcaaccatgatcatcgntggattccaaactgccgagggtggaccaacgttgcgaacctggtggtcatgctttgctgacttntggggngtcctccccccaaggatctctccccggnttntggactttatnaatacgtatcgccattacttattagnggnggcatgttacacangagtcncaacacaaacgtacatgtgccgaaataaatngtgccgtaaccnccaaaggtttnnttggcaaaaacatggaa

SEQ ID NO: 7 - DNA, 1481 bp, Fusarium venenatum
  misc_feature (1)...(1481): n = A,T,C or G
caactcttctatctcccgacctccgtctccttctccatcaacgtctcttcttttcccctttcccatacacacaccgtaatccacagccatggaggaagaagttgctgctctcgtcatcgacaatggttcgggtatgtgcaaggccggtttcgccggtgatgatgctccccgagctgttttcccttccattgtcggtcgcccccgtcaccatggtatcatgatcggtatgggtcagaaggactcgtacgttggtgatgaggctcagtccaagcgtggtattctcacactgcgataccccatcgagcacggtgttgttaccaactgggacgacatggagaagatttggcaccacaccttctacaacgagctgcgtgttgcccccgaggagcaccccgtcctgctcaccgaggctcctatcaaccccaagtccaaccgtgagaagatgacccagattgtcttcgagaccttcaacgcccccgctttctacgtctctatccaggccgttctgtccctgtacgcttccggtcgtaccaccggtatcgttctggactctggtgatggtgtcactcacgttgttcccatttacgagggtttcgcccttccccacgccattgcccgtgtcgacatggctggtcgtgatcttaccgactacctcatgaagattcttgctgagcgcggttacaccttctccaccaccgccgagcgagaaatcgtccgtgacattaaggagaagctctgctacgtcgcccttgacttcgagcaggagatccagactgctgcccagagctccagcttggagaagtcttacgagcttcctgatggtcaggtcatcaccatcggtaacgagcgattccgtgctcctgaggctctcttccagccttctgtccttggtcttgagagcggtggtatccacgtcaccactttcaactccatcatgaagtgtgatgtcgatgtccgaaaggatctctacggaaacattgtcatgtctggtggtaccactatgtaccccggtctctccgaccgtatgcagaaggagatcactgctcttgctccgtcttccatgaaggtcaagatcattgctcctcccgagcgaaagtactccgtctggatcggtgggttccattctcgcttccctgtccaccttccagcaaatgtggatctccaagcaggagtacgacgagagcggtccctcaatcgttcaccgcaagtgcttctaagctttccgatcganaaattaaatcctcccactcgcgcaacgacaagatcatggaggtggcgacagacgctaaccttgggtgggttggccagcgtcgaagtcgaatctcgtatttacgaaaagtttttgacatggtcgaaagagtgggcgttgcgcttattacgaagagatgtgatggccccttttcttgtagttcgcgtataatgcgtgcctaggggtagaagccgaggttgacatacaaatacttttttactttccgaaaaaa

SEQ ID NO: 8 - DNA, 1237 bp, Fusarium venenatum
  misc_feature (1)...(1237): n = A,T,C or G
gtcaaagctaaggctacttcagctcttgaactacttcggcccatttcttcttctctttactctccatatcccatctttacatccacagccgtcaatatgcgtgagattgttcaccttcagaccggtcagtgcggtaaccaaatcggtgctgntttctggcanaccatctctggcgagcacggtctcnacagcaatggtgtttacagcggtacctccgagctccagctcgagcgtatgagcgtttacttcaacgaggcctntggtaacaagtatgttccccgtgccgtcctcgtcgatctcgaacccggtaccatggacgccgtccgtgccggtcccttcggacagcttttccgacccgacaacttcgttttcggtcaatccggtgccggaaacaactgggccaagggtcattacactgagggagctgaacttgtcgaccaagttctcgatgtcgtccgccgtgaggccgagggttgtgactgcctccagggcttccaaatcacccactctcttggtggtggtaccggtgccggtatgggtaccctgttgatctccaagatccgtgaggaatttcccgaccgtatgatggcaaccttctccgtcgttccttcccctaaggtctccgacaccgtcgtcgagccttataacgccaccctctccgtccatcaactggttgagaactccgacgagaccttctgtatcgacaacgaggccctctacgacatttgcatgcgcaccctcaagctgtccaacccctcttacggcgacttgaattaccttgtctccgccgtcatgtccggcgtcaccaactgtctccgtttccccggtcaagctgaactctganctccgaaaagctcgccgtcaacatggtgcccttccctcgtctgcacttctttatggtcggattcgctcccttgancagccgtggtgctcactctttccgtgctgtcagcgttcctgagctgacccagcagatgttcgaccccaagaacatgatggctgcttccgacttccgcaacggtcgttacctgacctgctctgccatcttccgtggccgtgttgccatgaaggaggttgaggaccagatgcgcaatgtccagagcaagaactcatcatacttcgtcgagtggattcctaacaacatccagaccgctctctgcgctatcccacctcgtggacttacaatgtcttccacttttattggaaactccacctctatccaggaagcttttttttt

SEQ ID NO: 9 - DNA, 2197 bp, Fusarium venenatum
  misc_feature (1)...(2197): n = A,T,C or G
aggggaatgggccnttaaangangctcgaacggcgncagaaaaatnttaanatatagnggtttttttttttaaaagtccaaatacaatcgattattaagctctaacgggttatcctttacacgcagttaccgcccccatgaaaagcaatttgtgcctcatgaagaatgaccaagcacaagatgtcgtaaagaaaagtcaggaaacatgatgacgacagagaacgacgcctttaaagagaaaagctagtagtcttgcctcatctatgtttagaagatctgagcgagggcagcaacaccagcgagggcgaggacagccatgttgatgctgacactgccggcggcgctgtcgtcgtcctcgttactttgggaagaaccagagccatcgctctcctcaccgccgtcaccaccctcgttggccttcttgttgttgaaagtgcagctctccttgccgtcaatcttgccatcgctcttcaggtcgtcaaagtatttgcagaactcctcaatatcggtagttgatgaaacgacgacactgccgctgacttggtcgagcttggggagtttgaccttctcgaagctaccacggagagcaacaccaccggtaaccttctccagcttggggaagtcgtcaatggccagaagcttggtgttgttctggatagtgaaaccaccaccaatctcctcgagtagagggaaagagatattggtgagcttcttcatgtcaatgagagagagggtttcctcgatgatagtcaggttgggggcgctgaagaactcaagcgaggggttggcgctcagcttcaagctcttggtgacctccttgagaaggggaactgagaagttcttggcgctagagatctgaatctcagcagccaactcaagcttgtccatgatgatctccatagcatcgttgccgttgtcgaagatcttgagctcggaggtgatgttgacgaggtcagatcggaaagcgttcatttttcggttgttgtcgatctggaagctctcgacggtggcaacgctaagaccgctcaggtcgctgatgaaggtatcggtaattcgaatgctcttgatcttagtgacaccttcggtaccgaagttcagctctccgagacgaggaagcttgatgaagctgaggccgctaaggctcttgagggtggagaactcgaggttgctgagagcctcgaggttctcaagctggaagttgccatcgatagactcaatagaagtactggagatagagatgatgtcgccaccgttcttggcaacgaagttaccctcgatctgctcggggccgttgataacaacagcgccggcgaccttcttgtcgatgatgatgtctcccttgacaactgtgcagtcgattgtgggggtgggctcggtaaccttgacgtcgctggtgcaggtagcggcggagaccgcagagacaccgagtgccgcaatggcggaaagaaccttaacggaatgcattatgacctagtttgtaattggaaaggatcctgtgattgattttgtggatggtgtttgtttaagaaaaaaaaacttgatggtttctcggcgaacgatggagatatgcaacagggaatagtatagattgatattcctggaattaggtgtaaaaagtctggcgtatggacgaaaagtcacaatgaagcctgacaggaaacgagtggcgtgaagagaaaaagggacgagaatattaccaacaatgagaggaagtcaatcacaggatcctttccaattacaaactaggtcataatgcattccgttaaggttctttccgccattgcggcactcggtgtctctgcggtctccgccgctacctgcaccagcgacgtcaaggttaccgagcccacccccacaatcgactgcacagttgtcaagggagacatcatcatcgacaagaaggtcgccggcgctgttgttatcaacggccccgagcagatcgagggtaacttcgttgccaanaacggnggcgacatcatctctatctccagtacttntattgagtctatcgatggcaacttccagcttgagaacctngaggctctaacaacctcgagttctcccccttaaaagccttacggcctcagcttnattaaactttctcgtctngganagctgaacttcgnaccgaagnggcacttaaancaagagctttcgaattaccgatcctttattaacgacctgggcggtntagcgt

SEQ ID NO: 10 - DNA, 1086 bp, Fusarium venenatum
  misc_feature (1)...(1086): n = A,T,C or G
caagaccatcgctgtcataaacgccagcgggcgacaggctgcgtctttcattcgcgtcgccaccgctgttggttaccatgttcgtgctcagttgagaaaatctggacgcgtgatcgcttctgaaagtctccgcgaaatcccaatgntgaccgttcttgttgggtgaaactgtacacgaggcaccagccctctgaaagcaaaccgcgatgtcaccaagcatggccctctgactggtgtcggagtcaactacgacctgatcgccaatcttttccgcggagctcaactcgccttcatcaacaccactttttacggcgacgagatgccattggaaaagcccttgccgatgccgccaagcgcgccggnaatccagcactatgtctactcatcgatgcccgaccatgctgcctatgataccaagtnggccctcgctgcctctttgggccgccaagcatgaagtcgagcagtatgtgcgcaaaattgagaatgccctgccactttgtnttacactgggcatttacaacaacaacttcacctctcttcaataccccctcttctgtatggagnttgcagaaggacggctcctttagatggcaagcgcctttccatcctgatgccaagctaccttggctagatgctgagcacgacgtcggtcctgcagttctccaaattttcaaggacggccctgccaagtggaacggagagcgtatcgcacttgcatacgagtacttgaccccaaaggaggtgtgtcgccttttctccaagggagttggtcgtcctgtgcgctatgttcatgggcccatcgaggtgaangtccgcatcccagaangttaccgcgaacagctcgtggctcttgagcaactctacgaccccaaccgaaaggatcctagaaagcagccgccttacttcggagatccaaaggttgaactaagctgcccaagcgaactctggaactatgggaaggtcccgaagcattgaanantacccagggagatgtttcctatagaagaagaaccaacggnctgacatggatgttggaagatgaatccagcgacaacaaagaagtgcaacaccagcacactcggtcga

SEQ ID NO: 11 - DNA, 1463 bp, Fusarium venenatum
  misc_feature (1)...(1463): n = A,T,C or G
cgccgagcttctgcccgagaagattgagcaggtcaaggccctccgaaaggagcatggttccaaggttattgacaaggtcactcttgaccaggtctacggtggtgcccgtggcatcaaggccctcgtttgggagggttccgtcctcgactctgaggagggtatccgattccgtggcaagaccatccccgagtgccaggagcttctccccaaggctcccggtggcaaggagccccttcctgagggtctcttctggcttctcctgaccggtgaggtccctactgagcagcaggtccgcgacctctccgctgagtgggctgcccgctccgatctccccaagttcgtcgaggagctcatcgaccactgcctaccgacctccaccccatggctcagttctcctggccgttactgctctcgagcacacctccagcttcgccaaggcctacgccaagggtatcaacaagaaggagtactggggctacacctttgaggactccatggacctcattgctaagctccccaacatcgcttctcgtatctaccanaacgtcttcaagggcggaaaggttgctcccatccagaaggacaaggattactccttcaacttcgccaaccagcttggcttcgccgacaacgccgacttcgtcgagctcatgcgtctttacctgaccatccacaccgaccacgagggtggcaacgtttctgcccataccactcaccttgtcggctctgctctcagctcccccttcctctctctcgccgctggtcttaacggtcttgccggtcccctccacggtcttgccaaccaggaggtccttaactggctcaccgagttcaagaagtctgttggcgatgaccttagcgacaaggccatcactgactacctctggtccaccctcaacgccggccgtgtcgtccccggttacggtcacgccgttctccgaaagaccgacccccgttacatggctcagcgcactttcgctcaagagaagatgcccaacgaccccatgttcaagctcgtctctcaggtctacaagatcgcccctggtgtcctcaccgagcacggcaagaccaagaacccctaccccaacgttgacgcccactccggtgtcctcctccagtactacggtctcactgaggctaactactacaccgtcctcttcggtgtctctcgtgccattggtgtccttccccagctcatcattgaccgcgctctcggtgcccccatcgagcgacccaagtctttctcactgacaagtgggctgagctcgtcaaagaactgtnaacgatttagaagcaaaagggaaaaagaangtgatgggangggtctgccnaagaaatggacagaatggatgccgagtcaatggcatttgtacaacacaatgggactggtttaagttaataatgacaaatcgtcgttgacgccgattggaatgaaatgatttgnacagttaatctgcaatttt

SEQ ID NO: 12 - DNA, 1384 bp, Fusarium venenatum
  misc_feature (1)...(1384): n = A,T,C or G
ctcaaaccacacagcccgcccaagatgagtcacagaaagtacgaggctcccagacatggctccctggcttacctgccgcgcaagcgggctgccagacatcgtggaaaggtcaagtctttccccaaggacgaccccaagaagcccgtccacctgactgccgccatgggttacaaggccggtatgaccaccatcgtccgcgacctcgatcgacctggcgcgaaggccaacaagaaggaagtcgttgaggctgtttcaatcgttgatactccacctatgatcgttgttggtctggttggctacatcgagactccccgaggcctgcgatccctcaccaccgtttgggctgagcatctgagcgacgagctcaagcgccgattctacaagaactggtacaagtccaagaagaaggctttcaccaagtacgccaagaagcactccgagaacagcggtgcttccatcacccgcgagcttgagcgcatcaagaagtactgcaccgtcgtccgtgtcctcgcccacacccagatccgaaagactcctctcaagcagaagaaggctcacctgatggagatccaagtcaacggcggctctatcgccgacaaggtttccttcggccaggagctcttcgagaagcccgtcgatgtctccagcatcttcgagcaggacgagatgattgacgtcattgccgtcaccaagggtcatggtttcgaaggtgtcactgcccgttggggcaccaagaagcttcctcgcaagactcacaagggtctccgaaaggtcgcttgtatcggtgcttggcatccttcccacgtccagtggactgttgcccgtgccggtcagagaggttaccaccaccgaacctcggttaaccacaagatctaccgcattggtaagggtgacgctgacgacaacgccgccactgagatcgatgtcaccaanaaaaccattacacctcttggtggtttcgtccgctacngtgagatcaanaacgacttcntcatggtcaagggctctatccctggtacaagaagcgtgtcatgacctccgaaagaccatgttcccccagacctcccgaaaggccctcgagaaggtcagcctcaagtggatcgacacctcgtccgagtttggacacggtgctttccagacccctgccgagaagaagcagtaccagggtactctcaagaaggaccttgcctccgcttaaagcggcagcttgtttcttttcgtgtcttaaccaatcattccattgcatcggtgtcaagggttggttcgttacgccttgcgtttgggctgggtcaggtatgaactggcatggagcataaaaaaaagtccagctaggagagggatagtgatcaaaaattctaacgagattccaatttaaaattattaa

SEQ ID NO: 13 - DNA, 1852 bp, Fusarium venenatum
  misc_feature (1)...(1852): n = A,T,C or G
cgagaggacacctgggaggctgatgaggccacttactacggtggtgaggatacctggctcggaaacgacgtccgttactccaacggaagcaagggaaccaccaagcctggtgccaccgactcggatcagcccgcgaacactgattatcacaaccgagatctcgagaagcctttggctgctgctcaccacggtctcatctatgttaaccctgagggtcctgatggtaaccccgaccccgtcgctgccgcccgtgacatccgcgagaccttcggccgcatggccatgaacgacgaaaagaccgttgctctgattgctggtggtcacaccgtcggcaagacccacggagctggctcaaccgaccacgtcggccccgagcccgaagccgccgaccttgcccagcagggtctcggctggtccaacagctacaagacggaaagggtccgacacaaccacatctggtattgaagtcacatggacaagcactcccgtcaagtgganccatgactacctcaagtactcatggctccactttgagtgggagcttacaaagaaccctgctggcgctcaccaatgggttgctaaggatgccgccgctaccgtccctgatgcctatgactccagcaagaagcacaggcctagcatgttgaccaccgacttgtcgcttcgcttcgatcctgagtacgagaagatctctcgtcgtttncttgagaacccccaggagtttaacgatgccttcgccaaggcttggttcaagctcactcaccgtgacatgggtccccgcgaccgttacctcggccccgaggtccccaaggagatcttcaactggcaagaccccgtccccgagcgtgactacaagctcgtcgacgacggtgacatctctgctatcaagaacgagatcctcaagtctggcattgacgtctccaagctcgtctctactgcttgggcttctgcttctactttccgaggcagtgatctccgcggtggtgccaacggtgctcgtctccgtcttgagccccagaagaactgggaggtcaacaacccctctcaattgggccaggttctcaacggccttgagaagatccagaagaacttcaatgactcccagtccagcggcaaggccatctctctggctgatgtgatcgtccttgctggttccgctgccgtcgagaaggctgctaaggatgccggtgtcaacgtcaccgtgcccttcactcctggccgcaccgacgccacccaggaacagactgatgttaagtctgttggtcacttggagcccgccgccgacggtttccgaaactacggcgcctccacagaccgcgtcaagctcgagcacatgctcattgaccgtgctcagcttctcactctcagcgtccccgagatcaccgctcttgttggtggtcttcgtgcgctcaacaccaactgggatggatcatcccacggtattctcaccaagcgccctggtgtcttgtccaacgacttcttcgtcaacctcctcgacatcaacaccgagtggaagcctgtcggcaacggcgacctgttcgaaggtattgaccgcaagagcggcaacaagaagtggaccggtacccgcgtcgatctcgtctttggatcgcacgctgagctccgcgcgacagctgagacttatgctgaggctggcggtagcgagaagctggttcgcgactttgtcgctgcttggaccaaggtgatgaacctggaccgatttgatgttaagaatggtaatgcgcctaatgtctctcctcgactgtaattttatgaatagcaatgtagcaaaatacctttgagaatgaaatgattacgaatctgacttgaaaaaaaaaaaanantttaaaatcct

SEQ ID NO: 14 - DNA, 1710 bp, Fusarium venenatum
  misc_feature (1)...(1710): n = A,T,C or G
ccacaactctcatcttctctttcatataaatctcctcacctttgataccccaatacccccctctctttatatcacataacatactatacacaatggctctcaccgtcgagctgtccactcctgttactggtacctaccagcagcccattggcctcttcatcggcggcaagtgggttgagggtgtcgacaagggaaaatttgaagttatcaacccctccaccgaggaggtcatcacctccgtctgcgagggtaccgaaaaggatatcgacctggctgtcaccgctgcccgcaaggctttcgatggcgagtggaagcagactactccccaggctcgaggcaacctcctcctcaagcttgccgacctcgccgagaagaacctcgacctcctcgccgctgttgagtctctcgacaacggaaagtccatcaccaacgctcgtggcgatgtcggtgctgttgttggctgccttcgatactacggtggttgggccgacaagattgagggcaagaccatcgatattgctcccgagatgttccactacacccgatccgagcctatcggtgtctgcggtcagattatcccctggaacttcccccttctcatgctggcatggaagattggacctgctctggccactggtaacactatcgtcatgaaaactgctgagcagactcctcttctccgctcttgtcttcactcagttcatcgagcaggctggtttccctgccggtgtcttcaaccttgtcttccggntacngcaagactgnccggtgccgccctctcctctcacatggacgttgacaagatcgccttcactggttccaccgtcattggccgacagatcatgaaggctgctgcttcttccaacctcaagaaggtcaccctcgagcttggtggcaagtcccccaacatcgtcttcgaggacgctgacatcgaggaggccattaactgggtcaacttcggtatctactacaaccacggccagtgctgctgtgccggtacccgtatcttcgtccaggagtccatctacgacaagttcctcgctgccttcaagaagcgagctgaggagaacaaggttggcgaccccttcaacgaggagaccttccagggtccccaggtctctcagctccagtacgaccgtatcatgggctacatcaaggccggtaaggacgagggcgccactgttgagactggtggtgagcgtctcggtgacaagggttacttcatcaagcccaccatcttctccaacgtccgccccgacatgaagatcatgcaggaggagattttcggccctgtctgcgctatttccaagtttaaggacgaggctgaggtcattgaccttgcccacgacaccgcttacggtctcgctgccgctgttcacaccaagaacctcaacacagccctccgcgtttccaacgctctcaaggccggcacagtctgggtgaactgctataacatgcttcaccatcagcttccctttggagggtacaaagagagcggaattggacgagaactcggggaggcagccctcgccaactacacacanaacaagtctgttgccatcaagctgtactaaacatancaaagcgaattgtggggacttgggaaagaaatatgggcggcgttgtaactgcatgancaatctgtatatgattccactttattttacgtatttgatgaaaaaatgttaaagaaatcgtcnaaaaaaaaaa

SEQ ID NO: 15 - DNA, 1253 bp, Fusarium venenatum
  misc_feature (1)...(1253): n = A,T,C or G
cacaaactacatcgaaaaacactttaaagaaacccaagataacttcaaatcactctcaaacctggtcaccaaacatgtctccccctgctgccatctcccccacttcccgctctgctgagcttgctacctctaccaccaagctccctgtccacgcgggcaagaacgttaacaccaagaccattgaggaaatgctcggtaactgggatgacttcaagttcgctcccatccgagagagtcaggtctctcgtgccatgactcgacgctacttccaggacctggacagctacgccgagtctgacattgtcatcatcggcgctggatcctgcggtctgagcgctgcctacgtcttgggcaagaagcgtcccgatctcaagattgccatcatcgaggcttcagtgtctcctggcggtggtgcttggctcggcggacaactcttctctgccatgatcatgcgcaagcccgctgatgctttcctccgtgagatcggcgttccctacgaggacgagggtaattacgtggttgtcaagcacgctgccctcttcacctctaccatcatgtccaaggttcttcagatgcccaacatcaagctgttcaacgccacttgtgtcgaggatctcattactcgaccttctgacgagggtgttcgcattgctggtgtcgtcaccaactggactcttgtctcgatgcaccacgatgaccagtcctgcatggaccccaacaccatcaacgctcccgtgancatctccaccactggccacgatggtcccatgggcgctttctgcgtcaagcgtcttgttagcatgcagcgcattgagaagctcggtggtatgcgtggtcttgacatgaacgttgctgaggatgctattgtcaagggtactcgtgagattgttcctggtctcattgttggtggaatggaactttctgaagttgacggtgctaaccgtatgggtcctacctttggtgctatggctctgagtggtctcaaggcagccgaagaagcactcaacatctttgacactcgcaagaagcagaatgagcagtaaatgagtctgtatcaaagaacctcaaaaatggaaaacggacacatcgaataaggctccagaacctcgtctctcattcgggttgtggaaacttgtcattcatttgaactattgttgacttgttcaagcatgaagaatatgtgaaccaagcttgaaagtcaatttacagttaaacaaaattgaataaaataagtcattgctttctgtattcat

SEQ ID NO: 16 - DNA, 2504 bp, Fusarium venenatum
  misc_feature (1)...(2504): n = A,T,C or G
ccatcatcaccctctccatccttnacagcatcgatcttgtctgattttattaatacagacggtcgaggacatcactttgtccacttgtttttgtctttgagtcgcangtagacacaatttccgagctttgcgcgtttcgtcatcatgaagtccgctctcactctctccgtggccgctgtcgccagcgctgcctctttcagcgtcggcaccgtccacgacaaggccgctcccatcctcagctccatcgaagccgagaccatcccagactcgtacatcatcaagttcaaggaccacgtcgatgagcgtgctgcctccaaccaccacatgtgggttcaggacacccacaccaacggcgagtctgagcgcctggagctgcgaaagcnatcctccattcccttcacagacaagacattctctggcttgaagcacacctttgacattggtgaggccttcaagggctacgccggccactttgacgagtccatgatcgagaaggtccgaaaccaccctgacgtcgagtacatcgagcgcgacactcttgtccacaccatggtccctgtctccaacaaggacatgatcactgaggacaagtgcgacggcgagaccgagcgatcagctccttggggtcttgcccgtgtctcccaccgtaacaccctcaacttcggtaccttcaacaagtacctctactcctccgatggtggtgagggtgttgatgcctacatcgtcgacactggtaccaacatcgaccacgttgactttgagggtcgtgctaaatggggcaagaccattccttccggcgacgccgacgaggatggcaacggtcacggtactcactgctctggtactgtcgccggtaagaagtacggtgttgccaaaaaggcccacgtctacgctgtcaaggtcctccgatctaacggctccggatccatgtccgacgttgtcaagggtgtcgagtttgctgccaccagccatcttgagcaaaaaaagaaggccaaggatggtaagcgtaagggctttaaaggctctgtcgccaacatgtcccttggtggtggcaagacccangctctcgatgctgncgtcaacgctgctgtccgcactggtgttcactttgccgtcgctgctggcaacgacaacgccgatgcctgcaactactcccccgctgccgcttctgagcccgtcactgtcggtgcctctgctattgatgacagccgtgcctacttctccaactacggaaagtgcactgacatcttcgcccctggtctgaacattatgtccacctggatcggtaacaagtacgccgtcaacaccatctctggtacctctatggcctctccccatattgctggtctcctggcctactacctctctttccagcccgctganggactccgagtaccgctcttgctttccatcacccccaagaagctcaanggagaacctcatctccgttgccaccgagaacgccctttccgatattccctccgacacccccaacctgctcgcctggaacggtggtggctgcagcgactacaagaagatcgtcgaagctggtagctacaaggtcaacaaaggctgctccttcttctcgcgttgagaacatcaaagcacgccgttgaagcacgaaggtcgatgttgtctcttggcaagctgaccactggcgctaaggacnttggncttccaaggccgnagaagttcttcaagaagaatcacganttcgtcgatgangancntcgagcaagttnatnaaggagctcaacatgttaagancataatcntatcatggtgtaatggntacgcatagggttcatncggtataacggccgatgggaatttgtcaccttggccttcaccagcaaagatgatttcgcccttgtagtaaatgccaccattggggttaatgacttgagggttagctgtgtcaacgactgtcaccttcacttcatccttgcctagggttcccttgcgcaaagcntctgcatctttgagagaaatcttctggatgatggaagacttgttcaggccagtgcctgccgcaggagcacccgcattttgcacgaaaaaaacctcgtctgtaggtgggtaccagactacagcctcgtggaagatggggtcgctttctgacgtagcaacaagtgtcagagagggatcctttccgatgacatcgaggaattcatcatcataaacatggaagggtttctcgacgagagattcctctgtcactccgggccatgtaaagaccagtgtgtcattagccacggaaggtggtgggacatccttcaaaacattgaaagacttctgatcaatgacctgagccgtggagggaagtttggcagcggcaacgccacaaatcccgacaacaagggcagcaatggtggaaggcatggcgaatgaggtagaagtgaaactgagtggtgtgggagccaagctgcagaacgaaggaggatggtcaggctgtactaaatatgtgccttggaagaactttatccacgattgatcatctccgc

SEQ ID NO: 17 - DNA, 1227 bp, Fusarium venenatum
  misc_feature (1)...(1227): n = A,T,C or G
gctttctcttcctcctcctcagccaagtcattgttgtaaaagccttgcctggcctgttcttttttgtcgtccttttctctgtggtccctcttctttgctcttgcatacttcctccatctccatacttgtaaatcaacaacatctgcaaacatgcgtgaggtcattagcatcaacgtcggacaggctggttgccaaatcgccaactcttgttgggaactttactgcctcgagcacggtatccagcctgatggttacctcaccgaggagcgcaaggcgcaggaccccgatcagggatttagcacattcttctcagagactggcaacggaaagcatgtcccccgagccatctactgcgatttggagcccaatgtcgtcgatgaggttcgcaccggtccttaccgtaacctcttccaccccgagatgatgatcactggcaaggaggacgcttccaacaactatgctcgtggtcactacactgtcggcaaggagctcatcgatggtgtcctcgacaagattcgccgggttgccgacaactgtgctggtctccagggtttcctcgttttccactctttcggtggtggtactggatctggtttcggtgctcttcttatggagcgcctgtccgtcgactacgggaagaaaancaagctggagttctgtgtttaccctgttcttnagaccgccacctnagtcgtngagccctacaactttattcttaccacacacaccactcttgagcactccgactgntcnttatggncgacaacganggcatttacgacatntgncggcgaaaccttggtctcgagcgccccaactacgagaacctgaaccgtcttattgctcaggtcgtctcttccattactgcttccctccgattcgacggttccctcaacgtcgacttgaacgagttccagaccaacctggtcccttaccccagaatccacttccctctcgtcgcttactctcctgttatctcggctgccaaggccgctcacgaggccaactctgtccaggagatgacatgtcttgcttcgagcctaacaaccagatgtcaatgtgaccccgccatggcaagtacatggccacttgtctgctgtaccgcggtgactctcccaacaagccacccgccgtgctaccttaanacaaggaacancattcgtgacggtgcctatggttcaactggttcgtacagcccgaaantccaagggactcncaagtagcggc

SEQ ID NO: 18 - DNA, 941 bp, Fusarium venenatum
  misc_feature (1)...(941): n = A,T,C or G
ctcttacaatcccgacaccggccaccgcagcagtgcttccgtcgcttacatccaccctatccttcgaggcgacgagcgacgccccaacctgactgttcttaccgaagcccatgtctcaaaggtcattgttgagaacgatgtcgctacgggcatcaacatcaccctcaagtctggcgaaaagcacactctccatgctcgcaaggagactattctgtgcgccggtgcggcgatacacccanactcctcctcactctggtattggccccaaggctcanctcgagtttttcaacatcccccgttgcaaaggacatcctggtgttggcgaaaacctnttggatcaccccgagaccatnatnatgtgggagctgaacaaggccgtccntgccaaccaaaccactatggactctgatgctggtatcttccttcgacgggagcctaagaatgctgccggcaacgacggtgatgctgccgatgtcatgatgcactgctaccaaatttctttccacctcaacacagagcgtcttggataccccaagattaaggatggttacgctttctgcatgacacccaacattcctcgcctcgctctcgtggccgtatctttttgacctcggccgaccctactgtcaagccttccctcgacttccgctacttcaccgaccccgagggttacgatgcggctactcttgttcacggtatcaaggctgctcgtaagatcgccagcagagccccttcaaggagtggctcaagcaggaggncgccctggccccaagattcaaacccgatgaggagaatagcgagtacgcccgtcgtgtcgctcacaccgtctacaccctggcggtccaccaagatgggcgataccgaacgagatgagatggctgttgtcaaccccgactcaaggtccggggatnaacaacttcgaatggtgagctggnatttcn

SEQ ID NO: 19 - DNA, 1727 bp, Fusarium venenatum
  misc_feature (1)...(1727): n = A,T,C or G
cagatcaacatcactgctatcaccaacatgcttactcaagtcctttatggcttggtagccagtgccctttggcaaggccaagtcgttgcatcaccaagcaaggacaattcactggagcgcttcattgacaaacaagctgatatttctatcaagggtgtccttgctaatattggcgctgatggaaaaagggcacagggtgcagcgcctggtgctgttgtggcaagtccatcgaaagaagatcctgattattggtacacttggactcgtgactctgctttaacgtacaaagtgctcgttgagagattcatccacggcgacaaatctctccaacgaaagatagatgaatatgtctccgcacaagcgaaactgcaagggaccacaaatccatcgggcagcccagaatcgggcggtctcggcgagccaaagttccatgtgaatctcactgctttcactggatcttggggtcggcctcagcgcgacggccctccgcttcgggctaccgccttgactctgtatgcagaatggctcatttcccacggcgaaagatccaaggctttgaacaaagtctggccagtcatcgaaaaggaacttgcgtatactaccaagttctggaatcgcactggctatgatctatgggaggaggttaatggatcttctttctttacactttcggcttcgcatcgtgctcttgtcgaaggtgccgctctggctaagaaacttggcaaatcttgtcctgactgtgtcaccaacgctcctcgcgttctgtgcttccttcanactttctggactggtggctacgttgactccaacattaacgtcaaggatggtcgcaagggtctcgatgtcaactccatcctctcgtccattcatacattcgatcccaactccaagtgcaccgactcgacgttccagccttgttcacccagagctcttgcgaaccacaaggcggtcgtcgattctttcaggtcaatctatggtgtcaacaaaaatagaggtcaaggcaaggccgcggctgttggtcgatatagcgaggacgtgtactatgatggcaacccttggtacctggccactcttgctgctgcagaacaactctacgctgcggtctaccagtgggataagcttggcgctgttactgttgacgatgtatctttgtctttcttcaaggatatcgttcccaaggtctccaaaggcacttatgccaagaagaccaagacatacaaggagatcatcaaagcagccaagacttacgccgacggctttgtcgctgtcgtgcagacatacactcccaaggacggctcactagctgagcaatttgacaagtcaactggagcccccaagtccgctgttcacctcacctggtcctacgccgcctttgtcgccacaactgaacgtcgcgacggcatcatctctccctcctggggcgaaagcagcgccaacaaggtccccgccgtgtgtcaagctgccccagcatgtgacacaaccatcaccttcagtgtcaaaaacgtgcaagtttcatccgaccaaaaaggttacgtggttggctcagtgactganctttctaactggtcacctgatgatggcattgcgcttacgccatctagttccggagtgtggaacgtcaaaggttaagattccttctgatccagctttgagtacaagtatattaagaagactagcagtggggatgttactgggtgagtgatcccaacaacccggctattacnggt

SEQ ID NO: 20 - DNA, 887 bp, Fusarium venenatum
  misc_feature (1)...(887): n = A,T,C or G
cctaaactacaactctaccggctggttagtctacgatgaagaggccgagaaaccagatccagccactgtcgaaacactagatcctttcgatgacatgacccttgttccatatgacaagatggaaattctgggaaagcctgacaaggaggtgatcctggatgttaagatggataacttgaaggacggtaagaattacgccttcttcaacgacatcacatataccgaggccaaagtccccacgctctacacggcactcagtgcagggaaggacgccgaagaccctactgtatacggaacttatacacactctatggtcctcaagaagaacgagattgttcagcttgtggtaaataaccttgactcgggtcgtcatcctttccatcttcacggtcatgcattccagtctgtctatcgatccgaggaagagctggtatttgggccgataccaatgtcacagacaangatctgccaaaaacccccatgcgacgtgatactctagttatataccccaacggtaacattgtcatgcgtttcaaggcagataacccangtgtctggctgttccactgtcacattgagtggcacgttatctctggtcttatcgctactttcgtagaaaaccccttaccctccaagaaaccattgagatcccaagaaccaccttgatgcatgcgctgccgccgatatgcctaccaagggaaacctgctgccaacacagaagantttctcgatcttactggcgaaaaaaaacctgccaagttttgctctgntttaacttgcggttnngcctcttttactgattgnggattttcgggggctntgccatggacggtttttgccaattgattnacaggccgngccttataccggntgtnaaaacaatcgga

SEQ ID NO: 21 - DNA, 1217 bp, Fusarium venenatum
  misc_feature (1)...(1217): n = A,T,C or G
gcaccttgatcctctgcatcgcctcgtcaccgcaaaaatggccgaacaattgatcttgaagggaaccctcgagggccacaatggctgggtcactagcctggctacctccatggagaaccctaacatgctcctgtctgcttcccgagacaagaccttgatcatctggaacctcacccgcgatgagacccagtacggttaccccaagcgatctctccacggccactctcacatcgtctccgactgtgttatctcttctgacggtgcctacgctctgtctgcctcttgggacaagactctgcgtctttgggagcttgctactggtaccaccactcgacgattcgtcggccacaccaacgacgtcctctccgtcagcttctctgccgacaaccgccagatcgtttccggttctcgtgaccgaaccatcaagctctggaacaccctcggtgactgcaagtacaccatcaccgataagggccacaccgagtgggcctcttgcgttcgcttcagccccaacccccagaaccctgtcatcgtttccgctggttgggacaagcttgtcaaggtttgggagctctctacctgcaagctccagactgaccacattggtcacaccggctacatcaacaccgtcaccatctcccccgacggttntctgtgcgcctctggtggcaaggacggtaccaccatgctgtgggatcttaacgagtccaagcacctttactccctcaacgccaacgacgagatccacgctcttgtcttctcccctaaccgatactggttgtgcgctgccaccgccagcagcatcatcatcttcgacctcgagaagaagagcaaggttgatgagctcaagcccgagttccccgctgtcggcaaaaaaagccgggagcctgagtgtgtcaacttggcttggtctgctgatggccanaccctgttcgctggttacactgacaacatcatccgtgcctggggtgtcatgtcgagggcataaattgctctaccctgtaaaaaaaaggcgtggtgacgaaggcgagcggaagaaggtagatcattggtggggcgtcaattggntggcttncttcgnttggtctttattgatgcaaaggaaggggggcgattacaaatctgacgagggcataacgcatttgctggttataaggcagcccctgaaattacccgggattcatccttttgttctccaataaagaactcgagttttc

SEQ ID NO: 22 - DNA, 1654 bp, Fusarium venenatum
  misc_feature (1)...(1654): n = A,T,C or G
caagagggccccaattcttctcttttgatctgcactttttgatctttgcttgagagagatcaaccatcaacaatgacgtccaaggaggaaaaggtcgacatcggcactcacacgccgccgtcgcacgatgtcgcgcccggacaccagaaggatgtcttcactggcgacattgagggcgttcgcgaagactttcgcgaggatgactttatgacccgtaacggtctcaacctcaagtccttccagcgccgtgactacggtaccggcgtcgtccaactcgatcgctctatgaagaagcgccatctccacatgattgccattggaggttctatcggtgctggtttctttgtcggttccggtggtgccttcaccaaaggtggccctggcgcagtcctcatctgcttcttgattgctggtgtcatgatcttcaacgtttccacnctcttggtgagcttgctgttatgtaccccgtctctggtggtttctatacctactctactcgcttcatcgatccttcctggggtttcgccatgggttggaactacntcttccaatgggtcattgtcttaccactcgagttaaccgtcgcctccttcaccgtgcaatactggaatccaaacattaatgaagccgtttggatcacagtcttctggttgttcatcatcttcatcaacatctttggtacactaggttaccccangaanattctggaattcttgcttcaagctcgctgccatcatcatcttcatgattgtcgctgtcatcctcatctgcgggtggtggtccttctcgtggcaacttcgatacctaccaagggtgctaagctctggtacaaccctggcgccttccaaaacggtagccgtggtttctgcgccgtctttgtcactgctgctttctctttcgctggcactgagcttgttggtcttgctgctgccgagtctcgcaaccccgccaaggcccttcccggtgccatcaaagcaggtcttctgggcgtatcaccctcttctacatcgtcggtcttactcttgtcgggatgctcgtcagctccaccgatgaccgtctcctcaacagtgccaacccatacaaggatggtgtctctcccttcgtcttggctgctcttgatggtggtctttacggttacgacgacttcatgaacctggtcatctgtgtttctgttgtttctatcggtgtctcttgtgtctacggtggctctcgtactctcactgcccttgctgagcaggactacgcccccaagatcttcacctacattgatcgctccggtcgccctctcatgtccgtcgctttcaacctcatctggggtgctcttgcctatatcgtccttgcctcttctggtggtcttgtctttgactggcttctcgccgtctctgccctggccggtctcttcacctggggcttcatctgtgcttggcatatccgtttccgctctgcttggaagcgtcaaggccgtaccctcaaccaaattcccttccacgctgccggnggtgtctacggtcttggntgggtctcaccctntgcttcgtcattctcggntgcaactctacgtcggtgtctgcccccccttaangaggggttacngnaaccccgaagacttntttatggnttgccttgccattcccggtgtcttgtcttntggctt

SEQ ID NO: 23 - DNA, 2468 bp, Fusarium venenatum
  misc_feature (1)...(2468): n = A,T,C or G
cttcttcctttactcgcatctcttgtctcgtcttgttcgagtcaacttccttctctctctaaactatatatccacttacacattcagtcaagatggtcaaggctgttgttgctggcgcctctggtggcattggccagcccctctctctccttctcaagacttctcctcacattgacgagctcgccctgtacgatgtcgtcaacacccccggtgtcgctaccgatctctctcacatctcctcccgcgccaagaccactggctaccttcccgccaacgatggcgctaaggctgccttcaaggacgctgacattattgtcatccccgctggcattccccgcaagcctggaatgacccgtgatgatctcttcaacatcaatgctggcattgtcaagggtctcattgaggtcgctgctgaggtcgcccctaaggcttttatccttgttatttccaacccagtaaactcgactgttcccatctctgccgaggtcctcaaggccaagggtgtcttcaaccctcagcgtctctttggtgtcaccaccctcgacatcgttcgtgccgagacttttgttgctgagatcactggcaaagctaacccccaggagctgaccatccccgtcattggtggtcactctggcgagaccatcgtccccctcttcagcaaggcctcgccttcagttcagatccccgacgacaagtacgatgctctcgtgaaccgcattcagttcggtggtgacnaagttgtcaaggcgaaggatggtgctggttccgccacactgtccatggcttatgctggtttccgattcgccgagaaggttctccgtgcccgttaanggcgaaaaaggccttgttgaacccaactacnttnacctttccgnngtcccggatgtgaccacacatggataaggaaacatggctctcgcaattattaccacgtatcaaggtaacgtttaaaaagaacgcatccgggtgttcaactgtctctatgctctgtgcctcaacctcagctgtcataacttgactaaggcttgaggacgaccacgagcagggcagttgatctgagaaataccggcgaacttgatctggataataccagcgaaaggacatgcttcttgacatcccctcccccatgattccgggtgactggggaactaaccatagcagtataccacttngatctttcagaattatctgcccacacctggacaagancctttgcttaactcaccaaatctacacctttcgtataccacttgatctttcaaaatgtcgactgacaagatcactttcctcaccaactggcacgctacgccctaccacgccccgctgtacctggcccaagccaagggatacttcaaggaggagggaatcaaggttgctcttcttgagcccaatgatcctagtgatgtcactgagattattggaaccggcaaggtcgaccttggtttcaaggccatgattcacactttggctgccaaggctcgaaacttccccgtccagtccatcggcagtcttctcgacgagcccttcactggtgtcgtctaccttaaggattcgggaatcaccacggacttccgcaccctcaagggcaagcgcatcggctacgtcggcgagtttggcaagatccagatcgacgagctcacctcgcactatggcatgacccccgaggactacactgctgtacgatgtggtatgaacgtctccaaggctatcatcaagggcgagatcgacgccggtattggcctggagaatgttcaaatggttgagcttgaggagtggctcgctgcccagggccgccccaaggacgatgttcaaatgctgcgcatcgatgaacttgctgagcttggctgctgctgcttctgcaccatcctctacatcggcaatgagaccttcctgtctganaaccccnaaaaagtacgctcgttcctccgcgccgtcaaaaaggccaccgactttgtcctcgccgagcctgacaaggcatgggccgagtacgtcgacttcaagcccgtcatgggcacagagctgaaccgcaagatctttgaacgtagctttgcctacttcagcaaggatctcaagaatgttcgtcgtgactgggacaaggttaccaagtatggaaagcgtcttggtgtgcttgatgagagctttgagcccaactacaccaactcctaccttgagtggactctatctggagagtccagtgaccctactggagaccagaagcgcattgcccagttgcagaaggatgttgctgcctctggaggcttccaccgtcttgaagctgaggctccccaggccaaagcataggtgtgtatatagggcattaaaggtatacgagttggagtctagagctctgccacagtcattacgatctcggaggaaactataaggacaatcatttaattgaaattataacacaattgcaccagaaagtagcaataaaacaagtagaaattactcttcaaaaaaaaaaa

SEQ ID NO: 24 - DNA, 809 bp, Fusarium venenatum
  misc_feature (1)...(809): n = A,T,C or G
ctcatcgttagggataacctcgccaataccatactgagcaatggaatataggccccagacaccgataatggttgaaataatcaatgccaaatatccttcagtagtaaatccctttggtagtggctcaggttgtcttggtaatccttttaagtcaaaccaatcattcgaatgacctgcagcattaccaactaccggaatatcagcggctttgcatatatccagatagttctcattaagcttttccctttcctgaagtaaaacgggtgcctcaataaagaccgaagccaaaccttgttgtaagtgccaatctacatgacaatggaaataccagacaccagggttgtcagctctaaatctcaggacaacatgtccactaggttcaagaaccactgtatctctcaccatcggcctctcagggaacggttgtaatggcgcagattcgttataagggacggtcatttcatcttgctcagattcgtcataagcttcatcaacatggaaccctggcgacttttggactatttggaaattatgacccgtgcaaatggaatggatgtctgccacaatcataaatgtttaagaacaacctctatgatatcattatggttcaataactgcgcattgatattatcaccataaattctaaggatctgacgcaagcttttctganggaaagcaacgttgtcnaaagtaggcccttttggtggggacgtaaggtgattttattggaaaaaggctcctttacaccttncccaaggttgaccattttttacattcattaaaatttgggngggcataangggcaantn

SEQ ID NO: 25 - DNA, 1063 bp, Fusarium venenatum
  misc_feature (1)...(1063): n = A,T,C or G
cggagagtctctcgccgtcgacaagcaccacggtgacaactgttacgcttcttccgctgtcaagcgtggtgaggctttcgttatcgttactgccactggtgacaacaccttcgtcggccgtgccgctgctctcgtctctcagtctgctggtggcactggtcacttcactgaggttctcaacggaattggaaccattttacttgttcttgttgttgccactctcttgatcgtttgggtctcttccttctacagatctaacggcatcgttgacatcctccgtttcactcttgccattaccattgtcggtgtccctgtcggtcttcccgctgtcgtcactaccaccatggctgtcggtgccgcctacctcgccaagaaacaagccatcgtccagaagctctccgccatcgaatcccttgctggtgttgagattctctgctctgacaagaccggtactttgaccaagaaacaagctttctctcgctgagcctttctgtgttgctggtgttgagcccgatgaactgatgcttactgcttgtttggctgcttcccgcaagaagaaaggtattgatgctatcgacaaggctttcctcaaggctctcaagttctacccccgcgccaagggtgttctgtccaagtacaaggttcttgacttccaccccttcgacccgtctccaagaangtccaggctgttgtcgagtcccccagggcgagcgtatcatctgtgtcaagggtgccccacttttcgtgttgaagaacgttgaagaagaccacccaatccctgaggaagttgactctgcctacaagaactgtgtcgcggaattcgcaactcgtggcttccgatctcttggtgttgctcgcaagccaagtgaaggtgcttggganattctcggaatcatgccttgctctgaccctnctcgccacgacactgccgcactatcaacgaggccaagcgccttggtctcttcatcaaaatgcttactggtgacnccgcggtattgccgtgaaacttntngtcagctcggtctnggtaccaacgtctacaacgctganccctcggtcttgg

SEQ ID NO: 26 - DNA, 1155 bp, Fusarium venenatum
ttacgatttcgttgaggctgccgatggtttcgctgaggtcttcccccagcacaagtacaacgtcgtcgaagaattctccagcagcgtggttaccttgttggctatgaactggtgaatggtgtcaacgaatgctccctctctgaaagaaaggctgaataccggcattgctgtcgagggtgcctccgatgccgcccgatctgcctccgatatcgtcttccttgctcctggcttaggggcgataattgacgccctaaaaactagtcgccagatcttccatcgaatgtacgcctacgttgtctaccgtatcgctctctctctgcacatggagattttccttggtctctggatcgccatcctcaaccgatctctcaacattgagctcgttgtcttcattgccatcttcgccgatattgccaccctcgctatcgcctacgacaacgctcccttctcccagactcctgtcaagtggaacctccctaagctctggggtatgtctgttcttctcggtgttgtcctggctgttggtacctggatcgctcttaccaccatgtacgccaactctgaggatggtggtatcgtccagaacttcggtaagatcgacgaggttctcttcctcgagatctctcttactgagaactggctgatcttcatcacccgtgccaacggtcccttctggtcttccattccctcttggcagctttccggcgccatcctggtcgtcgatatcctcgccaccctcttctgtatcttcggttggttcgttggtggccagaccaacattgtcgctgttgtccgtatctggatcttctctttcggtgtcttctgtgtcatgggtggtctgtactacttcatgcagggcagcactggcttcgacaacctcatgcacggaaagtctcccaagcagaaccagaagcagcgatccctcgaggatttcgttgtctctcttcagcgtgtctctacccagcacgagaagtctcagtaaacagatggtatatacccggaccaccatcgaccggactttcactttcgctacgtccaaatttgacctgtaatactcacacccgagtactgagactcctggagtagttgaggaatctttcatacccctagatcgtctattagacacttaataatacaaagtaaaataatattttg

SEQ ID NO: 27 - DNA, 1322 bp, Fusarium venenatum
  misc_feature (1)...(1322): n = A,T,C or G
ctccattctctcttccttctttcatcctcaatctcccctcaatcctttcgtcttgttcaagggaaagaccatcacagccgctaccatgtctcctcctgctgatcaaggaccccagacggtcttgggcatgcccccattcgtcgctgacttcctcatgggtggtgtctccgccgctgtctctaagactgctgctgcccccatcgagcgtgtcaagctcctcatccagaaccaggatgagatgctcaagactggtcgtctcgaccgcaagtacaacggcattggtgactgcttcaagcgcaccatggccgatgagggtgtcatgtccctctggcgaggaaacaccgccaacgtcatccgatacttccctacccaggccctgaacttcgctttccgtgacaagttcaagaagatgttcggctacaagaaggacaaggatggctacgccatgtggatggtcggtaaccttgcctccggtggtgctgctggtgccacctctcttctcttcgtctactctcttgactacgcccgtactcgtcttgccaacgatgccaagaacgccaagtccggtggtgaccgtcagttcaacggtctcgtcgacgtttacaagaaaaccctcgcctctgacggtattgccggtctctaccgtggtttcatgccctccgttgctggtatcgttgtctaccgtggtctctacttcggaatgtacgactccatcaagcccgtcgtcctcaccggtaacctccagggcaacttccttgcctctttcgctcttggttgggtcgtcaccactggtgccggtatcgcctcttaccctcttgacaccatccgccgacgtatgatgatgacctccggtgaggctgtcaagtacaagaacaccatggacgctgcccgccagattgtcgccaaggagggtgtcaagtctctcttcaagggtgctggtgccaacattctccgtggtgttgccggtgctggtgtcctctccatctacgatcagctccaggtcctcctcttcggcaaggccttcaaataagcgattcgttcaacataccctgtatagatgagtgtgggggataaggattcgaggagaatcttaattggcggacctggcatggtgtccgctggttgaaacaaaaaggcgagatcgaagtgcagatcgagggaagttgtcacagatacccgacgtggtctgaaacagcagctntttacgggttagaagtggcataggcacggcgtctttttctaatcttgctttgccttccgttctangccgctgtaatttatacaccaatgcaaattccctttactggctaataaaaaaaaaa

SEQ ID NO: 28 - DNA, 1142 bp, Fusarium venenatum
  misc_feature (1)...(1142): n = A,T,C or G
gtcagaagcgatccaccgtcgcccagttcgtcaagaccctcgaggagaacgacgccatgaagtactccatcgtcgtcgctgccactgcctccgaggctgctcctctccagtaccttgcccctttcaccggtgcctccatcggcgagtggttccgcgacaatggcaagcactctctcgtcatcttcgacgatctttccaagcaagctgtcgcttaccgacaaatgtctctgcttctccgtcgtccccccggacgtgaggcttaccccggtgacgttttctacctccactctcgtctccttgagcgtgctgccaagatgaacgacaagctcggtggtggttctatgaccgctttacccgtgattgagacacagggcggtgacgtttccgcttacattcctaccaacgttatttccatcactgatggtcagatcttcttggaggctgagctgttctacaagggtatccgacctgccatcaacgtcggtctttccgtctctcgtgtcggttccgctgcccagcttaaggccatgaagcaggttgctggttccctgaagcttttcttggcccagtaccgtgaggttgctgctttcgcccagttcggttccgatttggatgctgctaccaagcagaccctcaaccgtggtgagcgtcttaccgagctcctcaagcagaagcagtacagccccatggctgttactgagatggttcctctcatcttcgctggtgttaacggtttcctcgacaccatccccgttaacaagattcttcagtgggagtccgacttccttgcccacctcaagacaacgagaccganctccttgccaccattgacaaggaaggcgccatctccaaggacactgaggctaanctcaaggacgtcgtccagtccttcgtcaaaacttcctcggttaaatgtaatcaaaagcaacttgtgcggagaatagcgggggcctttggggatgtcgctgtctatatcgaatatctattgtcgtttttctctcttgaggcggagggaacatgtcgaggggtcgcgcctggatggagcgacgggaatgagttgagggagattcgcccgtcgtattgccacttgtaaaatagaagcacaaaactcaatgaatgccctcgattccttttgttcttga

SEQ ID NO: 29 - DNA, 2298 bp, Fusarium venenatum
  misc_feature (1)...(2298): n = A,T,C or G
gtcttcaaataccacgatcttccttgaagcaaaccgcgttttctttttcttttctcttccctaatctctctcatacactctacataaaccatacacatcacacaaaatgggtcccgctgtcggtatcgatttgggtaccacgtactcttgcgtgggtatcttccgtgaggatcgatgtgatatcatcgccaacgaccagggtaaccgaactaccccctcattcgtcggtttcaccgacaccgagcgtctgattggtgatgccgccaaaaaccaggtcgccatgaacccccagaacaccgtcttcgacgccaagcgattgatcggtcgcaagttccccgatgctgaggtcaagnccgacatgaagcacttncctttcaaatnatcgacaangncggcaagcccctnatcgaggtngagttcaacggtgagaacaagcaccttcactgccctgaagagatctccgccatgatcctcaccaagatgaagtgagaccgccgagaccaacctcggcaagaaggtcaacaacgcagtcatcaccgtccctgcctacttcaacgactaactcagcgccaagccaccaaggacgccggtctccatcgccggcctcaacgtcctccgaatcatcaacgagcctaccgctgctgccattgcctacggtctcgatgcaagtaaggtctgagaagcgagcgcaacgtcctcatctacgatctcggtggtggtacattcgatgtctccctcctcaacatccaggagtggtatcttcgactgtcaaggccaccgccggagacactcatcttggctggccaaagatttcgacaaccaacctcctcaaccactgcgttaacgaaagattcaaagccgaaaagaacaaaaaagactctctggcaccaacgcccgtgctctccgacgtctccgaaaccgcctgtgagcgtgccaaagcgaacttctttccaaccggtcgctcagaccttcattgagatcgacttttttttcgaggggatcgacttctacacctccatcacccgtgctcggttcgaggagcttctgccaggaatctctttccgatccactattcaacccgtcgaccggggtncttactggacgccaaaaatcgacaagtcccttgtccacgagatcgtcctcgtcggtggatctacccgtatcccccgtgtccagaagctcatcaccgactacttcaacgggaaaggagcccaacaagtccatcaaccccgatgaggctgttgcctacggtgccgctgtccaggctgctattctctctggtgacacctctagcaaggccaccaacgagattcttcttctcgacgttgcccctctctctctcggtattgagaccgctggtggtatgatgaccaagctcatcccccgcaacaccaccattcccaccaagaagtccgaagtcttctctaccttctccaacaaccagcctggtgtccttatccaggtctacgaaggtgagcgtcagcgcactaaggacaacaacctcatgggcaagttcgagctcactggtatcccccctgctccccgtggtgttccccagattgaagtcaccttcgatcttgatgccaacggtatcatgaacgtctccgccgttgagaagggcaccggcaagtncaacaagaattgtcatcaccnacgacaagggcccgccttgtctaaggaggagattgagcgcatgctcaacgatgccgagaagtacaaggaggaagatgaaggccgagggcaagcgtgtcgctgccaanaacggtcttgagtcttacgcctactctctccgcaacactctctctgaccccaaggtcgaggagaagattgaggcttccgacaaggagaccctcactgctgagattgataaggtcgtccagtggctcgatgacaaccagcaggctactcgtgaggagtacgaggagcaccagaaggagctcgagggcaaggccaaccccatcatgatgaagttctacggagctggtggtgagggtgctcctggtggcatgcccggtggtcctggtggcttccctggtgctggtggccccgctcccggcgctggtggtgacgatggtcccaccgtcgaggaggtcgactaaattctttgataccccaataacatcagtctcgacttctagagcagtcatgtatccatgggtacaatgcggaggctagtcgttttaatgggatgatgagattaaattttcctttttctgtttttatgcgacttttacggttatgaaaagctaagggggtttacctctcatgtnctttaatgaatcaatgaatcatnttcat

SEQ ID NO: 30 - DNA, 994 bp, Fusarium venenatum
  misc_feature (1)...(994): n = A,T,C or G
cttgagacctttgtccaacttttcttcaagcacagctctggcacttcctggtacacgccgcacgcgcctgtctcgatccaggatgagcccgagtaccctcatcgaggcattcttctcgatgttgcccgtagcttttttgaagtcaagcacatcaagcgcacaatcgacgccatgtcgtggagcaagctgaatcgccttcaccttcacatcactgactcgcagtcctggcctctcgagatcccagccctacccaaactggccgaaaagggtgcataccgcaaaggcctgacctactctcctgaggatcttgccggtatttatgagtatggtatccaccgcggagtcgaggtcatcatggagattgacatgcccggccatatcggtgtcgttgagcttgcctataaggatctcattgtcgcgtacaatgagaagccttatcaatggtggtgtaaggagccaccctgtggtgcgttccgcatgaacagctctgatgtttatgactttctcgacactctttttgatgacctcttccctcgcatttccaagtacagtccttacttccaccttggtggagacgagctcaaccacaacgattccagacttgaccctgatgtgcgctctaacgaaaccgaagttctggcgcctcttttgcaaaagttcgtcgattacactcacggcaaggttcgagatgccggcatgactccgttcgtctgggaggagatgattaccgaatggaacatgactctgggtaaagacgttgtgattcantcctggctcggtggcggtgctatcaaaacctggctgaggctggtcacaaggnaatcgatagtgattacnacttctggtaccttgactgggggccgtggacagnggntaactttgacaaccggcgatcctttcaaacatactacccctttaacgactggngcggnctaccaaaactggngggttatttactccacgaatcttgggccggctatccaggaacaaccaa

SEQ ID NO: 31 - DNA, 1124 bp, Fusarium venenatum
  misc_feature (1)...(1124): n = A,T,C or G
ggccaatacatcaccggcgaagattactgaggagcagcgattcgatattatccgaaatgcctgccctggtggtggtgcttgtggtggcatgtacactgccaacaccatggctactgccattgagactttgggacttacccttcctggtagcagcagcagccctgctgaggaccccagtaaggtcgccgagtgtgaggctgttggacctgctatccgcaacattctcaaggaggatatccgacctcgtgacatcatgactcgtcaagcctttgagaatgccatgatcgtcaccaccatccttggtggcagcaccaacgctgtcctgcaccttatcgccattgctgactctgtcggtatcaaactcgacattgaggacttccaaaaggtttccgaccgcactcctttccttgccgacctgaagccctccggaaagtgggtcatggccgatatgcacaagattggtggtactcctgctcttctcaagttcctcctgaangaaggcattattgacgctctggtattactgtcctggtaaaaccatgaagcagaacgtcgaggacttgcctggattccccgaggaccaaaccattattcgccccctgagcaaccctatcaagcctaccggccacatccagattcttcgcgggtcgctggcccctggtggctgtgttggtaagattactggcaaggagggtctccgattcgagggtaaggctcgtgtctacgactccgancccgccttcatctctagccttgaggctggtgagatcaagaagggtgagaagactgtcgtcatcatccgatacgacggacccaagggtggtcctggcatgcctgagatgctgaagccttcttctgccatcatgggtgctggtcttggtcaggatgtcgcccttctcactgacggtcgcttctctggtggttcccacggtttcattattggccacattgtccctgaagccatggaaggtggtcctattgcccttgtcgaagacggtgatagcatcgtcatcgatgccgagtctcgtgctatcgaccttgttgttcccnaaggaagaagtcctccccgccgcaaggcttggaaagcccctcctccccggtacaccaagggttactctcagcaa

SEQ ID NO: 32 - DNA, 935 bp, Fusarium venenatum
  misc_feature (1)...(935): n = A,T,C or G
gaatngcccgaaaattgtttattgggagatgccgcgccatcatttntggtctgcgttactacactcgaactattatacaacattatgccttctgcatcgagcgcatatgccaccgggcggttcatcacgcttacctgacccctcgccttacccttctcgcaatatcgcttttcaagcagcggctatgataacctccatcgtcnagaacctcgctgcacatgatcagctacggtattgncccgcctttgttgtatacagtctattctcagccctcattatgcatgtctatcaaatgaagtcaccagtaccctcgattcagcaggtaacccaagacaggttgcgtagctgcatgtcagctatgaaggaaatctcacgggtttggcttgtcgggaagatggtttacgccctctttgaatccatcatgggaaacaaggtactggaagagcgacttcaaagggctgaaggcaagcgacaccgaaatttgcgccaaacactttctcaattggaacaacagcaaaatcgacaggccgaggcaaccaagcggaagtatgatgacatggccatcgactttagtaccaatacgccttagccttaggagtcttacgagagatcacggcctcaaacgcctagtgctgcaagacggagccaacaagctcgatgcagcctccgccggtgacgtcttcaaacgcaagacagagtacagccgcacttcatgggaggnacgaactcacgtncacaaactcgaccaggaacgccttttaatncatctttttttntccgccacaccttctgactattttggtacaaggactcttcgaccttcacaatcttttgggaaacttccagcagacaattattcttgttaggntggtttgcagcttccgaactnngccacgcaaacactcatttgacacacacatggttcantccccggt

SEQ ID NO: 33 - DNA, 937 bp, Fusarium venenatum
  misc_feature (1)...(937): n = A,T,C or G
ttcgtcgtgaagtgctgttcttcatttccccaataaccacaatcaaaaacgaaactatggctgaaagcgcaggaggaatcgatcgcaaggccgatgagaggatggagttttccacctccaaggaggttacggtccatcctactttcgagtccatgtcactgaaggagaacctccttcgcggcatctacgcttacggatacgagtctccttctgctgttcaatctcgtgccatcgtccaggtctgcaagggccgtgacaccatcgcccaggctcaatccggtacaggaaagaccgctaccttttccatcagtatgctgcaggtcatcgacaccgcggtgcgcgagacacaggccctagttttgtcacccacacgagaattggcgactcagatccagtccgtcgtaatggcgctgggtgactacatgaacgtccaatgccacgcttgtatcggaggtacaaacgttggtgaagatatccgcaagctcgactacggccagcacattgtctctggcactccagggcgtgtggcagacatgattcgacgacnacacttgcgcactaggcatatcaagatgctggttctcgatgaagctgacgagctcctcaacaagggattccgtgagcagatctacgatgtctaccggtacctccctcctgccacacaagtcgtggtcgtcagtgccaccctgccttacgatgtcctcgacatgacgaccaagttcatgaccgatcctgttcgcattctcgtccagcgtgacgaattgaccctcgaaggtctcaagcagtacttcatcgccgtcgagaaggaggactggaagtttgataccctatgcgatctctacgacaccctcactatcacgcaagccgtcatcttctgcaacacacgccgcaaggttgactggctcaccgacaagatgcccaaaccaactttaccgtc

SEQ ID NO: 34 - DNA, 976 bp, Fusarium venenatum
  misc_feature (1)...(976): n = A,T,C or G
cgatacccctactggcagccagcctttcgcccacggtgttgatgttcgatccaacttccttttcaactctcagatctggggaattgaggaggccgacgctatcctgattgttggcagcaaccctcggcacgaggctgccgttctcaacgcccgtatccgaaagcagtggctccgatctgacctcgagattggtcttgttggtgagacatttgactccacctttgagttcgagcactttggtgccgatcacgctgctctcaagactgctctctctggtcccttcggcgagaccctgaagaacgccaaacgacctatgatcattgtcggctctggtgtcactgaccacgctgatgccaaggcttactacgagaccattggtgccttcgtcgacaagcacgcctctaacttccgaactgaggagtggcaaggttacaacgtccttcagcgtgaggcttctcgtgctggtgctttcgaggttggcttcactactccttctgctgaggtgcccaaaccaagcccaagttcgtctggcttcttggtgccgacgatgtcaacgaggccgatatccccaaggatgctttcgttgtttaccaaggtcaccatggtgacaanggtgcccanatcgctgatatcgtcctccctggtgctgcttacactgaaaagggcggtacttacatcaacactgagggtcgtgttcaaatgactcgagctgccacttctctgcctggtgcctcgcgaactgactggaanatcctccgagctgccagtgaattcttggggctccctttccttacaatgacgtcccatggtccgagaccgcatggtcgaaataaccctnctntggccgcctacaagtttgttgaacccgtcnccttccttgtttgancaaggttaacttgtaaacaaaacaagggtgccaangnttccgganctcccctaaaaaagttatcncaacntttactttacaaattgtttt

SEQ ID NO: 35 - DNA, 918 bp, Fusarium venenatum
  misc_feature (1)...(918): n = A,T,C or G
ccactgtagagtggtctcaagagcgatataccgagtgcacatccaaactcgcacagtttcttaagggtactggttacaacctcaagaacgacgtttacttcttgccaattgctgctcagcaaatgaagggcatcaagacccgtatccccaaggaagacgctccctggtgggagggtccctcgctgctcgagtacctcgacagcatgaangcgcttgagcgtaaggtcaatgctcctttcatgttgcccgtcaatggcaagtaccgtgatcttggtacaatggtagagggaaagattgaagccggtgttgttaagaaaggcatgaacatgatcatgatgcccaacaagcaaagtgttgaagctgccgccgtctacggcgagcaggaagatgaaattcaactggctcaatgtggtgaccaagtgcgaattagactcaagggtatcgaggaagacgatatcctgcccggattcgtgctgtgctcaccaaaccaacttgtgcacactgtcaccgaattcgaggcgcaaattcccattttgaagcttaagaatatcttgaccgctggctccaactgtgttcttcacgtccactccgccattgaggaagtgacattcgctagccttctacacaagctacaaaagggaaccaaccgcaagagcaagaacccacctacacacgccaagaagggcgacagcattatcggccgcatgcaggtgattggcggacangcgctgtgtgcgtggagaagttcgaggactacccccagatgggtcgcttcacattgagagaccaggacaaaccatcgctattggcaagatcacaaggntcatctntgacgaacttaaatgaattatgaatgggtctttgaatcacctaggacacgaattattgtgacgnccaaaaggatagtgggcattggca

SEQ ID NO: 36 - DNA, 1316 bp, Fusarium venenatum
  misc_feature (1)...(1316): n = A,T,C or G
aaacacaacaactacttctttcttcaccaaaagaacctccttaacaaaatggctcccatcaaggtcggcatcaacggtttcggtcgtatcggccgtatcgtcttccgcaacgccgtcgagcaccccgacatcgaggttgttgctgtcaacgaccctttcattgagcctcactacgccgtctacatgctcaagtacgactcttcccacggtctcttcaagggtgaggtcggcaaccagggcaacgacctcgtcgtcaacggcaagactgtcaagttctactctgagcgtgaccccgccaacatcaagtggtccgagaccggcgccgactacgtcgttgagtccaccggtgtcttcaccaccattgacaaggccaaggcccatcttcagggcggtgccaanaaggtcatcatttctgcccctccgccgacgctcccatgtacgtcgtcggtgtcaacganaacaagtacgacggntctgccgacatcatctccaacgctttttgcaccaccaactgcctggcttctttcgccaaggtcatcaacgacaagttcggtatcgttgagggtcttatgaccaccgtccactcctacactgccacccaaaaaaaccgtcgatggtccctccgccaaggactggcgaggtggccgtggtgctgcccaaaaacatcatcccctccagcaccggtgccgccaaggctgtcggcaaggtcatccctgagctcaacggcaagcttaccggcatgtctatgcgtgtccctaccgccaacgtctccgttgtcgatctgactgtccgccttgagaagggtgcttcttacgaccagatcaagcaggtcatcaaggaggcctctgagggtgacctcaagggtgtcctggcctacactgaggacgacgttgtctcctctgaccttaacggcaacaccaactcctccatcttcgatgccaaggccggtatctccctcaacgacaacttcgtcaagctggtctcctggtacgacaacgagtggggttactcccgccgtgtcctcgacctcctggcccacgttgccaaggtcgatgcctccaagtaagcgcagagcgctcaaggggctggaagcaaaaccaaacctaattagacgcgacatgataaagattccagtcggtcgtgtgttttaatgaagcaaagaaatgaaagcaaataaaaataccaaaatccggggagattgtcggaggggatgacaacgaggttgttatcatcggctcgagttccctactagacaattgatcttagtatagccgtggacagaaaaaatatagatccatccctcttgaaaaaaaaaa

SEQ ID NO: 37 - DNA, 1189 bp, Fusarium venenatum
  misc_feature (1)...(1189): n = A,T,C or G
cttcatcaacacctcaacctccatctcgaccgccaccttcgtcgacctcctcccccggttcgacatcgcattccatacggccacagtcgccgaatttatctatctcacctaataatcaatccgataacgcgccagtttcgccgcccaatatggctcctaagaaggctgccaacaacagcagcaagtccaacgaggacgatggatacacagctggtaaaatctactccatctccggtcctgtcgtcattgctgaggacatgattggtgttgccatgtacgagttggtcagagtaggacacgacaacctcgttggtgaggttatccgaatcaatggcgaccaggcctctatccaggtttacgaggagacatccggcgtcatggttggtgaccccgtctaccgaaccggaaagcccttgtccgtcgagcttggtcccggtctgctcaacggtatctacgacggtatccagcgtcccctcgaggctatttccaagatggccaagtccatttacattccccgcggtatcgccgttcctgccctcgaccgcgaaaagaagtgggagttcacacccttcgtcaaggtcggcgaccacctctctggtggtgatgtttggggttccgtctttgagaactctttccttgccaaccacaagattctgttccctcctcgcgcccgaagaaaccgttaccaatatcgcctcccagggcgagtacaccgttgtcgacaacatcctcgaggtcgagttcgatggcnagaagaccgagtaccccatgatgcagtcctggcctgttcgagtgccccgtccttccaacgataagaatctgccgatcagcccttcattgtcggccagcgagtcctcgacgcccttttccccagtgttcanggtggtaccgtcgccntccccggtgctttcggttgtggaaagactgtcattagtcagtctgtgtccaagttctccaacagtgacgttnttgtctaccttggttgtggtgagcgaagtaaccanatggctgaagtcttgaaagatttccccnancttaccatttaagtcgacngccgccaggagcccntcctgaacgaaccacacttattggcnacacttccnacatgcccgtcgctgcccnaaaaacttccatttacncnggaaattacgggggctgaatatttccgcnatcagggtctcacgtcccc

SEQ ID NO: 38 - DNA, 1105 bp, Fusarium venenatum
  misc_feature (1)...(1105): n = A,T,C or G
ctggaaggacatcgtcaccttcgatggtcgtgctgaccaccctgccaagtctcaggactcgatcgagaagatcatggccaacatgcaaaacacaagcaaggccaaggaatcctctggtgaacctgattacaagaaggtcattgctgaaactgtcaagcaggagggcaagcctactgagtacaaatttgaggagcgagatgttatcctctataaccttggtgttggtgctaagcgcaccgaccttaagtatacctttgagggctctgaagacttccaggttcttcccactttcggagtcatccctcctttcaacgccgagatgcctttcaactttgacgacattgtgcccaacttctctcccatgatgttgcttcatggagaacagtatctcgagatccgcaagttccctatccccaccaacgctcgtcttgttagccgaggtcgcctcctcgaggtcgttgacaagggtaatgcttctgttgcccgaagctccaccactactgttgacgccaacactggtgaggatgtcttctacaacgagtccagcgtcttcctccgcggtacaggtggctggggcggtcccaagcgtggtgccgaccgcggtgccgccactgctgccaacaagccncctgctngcgctcccgatgtcntcgtcgagtcccccacacacgatgaccaggctgntatctaccgcctgagcggcgactataaccctctcacatcgatcccgagttngccaaggttggtggcttcaaggcccccattctcacggcctctgcagcttnggtgttgccggaaaggccgtctacgagcgcttcggtgctttcaagaacattaaagtccgcttcgctggtgttgttatccccggccagaccattgtcactgagatgtggggtgagggcaacagaattatctttcagtccaaggtcaaggaaactggcaagcccgttattgccggtgctggccgttgacctaaggaccgaccggtaagagcaagcttntaaacaaacattggttcttcacnggagtttgnaagggaatttggggaaantcaaaatgnccngggggtttggacctttcaatctganagttaaattgttgctgg

SEQ ID NO: 39 - DNA, 977 bp, Fusarium venenatum
  misc_feature (1)...(977): n = A,T,C or G
nattttttntccttaaatatcctcatcttttcaaattgnttggtccaaagtggacggttttttacaattnaaaaagcgcttccaagctttttggtaagtcgaagnagggcttcttttttgcttttccccnactgggttaaggctgntacccaaaaagttcgaatttcaaaatngctnggtcaaaactaatcctgacaatgctttcgaaccccaagtatttggaatnatgggcaatggccatttctacatcgaggtggatattggcgaccgggtatcatcgatggcatacaatctaagaaaacaatctactttcttacactttntgggctctacatgaatggnaacacccacatggatggncctgctggnggtaagcaatgncccaatgggtcctggaactaagttttacatacaacttcactggtgatcaagcccggcacaaactgggtatcacaagtcacactgcagcacaatatccagacggtctacgcgggccctttatcgttcacgataaagacttcccgtatcaaaagaaatacgatgaagaggttatcctcacactttctgattggtatcatgatgaaatgcggtcgctcataccacaattcatggccaagtcaaatccttcaggcgccgagcctgtgcctaagaacgccctcatgaatgaaaccacaaacttcacaatgcctgttcaacccgaaaagacatacctgttccgggtgatcaatgtcggtgcttttgcaggtcaatatctctggtttgaagggcacaaaatgcgaatcgtcgaggttgatggcatttacaccgaggaagctgaggcagaaatgatctacatctcggctgcacaacgagtcagttttcttttaactaccaagaacgacacttctaaaaacttcctattgttgctagcatggacactgtgagtaaactccctcaaaatgatcacagggaaagtaccacaacatcttagactcttt

SEQ ID NO: 40 - DNA, 1299 bp, Fusarium venenatum
  misc_feature (1)...(1299): n = A,T,C or G
ctcctcgccgcctgcatcgtctacggaaccgagaacatgaactccatgaagtcttaccagatccccatcggtatccagttcccctgggctgtcatcctcgctgtcggtcttttcttcctccctgactctccccgatactttgtcaaagcgcggtcaaatcgaaaaggctgtcgacgctctcgcccgtgtccgtggtcagcccaaggactccaagtacgtccagtctgagattgccgagattgtcgccaacgaggagtacgagcgccaaatcattccctccacctcttggttcggctcttgggccaactgcttcaagggttctctctgggatggcaagtctaaccttcgccgaactatcctcggtacttctatgcagatgatgcagcagtggactggtgtcaacttcatcttctactactctactcccttcctcaagtccaccggtgccattgacaacgtcttcctcatctctctcgtcttcacactcgtcaacgtctgctctactcctctgtctttctggactgttgagcgattcggtcgccgatccatcctcctcatcggtgctcttggtatgcttatctgccagttcctcgtcgctatcattggtgttaccgtcggttttaaccacacccacgcttcccccactgaggccgaccccgaccgcatgatcgccaacaacatcagcgctgtcaacgcccagattgctttcattgccatcttcatcttctggttcgcctccacctggggccctggtgcctggatcgtcatcggcgagatcttccccatccccatccgatctcgtggtgtcggtctctccaccgcctccaactggctctggaacaccatcattgctgtcatcaccccctacatggttggtgagaaccgaagcaacctcaagtcctccgtcttcttcatctggggtggtctctgcacctgcgctttcgtctacacttacttcctcgttcccgaaaacaagggtctgtctctcgagcaggttgataagatgatggaagagacactcccgaanctctgccaagtggagacctcatcagaactttgcccagaccatgggtgctggtgatgttaagatcgtccccaagaccgagcatgacgaccacgtctaancttgtctgcacacaagtcttgttatttgtttgatgtggaggaaagttttctattttaattatacctgaatgttttggaggtcatggtgttatgatctaagatgatgagaacgcggaagtatattgaaaaataatgtgtatatatctcaaacagaangaaaccaacatnttttct

SEQ ID NO: 41 - DNA, 3203 bp, Fusarium venenatum
  misc_feature (1)...(3203): n = A,T,C or G
tacagcccatcatgtacttcgtttcttccgctttcctcctcggctcatttgctctacagagcgtcttgggccgaccagccctacaagaaaaggcaatcttctctcgaatccttcatcaattccgagagttcgattgctatcgagcaactcctgtgcaacattggttctgatggctgtcactctcagggtgttgcttccggtgttgttattgcgtctccagataccgaggaccctgactactttttcacttggactagggatgctgctcttgtctttaaatatgttatagataggttcatcaaccagtacgacgctggcctgcagaaaaagatccaacaatacattgcatctcaagccaagcttcagggagtttctaacccttcaggatccctctcagacggttcaggtttaggagaagccaagtacgaggttgatcttagcccctttactggtggttggggtcgacctcagcgagacggtccagctctccgagctactgccatcatcacgtatgctaactggctgattgataacggatacacttctaccgcctctgacattgtttggcctgttgttcgcaacgatcttaactatgtagctcaatactggaaccaaaccggctttgacttatgggaagaggtcaggggaagttcgttcttcacaaccgcttctcagtaccgagctctcattgaaggcgccgctctggccaaaaagctcggaaaatcaggagacacttacaccactatcgcacctcaggctctttgcttcttgcagacttactggattccctctggcaaatatgttgattccaacatcaatgtcaacgatggacgtactggaaaggacgccaacagtattctcacatccatccacaacttcgaccctgccctgagctgcgatgccgctactttccaaccatgcagcgataaggccctcgccaaccataaagcagttaccgattctttccgctcatggaacatcaacaagggaatctcccagggaagcgcgtatctgttggaagatacatcgaagattttattacaacggtaacccttggtaccttgctacgctcgctgcggctgaacagctctacaatgcgctttactctggaagcaaaanggatccatcactgtcacacttttctcttttctttctcatccaagatcnttgctctgagatactctgcctcgtcacttgtgcacgactatctaccccttactagcatcatactataatcaccatccacaagtccacatcaaaactctacaatgtctgcgcgaatcccagccattgctgccaaccgcgttagcgatgctgccaagaagcagcttgacctcgtcgccaagttcgttgaggaagaatgcattcctgccgaccctgtagtagaagcccttgctggcgagggtgatgcccgctgggaaggccacccatctatcattgaggacttgaaggaaaaggcccgcaagcttggtctctggaacatgttcctccccaagggtcactacaaggagtcgcctggctggactaaccttgaatacggcctcatggccgagtggcttggtcgctcacacgtcgcatctgaggcttgtaactgtgccgcccctgacacgggtaacatggaggtattggccaagtacggcaatgacncccanaaggcgccgtggttgaaacctcttatggacggcaaaatccgctcagctttcctcatgacagagccccaggtcgcttcctcagatgccaccaatattgagctaagcattcgtcgcgagggcaacgagtatgttctcaatggccagaagtggtggtccagcggcgctggtgacccacgatgcaagatctacatcgttatgggcaagacagatcccgacaacaaggatccttacagtcaacagtccgttgtcttggtgcctgctgagacacccggtattactatcaaccgtatgctcaaggtctacggtttcgatgatgcgcctcacggtcacggacatctgacattcaacaacgtgagagtgcctgcctctaacattgtgctcggagagggacgtggatttgagattattcagggtcgtctaggacctggccgtattcaccatgctatgcgcagcattggtgccgctgagncgctcttgactggatgctcctccgagtcaacgattactttccaagaatgccattctggcaaatcctccgcgagcacggtcgttattcttgcatggatgctgccaagtccgcgtcgagtatcgccgctgctcgtctcattgatcttcaccgccagcaagcccttgattggccaaggaggacagttttccaaacccaccctagcttccctttctctcgagggcaagacaattgtcataaccgggggtgcaagaggcctcgggctagtcatgggacagggtgtggtctactcaggtgctgatctagcgatcgtcgatttaaacaaggacgaagcccagtctcaagtaggccaattgacagatgctttcaagaaagagaacccaaacagcgagacaatcccgagagtcactgctcactatgcagacgtctctgaccctgactctgtaacaaactgtatcgccgagatcctcaacattcatcataagatcgatggtctagtcacgtcggctggcttcacggagaatttcgaggcaatcaactatcccatcgatcgtatgcgcaagttgtggggtgttaatgttgacggtacttacctctttgcagttgcagttgccaaacatctcatggaacgccaggtacctggtagtatcgtggttattggaagcatgtctggtgctattgtcaatgttccacagccacaggcaccatataacgcggccaaggcagctgttcgtcacctggctgcttccctcgcagtagagtgggctcacgctggaatccgagtcaactgtatctctcctggctacatgttgactgctctaacgcagaagattctgaacgataacccagatatcgagaggacctggacatctcttattcctcagggacgtatgggactacctcaagatctgatgggtcctgtgacctttttgttgcagatgcgtcttcttacatgactggggcagatcttagagtagatggaggatatactgtgacctanttgcaagaaatgatgttctctatgattacttgccggcagaagatagacaatataattatagtgttnggtccctctgaaaaaagaa

SEQ ID NO: 42 - DNA, 859 bp, Fusarium venenatum
  misc_feature (1)...(859): n = A,T,C or G
ggcttagcactgattccaaccaagttcggtatctctttcacggctttgtttctgaaccaggccggagcattggtacacatctatcacgatggttcagttctagtagctcatggtggtacagagatgggacaaggcttgtacactaagctcactcaaattgctgcacaagcattgggtgtaccactggacaacgtcttcatctcagaaacttcgacgaatacggtggccaacgcatctgcaacggctgcgtcggcttcttcagacctgaacggatatgccatcttcaatgcatgcgaaatgttgaacgagcgattggcgccgtacccgaaagaagctttggccctgaggcgacgatgaaagaacctcgccaacgccgnttactttgaccgcgttaacctttcagcgcaaggtttctacaagacccctgaaattggatatgactggaccactggcaagggcaagatgttcttctacttcactcaaggagttgcggcagctgaggttgaggtcgatttactaactggaacctggacatgcattcgggcagacatcaaaatggacgttggccagtccataaatcctgcaatcgactacggccagatccagggtgcttttgtccaaggtctcggtctctttacgatggaagaatcactctggttgcggaacggcccaatggcaggtcatntnttcacgcggggacctggagcatacaaaatccctggcttncgagatattccccaaacgttcaatgtgtccttntcaangaccgtggagtggaaggaactacccncgattnaaaaaagtcgtggggtangcnaaccgccgttntttatgggcaagntttgtntttttcnccatc

SEQ ID NO: 43 - DNA, 957 bp, Fusarium venenatum
  misc_feature (1)...(957): n = A,T,C or G
caccgataccaccgagatgaagacaaagattgttgaggagaccaagaaggaagagcctaagaccgctcctgcccccggcattaaggctgaggaagccgacgagcccctccttcaagaaaaccctcagagatttgttctcttccccatcaagtaccatgagatttggcaaatgtacaagaaggcagaggcctccttctggacagccgaggagattgatctttccaaggatctccacgactggaacaaccgtctgactacagatgagcagttcttcatctcccacattcttgctttcttcgctgcctccgatggtatcgtcaacgagaaccttgttgagcgattcagcggcgaggtccagatccccgaggctcgatgcttctacggtttccagatcatgatggagaacatccactccgagacatactccctgctcattgacacctacatcaaggagcctgcccaaagaacatacctcttcaacgccgttgatactattccttgcattccgaaagaaggcttgactgggccattcgatggatccaggacaaagactcctcatttgctcaacgtcttggtgcctttgctgctgttgagggtatcttcttcagcggtgcctttgcctccattttctggctcaagaagcgtggcctcatgcctggtttgaccttctccaacgagctcatctcccgtgatgagggtcttcacaccgactttgcctgcctcctccactctcaccttaagggacgtgccagcaagcagatgatccaggacatcatcaccgatgccgttaccatcgagcaggagttccttactgaggctctcccttgnggtcttctaggcatgaactccaacctcatgaacagtacatcgagttcgnggctgatcgtctgctcgttgctctcggcaacnaaaaggtgtacaaggccacaaaccccttngactttatgganaacatct

SEQ ID NO: 44 - DNA, 2780 bp, Fusarium venenatum
  misc_feature (1)...(2780): n = A,T,C or G
caactttcaaactgaagtcccaacttgcccggttctcatacacaatccacttgacttgttgtcttgatacacaactctctacctcaactgtgcttcacttcttcacaatcaacctgctcaacgttgagccatcaccagaaccaattctcaaaacattcaattgacataaccacatcttcttctattctcaatcatcatcatgtcttctcattacacttctgtgggctactccatgcctcttcccgtcccctccaagggctcgcagtaccccacctacagtcaatattctgtctcgcctccggaatgtgatgactcggttagctccgcctcgggcatcccctcttacagcaatggngggtactcggctacctcgtccggctacacatactctggcggatacaacgactatgagagcactcgctctgctagcggcgtggacttccaggagtacatgcaggaccgctttgccaactccttcgacccaatccctcttgaccgcagcatggctatgcaagctcaagacatccggaaaagatgaacgccaagcaccgagaagctcatggagctgcaaaagaaggcgcaggctcgtnttgcaaagacacgagagcgcttccaggagggtatgcgcgatgctcatgaggtccgcagcgaccttgaatggacacaaaagaaagtcagctcgctcaagaccaaggcttctcgcaaacatggcaaggagtacagcaaggctcgcgcccgttacccatctcctgagaactagattctctagatttcactttctttggagcggcatctttacttttacaacaaaatttcctttcagcgagcaacttttattcgcaatcaactcaccaaagtttcgcacataaaacacgttttccgcagaaaatgcggaacgcgaaaaaantcggatttctgatatctcaattgagatcttgtttactatttaattttacgagcatcccacgacacccacatgttcaacgtgcatgaacgagtagttcatgcaaggggaatgtgaggtgacgttagaatcaagggcactaagcgcggcaaattgagcccgctggcgcgagggtcttgctacctttgctaaaagcagcagggcaattatgcgggcggtatttagccaggaacgccaacctcgcggccactggagccagtgtgggggaaagacgcaaaaaaagcgagaatgggcgactgtttcacgacttacggtttatgattggatgaactgaacgatttaggggcgattgttaaaagtacacctcctcccaagcatctgtgggggtgttagggaatagcgtcagcaggttggcancaaaacatgatgtgtcggcaccnattgctgcaagggcagcagggttggcagcatctctggagtatgggtgacgcggnaacagccgaggattgcaaagtcnaccgacttgtcgggttcgttgaggggtgtgtattgagtgatatacccagggaaccactacaaagacgatgacggtttggaaaatagtagcgagtttgcaaatgtcagtcaatttcggacgcttgccctaatcagttgggaggcagcaatgtnaagaacntgctcaataggctttaatgttcatctggaagagctcaaaactgatgaagctccttcgaacttgggcaaggctaagggtctcgaaaaaaattccttgccggcgtgaaagcctcaatctcgatacgggtgctcttctnaagaagacagagtacgcttggccttctcggcctcacgcttgagcttacccatggccttgaggtccttggtgatgtcgacgttgttcttctggttgtactgcttggcgaagtagttgatgacacgctggtcgaaatcctcaccaccaaggtgggtgtcaccagcggtagcgagaacctcgaagataccgtcgtcaatggagaggagagagacatcgaaagtaccaccaccaagatcgtagacaatgatctggcgctcaccatcgttcttgtcaagaccgtaggcgatagcggcggcggtgggctcgttgacaattcggaggacgttgagaccggcaatgacaccggcatccttggtggcctgtcgctggttgtcgttgaagtaggcggggacggtaacgacggcgtgggtgaccttcttaccgaggtagccctcagcgacctccttcatctttccaagaaccatagcagaaatctcctcaggagtgaactgcttcttggcaccatcgacctcaacttggacgacgggacggtcatcacggttgacaaccttgaagggaagtgcttgatatctccctggagggtcttctcggagtacttgcggccaatgagacgcttgatatcgtagatggtgttggtggggttagcgncggcctggttcttgncggcgtctccaacgagacgctcatcctcggtgaaggcgacgtaggaaggagtaattcggttaccctgatcgttgacgagaatctcgaccttgcccttctgcatcacaccgacacagctgtaagtagttcccaaatcaataccaatgacagtgccgtagctgtcaacatcgtcagcctgaacggtctgaacgaaggcgagaggagagaagaggagggcgatccaacaaaggagtcccaggccaagggccattgagctccttgaacgagccatgatgagctctgtgtatgtagttgctttactgattggaagtgcaacaagactttatgatgggaaaagaaaagaaaaacaaatcaatctatgatcaagcaaaggctgtntcttgccttgcacacagattttat

SEQ ID NO: 45 - DNA, 1278 bp, Fusarium venenatum
  misc_feature (1)...(1278): n = A,T,C or G
cggtggtaacgaggaggcctgnccccacattaaggacatcttccaaagcatctccgccaanagcgatggcgatgcttgctgtgagtgggttggcnacgagggtgctggtcactacgtcaagatggtccacaacggtattgagtacggtgacatgcagctcatctgcgaggcttacgatatcatgaagcgcggtcttggcctctccagcaaggagattggcgacgtcttcgccgagtggaacaagggtgttttggactctttcttaatcgagatcactcgtgacattatgtactttaacgacgacgatggcactgctctcgtcgagaagatcctcgacaaggccggccaaaagggtaccggcaagtggaccgctgtcaacgctctcgacctcggcatgcccgtcactctgatcgccgagtctgttctttctcgatgcttgtccgccatcaaggacgagcgtgccgccgcctcctccaagcttgagttcgtcagccgaaccaccaagttcgagggtgacaagaagcagttcatcgacgacctcgagcaggctctctacgcctccaagatcatctcctacgcccagggcttcatgcttatgcaggaggctgcccgtgagtacggctggaagcttaacaagccttccatcgcccttatgtggcgaagtggctgcatcatccgatccgtcttcctcaaggacatcacccacgcctaccgcagccagcctgacctccagaacctcctgttcgacgacttcttcaacaaggccatccacaaggctcagcccggctggagagacnttattgccaaggntgccctccttggtatccctactcccgccttctctaccgctctgtcttggttcgacggttaccgcaccaaggacctccccgccaaccttctccaggctcagcgtgactacttcggtgcccacaccttccgcatcaagcccgagaacgctagcgagaagtaccccaacggccaggacattcacgtcaactggactggtcgtggaggtaacgtctccgcctctacttaccaggcttaaacggcccagggtaaagagaaggaatcatgataggttaagaaatgaataccgcgggcccgtacgaagctcgatagctgcgtcttataaaaaaaaatccgtgattaggaacgcaggaataacgcttggcgctgcagggataatgatgaatgagctggtatggatttagaaagctcagtggatgacatccgggttcgtgttanaacccaaacngagaaataaaaaatnttncaaat

SEQ ID NO: 46 - DNA, 614 bp, Fusarium venenatum
cccaaccccgacaccaactacctattcatgggtgactatgttgatcgaggttactactccgtcgagaccgtcacccttctcgtcgccctcaagatccgataccctcagcgaatcaccatcctccgaggaaaccacgagtcccgtcagatcactcaggtctacggtttctacgacgagtgtcttcgcaaatacggaaacgctaatgtctggaagtatttcaccgacctctttgactaccttcccctcactgccctaatcgacaaccagatcttctgtcttcacggtggtctttctcctagtatcgacacactcgataacatccgagctttggatcgtatccaggaagtcccacacgagggtcccatgtgtgaccttctctggtcagaccccgacgaccgatgcggttggggaatttctcctcgaggtgcggggtatacattcgggcaggatatctcagaagccttcaatcacaacaacggcttgaccttgatcgcacgagctcatcagctgggttatggagggttacaactggtcccaagaccgtaatgtggttaccattttctcagcacccaactactgctatcgatgtggtaatcaagccgccatcatggaaa

SEQ ID NO: 47 - DNA, 1928 bp, Fusarium venenatum
  misc_feature (1)...(1928): n = A,T,C or G
caatttcaccggtcgacgccttctgtcgtttttattccggtcttcatccttctttccttttcaaccccaactctctcgctattgggcttattctagtttgactgtaattcaacaaccactcaccagatactctcatttacacaatacaacgcttccgttccgattttcgactctttttttcccttctttttctacaacaatttctcaatcaactccagtaatttcgacccattacattgatccaacaaattcacaatgaagtctgtcgctcttctctcagtcttggcggctgtcgcctctgccacccctactctcaaggagcctcccagcaagcgtggatcccttcctaccgtcactgcttcaggcaatgctttctgggccggtaacgagcgtttctacctccgaggtattgactaccagcctggtggtgcctccgctaatgaggatcctctggccgaccccaagatctgcaagcgtgatatcaagtacttcaaggagctcggtgtcaacgttattcgcgtttacgccgtcgacaacaaggccgatcacgatgagtgcatgaaggcgctcgacgatgctggcatctacctcgttctcgatgtcaacaaccccaagtactccatcaaccgtgccacccccggtccttcgtacaacgccgcctacatccagagcgttttcgctactgtcgagatgttcgcccaagtacgagaacaccctcgctttcttctctggtaacgaggttatgaatgacgagaaggacaccgacaagtccgctccttacgtcaaggccatcacccgcgatatgcgaaactacatcaaggcccgcaagcttcgcaagattcccgtcggttactctgctgccgatgttgcctccaaccgtatgcagactgcccactacatgaactgcggttccgacgaagtccgatccgacttcttcgctttcaacaattactcctggtgcaacagtgacttcaagaactccggctgggatgtcaaggtcaagaacttcactgactacggtattcctatcttcctgtctgagtatggctgcattgagagccgtccccgtaagtttgaggaaatcaagcccatgatggactccgacatgtcctctgtctactctggtggtcttatgtacgagtactctctcgaggacaacgactacggtattgtcaagatcaagggcaataccgttcagcctgaggacgagttcgacctcttcaagtctgctctctccaagtaccctgctcccactggcgccggcggtgccgccaaggcttctcacggtgtcgagtgccccaagtccgantctgtctggcaagtcgaccccagctacctccccgagatgcctgcacaggccgagaagtacatgnaaggacggtgctggcaagggtcctggtatcaacggcgacggttctcacttcgacactgacagcggtactgccaccgccagtgttgccgttggnacctccacatccaccggcgaactcttcctcatccaactctgaggatgaacgatgacagcggggccgctacccttcggctttcggggctctctatgtcaaccggcgctgccaatttcttcaaccctcttctggaacccttcttcttgtaaaatagcagaatttgctatgaaatggcttgcttttgttaagtttagggattggcccccaaagctatgatttaggcctccccgttgggttcatgataatcacaataagatgttggtgacgagcgcttgattagctgcgctgggtatgtcgggttcgtattttttcaacaggagcattggcgtctagccttggaagggcagacaaatgattataatgctatctgggcgattatcgcctttgtcatttgagttaaaagaagttcggtgcggaaacacaatcagtagacttttcttaaactaggncatgaatttgccg

SEQ ID NO: 48 - DNA, 1563 bp, Fusarium venenatum
  misc_feature (1)...(1563): n = A,T,C or G
agaagagatttaaatcaggtatcgacgcctgatctggagatcctgccatatcaattccacattcgcgagaacgagacgcaactatggctgatgctgctgcccctccgaccgagcaggttgccaacctgcacctcgacgaggtaactggtgagaagatctccaagaccgagttgaagaagcgccagaaggcccgccagaaggaggaggaaaagaagaagaaggctgccgagcgtggtcctgctcctgctcccaagaaggctgccggtggtgctgaggctgctgagaaggacctacccccaaccagtacttcgagatccgatccaggaacatcaacaagctccgcgagaccaagagcccaaccctatcttacaagttcaatgttacatacgacctgcgaaagttcgtcgaggagtttggtcacctcaagtctggcgagcacgccaaggacaagatcattcaaattggtgcccgtgtccacggaaagcgagcatctggcgccaagctcctcttctacgatgttcgaactgaaggtgtcaaggttcagatcatgtgccaggctcaagaggttcgcgagggagctccttctttcgaggatcagcatgaacacctccgccgaggtgatatcatcggcattatcggataccctggtcgaactgcccccaagaccaagattgagaagggtgaggagggtgagctgtccatcttcgccactgaggttgttctcctgactccttgtctgcacgcccttcccgatgaccactacggcttcaaggatctcgagcagcgataccgcaagcgatacctggatctcatctgcaacgagaaggcccgtaacgtcttcatcacccgatccaagatgatcacctggattcgccgatacttcgacgagcgtgacttcgtcgaggttgagactcccatgatgaaccaaattgctggtggtgctaccgccaagcccttctccactcaccacaacgagtttgatattccgttgttcattcgtgtcncccctgaactctacctcaagatgcttgtcgtcggtggtntcaaccgcgtgtacgagattggacgtcanttnagaaatgagggtgctgatcttactcacaaccctgaattcaccaccattgaattctacgaggcctacgcggacgtnancgacctgatgaagaccactgaggacatgatcttcggtcttgtaagtacctnactggtggctatacgactactttccatactcagagtggcgagaagtacgangtcagctgggaggcaccctggctcnatatgagatgattaccatcttgangaggctactggcgagangttcccttctggtgaccagctccatactcaagaanaccaacgaagttcctcaagaaggttctnaanaagatgaacctggagtgcacacctctttgaccaacgcccgcattattgacangctggttgggnnaagttcatcgaggagaantgggtcacccctcttttattactgggccacccttnagggnatgagccctntcgccaagtaccaccgtgagacccccggtctgngngagcgatnca

SEQ ID NO: 49 - DNA, 1670 bp, Fusarium venenatum
  misc_feature (1)...(1670): n = A,T,C or G
cttgtttcaattactaaaacagaataatggcttctcctcctcatgttgggagtctctcccgtcttcctgccaacttgcgcggtggtattgagtctgtcacgcgcggtagacataatgtgtcttggcctttgctaaacctcgatctattgcgcaacatcctcctctttcttttcttttggcgatggacccgtcgcgcattctggcagctnaaaggtcgtggtattatcggctncgtcgtcgagctatacaccaacatccggcgcatnctntacgggtacttncttcgagcccccggcgtgcgaagtaaggccaacaacaggtcaacgaatccttggttaaactatccgataaagctagttccaaagaccagattcgctacctcacgctacaaaggagggattctnttatgatgtcgtgcgctccgagctcgagaacctcgccaacatggaccacacgcgctgggaggatgggtatgtctcttggtgctgtgtaccacggagaggatgaactgttggctctgcagactgaggcgtatggaaaagttcaccgtgccaatccattcattccgatgtcttccctggtgtgcgcaagatggangctgaagttgtggccatggttctgagcatgttncacgccccttctgggagccgtggacatntactagcggaggaactgacagtatcttgatggcttgtctggctgctcgccaaaaggcttatgctgagcgtggagtgacagagcccgagatgattctccccgagactggtcacactgctttccgcaaggctgctgagtacttcaagatcaaggtccacctcgtcgcatgcccagctcccgagtaccaggttgacgtcaacgctgttcgccgtctaatcaaccccaacacgattatgctagtcggctctgctcccaacttccctcacggtatcatcgacgacatctctgctctgtccaagcttgccctccgcaagaacctctggcttcacgttgactgctgtctgggatccttcctggtccccttcctcgagcgtgctggttttgaaactctgctgtttgacttccgactgaagggtgttaccagtatcagctgtgatactcacaagtacggttttgcgcccaaaggtaactcgactgtcctctaccgaacggccgagcatcgaaagttccagtactttgtttcccctgattggtccggtggtgtctacgcttctcccggtatgggtgggttctcgacctggtgccctcatcgctggttgctgggctagtttgatgaccatgggtgagtccggttacatcgatgcatgcaccaagatcgtgggaaccgccaanaanatcaccgaggntatccacaccaccccagcattgggtggcgagcttgagatcatgggaaagcctcttgtctntgttgttgcattcacagctcgcaatctcaacgtctacnatattgccgacggtatgggtgccaaggggtggcatctcaacgntnttcagagccctcctgctatccacgtcgccgttnctctgcccatcaccaaggtgtggaagaatctnatcgccgacctcgaggctgtcgttgaagaagaaccccaaaaagaacgtgttcntttanttgagggcaagggtacccatggtnacgccatgggtgacccctcacattgngcgggggtggn

SEQ ID NO: 50 - DNA, 633 bp, Fusarium venenatum
  misc_feature (1)...(633): n = A,T,C or G
ggaagtccgatttgtgggaagccgcaagcattccctccccacccggcgacgatgagaccaatgaagccatcgttttcggttatcttgttgcctggttcctgggcgagttcgtctgccacgagaaaaagaaggctgttattgctcacttccacgagtggcttgctggcgttgctctgcccctctgcaagagacgccgcatcgatgtcacgacgatctttaccacacacgctactcttctcggccgatacctttgcgccggctccgtggacttttacaacaacctacagtggttcgatgtcgatgctgaagctggcaagcgtggtatctaccacaagatactgtattgagcgagctgccgcacatgcttgcgatgttttcaccactgtttctcacatcacagctttcgagtcagagcatcttctgaagcgaaagcccgatggtgttctgcccaacgggctcaacgtcacaaagttctctgctgtgcacgaattccagaacctgcancagcangcaaaggagaagattcacgactttgtccgcgggacatttctatgggcactacgactttgatgtcgataacacattgtatctcttcactgctgggtccgttacgaattcaaggaataanggcgt

SEQ ID NO: 51 - DNA, 749 bp, Fusarium venenatum
  misc_feature (1)...(749): n = A,T,C or G
gaaagctgaccatcaagacaaccgacatggaggcagtttatgatatgggtagcaagatgattgacgccatgaccaaggagcgcgttatggctggcgatatcatctcgatcgacaagtcttctggcaagatcaccaaactcggccgatcctacgctcgatctcgcgattatgatgccatgggcgtcgatacaaaatttcttcaatgccccgacggagaacttcagaagagaaaagaagttgtgcatactgtgactcttcacgaaatcgacgtcatcaactcgaggacacagggcttcttggctctattttcaggcgatactggagagattcgcagcgagattcgagatcaaatcaacaccaaggttggcgagtggaaggaagagggcaaggccgagatcgttcctggtgtgttgttcattgacgaagttcacatgcttgacattgagtgcttctcatacatcaatcgagctctcgaggacgatctggcccctgtagtcattatggccagcaacagaggcaactcacgcattcgtggtactgattatcgaagccctcatggactgcccctcgactttttggaccgagtttccatcatcaacacgcactcctacacacccgaggagatcaagcagattctatctattngagcgcaagaagaaataggtcgacgtacacccgngacgctctcgccctccttacaaagatcggccaagangcgggtcttcgtacaccagcaatnttatcaccac

SEQ ID NO: 52 - DNA, 1283 bp, Fusarium venenatum
  misc_feature (1)...(1283): n = A,T,C or G
ctcaaccaaactttccacgatacatacgacttaataccattcatcatgtcttcatctctcgagcagctcaaggccaccggcactactgttgtgtccgactctggtgactttgtctccattggcaaatacaagcctcaggatgctaccaccaacccttctctcatcctcgctgcttctaagaaggaggagtacgctaagctgatcaacgtcgccatcgactacgctaagcagaagggtggctctatcgaccagcaggttgatgatgccctcgaccgtctcctcgttgagttcggcaaggagattctcaagatcatccccggcaaggtctccacagaggttgacgctcgttactctttcgacaccgaagcctccgtcaacaaggctctccaccttattgagctctacggtgagcagggcatctccaaggaccgcattctgatcaagatcgctgccacctgggagggtatcaaggctgctgagatcctccagcgtgaccacggnatcaacaccaacctcaccctgatgttctctctcgtccaagccatcggtgccgccgaggctggcgcttacctcatttcacccttcgtcggccgtatccttgactggttcaaggcctccaccaagaaggagtacagcaaggaggaggatcctggtgtccagtctgttaagcagatcttcaactactacaagaagtacggctacaacaccattgtnatgggcgcctnattccgaaacactggcgagatcactgagctcgctggctgtgactacctgaccatctctcccaacctgctcgaggacctcctcaactcctccgagtctgtccccaagaagctcgatgcttctcangcctcttctctagacatcgagaagaagtcttacatcaaggacgaggctctcttccgcttcgacttcaacgaggaccaaatggctgttgagaagctccgagagggtatcagcaagttcgctgctgacgctgtaactctcaagggcatcctcaaggagaagcttgcctaaatttctacgcacctgaaggggtaaagaaaatgatttnaaaagttacaaaactcccgtccaaggaagaaacagtatttgagttgattgcgaacaatgagcttgttntgctgccnggcgatctttattgaanggtgccgattatccacatacctctntntctaaaacccctacctcnnttagtgaangcatgngggattaacggntgataggacatcanatgtcctggaacanatagngctcataacnaattgaacaccccttccccc

SEQ ID NO: 53 - DNA, 661 bp, Fusarium venenatum
  misc_feature (1)...(661): n = A,T,C or G
cgagtactggatttctcacaacttgtccaaggcctttgagagtttgttcggctccgttacttgtttgcctggttgtttctcaatgtatcgaatccgcgctgctgagactggcaagcctctgttcgtcagcaaggaaattgtcgaggattactctacaattcgtgtcgatacccttcacatgaagaatctgcttcaccttggtgaagatcgataccttacgactctgctcctcaagtaccacgccaagtacaagacaaagtacctctacagcgcgcaggcttggactattgcccccgactcttgggctgtcttcctgtctcagcgacgtcgttggatcaactctacagtgcacaacttggccgagcttattccccttgccagctttgtggtttctgttgtttcagtatgagattcgtcgtctttatcgatctcttgagtactattgtccacctgncattgntatgtacatttgggtacctgatttatcaggtcgcgtccaaccccgccgttgtgcccatcaaagccttcttggtgcttgctgctatctacggtctgcaagccattatcttcatcttgcgccgccaagtggaaaaggtggttgatgncatgtcatgtgcatttccggttttctttgttngctttacctttgggtatggtgatt

SEQ ID NO: 54 - DNA, 960 bp, Fusarium venenatum
  misc_feature (1)...(960): n = A,T,C or G
ctcccctcaatctcagagccctccctccctccacatcatcacaatggcttctcgcaatatctcaaaggccctccgtggccctgcccgccagcttgcttccgctccccgtgttcagcagcgaactttcgtctctgctgctcgcgctgctgtccgtgctggtgctgttgcccgacctgttgctgctcctatccagcagcaggttcgtggtgtcaagaccatggactttgccggccacaaggangangtctatgaacgtgccgactggccccaagaaaactccttgagtacttcaagaacganactctggccctcattggttacggatctcanggtcacggccagggtcttaacctccgtgacaacggcttaacgtcattgttggtgttcgaaagaacggaaagtctggaaagacctgaacaagatggctgggttgccggcaagaaactgttcgatgtcaacaaagccatctcccgtggtaccattgtcatgaaacttctctctgatgccgcccagtctgaaacttgggcccgccatcaagccccagctcgttgaaggcaagaacctttacttctcccacgggttctcccccgtcttcaaggaccttaccaaggncgaggtccccaccaacatcgacgtcatcctctgtgcccccaagggctctggccgaaccgtccgatccctcttccgtgagggccgnggtatcaactcctctttcgctgtcttccaggacgtcactggcaaggcccaaganaaggctatcgctctcggtgtcgccatcggctccggttacctctaccagaccacctttgagaaggaggtctactctgacctctacggngagcgtggctgtctcatgggcggtatccacggtatgttccttgctaatacgaagtcctccgtgagcgtggccactcccccagngaggccttcaacanaaaccggtgaggaggctacccaatt

SEQ ID NO: 55 - DNA, 1299 bp, Fusarium venenatum
  misc_feature (1)...(1299): n = A,T,C or G
gtcgcgatcattggatccggtcctgctggtctggccgccgccgatcagctcaaccgcgctggtcacctcgtcactgtctacgaacgagctgaccgcctgggtggtctcctcatgtacggtattcccaacatgaagctcgataagcgtattgtcaagcggcgtaccgatttcatggcggacgagggcatcgtcttcaagactggtgttgcagttggtgaggatggccacccatctctacaggatctccgatctagccacaacgttgttgttattgcaactggtgccactgtcgctcgtgacctccctatcaagggccgccaactcgagggcattcactatgccatggagttcctgcacaagaacaccaagtctcttctcgactccgagcttggtgataatgcttatattagtgccaaggacaaacacgttgttgtcattggtggcggtgacactggtaacgattgtatcggaacctctctccgtcacggtgccaagtccgtcaccaacttcgagcttctgcctcagcctcctcctgagcgcgccaacgataacccttggcctcagtggcctcgcatttaccgcgttgactatggccacactgaggttcgccagcacactggcaaggaccctcgtgagtactgcatcatgtctgaagagttcatggacgatggatctggcaaggtcaagggtatcaacaccatccgtgtcgagtggaccaaagtcttccancggtggttgggacatgaagaangtcgagggctctcagcaagttcttccctgctgacctcgtcctgcttgcaatgggttttcttcggacccgaggctcgtgttctttggtgatgaaattgagaaaggacgcttcgccagaatgtcaagaaccgcccccggcaagtacagcaccaacctcgagggcgtcttcgctgctggtgacgcccgtcgtggtcaatctctgattgtctgggggtatcaacgaaggtcgccaaggctgctcgtgagattgatctgtatcttgaagaaattacaccaacctgcccgtcactggcggcattaccaagcgaactgcgcaggaaatctttagccagatccaggttgaggcttagattaaaatcgtgctttagttattatattcgggatcggagcaaaaggaacaggaataccggctgtgacaaaacaaaccgatttgaacggtctcaacccgtgcctttggaagcgtaagaaacgaaactagtgggtcaatttatgttatatataccagactttaggncatttattttcatatnctaagatgagggaaaaaaa

SEQ ID NO: 56 - DNA, 1107 bp, Fusarium venenatum
  misc_feature (1)...(1107): n = A,T,C or G
ttctcgattctgtgatccttctctcggttttgctcttggctggacatactggtttaaatacatcatcgtcacgcctaaccaacttaccgctgccgccctcgtcattcaatactgggtcgatcgagatacagtcaatccaggtgtctttattgccatattcctcgtcgtcatctgcgttatcaactactttggtatcaaattctttggtgaactcgaattctggctttcctccttcaaggtcatcaccatcatcggtataatcctgttctctctcgtcctggctctcggcggtggccccgaccatgaccgaaagggtttccgatactggagcaaccctggtgccttcaagccttatatcatggaaggcgacgctggaaaattcctcggcttctggtcctgcatggtcaacgccacctttgcttacctcggaaccgaactcgtcggtgtcacagtcgctgaggctcagaaccctcgcaagaccatcccccgcgccattaagcttaccttttaccgaattctcttcttctactgtctctccgtcctcctcgtcggcatgatcgtcccctacaactctccggagcttgcctttgccaccactgccaaggctggtgcttctgcttcaccctttgtcgttgctggtacactcgctggtgtccgagtcctccctgacatcattaacgcctgtatctgcgtctttgtcttttctgcttctaactcagatctgtacattgccagccgtaccctctacggtcttgcctccgacggttcagctcccgccattttcaagaagaccaacaaggacggtgttcccatctacgcccttggcatgtctgcttctttctgtctgctcgccttcatgaacgtctcggacnactccacaaaggtctttggctactttgttaacctgaccactatcttcggtcttatgtcatgggatctccatcctcaccactcacatattctggtgccgcgccaanaaagcacaagggcctgggcaacgnaacccttccctacgtcgccccctttggcatgtggggatctgttggtgcccttgccatgtgcatcctcatcgctctgaacaaaaatacgaaatttttgttcgcgaca

SEQ ID NO: 57 - DNA, 888 bp, Fusarium venenatum
  misc_feature (1)...(888): n = A,T,C or G
ctcctcatcaccgccgacaaaccagccaaccgacacaatggcccgcggaatcaagaagcaccagaagcgcctcagcgccccctcgcactggctgcttgacaagctgtccggcacctacgctcctaagccttctgccggtcctcacaagctccgcgactgcatgcccctgatcgtgttcatccgtaaccgactcaagtatgctctcaactaccgtgagaccaaggccatcctgatgcagcgactggtcaaggtcgacggcaaggtccgcaccgattccacctacccctccggcttcatggacgtcatcaccatcgagaagactggcgagaacttccgtcttgtctacgacaccaagggtcgattcaccgtccaccgaatccagaacgaggaggccgagtacaagctgggcaaggtcaagcgtgtccagcttggtcgcggtggaatcccattcttggtcacgcacgatgcacgaaccatccgataccccgaccctctgatcaaggtcaacgacactgtcaagattgaccttgccactggcaagatcaccgacttcatcaagttcgacaccggcgccgttgtcatggtcactggtggtcgtaacatgggtcgtgttggtgtcatcacccaccgtgagcgtcacgatggtggtttcaacatctccacgtcaaggatgccattgacaacagcttcgccacccgtganaacaacgttttcntcattggccaggacaagccctggatctttttgcccaagggcaagggtgtcaagctcaccatcgccgaggagcgtgaccgccgacgcgcttacgccatcttttantaaattgtgaatttgcgataggaatgatanaaaatggcatgtggtctggagtctcggatttgacgtttg

SEQ ID NO: 58 - DNA, 637 bp, Fusarium venenatum
  misc_feature (1)...(637): n = A,T,C or G
gagattgatgccctacctctcctgcctcttgttgttgctcgttgtgcccctcaaaccaaggtccgtatgattgaagcgctccaccgtcgcaaggctttcgtcgccatgactggcgatggtgtcaatgactcgcccagtttgaagcgttcggacgtagggattgctatgggtctggctggatctgatgttgccaaggaagcttccgacattgtcctaactgacgacaactttgcctctatcctcaacgccgtcgaggaaggccgacgaatgtttgataacatccagaagttcattctccacgttttggctgaaaacattgcccaagcctgtactcttcttattggccttgctttcaaggaccgtaacaacctgtccgtgttccccttggcacctgttgagatcctctggatcatcatgattaccttcggtatgcctgatatgggactcggctttgaaattgctgcgccagacattatgcagcggtccttcttaaaacttaaaacaaggtgtctttacttccgagttgatgaattgatatggttgtctatggtctttggatgtctggcctctgtcttagctctttcgntccttgtcctctacggcttcggtnatggcctgccgacattgganacaatgc

SEQ ID NO: 59 - DNA, 1127 bp, Fusarium venenatum
  misc_feature (1)...(1127): n = A,T,C or G
acccatcgcatcattaccttcaaaatgctgtccacactccgagttgccagccgacgggctgcccgccctgctcagtacaacctggccgccatccgcgctgcctccaactgggccaacgtccctcaaggtcctcctgatgccattcttggtatcactgaagccttcaaggccgacaagttcgacaagaagatcaacctgggtgtcggtgcctaccgtgacgatgccggcaagccttacgtactcccttccgttcgtgaggccgagaagaaggtcgtcgagtctaagttgaacaaggagtacgctggtatcactggtgttcctgagttccctcccgccgccgctaagctggcctacggcgccaacagccccgccttggaccgcatcaccatcacccagaccatctctggtactggtgctctccgtgtcggtgctgctttcctcgccaagttcttccctggcgagaagaagatctacattcctcagccttcgtgggctaaccacaaggccgtcttcaaccacgccggcctcgaggttgaacaagtaccgctactatgacaagaagactatcggccttgactttgagggtctgattgctgatgtcaaggctgccccaacggcagtgtcttccttttccatgcttgtgctcacaaccccaccggtgttgatcctacccaggagcagtggaagcaaatctccgacgtcgtcaaggagaagggtcacttcgccttcttcgatatggcttaccagggctttgccagcggtgacactgacaaggatgctttcgctgttcgctacttcgttgagcanggccacaacattgctctttgccagtctttcgccaagaacatgggtctctatngtgagcgnattggtgccttcttcatggnctgtgccgatgccgacnagaanaaacgcgtcgactctcagctcaagattctcattcgacctctgtactccaaccctcccatccacggtgcccgcatcgncgncgagattctgaacagcctaccctctacaagcagtggctcggcgaggncaaggagatggctgnccnatcatctcatgcgtgctctctnaaggataccctgagaacttcggttcaacaccaatgggcttacantaccagc

SEQ ID NO: 60 - DNA, 1319 bp, Fusarium venenatum
  misc_feature (1)...(1319): n = A,T,C or G
gaacaacacaaatacacatctccatcctagatttttgttgattctccttctttgagaatctcgagtctagtcgataccagctttattttccactaaacgattaccaggcgcagtcttcagtcgaagttctgccctcttttttcgcttccttcaccccgcgatttctcacatctaggtcgagccgagcttgatctagactttcaaaagcctcaaccgcaatcatggctgacaagggtcttgaggatgtccctgagacacagatcgagggtaactacgatgagaccgtcgactccttcgatgacatgaacctcaagtctgagctcctccgaggtgtctacgcctacggtttcgagcgtccctctgctattcagcagcgtgctatcatgcccgtcatcaagggcagcgatgtcattgcccaggcccagtccggtactggaaagaccgccaccttcttcatctctgtcctncagaagatcgacgccaacgtcaaggnttggcaggccctgatccttgcccccacccgtgagcttgctcagcagatccagaaggncggtatcgctattggcgacttcatgaacattgagtgncacgcctgcattggtggnaccaagtgttcgtgatgacatgaaggccctccaggacggtccccaggtcgttgtcggtacccccggtcgtgtccaggacatgatccagcgccgtatcctcaagaccgacgccatgaagatgttcgttctttgacgaggccgatgagatgctttctcgtggtttcactgagcagatctacgacatcttncagcttctnccttagtccacccaggttggtcctcntttccgccccatgccccaggatgtccttgaggtcaccaccaanttcatgcgtgacccccgtccnnattctggtcaagaaagacnantttaccctggcgggtatcaatcagttctacattgctgttgatanaggaggacgtggtatctcgacactcctttccgacttgtacgaggagcgtcaccatcacccagtctgtcatcttctgcaagactcgcatgaaaggtcgactggctcaccgacagggctcactgcgtcgtgacttcactgtctccgccatgcacggtgacatggaccattcgtcacgcgtgatctgatcatgagctgaggttccgatccggatcttctcncgtcctgattgccactgaacttctggccgtggtatcnatgttcaacaggtttcctggtctcactacaatctcccgcccaccgtganaatactccccncctccgtcctggaagantttcggccaaaaggttcccctcacttcct

SEQ ID NO: 61 - DNA, 755 bp, Fusarium venenatum
  misc_feature (1)...(755): n = A,T,C or G
gatttcaactggggtaacactcgtgttattgctggtgagtctggcaagaagatcgttgtttccgacgaaggcaagttcgaccccaactcgatccctcgcaagaagtgggaggagtaccaagccgagctttgggagacccaaacacagactgctcgcgacgatgttcgatccgagatttccggttacagttatgcgaccaaggctcaaggacccttctccgattacaatggtggttaccagcccagccgccctggctcaactgccggcttcggtcaccacaacatgtctcgcatgtctctggcccactccgagatgcctggtaaccgcacgagccagttcggtggctcacaattcttctcccctgaagagatggttggcatgcccagtgatgacgctcttctcgccgagatccgcgacattctcaagacagccgacttgatgaccgtcaccaagaagggcatcaagcaagaagttggagagacgcttcaacgttcctctagacgccaaaagggcctatatcaactctgcgactgaagccttgctttctggccaactatagactgnattaagaacccaatgaaacgggcttttattaatgcctatcttaaaggcctggcgataatctttggttatttgaacttggnaatctttcatttatttttatatatggggaacatgggaatgggaatactaaaacttaacaattttggttaacngnacaacccaattttggccgggcntatncataaaactgg

SEQ ID NO: 62 - DNA, 1272 bp, Fusarium venenatum
  misc_feature (1)...(1272): n = A,T,C or G
tcacattacttatcgcattttgctgcgttcttcatcgatgccagaaccaagagatccgttttttttttgaacgatcaagaaaataatattgccaagttagctatcagaacacagcatgaaactcctttcatctagcatatacacagggttaaagtcctaataatctcattcgcagttttcatctgcgataacccttcagatcgcttccccctcgctcgcaaacattcgttttaacaacaacttatgttttattcgtttaagttgccgaaagccatctgcttcttgatctcggcgatcgccttgccggggttaaaacccttggggcaagctcgggtacaagttaaggatagtgtgncaacggtacaagctcattgagttctcgagnttctgctttcgctcggcggtacgctggtcacgagaatcggcgagccatcggtaagactggagcaggatagcgggaccaaggtactcctcagagttccacccnagtaagatgggcatgaagtagagcagcaggcgcagagaatgcacttcgtaaagaccgtcgagcttgcgtcggtcctccttggtctgtcggtactcccgtccgtcttcggcaggggtgtcgcgctgaaggtagggcttgatgctcttgtactgcttgtagaagtgcgtcagatcagggacaagtccttgacgacgtaggtatgaggaaaagggtagatcttgacgtcgnaagcagcctcggtagggatacggcacaagcagccaagggtgttctggccgttgatgttcatggcacagctaccacagataccctcacggcaacttcgtcggaaggtcagagtagggtcgagctcgttcttgattcggataagggcatcgagaatcatgggtccagtcttgttaagatccagagtgtaggtctggagacggggcttctcgctgggggtatcggggttccatcggtagatctggaaggacttcatctttgactcgggctccttggcaggctcgctgacggaggccatagaacgagtgaagacagtgccgggtcggatggcagccgaccttgagaaggcgccaacaaggcgagaggaagatcgaagagcagccatggtggatcgaatcgaattacaattgcgattgggaccggaggagaaggacagtcaaacttcgcgatatatagttggagctgtagtcaggcgattgacaggaagaaatgccgtacaatcccctccgttagagctgaattgtcgatattctcaaagggtggcggccagaggattctcg

SEQ ID NO: 63 - DNA, 570 bp, Fusarium venenatum
  misc_feature (1)...(570): n = A,T,C or G
atgaagccctggcggttaacactttccaagaagtctcatttactcttacggcatgtctttcgccatggacaattatatctccaggtcggccacatacgangaactcgccgagtttcactcctcggactatctggacttcctcggcacagtactgcctgagccagtacctcgagatctcgaaaaccaaggagtcgacctgaagttcaacctgggtgggtctgactgtcccctctttgatggcctattcaattattgttctttgtccgctggcgggtcccttgatgcagccagaaagatttgctcaaagcagtctgatattgccatctcttggggcggtggccttcatcacgccaagaagtctgaagcgtccgggttctgctacatcaatgacattgtgatcgccattctccaactccttcgccattatccccgagtcttgtacattgacattgatgttcatcacngcgacggaatanaaaaaccttcttctctactgatagantcatgactgtctcttttcataaatacaaccaaacactcttcctggttactggtgctcttgataaaacg

SEQ ID NO: 64 - DNA, 577 bp, Fusarium venenatum
  misc_feature (1)...(577): n = A,T,C or G
cgtggcgaagcccgactcttccctcaagaccgctcaggaaatcaaggaggagtactgctacgtctgtcccgatatcgtcaaggaattcggcaagtacgaccaagatcgcactcgatttgccaagcatgtcgtgtcgcaccccaatggccgccaggtcagcgttgatntcggttacgagcgttttctcgcccccgaaatcttcttcaaccccgagatttacagctccgatttcttgacccctctccctgtggtcgtcgatggtgttattcagcagtcgcctattgatgtacgacgaggcctttacaagaacattgttctctctggaggaagcacactatacaaggatttcggtcgccgattacagcgagacattaagcagctggtggatgccagaattcgagccagtgaagtccgtancggtggtgctcgaantggtggcttggacgtgtctgttatctctcataagcgacagcgacacggtccttggttcggaagcagtcttctcggtcaaactcccgaattccgatcgtactgccataccaagggcgaataccaagaatatggtcccancattgtg

SEQ ID NO: 65 - DNA, 1314 bp, Fusarium venenatum
  misc_feature (1)...(1314): n = A,T,C or G
agctccgtcgcaaaataaaaagtgaaatcttttctctcttcctnaaacctttttctcttccctttccttcgtcgccgctcttgctctcgaagccgtccgaggttggctagctgccaacctaaatacttcaacacgaagtccttcagatcatctctcttcttcgcttcttcctttcctcttgcaccccgcgcagccagctctgcagctcttggaaacgttccattcacgcgttccggtctagttttctttgttcaacatcgtaactacgccaagtcaagaaagatgcctcccaagaagcaagtcgttgaggagaagatccccctgggcaggcctggaaacaacttgaaaagtggtattgtcggtctagcaaacgtcggcaaatctaccctctttcaggccattaccaagtctaacctcggtaacccagctaacttcccctatgccactatcgaccctgaggaagctcgtgtcgtcgttcccgatgaccggntcgactggctcgtcgagaagtacaagcccaagtcagntgntcccgccaacttgaccgctatgatatcgncggtctgactcgcggntcatncactggtgctggtcttggnaactctttnctgtnccacattcgcgctggtgatgccatctttcaagttgttcgntgcttcgacgatgccgagatacattacattgagggtggcgtgaaccccacccgtgattttgacatcatcagcgaggagctccgactcaaggatatcgagtttactgaaaaggctctcgagaaccagaagaagaagacccgtatgggtggtcagagtctggagcagaagaaggctgtgcaagatcaagccacgcttgagaaggttctagcctggctcaacgatggcaaggatgtccgcaagggcacctggggccccaaggagattgaggtcattaaccctctcttccttctgactgccaagcccgttgtctaccttgtcaacttgtctgaaaaggacttcatccgcaagaagaacaagcatcttcccaagattgtcgagtggatcaacgagaatgccaagggcgaccctctcattcctgtctccgtttcttacgagtctcgtctcactttgtgcgagaccgangctgaagctaaggaagagcagaaaaatgccggtgccgactctgttctgcccaaggtcattcttcanatgcgaaaaacctgcagcttggcagcttcttcacagtttggacctgatgaagtccgacagtggaccatccgccatggccccaaggccctcaggcgccggtgtcttcncnacaatttcaaaaaaacttcatcca

SEQ ID NO: 66 - DNA, 1877 bp, Fusarium venenatum
  misc_feature (1)...(1877): n = A,T,C or G
ccatgcccggtgacacagagttcaacaccggcttcagcttctggggtggaaacctgaccctcgctgttgtcaacggtaccgttcccgcttggagaatcgacgacatggctactcgaattatggccgctttcttcaaggttggtcgatctgttgaggaggaacccggcatcaaattttcctcttggactcgtgacgagtacggctttgcccagacctacgcccaagagaaccgagaaaaggtcaactttgctgttgatgttcagcacgaccacaagcgccatattcgtgagtctgccgcaaagggaaccgtcatcctcaagaactctggctcgcttcctctcaagaagcccaaattccttgctgtcattggtgangacgctggccccaatcctgccggtcccaacggttgcggcgatcgtggatgcaacaacggcactcttgccatgtcatggggttctggaacctctcaattcccctacctcgtcacccccgatcaaggtatttcgctccaggctattcaggacggcagtcgatacgagagcatcctcaacaacaaccagtggccccagacacaggctctcatcagccagcccaacgtcaccgctatcgtctttgccaatgccaatgctggcgagggttacatcgaagttgatggcaactacggtgaccgcaagaacctcactctgtggaaccaaggtgatgagctcatcaagaacgtctccgccatctgccctaacaccattgtcgtcctccacaccgtcggccccgttctgctgaccgaatggcacaacaaccccaacatcaccgctattgtttgggccggtgttcctggacaagagactggtaacgccatcgctgacatcctctacggcaagactagccctggacgttccgtctttacctggggccgcactgccaagagctacggcactgaggttctctacaaggccaacaacggcgagggtgctccccaagaggacttcactgagggtaacttcatcgactaccgtcactttgacaaacaatcccctagcaccaacggaaagcgagctaccaacgactctgctgcccctctctacgagtttggcttcggtctgtcctggaccacctttaagtactctgacctcaaggtcgagtctgtcagcaacgcctcttacagcgcccctgtcggaaacaccattcctgcccccagctacggcaactttagcaagaacttggacgattacaagttccctgctggcgtccgatacatttacaagttcatctaccccttcctcaacacctcttcctccgcccaagaggcttccaacgacattgagggtaactttggtgacaccgccgacgagttcctccctcccaacgctctcaacggctcatctcagccccgtctcgcttctggtggtgctcctggcggcaaccctcaactttgggatgtcctttacactgtcaccgcgaccatcaccaacactggcgatgccacttctgacgaagttccccagctgtacgtcagccttggtggtgagaacnaacccatccgtgtcctccgtggtttcgagcgtctcganaacatcgctcctggtgagagtgccacattcaccgctcagcttactcgtcgtgatctgagcaactgggacgtcaatgcccanaactgggtgatcaccgatcacgccaagaanatctgggttggtagcanctctcgcaatctgctctcagcgctgaactgtagtggaaaatggattgatgggatatgtttcttgaagctgaaaggttgtctacggatatgtaaacggtagaataactttgtgccagtcacgtcaatggccagcataattattttgacaaagcgtgaaaataaatttttcgttcatacatatgat

SEQ ID NO: 67 - DNA, 864 bp, Fusarium venenatum
  misc_feature (1)...(864): n = A,T,C or G
gacatggttcctcgagaagaccgacaacaagggcganattgccaagcactttgttgctctctccaccaacgaggaggaggtgaccaagtttggcattgacagcaagaacatgtttggcttcganagctgggtcggcggtcgctactctgtctggagtgccattggtctgagcattgctctctacgttggctttgacaacttccacaagttcctcagcggtgctcacgccatggacaagcacttccgcgagactcccctcagggacaacatccctattcttggtggcctcctgagcgtttggtactctgactttttccaggcccagactcaccttgttgctcctttcgaccagtacctccaccgattccccgcctacctccaacagctctctatggagtctaacggcaagactatcacctctgatggatcttccgccaagtacaccactggtcctatccttttcggagagccttgcaccaacgctcagcactccttcttccagcttgttcaccagggcaccaagctgatccctaccgacttcatcctcgctgccaagtcccacaaccccgtcagtgacaaccttcaccagaagatgcttgcctccaactactttgcccaagctgaggctctcatggttggaaagactgatgagcangttcgcgccgagggtgcccctgaggagcttgtccctcacaaagcgaatcttgggtaaccgacctacaacctctattctcgttggtggtgccattggccctgccgaattgggtgctctggatcgtctactacaagcacctcaaccttaactgagggtgctattttgggacataaacagcttcgaacagtgggggggtcgagctgggcaaa

SEQ ID NO: 68 - DNA, 1023 bp, Fusarium venenatum
  misc_feature (1)...(1023): n = A,T,C or G
ccgcactgctatgagtgtcctcctccacggtgacgctgcctttgctgctcagggtatcgtctacgagtgcctcggcttccactctctccctgccttctccactggaggtaccatccacctggttgtcaacaaccagattggtttcacaaccgaccctcgtttcgcccgatccaccgcctactgtaccgatatcgccaaggccatcgacgcccccgtcttccacgttaacgccgatgatgtcgaggccgtcaacttcgtctgccagctcgctgctgactggcgtgccgagttccagcacgatgttgtcattgatctcaactgttaccgaaagtacggtcacaatgagaccgatcagccttctttcacccagcctctcatgtacaagcgcatcaacgccaaggagcctcaaattgacatctacgtcgataagcttatcgaggaaggttctttctccaagggcgatgtcgaggagcacaagcagtgggtctggggtatgctcgaggagagcttcaccaagtccaaggactacacacccacctccaaggagtggaccacctctgcctggaacggcttcaagtcccccaaggagctggctaccgaggttcttgccaccagcgagactaacgtcaagcccactactctcgagcatatcggtaatgctattggaagtgttcccganggcttccaagttcaccgcaacctgaagcgtatcctaagcaaccgaaccaagtctgttgttgaaggtaagaacatcgacttcccaccgccgaagctctggctttcggtactctcgttactgaaggttaccacgtccgtgtctccggtcangatgttgancgtggtactttctctcagcgccacgctgtcttccacgaacagganactgangatactcacactcctctccagaaccttagccaagaacaaggcaagtttgtgatctccaactcttctctgancgantttggtgccttggtttcnaatacggttactctctgtcatctcctcatgctcttgtcatgt

SEQ ID NO: 69 - DNA, 1032 bp, Fusarium venenatum
  misc_feature (1)...(1032): n = A,T,C or G
cgcaagaacaccttcaccgagaagttcgaggaggcggctatctcttctttcatctccacttccgctactcccctcattggtgaggtcggtcctgagacctacgctggctacatgtccgctggtattccccttgcctacatcttctctgagaccgaggaggagcgcaaggagctcggcgaggccctcaagcccatcgctgagaagtacaagggcaagatcaacttcgccactattgacgccaaggctttcggtgcccacgccggtaacctgaacctcaagactgacaagttcccctctttcgccatccaggaggttgtcaagaaccagaagttccccttcgaccaggagaaggagatcacccacgacagcatcgccaagttcgttgaggagttcgacgctggcaagattgagcccagcatcaagtctgagcccatccccgagacccaggagggtcccgtcacagttgttgtcgccaagagctacaacgacattgtccttgacgacaccaaggatgtccttattgagttttacgctccttggtgcggtcactgcaaggctcttgctcccaagtacgacgaccttgcttctcagtacgccgcttctgagttcaaggacaaggttgtcatcgccaaggttgacgccaccctgaacgacgtccccgatgagatccanggtttccttaccatcaagctctaccccgntggtgccaaggacgctcctgttacttaccagggctctcgtaccatcgaggacctcgccaacttngtcaaggagaacggcaagtacaacgccgagctctccatcaaggaggagggtaccgaggaggctgcccccgccgccagtgaggagaagaaggacgagaaggccgacgaggatgtccatgatgagctgtaaagaattcatgtcgcattgttagtatacaaaatggggtataactgatttcatgggcgcgggtttttatggtgctaagattttatcgcacctcttaggtatttagttctcgtggcaatgggactgtttcatgacttgact

SEQ ID NO: 70 - DNA, 563 bp, Fusarium venenatum
  misc_feature (1)...(563): n = A,T,C or G
gggtaccaagctcttctgtatctctggccacgtcaacaacccctgcaccgttgaagaggagatgtcaattcccatgcgtgagctgatcgataagcactgtggtggtgttcgaggtgggtgggataaccttttggctgtcatccccggtggttcttccactcccgttcttcccaagagcgtctgtgatgaccagctgatggactttgatgccctcaaggatagccagtctggtctcggtaccgccgctgttatcgtcatggataagagcaccgatattgtccgagctattagccgtctcagccacttctaccgtcacgagagttgtggccagtgcacaccttgccgagagggtagcaagtggacagagcagataatgaagcgattcgagaagggtcangctcgtgagcgtgagattgacatgcttcangagcttaccaagcagggtgagggtcacactatttgcgctcttgggtgangnttttcgnctggcctattcanggncttatccgacattttcgacctgagcttgaggctcgtatgccaaaagtcgttaaggaaaaccg

SEQ ID NO: 71 - DNA, 595 bp, Fusarium venenatum
  misc_feature (1)...(595): n = A,T,C or G
tcaggtataccaggtttaccataacggtttgacntatcccaaaagcagcatccgagctgcctaacggaatcggcggccgtgtctacctgaacagtacgggcgccgtttttacagctaaaatcgtgcttcctgaaactgtcaaaaacaacgactcggtctctactccctatatttattctggctttagggcaacaagcggaactgaagccgatatcgggcttcagtacagcaaacaatacaacgtctggaagcccctcatgaaggttgggtccaaaaatgaagaaacgtacatcgaaggaaaagacaaattcacatacaataaaggcttccgccctggaagcacagtccaaatgacaatctataaaaatttaagcggcaatacgcgcatgaccctttggggaacgaacaatgacggctacaccggacggattatcacagaaattcaaggaaccaacatcggcacgatttcaaaatggaaaacacttgctaccgcggntgtttcgtntgaaagccagcgtgatgccgatcaaaagcaacctttttcgacccttttttaacaacattncttntccgacaataaagcccgcccttcttg

SEQ ID NO: 72 - DNA, 905 bp, Fusarium venenatum
  misc_feature (1)...(905): n = A,T,C or G
ctcctattcacgatgggtagagttattcgcaaccagcgtaagggtcgtggatccatcttcacggccaacacgcgcctgaacaaggctcccgccaagttcagaaacctcgactatgccgagcgccacggataccttcgaggtgtagtccgcgagattgtccacgatgctggtcgcggtgctcctctcgccaaggtcgtcttccgccacccctaccgattcaagcagactaccgagaccttcatcgccaacgaaggcatgtacaccggccagttcatctacgccggaaagaaggctgctctgaccgtcggcaacgtcctccccctcggtgagatgcctgagggtaccgtcgtctccaacgtcgaaganaaggtcggtgaccgtggttctctcggccgaacctccggcaactacatcaccattgtcggccacaaccctgatgagggcaagaccgcatcaagctcccatctggcgccaagaaggtcgtccactccggancccgaagaatgatcggtatcgtcgctggtggtggccgaactgacaagcccctcctcaaggcttctcgtgccaagcacaagttcgctgtcaagcgtaacagctggcccaagactcgtggtgttgccatgaaccccgtcgaccatcctcacggtggtggtaaccaccaacatattggtaaggnttctaccatctccgatacgccgcccaaggtcaaaaggccggtcttattgccgccgcagaacgggtcttctnccgtggtacccaaaagacaaaggagtaaagttgtggcttgggttcatggtctcattgggatggtgtttactgggctgcttgcatctattgaaggtactgccaaaancagatggctggtagctnaanaaggcaagcactatggcattttggcgcaaaaa

SEQ ID NO: 73 - DNA, 1043 bp, Fusarium venenatum
  misc_feature (1)...(1043): n = A,T,C or G
gcgaaacgacatccgtgtctttttctgcaagtacaacgaccccatttatgtcaaggttacaaagctggaactcatatttatgcttgctactgaggataatattgatgaggtgttgacggaactgcgagagtatgctactgaaatcgatgtccactttgtgcgcaaggcggtgcgcgccatcggtaagctggcgatcaagattgaaccagcggcacgacgatgtatcaacttacttctcgagcttgtggctaccaagattacatatattgtgcaggaagccacagtggttatccgaaacatcttccgaaaataccccaaccaatacgaatccatcatcagcactttgtgcgagcacctcgattctctggatgagcctgaagccaaggcagctatggtttgggtaattggtcagtacgcagaccgaatagagaacagcgatgctttgttggaagacttcctatactcatttgcggaggagcctgttgaggtccagcttgctttgctcactggtacagtgaagctcttcattcagcgacctaccaagggacaggagttggtcccgaaggttcttgaagtngggcaacagaggagactgccaaccctgatcttcgagatagagcgtatatgtactggcgtctcttgtcaacagacatgaatgcagccaggcaaattgtcatgggagagaagccagccattacggctgagtcggagagactagactcagcgacactggaggagatgtgcctgaatgtaggaacactagccacggtctatttgaagccggtgcagaccgttttcagatctgctcgaccacgcaaacttcaagactctccggcgttgcagaagcaaaacctccttgttgccggagacagccagaagantatcacatgtttggtaatgctggagcagcgacggatatcgacccaaggaccgaaaccccatgtcgggtgatgtcaggggaacctcgcncaggccgtcagcgacgccgatcctacttctcgggggatcggggacccaccagatgacgccaatgcntggtgatc

SEQ ID NO: 74 - DNA, 1084 bp, Fusarium venenatum
  misc_feature (1)...(1084): n = A,T,C or G
aacacccaagtcgtcgttgagccaataccgtcaagatggtaagttgaggcctatcgaaggggggtttccttgcaaaggagcttccttgatgttttccattctacggcagaaatgccaattgctcttggaagagtcaacgcaagatgcttcggaagaagagcaacatcccaagtcgtcgttgagccaataccgtcaagatgcctttccacaagttggtcaagaacagcgcgtactacagtcgctaccagactaagtacaagcgccgccagcagggcaagaccgattactacgcccgaaagcgccttatcacccaggccaagaacaagtacaacgcccccaagtaccgcctggtcgtccgcttcaccaacaaggacatcatctgccagatcgtcacctctgagatcactggcgacaaggtcttcgtctctgcctacgctcacgagctcaaggcttacggtatcgagcacggtctcaccaactgggccgctgcttacgctaccggtctcctcgtcgcccgccgtgccctcaagaagctcggcctcgatgaagactttgctggtgttgaggaggctgatggtgagtacaagctcactgaggccgccgagaccgacgatggtgagcgccgccccttcaaggtcttccttgatgtcggtctgaagcgaacctccaccggtgcccgtgtcttcggtgccatgaagggtgcctctgacggtggtatcctcgtccccactccgaaaancgtttccctggctacnatatggagaaccaaggactcgacgccgacacctccgaaatacatcttcggtggccacntcgctgantacatgganacctcccgatgacaataaganctttcccatcagttccaaaattttcagacaacnacgttgaggctgagggtcttgaggacctttacaccgaggcccatgccgccatccgngaggacccttacaagaaggccgagagcgacgctcccaanaaaaccaaggaggagtggaangagatctccaagaatacaggaacaagaagctcaccanaggangaaaagganaagcgtgtccaagaacccattcaagaaaatatg

SEQ ID NO: 75 - DNA, 2242 bp, Fusarium venenatum
  misc_feature (1)...(2242): n = A,T,C or G
agcgacaatcaaagctcantcgggtagctncatctngtnacttttgccggtcagccttttattagtcgtttttgcttctgccatcatcacatccttcccccgccattgctatatcctccgagcataactgttcatcatgtcctacgatcagtacaaccagaacccttaccagcagggcccagctcaggaaagctctcatggttacagccagaccaatccatatgcgcaagatgcgccagcccatggcaacaaccaatatgagatgcaagattactcgcaacaagctcctgctgccagctcaagtctttcgcaacaggaattcctaaaccgcgtccagaagcttcgcgatgagattaagggtctgaccactgacattgatcacattggtgtgcttcattcgcgaactctcggcagcactgatgggtccgcaaaccacgagctcgagcagtatgtctctcagactcagattcgcaacactgccatcaaggatggaatcaagggactagagcgcgatcttgcaaagaccaatgacagctctcgcaccacaaagaacacccagttgcaatctctcaagaccttcttcaaatctgagctcgacaagtaccagagcgtcgagcgcgattatcagcaacgataccgtgatcagattgctcgtcagtaccgtattgtcaaccccgatgcatccgaagaagaagttcaagaagccgccaatgccgattggggtaacgagggtgtcttccaaactgctctgcgaacgaatcgcaccggacatgccagctccgtgcttggtaacgttcgcgcccgtcacagcgagctccagcgtatcgagcagactctctccgagcttgctatcctctatcaggagcttgccactattgttgagcagcaggagcccgttgttcaggccgccgaacaaaacgcgatgaacactaacgagcacatgattaaanggcaacgagcaagtcgaagttgccaagaagcacgcccaagaaccgccgtaagctcaagtggagggcgctctcgacgtcctacttattatcatcgcatgccgccacggntggtgtngtgacaangtaacaccacatcaacatctagaagatcgaggtccttgttgaacatgcccttggtcttttcgtgaaggggccagttgatggtancaatatcacactgagcgagcatctcctcaagagtgtcgacgcggcggcagccantctccttctcggtctcagaagaaaggggctggtagtcgaagtagagaagctccttgcattcgaaaggcttgaagacggcggagacacgtcaccgatgcggccgacagcgacagtaccgacaaccttgccctcaagatcaaactcctgttagcagcgtgggcgacatcccattcaccagcctcaatctgttcgtgggcagggacgaagttgcggatgagaacgaggatggtcatgagaacgtgctcagcaacggatacgacgttggagccagtgacctcagcgacggtgataccgccgttggttgtgttggcagcgttgaggtcgacgtggtcggagccgataccagcggtaacagcaagcttgagcttcttggccttggccagacgctcagcggtcaggtaaccggggtggaagggagtggtgatgataatctcagcatccacgagctcctcgtcgaacttggaaccctcacggtccttgtcggaagtggtgacaagagtgtgaccttggtcctcgagccacttgcggatgccgagctcgttctcagtggttccgagaaggaggggttgatccttggcgtgctggccaccgtcgtagagaactgcaagaaccttgaccattttggcggttgtgaaaagggttgtttgttttgttggaaaggtgagaagaaggaagaaagatgatgatgatgatgagagtgaggaggaaagaaagtagaatatcgagggtccaatgccagatatttatgctctcgatggaacaccatgactatgtgtcttgtcaccaagtaacgggcacccagtgtgtaacggatgccctccacacgagcaacacggaaacagccaaggatccacatctcacacactgcagtgcaatgaatggattgtgcatgttcgccatgaacggnatagnacccgtggcccggtcgaggtcgcccaagactngctcccccaccctaacaagggatttcccttcggttccccgaaatcccaaacctgntggnctttttaacccaagaaggggcnaggggn

SEQ ID NO: 76 - DNA, 1131 bp, Fusarium venenatum
  misc_feature (1)...(1131): n = A,T,C or G
cgccgcctttcaaaacatcattcgagtttgagccctcttgaaagntnttgtcaancgaatacccaccaacaagcaacgcttttttcagcaccccgcttgtttacatctttcgcacctgtcgctacaacaccacagacacaaccatcaaaatggctgagcagcagacccctaccttcaagctcgtgcttgtcggtgacggtggtaccggaaagaccaccttcgtcaagcgccacttgactggtgagttcgagaagaagtacatggccaccctcggtgtcgaggttcaccctcttggcttcaccaccaacttcggtcagattcagttcgatgtctgggataccgccggtcaggagaagttcggtggtctccgtgacggttactacatcaacggccagtgcggtatcatcatgttcgatgttacctcccgtatcacctacaagaacgtccccaactggcaccgtgatctcgtccgagtttgcgagaacatccccatcgttctctgcggtaacaaggtcgatgttaaggagcgcaaggtcaaggccaagaccatcacttttcaccgaaagaagaacctccagtctacgatatctccgccaagtctaactacaactttgagaancccttcctttggctcgcccgcaagcttgtcggcaacccttcacttgagttcgttgctgctcccgctctggctccccccactgcccaggtcgacgagaagctcctggaaggagtaccgcaaggagatggacgaagccgccgccatgcctctgcctggtgagctttccgacgacgatctgtaaatgactcgtgcgttcacggaataactttcgttgaggaggatgctggcaaagtgtccaaggaacggtgcattgggcagtgtttgaggatggcacataggcagccggaacgatcatttatgagtacaggacggaagtnctggagtttacagcagcgtgattatggggcggcacaaaagactggccgtcatgcctctctttgggggttacaagggacggtgtactgcaaagagcagtgtcttatttagtttagctagacttcctccaccaaaacaataaacagggccaagtttgcgtggcttggctaagacagcgaactttgaccctttgatgg

SEQ ID NO: 77 - DNA, 1264 bp, Fusarium venenatum
  misc_feature (1)...(1264): n = A,T,C or G
ccgagaatctttctgtatattaatcctccctgatactactcctccatctaaatatttcatctcttcctgtctttgtcttgcgcattatacccagtcctcaacttctttactacatcacactcagttacatcatagcaaaaatgggcgtcaccgaccgcattattcagattggaggccagatctctggtaacccgaccgctggcggtcgtgagaagatcctacagaagaaccccgatgatatcgtcgtcaccgccgcctgccgaagcgcattcaccaagggaggccgtggtggtttcaaggacacacacgctgctgatttgatggccggagtcctcaaggctatcctcgaccgttcaaagatcaaccccgccctcgtcgaggacctgtgtgtcggaactgtgctcgcccccggtggtggtgctactgagatgcgagctgccagcttggtcgccggtttcccagagtccatcgccgtccgaactctcaaccgacagtgctcttctggtctccaggctactgtcgatgttgccaaccagatcaagactggcatgatcgatattggtatcggtgctggtgttgagagcatgtctatcaactacggtcctggcgctgtcgctgagttctccgaggaattcgagaaggtccctgaggctgccaactgcaaggtccctatgggtgttctgtccgagcagatggccaaggatctcggtatcactcgacaggcgcaagatactttcgccgccgcatcataccagaaggccctcaaggcccaaaaagagggtctctttgatgaggagatcgctcctttcaaggtcaagttcgaggacaaggagggtaacaccaaggaaatcactgtctccaaggatgatggtgtccgagaaggcatcaccgtcgagtccctcggcaagatccgccctgcctttgctaaggacggatctatccacgctggtaacgccagtcagatctccgatggtgccgctgctgttcttctcatgaagcgatctaccgctganaagctcggacagaaaantatcggcaagtacgtctgcgcctcaattgtcggtgtcaagcccctcctcatgggtcangggccctggaaagctatccctaaggctctcgacctcnctggtatctccaaggatgatttcaaccttttggagatttaacaaggcttttgccagcctttgcttgtggtcgccacaactggtttnccccnaaaaaattancccanggaagtgccntgccttggtccccccttgggtgn

SEQ ID NO: 78 - DNA, 876 bp, Fusarium venenatum
  misc_feature (1)...(876): n = A,T,C or G
acgagttcggcttcaccgatcagatgggttaaggggtgagatcagcgccctctctggtggttggaagatgaagcttgccttgtgccgtgccgtctttgaggctcccgatattctgttgcttgacgagcctaccaaccatttggatgtgaagaacgttaagtggctcgaggagtacctcaagaactctgcttgcacttctatcatcgtctctcacgactctggtttccttgacaacgtctgccagcacatcgttcactacgagcgattcaagctcaagcgttacaagggtaacctggctgctttcgtcgcccgcaacccctctgctaagttctactacgancttggcgagtccgagatcgaattcagcttccccgagcccggtttccttgaaggtgtcaagaacaaggccaaggccattctccgtgccaccaacatgtccttccagtaccccggtacctccaagccccagatcagcgacatctccttccagtgttctctgggatctcgtattgccgttattggtcccaatggtgctggcaagtctactctgatcaacgtcctcactggtgaactcatccctacccaagggtgagatctaccagcacgagaacatccgtatcgcctacattaagcagcacgctttcgctcacatcgataaccacctcgacaagactccttccgagtacatccagtggcgattccagactggtgangatcgtgagaccatggaccgtgccaacaagatcatcaccgaagctgatganaaggcatggacaaggtctccgcattgaaggtaccagcgactgtcattggtatcaacagccgaanaaantcaagaatcttacaatacaatgttctttcccccccggngaaaac

SEQ ID NO: 79 - DNA, 822 bp, Fusarium venenatum
  misc_feature (1)...(822): n = A,T,C or G
attagattatacgccaatctattgggagactgccaaaatgtcgaaaatcacagtcgctaatgtccggacccaggtcggagagctccttgagtactccaatgagaccaagaagcgaaacttcctcgagaccgtcgagcttcagatcggcctgaagaactacgacccccagagagacaagcgtttctccggctccatccgtctcccctccattcctcgccccaacatgtccatctgcattctcggtgaccagcacgatatcgatcgtgccaagcacggtggtgttgacgccatgtctgctgatgacttgaagaagctcaacaagaacaagaagctcatcaagaagctcgctcgcaagtacgatgctttcgtcgcttccgaggctctgatcaagcagatcccccgtctcttgggtcctggtctgtccaaggccggaaagttccctacccccgtctctcacgccgatgatctcactggacgtatcaacgaggtcaagagcaccatcaagttccagctcaagaaggttctctgcatgggtgtcgccgtcggcaacgtcgagatgacccaggagcagcttgttggtaacatcatgttggccatcaactaccttgtctctcttctcaagaagggctggcagaacgttggaagccttaccattaaggcttccatgtctccccccaagcgcctgtactaagtgtgtttctttggccttcgcctgagatggttcggcaattgagttcgctgaaatgtggacggtagcgtagactaggatggcaggaaaaataaacaatacgagacaaaccacnaaaaaaaaaaanaaaaaaa

SEQ ID NO: 80 - DNA, 987 bp, Fusarium venenatum
  misc_feature (1)...(987): n = A,T,C or G
tgaggacttcactatgtccatcacccgtgcccgtttcgaggacttgaacgccaaggctttntctggcaccatcgagcccgttgcccaggtcctnaaggacgccgntatcganaagaaggccgtcgacgagattgtcctcgtnggtggttctacccgtatccccaagatccagaagcttctgtccgagttcttcgatggcaagaagctcganaagagcatcaaccccgatgaggctgttgcttacggtgccgccgtccaggccggtntnctctccggaaaggccacctccgntgagaccgccgacctcctcctcctngatgtcgttcctctgtctctcggtgtcgccatggagggtaacatcttcgcctccgttgttccccgtggtaccacctgccccaccctcaagaagcgaaccttcaccactgttgccgacaaccagcagaccgttcagttccccgtctaccagggtgagcgaaccaactgtgaggacaacaccagcttgggtgaattcacttttgcttctatcccccccatgcgcgccgggtgaggccgtcctcgagtgtgtcttcgaggtcgaatgtcaacggtattctcaaggtcactggttccgagaagaccttccgggcggagcgccatcatcaccatctccaactccgtcggaaagctcaccaccgacgagattgagaagatggtcaacgaggctgagcagttcaagagcaacgatgatgctttccagaagaagttcgaggctaagcagcagctcgagtcctacattggccgtgttgaggagatcgtcttcgacccactctgtccttnaagcttaagcgtggccagaaggagaagatcgagagcaccatctntgatgccatggncggtcttgagacaacgagagcccgctgaggacttaanaagangagcttggcctnaagcgttttgttacaanggcatntcctccgntaaatgcncaaaattgttgggattganngg

SEQ ID NO: 81 - DNA, 650 bp, Fusarium venenatum
  misc_feature (1)...(650): n = A,T,C or G
agaaggtcttctggactctctacactctcgactgtttctctgctgctactcttggtcttcccaagcttctcaaagaggacgaaatccagactgaatacccatgcgacaccgacgatgagtatgtgactgagaaaggctttcagcctactctccctggcgagtatactcgcttgtctaatgcactggccctgtttcgtgcgacgcgaattcttgccaaggtactagagaagaactaccccgcctcaagctcctacgagatatctcttcaacagatggcttctcttgagagtgagctggatgcttggtaccatcagctgccttctcatctgagactcaactttgttcaagacaaaccgtcaacagatgtgactggcagtcgctcgcctctattagctctggcttattactacatccgcacgctcatctatcgtcctgccgtgggctccagtctaggttccaaggcggcatcagccctgatatcaatcggatcatcgagtaagcacatggttcagattcttcagctgcttgaagagcgtggcatgactttctcattctgcctgaacaagactgatctactgggtgatctgcggcatgacgttgctctaccactcaattgatctcaaacaagacagtaagataatgcgcgagnc

SEQ ID NO: 82 - DNA, 1037 bp, Fusarium venenatum
  misc_feature (1)...(1037): n = A,T,C or G
gctcgacacttttccacctcttcatcacccaccggtcctgtctcaaagcaaaagcccgacatggcctccaactacaccgtccgcaagggttgcggctcccaacaccctcgagcaccgagtctacatcgagaaggatggacagcccgtctctcctttccacgatattcctctctatgccaaccaggagcagactatcctgaacatggncgtggagattccccgatggaccaacgctaagcttgagatctccaaggaggagcttctcaaccctatcaagcaggatatcaagaagggcaagcttcgatacgtccgaaactgcttcccccacaagggttacctgtggaactacggtgccttcccccagacctgggaggaccccaacactgtccaccccgagaccaagggcaagggcgacaacgatcctctcgatgtctgcgagatcggtgagctcgtcgggtacccccggtcagataaagcaggtcaaggncctcggtgtcatggctctnctcgacgaggaggagactgactggaaggtcattgtcattgatgtcaacgaccctctcgctttcaagcttaacgacgttgaggacgttgagcgacacctggccggncttttccgtgccaccaaagagtgggttccgtatntacaagaattcccgatggcaagcccgagaacaagtttgccttaactggcgagtgcaagaacaaggactacgctcttgacgttgtccgcgaagtgcgcttgaggcttgggagcgtctcgtaactggcaaaaacccctctggcggtgtttcaccacaaacgtcaatggcagcaatctcttctcgcgtaagcctgacaagcttcttctctgcttgctaaaaaggagctcccgccgagaagatcgacgcttcattgacaagtgggtcttcatcagcggngcctctgcttaagtgttatagaccatcttgcataaaaaagaacaatttngatnggcatctaagtnttacaaaaagttgagcataaatgcttngagcaatgtaaaacattgatgcccc

SEQ ID NO: 83 - DNA, 871 bp, Fusarium venenatum
  misc_feature (1)...(871): n = A,T,C or G
cgtgaacttggcctcgagtctgacggcaaggataagcttgtcgaaaagttcaaggagaaggcaaacaatcttgccatgcccgaagctgtacgcaaagtctttgacgaggagcttaacaagcttgctcatcttgaaaccgctgcttccgagttcaacgtgacaagaaactatctcgattggcttacccaaatcccctggggcaggaggagtgccgagaactttggcattcatcacgctgtcaagatcttggatgaggatcaccacggtctgaaggatgtcaaggaccgcattttggagttcatcgccgttggtaagcttcgaggcactgttgagggcaaaattctctgctttgtcgggcctcctggtgtgggtaagacgagtatcggaaaatctattgctcgtgctctcaaccgagaatactaccgattcagtgtcggtggtctcacggatgttgcttgagatcaaagggtcacccgaagaacctacgtttggtgccctgcctggtcgtatgatccaagctttgaagaaatgtcaaactgagaacccctttgatacttgattgacgagatccacaagaatggtagaggttaccaaggtgatccttcatccgctcttgctcgaattgctcgaaccccaagcagaacaactccttcttggatcactacatggatgtgcccgtggacttatccaaggttctgtcgtgtgcactgccaacatgacagacactatccctcgccctcttttggaccgaatggaactcatcaccctctcangatatgtcgctgacganaagatggccattgntcaacgctatcttgcccctgtgntaaggaactggtgganttcaaaagccgatncacttttgagcgag

SEQ ID NO: 84 - DNA, 844 bp, Fusarium venenatum
ccctcccacaaccaactccgcccagatcaatcaacaatccgacaaaatggcgcgccgtcccgctcgttgctaccgatactgcaagaacaagccgtatcccaagtctcggttcaaccgtggtgtccccgaccccaagatccgaatcttcgatctcggccgaaagcgcgccaacgtcgatgacttccctctctgcattcacctcgtttccaacgagtatgagcagctgagctctgaggctcttgaggccgcccgtatttgcgccaacaagtacctggtcaagaacaccggtaaggagggtttccacctccgagtccgtgctcaccctttccacgtcgtccgtatcaacaagatgttgtcttgtgccggtgccgatagactgcagaccggtatgcgtggtgcctggggtaagcccaacggcactgtcgcccgtgtcaacattggccagattctcatgagcgtccgcactcgtgatgctaaccgtgccatcgctctcgaggccctccgccgatctcagtacaagttccctggccgacaaaagatcattgtctccaagaactggggcttcactcctctccgacgtgaggagtaccttgacaagaaggctgccggccgcgtcaaggtcgacggtgcttacgtccagttcctctccaaccacggttctcttgagcgcaacatccgtcgtttccccgacgctttcaagtctgaggcttaaaggaatgattgataggatggaatatgggttttctggcgtcaaaatggcttgtcaaataaggacctcttaaaactcgctagttacagggcgtcgattaggcaaattgaaatcttacattcagaactggacttt

SEQ ID NO: 85 - DNA, 805 bp, Fusarium venenatum
  misc_feature (1)...(805): n = A,T,C or G
tacgcaactgggctatctatgcacgaaagcatcgtcctcaggatcttcccgtggagaacctgacacatattctttactcgttcgctaatattcgtagcgactctggcgaagtccatctcaccgactcatgggccgataccgatattcattgggatggagattcctggaatgatgtcggtaccaacttgtacggttgcatgaagcagcttaacctgttgaaaagacgtaaccgaaaacctcaaggttcttctcagtattggaggttggaccttcagtagcaacttcaagggccccgctagcacaccccaaggacgtgacacattcgccaagagctgtgtcgatctgatcaagaacctcggttttgacggtatagatatcgattgggagtacccccaggatgccaacgaggctagaaactatgtcgaacttctgggcgccgtgcgtcatgagatggatgcatatgcacagacattgagccaaccttatcactttgagttgactgtggcctgtccagccggtgcgacaaacttccagaagctcgatatccgtggaatggatcaatacctcgacttctggaacctcatggcttacgactatgctggttcttgggaccaaactgcgggtcatcaggccaacctgtacccatctcacgacaacccantatcaaccccattctctacctctgctgccatcgacttttacgtcccagcggtgtgaaccttcaaanatagttctcggcatgccactctacggccgaacctttganaacaccgacggtcccngccgccctaccaaggcttngaca

SEQ ID NO: 86 - DNA, 628 bp, Fusarium venenatum
  misc_feature (1)...(628): n = A,T,C or G
acgccgtgcaaactcatcgatctaggaaacggcatgatccctgctcttgaaaaccgagccaccccatcgcttgccgataacaccaaatctttcgaaattctacttgccgaggacaacaccgtcaaccaacgattagcagtcaagatcctcgagaaataccaccacgtggtaaccgtggtaggcaacggctgggaagccgtcaaagctgttcaacgcaagaaattcgatgtcattcttatggatgtacaaatgccaatcatgggaggtttcgaggccactggcaagatccgagagtatgagcgtggcataggaagccaccgcacacctattattgctctaacggcccacgccatgatgggcgatcgagagaagtgcatccaggctcagatggacgagtatttgtccaaacctttgcagcaaaaccacctcatccagaccatcctcaagtgtgctactctttggtggtccatgctcgagaagaatcgtgaacgcgagtggcgctccacgccgaaacgaaatcgaanataaggaagangccaggcttgntgngaccgacactnganagccgngcttnacgagtcgnagccctatggggaagggaagganagcctgcattttgcaccgggaa

SEQ ID NO: 87 - DNA, 993 bp, Fusarium venenatum
  misc_feature (1)...(993): n = A,T,C or G
cttgtccacaccatctctttctccctcacccgcgccctacgcgcgatctgtgtctactccagatttggacgttgacttctgcgacccaagaaacttgactgtcggtactggcgctatcaacagcactcttgctcctgagttctgtgccgacgagatcaaggttgagcccaagatcgcttctcagtcgtttgacttcaaccctgctgctcacggcctccccacctttgaagacttttccgagtttgactctgaggacgacttcgtcaacagccttgtcaaccttgctgagcagcctgccaacgcctctactgacattactcgacctcgtgcctgcaccggttcttcggttgtctctctcggccacggtagcttcattggtgacaaagatctatcctttgacaanaacgaagctttccaatttccttcccancctagccctccttccacctgcgcttccacctgtgcttctgaagactgccaccagaaacaagcgagtcaagaagtcccagtccgaggagcgccacactgctcccgccatgaacatcgctgcttccgctgccgactctggcaacgcccaggagtcccccaaccaggctgatgagggtagcgactctggtgcctcctctggttccgagggttctcctgctcctctccctgctcctgccaaccgccgaggacgcaagcagtccctcaccgaggatccctccaagactttgtctgcgatctttgcaaccgtcgtttccgccgtcaggaacacctcaagcgccactaccgctctctccacactcaaganaacctttgagtgtacgagttggcaagaattctccgaacgacacctggccacatgcccgaaccacgcncgtgccatctcanaactgatgananatctctgctacgtgctctatgtgttgcgccannatatataatacggnagtctctcaatgctcgagtctgcgcgcatgaantttcganagganacagacaaaaancagg

SEQ ID NO: 88 - DNA, 1157 bp, Fusarium venenatum
  misc_feature (1)...(1157): n = A,T,C or G
ctaaataacataaacagaattattaatctcgtctcttatgtctaaatccaccagcttggaaccgaattaaatgaaatgtattgacaagcggtaggtactaaaaaaanaaacatggtcgccaattcccggttcagccttagatcccccgnggagatgctctaaccataaaccccatcagaccactgacacggccatcagcgctgtactagggactacnaaatattgttttcttcgttttcgcatcgcatgatgattatggcgctgggaatcatgagaataacagaatcatgtttctccgcgccttcaatgcttctccgggggacgatataaagtcggcagtatagacacaattaacctacaacaggcacaataaacaaacagcacatacagaacagacaccataccgtcagtacagaaacacacaatggctctcacagcagcacaagtagctatcgtcaagagcacagctcccattctcaaggagcatggcaagaccatcactaccacattttaccgcaacatgctcggcgcccatcccgagctaaagaactacttctcccttcgcaaccaacaaacaggcgctcaacaagctgctctcgcaaactccgtcctcgcctacgccacatatatcgatgatctcggcaagctgtcccacgccgtcgagcgtatcgcccagaagcacgtctccctcttcatcaaggccgagcactaccccatcgtcggcactcatctcatcgggccattggtgaagtcctcggttctgctttaaccactgagatcaaggatgcttgggttgctgcgtatggccagctcgcagacatctttatccagcgtgagggtcaagctgtatgatgctacaggtgaatggaactcatggcgcaagttcaagaattgccaagaaggaggctgagaacgactctgtcaccagcttctaccttgagccttttgatgaacaagcctttttccaagttcctttcccggacaatacgtcagtctggnaaaattctatttctgagcttgatggtctttttcaaagccgcaagttaagtctggagcgagggcccaggatccaacccttccggattagnggtaaagcttcangggccanaggaggacctttcattgaanatttttcgttggggnangggccccggntt

SEQ ID NO: 89 - DNA, 858 bp, Fusarium venenatum
  misc_feature (1)...(858): n = A,T,C or G
gagctgttggcgatagcaacacgacacgtcgtcggcctctcaatcaccgaattcccatctcccatctcttatacagtgaatatggccaaccctccacccattgtcctcgatggaggtaccggtttcctcaaagtcggatatgccgcgcagaactttcccgagcatcaatacccttccatcgtcggccgaccgatcctgcgttcagaggagcagaccgatngcgatgttgtcatcaaggatatcatgtgcggtgacgaggccgccgccgcccgaacaatgctccagatcagctaccccatggaaaacggtatcgtcaagaagtgggatgacatggagcatctttgggattacactttctacgagaagctcaaggtcgatccccagggccagaagatcctcttgacggagcctcccatgaatcctcttaaaaaccgcgagaagatgtgcgaggtcatgtttgatagatatggattcggcggtgtctacgttgcaattcaggccgttttggctctttacgcccaaggtttgaattccggtgttgtagtcgactctggtgatggtgtcacacacattgccccgtctacnaatccggggtcctcaaccaccttacgaagcgattagactttgccggccgagacgtcacgcgcaacctgatcaagcttgttgctgcgccgnngctactctnttaacccgaaccgncgnatttcganactgtcccgccaaatcaagganaaactatgctacntgtcgnaccaaccttnaactcaaaaagcccttgagtgaggataccaccnttcttgtcgangattacantntgccggacggacgngtgatcccggtgggcagagagcgttttga

SEQ ID NO: 90 - DNA, 709 bp, Fusarium venenatum
  misc_feature (1)...(709): n = A,T,C or G
caacaaggagttcaagagaccttgcgatcttacaaagcacgagaagacgcactctcgcccttggaagtgccccgtcgcaacttgcaagtaccacacctatggctggccaactgagaaggagatggatcgtcaccataacgacaagcactctgatgcccccgctatgtatgagtgttcgttcaagccatgcccctacaagtcaaagcgtgaatcgaactgcaaacagcacatggagaagctcacggctggacctatgtncgaaccaagaccaacggcaagaagctgccgtcgatcgctggtagcgttcaacagcaaactccccctctgggcaacatgtctacaccatcttcaatcgactacaacaatgtcccacgcctccacaaaacgactgacacaattcatgggcaacgactttcctctttaccccaccgactctgactggatgtcagttaacaacatcccctctgaggcaatgcatatggatctgactcttgattcgacttcgcctgcttctgctagttcctacgaagcagtatgcaccatatcaaaacggttcagcttttatccttgacaacgaagatctttacgctgctactatgcaacttccggctcagttccctcgcctgagcaagttggcatgtncggtaaccctaagatgatgcaacagcagctgcccatgttccagcaaagttcctcaacagattcctca

SEQ ID NO: 91 - DNA, 980 bp, Fusarium venenatum
  misc_feature (1)...(980): n = A,T,C or G
atctctccaacggttcacacacaagccagcaaacatggcggttggaaagaacaagagactctccaagggcaagaagggcctcaagaagaagacggtcgaccccttctcccgaaaggactggtactcgatcaaggcccctaaccctttcaacgttcgagatgtcggcaagacccttgtgaaccgaaccactggtctcaagaacgccaacgacgctcttaagggccgtatcctcgaggtctctctggccgatctccagaaggatgaggaccactccttccgcaaggtccgcctccgtgtcgacgaggtccagggcaagaactgcttgactgctttccacggtctcgacttcacctccgacaagctccgatctctcgtccgcaagtggcaaactctgattgaggccaacgtcactgtcaagactaccgacgactacctcatccgcctcttcgccattggtttcaccaagcgacgaggaaaccaggtcaagaagaccacatacgccgcctcttctcagatccgagccatccgacgcaagatgaccgacatcatncagcgtgaggcttcaagctgcactctcacccagcttacctccaagctcattcccgaggtcattggccgcgagattgagaagtccacccagggcatctaccctctccagaacgtccacatccgaaaggtcaagcttctcaaggcccccaagttcgatctcggtgccttgatggctctgcacggcgagtctggtaccgacgaccagggccagaaggttgagcgggagttcaaggagcgtgtccttgaggaggtttaaaaggattattttggcaggttggcgcggggtaggcaatagggcctcgcggcgaataaactcatccctaccaaattttttcggtcgtccaaatggcgtagcatcacaaaagggagctcgggggattggttcatgttcctttgaatggtaaaaacaaacgttcagtcaacccaaaaaa

SEQ ID NO: 92 - DNA, 1549 bp, Fusarium venenatum
  misc_feature (1)...(1549): n = A,T,C or G
ccattatccccccttactacatacctattcaataacactgactatttcatcacttgtaccttacaatatgcgtctgatcatccgtgatgacgagaccgaggcgtgccggtatgtcgccaactacgtcgtggatcgtatcaatgccttccaccccacgcctgagcatcctttcattctaggtttgcccacaggctctagtcctatcggcgtctacaatgagctcgtgcgcagctacaaggctggccaagtctcgttcgagaatgtagtcaccttcaacatggacgaatacgtcggtcttcctcgggacgatcccaactcgtaccactcattcatgtggaagcacttcttctcccatgtcaacatccatccttccaacgtacacatccttgatggtaacgctgccagccctgaggctgaatgtgatgcgtacgaagaggctatcaaagccgccggtggcatcgatctgttccttgctggcattggtgaaaatggtcatatcgctttcaacgaacctggatccagtcttgccagccgcaccagaatcaananactagcctacgacaccatcctttctaactcacgcttctttganaatgatgtgagcaaagtgccaaggatggncttgactgnaggcgtccagactgnccttgaagcgagagaaagttggtgcattatcctgggagcccgcaggnacttgntttacaaaaagggggtcgaacagggcgtcagccacatgtggtcactatcatgcctgcaaatgcacccacatcccatgattgtcgtcgatgaagacgccacactagaactacaggtcaagacagtcaagtacttcaagagtatcgagaaagttgctcgcgagcagggattcgagcagattctcccctcaaaagtacgaactggcaacgtcgccatccccgaaaccaagatccatagaacccagagccccgtcatcatcgctcccgagcctatcgcctcgcaccttttgcgcgcaacacccatgggtgactattctatgagaacaccctcgcccgacctattgccggatcgcatggcttcacgcatcccggaaccaaacttgaaccgcagacttacaccaaatcttgaagttcagaccgacgttcctaagacaaaggttgatatgatcgatagcgcggttgccatgtctcccgaacttgcctctgatttccttcagccgccgatgacaaagacaatgcggtctccttctcctgacctagttccggatcgcatggcttcgcgtatccctgaaccaagtctgaatggcagattgacgcctaaccccgaattgtaggatggaatgaatactggtgaactttattaagtggagaagaataaggatgtcnagtcantaggaagatggcgtagtagaaatggagattaggactgtatcaatatcggtatatcaaaacaaatgaccttattgcatgcctaccaggtaggccgcatgaaaactggcgctgattaaagtaggttatagaaatattagatcatctctagtgtgtagctagcctaagagtgtctaatattttcg

SEQ ID NO: 93 - DNA, 1670 bp, Fusarium venenatum
  misc_feature (1)...(1670): n = A,T,C or G
tctcaacctccaaaaattcccatcttcttactcaacctcaacttcttaactttcttttccgttacgcttcctcttttctatcaaaccgatacccaaaatcttccacaatggctactgagcgtgaaagcaagaccttcctcgcccgcctctgcgagcaggctgagcgctacgatgagatggtcacctacatgaaggaggtggccaagctgggcggagagctcaccgtcgacgagcgcaaccttctcagcgttgcctacaagaacgttgtcggtactcgacgtgcctcgtggcgcatcatttcctcgatcgagcagaaggaggaatctaagggatccgacaagcacgtttccaccatcaaggactaccgcaacaagatcgagaccgagctcgagaaggtctgccaggatgtcctcgacgttttggacgacttcctcattcctaacgctgccactggcgagtccaaggtcttctaccacaagatgaagggtgactaccaccgttaccttgctgagttcgcctctggtgagaaacgcaagggtgctgccaccgctgcccacgatgcttacaagagcgccaccgatgttgctcagactgagctcactcctactcaccccatccgtctgggtcttgctctcaacttctccgtcttctactacgagatcttgaactcccccgaccgtgcttgccacctcgcgaagcaggccttcgacgatgctattgccgagctcgactccctgtctgaggagtcttaccgtgacagtaccctcatcatgcagcttctccgcgacaaccttaccctctggacttcttctgacagcgctgagggcgaggccgccggtgctgcttgatgctcctaaaaaggaggagggcgaggctgcaagcccgccgaggagcctgctgaggaggctgctcctgctcctgcttcctaaatctatcaataatcccctngatccacatacgtctcggcatataagaaccgaaaagtattctcgcccgggtacactcgtctggccctggacacacggatagctgggactgtcttgggcnggctggatgatagtacgaggcttcttntttttgcgcngggcggtgctttttttcacgacgatggagagggaggaatggatcaaataagggtcttgactcttgggttctggtaaangggaaagggttgcgggcgcggaatctttcgtctcgtctcgttcgtcggactcttgaaaaaaatcgaccgccaacctctgatgatgacggctcttgtttttttcttttttacctggcagataaatcgcaaagtttcccccctttcaccttttgtccttggtctatctctggcacctagcatttgtgtatctctctcacttccgtcttgttgttcattaagaaagtggacagggcataccccatcccgatggatcgccacgaagaaggctttctcatgttacgcctttttctcccttgncccatgtcgtttatgtcttttcgttcctgtctatcggtcccttatcaaaccataccctagtgaaagaagacggatggagatgaatggttttctggtatttttctttaaaaaaaaaaaaccactttcccctaaaaaaaaaccttacattttttgctcacaggtaccgagaagagagactgttgctctatctcatttcgcttctttcctcctg

SEQ ID NO: 94 - DNA, 859 bp, Fusarium venenatum
  misc_feature (1)...(859): n = A,T,C or G
gcccctactgagaagggtcagacgcgagagactggattcgacatcaccgtcgctagtgagtgtatggctatcctcgccctcagcaacaacctggctgagatgcgcgagcgtctgggatcaatggtcgtagccacatcacgaggtggtgaccctgtcacagctgacnatcttggtgctggtggtgccctcactgctctcatgaangatgctatcaagcccaacctcatgcagactctcgagggtactcccgtctttgtccatgctggtccctttgccaacattagcattggacagactctatcctcgccgaacaagcttgcactgaagcttgccggtaccgaggctgaataaaaaccacaaggagaaggccggtttcgtcgttactgaggctggatttgactttaccatgggaggtgagcgattcttcaacatcaagtgtcgtacctctggacttgttcccgacgttgttgtcatcgttgccactgtccgggctctcaaggtccacggcggtgccccccctatcgctcccggtgctgccctcagccctgtttacaaggaagaaaaagtcaatatcctgcgtgctggctgcgtgaacctcaagaagcaaattgccaatgccaagtcttttggtattcctgtcgtcgtcgcaatcaacaagtttgcgaccgacacagatgctgaaatcgctgtcatccgcgaggaggctgtctcggctggtgctgaggatgctatcctgtctaaccacttgggctgagggtggcaagggtgcccgttgacctggcccacngtgtcattgcggcagctgataagcccaaggacctcaagttcacttacaaccttcnanggaacccntccaaga

SEQ ID NO: 95 - DNA, 1107 bp, Fusarium venenatum
  misc_feature (1)...(1107): n = A,T,C or G
ccaccgtctgcctcgacggtgaggtcctgaaggtctcgccccagggcaaggacatgtcttcgcacattgctccccctatgtcgcctcccattaagcctaccacttcgattgcccaggcctcagactccccacgagaccgccgactttctctgctgggtaacttccagcctctgaaccgcctccggggtgttgactctggtgctgttggtgccaatctgccttcgcccgctcgtggtgccgcccctgttgacnaactcgcccctggtctgcagctccaacctctggtcagctcgtcgctccaacagcttctggctcgaccttcgtcgttcaagaaactcacgttctgtccgtcaaagcttacagtcganctgatcttcatctgctcttcactgttgcgcanganatgcgtcttggtgtgcaacntgaaggtgtcttgaacatcctccgaagtcgtgtgttgacacactcttctacgaaccttctactcntacatcggcgtcgtttgatgctgccatgcaacgtcttggtgggcggnaccatcgccatctccacctctcactcttccgtccagaaaggtgagaccctccaggacaccctccgaactctggcttgctacggtgatgccgttgtcctccgtcaccctgaggagaccagcgtccacgttgccgagaagtacagccctgtccctgtcatcaacggtggcaacggcagcaaggagcaccctacccaggctttcctcgacctcttcaccatccgtgaggagttgggtactgtccagggtttgaccatcaccttccttggtgaccttctctatggccgacctgtgcactctcttgtgtacttgctccgccactaccaggttcangtccagcttgttgctcccaagtctttggctctgcccaccaaggtccgagagcagctcatcgcttctggccaacttctctgcgagtctgagactcttactcctgagatcctggctcgtaatgatgtcctgtactgcacacgtntngcagcgcgagcgcttccccagtgaagaagaataccacgggtcaagaactcttaccgcgtggacaaccttcgctcaancatgccaagaactcttgcatt

SEQ ID NO: 96 - DNA, 931 bp, Fusarium venenatum
  misc_feature (1)...(931): n = A,T,C or G
ccgagcctctacccccatgtacctcttatcgagaaagatcaaggccatgggtatcaagatggttctgagtggcgagggtagcgatgagatctttggcggttacctgtacttccacgctgcacccgataaggagtctttccacgaggaaactgtgcgacgtgttaanaacttgcatctatctgattgtctgcgagctaacaagtctacatctgcttggggtcttgaggctcgtgttcctttccttgacaaggagttccttgagtactccatgaacattgacccccaggacaagatgatcaccaaggagaagctcgaaaagtacatcgtccgcaaggccttcgatacttcagatgagcccgatgagcagccttatcttcccgataacatcctntggcgacagaaagaacaattctctgatggtgtcggctacggatggatcgatgccctcaaggacaccgctganaagcaggtcactgacgagatgatgaagaaccccaagcctgagtggggcaacgatattccctgataccaaggaggcatactggtcccgatgcatgtttgacgagcacttctccccttactgcgcgtcaactgtcatgcgctggactcccacctggtccaagcaagagtgaccctagnggccgagccattgntacccacaacgccaaatacgacaacgcggnttaatgacatagcgaatcgagtaaaacaccaagtagagaaaacttggcccactcattggaacttatactatctgaggtatctgncatgaacctgatctaaggagcaactntgggtgtcgtttnttggaggnanaaaaaaaggcgtntgggatttgcttaactaccttggaatgctgatgactggaaaaagggaccgatgatntgggcaaggaccctgggaataaaaaataaagacaaaagntnttaaa

SEQ ID NO: 97 - DNA, 1158 bp, Fusarium venenatum
  misc_feature (1)...(1158): n = A,T,C or G
cttggaacagaccttctctactgaagatgaaaggttcggagttctcaccaccgaggatctcattcctggcggtcgcgacattgaagtcaccaacgagaacaagaaggagtatgttgatctaatggtcaaatggcgaattganaaacgtatcgccgagcaatttcaggcttttaaggaaggtttccaagagcttattcctcaggatctcatcaacgtcttcgatgaacgtgagctcgagctccttatcggaggtatcgccgagatcgatgtcgacgactggaagaagcacaccgattacagaggatacaccgaatccgacgaggtcgtgcagaacttctgggcgacagtgcgatcctgggacggtgaacaaaaatcacgactgttgcaattcactactggaacctcacgaattcccgtcaacggattcaaagatcttcagggcagtgatggtcctagacgatttactattgaaaaggcgggagaaatcactaatttgccaaaggcacacacttgtttcaaccgactcgatttgccccttacaagancctagagatgcttcagcagaagctcacgattgccgtcnaagagactatgggtttcggtcaagagtagacaataacgacattaccttcagcagggacacttgaactggaaaggtttaaactacagtcaattgcactgccctgtattcaccacacaagagcgaccttctctggtctgccccattcctctctcatatacatgcaacaacatttgggtatttgctttggtcccaaagagggacagacttgggtcatatggcgctggtgaaattaattcgccttcaacatgcgatgcatcatctgattcttctcctggctcctcgagagaaaatggacgagattttaaacgggcctgccaatacaaagtgcatctcgccgacctgtttcgtggagaagaagaactttcgcaaacattgtggaactactangcatgcgccgggacagacnggtccttggctgcgatgntgctttgacgagcgatggaaaaagaaactgtacttagccatgtattacgtgccgttggcagcaaangcgaagccagcgtgtttgagcttggaagttaaaaanggcanggtnacaacgcttnatttcaactatttttttcatatnttgcaan

SEQ ID NO: 98 - DNA, 596 bp, Fusarium venenatum
  misc_feature (1)...(596): n = A,T,C or G
gaacgttggcatgaagaacgagcgatgggttcccatgatgactgctgacaacgcctggttgccccgaaacgaacttctggcttctcaccagaagatggttgctgatgttgatatgaaggaggcccttgcctctggtcagttccgacctctggtccgaaaggagattgagtctcactgcgccaacttcggtctcgacgctgagcttgtttctcactctcgtatgcgtggtctgtccggtggtcagcgtgtcaagactgtcttggctgcttgctcttggcagcgaccccatcttatcgttcttgatgagcctaccaactatcttgaccgtgactctctcggtgccttgtccaaggctctcaaaaagttcgagggtggtgtcatcatcattacccactctgctgagttcaccaaggacttgactgatgaggtcttggcccgtcatggacggaaggatgacttctttcggccacaactgggttcagggtcagggctctggtccccgtttcaagggttacgacngtgattaggangagaagttcgatgccttgggcaacaagattgtcaccaccataganaaaggcaagctgactttntta

SEQ ID NO: 99 - DNA, 593 bp, Fusarium venenatum
  misc_feature (1)...(593): n = A,T,C or G
gggaggatctgcagaatatcccactccatcccttgatccagcctgttcgtggtgtcgacatcatctttgccatcgattcttcagcgggatacggacaacaattggcccaatggtaccgctcttcgtgcgacatacgatcgtgtcgattccagcttaggaaacggaactcagtttccctctattccatcagctgagactttcattaatgagaagttgaaccaacgcccaacactctttggctgtgatgcagacaacttcacgctttcagacggcaaagctcctcctcctcttgtcttctacattcccaacgcgccctacacattcttgagcaatgtctctaccttcgatctctcatacagcatccctgagcgtgacagtatcattctcaatgctctgaacggtgccactcagggcaatggtactattgataaagaatggccacgtgtgtcgtttgtgccatcatganccgaattggtggaagtccaatgagacgttccaaagantgcagtactgttttgacagatacgctgggacggaaatcaataacacagctgttaagactacaacctggattatcattctaacaaaatgcg

SEQ ID NO: 100 - DNA, 836 bp, Fusarium venenatum
  misc_feature (1)...(836): n = A,T,C or G
ctgatatccagactgccgaggaggctcttgagctcatcaccgatgccattgagcaggctggttacaccggccagatgaagattgccatggacgttgcctccagcgagttctacaaggagtccgagaagaagtacgatcttgatttcaagaaccccgagtccgatcctaccaagtggatcacctacgaggagctcgccaacatgtactctgagctctgcaagaagtaccccatcgtctccattgaggaccccttcgctgaggacgactgggaggcttggagctacttctccaagacccaggacatccaggtcgtcggtgatgacctgactgtcaccaacccccttcgnatcaagaangctattgagcttaagtcttgcacgctctcttntcaaggtcaaccaagattggtactctgaccgagtccattcaggcttgccaaggactcttacgccgacggttggggtgtcatggtttctcaccgatccggtgagaccgaggatgtcaccatcgccgacattgctgtcggtctccgtgctggtgagatcaagactggtgctcctgcccgatctgaacgtctcgccaagctcaaccagatcctccgcattgaggaggagctcggtgaccaggctatctaccctggtaaggacttccgcaagtctgttaacctgtaaatgatggttatcgggtgtgtggaacaaaagccttgtgatgattatgatgcctttaggtcttcagccaggacgcgtgagaccatatccangatggcaaattgaaagtaatagaggcaaaaatagtaaaagccaactgatcaattaatgaaactttgattgaagttt

SEQ ID NO: 101 - DNA, 1380 bp, Fusarium venenatum
  misc_feature (1)...(1380): n = A,T,C or G
caactctctacatctcattcccaaccaaatctccacgtcttttgcagcctcctattccatcacgcccgacgactcatttctaccgatcttattgacttgtcttaccgcgacataacgagcagccgccatcatgaaccccgaatacgactatctcttcaagctcctcctcatcggagattccggtgttggaaagtcttgtctgcttctgcgatttgccgacgacacctacactgaatcctacatctccaccatcggtgtcgactttaaaatccgaacgatagaactcgatggcaagaccgtcaagcttcagatttgggataccgccggccaggagcgtttccgaactatcacctcttcctactaccgtggtgcccacggcatctgcgtcgtctacgatgttaccgacatggactctttcaacaacgtcaagcaatggcttcaggagattgaccgatatgccacagagggtgtcaacaaagctgctggtcggtaacaagagcgatatgtcagacaagaaggtcgtcgagtacagcgtaacccaggagttcgccgacaggctcggaatttcatttctngagactttcggcaagaacgccagcaacgtcgagcangctttnttggaccatgggccgtcagatcaaggagcgcatgggcaccaccacagccaacaacaccaagcctagtgtgcaagttcggtcaaggccagggtgttggctcttcttccaacaacagctgctgctaaatgcatttgcgctctcctttctcagtgaagcaggatgacggagtacagccggaaagatggatcatgctagggatacgaccagacaaattcaattacgatgtttgctttctaccttttctctcgtcgttccgcatagaccagatcataatcgctcggattatgcatttcgttactgcaattacgactcttattgccttcagtacccagaggaacggctctttccctctctacgcctgccacggaccctgacgctaaacgcggtggaaaatagacggagcgatattgattgtggggatggacttggagagggaggtttgcagatacggaggcaggtcctatgttcctgggcgggtggctgtggaaggttttgcgcacgcgcaagctgtattttctcgttttcttcctttgccgtgccttctatcacggaacgcaaacatcgaagggcatcttgtcggttcttgttctttttaacctgccattcattcgctggaaacatcattttgcgcaccctcgttctnccttttgccaatcctggtcttttgttattttgttagtctttttgagcccaccaagaagttacaaganaaaggttggtgcttanccggtttttnttacctggggttttgaaatcggggggg

SEQ ID NO: 102 - DNA, 579 bp, Fusarium venenatum
  misc_feature (1)...(579): n = A,T,C or G
cgccattgtcggatctcactcaggggtcaagacatgtcgatgggacaaaatcagctcttcgtggacgcggctcctgttacaaatggtcattctacggtattgcgagtcatcaatgtatggaaacaaccccttcgctctcctgctcgaacaagtgtgtcttctgttggcgccacggcacaaacccagttggaacaacatggcgatgggttgtggaccctcctgatctcatctttgacggcgtcaaaatgaaccattacaagaagatcaaaatgctgcgtggcatgcctggtgtgcgagctgagcgattcgccgaagctatgcagattagacactgcgctctatcgcttgtcggagaacccatcttctacccctatatcaacgaatttctcggcatgttacatgccgaacgcatttcctctttccttgtctgcaatgctcagcatcctgaccaacttgcggatctcaaagccgtaactcagctatacgtatctattgatgcagctgataaggaatcactacggagaattgacagacctcttcacaganacttctgggaacgcttcaaccgctgccttgaca

SEQ ID NO: 103 - DNA, 928 bp, Fusarium venenatum
  misc_feature (1)...(928): n = A,T,C or G
cgagatcagtctacctgtnccagcacgttcatcgactcgctgtagttttatctgtccaaattatacaatcgtccactcccaatcgtatcagtgttcaagcttgctcaaaatgagaccctccctcatcaagcccctcctaccccgccatacctgcttctctgccgcgagaacttcttcttctcttcctcaactctccaacacaatcaaatctgttagatttttctcagcttcatccgcagtcatgggtaacaaggttttcttcgatatcacctgggagggtcccgtcttccagaacggcaagcccacctccaccgttaaggagcagactggccgcatcaacttcaacctcttcgacgacaaggtccccaagaccgccgagaacttccgtgctctctgcactggcgagaagggtttcggctacaagggctcttctttccaccgaatcatccctgacttcatgcttcagggtggtgacttcacccgtggcaacggcactggtggcaagtccatctacggagagaagttcgccgacgagaacttcaccttgaagcacgagaagcccggtctgctctccatggccaacgctggccccaacaccaacggctctcagttcttcatcaccaccgtcgtcacctcttggctcaacggacgccacgttgtctttggtgaggtcgctgaccagcagtcccttgatgtcgtcaaggcccttgaggctactggctccggcagtggtgccgtcaagtacaacaagaaggccaccatcgtcgactgcggtgagctgtaaacagctcaatccgtacgacgtggcgagcgggaatttggaattgcataacaaaacctcactgagggctggcgacatggagctagttagtcacaggctagtaaaagcatctagctattgaacaatgtgaaccaataaacccaanan

SEQ ID NO: 104 - DNA, 670 bp, Fusarium venenatum
  misc_feature (1)...(670): n = A,T,C or G
naacatnaatcgatncccctttcccgcttgaactgagtccttatctnnggatataccttcattgaacctctgtcctactgtacctacctttcattcacttacaccagccttcaacatgaccaccgagtttcttcctgcttcagccagctctgcttacgattacattatcgtgggtggtggcacggctggttgtgttctagcttctcgtctctctgcctacctccctgagcgcaaggtccttgtcattgagggtggtccctcggacttcggtctcaacaatgttcttaaccttcgagagtggttgtcgctcctcggtggtgacctcgactacgactaccccacaactgagcagcccaatggcaacagtcatatccgacactcgcgagccaaggttctcggtggttgctcctcgcacaacacccttatcttcttccgcccttccgccacgatatggaccgttgggtcttcaagggttgcaagggatgggactttgaaaccgtcatgcgcagggtcgacaacctgggcaaccaggtgaaccccgtncacccccgtcaccgtaaccagttgantaaagactgggtcaangntttgcttcganggcatgggtatttccattattccacgaatttaaccacgagaatttaananaagggccaattggaccaagggg

SEQ ID NO: 105 - DNA, 998 bp, Fusarium venenatum
  misc_feature (1)...(998): n = A,T,C or G
atcctccactaacttcgcagcagccaggtcaagaacacttgcaccatcacaactggcaatatgaagttgaacatcagctaccctgccaatggcagccagaagctcatcgacattgaggatgagcgcaaggtccgtgtcttcatggacaagcgcatgggcgctgaggttcccggtgactctatcggcgatgagttcaagggctacatcttccgcatcactggtggaaacgacaagcagggtttcccaatgaagcagggtgtcatgcaccctactcgtgtccgcctccttctttccgagggtcactcttgctaccgccctcgccgcactggtgagcgcaagaaaaagtccgtccgtggttgcatcgtcgccatggatctttccgtccttgctctcagcattgttaagcagggtgatgccgatatccccggtctgaccgatgtcgtccaccccaagcgccttggtcccaagcgtgccaccaagatccgcaagttcttcggcctcaccaaggatgacnatgtccgcaagtacgttatccgacgagaggttcaacccaagggtgaaggtaagtcccttacaccaaggctcctcgcatccagcgactcgtcaccccccagcgtctccagcacaagcgccaccgtgccgctttcaagcgacgacaggccgagaaggtcaaggacgaggccaacgagtatgcccagatcctcgccaagcgtgttgccgaggccaaggccaacaaggccgatgcccgcaagcgacgtgccagctctatgcgcaagtaaggttccggcgtttaatgaaaaaaaggggaatcataccttggtcttgtggtttgcatgcaataggagtgaggattctctatagggctcaatttgagccaatcacgactgtattagaggcatttcgggaaaaataagaacatgcattgatgcactcgtgccatacgccaganaacgcgcatgttcattgncttggatacccattcaatttctcgcccatcc

SEQ ID NO: 106 - DNA, 616 bp, Fusarium venenatum
  misc_feature (1)...(616): n = A,T,C or G
gagaattgttcgagatggctcggacaaagaaggcttgcattatcttctttgatgaaatcgatgccattggtggtgcccgatttgacgacggtgctggcggagacaatgaagttcaacgtactatgcttgagctaattacccagcttgacggtttcgacgcccgaggaaacatcaaggtcatgttcgcgaccaacagaccctcgacattggatcctgccctgatgcgacctggacgtatcgatcgaaagatcgagttctcattgcctgatctcgaaggccgtgccaacattctncgcatccacgcaaagtccatgtctgttgagcgagacatccgatgggagctcatctcacgtctttgccccaacgcaacaggtgctgagctgcgcagtgtgtgcactgaagccggtatgtatgccatccgcgccaggagaaaggttgcctcggagaaggatttctnagcgcggtagacaanggtattaaagggcaacctcaagttcaacttntacagcgacgtacatgcagtacaactagatatgttcaccatagcgagaggngtaatttaatgcngngtatgattagangggcaattaantngggggaacttggaccgttacaa

SEQ ID NO: 107 - DNA, 747 bp, Fusarium venenatum
  misc_feature (1)...(747): n = A,T,C or G
ctcgcttctcttccgacggnttcaagcgcttntacnacaactgggacgcttacgccgacaagatnctactccgaagccaggctgtctccaacgcccctgagatcatnaagcgtntcggtgttattggcatgaacacacctgtcgaggtcgacatntacgcccacgccaactccacctgtgttagnggaacccgtatgctcaacggtctcggnggttcagncgatttcctccgtaacgccaagtactacatnatgcacactccctccagncgaccttncaagaccgacccccacggtgtctcttgcattgtncccatgtgcactcacattgaccaaaccgagcacganctcgacgttatcgtcactgagcaaggnctcgctgatgttcgcggtctttcttccgcgagcgcgcccgcgtcatcatnaacaagtgtgcttacccaagtaccagcctattctgacacactactacgaaaaggccgagagcgagggtctcaagaagggtatgggtcacgagcctcaccttttgttcaatgcttttgatctccacaaggctcttgctgaggagggtagcatgcttaaggtcaagccttggtaaatttagtctggtgttgtatataatgtggatgggaaactagaaatgacaaatttttgcgtagcctttttttgtttgggaaggaaatattggattgtggctacatagatgttttggagataattccccagcaaattaagcattgaatctgat

SEQ ID NO: 108 - DNA, 1039 bp, Fusarium venenatum
  misc_feature (1)...(1039): n = A,T,C or G
tcttnattaaccccaaattccataacgataccccttggccttaaacaacctgccttcagtcaaataagaagatatgggggccaagtctaacaagtcgctttacttcgacaagctcaagggcttgctcgaggagtacagctccatcttcatcgtcgagatcgacaatgtcagctctcagcagatgcacgagatccgacatgctctccgaagcaagggtgttgtcctcatgggcaagaacaccatggttcgccgtgccttgaagaccttcgtcgccgactcccccgagtacgagcgtctccttccccacgtcaagggtaacgtcggtttcgtcttcaccaacgaggacctcaaggaggttcgcgatgtcatcctcgccaacaaggtcgctgctcctgcccgtgccggtgctctcgcccctgccgacgtctgggtccctgctggaaacaccggtatggagcccggaaagacctctttcttccaagctctcggtgtccccaccaagattgcccgtggtaccattgaaatcaccactgatctcaagctcgttgaggccggctccaaggtcggtcctccgaggccaccctgctcaacatgctcaacatctctccttcacctacggtatgggtatctctcaggtctacgaccagggccagaccttccctcccagcggtcctcgacgtcggtgaggagcagctcctcaagaccctgtctggtgctatcactaccattgccactatctctctggctctgaacttccctaccctgccttccgtccttcactccctcgtcaacagctacaagaaggttctcgctgttgccgttgtcactgaggtcacctggcccgagattgagcagctcaaggaccgcatcgccaaccctgatgcttacgcctctgctgctcctgctgctgccgttccggcgatgctactgccgctgctgaggaagagaagaaggacgagtccgaggaagaagaagataatgaaggctcggcggtctcttccactaaatgtaccacatcctaacaagttacantgccttc

SEQ ID NO: 109 - DNA, 635 bp, Fusarium venenatum
  misc_feature (1)...(635): n = A,T,C or G
cacatattactgaagctcaagttaaggtgtcaggcctcaaacccaacgatattataaaacaaggctttccctcatcattttttgaagcccaaacatcgcttgacaaatttctaacaagatggaccctcaaaacccccaagcggcgcaacagactcgtcaaagacctgtctatgatcccagccaaggtggacattacggtgcctccgctcatctcgcgtcgcaaggcttcgcgccaagtgagctgtatactggtccctgggccaatgcccatcaaggtctaaccggccagtacaaagacattctcacgacctactggcaacataccatctcacacctcgaaaatgatagccatgattacaagatccaccaactcccgctggcccgtatcaagaaagtcatgaangccgatcccgaagtcaagatgatttctgctgaagcgcccattctcttcgctaaaggatgcgatatcttcatcacagagttgacaatgaaggcatggattcatgccgaggaaaacaagcgcagaactcttcagcgctccgatattgcatctgcattggcaaagtctgacatgttcgacttcctgatcgatattgttcctcgtgaanaagcctcttcccacgccaaaagggcga

SEQ ID NO: 110 - DNA, 612 bp, Fusarium venenatum
  misc_feature (1)...(612): n = A,T,C or G
caacacccagtccgccaccactgaacaaatttcctattcactataatactcatctccgtccctcgccccatcgtgctgcctcgggaaaatcttaaaatttgcttaatcctacatgtttgctcaattctacgtcgagtgttgaatcattcatcatgcctgctccaggtgatcaacattcggtggtgacgaacccttacgaggaaccacgtccacgaattgctgaatgggctgcaaaggacattgctacgatagcggcgaagctcgacaaacaactcggtcccgaatacatctctgcacgcgcaggccctggtggtacgaaagtccactatctgactgctgagaaatgtatcaccttggcgaatgaagttttcggtttcaacggatgggtcatcttccattcagaacattcaagtcgactttgccgatgaaaacccccagacacaacgcttcagtgttggcctgtctgtcattgccgaattacattaagggatggaacgtaccatgaggacgttggctacggntncatcgagaacgcaaaaggcaaggcaatggctttcgagaaggccaagaaggagggcactactgacggaatgaaacgtgcctaagnaaact

SEQ ID NO: 111 - DNA, 930 bp, Fusarium venenatum
  misc_feature (1)...(930): n = A,T,C or G
gcgcccacccccaatccaatccatccatattatccatccatccatcgtcgctcgtcgttttttctgcaccaccactccaaggaccgccccacgatccaaaccctttactctatccctacaaacacaggcttcgacgccgtaaaccgcaaacatgggtctcgccttttcgaagcttttcgacagactgtgggggaagaaggagatgcgaattctgatggttggtcttgatgccgccggtaaaaccaccatcctttacaagctcaagcttggtgagatcgtcaccaccattcccaccatcggcttcaacgtcgagaccgtcgagtacaagaacattcaattcaccgtgtgggatgtcggtggtcaggacaagatccgtcctctgtggaggcactacttccaaaacactcagggtatcatcttcgtcgtcgactccaacgatcgcgaccgtattgttgaggcccgagaggagctccagcgcatgctcaacgaggacgagctccgcgatgccattctccttgtcttcgccaacaagcaagatttgcccaacgccatgaacgccgccgagatcacagacaagcttggcctccacagcctgcgacaacgcgcctggtacatccagtctacctgtgctacctcaggtgacggtctctatganggtctcgagtggctcgccaacaccctccgaaaggcgggtcaccagtagaaagattgacgagaagcatctcttgaagaaacccgccttttcctcttgctctgccacatcctctcaaatggctctttgtgtcgactcgaggtttcggttgttatttgcaaagttatcggtcaaccaatcgaaaatgaatccttgaaccaaagtcgcatctatcacttttctattaaacaactgtttctaccttcctcctctctcatggtgcttcctgtgacctctcg

SEQ ID NO: 112 - DNA, 652 bp, Fusarium venenatum
  misc_feature (1)...(652): n = A,T,C or G
ggcggaaatgaaggcctgcggcagagtgcgggccttctgttttgaggattataatcagagtatattgaaagtttcgcgatcttttcgtataattgttttaggcatagtgcaatcgataagcttggctgcaggtcgacggatcgcatgggcagcatcggcctggaacaccaccgttccagcgaaaaccagcaggaacccaagagcctgaccgactgggccgcctatgactgggaccgcaacgtgatcgcccacgaattcagccacagctgggatggcaagtatcgccgctcggccaagctgtggacgcccgactatcgccagccgatgcaggacaacctgctgtgggtctatgaagggcagacgcagttctggggcctggtcctggccgcacgctcgggcgtgcagagcaaggacgtggtcttgggcagcctcgccaactatgccggcacgttcacccagaccgccgggcgcgactggcgctcggtggaagacacgacgatggatccatcttcgccgcccgcaagcccaagccctattcctcgcttacccgtaacgaggactattacaccgaaggcgcgctggtgtggctggaagcgggccaaatnatccgcgatggaaccggcggcaagaagggctggattgatttcnccan

SEQ ID NO: 113 - DNA, 1210 bp, Fusarium venenatum
  misc_feature (1)...(1210): n = A,T,C or G
ggatcaattggtaaaaatgttcgccgcctctcgcatccagcgccgtgctttctccgccaccgcccgggacctttccaaggtcaccgttctcggtgctggtggtggtatcggccagcctctctctctcctcctcaagttgaacccccgcgtcactgacctcgccctctacnatatccgtggcggacccggtgttgctgctgacatctcccacgtcaacaccaagtccaccgtcaagggctacgagcccaacgctgctggtctcaaggaggccctctccggcgctgaggtcgtcctcatccccgctggtgtcccccgcaagcccggcatgacccgtgacgatcttttcaacaccaacgcctctatcgtccgtgacctcgccaaggccgccgctgaggctgcccccaaggccaagctcctgatcatcttcaaccccgtcaactccaccgtccctatcgtcaaggaggtcttcaaggctgctggtgtctacaaccccaagaccttttcggtgtcaccaccctcgatgttgtccgtgcctccgattcgtttccgaaattaagggcaccgaccccaaggacgaaaacattaccgtcgtcggtggtcactctggtgtcaccatcgtccctctcttctctcagtccaaccaccccgacctctcctccaacgctgagctcgtcaagcgtgtccagttcggtggtgatgaaagttgtcaaggccaaggatggtgctggctctgccactctctccatggccatggctggtgcccgcatggctgacttcgtcctccgcgccgtccagggcgagaagggtgtcaaggagcccgctttcgtcgagtctcctcttntacaaggaccagggcattgagttcttcanctctcaggtcgagctcggccccgagggtgttganaagatccaccctctcggcaagctcgacgccaacgaggagaagctcgttgacgccgctctcgtcgacctcaagaagaacattgagaagggtgttgccttcgttgcctccaaccctccnaaataaattacttgagctctcttcgagttaatggggacgtagtancttaaaacactatgcctcctgggngaaaaggggaaaatttaaaacggaanctntgtcgnggcacaagatgtntttctgaggattgggnaaaaaaacaggggcntataagcaatggatatcctatgtttccctcccattggtccn

SEQ ID NO: 114 - DNA, 930 bp, Fusarium venenatum
  misc_feature (1)...(930): n = A,T,C or G
ctgagaccaagatgaagatcgcaaaggcccttgacgacattggtgtngaatacctcgaattgacgtcacctgcttcctccccccagtctaaggccgatgcccaagccatctgcaagatgggtctcaaggcaaagatcctggtccacattcgatgcaatatggacgacgctcgcctcgccgttgaaacaggcgtcgatggaatcaacatgtgcatcggcacttcggctcagctcatgaagcactcccacggaaaggacctcaattggattgccgaaaaggccaaggaggtcatcgagttcacccaagcccacggcctcgaggtccgcttctcgggtgaagactctttccgctccgactttagcgagatcatcaagctgtactctctcatggaccgtctcggtgctcaccgcgtgggaatcgccgacaccgttggaggcgcctcttggcgtgaggtctatgacaaggtctttacgctgcgccaggttattggatgtgacatttgaaactcacttccacaacgacactggttgcgccactttcaacgcttacaccgcttttgaagctggcgccacccacatcgacactaccgtcctgggcattggtgagcgaaacggcattactcccctcggcaagctgttccagtgcatgcttggctttggacacgantacgttgccaccaagtaccgtctcgacaagcttcctgctcttgagaancttgttgctgaagctgttgatattgagatcccctgggatactcctgacctctcggtgtttctgtgaaaacacctttttgggaaaaaacctgtgataaggcttatggagaagcttgatcctcccaggaacctttactttcaaccanctcagttttngggacacattttaccgtanaaaanatgtgtctgacagtcattaccgctctaagaacccccn

SEQ ID NO: 115 - DNA, 590 bp, Fusarium venenatum
  misc_feature (1)...(590): n = A,T,C or G
caaaggcataggctgctccgtcgtcaacattggtgcgggtgacatcattgaggtcagagagcatcttatcctgggtctgatttggcagattattcgacgaggacttctgggcaagatcgatattaagctccaccctgagctttaccgactgcttgacgaggacgaaacccttgagcagttcctcagactacctccggagcaaattctccttcgctggttcaactaccatctgaaagctgctaattggtctcgcactgtcaacaacttctcttcagatgtcnaggatggcgaaaattatgcggttctgcttgcccaaatcggtcctgaatatggcgttacccgtgcgcctttgcagaancaagaactacatgatcgggccgaagctgtcctccaagaacgganaanctcgctgccgcaantcttgacccaaatccttgttgcaggaaatccaaacttaacttggctttcgtggcaactcttaacaaccatccgctctgaccttttccgaggaaganaacttgaatcaagactcaatccgaggaaacttagnncatttccttntggtcacacttgattcaccgcattttttt

SEQ ID NO: 116 - DNA, 1176 bp, Fusarium venenatum
  misc_feature (1)...(1176): n = A,T,C or G
cttcactcacccaaccttcaacattctaaactctacgaatcccacgactcagaattcatcagcaatcatggcggttcgtgctcagttcgaaaactccaacgaggtcggtgtcttttccaccttgaccaactcttatgctctggttgcacttggtgccagtgagaacttctacagtgtcttcgaggccgaacttcaagatattgtccctaccgttcgcactaccatcgccggtacccgtatcattggccgcttgactgccggtaaccgaaagggtcttctcgtccctaccaccacaaccgaccaggagctgcagcatctgcgtaattcgctacccgattcagtccgcatccagcgtattgaggagcgcttgtcaagcccttggaaacgtcatcgtcacaaatgatcatatcgccctggttcatcctgatctgggagcgcgaaacagaagagattattgcggatgtgctcggcgtgggaagtgttccgacagactgtcgccgacaatgttctagttggtagctacatgagcctttccaaccaatggaggtctcgtgcaccccaangacccccattcaggaccaggacgaagttgtccaagcttgctnccaggttcctccttgtcgccggtagtgtcatccgtggttccaacgttgtcggtgctggaatggttgtcaacgattggctcgccgttactggtctcgacaccacncgccacccgagctcagcgttatcgaaaagtgtgttccgtcttggngaagggccaagggccccagcaacatcaacaccagcatgaaggacaccatggtcgagtctttctactaagcttgatctgtggattgttttctgcatgtaaattgattgcttggttgcatgggctttgctgctgctacctactcttcgggtatcgatcaaacgacgtcattttccgccgcnaacgaaattttaacttataccgggcctnggggttgggaatactgctgaattttgcggatggtttcaggaattggtnttatgatgatcgaacgataggattcttttagggaaacgggaccctntaactagtncttttacggaacnaanaggacaaggttggtgggggatganaacctggtggtacaaagggccatccatttgatccnctgggctnttgggttgtccaaggccnctcccntttgt

SEQ ID NO: 117 - DNA, 957 bp, Fusarium venenatum
  misc_feature (1)...(957): n = A,T,C or G
aaggttacctgcattgaaaagcgtggctccctcggcggtacctgcttgaacgtcggttgcattccttcaaagtctcttctcaacaactcgcatctctaccaccagattctccacgacaccaagcaccgcggtatcgaggttggtgacgttaaacttaacttggccaacttcatgaaggccaaggagacttctgtctctggtcttaccaagggtatcgaatacctcttcaagaagaatggagttgagtacatcaagggtgctggttcttttgtcaacgaacacgaggtcaaggttgacctnaacgagggcggtgaaaccagtgtcgtggtaagaacattctgattgctactggatctgagggcacacctttccctggtcttgagatcgacgagaagcgcgttattaccagcacttggtgctattggccttgaggaggtccccgagaccatgaccgtcattggtggtggtattatcggtctcgagatggcttccgtttggtcgcgactcggatccaaggtcactattgttgagttcctcggccaaattggtggccccggtatggactctgagatcgccaagaacactcagaagatactcaagaagcagggtctcgagttcaagctcaacaccaaggtcgttggccggtgacaagtccggtgacaaaggtcaagctcgagattgacttccgccaagggtgcaaggccgatctatcgagtctgacgttgncctcgttgccattggccgacgaccntacaccgttgcctcggcctcganaatatngcctcgaggctgacaccgtggccgtgtcgtgacgactccgataccgaccaagatccccacatccgatgtgtggcactgccatttggtcctatgcttgccacaaggctangaggaggccntgctgcgttgagtnatnaagaaggatacggcacgnaacttgggcctttcttnagtatt

SEQ ID NO: 118 - DNA, 1543 bp, Fusarium venenatum
  misc_feature (1)...(1543): n = A,T,C or G
gcgtcatgcgtcaatgcccgcatatgctctcgagtactctcccgccccatcattcgtctcctcccagtacgaggactacagcaaccgaggaatctccttcgaacccatcacgcctccgcaacaggcgttgggtatctctgctgaacctgcgtatatcgccaacgaggagaccggtctgtactccgccatcccagatcatatggctagcatgaacggactcaacggcatggttcagcttcctccatccaacttggctggcccccagttctctcgtccctatggtacaaacaacgtctactctgtgatcgaaggttcgccgacatataagccaaaaaaaacgctttcatccattcccccatctatttcggcgaatcgcgccccccaactgcccttctcaccccagcacactcacactttcgtccaaccgtctgattctgcgaacgtccgtttccgcttcccgttngccccgttgctgaggtnaatgaattcttgcaaacaactcacctcctggcctgtcatacagcacttctggcatatcgaatgaaaagccaacaccaccagaacatgtcttcaacacgaaactccactgtctgctgttgaaggaagccccgctacccattctatgggtctgcatcaggatttctcccacctcgccagtgaggaatacaacggcgacggctcattgagcgagcagcgacgatctgcacccgcttctaacggtgctgtccgacgggctcgttccgctactgttatggaagttggtccttatccccagaagtcccactcctgccctattcccacctgtggccgtctcttcaagcgtttagagcacctcaagcgacacgtccgaacacacacacaggagagaccctatgtttgccctcactgcagcaaggccttttcaagatccgataatttggcacaacacaagcgcacccatggtcgcgaagacggcggtgacggttcattacacctgtctggtgatgaanaggaggacttctccggtgatgaccatctcggctcattggaagangcttcccctcactctgacagtgcatacgtgacgggctcgctgaatactgccgctcatggctcgactcccccttcaagcaatgcacccacacaaaccttcnacagcctcgaaaccnttagcatgcccatgacnataaccaaccggntgctatcaacgctagcngcatgatgttacggttgaattatgtncaacttgtcnttttatttgcacacagttcataactacaagggatttatggcttcaattttggcggcaatctgcaacggtttttgcgtgcactctgcttgactttcctatgttcatattttactacatttatttttttggntggaagcgctcatcggnggccaaaatatggttttgatagacccatgctgnggtagctgggacaaagcttctgatgaagggctgnggtcatcatgaanacagcattatgttgaggagtncaaaggatgcatntatatataaataggtgccgtcttttgatgattggtaaantatttaaaatat

SEQ ID NO: 119 - DNA, 563 bp, Fusarium venenatum
tacaaacgctatccaatggccgacgaatcaaagaaagatggtggtatcacctttgcaggccaagacaagctgccgaagttgccgatccccgagctagaagccagttgtaagaaatatctagaagctcttaagccgcttcaaactgctcgcgaacatgcacaaacacagtatgcggtgaacgagtttcttaagggcgacggccctgagctacatgagaaattgaaggcatatgctgaggggaagacaagttacatcgaacagttctggtacgactcttatctcaactttgataaccccgttgttcttaatctgaaccctttctttcttttggaagatgacccgactcctgctcgtaacgaccaagtcacccgcgccgcttctttggtcgtttcgtctcttgaatttgtccgcgctgtgcgtaaagaagaacttgccccagacaaggtcaaaggaacccccctttgcatgtaccaattctcgagactgtttggtactgctcgggtgcccactgaggaaggatgtcaaatcgagcaagatcccgaatcgaagcacattgttgttat

SEQ ID NO: 120 - DNA, 856 bp, Fusarium venenatum
  misc_feature (1)...(856): n = A,T,C or G
ttcttaacgaaccatcttcctccaaatcccgcctcttctactctttcagccttgactgaatttctttacgctgacatatagtcgacaatccagcaaacttctctccctcaacacataaatacgacttggtctcctgttttattacatcaggacgacctcttctttgcaaatcaacgaccgcgataactcgcaacacctatcttagatacccccttctacacatcaaaaatggctcttaagcgtattaacaaggagttgactgatctcggccgagatcctccctcttcctgctccgctggccctgttggcgaggatctgtttcactggcaagctacgattatgggtccttctgactccccttactccggcggtgtcttcttccttgcgattcacttccctaccgactaccccttcaagcctcccaaggtcaacttcaccacacgcatctaccaccccaacatcaactccaacggaagcatctgcttggacattctccgagaccagtggagccctgctctgaccatctccaaagttcttctgtccatctgctcaatgctaacggatcctaaccctgacgaccctntggtgcctgagatcgcccatgtctacaagactgaccgaccccgatacgaggccacagcccgagagtggactcgaaagtccccatttaaatgacnatatggacgaaggcgggtggaccttgagtcgatttgtttccctatcatgagcgacgtgaaacgatcgagtggaaacttcccacggcgttgcnatatggctttaagtcggcgtgacccaaaaagatgttttttgcctgtatcgangctttnactgggggttgacaaanaagaaancaacc

SEQ ID NO: 121 - DNA, 746 bp, Fusarium venenatum
  misc_feature (1)...(746): n = A,T,C or G
gcnatataacgttggtgacgaggtcgagttgagcgctcccgctgganagttcttcctcaaccccgccgacgcctcagccgagaagaagcctcttgttctcctctcggccggtgttggagccactcctctcatttccatcctcgattccgttctcnaatcggagactgcctcgcggcctatcacatggatccatggagctcgttattccggctcgacatgcttcgtgcctcatgttttggactcggccaanaagcacgacaacatcaccgccaagatcttcctcgaggatgtcaaagaaggcgaccagtacgactttaagggcgagatcgatcttgctcgtctgcaaacggacaagcttctccagcttgacagctctgatgctgaatacttcatctgcggtcctgaggactggatggtcaaggtcagggcgttcctcgaggagaatggagttccccgcgagcgtcagcacctcgagttgttcaagactggtgacgtctaaaatactgtgaaagcgtcatagattgtgtntttttatcaaattgtgaattggttttgattggcatattgaaggcgttggggactgcttcatggggagggtgtattattcgagacgcttgaattgaccaaagactacatatactagataccagccactaccctcatctcaaacaaaaataaaaagttatttncttctaaaaaaaanaaaaaaatncctgcggtcgttcgagcatgcatttnnagggccc

SEQ ID NO: 122 - DNA, 589 bp, Fusarium venenatum
  misc_feature (1)...(589): n = A,T,C or G
catgcttgctctttctttgatgacagtcgacccgaccgaggatcctgaagaggcgttccttcgtaccgttaatacccgaattgccggtggtggaaggctggctgcaacagctgaaccaccgcgtgtagtggtagacgtacganaattccgttcctctttaccttcactccttcacggtcgctccatggtcatagtcccatgtatgctcacggttggggattacattctgtcaccgaatatctgtgtggaacgtaagtccatcagtgatctgatctcatcgttcaaggatggcaggctctacagtcaggccgagaccatgttccagtactacaagaatgtgatgcttctgatcgagtttgaccagaacaagtccttcactttggagccattcgctgatctttctggaagcctgagcagtgttgccccaactaacatgtcatccgaccttcaatccaaactagtgctactcaccatagcatttcccaagttgcgcatcatctggtcctcttctccctatcagaccgccgagatctttgagacctcaagaccaagaagaagancagatccgatcgccgctgtcaaaactggt

SEQ ID NO: 123 - DNA, 2338 bp, Fusarium venenatum
  misc_feature (1)...(2338): n = A,T,C or G
gaagaatggccagcagtttttggagtataatattattggcggtgttctcgacttttacttcgttgctgggccatcgcctcgtgatgtcgcgaagcagtacgccgagattaccactctacccctcatgacgccttactggggtctcggttttcaccagtgccgatacggctaccgtgatgtttatgaggttgctgctgttgtagccaactattccgctgntggaatcccactcgagacgatgtggacagatattgactacatggaccgtcgacgcatnttcaccattgatccagagcgcttccctgcagacaagtacaaggaccttgttgatacgatccatgcacgagaccagaagtacatcgtcatggttgacccagcccgtatatgacatggaatctaatccggcccttgattcaggcctcgagtacgacactttcatgaaagagcccaacggctccgactaccgaggtgttgtgtgggctggacccantgtcttccctgactggttcaaccccaactcacaaaagtactggaacgagctctttgccaatttcttcgatggcgaanaacggtcctgatatcgatggtctctggattgatatgaatgagcctgcaaacttcttcaaccgtccttaccctggcaacaacaccactcctgagaagttcgcaganattgatggtgatccccccaagccgcctcccgtccgtgatggtcctcctgctcctatccctggcttccccgacagtctacagcctgcatcttctcgtcttaacacgcgtgaatctgtttccatcgccaaaaccaccatccacaagcgctccatggcagcccgcacaacatcccacagccgtggcgttggacagtgggctaccaagaagcactggggacagaacaagtacggccgccctggctccagctggccaaatggcaagaagaccggatctggttgtggcccgaatgagtgcaagggtcttcccaatcgagagctcatccagcctccctacatgatccagaacggcgcgggaccgacgcttgctgacggcactaccgataccgatcttgtgcagagcggagattacctccagtatgacacacacaacttgtacggcgctcagatgtcaacacattcgcacaatgccatgcgtgctcgacgtcccgacaagcgcgctcttgttatcacgcgtagcacctttgctggttctggcaaggatgtctcgcattggcttggtgacaacctctcgatctgggatcagtaccgctttagcattggtcagcttctccaatttgcatccatctaccaaattcctgttgttggtgccgatgtctgtggtttcggcggtaacgtcactgagactctatgcgctagatgggctacgcttggaagtttctacactttcttccgtaaccacaacgagatcactgctgcatcacaagaattctaccgctggcccaaggtcgccgaggcagcccgtactggtatcgccattcgttacaagctcctcgattacatctacactgccatttacaagcagaaccagacaggcacccctactctcaaccctctgttcttcaactaccccaacgacaagaacacatactccatcgaccttcagttcttttatggtgatggcatcctcgtcagccctgttacaaaggagaacagtactgagttggaatattacctccctgatgacattttctacgagtggtccaccggaaagcctgttcgtggtactggttcatatgagtctgcagaggttgagctcactgatatcatggttcattacaagggtggcatcatctacccccagcgtgtcgacagtgccaacactaccaccgctctccgcaagaagggtttcaaccttgttattgcacccggtctgaacggtaaggcttctggatctttgtacctcgacgatggagagtctgtcgtccaggacgctgtatccgagattgacttcacttacaccaagggcaagctgagtatgggtggaagctttgagtacgatgccggtgtcaagattgagacgatcaccattcttggtgttgaaaagcagcccaagggcaccgatcatgcagagtatgactctgagaacaagaagctgatctttgcggcggatgtacctttgacgaaaaaagtgttatgtggatctcttctgagaacagagcgaacaggatgatgattttgctactttgacgctggttcatgactgtattcaaaattcttgatgtatataatgagccgttaatgaaggttgtggttatatgaaagatgttaaattgatcaaccactcatgtatactaatgtaananatttctgcgncggtncagctgcat

SEQ ID NO: 124 - DNA, 568 bp, Fusarium venenatum
  misc_feature (1)...(568): n = A,T,C or G
gcaccgtcgatctcaacgaagttccagaccaacctggttccctacccccgaatccactaccctctcatcagctacgctcctgtcatttctgccaacaagagcgagcacgagagcttcaaggttcaggagcttaccttccagtgctttgagcccaacaaccagatggtcgtctgtgacccccgaaacggcaagtacatggctgtcgctcttctgtaccgtggtgattgtgttcctcgcgactgcaacgccgccatcgcttccctcaaggccaaggcctcattcaatcttgttgagtggtgccccactggtttcaagctcggaatcaactaccagaagcctatggctgtccctgctcctgctgaagctggtggtcttgctcccgtcaagcgatccgtctccatgctttccaacaccaccgccatcgctgaagcctggtcgcgtcttgactacaagttcgaccttatgcacagcaagcgtgctttcgtccattggtacgtcngcgaaggtatggaagaanganattcaccgaaggccgagaagatctcnctgctctgganaaagattacaa

SEQ ID NO: 125 - DNA, 1700 bp, Fusarium venenatum
  misc_feature (1)...(1700): n = A,T,C or G
caacgacgccaacgaaacgtaacgacgactctttttctcttttacaccatacacaccaccacttctttttactaccaattaatactcactcacatttaatacgtcgtcatcatgtggatcgtcaactggttctacgatgtgctgtcctccctgggcctgctcaacaagcacgcaaagctgcttttcctcggtcttgacaacgccggaaagactactcttctccacatgctgaagaacgaccgtgttgccattctccagcccactcttcaccccacatccgangagcttgctattggtaacgtccgcttcaccactttcgatcttggtggccatcaacaggcccgacgtatctggcgcgattacttccccgaggtcaacggtgtcgtcttccttatcgacgccaaggaccacgagcgatttggtgangctaagggcgagctcgacgccctcctctctatggaagaactttccaaggttccctttgtcatcctcggcaacaagatcgaccacccgatgccgtctccgaagacgaaatgcgacaccaactcgggctctaccaaacaaccggtaagggcaagggtcaacttgagggcatccgacctattgagctcttcatgtgctcantagttatgcgccaanggttacggggacnggtataagcctggttggtcacagntacgtctaaagggaaaaccngaaaggggaaacggggggtggnctggagattatatcttacgttacgttacnatncttggtcganngggaaaacgaagacatgtgactattcattgttgttgcaacatttcanaaattcttcgttngcgtcgcggcccatgaagttcaggatggcctgcacgccaccgggtgttcttcgagccagtcgttcaggtccaggacgacacccttgacgacgacccagacgttgtcctnggtgttgtgctctggatntcntccatggtgtatcctttntcgggaaccttgaaggccttgggtcgttgggcttagcagccttggcaccatcctccttgacggggttgggaccggcggcaacgctgggtgtttgtcgacctttgaaggagtccggaagcctgaagaagcggcgccaggagcaccccaggagacagtcaccttggttggggattgaaggatcgaggtgcagagagatttgaccaacacgttcagcggcgctgccagcactgcccttaagggcgttctggaagaggtagttactggcagtgtcaccagcaacacgaccgtagacaacacatccgagaagagaagaaccacccagacggttggcaccgtggacaccaccagccaactcaccacaggcgtagagaccgtcgaagggctgcttgtcctggttgaggacctgggccttgtcgttgatctcaataccacccatggtgaagtggagaacgggctccatgacagcgacgtggaagtcgtcgtcaacgttgacgggcaggttgtggaagaacttcttgccccaagggtccttctgcttgccgtcggcaatatcgttgtatgtagagaaggtcttctggaggtgctcgggggtgcagccaatctccttggcaagctccttaccagtcatcttcttcatgagaccacggccagagtagtggcgagtgtggaaatcaaggaccttggaagccttggagttgagaataagtcggatagggaacttgtccttcttc

SEQ ID NO: 126 - DNA, 819 bp, Fusarium venenatum
  misc_feature (1)...(819): n = A,T,C or G
caaggagcaagtcaagatgcctccccgcgcccactccaagacctntcgtgtcccccgccgacccttcgagtctgcccgacttgactccgagcttaagctcgttggcgagtatggcctgcgcaataagcgtgaggtctggcgagtcggtctgactctgtccaagatccgtcgtgctgcccgtcagctccttaccctcgacgagaaggaccccaagcgtctnttcgaaggcaatgccctcattcgacgtctcgtccgtgttggtgttctcgacgagtcccgcatgaagctggattacgtcctggccctcaagatcgaggatttccttgagcgtcgtctccagacctgtgtctggaaagctcggtctcgccaagtctatccaccacgcccgtgtcctgatccgccagcgtcacatccgagtcggaaagcagatcgtcaacgttccttntttcatcgtccgtctcgactcccagaagcatatcgacttcgctcttacctcgcccttcggtggnggccgtcccggccgtgtccgcaaaaagaaggccaaggccgccgagggcggtgagggtggcgaggatgaggaggacnaggagtaaatgcaactaaaaaatgcaaaagcggntctccctgtctagggcacttggtgatgggataccactcatgggaaggggattctcttcatagcttgcggcgttggccagaggataaaaatggaatgatttcaccggataacgacaaacaaaactttcccggtgtctcttcactgtgtatatgaatcccatgaaacatgaatccaatcatgacatctcccccnnaaaaaaa

SEQ ID NO: 127 - DNA, 925 bp, Fusarium venenatum
  misc_feature (1)...(925): n = A,T,C or G
cctcaacgacgtcgacttgtctttctcgtagcgcactcactttcaccttcatcacctccatcctcgaactcgaccctaatagaaacccatcccaagctacaatatcgcagccatggccaacgacgagtatgatttcctcttcaaagtcgtcttgatcggagactctggagtcggaaagtccaaccttctcagtcgattcacccgcaacgagttcaacctcgactctaagtcgaccatcggtgtcgagttcgccactagatcaattcaggtcgactccaagacgatcaaggcccagatttgggataccgctggacaagagcgataccgcgccattacttccgcttactatcgaggtgccgttggcgctctcctcgtctacgatattagcaagcaccagacctacgagaacgtcacacgatggctcaaggagctgcgagatcatgctgatgccaacattgtcatcatgctggtcggaaacaagagcgatttgcgacacctgaganccgttcccaccgaggaggccaagtcctttgccagcganaaccacctgtcctttatcgagacgtccgccctcgatgctagcaacgtcgaacttgcattccagaacattttgactgaaatttatcgcattgtttctagcaaggccctcgacagcggcgatagcgcccangccaccataggtgcgggcaccaacatttcgctcagcaagcccgccgatgacgatgcttccaagggtggaaagtgctgttaaattctttgcggaaccgtttgcagactgatatagggctctgggggttnggatacctggcgtctcgtttgtccccgaaaatgctcctcggcaaacgagagtggaggaggcgaggaatcgtgatacgtctttttttgatatcaggaggcgcggttacttcggctttcctttgttctt

SEQ ID NO: 128 - DNA, 858 bp, Fusarium venenatum
  misc_feature (1)...(858): n = A,T,C or G
tgaatcttgacaagaatgagtcagaaacctgtgcaagaggcgcctcatgtgtcgggccagtccaacactcccatgtcagcacctgctcatgctctcacttacgagcaggttgctaaagagttgaacgccaatcttgaagatggacttacggatcaagaagctaagagtcgtctcgagagtgctggacgcaacgaattcggagagcaagagggtgttcaacctctcaagatctttatcggccaaattgccaatgctctcactctagtactcatcctcgccatggctgcttctttcggcattcagtcatggatcgagggtggtgtcatcgctgctgtcatcgttctcaatatcgtcgtcggtttcctacaggagtttcaggctgccaagaccatggactctcttcgtggtctcaagctccccgactgcctcagctgttagaaacggcagcaatcaagttattcccacggccgagatcgtccctggtgacatggtcgagctcaagactggtgacactatccctgccgatctccgccttgtcgaggccgtcaactttgaaaccaacgaggccttactcactggagagtcccttcccgtccgaaaggagatnaacangatcttcgacaacgacactggccctggcgaccgtctcaacgttgcctacagtcctcgactgtnacaaanggtanagctcgcggtantgtcttgcactggtancatacagaaatagtcaaatcgtgtactcttcgcggaaatctccaagcgccgacagcaaagagaatgccaagnaaggcaaagctgcctcacgtnaagcttgacncgacaattcnatgctgtcgncncttctggggtcaagttgga

SEQ ID NO: 129 - DNA, 674 bp, Fusarium venenatum
  misc_feature (1)...(674): n = A,T,C or G
tcaaagtctttaaacatgtctcgtcctcagaacattggtatcaaggccattgagctttacttccctagtcagtatgttgaccaggtcgagcttgagaagttcgatggcgttagcgccggaaagtacaccattggtcttggccagaccaagatgagcttctgcgacgatcgcgaggatatctactctttcgctcttaccgctacctcgaagctcctcaagaactacaacatcgaccccaactcgattggtttcctcgaggttggtaccgagactcttctcgacaagtccaagtctgtcaagagtgtgcttatgcagctctttggcgacaacaccaacattgagggtgttgacactatcaacgcctgctacggtggtaccaacgctgttttcaacgccatcaactgggttgagtcttctgcttgggacggtcgcgatgctatcgtcgttgccggtgatatcgctctctacgccaagggcaatgctcgccccactggtggtgccggngccgcgctcttctgatcggcccaacgcccctattgttggcgagcccggctgcgtggtacctacatgcagnacgcctacgatttctacaagcccgaccttaccaggcgagtacccctacgttgatgggcactacttccgtcaactgntacagnaanggttctcgatgccng

SEQ ID NO: 130 - DNA, 508 bp, Fusarium venenatum
  misc_feature (1)...(508): n = A,T,C or G
ccgcttacctgggtgccaagcttgcctcgttctacgagcgagccggtcgtgtccagacccttggttctcctgagcgcgagggtagtgtcagtattgtcggtgccgtcagtccccctggtggtgatttctccgatcccgtcacgacagctactttgggtattgtgcaggtcttctggggtctcgacaagaagcttgctcagcgaaagcatttcccttccatcaacacctnggcctcttacagtaagtacaacaacattttggacaagtactacgagaagaactaccctgatttcccccgactccgcgaccgtatcaagcaactnctttccgactctgaggagctcgaccaggtcgtgcagcttgtcggaaagagtgctctgtctgaccctgacaagattactctcgatattgctggcctgacaangaggatttcctccagcagaacggttactcaaactatgaccagttctgnccatctggaanactgagtggatgatgaancttatgg

SEQ ID NO: 131 - DNA, 1012 bp, Fusarium venenatum
  misc_feature (1)...(1012): n = A,T,C or G
attcaatggaaggtctggcatgatcccgtccatgagcgagaccccagcaccgagtcaccagagctgcaggaatgcttccgttacctcaacttgacaagccgcagttttgcgactgtcattcaagagttgaaccacgaactcctcgtccccatcactctcttctatctctgcctccgtggcctagacaccattgaggatgacatgaccctgcccctagagaagaagattccccttcttcgaaactttcataacactatggaagaggatggttggcaattccatgagagtcaagagaaggacaaggagctgctagagcacttcgatgtcgtcatcacagaactcaagaagatcaagtccccctaccacaacatcatcaaggagatgactgaaaagatgggtaacggcatggctgactacgcccgagaacgaggagatgatcaagaacggtgttcaaactattgaagagtacgaattgtactgtcactacgttgcgggtctcgtcggtgagggtctaacacgcctcttcgtcgaatcagagcttgccaaccccaagctttccgagcgcccttctcttaccgagtcgatgtcccagttcctccagaagacgaacatcatccgagatctccgcgaggactgggcaagacggtcgaaggtggtaccccaaggagatctggagccagcacgtgggacaattggggaagaccttttcgaccctcgctatgaaactaaggctatcgagtgtgtgtcccatatggttctcgacgcactaaagcactgcgaggagtgcctgttctacatggcgggcatcaaggaccagaatgtttttaactttgttgccattcctgaaggcatggccattgcaacactgggaactttgtttccgccaccctgatgtcctccagaagaacatcaagatcacaaagggcgaagcctgcaagatcatgttcgaatgcacacagaactcttcaccgtgtgtgangtcttcaagcnaatatgcccgccaagatcgcca

SEQ ID NO: 132 - DNA, 1949 bp, Fusarium venenatum
  misc_feature (1)...(1949): n = A,T,C or G
ctagtattcccataattatttatccttcgtccttcctcgttccatccttaagaatttgtgcatcccctttatttatttatttattcatcttcccttctcttcctgtctagaagagtaaacaggttgacaccactcgtttcagctgtaaaaccgacaaccttgtagaggaaagctgtgctccctcgcctttgcttgcactcgagaaccatcagtcaatcaatacctcttgactctccttttatttatttgctacatcactcgcatatttatttgtctctttacctggcattacttacattttattgctttctcttggcgtgtatccatcaccgagaccatcactcgacgttatcatctacgacactttcatttcccttgtcctcaagtcgttacactctggacacgaaacgccgatcaaattccttcggtttacagaaacaatcatttaattatcgccgatatcgcataaacaactcacccgttttatttaatacatcttggacatcccatctattcgtcacctttcagtctcaaccttttgggactgaaacgaactacctacaaattgtttcactgaaacgcaacgcataaacattaagaaacatccaaacttcatttctcaaatcgagancacgatncttcagcttgttggttgtcagcatcctancgcgtttcaactgggttcccgttttattgaaccaaagatctatatcaatgcttcaagtctgagccaagccacaatcagctcngtcatataactgagcttgaagcactttcgataacttgatcaaaactttcattttggaaacaatattcttaacacttgttctcatacacaacacatcattcacaatgactggacaatctacaagacgatggcttcagctatctttccttctcatggctggcaccgcttcagcaggatccctcaagctatccgactttgagtcgataagcgacaagtctttcccatcaaactgtattgcagcatacgatacgccactcgcagactgtacccccaacgacttcactggtggcaangcatgcagtgctgcctgcaaggactcagttcaacaaactcagggcttcatcatggcttcatgtggtgacgtctcagccgactccgaatctcttcttagccgcggccagaaaggcaacctcgttgctgttcgctgccgagatgacgatgaaccnccaatcccagtctgaaggctcaatcagaagcgcaaccctgaccgacatcaaccaaactctgagcaacgaaactcaagcgtccatgccagcaatcatgacaacaggtancacgcttgataccgtcgacaaggnactcacgccanccgtaaaggttgtcaaacttggacttggtgacggagtcgttgacgttgatggcgggacaaggagcttgttgtcacggagcatgcggtagaggtggtggacaccggtggtggtctcctcagagacaccgaagcagtccttgagcatctcagggtacttctggtggacaagggtggtcaggtcaccaccgtcgtcgaggatgaggttgagcttcttgttgtccttgaaggcagtaagctgctgctcgaggcaccagttgtactcctcatcggtctcgcccttccaggcgaagacgggaacaccagcggcggcaatggcagcggcggcgtggtcctgggtggagaagatgttgcagctggtccaggtaacctcagcaccgagagcagtaagggtctcgatgaggacggcggtctggatggtcatgtgaaggcaaccagcgatacgggcaccggcgagaggctggtcggcagcatacttggctcgggtctgcatgagaccgggcatctcgttctcagcgagctcgatctccttgcggccaaaggcggcaagagaaaggtcagcgaccttgaacttgtgggcgggagcagacataatggatgaggtggaggagagga

SEQ ID NO: 133 - DNA, 579 bp, Fusarium venenatum
  misc_feature (1)...(579): n = A,T,C or G
tgatgttccaagcttcccagttgggtcttggatcccagtggcttgagaccaagaagcctacgagcatgccaacgagcttctcggagatatcgtcaaggtcaccccaacctctaaggttgttggtgatcttgctcaattcatggtctccaacggtctttcccctgaagatgtcaaggcgaangcttctcaactcgatttccctagttccgttctggagttcctcgagggtctgatgggtcaaccctacggtggattccccgagcctcttcgatccgatgctcttcgtggccgacgcaagctcgacaaganacctggtctgttcctcgaacctgttgacttcgtgaagaccaagcgcgaacttggcaagaagtacggcgcaccagttactgagtgcgaacttgcttcgtacgtgatgtacctaaggtctttgaagactacaagaaatttgttcagcaatacngtgatctttccgtgctgcccactcgatacttcctgtctcgccctgagattggtgaagaattcaacgttgaactccaaaaaggcaaggtcttgattctcaanctcctgccgttggtcctc

SEQ ID NO: 134 - DNA, 622 bp, Fusarium venenatum
  misc_feature (1)...(622): n = A,T,C or G
gttcgatattacgacttgactaatgttcagggtaccgctcgtggttgggagcgcgaagagcgtattctcctatgcgtgccgctccgtgatgctgaagcgcacttggagatgtttttttcccacatgcgcaacctgacatacccacaccacctgattgatctcgcattcctcgtctccgactcaaaggacaacactctcaaggtcctctccgatagtttggaggctattcaagccgacggggaccctaagcagccttatggcgagatctctatcattgagaaggactttggtcagaaggtcaaccaagatgtcgaaagccgtcacggattcgccgccaggctagtcgccgaaagctgatggcacaggctcgaaactggcttctgagtgcggccctgcgaccctatcattcttgggtttattggcgcgacgtcgacgtcgagactgcgcctttcaccatcttagaagatctcatgcgccataacaaggacgttatcgttccaaatgtctggcgacccttgcctgactggcttggtggtgaacaaccctatgacctgaactcctggcaagagtccgaaacgggtntagcttttcgccgccctcttgatgaagaagctggcatcgt

SEQ ID NO: 135 - DNA, 819 bp, Fusarium venenatum
  misc_feature (1)...(819): n = A,T,C or G
gcccgtctcaagtacaccatcgacgacatgaccgtgcctgtcttccgcagtaaggttgaggagctctggggcaaaaagttcgagaacgagaagcctttcgagttcaagagcaacgtcgatacctttggctggcagaaggatgagaacggccttaaccacttcacctttttcatcgagaacggccgtatcgaggatacccctgagttccagatgaagactggctgcgcgaaattgccaagtccctcaagggcgaagtctgagtttcgcttaccggtaccaagcatctcatcctcagcaacgtcgccgacgaggacctttccgatgtcaagggagctcatgaagaagtataagctggacaatgttcagttctttggttctcggtttcagcttttctggttgtgttggttttcccacttgtggtcnttgccatggccgagtccgaagggataccttccctggtcctacatttccaagcttggagggttggcctcgaggagaacggtcttcgccaggactctatcgtcatgcgtatgactggttgccccaacggttgcgctcgtccttggttggccgangttgctttcgtcggtaaggcgtacggtgcttacaacatgtacctgggtggtggctaccacggccagcgcctcaacaagctatatcgccagancatcaaggangacganatctcgacatcatgaacctctcctcaagcgatacctctcgancgaaacgaaggcgaacgcttcggtgacttctgcgtccgctctggtgtcattgttgccaccaccgacggccaaacttccacaaaacnttgccgaa

SEQ ID NO: 136 - DNA, 610 bp, Fusarium venenatum
  misc_feature (1)...(610): n = A,T,C or G
ggtctttcagacgagacagacatcactgtcaagggtctagaggttgtcaagaaggcttccagggtttatctcgaagcctacactagcattctgctggttgagcaatccgtcttggaatcctactatgggcgctctatcacggtagctgaccgtgagatggtcgaatccaacagcgatgagatcctccgaaacgcgcagaacgaggatgttgcattccttgtcgttggcgatcctttcggtgcgacaacacatacagacctcgtccttcgtgcacgagaactcgaaattcccgtcggaacagttcccaatgcctccatcatgtccggtatcggtgcatgcggtcttcagctctacaacttcggtcagaccgtgtccatggttttcttcacagacacttggaagcctgcatccttctacgaccgcataaaggagaaccgncagattggccttcatacattggntctggtggatatcaaggtcaaggagcaaagtctcgagaacatggctcgtggtcgcctcgtctacgagccccctngctacatgaccgtgggccaatgtgctcagcaaatgttggaaattgaggaggaacgcaagganggtgtatacacta

SEQ ID NO: 137 - DNA, 810 bp, Fusarium venenatum
  misc_feature (1)...(810): n = A,T,C or G
ctcatcttctctcatcatcatccttcacttgcctaccacactggtttatgctggctacaattgnaggcaaacactgatccaacaactcacttagaaacataacataaagtcaacatggctatcaagaaggtcttcgcccgctccgtctacgactcccgtggaaaccccaccgtcgaggtcgacgtcgtcaccgagactggcctccaccgtgccatcgttccctccggcgcctctaccggccagcacgaggcttgcgagctccgagatggcgacaagtccaagtggaacggcaagggtgtcaccaaggctgtcgagaacgtcaacaccgtcattgctcccgctctgattgagaagaacctcgatgtcaaggaccagtctgctgttgatgctttcctcaacgagctcgatggtaccaccaacaagaccaagcttggtgccaacgccatccttggtgtttctctggccgtcgccaaggccggtgccgctgaaaanggcgtcctctgtacgctcacgtctccgatctcgccggaaccaanaagccctatgtcctccccgttcccttcatgaacgtcctcaatggtggttcccacgctggtggccgccttgncttccaagagttcatgattgtccccactgacgctcctaccttcactgaggctctcccccagggngctgaggtctaccaagctnttaagggtctggccaaaaancgatacnggcaatcttgccggcaacgttggtgaacnagggtggtgttgccccttgatatccaaaactggccgangaggctntttgagctcatcaaccgat

SEQ ID NO: 138 - DNA, 886 bp, Fusarium venenatum
  misc_feature (1)...(886): n = A,T,C or G
ctttttccttttgaaaaatcttcgacatcctactaaccaccaggacctcgaccaagccgccaagatgggtgccctcaagtacgtcgaagagcttcagaagaagaagcagtcggatgtcgttgccttcctcctccgagttcgctgctgggaactccgtcaattgaacgtcatccaccgcgcctctcgtccttcccgtctggacaaggctcgccgtctcggatacaaggccaagcagggctatgttatctaccgcgtccgcgtccgccgtggtggccgcaagcgccctgctcctaagggtgccacctacggcaagcccaccaaccagggtatcaaccagctgaagtaccagcgatccctcaaggctaccgctgaggagcgtgtcggccgccgctgcgctaacctccgagtcctcaactcctactggatcaaccaggactctacctacaagtactacgaggttatcctcgtcgacccccancacaaggccatccgcatcgacccccgcatcaactggatcgtcaaccccgtccacaagcaccgcgagtgccgnggtcttaccgccaccggcaagaaagtcccgtggtctcaacaagggccaccgntacaacaagaccaaggctggccgcaaaaagactggaagcgccacaacactntgtccctgtggcgataccgataaacgtctcgccccctggctgggacgtttgttttcgcaccacggctgtctggttgtactcgcgatttcgatttgggagggtttggctttggcactgnatgcttggactctggggagtcgggaaccttgtttggtagcataaaaaatggaatcaaaagtaattccaagttcatgattaagatttagatatacctacggtttcccggctaaaaa

SEQ ID NO: 139 - DNA, 615 bp, Fusarium venenatum
  misc_feature (1)...(615): n = A,T,C or G
ggtggacaaggtcaagctgaagcaaggnacccgtgtggcactcgacatgacgacacttaccatcatgagaatgttgcctcgcgaagttgatcctttggtgtacaacatgtctctggaggacccgggtcaggtgagctttgctggaattggtggattgaacgatcaaattcgagagttgcgggaggttatcgagcttnccctnaagaaccctgagctgttcctacgagtcggaatcaagccgccaaagggtgttctgttgtatggcccccccggaaccggcaaaactttactggcacgagctgttgccagtantctggagacgaacttcttgaaggtcgtatcttccgccattgtcgacaaagtacatcggtgaatcggtccactcattcntgagatgtttggatatgccaaggagcacgagccctgtatcatctntatggacgaaatcgacccatcggtggacgacgcttctcanagggtaccagtgcggatcgagaaattcagaaaacacttatggagttgctnaaccagntggatggatttgactacttgggccanaacaaagatcattntgggcaccaacccgacccgacacgttggaccctggactggttt

SEQ ID NO: 140 - DNA, 624 bp, Fusarium venenatum
  misc_feature (1)...(624): n = A,T,C or G
ccaccttgctgtcaagcacttctccgttgagggtcagctcgagttccgtgccatcctcttcgttcccaagcgcgctccctttgatctctttgagaccaagaagaccaagaacaacatcaagctctacgtccgccgtgtcttcatcaccgacgatgctaccgacctcatccctgagtggctcggcttcgtcaagggtgttgtcgactctgaggatctccccctcaacctgtctcgagagactctccagcagaacaagatcatgaaggtcatcaagaagaacatcgtcaagaagtctcttgagctcttccaggagatcgccgaggacaaggagcagttcgacaagttctacagcgccttttccaagaacctcaagcttggtatccacgaagactcccagaaccgatccatccttgccaagctcctccgattcaactccaccaagtctggggatgagcttacctccctcaccgactacgtcactcgcatgcccgaacaccaaaacaacatgttctacatcactggggaatccatcaacgctgtttccaagtctcccttccttgaagctctcccnagaagggtttgaggtntgtcctcgtgccccatgatgagnccctgactcactca

SEQ ID NO: 141 - DNA, 1012 bp, Fusarium venenatum
  misc_feature (1)...(1012): n = A,T,C or G
cgaccaattgaccccccggagttcaattgaacctctcctctccgccagaccctcggtccacctcgaacgacctctccgagccaaactccctcagttcacaatggcccacgccactatgcttgcgcgacgacagctcgcctcgagctctttgagcaccagagctaccagcatcgttggcctcgtccagcagcgaggctatgcgacacctcacggccctccccccgccaacttccgaacgagtaagcctgtgaagtggacgtgggataatgatagcaccctggaccgcatgggaaagtttttcctcatgaccgagatggcgaggggcatgtatgtcctgcttgagcagtacttccgaccaccttacactatttactaccccttcgagaagggccctatctcttcccgattccgtggtgagcacgctcttcgacgatacccctctggcgaagagcgatgtatcgcctgcaagctctgcgaggctatttgccccgcccaggccatcaccatcgaggctgaggagcgagctgatggatcccgccgaaccaccaagtacgatatcgacatgaccaagtgcatttactggcggtttctggcaggagtctttggccctgtcgacgccatcgttgagtcgcccaacgccgagtacgctaccgagacccgagaagaacttctgtacaacaaggagaagcttctttccaacggagacaagtgggagcccgagctcgcagccgncatncgcgccgactngccataccgataaactagtcaactgggaaagccgtcatgaaaaaagggaaatggagatgttggatttgaatgcatagtttttatttgttgttttcgcctttgttacctagggtcgtttggaacgtcgctgctgtaggaacataacttttttttggtggtagcaaggcggcaaaggactagaggggggcgggctttcggatggttcgagcggagagggcagatgtacataatctagacgtccaaaaaatgcccctttgtcactcat

SEQ ID NO: 142 - DNA, 1109 bp, Fusarium venenatum
  misc_feature (1)...(1109): n = A,T,C or G
ctgaatatgaacgcgacagagcgagttgtcgagtatacanaccttgagatggagtcactcgtgggggagaagccccctgctgcgtggcctacttngggaactatgaagattgataacctggaggtctcatatgcatatgatctgccacctgttctcaaaggaatctctttcgacgttaagaacaatgagagagtcggtgttgtaggacgcactggcgctggaaagtcgtccctgacacttgccttgttccggttcttggaggctcgttctggcagcgttaccattgacggtctggatatctctaaggttgatctgtatagcttgagatctcgtctcgccatcatacctcaggaccctgtacttttctcgggcactatcagatcaaacctcgatcctttcgaagataatacagacgacgagctccgcgaatctctgactcgtgtccaccttgtggattctcagcccgctacgcctgcaaatgaaccctcgtcggcagcaacatcgacacttgctgtcaagaacacaaacattttccgagacctctcaagccccatctctgaatctggaggtaacctctcgcaaggtcagcgtcaacttctatgcttggctcgtgccattgtagctcgacccaagattatggtcctggacgaggccacctcggctgtcgatatgactaccgatgcactcatccaacgaagtattcgtgaggagttcactgacagcacattgatcgtcattgcacaccgtctgagttccatcgctgactttgaccgtattcttgttctttccgatggtcaagtcgccgagtttggaacacccaagggagcttttgggaacaagaaggcgtgttccgcgacatgtgcgatagcagtggagagaaggaaaagttgagacagacaatatttnggttgaaaaatngaaaacagcacgatntttaggggnggattnaaaaggtggcgcacaagctgcaattggatntatggttnaaatggcaaatgcaatgatatttggtttacttcacttnttacaggcagcttcnttttanagctttccggatgcaccngntttaacttttggattaaaaaaaaccnaaaatggtacaaaaaggc

SEQ ID NO: 143 - DNA, 1087 bp, Fusarium venenatum
  misc_feature (1)...(1087): n = A,T,C or G
caaagccacttctttttttcatctctctactttactctactctactcttggcctcccgttccgttcaccatccaccatctatctttccttcaactgaaagcttcttctcagctgaatttcgttatttcccctttcctttaacaacccttgaaatctaaatccaccaactttagtcgccaaacaccgccaaaatgggtcacgaagatgctgtctaccttgccaagctcgctgagcaggccgagcgatatgaggagatggttgagaacatgaagattgtcgccggtgaggaccgagatctcaccgtcgaggagcgaaaccttctctccgttgcctacaagaacgtcattggcgcccgccgtgcttcctggcgcatagtcacctccatcgagcagaaggaggagtccaagggcaactcttctcaggttaccctcatcaaggagtaccgacagaagatcgaggccgaacttgccaagatctgcgaagatatcctcgaggtccttgaccagcacctgattccctctgccaagtctggcgagtccaaggttttctaccacaagatgaagggtggactaccaccgttacctcgccgagttcgccattggcgaccgncgcaaggactctgccgacaangtccctnganggctacaanggntggcacttganggttggcccaanactgagctttcttccacccacccccaatccggctttggtctcgcccttcaactttttccggttttctactacgaagattctcaacgccccctgaccaagcttggcaactggctaaacaaggcctttgatgaatgccatcgctgaacttggacacttctgagcgaaggagagctacaaaggactccacactggatcatgcaactggttccgtgacaaccttaaccttttggacctttttcgaggnccanaacttcccttgttgggncacggttgangcttccnaaggaggatgcccttgttgcccccaccnncgaggatgccnttgngggccgtntngccttcantttanaaggcccaatttgncctantagggagtggggttacaaattnactggccggcgttttanaacgg

SEQ ID NO: 144 - DNA, 702 bp, Fusarium venenatum
  misc_feature (1)...(702): n = A,T,C or G
caccacaatcctcttcgccgtcactctcccaagccatcccttcgtcaatccagacaagagaacatatccgtcaagatggctccctccaacctgccctccgtcatgaacgccaccagccaggacatcgagaccctgctggccgctcagtgccacctcggctccaagaacctccaggttcacatggagaactacctctggaagacccgtcaggatggtgtcaacgtcatcaacgtcggcaagacctgggagaagattgtcctggctgcccgtgtcatcgctgccattgacaaccccgccgacatctgtgtcatctctgcccgtccctacggtcagcgtgccgtcctcaagttcgccgcccacactggtgctaccgccattgctggtcgcttcacccccggttctttcaccaactacatcacccgatctttcaaggagccccgtctgatcatcgtcaccgacccccgaaccgacgcccaggctatcaaggaggcttcttacgtcaacatccccgtcattgccctcgccgacactgactctcccaccgagtacgtcgatgttgccatccccaccaacaacaanggtcgccacgctatcggtgccgtctggtggatgctcgccgtgaggtcttcggcttcgtggtaccatctacaaccgcgagaacccctgggacgtcatggcgatctttacttntaccgtgacccc

SEQ ID NO: 145 - DNA, 988 bp, Fusarium venenatum
  misc_feature (1)...(988): n = A,T,C or G
atatctcccccaaaatggtttctgctacaaatttccctgccgaagtcgtgccccaggcacctgaagaccctctctttggtcttgcacgagagtacaaggccgacgacagtcccaacaagattgatcttggtatcggcgcatacagagatgagaatgcaaagccctgggtgttgccagtcgtcaagaaggctgatgagatcctccgaaacgacccttgaactcaaccacgagtaccccccaatcgcgggttttggcagcttcacatccaaggctgncgagctagtctttggccccgattcttcagccatccaaganaagcgctnaacgacactacanacaatctctggtaccggtgccgtacacttgggagctcttttccttgcaagttctacaagggcaaccagactgtctacctntcaaatcccacatgggcgaaccatcaccagatcttcaagaatgttggcatgtcgatcgacacatacccttactttcacaaggagacnaagggcctggatttcgagggtttcaagaagactctgcaatccgntcccgagggttccgtttcgtccttnatgcatgcgcacacaaccctactggtgtcgaccctacgcaagatcaatggacttgagattgnttntattatgaaggagaagaaccacttccccttcttcgatactggctaccaaggatttgcctttggggatcttgtcaaggatgcctgggctatccgatactttcgtcgaccagggctttgagcttgttggttgcttagagtttcgccaagaacttcggcctctacggagagcgcgccggttgcttncacgccgtcacatctcctgctcctggggcttcaaacacaatcactcgcattggctctcaattggctatcctccagcgatctgaaatntccaaccctcctntgtacggggcccgaatngtcagcactgttttnaacgatcgcnaccttttggtgngggggnggaaacct

SEQ ID NO: 146 - DNA, 778 bp, Fusarium venenatum
  misc_feature (1)...(778): n = A,T,C or G
ctttctgttctcttatctcttatcgaaaatctacgtcatctcttactcccccactttccgccgcttcacttacaccaaaccgccaaaatgaacactggtcttgtcaacagccgnttnctctccaagccagatgaggtcggcgtcgttgctgtcggtttctcaggcggccagcccaaagctggtgtcgatattggccctgctgctctcatccagtccggtcttctcactgagatccgcgatgagctcggctacaagctctttggtgacgagaaggtccagcagttcgaggatctgatccccgagtcagaccctgacttccgcggtatgaanaagccccgccacgcatctgcggtgactcgcaagatcgcctcgcacacctatgagcactcacgcgaggggcgcatgactctcaccctcggnggtgaccacagcattgccattggtactatcgccggaactgccaaggctacccgggagcgtctgaaccgcgagatcgctgttatctgggttgatgcgcacgccgacatcaacactcctgagagcagtgacagtggtaacatccatggtatgcctgttgccttcttgaccggtctggccaaggagganaaggaggagtnttttggctggctcgaggatgatatgcgtctgagcgttaaaaagctggtgtacattggtcttcgatccggccacattggcgaaaanaaaatccttccgtgaacaccggcatcaaggcattcaacatgcacgatgtccacccgccacggtattggccgcgtcg

SEQ ID NO: 147 - DNA, 989 bp, Fusarium venenatum
  misc_feature (1)...(989): n = A,T,C or G
gtgaaactcacctgaggatccattcgagttttgttgctacttgtcgcatcgccaatcgtcattgccttgttccgttatccggtctcccctcgcagtcttagcttagtaccttggatctgctctggtttactctactacatctacccagacaccaacagtcgctttgaccatcctcatctacccctcgactagacatcttggttgctgcgcttcgcatccttcttcgactttatacccagtccctcctatttctcgattattcgatcgcaacaatggcccagcccggcgtgcaatcattgaagtgtgtggtgactggtgatggtgctgttggaaagacttgtctactcatttcttataccacaaatgcgttccccggcgaatacatcccaacggtctttgacaactactctgctagcgttatggtcgatggcaagcctattaagtcttggcctctgggataccgctgggtcaggaggattacgacagactgcgacccctttcataccctcagaccgatggcttcctcatttgcttctncatcgncagccctncatcattcgacaacgtaaaggcaaagtggtacccccgagatcgancatcatgcgcccaacanttcccattaattttngtcggaactaaactcgatctttgagaggatgcatccaccctcgaatctctccgacagaagcgcatggagcctgtatcatacgagcaggcgctgacctgcgccaaggagatcaangcctacaagtaccttgagtgttctgctttnacccanagaaaccttaagagtgtttttgacgaagctgtccgggccgtcctcaaccctcgaccncgccttcgaagcaaaagaanaanaagtgcnctatcctgtanatatctnatgaagtcaccgccatggcacacgcgcgtttgaagatnaacaaaanctcttgacgaccnaaacacngaatattctggatgcccacnagcatggctctgattntaga

SEQ ID NO: 148 - DNA, 832 bp, Fusarium venenatum
  misc_feature (1)...(832): n = A,T,C or G
caaaaatctccatttgctctcctgtaaaggcagcaccgcaccccaatctcccctcctcccaattgcacccggctgcaattgctctcctttcatctccaaaacctcccgtatacctctaatatgttccggaacgcccttcgacagtcgacgcgcgccgtcggcgctgtctctgccgctggcagggtcgctgctctccgaaatgccgcacccgcctccatcaacgccgctcgattctacgcctccgacgccaaggcttctcccaccgaggtctcttccatcctcgagcagcgaattcgtggtgtccaggaggagtccaacctcgctgagactggccgtgtcctttccgtcggtgatggtatcgcccgtgttcacggtatggccaacgtccaagctgaagagcttgtcgagttcgcctccggtgttaaaggaatgtgcatgaaactcgaggccggccaagtcggtgttgtgctgttcggttccgatcgtctcgtcaagaagggtgagaacgtcaagcgtaccggtgagattgttgatattcctgtcggccctgagatgctcggccgtgtcgtcgacgctctcggtaaccccattgacggcaagggtcccatcaacaccaaggagcgacgccgtgctcagctcaaggctcccggtattctgcccagaaagtccgtcaacaagcccgtccaaactggtctcaagtccatcaaccccatggttcctatcggccctnggtcagcgtgangttgatcatgggtgaatcgccagaccggttaaaaatgccgttgggtcccaacaccaccctttaaccaaaancgatggaacnatngcaacc

SEQ ID NO: 149 - DNA, 644 bp, Fusarium venenatum
  misc_feature (1)...(644): n = A,T,C or G
cgtcgaccctccaaacctgcgtcatggcgtcccggagactggctttgaacctctcgcgaggtctgcnaaaccgtgctgggttttcggccgccgttcntttcacacgaggctttgccactccctctaccgtnggcaagactcagactacaactcttaagaatggattgactgtcgctaccgagcactcgccctttgcgcaaacgtcgaccgtcggtgtctggatcgatgccggttcccgagctgagactgatganaacaacggtaccgcccacttccttgagcatctcgctttcangggtaccgccaagcgaactcagcagcaattggaattggagattgagaacatgggtggtcacctgaacgcctacacttcgcgcgagaacaccgtctacttcgccaaggctttcaactctgatgttccccagtgtgtcgacatcctctccgatattctccanaactccaagctcgagcagtccgttatcgagcgtgagcgcgacnttatcctccgcgagtccgangaggtcaaaaagcaggttgaggaggtcgttttcnatcacctcaccccacttgttttncaacaccagccctttgggccgacnatcttgggccttgnaaaaacatncgngacatccccgaatcggctt

SEQ ID NO: 150 - DNA, 2459 bp, Fusarium venenatum
  misc_feature (1)...(2459): n = A,T,C or G
cccaatatcgcatacggcattcctgacttggatgctaccgtgcgcgcatatgtcaacatgacatccactggcgagagcgtcgcatgtgttgaggcagacttttccaccggaaagacagttgagcaactatcagtcaaatgggtcactgccatcatcatcggaataggactcatatcctcagctctgatctcgctggcgggctatggcaatgcatcctctcaccttgctgccaacaccctcgctctattcacatacttccaagcccaagctattataggacttacaggaatcaccatgcctcccattgttgatgcgtggactcagaacttccaatggtccatggggcattatccgccttggttgggatgcaagatatcttcacctggtatcagcgcgccacaggcggcacacccgctcgcatcttcgatcatcttgccacttcttccgttcaagtcgccaagcgatctatcgagtatatccctggtgctgcagctctggttcgccgtggctttgccatgtccaaacggtccaacattgagcttgagaacggctcattcctggtctacggcatccagcgtgtggctttcagatcccggatcgagacaacgaatcttttcctcactgcgctcaccttctttatcgtcttcatcgtttttgcttgtatcctcgttctcatcgccaaggtcattctcgacctgtgcgcaaaacaagcttggatcaagcatgagcgcttccttgagctccgaacagagtggcgcacgctcctcaaaggcattcttcttcgacttaccctcatgggctttgctcccatcgctattttttctctctgggaattcactcaagttgactcggctgccttggtagtccttgccgtcttcttcttccttgccgtcacgatcaccctcgcattggcagcattcaagattgtcacctttgccagacatagcaacccagtcatcactctgtactcggactcgcgcattttgaacaagtgggggttcttgtatattccctatcgagctactgcctactactttggtgngccccagcttgcctatattcttgtcaagagcatgtttatcgctctgagccagaagagcggcgtagttcaagcggtgncctcattattatcgaggtggctgctttgatcgcgacaagcgtnatgcgccctttatggataanagcgtgaactcgttcaacattgcatcttcgtactcaacttcctnaacgccatttgctattatttttaccaatgtttggggtatgcctagaatgggctcctcagtcaccgggcttgtgctatttgttgtcaatgccgcattctctttgatccttctccttatgatcatcatatcgagtgcgttggtgttttggaggaagaatccggatgcacgataccagttcatggctgatgatcgancatcctttatgaagtccaagtcatccacgcagcttgacacaatgacgcagctggaaccctggctgccacagcccgtggggaccaacaaaacattcacttctttttgaacccaaccattcatctacatcatcccatccgaaataccatcaacccaagaacacttgcatcataccactgccatcatgcaaatcttcgtcaagacccttactggcaagaccatcacccttgaggtcgagtcctcagacactatcgacaatgtcaagtccaagatccaggacaaggaaggcattcctcctgaccagcagcgactgattttcgctggtaagcagcttgaggatggccgcaccctctccgactacaacatccaaaaggagtcaacccttcatctcgtcctccgccttcgtggtggtatgcagatcttcgtcaagaccctcacaggcaagaccatcacccttgaggtcgagtcctcagacactatcgacaatgtcaagtccaagatccaggacaaggaaggcattcctcctgaccagcagcgactgattttcgctggtaagcagcttgaggatggccgcaccctctccgactacaacatccaaaaggagtcaacccttcatctcgtcctccgncttcgtggtggtatgcagatcttcgtcaagacctcacaggcaagatcatccccttgaggtcaatctcagacactatcgatcaatgccagccaagatgctacgcccgtctccctccccgtgccaccaactgccgcaagcgcaagtgtggtcacaccaaccagctccgacctaagaagaagctcaaataaacgattactccatggatatggcgtctgggatttggcatttgggggtcgatggcgaggacagaggagagctttcttttgttcacacgaggctggttgttttttaaaatagcatgtgcagctccggcaatacattctagatgatgcccatatgacgatgtgccgtgccgtaaggtgtcccggccagacccctcaaaagaaataaaaagcattcaagcttcaaaaaat

SEQ ID NO: 151 - DNA, 636 bp, Fusarium venenatum
  misc_feature (1)...(636): n = A,T,C or G
ggtggtctcggacagctgtgtgacttgctcaccgcccctgaggaccgcgtcaaccttgacaacttctccctcgagaagtacagnttcatcgtcatctacaagaccgcttactactctttctacctccccgttgcgctcgccctccaccagctcaacctcgctaccccaagtaaccttaagcaagctgaggatatccttatccctctcggagagtacttccagatccaggacgactacctcgataactttggcaagcccgagcacattggtaagattggtaccgatatcaaggacaacaaatgttcttggctcgtgaaccaggctctcgccgttgccacccctgagcagcacaagatccttgaggagaactaccgccgcnaggacgatgaaaaggagaaggtcatcaanaaactctacgacgacttgaagcttgagcagctctacctcgactacgaggagaangncgttggccatattcgcgagcgcattgcccacattgacgaaaagtggnggcctcaaaaanactgtgtttgangccttctngncaaaatntacaagcgcagcaagnaagctgganttttaatgtattaaagangacatganatanaccggttgaaggcaaaagttctttgtctn

SEQ ID NO: 152 - DNA, 1686 bp, Fusarium venenatum
  misc_feature (1)...(1686): n = A,T,C or G
gaattttttttttttttttttatgtgattaaagtcgtattctacgtatcgatcaaacaaagaaacacctaacngtagaataagatctttgaacaaaagaaaccccaacgccaaaacacaaaacccttccnattgcctgatgcgccacgcgcttcgtcgcaggtcattcctttgcctgctggagaggagtcgaatactccaacatctcgtaatttgtagatccgtttatcggcggcggtgatatcgagtaataggtcagattgacgcttagaaaaggcagtccaaacagcagcagcatgcgagaccagctagaagaccggtcatgagaccgccgccgccgccaccaccgtttcttcttgaatcatcgttggggtaatagccttgagggggaggctggccgtagggaccctgctgaggaggataggggccctggccagcgggaaagggtccttgttgctggttgtagtagcccatctgaggaggagcttgctggtagtagccttgaggagggggcgcgccgccctgctggtacggatcttgctgataaccgccatatgtaggttgaggggcacccgggggagggccgtaggctggaggttcgtcttgcttgaaggccattgtgatagtagagtaaagcgctatgcgacaacagataggaggtggatcttagagtcgcgcaaaagatagatcgtcaggtacgaggaagatcccnttgttgatnagganacgntgtgaaacggnagcagagattggcacnagngggagncgatgcagagatgtgcccttagatcggatgantggtagctgttggaanggcttctcgccagcagcgacaagaagagcagcgtgaggcccgagaccatcaggggtagtagcnttgacatcggcaacaatgttcttggtcttggtgaagtcgataaaggtttgagcgccgagagacatgcacatnttctctttctcctcaccaccatcaatggcaatggcgtggatgcccatagccttagcgtactggacagcaatggaaccgagaccaccaccagcaccgacaatagcaagagantgaccggccttgacaccagactccttgatacccttgtagacggtgataccggcgcaaagaataggggagatggcctcgaggtcacactcctcagggatgcgagcaacgtggatagccttggcgacagcgtattgctggaaagaaccatcgacggtgtaaccggagagaagagcctcagcgcagagagactcgtcggcgttttggcagtaagagcagcttaagcaagagccattgagccacttgataccgaccttctcgccaatcttgagatccttgacaagctcgccgagggcgacgacaacaccggcaccctcgtggccaccaacaaggggcagcttggtgtcgaggggccagtcaccctgccaggcgtggagatcagtgtggcagacaccggagaacttgacgttaacgaggacctcatcgggaccgggcttctggacgggaatctgcttgtactcgatgggaccagcggtcttctcgaagatctgagcccactgctgggaaggaatttggggagcggccattttgattgttgggtgggttggttgttgggttgaagggtatcgaaaggttgtcgtgaagactgaagagttgttgttgagagtgttggagagttgtttgatgatc

SEQ ID NO: 153 - DNA, 581 bp, Fusarium venenatum
  misc_feature (1)...(581): n = A,T,C or G
cganatgacccgcatcatctggcaggtcatcaaggacaagttcatccacccctacctcgacatcgacctcaagtactatgatctcggtcttgagtaccgtgacgagaccaacgatcaggtcaccattgatgctgccgaggccatcaagaaatactctgtcggtgtcaagtgtgctaccatcactcccgatgaggctcgtgttgaggagttcaagctgaagaagatgtggctttctcccaacggcaccatccgaaatgcccttggcggtaccgtcttccgtgagcccattgtcatcccccgtatcccccgtcttgttcctggctgggaagaagcccatcatcattggccgtcacgccttcggtgaccagtaccgcgccaaggatgctgtcctgcccggtcctggtaagctctccatggtctacacccccgagggtggccagcccgaggagattgaggtcttccaattcaaggaaggaggtggtgttgccagactcagtacaacaccgacaagtccatcactggattcgctcacgcttctttcaactcgctaatgacaagggtctcccctctctacatgaagc

SEQ ID NO: 154 - DNA, 1137 bp, Fusarium venenatum
  misc_feature (1)...(1137): n = A,T,C or G
tccactggtgagtataccactgatcaattctatgtaattttcatcgccgtcgtcttctcgggagaaacatcagcaatgctattccagtacactacgagtatcacaaaagcacggacagcgatcaactacatattcgagcttcgacgccaaaaggtgcttcacgatgacatagggaatgagcctagctgtgagaagaacccgaatgggaagggcatcgatatttcttgccaagagctcgcctttgcgtatcctcgtcgacctaaactgccggtgcttcgaggtgtggacatcagcatcgaacctggcaagatggtagctctcgttggggcatctggatgtggcaagtcaactatgattgcactacttgagcggttttacgatccaaccagtggcatgataatggcggaaagtcaagatatcagcacaaaagataggcgattgcatagacgagacatcgctcttgttcaacaggagccggttctgtatcaaggttcgatccgagacaacatatccctcggtatcgaagagggcaacccgcctgacgacgacatcatcgaggcttgcaaacaagccaacgtctatgattttgtgtcctctcttcccgaaggcctcgccacttcttgtggcaaccaaggactctcgctctcaggtggccaacgccaacgcatcgctattgcccgcgctcttgttcgcaaaccccgtttgttacttctcgacgaagccactagtgcccttgacgcagagagcgaaaaggtagtcaaggaggcgctggatcgagcacgcgagggaagggcgacagtcgttgtcggacattgactaagcacaatccgggaggcgggttccatctgcgtgttttctggtggggaaatcgtcgagaganggagacacgaagatcttggttgcgaagagggggttgtattatgaaatnggttttgggccaatctctanataganaagcatgatgcttnaaaatgcgtcggggtttgagangactaaatctttattggtttgatcacatgggcagcggatattcggttggtctaaggtttgggggggtcatcttttttnatctggtcttggnctaaaccataagtcgggggatttccggcatatatcganagaatctggnaaattctt

SEQ ID NO: 155 - DNA, 605 bp, Fusarium venenatum
  misc_feature (1)...(605): n = A,T,C or G
caggattcgcgatgcccaactttctgcgctctggtcgcctacatcaagaacgagcgttgggacggcgtgcctttcatcatgaaggccggaaaggctctcaatgagcaaaagaccgagatccgaatccagttcaaggatgtcacatcgggtatctttaaggacattccccgaaacgagcttgttatgcgtatccagcccaacgagagtgtttacatcaagatgaactccaagctgctggtctcagcatgcaaactgtcgtcaccgagcttgatttgacctaccgaagacgattctccgacctcaagattcccgaggcttacgagtcgcttgttcttgactgcctcaagggcgaccagtccaactttgttcgtgatgatgagcttgatgccagttgggcgcattttnacaccactggtcactaccttgcgacaccangagatatcccattggagtatcctatggtctctggcctgctgcttgacncttactcnctatgntccaagtcacgcctgtgtaccaaggcacaccaacgtgttgtgcccacagttatgccctcaacatggaccgnccattngctttatccngctacaggacaacactgatgt

SEQ ID NO: 156 - DNA, 647 bp, Fusarium venenatum
ctcgacccaactggacaacttatttccatcttctcggcgtcccacgacgaaaagcaccgatctcggtccaagcaaaagtttccttcttacctttcgaactcgcttcacgttgccaacatgggcaacaccaccagcgcagtcttggacaatctcgtccaaggatccaacttcgacagagacgaagttgatcgtctgcgaaagcgattcatgaaactagacaaggacaactccggtacgatcgagcgcgatgaattccttagtcttcctcagatctcttccaaccctctggcaacacgaatgattgccatctttgatgaagatggtggtggtgacgtcgatttccaagagttcgttacaggtctttcggcgttcaacagcaagggaaacaaggagcagaagctccaattcgccttcaaggtctacgacattgaccgcgatggatacattagcaacggagagctttttattggcctaaagatgatgggtggcagcaaccttaaggccagcagctgcagaagatcgtggacaagaacatcatggaggccgatctcgacaaggatgggaagaatagctttgaggaggtcaccaagatggtgggaaataccgtggtagcatgagcatgatggttgaccagttttagcaagctt

SEQ ID NO: 157 - DNA, 622 bp, Fusarium venenatum
  misc_feature (1)...(622): n = A,T,C or G
cttcttcttattactctttacaatgactgtcaacaaacgcacaaagcagtggtggaagcaggccactatctaccaaatctaccctgcatccttctgcgactccaatggcgatggcatgggagatcttcaaggcatcatatccaagttggactatatttccagcttaggtgttgatgttatttgggtctgtcctatgtatgactcaccacaagttgacatgggctatgacatctctaactatgaagatgtctatggtccctacggtactctccaagatatggaagagttaatccgcaagactcatgaaaagggcatgaagatcatgcttgatcttgttatcaaccatacttctgacaagcatgcctggtttgaggagtcaagacttagcaaggatagccccaagcgtgattggtacatctggcgacctgccaagtactcagatgatggtcaacgtctccctccaaacaactggcgctccaactttggaaagggcagtgtctgggaatgggatgaggcaacaagggagtattatcttcatctctttgctaaggagcaacccgatctcaactgggaagaacccaagagaccanaaagggccatctatgcntcctctatnggaatt

SEQ ID NO: 158 - DNA, 1435 bp, Fusarium venenatum
  misc_feature (1)...(1435): n = A,T,C or G
catctcccaagctcaactcaagctcaagctcgcattctacgccagcaaattcgtccatttctcacaacttcttcacccaaaaacacctctaatcaataaccatggctgagatccgccgaaagctcgtcattgtcggcgatggtgcttgtggtaaaacctgtttgttgattgttttctccaagggcactttccccgaggtctacgtcccaaccgtcttcgagaactatgtcgccgatgtcgaggttgacggcaagcacgtcgagctcgccctatgggatactgctggtcaggaagattacgaccgtctccgacctctttcttaccccgactcccacgttatcctgatctgcttcgctgttgactctcccgactccctcgacaacgtccaggagaagtggatctctgaggttctgcacttctgccagggtctccctatcatccttgtcggctgcaagaaggatttgcgatacgaccagaagatcatcgaggagctccgaaagacgagccagaagcccgtttcccccgaggagggtgaggagatccgcaagaagatctctgcttacaagtaccttgagtgctcagccaagaccaacgagggtgtccgtgaagtgttcgagcacgctactcgcgctgctctgctgtcacgcagcacccgtagcaagtctcacaagaagtgtcttgtctgtaaagggcgccatcgaagccctttgaacgcagccgacgcacacataccgtggcttgactctgcgttgtaatcctttgtcacaagtcaacctcaacttggccccggcagttcggatgaaacgggcccgtggcggccaaaaaggccagggctgtcggcatgcatcggttttctcggaatctggagtttgatatcgtctcgctcatgtctggtccatcggcctacacgccgacctttctcgctggattgatggttttctagtcggtggaagcccatggtttcttggacctcctgaatctcgcaggggggttgctattatcgacagatacctcatcttttttattatcaccactggcaggcgagcgggacctttgttttatgtatgtgcttgccgcgtatggggaggtgggccagatgtctttttttgttgggggcttttgaggaggaggaggaggagtgactctcgttccttgctctcctgtctagtctgtcagtgcaggctgatggacgaanaatcactcgggagatgttacaggaggccaggananactctgtggactggttaccgcgaaaaccgtttgcgtctgcttatgtgtggatatgggactcggctgggggaacccaagtcaagtcaggccataaatcttttcgttttttctcttggagcctcaaaaccgttccttaaaccatggagatgggacatnttnttgcgtaggggcccgnccggttnatctcttgatttttttnaaaaaa

SEQ ID NO: 159 - DNA, 796 bp, Fusarium venenatum
  misc_feature (1)...(796): n = A,T,C or G
tgagcggagataagatggacgtcgaggtcgcggagcagaagatgaactccatggagcacagcgagcagcactacttcaagagctacgatcaccatggtattcacgaggagatgttgaaagatgaggtccgaacacgatcgtatatgaacgccattatgcagaacaagcacatttttaaggacaaggtcgttctcgatgttggctgtggaaccgccattctctccatgtttgctgctaaggccggtgctaagcatgttattggtgtcgacatgtccaccatcatttttaaggcccgtgagatcgtcaagattaacggcctttctgacaagatcactcttctccagggcaagatggaggaggttgagctccccttcccaaggtcgacatcatcatttncgaatggatgggatcttcctnctttacgagtccatgcttgacaccgtcctctacgcccgtgacacttaccttcagaaggatggcttgatcttcccgacaaggccaccatcttcttcgccggtattgaggatggcgactacaaggaggacaagattgagttctggaacgatgttacnggttcgactacaccccccttaaggccctgnttttttgngaacccctcgtgacacttntgangtcaaggttggtgncaaccgancccntctgnccttaccctgatctttacacctgcnccgcgccgacctggntttccaagggccctttaacttttccgtaacccgacgattnntccccccctggggggcggggttgaanttgactttaccgctgccccaagcct

SEQ ID NO: 160 - DNA, 902 bp, Fusarium venenatum
  misc_feature (1)...(902): n = A,T,C or G
gttagggacgcttaaacactttcttccttttttcctcccccccaaaaatcttgttcctctgtttctctcatcaacagaaaacagcagcacccaacctcagctattattctctcaatacctgctgcatacctatagccgcgttcttcaatacctaagaatcgacattctcttttaacgtcacctaccatggccgaagagaaggcagtcggcgcgcctgcgctcgacaccaacatcgagactggcggcttcgatgagaagcgaggacaagctcccgctacccacaaccccaaggctcccgtcgccgaggatgaggagcccgatgaggacatggacgccctgatcgaggacctcgagtccgaggacggccacgagatcgacgacgaagaggaggccactcccggnggtggacgtgtcgtccctgaagaccagctccagactgactctcgtgtcggtttaactgaagcagaggttatcgcacgcanaaagaagtggggcctcacccnatgaaagaanaaaganagaacatgattctcaagttcctcatgttcttcggtggcccaattcaatttgtgatggaagctgccgctgttttggctgctggacttgangactggatcactttggcgttatctgcgctctcttgcttcttaacgcttgtgttggatttattcaggagtatcaagctggcagtatcgtggaaganctgaagaanactcttgctctcaaggctgttgtcctccgtgacggtactctcaaggagatcgaagcccctgangtcgttcccggtgatatccttcaagttgaagaaggtactatcattcctgctgatggtcgtttcgtcaccgaaggctgcttctgccaggttgatcatctgccatcaccgganaatctctcgccgtcna

SEQ ID NO: 161 - DNA, 925 bp, Fusarium venenatum
  misc_feature (1)...(925): n = A,T,C or G
ccaactncatcttgnatnttgcatctngcatcttcattcttnatnaacaccacagctcgcaatactctttgtcgagcatctctattcacattcaacccggtcgcattctcgatccgattgcccatcatgaagagcgctcttcttaccgctgccgcgcttctgggctctgcccaggccggcgttcacaagatgaagctcaacaaggttcctcttgccgaccagctggctatgaactccgttgaggaccaccttcagagcctcggccagaagtacatgggtgctgctcgccccaagaacgctgccgactacgcttttgctaccaacgtccccagcgttgagggtggccaccccgtccccgtttccaacttcatgaacgctcaatacttctccgagattaccattggtactcctccccagagcttcaaggttgtcctcgacaccggtagctccaacctttgggttccttcccaagagtgtggcagcatcgcctgctacctccactccaagtacgactcatctgcttcatccacctacaanaagaacggcagcgagttcganatccattacggctctggcagcttgtccggtttcgtctccaacgatgtcgtttccattggcgacctcaagatcaaggaccaggactttgnttgaggctaccaaggagcccggnctggccttcgntttcggncgctttcgatgggatcctcggtctcggcacaaccgaattgccgngaacggcatgggccctcccttttaccaaagggttaacaaaaactcctggacgacgccggttttgttttctaccttgacggtaagagggccaaancgaggctactttcgggggggtgacaaggtccaagaacactggggactcgattcatttctttcnccgcaagggttantgggagggcnaccttntgccttt

SEQ ID NO: 162 - DNA, 857 bp, Fusarium venenatum
  misc_feature (1)...(857): n = A,T,C or G
atcctcaagaagtacgatggtcgcttcaaggacatcttccaggaagatctacgacaccacctacaagaaggatttcgaggccaagaagatctggtacgagcatcgcctcattgacgacatggtcgcccagatgatcaagagctccggtggttacatcatggctcttaagaactacgatggtgatgtccagtccgacattgtcgcccagggcttcggctctctcggtctcatgacctctgtcctcatcacccccgatggcaagaccttcgagtctgaggctgctcatggcaccgtcactcgccactaccgtgagcaccagaagggcaatgagacctccaccaaccccattgcctccatctttgcctggacccgtggtcttatccagcgtggtaagctcgacgacactcccgagctcgttgccttcgccgagagcctcgagcaggcctgcattgacactgtcgacatcgacggtatcatgaccaaggatcttgcccttgccactggcaagtctgagcgcaaggactatgccaccaccaacgagtaccttgatgctgttgagcgccgcctcnagaagaacctcaaggagaagctgtaaacatctttacaatggattcccaaacttcccctaatcactcaatacttccgcttctggtctcttttacactgcaagancacactctatcttcaggcatcggcgtcgaatttgttgtcaccgtctgaatgcatctcactcccaacaaaccacnagacctcacctcttgtggcttcttgacatccatctctcacggaaaaaaaaaagggttgtcnatncttcatcaccggaacccctgcaaggcccctgccgcaactacaattat

SEQ ID NO: 163 - DNA, 1049 bp, Fusarium venenatum
  misc_feature (1)...(1049): n = A,T,C or G
ggaanaattcgggccgcaggaatttttttttttttttttngaaggatgaaatttctttttcatttcagaccgttaagccatcnatcaccatagcctatacgatctgaagtgtcctaaccggccaacctatgcaatgaaacacaatggattcgtgactccgcggcaccagtttccagcttcccatcagttcataaaacattcccgctctagtatcgcttgccctcgcgcagagtatcggcgaactcgtccaggggacttcggatgagcttggtctccttccagaggttaggggtgaggaatccgtaggtgttggagacggcaacgaaagtggccttgagggtgttctcgagggtcttggtggaaccggcagaggatgtgtaggcgtccttcgacaccggcgagctggaggaatcgcttgacagcgggagaggcaacgaggccagtaccacggggagcggggatgagacgaacggtgacggaaccgcacttgccgctctccttggtgggaaaagagtggacggcaccaaggttggtaccccagtaaccacgtcggacggggatgacgcttgagcttaacgatgatgatggcggcacggatggcggtggcaacctccttggaggtcttgataccgagaccgacgtggccctcggagtcaccaatgatgacaatggccttgaatcgggttcgctgaccggcacgggtctgcttctggacgggcttgatcttcatgacctcatccttgagcttgggcagnaagttgtcgacgatctggtactccttgatgggcagagagtgaaggtagatctcctccatgctgttgatcttgccggccttgacgagacgaccgagcttggtgacgggctgccactccttctcctcgttcttaccgcgaccacggccacggccacgaccgcgtccacgtccacggtcaccacctcgggaagcgaagcctccaccgcgagaagttcctcggtcagccattgtgtctgattgtgttgattgagctggggggtgggagggagaagttaggtgctacgcaagagcaaag

SEQ ID NO: 164 - DNA, 728 bp, Fusarium venenatum
  misc_feature (1)...(728): n = A,T,C or G
gcttgctcaacaaggagcagncaagcttcttttgatatcatggatgtcactacctcagaccgaagcccccgctcgtcntnttgccgcgcaggcgcttgcacnaatnttgataagcacgaatcctgcacttgtctttggtggaaacagatctacccctattggtgctgctgtaaggccactcgtgtccattattccacccgacccggctgctcagacgcgagatctcttgccctcctttgaggctctgatggcgttgaccaatcttgcttctatggacgacgaggagttgagacgcagcataatcaacaccgcgtggacgcagattgaggaacaaatgctagcctccaacacacttgtttcaagagctgccgttgaacttgtctgtaaccttgtgcagacgcctgaggctgttgctctctatgctgaaaaaactgccaaggcccgcaatcgtcttcatgttctcactgctctagctgatgcacctgacgccggaacccgtagcgctgctggtggtgcattggcgtcactgaccaactttgaangtgtcatccgaagcattattagccgagaccgcggcgtcaaatttattctgggaatgtgtgtggacgangaanaagatatccgacatcnaggcgtgtttgtggtgacaaacatggtcacagcggaaggtgaantcngcgaacttgcacnggaaaaggtcaagaacgaaggaagctcnaaacctcaag

SEQ ID NO: 165 - DNA, 922 bp, Fusarium venenatum
  misc_feature (1)...(922): n = A,T,C or G
cttgcacccaacaattcgagggacgactaaccccagcagcacaggaaatccaaatcttcgccgaccggtttgaggatttgtttgtctagccgtcgactgagctgcctttctttccttttctttaatccccccagaaaagacggttacgatgtccagcttcgagcaagttgtcgtcatcgatggcaagggccatctccttggccgactcgcctccattgtcgccaagcagctccttagcggtcagaagatcgttatcgtccgttgtgaggcccttaacatctctggagagttcttccgcgccaagctcaagtaccacgcccacctccgaaagatcacccgatacaaccccacccgcggtggtcccttccacttccgcgctccttccagaatcttctacaaggccgtccgtggcatgatccccacaagaccgcccgtggtgccgctgctctcgancgcctcaaggtcttcgaaggtgtccccctccttacgacaagacaanaagtcgtcgttccccaggctctccgcgttctccgactccagcccggccgcaagttctgcactgtcggccgtctgtcccacgaggttggctgggaattaccaggatttcgttgcccgattggaggagcgaagaaaggctaagggtgccgcctactacgagcgcaagaagattgctgccgacaactggccgatgccaagaagaacgccactgtcaaggaggagacctcaaaggctcttgccaacttcggctactaagctgttcatatncctcgacctggaatcttgccggctagatacagctggcaacgctatcatttctatgcgtttcattagatgcgccggnggtcaaanggattacttgatttntgantgatggcaaggtgntngaggataaatgtcnatncccaaanaatgtttttnaaaa

SEQ ID NO: 166 - DNA, 1247 bp, Fusarium venenatum
  misc_feature (1)...(1247): n = A,T,C or G
ggttttccccccttcttcctttctcttcttcactccacccaacaatctcccctcagtcctttgtcgtctgaataaccatcttcacaatggctgcctctaccggatccaccaaggtcgacgctgtcgtccagaacatcaaggctgagactcctgagaagaagtctggccttgccctctactcccgattcgcccttgccggtgctgtctgctgttccgtcacccacggtggtctcacccccgtcgatgtcgtcaagacccgtatccagctcgaccccgctacctacaaccgcggtctcatcggtggtttccgccaggtcgtcaagaatgagggtgctggtgctctcctcactggtgtcggccctacctttgccggttacttcctccagggtgctctgaagttcggtggttacgagttcttcaagcagcagtggattgacactctcggctacgagactgcttccaagaaccgaactgctgtctacctggcctcttccgccactgctgagttcttcgccgatatcgctctctgccctcttgaggctacccgtatccgtctcgtctctgagcccacctacgccagcggtctcgtctctggcttcggcaagattgtcaaagaacgaagggtgtcggtgctctctacgccggtttcggacccattctcttcaagcagatcccttacaccatggccaagttcgtcgtttcgagaaaggtcttttgagtctgtctttccgcactttccccaagaaggacctcttcgacggtatgcagactgntgccaaccttggctccggtctgaatggcggtttcgccggtgncatcgttttttagcccggcgacaccatgctcttcaagatcaaacaagaccaagggtctcccnggtgagggcactgtctctcgtctcgtcaagatcggtaaggagctcggtatccgtggctcttactctggtatcggtgcncgtctcttcatggtcggtactctcactgcaggccaatttgccatttatggcgacttgaagaaagctatgggtgctactggtggtgtngagatcgctgcttaaacgacctgaatacatttngataattgtggagaaaaagttactaggtgcaaaggatgaangggtnaatagccgtttncaagntcttgatgcactttcggccatttcgaaanaccatgatagataatgtcactnaagngcaggatgcttttacnaatnctttccttaaccttgtaaatcgttccaaaaccgt

SEQ ID NO: 167 - DNA, 646 bp, Fusarium venenatum
  misc_feature (1)...(646): n = A,T,C or G
gccaaggttcccttccctaaccctacgacttatgacgccattctgcgataccatctcgagatctgcgctcctgtttcccgtcaattcgtttctactctcgctgctttcgctcccaacgacgctatcaaggctgagatgaaccgtctcggtagcgacaaggactacttccatganaagaccggccctcactactacaacatcgctcgtttcctctccagtgtcagcaagggtgagaagtggaccacaattcccttctccgcctttattgagggtctcaccaagctccagccccgttactactccatctcttcctcctctntggttcagcctaagaagatctctatcactgccgtcgttgagtcccagcaaatccctggcagggatgaccctttccgnggtgtcgctacaaactacctntttgccctgaagcanaagcagaacggcgaccccaacccagcacctttcggncanacatatgagcttacaggtccccgcaacaagnacgatggtatccatgttcccgttcatgtcgtcactncaacttnaagctaccttcggatcctggcaagcctgtcattatnatnggccctggtactnggggtccctccttttccgggggtttcctccaagaaccgtgccaaggntg

SEQ ID NO: 168 - DNA, 1486 bp, Fusarium venenatum
  misc_feature (1)...(1486): n = A,T,C or G
tgagattcacaagggtattggttatgcgcccgagaagtacggcgtcggtctgtggtcgcagaacagagctgagtggcagatcgctgattttggcgctgcttctcaatccctgtattcagtctcactctacgagactctcggtcccgacacaacagaatacatcatcaaccatgccgaggtcgcctgtgttgtctgctctcttccccatatccctgttcttctcaagatgtcgcctcgacttccaggcctgaaactcatcgtgtctctcgatccccttgagcagggtgaactggcttctcacaccaaagcctctgtcctgaatgagattgcttctcatcatggaattcagatcttttccatggctcaggttgaggagattggcgccaagtctggacgtgcacctcaaccccctacccgagaagatatctgcaccatcaactacacctctggtactactggtaaccccaagggtgttttgatcactcacggaaacgccgtttctgctatcgcaggtggccgaacgaacggcaacgtgagccccaaggatactcacatgtcgtatttgcctcttgcccacatttatggccgactcattgatcagattgctgtcgctgagggtgctgcgattggtttcttccggggtgacatcctgggcttggttgacgatatgaagatcctcaagcccactggtttcatctctgttcctcgactctttaaccgtttcaattcagccattcgcacagctactatcgaagccgatggagtccgtggcgctctttcccgacgtgttatcgataccaagaaagccaatatgcgactaccgccaggaaaggcttccaacacccacttcttgtacgaccgaatctggactcccaaggttaaggccgctgtgggcatggacaaggntcacagcatggtcagtggcagcgcccaacttgatcctgatgttcagcagttcctacgtgccgcctttgccaaccactttgcacaaggttttggcatgaccganacatacgctgtcggctccatccaggcccgaggtgatttcactactggaaacatcggcggtcccatgtgttgtgtggaactctgcctcgagtccgttcccgagttcgattacactgtggatgacaagcccaaccctcgtggcgaagcttctcctccgcggtcctgttattttccgtgagtactacaagaacgatgaggagacccgcaagactctggatgccgacggntgggttccataagcggtgacatctgcgaagtggacaagatgggtcgcttcaagatcattgaccgcaanaagaacgtcctcaagctcgcccagggcgagtacatctcccctgagcgtatcaanaatgtttacatgggcagcaccagcctcgtcaacgcggtttttcgtccacggngacggcactcantcctcgttggtcgcgatttttggcattgatgtggaaaagcttttgccccattcgctaacaagaat

SEQ ID NO: 169 - DNA, 552 bp, Fusarium venenatum
  misc_feature (1)...(552): n = A,T,C or G
gtgggtgtttcagctacaagcgtggacgaaacttcaaaagtttgattttagagacacaccgaacaaaacctttgccaagctcaagaccctctttgagggaagtgatatgtatcagcgagcttcgccaactatcgctcatctcaaagaagttgtagagtattgtaagcacttgagtgtagggacaaangtctacatcaatcctctcaacagtctgaaggaggccttttacacagggggcgttcttttctcctgcctctatgacaagaaggtcaangatgtttttgctgccggtggcagatacgatcaattgatcaaggaacatcgacctaaagttggcagccagtttggagagcgtcacgctgttggattcagtttggcgtggggagcggttagcaaaaaccccaaaagctggtggacgttcgttcttgaagaaggctgaagatgaatcaaatggtctattcaacgctcgacnatgtgactgtcttgttgccagtttcgatgctgctgtgctganatcgtcaggtgttganatactccagactctttgggcgc

SEQ ID NO: 170 - DNA, 1522 bp, Fusarium venenatum
  misc_feature (1)...(1522): n = A,T,C or G
aaggcgtacgacacttttgaggatatcaactcagaccctgaaattgccgattctctgcgaaacctgtaccagcaccctgactacgtcgaattgtaccccggcatcgtcgcagangaggcaaaaacgcctatggttccaggtgtcggtatcgctcccacgtatacaatctcccgagtggttctctcagatnctgtggctcttgttcgtggtgacaggtactacactatagactaccatccacgcaacttgaccaattggggcttcaaggaagttgattacgacctcaagatcaaccatggctgtgtcttctacaagctcttcttgcgcgcattccctcagcacttcaagggcaattccgtctacgctcactaccccatggttatcccctcaganaacaagaanattctcactgacctgaagcgcgcggatcgttttgactttggtcgtcctgcgcccacagcaacacgcatcaacattgtgggctacaaggcagccaagtacatccttgaagaccaggtcaagtaccgtgtctgctgggaggagggcctcaagcaccttatgggtgagggtggtggacgctttatgctgtctggcgacacagcgctgcacgcacagcagcgcaagtgcatgggtcgtctgctgtacaacgacacctggcgcaacgcggttaagtcgttctactcgacaacggccgagatgcttctgaaggaaaagtcatacaagcttgcaggtaagacacaagttgatgtcgtgcgcgacgtgggcaacgttgcacacacacactttgtcgcgaggatgttcaaccttcccctcaagacgaagcagaaccccaagggtgtcttttcggaacaggagctgtacatgatccttgcagtcatctttgtgtgcatcttcttcgatattgaccctgccaagtctttccctctgaggcagggtgccagagaggttgcgcagcagttgggtaagattgtggagatgaacgtcaaacttgctaccagcgttggtatcaaagggattgtttaccagcaagcccaacaagaacgatgatccgctcgctgcgtacggtgagaacatggccaagggtctgaanaagctggtctgagcattgatgacatcgtgtggagccagatcttgcccactgctggggctatggtgccgaatcaggctcaggtgtttgcccaaaccctggattggtacctttctcctgctggtgagaagtatcgccctgagcttcatcgtattgccgctctggagacaggcaacgagacggatgctcttctgctcggctacgcgatggaagtattcgcatggctggtacatttggactgtaccgcgaaccacaaccgccgattcatccaaaaaaatnacgtcgtgaagttcctgtcnaggctggtgacaaatctttgtttcctttgtcacactgccaaanacccaacatcttccccaaccccgaagaattgatcctcncctcctctggaccntatatccctatgctttgccccatcttgtctttgaaaaaana

SEQ ID NO: 171 - DNA, 630 bp, Fusarium venenatum
  misc_feature (1)...(630): n = A,T,C or G
gtcacactcccctactccgtacgtgagggtatcaacatcttccttgacggtcacatccccaccgaaaacttgcgattccgtgatgagtctttgaccttcanaattgcaganaccgccgatgagttccaaatcgacaagtcgcgtgcattcacctaccccaagatgganaagaccctaggcagcttcaagctcagcatcgaagctggtgacttcactgattccgagatcattgtcatgatgggtgagaacggtactggaaagacaaccttctgtcgtntcttggccggcgccctgaagcccgacagcaanaagagcgtccccgagatgcgaatcagcatgaagccccagaccattacccccaagttcgatggtactgttcgccagctgttcttcaanaanatcaagcagtctttnttgtctccccagttccagaccgacgttgtcaagcccctcaagcttgacgactttttgaccaagaagtcaaaaacctgtccggnggtgaattgcaacgngttgctattggtcttgctctcggnatccctgttgatatctaccttatcgaagagccctntgnctaccttgattncgagcagngtttattcgcctcgggggttatnaaacgatttatna

SEQ ID NO: 172 - DNA, 625 bp, Fusarium venenatum
tgcgacgccatctggatggagtccaagctgcccgattacgctcaagcccaacagttcgccgaaggtgtccacgctgtgtggccagagaagaaactcgcctacaacctatctccatccttcaactggaaagcggccatgcctcgtgacgaacaggagacttacatccgacgcctgctaagctcggttactgctggcagttcattactcttgcaggcttgcacacaacagcattgatcagtgaccagttcgcaaaggcttacagcaccgtcggtatgcgtgcatacggtgagcttgtccaagagcctgagatggaccaaaaagtcgacgttgtcaaacaccaaaagtggagtggtgctcctacgtcgacgagttgcagaagatggtcactggtggcattagcttcacggctgctatgggcgccggcgtgactgaagatcaattcaaatagatgtcacccgagcgagtgatgggatgattacggaggcgaggaaacgagacgcgatgtctcgtgggaaaactttatggatgtgggaaaataaaaagacaagcggcgaagcttttataatcttttaagcatttaaatatcatgtactttctgcaaattctgacttgcatttccgtcaaa

SEQ ID NO: 173 - DNA, 588 bp, Fusarium venenatum
  misc_feature (1)...(588): n = A,T,C or G
ggaaagtactctgaagtctttgagggtatcaacgtagtcaactaccagaagtgtgttgttaaggttctgaagcctgtcaagaagaagaagattaagagagagatcaagattcttcagaacctggctggcggccccaatgttgttgccttgcttgatgttgttcgcgactcgcagagtaagacaccgtctctgattttcgagcatgtcaacaacaccgatttccgaagcttgtaccccaagttcaatgatattgatgtccgattctacatctttgagctcctgaaggccctcgatttctgccacagcaagggaattatgcatcgcgatgttnagcctcataaccgttatgattgatcatgagaaccgaaagcttcgtctgattgattggggtctggcncgaattttatcaccctggtacccgaatacaatgttcgtggtcgcctctcgttatttcaagggccctgaggttgttggtcgatttccaggagtnccaatacnagccttgatatgtggagccttggagcccatgttgcctcctganctttncccaaaagagccttttttttcacnggaancagaactccgant

SEQ ID NO: 174 - DNA, 588 bp, Fusarium venenatum
  misc_feature (1)...(588): n = A,T,C or G
gacggctttgctaacgtcagcgtcgacacctggcttgaggtcattccccaattgattgcgcgaatcaaccaaccgaacaagcgcgttcagcaatcggtgcataacttgcttgccgatgtcggacgagctcatccacaagctttggtgtatcctcttactgtcgccatgaagtcctggcagaacacaagacgatctcgttccgcagctcaaattatggacagcatgcgacagcatagcgcaaacttggtcgctcaggcagacattgtcagccacgaactcattcgcgtggccgtcttgtggcatgaactttggcacgaaggactggaagaagcttcgcgtttgtactttggtgaccacaacattgaaggcatgtttgcaactctggagcctttgcacgagcttcttgagcgtggacctganactcttcgtgagatctcattcgcgcaagcatttggtcgagaccttaaggaagctcaagantggtgccggcaatacnanacaagtcaagactcaatgaactgaaccaagcatgggatctctactaccangtgttccgtaaatcacangcagcttcctcaggttactact

SEQ ID NO: 175 - DNA, 756 bp, Fusarium venenatum
  misc_feature (1)...(756): n = A,T,C or G
tcctcaattcttttacttcctacaaaacatcgcaatcatgtcgctgtccaacaagctctccatcgctgacgttgacgtcaagggcaagaaggtcctcatccgagtcgacttcaacgtccctctcgacgccgacaagaacatcaccaacaaccagcgaattgtcggtgctctccccaccatcaagtacgccctcgagaatggcgccaagtccgtcatcctcatgtctcacctcggacgccccaacggctcccccaacgagaagtactccctcaagcccgttgtcgccgagctcgagaagctcctcagcaagaaggtcacctttgcccccgactgtgtcggtcccgaggtcgaggagatcgtcaacaaggccgaggatggctctgtcatcctcctcgagaacctccgattccacattgaggaggagggctcttccaaggataaggagggcaacaagaccaaggccgacaaggctcaggttgaggctttccgtaagggtctgaccgctcttggcgacgtttacatcaacgacgctttcggcactgccaccgtgctcactcctccatggtcggtgtcgacctcccccaaaaggcctccggtttcctcgtcaagaaggagcttgagtactttggcaaggcttttgagaacccccagcgcccctttctgccatcctggggggngccaaggtctcccaaaaganccacttaatcacaaccttttttgaaaggtcaacacnnttttatttgngggggattggcn

SEQ ID NO: 176 - DNA, 591 bp, Fusarium venenatum
ctggaatcaccgcaacgttcgacgatcagcttcgcagaacatcggcatcatgtctacccgaaggccccaattctctcagcaggtgcttatcgacaccactccgttgccctcggacattcccgctgtcaaggaggtcggtgccagttctgcgcctcttctttcagcctctttcttcatcggcgctcgatgccgcgactacagcgatgattacatgcaatgcaagaacgacaaccccggccgaggagagtttgagtgcttgaaggaaggtcgacgagtcactagatgtgcctccagcgtcatcaaggacatcaacacccactgtctggccgagttccgcaagcactgggaatgccttgaagaccgaaaccaccagctatggcagtgccgccctgctgagtggaagctcaacaagtgcgtttacgataacttgaaacttgagaagaagattcctgaccagcccaccaactcgactcccgttcacctccgaccaaagcagatctttgccgacgtgcgcatcggccctggtgatggtaagccctttgttccggggcaggaggatgcgcacaatagaatgctggaatcagttaaagt

SEQ ID NO: 177 - DNA, 587 bp, Fusarium venenatum
  misc_feature (1)...(587): n = A,T,C or G
ctattgccggccagattcccggcttctgcgctcttgtcgaccgtaacgttctcctcaacgatattatgggcagcatcgaaagaacttgtctccgacacttctcaacatgttcgcgctgcgcttggcaccagatcagtggcttggctcctattcttgggaaagcaagaaaccattgaccaccttctcccatgttccttcagatgctcaaggacgantttcccgangttagacttcatatcatctcaaagctcgagcttgtcaaccaagttattggcatcgacctgctctcgcagtcactccttcccgcaattgtgcaactcgccgaagataagcaatggcgaatgcgacttgccattatcgagtacattccccttctggccagccaactcggtgttcaattcttcgatganaanctcagcaacttgtgcatgggctggcttggagatacngtcttctccattcgtgaagcggctactcacaacctgaagaaacttactgaagtttttggtgtcnaatggggcagcgaggctatcattcccaaggttatggctatgggttaccacctaactacctctacagaatgacta

SEQ ID NO: 178 - DNA, 2012 bp, Fusarium venenatum
  misc_feature (1)...(2012): n = A,T,C or G
cagacatctcgtttcaccccccttcgtttcaacagtctttcccacatcagactgccagcaggactcaagtcaaaatgacttccaccggtcctatcgacaacgacgccatcgcccgctcagggctcgtagaccccgagactcacggcatcccccaggtcgccgccaagggctctatggacgtgacacgccgctccgtctccgactctgacgatgagcttcccacacaggaggagcttcagacgctccgtcgtgtctctggaaagatcaagtgggccatgtacaccattgccttcgtagaggcctgcgaacgtttctcctactacggatccgctgtgctctacaccaactttgttgcccagaagctccctcctggttccacaaccggtgctcctcttgatcccgatggtaaggctggcgctcttggcatgggtcccaaaaccgcccagggtatctctctgttcaaccagttcttcgcttatctgatgcctcttgtcggtgcctgggttgccgatgctaagctcggtcgtttcctcacccttcacatcgccattgccatctctaccattgctcacactatcctggtcgctgcttcatcccccaacgtcattgtccgcaaggaccctgcattcggtgccttcatcgtcggtctcatcactctctgcgtcggaactggtttcttcaaggccaacgtttctcccctcctggctgatcagaatgaggacaccaagatgcgcgtcgaagtccgcaacggcgagcgagttattgtcgaccctgccgtgacaaacacccgtgtcttcctctacttctaccttgccatcaacatcggttccgtctgcggtcagattgctatggtctacgttganaagtaccactccttctggttggcttcttcatcctaccatcttcttcctcatcgctcccattgtcctggctgtcaacaagaagaagtacaagctcaagcctgcgactggttccgtcctgtccaaattcttgcgcatgttcatctacgtctccaagcgcagccctgctttccgacctaactgggagcacgccaagccctctcagattcctgtcgaccagcgccctgcttggatgacctacnatgacgcctgggttgacgaagtccgacgnggnctcatggcctgcaaggtcttcctctacctgcccgtcttccatctggcttacaaccagatgaccggtaacctgaccacccaggcttccaccatggttcttaacggtgtccccaacgatgttatccagaacctgaaccctatctccattgtcatcatggttcccatcatcgatcacgttctgtaccccggtctccgaaagctgggcatntctttcacccccatcaagcgtatgacagttggtttcttgatctccgccctatccatggtcgcctctgcagtgatgcaacactacatctaccaaaagagcccttgtggcaagtatgccaacggtgacgacccttcaactggcgagaagtgcgctcccgccgatatcaacgtctgggctcagtgccttccctacatcttcatcggtctcggggagatcttcaccaacgtcacttcttacgagtacgcctactccaaggctcccgagaacatgaagtcacttgtcatgagtgtcaacctcttcatgtctgcctttgcctccgccatcggtcaggctttcacacctctctccgatgaccctctcctcgtctggaactacaccgttgttgctgtcatcgcctttgtcggcggtgttgctttctggttccaattcaagcacctcgacggtgaggaagacaagtggaacatgctcaaggcctcaaagttccagggtggataccaacccaatgctgttgagaacaaggttgccgatgagcatgaggagccttccaatgctcctcgggatgttgagaagatgtgactcccaaaggagtgcaagagttgttatcgctttagttaagatccactagtataatgtcctggattactcttaaataattgaatccatttactccc

SEQ ID NO: 179 - DNA, 859 bp, Fusarium venenatum
  misc_feature (1)...(859): n = A,T,C or G
ccttctgaaagttttcactacaagcctttgtttgcgcaacaagattcttcaggcggccagacctcgctcgatgagactgtctcctcgtttggccctcctgaggaaagtaacgttggcgaatcgaaatggggatttagtggttccggtgcgtccagccgtaggaagcgccgtcatgatggcgccataatctactacagcggtgctccgttctgtacagacttgtctggggaccccggtgatatgtcacccaccacacaaatgcgagcggctggtcaaacccaaacggataaggatactttcaaggttcccctgtcgcctctccgacgaacagactctggatcgtttctcaactaccgaccattgactgaccgcgggattctcccgacccaagcgactacagctatggatatcgatagtgaggacccgccaagccttacagatgataccgatgatgcaagcgaaattgatttggacttcacttggagcgataacccccaatatatgcagcattacccccttgagccttggggtttaggcggggtcctgcctgaagatcacttcatggtagttgctccacgaaaagatcgaaacaagatgaactgtcctcagttcaagtggctagtggaaggattggtgaagccacggatgccgtcgtccgtcgcttggcaactatgtcaacctcgtctccaatctcaggcggtctaaaaccttggccacctacgggtcccctccctgtcgagattgaatacatgtcaggtcgcatcaagcgactgacaccagtctcgttgccacctcctgcgattttcttcccaccatttagtcccagcgagtctaccgtagacnacaatgatgatatctc

SEQ ID NO: 180 - DNA, 865 bp, Fusarium venenatum
  misc_feature (1)...(865): n = A,T,C or G
cccgacaactccaatcaccaggtcgactaataacagcagccatggcttccgagaaggcaaacaaccccatgcgggagctgaagattcagaagctcgttctgaacatctccgtcggagagtctggtgacagacttactcgagcggcgaaggtcctagaacaactttctggccaaacccccgtctacagcaaggcccgttacactgtccgaactttcggtatccgacgtaacgaaaagattgctgttcacgttaccgtccgaggccccaaggctgaggagattctcgagcgtggtctcaaggtcaaggagtacgagctccgcaagcgcaacttctccgagactggcaacttcggcttcggtatcagcgagcacatcgatctcggtatcaagtacgacccctccatcggtatctacggcatggacttctactgctgcatgacccgacctggtgagcgcgtcacccgccgccgccgaacaaagtccaagatcggtgcctctcaccgcatcaagcgcgaggagaccgtcaagtggttcaagtctcgcttcgatggtattgtccgataaacggttgaaaaggaaaatggttatttgaatttacggactggtcacggcgaacattagggggaaaactcacatggggcttgtattttctgttgccattgctgcatcagctcgactcttttagtcgagccacggcctgagagaccgaccggcactctgccggctttccgatattcactcactctgaatgtgacatctgccatcaatcgttagatcattggtactttgtctaaaaaaaaactttgcctctcgctgttacgtctacgtgagacgatataaacatgtcctttgggactttgntcatc

SEQ ID NO: 181 - DNA, 719 bp, Fusarium venenatum
  misc_feature (1)...(719): n = A,T,C or G
tttaacagtaagtctcatgtacgtatgtcttaataagccatatctactttacatataatacataatccatcttttatcgttttctctctggccaagcatcgggaagaccctcataaatcgtcacattactgaatgtcacatcgccacttccactgtggaagaagcgaatatcagtcgagtcggcataccaggaacgagcccaggtggccacaccgaatcggtcgttggcgtgaacctcgaccatagcattatcaacaacaatagtaagatccaaggtctcaacctgctcttcgtcatcaatgacaacgtcaaacagacggagtcggccagcttcgtttcgagagtcgatatcgctggttgtgagggcagcagcactggtgttgttgcggtcaatgatgatagactcgttggagaactggtagtagatagtcgtggactccttctcagaagccaagatttggaaaccagccttcaggtcagagtcgcgggcagacttggggaaggagatggagctcttaagaaggtanaacttggagtcngggttgttgtcaaaaagtggcgatcctgacttgctgatgtttcgaccagcttcaataatgggcttaccttggtgaactcggccatgggctacgancaataacctgctttatgggnggcgagcttcaggatcctggctcgnttnttttaacgcgccatgagcccttctngcganaaaactt

SEQ ID NO: 182 - DNA, 1045 bp, Fusarium venenatum
  misc_feature (1)...(1045): n = A,T,C or G
tgccaattgcctacgccatcaatatgatctcgagatcgacccttgcgcgaaccgcgcagcaggctgcccgccagtcctgccgcgtccagcgacnaacatacgccgccgctgcttcgaccggatcatacgagacctcggatgcgtctggcctcaagattgcctcacgggatgcccacggccctactactaagctcgctgttgtagctaaggccggtactcgataccaacctctccccggtctgactgctggccttgccgagtttgccttcaagaacacccagcgacgatctgctcttcgcatcactcgcgagtctgagctccttggtggtcaattggcttcttcccactccagggaggctgttattgtcgaggccaacttcctccgcgaggatctgccttacttcactgagttgctcgctgaggtcatttccatgactaagtacactacccacgagttccacgaggatgtcgagcgtgttcttaccataagcaggccgcctcaacgccgacgtcgccgccactgntnttgacaacgcccacgccatcgctttccactctggtctcggttcctccatcctccccagcttatcaactccttaccagaagtacatgaacgaggagtacatcgccagcttcgccgatgccgcttacgccaagtccaatatcgccctcgtcgccgacggtgcctctgccgatagcctctccaagtgggttggtcaattcttcaacgatgtgccctccaccccccgaaacggcagaccctnaagaccgaggccgccaagtactttggtggtgagcagcgaacaaactccactgncggcaactctatcgtcattgncttcccggtaccagttacgagtctggcaagcctgagaacgctgtcctggctgntttcttggnggcaagcaactgncaagtgggcttntgggttaacatgctggccaaggcaccggtggnactgcngtttaacgnnaaaacttcaacttctttattttgacgncggctcttggcggtcaagttaacggtctggccgctttgtncgcaa

SEQ ID NO: 183 - DNA, 508 bp, Fusarium venenatum
  misc_feature (1)...(508): n = A,T,C or G
agcacgacgagatggtgcttactgctttccgagtgttcaacaacgctatcctcaagaccaactacttcacacccacaaaggttgccctgagcttccgtcttgacccctctttcctccctgacgtcgagtaccccaagcccctttacggcatgttcctcgtcatcagctccgagtctcgaggtttccacctccgattcaaggacatctctcgtggtggtatccgaatcgtcaagtctcgcaacaaggaagcttacggcatcaatgcccgatctctcttcgacnanaactacggtcttgccagcactcagcagcgcaagaacaangatattcctgagggtggttccaagggtgttatccttctggacccaagcagcaaaaccgtgctcgcgaagctttcgaaaaantacatcnatngtatccttgatctctcccgcccgctganacacctggttatcaaaaaccccattgttcaacctttacggcaaggaagaaaatctcttcttggggt

SEQ ID NO: 184 - DNA, 658 bp, Fusarium venenatum
  misc_feature (1)...(658): n = A,T,C or G
cgagaaggagtctggcctggctcgtgtgcttggttccggttccgctggtatcgctgagctggctgtcttccaccctgtcgacaccattgcgaagcgattgatgagcaaccagtctcgtatctctggttccagccagttgaaccaagtcatcttcaaggaccacgcctccgctcctatcggacgaaagttcgtttctctcttccctggtctgggatacgccgccggttacaaggtcctccagcgagtctacaagtacggtggtcaacctgtcgctcgtgattacctggccaagcactatggctctgacttcgagaacgcttttggcaagaagactggcaaggctattatgcactccactgctggaagtctgattggtattggtgagatcgtctctgcctctcgatgtcctcaagatcaagcgtcagacaaaccccgaggctttccgcggncgtggtgtcctcaaaatggtgccgatgaaggtttcggcttgtccgtggntggggttggactgncgccgtaacgcccctggttcgttcgctctgtcngnggctctgccttcgccaaggataccttttncaccttgaggatacaacaaggccactgggtncaaaactttgtgctttcattgcggggccttggctttnttggcgncttcccn

SEQ ID NO: 185 - DNA, 1030 bp, Fusarium venenatum
  misc_feature (1)...(1030): n = A,T,C or G
gtcccctcctccgagcttcgactttccaacctttctttgttcctgctctgtattctttgcaccatcatcaattggcagagacacagcaatcatgttcaaccttcgtcgcctttttgcgtcggccctgttccttgggctcggcctcctcttcctcgcccagacggccgaggctgccaagggtcccaagatcacccacaaggtctacttcgacattgagcagggtgacaagcctctcggccgcgtcgtcatgggtctctatggcaagactgtccccgagaccactgagaacttccgcgctctggccactggtgagaagggcttcggttacgagggctctgctttccaccgcgtcatcaagaactttatgatccagggcggtgacttcaccaagggtgacggcactggtggcaagtccatctatggcgaccgcttcaaggatganaacttcaagctcaagcacaccaagaagggtcttctctccatggccaatgccggccgtgacaccaacggctctcagttcttcatcaccaccgttgtcacctcttggctcgatggcaagcacgtcgtcttcggtgaagtcctcgagggctacgagattatcgagaagattgagaacagcaagaccggagcggcggaccgacccgtcgaggctgtcaagatcgccaagagcggcgagcttgatgtcccccctgaaggtattcacgttgagctctaaagaggcaacattgcacttgtccagtccgttctcgccaccgttgataaacttccaaaaaaaaaggcaggatttgctgatgcgtaaccctntgtcccgttaggccttgccggcacatctgaagttcccttgctgaaaaaggttgctttccactggatggtctcctattcagaaggcttggcctcttccncatctttgctggtgncctctttgttggtctccgcagcgcccgacagcactctcgattctaagcgactcgagacccggtcttttataaagaacaagacaagacaatacaatacctgacattccaaactc

SEQ ID NO: 186 - DNA, 765 bp, Fusarium venenatum
  misc_feature (1)...(765): n = A,T,C or G
ntcttcgttcaancgctggcctatcgattgcggcagcggcagctacatttcaaaaaacaactagaaaaccagccatcgagtttggtgtaaggaaaatgcacagcanggttgtcattatcggttccgggcctgctgcccacacggntgctgtctacttggcacgagccgagttgaagcccgttctctatgagggtttcatggccaacggtatcgccgctggcggtcaattgaccaccaccaccgaggttgagaacttccccggtttccccaagggtatcatgggaggcgagttgatggacaacatgcgagcccagtccgagcgcttcggcacagaaatcatcaccgacaccgtcgctaccctcgacctctcttcccgtcccttcaagtacactaccgagttctcccccgaggagacacacaccgccgagaccgtcatcctcgccaccggtgcctcagcccgtcgtctcaacctccccggtgaggacaagtactggcagaacggtgtctccgcctgcgctgtctgtgacggagccgtcccaatctttcgcaacaagcctctttttgtcatttggtggtggtgactccgccgccgaggaggccactttcctcacaaagtacgccagccacgttaccgtcctcgtccgtcgcgatgtcctccgtgccagccgaaccatggccaaccgacttgtcaaccacccaagtgcactgtcttgttcaacagcgggtgccactgaaatccgangtggtgaaganggtctcatgaac

SEQ ID NO: 187 - DNA, 1602 bp, Fusarium venenatum
  misc_feature (1)...(1602): n = A,T,C or G
atagtctcgtctcaaacagagacagatcacaacttgacataaaagagcttgatcccaccgctttctagtcacaacatcatcatccatcaatctcatactttcattcaatcatcatctcttcatctcttctgttgaccatgaaacttcttcaacttgccaccctggtggcttccatcagcccattcgccagcgcagcagacgcaaacgcctggaagtcgcgaaacatttattttgctctcacagatcgtgttgcgcgtagcggtagtgatagcggcggtaacgcctgcggcaatctcggaaactattgcggtggaacctttaagggtcttgaggctaagctcgactacatcaagggcatgggattcgacgccatctggatcactcctgttgttgagaacacggatggcggataccacggatattgggccaaaaatctttacgaggtcaatgccaagtacggaaccaaagacgacctgaagagtctagtcaacactgcccatagcaagaacatgtacgtcatggctgacgtagtagcaaatcacatgggtccaggcatccaaaaccacagacccgaacctctgaaccaacaaagttcttaccactcttcctgcgcaatcgactacaacaaccaaaacagtatcgagcagtgtgagatcgctggcttgcccgatctcaacactggtagcgcaacagtcaagaaggttctcaacgactggatctcatggctcgtctccgaatacagcttcgatggtatccgcattgacaccgtcaagcacgtcgaaaagggcttctggcctgatttccagaaggccgctggagtcttctctatcggtgaagtctgggatggaagccctgattaccttgcagggtactcaaaggtcatgcctggtctattgaactacgccatctactaccccatgaaccgcttctaccagcagaagggtgacccatccgcagtggttgatatgtacaacgagatcagccaaaagtttgacgacccaactgtcctgggaacattcatcgacaaccacgataatcctcgatggttaagccagaanaacgaccaggccctcctcaagaacgcccttgcctacgttattctctctcgtggtattcccattgtctattatggcaccgagcagggttacgctggaggcaatgaccccgcaaaccgtgaggatctctggcgtagcaacttcaagacagactcagacctttaccagactatctccaagctcggaaaggccgctccgctgttggtggtctcgcaggaaacgaccagaagttcctcaagtccaatgacagtgcacttatcttggagccgtgccgatagcgatctaattgttgtgactctgaatcgaggaaaaggattttccggagagtactgnttcaacactggcaagaacaacaangacttggggacagagatgctangccaaaggaactgtcaagtctgacggtaacngccagctatgtgttaagctacactaacggngaaccccgagggtctncgntgcgggaaactaaatgggnggncgagtttnaaaagaactagtactgggtacaagccttttggggtggattctactttcttatcttatg

SEQ ID NO: 188 - DNA, 1236 bp, Fusarium venenatum
  misc_feature (1)...(1236): n = A,T,C or G
tttttttttttttttaggcccttttntttttgggggcatcagatttttgcattcctttttccctatgaccgtccgtgacatgcagtaaccgcgataatcgataaaccaggcatccggcccatcccccaccgtgtgtatgcgcgtgcgctaacgacacggtcccatagttcacgccataacaaatcaatccaccctttcctttaacatcatcgtgataccatgcccaagagagagaaagtcgggtgctgggggcggacaacggttgagaagaggtagcttagataccgagcttggtcttgcgccaatgccttcgcttancgttgtagcggatggtgttgcagttcggaggcgaaccctcttcaactttgaacatctcatcccgcactactaacgccagtcccggaacccgactgtacagcaaaaatgtctgacaacggcgagatcgaggtcgagaactccgccctctacgaggtgcttcctaaggatgttgttaaggaggttggcaatgtcaagctcttcaacaagtgggactacgatgttgaggtccgcgatatctccctgactgactacatttccctgcgaaaccccgtctacgtcacccacaccgctggccgatatgccaccaagcgattccgcaaggccaactgccctatcattgagcgattgaccaactctctgatgcaccacggccgcaacaacggaaagaagctcatggctgtccgaattgtcgccacgccttcgagatcatccacctcatgaccgaccagaaccccatccaggtcgctgtcgacgccatcgtcaactgcggtccccgtgaagactctacccgaattggttccgccggtaccgtccgacgacaagccgttgatgtctctcctctccgccgagtcaaccaggccatctctcttctcaccactggtgcccgcgaggcctttttccgcaatgtcaagtccattgctgagtgccttgnttgaggagcttatcaacgttgntaagggttctagcaactcttacgctatcaagaagaaggatgagttggagcgtgtggccaagagcaaccgataaaaggtgcaaaggtgtatcacgtctggaagggttggctttggcgtgttccggcttatttcagaattgcattttgcgttcatcgggtctgggaacgcggctatggattttcttaggtggctacagattcaataaaaaagtcgggctccctgagagttaaatgaaatgaactcc

SEQ ID NO: 189 - DNA, 818 bp, Fusarium venenatum
  misc_feature (1)...(818): n = A,T,C or G
ggagttcgagggcaagaagcttgtcgacatcaccaaggactttgagctcgaggagaccgaggaggagaagaaggcccgtgaggaggaggagaaggagtacgagaaccttgccaagtctctcaagaacgtcctcggcgacaaggtcgagaaggttgtcgtctctcacaagctcggctcctctccttgcgctatccgaactggtcagttcggttggtccgccaacatggagcgtatcatgaaggctcaggccctccgtgacacctccatgtccagctacatgtcctccaagaagactttcgagatctctcccaagtctgctatcgtccaggagctcaagaagaaggttgagaacgacngtgagaatgaccgcactgtcnagtccatcgttcagctcctcttcgagacctctctccttgtctctggcttcaccattgaagagcctgctggtttcgccgaccgcatccacaagcttgtccagctcggcctcaacattgaggaggatgactccgctcctgctgatgctgatgctaccgacgccctgtcgctgccgccgcgggtgacagcgccatggaggangtcgactaaacgatcaatgcattctaaacgggataccataaaaagtcaacgganttgaagggtttcggtttttatnancaacaaggtctttgttttctggtttttatgcggacttgncggatttgaacagcccgccttatcttgccataattctcagttctagaantaggaccaggtgtaacttaagttagctttatgatcacgagagagatgaagtagatgcgaaaatggaaatggtatan

SEQ ID NO: 190 - DNA, 663 bp, Fusarium venenatum
  misc_feature (1)...(663): n = A,T,C or G
ttcgctctccgaccagcgaattgcaatcaacacaacaccgcgacaatggctgacgaatacgacgccgagcatgctgccgagctcaagagaaagagagcgttccgaaagttctcctaccgaggaatcgaccttgaccagctcctcgacctctcctccgaccagcttcgcgatgttgtccacgctcgtgcccgccgcaggatcaaccgtggtctgaagcgccgccccatgggtctcatnaagaagcttcgcanggccaagcaggaggctcagcctaacgagaagcccgatctcgtcaagacccacctccgagacatgattgtcgnccccgagatgatcggtagcgtcatcggcatctactccggcaaggagttcaaccaggtcgagatcaagcctgagatgggtggtcactacctggctgagttctctatctcatacaagcccgtcaagcacggtagacccggtatcggtgccacgcactcttctcgtttcattcccctcaagtaanaagtttgcggtcttgggtggtttctgcattcacggacattttgggcgaaaaggactggttctggtagatggactattaaaacatctatcaaaattactgatgacaatgggtnccatgatagtacaataaaggacattggccgcttgatgacttccttc

SEQ ID NO: 191 - DNA, 581 bp, Fusarium venenatum
  misc_feature (1)...(581): n = A,T,C or G
aggctagcgactcaactggtggactttctggtgttgagtggtctgcttggcccaaggaagatctcagcttcgccgaggctttcgtcgccgtcagcaacatcatttttgccttcagtttcgcgatcggtcaattctccttcatggacgagatgcacacccctactgattacatgaagtccatctatgcctcatgctttatccaaatctctatctacaccctgaccggagccctttgctacgcttttattggacctgctgtgcagtcgcctgctctgttgtccgctgggccacttatttccaagatcgcctttggtgtcgctttgcctgttatcttcatctccggttcgatcaactcgactgttgccctccgatatcttcatggccgtatgttcaaggactcgattcttcgatacgtcaatacccccatgggttgggtcagctggatcactcttgtcaccattttcactatcgtcgcatgggtcattgctgaagccattcccatcttctctgacttgctctctcttgcctcggctctntttgngtctgggttcttcttctggatcccaaggtgtcatgtggtt

SEQ ID NO: 192 - DNA, 696 bp, Fusarium venenatum
  misc_feature (1)...(696): n = A,T,C or G
tttttttatgtncaatgggtggactccaatttgtggatactaaatacaatgataaaacaacatatgatatcattaaaatcatggncgggaaagaaacccttcgttatacaacgcacataattatgaaacgcttgacttgactcctcatatccttttttgttatctttgccagttctggttccgcttcatagcttcaaagcagggctagaaggtccagcttgagtaattctcgttgtataaaagcgatgtaaggaagtcagcatagtcctcgccagtaacctgaccggagaagtattgagcagcgaggtggtncttgtttccnttaggggcagaggcagcaagctgatcggcagtntctttgaggagcttcaaagcataggacttgtcaacacgcttgccgtcagcggtgctgacgccatgcttaacccactgccagagctgactgcgagagacttcggctgtggcagcatcctccataaggtagttgatgggaacacatcccactcctcggatccaggcctccatgtagccgagaccaatgttgaggttcttcttgataccctcttctgtgatggtgccagggacgttcatgttgagcaagtcgttctggccgatggtgacatcgtctctgcgcacgaaaagctggttaggagtaggcatgtgcttgtcgaagatctcggtagcganactggccnn

SEQ ID NO: 193 - DNA, 1020 bp, Fusarium venenatum
  misc_feature (1)...(1020): n = A,T,C or G
cggactttgctcttcaacccacgagcaactactaacccgaacgattcaagatgcctcccaaagccggcaagaaggtcgctcccgcccctttccctcagggtaaggctggcaagaaggctgccaagaaccctctcctcgagaagcgaccccgcaacttcggtatcggccaggacatccagcccaagcgaaatgtctctcgcatggtcaagtggcccgagtatgtccgcctccagcgccagaagaagatccttcagatgcgcctgaaggttcccccggctcttgctcagttccagcacgtcctcgaccgcaacactgctgccaggctttcaagctcctcaacaagtaccgacctgagaccaaggccgagaagaaggagcgtcttcttcaggaggctaccgccgtcaaggagggcaagaagaaggaggatgtcttcaagaagccctacactgtcaagtaccggnctcaaccacgttgttggcctgattgagaacaagaanggnttctctcgtcctcatncccaacgacgtcgagcccattgagctcggtggcttccttcnttctctctgcaagaagangggtattccttacnccattgtnaaggcaanggcccgtttnggaactgtcgtncacaaaaagaccgttggttgtcctcgccattaccgaggtccggtccgaggacaagacttgagcttttcaagttggtttccgttgtcaaggatggttaccttgagaagcacgaccaggcccgccgacaatggggtggtggtatcatgggtgccaaggctcagatgaagatcatcaagaagcagaaggctctngaggctgctaccaagatctaagtctaatttgtttatacccctcaaatgcattgcgaaaatgggatcaacggtgttgcacggttcacggcatggaaaatgaatgatttttctcgggttactttttgttcccatccccactcgcagtgacatgaggggctggtcacccaaccctcttaaaaatagatgatgagcttgcttctgg

SEQ ID NO: 194 - DNA, 483 bp, Fusarium venenatum
  misc_feature (1)...(483): n = A,T,C or G
cagggactggaagctttcgacaagctaactatcgagaaagccagaactcttgatgtcgatgatctcgatgaagagggttggaggatcgccagtcttgaaaagagaattgtcgaaatcggaaaccttggtgagggtgctggtggcnccgtcacaaggtgtaagctcaagggtggtaacactgtttttgctttgaaggtcatcactacgaatccggatcccgacgtaaagaagcagatcctccgagagctaggatttaacaaggagtgcgcttcanaccatatttgcaagtattatggtgcatttgtggacccatctacggccaccatctntatcgcaatggagttctgtgaaggtggctccctcgacagtntttacaaggaagtaaaacgcctgggaggcaaaacgggaaaaaaagtgctgggtaaaattgccgagggtgttctcgggggtctaacatcctgcatccccgacnaatnattcccg

SEQ ID NO: 195 - DNA, 593 bp, Fusarium venenatum
  misc_feature (1)...(593): n = A,T,C or G
cacaacgatatcgtccagagtttgacatggaacgccagcggaagcatgctcgccaccacctcgcgagataagaaaattcgtgtgtgggatgtccgacaggagaagcccgtccacgagggccctggccacggtggtgccaagaacagtcgcgctgtctggctgggagagcacaaccgtttcgcgacaaccggcttctcgcgtatgagcgaacgacaaatagctctttgggagcctggcaggacagagcccattggcggattcaccatgcttgactccatctctggtgtctgtatgcctttctgggatgatggttcaaactgcctgtaccttgctggcaagggtgacggtaatattcgatactttgagtacgagaatgacaaattcgagttcctcagcgagtacaaagtcgggcgaccctcacgcggtatggctttcatgcctcgacgaggcattaacactcatgagaatgaggtcatganggcttacaagaaccgtcaacgatgcttacatcgagcccatcttaatttactggcccacgacgtggccgagaacctttcanggccgatatctttccccctgntggtgggaaccaa

SEQ ID NO: 196 - DNA, 654 bp, Fusarium venenatum
  misc_feature (1)...(654): n = A,T,C or G
caccatctgaggattgcttaggaaggcaataatcttattgtcgaggcatcatgcagattttcgtcaagaccctcacggggaagacgatcacccttgaggtggagtcttccgacaccattgacaacgtcaagtccaagatccaggacaaggagggcattcccccggaccagcagcgacttatctttgctggtaagcagctcgaggatggccgcaccctgagcgactacaacatccagaaggagtctactctccacctggtcctccgcctccgtggtggtggtaagaagcgcaagaagaaggtctacaccacccccaagaagatcaagcacaagcgcaagaagaccaagctggccgtcctcaagtactacaaggtcgactctgatggcaagatcgagcgccttcgacgcgagtgccccagcgacacttgcggtgccggtgtcttcatggctgccatgcaggaccgccagtactgtggtcgttgccacctcacctacgtcttcgacaagcagtaaatgtatcaacacgggattgggattgattgatgacggaacggattgggtgccaaaaatgggcgttgaaaggctgtagcacaaagcacatccggtttctgaaattatgcattcacgcttaagaagacaaaaaacatgatccctn

SEQ ID NO: 197 - DNA, 629 bp, Fusarium venenatum
  misc_feature (1)...(629): n = A,T,C or G
gaattctcgagattggtttcgaagatgaaatgcgacagatcatcaaggtccttcccaaggaggaccgacagactatgctcttctccgccactcaaacaaccaaggtcgaggatcttgctcgtatctcgctgcgacctggtcccctatacatcaacgttgacgaggagaagcagtacagtactgtggagggtctcgagcagggctacgttctttgcgacgccgacaagcgattccttctactcttctctttcctcaagcgcaaccttaagaagaagatcattgtcttcttcagtagctgcgcttgtgtgaaataccatgccgaacttctnaactacatcgacctttctgtccttgacctcacgnaagcagaagcagcagaagcgaaccacaccttcttcgaatctgtaacgctaacagggtaccctgatctgcactgatgtgccgtcgtggtcttgatattccttctgtgattggattgtcagttcgacccttcggatgancctcgtgactacattcaccngtcgtcgaaccgtcgaggcagcaacacaaggccgtcactatgttcntnagccaacgangcggntcttgcgatntaagggcctngtgtcccgtancggttgattcccgcn

SEQ ID NO: 198 - DNA, 965 bp, Fusarium venenatum
  misc_feature (1)...(965): n = A,T,C or G
aattttttttttttttttttttgaaaactcgggtgtcattcatcaaggtatcaatttccatatccctgtcatgaatccctgtcatgagtaaaacgccgagcacaatgcagatttttttttgaatccattaggtcctattgaccgatcccttaaaagccgtttttaaagacaatcccttagttcatctggcggacgagggcgttgatagcctcctcgcggttaccaaggtcaccaccctcgataaagtgcttgaaccttgcggggacggaaacccaccagtaaggttggaaaagcttaaagggccagaggaaagttgaaggcctgcttnaagttgggcccgacagtgtagatctcgtggaatgagatcctcaacacagacaaatgcggtacttgccgaggttctcctcaacaatgaagttgtcggtaagaacagttcgctgcttgttgacctttccgtagccacgcttgtagatgagctccttgacggtcttcaggttggggtaaccgtaggcgatccaaggctcgacaaccttgagcatctcagtgatggccttggtgaccttgacgaagacaccgttgttgatctggaggagacggagaagctggaggatcttgcggggcttggggggcatcttgttgatacccttgatacggacgacgaagatcaggttggcctcagcagggacgtaggcagagtcctcagacttggcaacgcggtgaagacggatcttctcacgctcagcatcgcggtactcctgaacgtacttctcagcacgcttgaagatgacctgacgcttctccttgttggcagtcttcttcttctcaacggcgtcggcgcgctcagcacgggccttctcctgagacttgcgcttcttgagaagggtctcggggaccaggatctggtcgttggtaggaacggtagcacccattttgtcggcgacggctgttggaagagtcggttagtg

SEQ ID NO: 199 - DNA, 887 bp, Fusarium venenatum
  misc_feature (1)...(887): n = A,T,C or G
gacctttctcttagtgtctacttaccctcctggattctcccatcaacaaggctggcaaactccagatctacatccataccgccaagggcgtcctgattgaggtttctccctcagtccgcattccccgaacgttcaagcgttttgccggtctcatggtgcagcttctgcaccgcctgtctatccgctccaccaactccaacgagaagctgcttcgcgtgattcagaaccccatcactgaccacctgccgcccaactgtcgcaaagttacgctgagtttcgatgcaccacttgtcaaggttcgtgagtgggtcgaatcttcgaattccaaggacagcatctgcgttttcgttggtgcgatggccaagggtgaggataacttcgccgactctcttgtggatgagaagatttctatcagcaacttctctctgtccgccagtgttgcttgtagcaagttctgccacgctgctgaagatgtttgggacattatgtaatgtccacccatcccaagtggcgtcggcaagaaaccgaagctgcgacgaacgccaagcgccggctcgcccaacgatgatacaacatcgtcgctgggancaagacggttcggtggtaacttggaatgcctggggtgttcgctgtcncttgtttttgcaaccaaaacatggggcgttcaacatcgggtccaagacttgaatgttcgtcttgatgggtctcttcaacatgatccacactttcctctttgttctttcttttctgttggctcagcgagtctgctctggttttgccctttagcaattaanggccatgttgcccaattttatcctggatcggacatgcttacccctagtcctaccgatctaaccaaggaacatcttgtgaaaatgggcaccatc

SEQ ID NO: 200 - DNA, 875 bp, Fusarium venenatum
  misc_feature (1)...(875): n = A,T,C or G
actccgtcgtcgtcaatccacgtagtcgaaccagccgtcaaaatgagcgcccaggcccttaacaagatcgctcccaacagcccctcgaggcagaacccctccgagctcgagtcgagcatcgcccaggctctcttcgacctcgagtccaacacctccgatctcaaggtcgctctccgacctctccagatcgtctctgctcgtgagatcgaggttggccacggcaagaaggctattgtcatctttgtccccgtcccttccctgcagggcttccaccgcgtccagcagcgtctcacccgtgagctcgagaagaagttctctgaccgccacgtcctgatcctcgcttctcgccgcatcttgccccgccccaagcgatctgcccgctctcgcaacaaccagaagcagaagcgacccgttcgcgaactctcaccgccgtccacgacgccatcctcgaggatctcacctaccccgtcgagatcgtcggcaagcgcgtccgcaccaaggaggacggttccaagctcctcaaggtcatccttgacananaaggancgtggtggtgttgantaccgnctcgacactactctgaggtctaccgtcgcttgacaggccgcaacgtcaacttcgagttccctcagagcggtcccgctgactactaagtcggtgcgtctacttcagagatgaattagtagtacgaggcaaaaacaaaataccaaacgtctttacacatcaattcaagggctgggagtgctattctttaaacatggttggtttggtcatcaaaaggggctcggcgtctttaaagaaagtagcttgataaatggtacaagctgcgtatgatttgacaagacaacctaaacacttctgtccaaaaaaaaaaa

SEQ ID NO: 201 - DNA, 639 bp, Fusarium venenatum
  misc_feature (1)...(639): n = A,T,C or G
caaggacgccaagggcgattattgtgaagtaatggagttctgtgctggaggagatctctacactctcgttctctcaagtgggaagctcgaagttcaagaagccgactgtttcttcaagcagatgatgcgtggtgttgaatatctacatgaaatgggcgtagcacatcgcgacctcaagcccgagaacctgctgcttaccacccgcggcgcccttaagatcacagatttcggcaacggagagtgtttccgaatggcctgggaaacggacgcgcatatggtatctggcctatgcggttctgcccctacattgccccgaggaatacactgataaggagttcgacgccagagctgtagacgtatgggcctgtggtgttattttcatggcaatgcgaaccggccgtcacctttggcgactggctaagaaggatgaagatgaattctatgcccgataccttgagggccgccgagacgaggaaaggtaccgncctatcgagtcttttcatcgggcccgtgncgcaacggaatttactcgggtttgatcctatctactcgccggttgacagtgctaagtncttaagtcaaaaatgggacgcgagacaactatgcaaggctggtgnaaaaggtctgtaatgacaggaa

SEQ ID NO: 202 - DNA, 818 bp, Fusarium venenatum
  misc_feature (1)...(818): n = A,T,C or G
gaatttttttttttttttttttatagcaattgtatcataatgtcatcatacatggagatctgggattgatatccgaattcctcgtcacgcatcgtgcacatcatgatttgttcgttgaagactttgtgatctattttcccttttcagacccgtctcccatgatcagatccctaaccgtaatgtcgatgcaagcaatccgaatagactccacgtgtcgaaatatgactttgtttccatccacgcgctcttcgcttaagaacggggcttctccttcttctccttccacagagcaaggagaccgacaccagagaccttgacgaccttgaatcgcacaccgggaatatcacccttggccttgcccttgcgaccgaaaccagccaggaggacctcgtcgttctcgtccacgaagttcaagcaaccgtcattggggacgaaggcagtgaccttctttccgttcttgatgagctgaacacggacacactttcggatagcggagttgggctgcttggcctcgacaccgaccttctcgaggacgatgcccttggcgtgtgaagaaccaccgaagggagaggacttataagcggtaccgagggcacgcttcttgtaggcgagatcggcccatttctggtcctttcggtttgttcgcagcttacgggcggcgttaagaccacggggtttgcctccagccatttttgcggatctgtctgtggatcgacgacgggttggtgcaaggtaagccttgctggaaatcgtcagaaactacgtattntccaccgatgttgccgtccgcgttgagnttccgacccatgaacttcccg

SEQ ID NO: 203 - DNA, 628 bp, Fusarium venenatum
  misc_feature (1)...(628): n = A,T,C or G
cgaaaaacactttaaagaaacccaagatatcatcactctcaaacctgtacggctctctcctgctagcagccatggagcctttcagcggtagttttgtccaggcctgatttgggacacactcttcaggtcaccaaacatgtctccccctgctgccatctcccccacttcccgctctgctgagcttgctacctctaccaccaagctccctgtccacgcgggcaagaacgttaacaccaagaccattgaggaaatgctcggtaactgggatgacttcaagttcgctcccatccgaaagagtcaggtctctcgtgccatgactcgacgctacttccaggacctggacagctacgccgagtctgacattgtcatcatcggcgctggatcctgcggtctgagcgctgcctacgtcttgggcaagaagcgtcccgatctcaagaatgccatcatcgaggcttcagtgtctcctggcgggggtgcttggctcggcggacaactcttctctgccatgaacatgcncaagcccgctgatgctttcctccgtgagatcngggttccctacgaaggacaaaggtaattacgtggtggttcaacacgctgcctctttaacctctacatcatgnccaaggtt

SEQ ID NO: 204 - DNA, 497 bp, Fusarium venenatum
  misc_feature (1)...(497): n = A,T,C or G
caagactttgacaagagcatcgagcttgacccctcaatgacgcaaagntatatcaagcgcgctagcatcagtntggagcttggngagcctgaaaaggccgaggccgagtntgccaaggccctcgagcaggacaagaacgaccncgatgtttactaccaccgtgcccaggcccatttcatcaagggcgaccttgccgatgctcagaaggactaccagaagtngatcgacctcgataaggacttcatcttctctcacatncaactnggcgttacccagtacaagatgggctcnattgcctcgtcaatggctactttccgacgatgcatcaagaacttccccaaggtccccgatgtttacaactactacggagagctactcctagaccaaggcaacttctccgaagccgtnnagaaattcgataccgncatggagatggagaagcagactaagcccatgttcatgaacgtcctgcccttatnaacaaggcctttggcttt

SEQ ID NO: 205 - DNA, 564 bp, Fusarium venenatum
  misc_feature (1)...(564): n = A,T,C or G
ggcacacctattcagaatgatctgacggaatacttctctctcacaagttttgcgaacccagatctgcttgggacacgcttggagtttcgaaagcgatatgaaattccgatcttgcgaggtcgagatgcagacgcttcagaagcggatcgcaagaagggtgacgagtgcactgcagctctactcagcgtggtcaacaaattcctgatccgtcgcacaaacgacattctttccaagtatttgcccgtcaagtatgagcatgttgtgttctgcaatctcgcaccgtttcagtttgatctctacaactacttcatcaaaagtcctgagatcangctcttttgcgaagtaagggaagccaacctctnaaaccatcaatattctcaaaaagctttgcaatcatcccgacctgttgaatatgtcggatgatctaccaagctcggagaagtgctatcccatgatacttcctaaagaacacttggtcgtgatcngaggtcaatctggtacctggtaaatggccgnctgaacgcatgctggtcnctccnccanaccaaataaaaaatgtctatc

SEQ ID NO: 206 - DNA, 925 bp, Fusarium venenatum
  misc_feature (1)...(925): n = A,T,C or G
ctctctgtctgactccaagggagctctcgtcgccaaggagggttcctctttcactcctgagcagatccacaacattgccgccctcaagattaagcaccagtccctgactgcttttgagcaccaggacaagttcacttggatcgagggtgcccgcccttgggtccatgttggcaaggttgacattgctctcccaacgctactcanaacgaggtcaacaaggaggaaacccaagcccttctgggaggctggtgctttcatcgttgccgangggtncaacatgggttgcactgctgatgccattgacgtctttgaggctcaccgcaaggagaagggtgcacaggctctttggtacgcttcaagnaaaggccttcaactgtggtggtgtcgccgtttctggtctttgagatggcccaaaacagccagcgtattcagtggtccnagaaggaggttgatgaccgccttaaggccatcatgaaggatgccttcgtcgccggccttganaccgcccagaagtatgtcgaagccaaggagggcgagcttcccagcttggtcgccggtagcaacattgctggcttcatcaaggttgctgaagccatgcacaaccagggcgactggtactaggatggacaatccgggaaagcatgaggcgagagatccgatactaacaggaagaccgttatacccgagctgagctcacatcaaggttatttggtccttcagaactctcacaaagtctctgcttatttctgcatggaatggcgttctcttttgcactatctgggcatgcattctgtagggcgttggaggggttcaagaatggaacattgtctttacttttcttctagatagactggattggattttgcgaatttgtttacttttctatagncccggtagtactcagaataaaagaagatctttattc

SEQ ID NO: 207 - DNA, 1007 bp, Fusarium venenatum
  misc_feature (1)...(1007): n = A,T,C or G
cgataatcaatccgactttatttccgatacaaatatctactaaagttgattgactagaatttatcacataccgctaccatgtcgggtctaacggaaaatctccctgccaagctttcaaaagattgcctccggcaaagtgcgcgatcttttcgagcttcctgacaagaacacgcttctcttcgtggcctctgatcgagtctcagcctacgatgctgttctcaagaacgcaattcccgacaaaggaaagatcttgaccctcctttcggcacactggttccaggtcttgacngagcgcattcctgacctgcgcacccatttcattagcctcgatgtccctgagggtgttagtgctgaggaggctcagatcntcaagaacagatccatggtcgtcaagaagctttctgtcatcaagattgaatccatcgtgcgangctatctgactggctccgcttacaaggagtacnagaagaacggtactgttcatggtatcaccgtcgaaactggtatggaagaagctcaaaaattcaagcagcccctggtggacacctagcaccaaggccgatgcnggaggagcatgaccagaacatccaccccgacgacgcttggaaggaggtcggcgaccgcgagactgcggaccgcgtcaaggagttgtccttgaagatctacgacgaggcctccaagtacgctgaanagcacggcatccttctggctgacaccaagtttgagtttgccaaggatcaagagggcaacatctacctcgtcgatgaagtactaacacctgactcttntcnattctggccagcagccggctacatgcctggccgtgaccaggacagcttcgacaagcagttcatccgaaactggctcaccaaggaaggactcaagggcaaggagggtgtcnagctttcccaggatattgcccagctcatcaaaaccgctccgagaggctttcttttgtgaccggtaanaaattcgangacnccgttagccaatnggcggnagggatt

SEQ ID NO: 208 - DNA, 724 bp, Fusarium venenatum
  misc_feature (1)...(724): n = A,T,C or G
gtcaagatgcgtgagattgtccacgttcaggtcggccaatgtggcaaccaagtcggttccagcttctggtctaccgtctccaaggagcacggcattgatggcagcggcgcataccacggtaccaatgaccagcagcgtgagcgtatcaacgtctactttgctgagggtggcaacgacaagtacgtcccccgtgctgttctggtcgatcttgagtccggcccccaggatgccatccgcgccggtcctcttggccagcttttccgccccgacaactacgtcgccggtgaggccagtgcccggaaacaactgggccaagggtcattacaccgagggtgccgagctcgttgaggaggccatcgacgttgtccgtcgcgaggtcgagaactgtgaccaccttcagggcttcagctgacgcactcttttgggtggtggtacccggttccggtattggtacccttctttntgtccaagatccgtganggagttccttgatcgcatgatgggcacctttttccgtcatgccctcgcccaaggtttccgatacccgttgtcgaaccttacaacgccactttgtttcttaaccaagttcgtcgagaaactttgacgagacttttttgtttcgaacaacganggtttgttcatatctacgaaggaccctaagncgccgaccttntacgcgatctaaatactgattcancgtatggccgggtnacanttttccatt

SEQ ID NO: 209 - DNA, 736 bp, Fusarium venenatum
  misc_feature (1)...(736): n = A,T,C or G
tccaattccatcttccgcaaccgccaagatgggtttcattgaggacgagctgaagcagcttaaggatgtcatcagcaccatcgacacgcgcattaanaagctcgaggcgcgagccaccggcggccctgtctctaccgaggagatccgaatgattctcatcggcccccctggtgctggaaagggtactcaggcccccaagatcaaggagcgcttctcctgctgccacctggctactggtgacatgctgcgatctcaagtcgctaagaagacccctctcggtgtcgaggccaagaagatcatggatgcgggcggtctggtcagcgacgagattatgattggtatgattaaagaggagctcaacaacaataaggagtgccagggcggcttcattctcgacggtttcccccgaactgtcccccaggctgagggtctcgatgctatgctcgcagagcgcaagcagaagctccagcacgctgtcgagctccagatcgacgactctctgctcgttgcccgtattactggccgattantccatcccgcttccggcgctcataccacaccacctttaaccctnccaaggagtncatgaaggatgacattactggggagcctcttntccagcgaagggacaacaatgccgatgctctaaagaaccccttgtatcctaccacaagaaacaagcttgtgggggctataccaaaaantggtnttggagggcttacccgccaaaaccgga

SEQ ID NO: 210 - DNA, 629 bp, Fusarium venenatum
  misc_feature (1)...(629): n = A,T,C or G
gccgaccaagaagaagcctgacatggctcccgagagcgagcgcttcctacgatgttgcgccgacgtcgcgaatgccctcattgaggaccacgaagcctcaaaggctggccgcacaactcgcgacatcaacctcaactcgctacgaaacaagctcgccaagaagcacaagctcatgaacattccacctttgaccgccatcatcgcctccatccccgagcactacaagaagtacatcctaccaaagcttattgccaagcccattaggacgtcctcgggtattgctgtcgttgccgtcatgtgcaagccccatcgatgccctcatatcgcttataccggaaacatctgcgtctattgccctggaggacccgactccgatttcgagtacagtacacagtcatacaccggctacgaacctacgtcgatgcgagccatccgcgcgcgatacgatccattcgagcaggctcgaggacgtgttgatcaactcaagtcctcgggcattccgcgacaagggcgagtacatnatcatgggangaacttttatgttttttttgagtcataccgagangaattnattggccagcttcacaacgctnttcagggggtattaaactacaatgggcgacgagncg

SEQ ID NO: 211 - DNA, 868 bp, Fusarium venenatum
  misc_feature (1)...(868): n = A,T,C or G
gagtttttatctctcatgccgnggggaagttgtagtttagttggtcttggtagatgcccaattatttgctacttccagatacatcctatcctcttatacaagattttcctcttctctttcttcatcttctaacgatattgtttttatttatatacacaatggctaccaacattacctggcacccttctctatcgcgcaaggagcgcaacgagacccgcggtcagcgcggtctcaccatctggctgaccggtctctctgcctctggcaagtccaccgtcgccactgctctcgagcagcaccttcttcacctgggcgtcgccgcctaccgtctcgatggcgacaacgtccgcttcggcctcaacaaggatcttggcttctccgaggccgaccgaaacgaaaacattcgtcgcatctccgaggttgctaagctgtttgccgattcttccaccatcgccatcacctncttcatctntcctaccgacagatcgcaaggtcgctcgtgagctacacgagcaggctactcaaggtggtgacgagcctatccctttcgtcgangtctacgtcgatgtgcccctcgaggttgctgagcagcgcgaccccaagggtctctacaagaaggctcgtgctggtgaaatcaaggatttcactggcatctctgctccttatgaggagcctgagaaggctgagattaccatcaagactcatgaaaactctgtcgaggagtgtgtagctcagatcgtcgagtggctcaacgagaagggttacctcaacaagaaataaatatgtaaatgatgattgtgttntgcgtttcaacaagatagatagggtattaatgtcatgtngactacggacgtngtcacatgcaggc

SEQ ID NO: 212 - DNA, 715 bp, Fusarium venenatum
  misc_feature (1)...(715): n = A,T,C or G
agcatccatcaactttcaatcccctcagcgaagaagcaccctaatcccttggtcagggccccttattttacgacactcccaaagctatggctaccattcgtaccgatcttccaggccccatcggggataagaagctggagaagaagcccatcaagttctccaacttgcttctgggcgctggtctcaaccttttcgaggttaccacactcggtcagcctttggaagtagtcaagaccactatggcagcgaacagaggcgacagcatggctacggctttgggacgcgtatgggcccgtggtggtcctctgggcttcttccaaggcctcatcccctgggcttggattgaagcctccactaagggtgctgtcctccttttcgtcgcttccgangccgaatactacgcccgtgccgccggtgcctccgagtttggtggtggtatccttggtggtgtcactggcggtgtcgcccangcttatgccactatgggtttctgcacctgcatgaagacagtcgagatcactaagcacaagctcgctgcctccggtgtcaagcctcagaccaccttccagaccttcgcagaaatctaccgcaaggaaggtattcgtggtatcaacaagggtgtcaacgccgtcgctatccgccagatgaacaactggggtagccgtttcggtctcagccgtcttgccgaaggttggattaagtccttaccggttaa

SEQ ID NO: 213 - DNA, 714 bp, Fusarium venenatum
  misc_feature (1)...(714): n = A,T,C or G
ctttatccctatacaatcaagttgccactctcgaggttgcaccattctttgatcattctttgcgtcgccaaggccaggatcgtctcctcaacgtaacaacagcatcgttttctccgacgacctatatctcttagctttgacagctgtcacatacaccgtccctgcaagagacaccgaaaaagaccacacaaccgcaaacatggcgcaggctggtggctcatacaacaaccccttgaagaagttcaagctggtgtttctaggagagcagagtgttggcaagacctctttgatcacacgattcatgtacgactctttcgacaacatgtaccaagcgacgattggcattgatttcctctccaagaccatgtatctcgaggaccgaacagtgcgattgcagctatgggataccgctggacaagaacgattccgaagtctgattccatcctatatccgtgattcaagcgtggccgttgttgtctatgatatctctaacgccaagtcgttccaaaacaccaagaaatggattgatgatgtncganccgaacgaggtaacgatgttattattgtgttnggttgggcnacaagacgggtttgaacgacaagcgagaagtcncttccccagcagggggaggaagaagcccagaagaaccacctgatgtttgtcgagacaagcgcaaagctgggtcacaacnttgaagaacctattcaagaaaa

SEQ ID NO: 214 - DNA, 687 bp, Fusarium venenatum
  misc_feature (1)...(687): n = A,T,C or G
cgcccaacgtcctaacagtccaataccgccaaaatgggtcgcgttcgtaccaagaccgtcaagaagtccgccaaggtcatcattgagcgttactatcctaagctcaccctggacttcgagaccaacaagcgtatctgtgatgagatcgctatcatcgcttccaagcgtctccgcaacaagattgccggttacaccacccacttgatgaagcgaattcagcgtggccccgtccgtggtatctccttcaagcttcaggaggaggagcgtgagcgcaaggatcaagtacgttcctgaggtctccgctctggacttcacccagaactccgagagcggccagctcgacgtcgacaccgagaccaaggacctcctcaagcaccttggcttcgagtccattcccgtcaacgtcatccccgtcactcagcagcagattcccgagcgtggacagcgatacggaaaccggccccgccgcgactaaaaatttggtttatgggattattatgggtgtcaggcatttgcagggtttcactacttggcgtctttaggacagtgagtgcataggtctcaaagaaagactttacgacccccccaaaaagggtcgccanttttngaggantcactgtgaccctgacncaatttttccttttnnggaatgaacttgcnaaggcagttccnaanagggattgactg

SEQ ID NO: 215 - DNA, 589 bp, Fusarium venenatum
  misc_feature (1)...(589): n = A,T,C or G
cttaattctgtacctgtaccaaaaccagcagtttgcagccatcgagacctatgttcagcaggtcaaccccggccgagctcccgaggttgttggcggtcttttggatgttgactgcgacgagaacgtcatcaagcagcttctgagctcggtcaacccccagagtatcaacattgactcactagtatcggaagtcgagtctcgcaaccgcctcaagcttcttttgcctttccttgaggccactctccaggctggcaaccagcagcaagctgtttacaacgctcttgccaagatttacattgactccaacaacaaccctgagaagttccttaagggagaacgaccagtacgacacccttactgttggaaagtactgtgaaaagcgtgaccccaacttggcttatatcgcctactctaagggtcagaatgatctggagcttgtcaacatcaccaatgagaactccatgttacagggctcaggctcgatacctcttggagcgatccgatgccganctttggggtttcgttctgancgaaaacaacatcatcgtcgttctgttgtcgaacaggtcaccgctacagctgtcctgaa

SEQ ID NO: 216 - DNA, 513 bp, Fusarium venenatum
  misc_feature (1)...(513): n = A,T,C or G
ccgacagactgcccagtctgcattcgtcgacgaactcaaggccgacattgcccaaaaggcagctgagaacacaagaatgaagacgctgattgacgatcttcaacagcgggtcaaggctggcgccaccgcgcccatggctaacggcaagacgatccagcagcagattgccgagtttgacgtcatgaagaagagtctcatgcgcgaccttcagaaccgatgcgagcgtgtggtagagctcgagatctctctggatgagacacgagagcagtataacaacgttctccgatcgtcaaacaacagggcgcacagaagaagatggcgttcctcgagaggaacctggagcagctgacccaagttcaacgccagctantcgagcagaactcancgctcaagaaagagntgctttcgctgncgcaagctcattgnccgaatgagcgtatccagacctggaagcctgctcaggatagcngganaagatggttgtgngaaccacaagttcgaggtnaactactt

SEQ ID NO: 217 - DNA, 775 bp, Fusarium venenatum
  misc_feature (1)...(775): n = A,T,C or G
cagaagctcctggacgagcccgtcttcgctttctaccttgacggtcaggagggccagagcgaggctactttcggtggtgttgacaagtccaagtacactggcgacctcgagtacattcctctccgccgcaaggcttactgggaggtcgaccttgatgccattgctttcggcgacgaggttgccgagcaggagaacactggtgccatcctcgacaccggtacatctctgaacgtcctccccagcgctctcgctgagctcctgaacaaggagattggtgccaagaagggctacaacggccagtacaccattgagttgcgaacaaggtctcttctctgcccgacatcactttcacccttgctggttccaactacagccttccctccaccgactacatcctcgaggtccaaggcagctgtatctctaccttccaggtatggacttccctgagcccgtgggtcctcttgttatcctcggtgatgctttcctccgacgatactactctgtctacgacctcggcaagaacgctgtcggtctggctcgcgccaagtagaaatgaacatttatgtatgaattattcaatagcgcatgggaatacncagcatggacacggggttggacaatggcatgggactactagtttgaactgtacgacagaattgagtatgctgtattgaggaaattgcttctcagaattgctgctctataatatgaactttatggacttttggaaaaaaaaaaaaaaaaaaaaaaaaaaaaaaaaaaaaaattcctgcgg

SEQ ID NO: 218 - DNA, 733 bp, Fusarium venenatum
  misc_feature (1)...(733): n = A,T,C or G
catcaccacctnaggccccttcttccccttacccctnaaagcgctgcgcgcgtagttatttctctccccatacttntttcccncaaacttcaaactctcgtcttagctttttaagcttcatttatacaagatgaagggcgagattcttcacctccacctgggccaggctggtacacagctcggtaactctgcttgggagctctaccttctggagcacggtctcggccccgacggtcgacctgaccccaatgctcccgatattggtgaccccggttctttcgagaccttctttaccgagacaaacagcggaaagtatgttcctcgatctctgttcgtcgatctcgacccctcgcctatcgatgagatccgaacaggcgaataccgcaaccttttccaccccgagctgttggtcaagtggaaaggaggatgccgccaacaactacgcccgtggcactacaccattggcaaggagaaggctgacgaggtcatggaccgcattcgtcgtgtcgccgacaactgcagtcttctcagggtttnctgatctttcactctttcggggggggtaccgggtcttggttttgggctcttctcctcgagcgttttccacttgattatggnaagaagtcaacttgagttggttgttaccctgtcccganatgaattgcggtgtgagcctanaagttgctnttactaaagacttttggaactcnctgncttcttttgttacaaggng

SEQ ID NO: 219 - DNA, 1124 bp, Fusarium venenatum
  misc_feature (1)...(1124): n = A,T,C or G
gcgagagcgctacatccaggatacacgtatccactgctgtctcttcttcatccagccatcaggccactctctcaagcccatcgatattgttgtcctgaagaagctttccgacgtcgtcaacgtggtgcctgtcattgccaaggccgacaccctgactgttgaggaacgccaggagttcaaggagcgcatcaaggaggagtttgccttccacaacctcaagatgtacccctacgacaacgacgagtttgacgacgaggagcgtgctttgaacggccagatcaagaaccttgttcccttcgccgttgttggatccgagaagtcgatcatcgtcaacggtaagcaggtccgcggtcgccagaacagatggggtgtcatcaacgtcgaggacgagactcactgtgaattcgtctacctacgagacttcctcctccgaacccaccttcaagaccttatcgagaccacctctcagatccactacgagaccttccgtgccaagcaactgcttgccctcaaggaaagcagtgctcacggtggtgctagcagcccgacccatcagccctgccgccgaccgcgagctcagccgaaactcgcaacgaatgacgatgaacggctactaagctgaatttgtgtttgaagttgtgctggcaatggagcgacngcgtctcggggcagctcgatagcccgcatttgttacgacactccacatatttcacggcctgatgtacagcaacccaaaagcaattgcttgccacggaaggttctcgtagtggactctgaccacagtgaacccctgaaggccttacatcgtttcgatgacatcggcatgcgagcaaggacgagagcagcattcttggggtatgaaccagatgagagatggggactggtccgttgagatccagatacccgtttcctggttacgtaccttggggactgtctgctggtcagtccgtatcgaagctgtacacgactttcttctttttctttcagtgttacccccggagaactatttggcctttttttatgctttaataagaccgattaccccatactctaatctggagttagtttcgttgcctacatagtgtatcaaattcgattggagtttcctgacgtaaaaaaaaaaa

SEQ ID NO: 220 - DNA, 492 bp, Fusarium venenatum
  misc_feature (1)...(492): n = A,T,C or G
gttaaggctgctattgatgcctttggccgcgtcgacattgtggtcaacaatgctggtatccttcgcgacaaggcattctccaacatgaacgacgagctctgggaccctgtcctgaatgtccacctncgaggtacctacaaggtcaccaaggctgcttggccttacttccttaagcagaagtatggccgcgttctgaacactacctcaaccagtggtatttacggcaactttggccaggccaactacgctgctgctaaatgtggtatccttggattctctcgcgcccttgctctcgagggccacaagttggcatctatgtcaacactatcgcttccaacgctggtactgccatgaccgcactatcatgcctgaaaagatggtcaggtctttcaaagcccgatacatagcccctcttgccctgctctttgtagtgncaagtggcctaacctatngcggtttgtccangtttgnagcngttgtgccgtnagctca

SEQ ID NO: 221 - DNA, 561 bp, Fusarium venenatum
  misc_feature (1)...(561): n = A,T,C or G
catctacgctgtaattcaggatgatgctgtggccttttggggcttccagaagttcatggagcgcatggaacgcaacttcctacgtgatcaatctggtatgcgcaaccagctcctgacgcttgatcaactcgtccagttcatggatcctgtactctggaaccaccttcaaaaggccgacagcaccaacttcttcttcttcttcagaatgattttggtttggtacaaacgtgagtttgaatggctagatatcttgcgattatgggaagggttgtggacagactacatgagtgccaacttccacctcttcatcgctttggcaattctaganagacatcgcgatgtcatcatggagcacctgcagcactttgacgaagtgctcaagtntattaacgagctgtccaccacaatcgatctcgaagcaactctcatcagggcagaaagtctcttcaagaaattccaaaggctcgtcgatgcagtcgacaagaancaaaacttccctgctccccgtttcaatcctaanaatcttctggatctccggaatcacagggtcagggcccccaa

SEQ ID NO: 222 - DNA, 570 bp, Fusarium venenatum
  misc_feature (1)...(570): n = A,T,C or G
cattgagcttgctgagaagcacaacgccttcattggcggcgacgacttcaagtctggccagactaagatgaagtctgcccttgttgacttcctcatcaacgccggtatcaagttgacttcaattgctagctacaaccatcttggcaacaacgacggcaagaacctgagttcccagaagcagttccgctccaaggagatctccaagtctaacgtcgttgatgacatggtcgaggccaaccacgtcctttacaagaagggcgagcaccccgatcactgcgttgtgatcaagtacatgcctgccgtcgcagacaacaagcgtgcccttgatgagtactacgccgagattttcatgggtggtcaccagaccatttcgctcttcaacatctgtgaagactctctcctcgcttctcccctgatcattgacttggtcatcattgccgaaatgatgtctcgtatccagtggaaggccgtgtcttccgacggcactgctactaccgaatacaaaagtttccacagtgtcctgagtgtccttagctacatgctcaanggcccctgacccccctggcactc

SEQ ID NO: 223 - DNA, 692 bp, Fusarium venenatum
  misc_feature (1)...(692): n = A,T,C or G
cttttcccgtaagctccctccccaattctaccatctccagtcatctcaccacatttctctttataccacttcgtccttcaactcttctatctcctcgaactccgtcgccgtctccatcaacgtctcttcttttcccctttcccatacacacaccgtaatccacagccatggaggaagaagttgctgctctcgtcatcgacaatggttcgggtatgtgcaaggccggtttcgccggtgatgatgctccccgagctgttttcccttccattgtcggtcgcccccgtcaccatggtatcatgatcggtatgggtcagaaggactcgtacgttggtgatgaggctcagtccaagcgtggtattctcacactgcgataccccatcgagcacggtgttgttaccaactgggacgacatgganaagatttggcaccacaccttctacaacgagctgcgtgttgcccccgaagaacacccngtcctgctaccgaggctctatcaaccccaantccaaccgtganaagaagacccagattgttttcaagacctttaacccccccgttttctacgtntttatcaagcccgttctgtcccttgtaccctttccggtccntaccacccggtttcgtttgacttgggaagngcactacntngtccattanaaggttcnccttnccccccttgcnggtaangggtg

SEQ ID NO: 224 - DNA, 548 bp, Fusarium venenatum
  misc_feature (1)...(548): n = A,T,C or G
gctctctgatagactctccaatgatctctgcatcgtcatgcgcgcctacctngagaagccccgaacaaccgttggctggaagggtctcatcaacgatcccgatatcgacaactntttcaagatcaacaagggtctccgtgtttcccgccagctttttgttgacctaaccactcagggtctcccaattgccactgagatgctcgacaccatttcccctcagttccttgccgactgtatctctgttggcgccattggtgcccgtaccaccgagtcccagcttcaccgngagcttgcctctggtctttctttccccgtcggtttcaanaacggtacagacggtagccttggtgttgccattgacgctattggcgctgctgccgtcaacaccactttatgggtgtcaccaagcagggtcttgctgttttaccccaaccaagggtaacgagcactgnttcgtcattctccgngggggaaccaagggtaccaactttgacaangagagcgtccaggctggtaaanaaggtccttcangaaaaanaaacaaaagg

SEQ ID NO: 225 - DNA, 889 bp, Fusarium venenatum
  misc_feature (1)...(889): n = A,T,C or G
cgacgccgcacgacgcccgaggtccaagtctcaaccttcacaatggcttccagacctaccgtcactattctcggcaaagatggtgctcccactggagctacccacgccattcctgctgtcttcaccagcccgatccgaccggacattgtccagcaggttcacaccggcatggccaagaacaagcgtcagccctactccgtgagcgagaaggctggtcaccagacctctgctgagtcttggggtaccggtcgtgctgttgctcgtattcctagggtttctggtggcggtactcaccgcgctggtcaagctgcttcggtaacatgtgtcgttccggtcgtatgttcgcccctacaaaaatttggagaaagtggcacgtccgagtctcggtcggacaaaagcgatacgccgtttgctctgcctcgctgccttccgcggccgttcctctgttcaggcccgtggacaccaggtcaactccgtccccgagggttcctctggtcatcgacttccgctggtttcgaggctgctgncattgccaaganctccgctgntntcggtcttctgaaggctgttggtgccgttgaagactcaacaaggtnaagaactccaagaacttcgtgctggtaagggcaacttcgtggccgccgccaccgccagcgacgtggcccttttgtcatctactccccgagactgatgggaaggacttattaccgctttccgcaacaatcactggtgtcganactggcccgtcaccggtcttaacttcttccaattggttctggtggtgaccttgggtcaattatgtttggacctccggtggtttcaaggttttganacatctacggttcnccactgaaggttcncccacaacgtnaattccccctccttcaac

SEQ ID NO: 226 - DNA, 643 bp, Fusarium venenatum
  misc_feature (1)...(643): n = A,T,C or G
cctctacctaaattccccgaaataaaaaccaaaaaccgtcaaaatggtcaaggctgtgagcgttctccgcggtgactccaaggtctccggtaccgtcgtcttcgaacaggagtctgagtctgctcccactaccatcacctgggacatcaccggtaacgaccccaacgccaagcgaggattccacatccacaccttcggtgacaacaccaacggctgcacttccgntggccctcacttcaaccctcacaacaagacccacggngctncttttgacgagacccgncatgttggtgatctcggaaacgtcgagactgacgctcagggcaatggcaagggcttcgtcactgactttcttatcaagctgattggcccccacagcgtcattgggcgaaccgttgttgtccacgctggtactgacgaccttggcaagggtgacagcgaggagtctctcaagactggtaacgctggtccccgacctgcttgnggtgttattggtatctccaactaagcagtgccgaactgaattgaatgaaaaaaaatgccattactcagttgctttttgtttagcaaaatttcagccatgaacaatgatgtgtctcatgatattcgatagcaacaatcaatccaattnaagtgantcnat

SEQ ID NO: 227 - DNA, 549 bp, Fusarium venenatum
  misc_feature (1)...(549): n = A,T,C or G
gagcaacttnaggcagccaagcgtgcatctctgttctntcgtgttgagcccagccataagtcccgactggttgatctncttcagtctcttggcagaagttgttgccatgactggtgatggtgtcaacgacgctcctgccctgaagaaggntgatatcggtgttgccatgggttctggaaccgatgtctccaagctggctgncgacatggtccttgctgacagcaactttgccactatcgaggttgccattgaggaagggcgctccatttacaacaacacccaacaattcatccgttatntcatctttttcaataattgggcgaaagttggttccatctttctcacgggcgntcttggnatgcccgaggctctggttcctgntcagcttctctgggtaaacctagtcactgatgggncttcctggcaccgntttgntctttaaaccttttgaacacgacatnatgaaagcgttgccccccggaaggcgagatgangngctcatttggncggggtgggntttttttttcngtattttggtaattnggaaca

SEQ ID NO: 228 - DNA, 610 bp, Fusarium venenatum
  misc_feature (1)...(610): n = A,T,C or G
attattgttaaatatctctgagatattatatgagaccttcactcatctcaaagctcagagccactccaatcgctgccaaaatgcctgttcaccatctcatggtcggcacctggacccctccaggagccatcttcacttttgcttttgatgacgaggctcttactctcaagcttgtcaagaggactgagattccccaagatgagcctatctcatggatgactttcagtcatgatagaaaagccatatatggcgctgccatgaagaagtggtccagtttcgcagttgagtcgccaacctcaataactcaccaagtttctcacccaatggagcacgaccccaatgcttctcttgcgacaaccaatacccgcgccatcttcctcctggcttgcaacaagcctccttactcagtctactgcaatccattctacgaccacgccggccacggngctgctttcaccaccgacaacaccacaaaagctnttaaggagaacgttcaaaactacccctaccagcctaacactgggatncatgggatgggctttgaccccgaggangagtattttactntggcganctttgcgccaaaaagntttggaccattggccgnngg

SEQ ID NO: 229 - DNA, 525 bp, Fusarium venenatum
  misc_feature (1)...(525): n = A,T,C or G
ggaatgtcggtggtctggatatgcanaagcaggagatccgtgaagctgttgaattgcccttgacgcacttcgatctttataagcagatcggtatcgaccctcctcgcggtgttcttttgtacggtcctcctggtaccggcaagactatgctggtcaaggccgtcgccaactcaaccaccgccaacttcatccgagttgttggttctgaattcgtccanaaatacttgggtgaagggccccgaatggtccgagacgtttttcgtatggctcgcgaaaactcacccgccatcatcttcatcgacnagattgacgccatcgccaccaagcgattcgatgctcaaaccggtgccgataganaagttcancgtattttgcttgactgtcaatcaaatggatggtttcaccagactgtaatgtcaaggtattatggcaccaaccgagccgatactntggatcctgccttctccncccggacgttttgaccgaaaancaatttcctngctgganaccgtgtgagcgacgttt

SEQ ID NO: 230 - DNA, 620 bp, Fusarium venenatum
  misc_feature (1)...(620): n = A,T,C or G
ttggcacatcgcttcgcatatatgacttgggtatgaggcaaatgctccgcaagtctcaggccgaagttgcaacacagcagattgtgtctctcaacacacaaggcagtcgaatcattgtaggcgatgttcagcagggcgtcacttacgttgtttataagcctgcttctaataagcttattccatttgtcgatgatacaatcgcaaggtggaccacatgtacaaccatggtggattatgaatcagtcgctggtggtgacaagttcggtaatatgtttatcgtacgttgtcctgagaaggccagtgaagaggctgatgaggagcaatccggcttgcatctgatcaatgcccgagactatctccacggcacacctcacagagtgagcttaatgtgtcatttctacacccaggacattccgactagtatcactaagacgagtcttgtggttggtggacaggaaattttgctatggagtggtatcatgggcacaatcggagtttttattccatttgtcagtcgtgaagatgcagacttttttcagaacctcgagcaacaccttangacagaagatccccactccgccggacgaagatatctcatgtatcgtggctattaagcccct

SEQ ID NO: 231 - DNA, 595 bp, Fusarium venenatum
  misc_feature (1)...(595): n = A,T,C or G
nccaaaaancnattatcgcccnccctgcccccatntttggtttcgaggacaacctcttgctgaagctggctggtgttactaaccttttcacttccaacaacatgcaagagaagttctaccccgttcattccattgatgtcggtgctgctctngagaagatcttcttcgacgacaccactggtggacagaccttcgagctttacggacccaagaagtacagcntggaggaaatttctgttatggttgacaagganatttacaagcagagacgacacgttaacgtgccaaaggctattctgaagcctgttgctgagctgctgaacaaggtgctttggtggcacactctgtcagctgatgaggttganagagagttcttggaccaagtcatcgaccccaaggccaagaccttnaaggacctcggcatcgagcctggngacatcatcaacttccctaccactatctgnaaggattncgaaccagaactactacgatcttcccctgcgacaaaaaanganaacgggaaaaaaaaaaatncctcccctnctggacnattgnaaanaaaangaatcggnttttgcgngctatngatgcngga

SEQ ID NO: 232 - DNA, 661 bp, Fusarium venenatum
  misc_feature (1)...(661): n = A,T,C or G
attccgtgttgcttctcactttccaattctctcacaaatttaaaacgcaacaatggatccatgcatggagctcaagcagaacacgacaattgtcgtgctcggtgcttctggtgatctggcgaaaaanaagacgtatcctgcacttttcggtctttaccgaaaccagttcctccccaaggatgtcaagattgtaggatatgcccgtactaagatggaccacgacgaatatattcgacgcatcaagtcatacataaagacccctacaaaggagattgagcaacaacttgaagacttcgctgggctttgcacctacgtctctggtcagtacgacaaggacgaatccttccagggtctcgagcagcacctccaagaagttgagcaggatcgccccgaaaaccaccgtctgttctacatggcgctcccccccagtgtcttcaccattgtttctcagcacctcaagaagatctgttacccaaaaacggcatcgcgcgtgttcntcntcnaaaaccnttcgcaagatcttgccagctcccgcgaacttcaaaattcccttgaccctgactggaacaaacaggaactgttccaatccacattacttgtnaganaaaggtcaaaacaccngatcctccaattggtacccttccccgcgccccttgaaacg

SEQ ID NO: 233 - DNA, 845 bp, Fusarium venenatum
  misc_feature (1)...(845): n = A,T,C or G
cccctacctcgacctactgctatcgattgcttaatacctataccaacctcttctttttttggttctgtccctgaaaaccctcccaacccaaacacgttcctattcaacttcaacaagagcttaccccgccaaatccgaaccccgccaaatcagacatacctcaccaaaatggtcggtcttggtcctcgtcgccctccctcccgaaagggatctatggccgatgtccccaaggacctcgccgaagagattaacaagcttgagaatctcttcacggtagagcccagcaagcttaaggagatcaccaatcactttgtttctgaactcgccaagggtctcagcgttgagggcggtagtatccctatgaaccctacctgggttatgtcataccccgatggctatgaaaccggcacctacctggccctcgatatgggcggcaccaacctgagagtgtgccaaatcacactcactgacgagaagtctgagttcgacatcatccagtccaagtaccgcatgcccgangagctcaagtccggcacctctgaagagctgtgggaatacatcgccgaatgtctctaccagttcctcgagacacaccacggagactgcagcaaattgganaaaatccttnttgggttcacaattcttgtaccccgncncccaaaactacattcgacgaaggggtattcttcaacgaanggaccaangggctttgacatttgacggggtcganggcaaaacattgtncccatgttcnaggaggccttgaangntttaggggttcttttnaacttgggggttttatnaatgatcttcccggcccattgatggcttccnctaccccaaan

SEQ ID NO: 234 - DNA, 615 bp, Fusarium venenatum
  misc_feature (1)...(615): n = A,T,C or G
attgggcacgcaaaccacgagcctctgccaacttcaacgacaactacagccaaaatgcctcccaagctcgaccccaatgagattaaggtgatccacctccgcgccactggtggtgaggttggtgcctcctctgctcttgctcccaagatcggtcctctgggtctttctcccaagaaggtcggagaagacattgccaaggctactggtgactggaaaggcttgcgcgtaactgtcaagctcaccatccanaaccgtcaggctgctgtttccgtcgttcccactgcttcttccctcatcatcaaggccctcaaggaaccccccagggaccgaaagaaggagaagaacatcaagcacaacaagtctgtcgccctcgacgagatcattgagatcgcccgcaccatgcgatacaagtctttcgccaaggacctctctggtaccgtcagggagattctcggtaccgcctacagtgttggctgccaggtcgatggcaagcctccccaggctatcatcgaagctatccaaagcggcgatatcgacatccccgangagtaaattcggtctcttacgaaacccaatnccncaaaacaagaacaatagatccattgtctgatggtt

SEQ ID NO: 235 - DNA, 618 bp, Fusarium venenatum
  misc_feature (1)...(618): n = A,T,C or G
aaactgtattttgttttatttttttagccagctcttctaataaaaggtcccttgcggacttgttctaccatgagctgagctcgaagcgactgatttcccatcttcaaaatgtctgtcattctctgtacagctggatacgatcatactattagattctgggaagctttatcgggtatctgttcacgaacaatccagcatcccgactcccaggtcaatcgcctttgtatctcccccgacaagcggtaccttgccgccgctggccaccacaccgtcaagctctacgatatcaaatcgacgaacccgaacccgcttttgaccttcgagggacacaccggcaacatcacaggcgtagcctttcactgcgagggaaaatggatggttactagttccgaagatggtactggtaagatctgggagacgaggactggatcaattcagcgaagctataaccatgggtgcccagcaaacgatgtcgtaatccaccccaaccagggtgagattatcagttgcgacaggtcgggaagtgtcagagtgtgggatcttggnccagaacaaatggtcccatgagctcattccaaaaggaagacgtctcagtctnttagcgtcaccgtagccagg

SEQ ID NO: 236 - DNA, 649 bp, Fusarium venenatum
  misc_feature (1)...(649): n = A,T,C or G
gagcattacgtctacacgaatcttgcgactcctcgatcagttcaccatccaccatctatctttccttcaactgaaagcttcttctcagctgaatttcgttatttcccctttcctttaacaacccttgaaatctaaatccaccaactttagtcgccaaacaccgccaaaatgggtcacgaagatgctgtctaccttgccaagctcgctgagcaggccgagcgatatgaggagatggttgagaacatgaagattgtcgccggtgaggaccgagatctcaccgtcgaggagcgaaaccttctctccgttgcctacaagaacgtcattggcgcccgccgtgcttcctggcgcatagtcacctccatcgagcagaaggaggagtccaagggcaactcttttcaggttaccctcatcaaggagtnccgacagaagatcgaggccgaacttgccaagatctgcgaagatatctcgaagtccttgaacagcaactgattccctctgccaagtctggcgaatccaaggttttctaccacaagatgaaaggtgactaccaccggtacctcgccgaattcgccattggcgaccgccganggctttgccgnaagtccttaggctnagggttcnttagttgccanatgggttcttcnccncc

SEQ ID NO: 237 - DNA, 518 bp, Fusarium venenatum
  misc_feature (1)...(518): n = A,T,C or G
tctccacgaagctttagagaagctcacccaggacactctacactcgtccaagcagatggtagctgtcttctctgacaaggaccctnaggtgatggacacgattgagtgcttcatgcacggctatgtcacgtggcacttgtgcgatcacaggtaccgttgaatgagatctacgaaaaggtcaaaggacaaaagaccgaggacgctcagaagttctgcaagttctatgagcagggctgctaacgtcggagccgtttcgccctcggagtgggcttatccacctattgcgcaactggcaaacattcggtccaaggatgtgaaggatgtgaaggatgtgaaggagattcagaagcctctgctgagctcaattgagctagtggaatgaccgacggtgagatggaagtatgttttgcgggtactcgctaggagaatactggtcgtttatcatgattacaaatagcttggttatgtttttattagcatttacagttgaacaaggataattactactgaaaaaaaaa

SEQ ID NO: 238 - DNA, 799 bp, Fusarium venenatum
  misc_feature (1)...(799): n = A,T,C or G
ctcaactctacctgccttactatctccaacctcaactattaatcccagcaaagctcaccaccacaaccccgccccgaataacgcccttaacaaaattactcgggtagctcaaattcatcatgtttcgaaacaactacgataacgattccgtcaccttctcgccccagggtcggatattccagatcgagtatgctgcagaggcagtgaagcagggctctgttgttgtcggtattgctagcaagactcacgccgttctgtgcgctgtcaagcgaaatgccgaggaactctcatcttaccagaagaaactcttcaccgtcgacnaacatgccggtatcgcaatcgctggccttacctccgatgcccgtgttctttccaacttcatgaagcagcaatgcctaggccaccgactcacctatggccgtgccatccccctccgatccctcgtcgacatgattggcgagaaggcccagatgaacacccagatgtncggcaagcgaccatacggcgttggtctcctggtttccggtgttgaatgagcgtggtcctcacctgttcgagttccagccctcaggcatgacagaagagatgcttttttttgccatttggcgcccgaagccaaatgggccgaacataccttgggcgcaacattgattcctttgccgattgctcgaaagaagactgattcagcatggtctcaaggccttgaaagaaagtctggtccaggacaaggactttcagtaganaacacatccgtcggcgtagtgggcatcaacatagtggaatggcaggaagaaggtcg

SEQ ID NO: 239 - DNA, 610 bp, Fusarium venenatum
  misc_feature (1)...(610): n = A,T,C or G
ggattctgaggtcanggctgagaagcaaaacactcggttccaagatgtccacggttgcgatgaagccaaggaanaactccaggaagtcgtcgagtttttgaanaaccctgagaagtttagcgacctcggtgccaagcttnctaagggcgtnctcctggttggtccccccggtactggtaagacgctttttgctcgagccgttgccggngaagccggtgttcctttcttctacatgtctggtagcgagtttgatgagatctttgttggtgttggtgccaagcgagtccgcgagctctttactgccgcaaaaacaagtcccccgccattgtctttatcgatgaacttgacgccattggaggcaagcgtaaccctagagatcaagcccacgctaaacagacactgaaccagctgcttaccgaatttggacggttttgatcaagacagcaagatcattntnattggagccnccaacttgnccaaagatgctggataangcccttactcgtcctggacgctttgatcgacatgtnaatgttgacttgncccatttagaggcccaatcncctttttaaccccatgcccagaaaancaaagtttctnccgatgtcca

SEQ ID NO: 240 - DNA, 639 bp, Fusarium venenatum
  misc_feature (1)...(639): n = A,T,C or G
gggcagtttcggcaaggtcatgcaggtgcgcaagaaggacacgaaccgaatctatgccctcaagacaattcgcaaggcacacatcatctcgcgatccgaagtcgcccacacactcgccgaacggtctgtgctggcgcagatcaacaaccccttcattgtgccgctcaagtttagtttccagtcaccagagaagctctactttgtccttgcctttgtcaacggaggtgagctgttccaccatttgcaaaaggagcatcgattcgacgtcaaccgatcccgtttctacaccgccgaacttctctgtgctctggaatgtctacacggcttcagtgtgatctaccgagatctcaagcccgagaacattctcctcgattatcaaagncacatcgctctgtgcgaatttggctttnaagcttgacatgaaggatgaggccgactaacactttctgtggtncccccagtatctggcgcctgagtgtgatggtcaaggtacacaagacagccgatggnggaccttggggtttgttacnaangtgacgggnctgcncctttntgatggacctacgagatnnccgagattntaagcttttatttnganggggcccagtncaggntctacaacttttaccgatttaaagg

SEQ ID NO: 241 - DNA, 623 bp, Fusarium venenatum
  misc_feature (1)...(623): n = A,T,C or G
gccgaggacattgtgtggcacgaggatgtcttgatttacagtgtctgggatgacgaggcctcaggctcaaacttcaacggctacctgtaccttgatcttcaccctcgtgacaacaagtatggccacaacgccaacttcaacctggagcctggttatgtcaccgaggatggcaagaagcactaccctgttactgccctggtctgcaatttcagcaagccaactcccaagaagccatccctgctgaagcaccacgaggttgtgaccctgttccacgagcttggtcatggtatccacgacttggctggtcgcacccgctacagctacttcacggaacctccacagtgctcgactttgtcgaggctccatctcagatgctcgagaactggtgttggactcccagcgtgctcaagtcactttctaaagcactgggaaacaaaggagcaaattcccgacgagcttatcgaaaagcttggttctaccaaagcgtctttaactcaacgatcggcgcactttggacagctagntattggnctgtttgacatgactgngcacacttcctgagtctcacgaaggttgtcaagaaactcaaacgcttggccgaacttgggaacgaagcttngaca

SEQ ID NO: 242 - DNA, 624 bp, Fusarium venenatum
  misc_feature (1)...(624): n = A,T,C or G
ggtatttcgtcttgacgacctcctccatcgtcaattggcctcgaatcgtcacacaaccggccatggcgaccagtatttctcgaagtagggctttggcctcagctctccgacccgcgaagccctccttccaggtccgcaacgatcaagcaatccgctgcttgtccaacacggctcgtcaatatgtcgcaatgcccaaggaaagccccaacctgcgaaaggcccctcgcgaccacatcggcacactcaaggctcctatcgtcaaccctgccgacaagtaccaaagcaagtctgacaacatgcaccgctacggtgcctggttgatgggttgccttcccaaatacgtccagcagttctccgtctggaaagatgaactcaccatctacatctctccgtcgggtgtctaccctgtcttcagcttcctgaagtacaacactgctgccgagttcacccaggtcagcacagttactgctgccgattaccccacgcgcgancaccgtttcgaaattgtctacaaccttctttcggtccgccacaactcccgaatccgtgtcnagactacgccgacaaggttctcctgttccagtatcactgggctttttgannggtgccaactggtatgancga

SEQ ID NO: 243 - DNA, 608 bp, Fusarium venenatum
  misc_feature (1)...(608): n = A,T,C or G
gttaccgcttgagatcattgccgcatctctaactctctcatactgggacgaaagtcttactcgcgccatctttgtctcggcgtttctcgtactcatcatcatcattaacatgtttggagtaaaaggctacggtgaagccgagttcatattctctataataaaggtcattgccgtcattggatttatccttcttggtatcgttctcaactgtggcggaacgccagacagtggttatatcggcggccgtttctggcatgaacctggtgctttcaataacggtttcaaaggaatgtgcaacgtctttgtcacagccgcattctccttcgctggcactgagcttattggtctcgctgccgctgaaactgctaacccacgaaagtcattaccgactgctttgaaacaagtgttctggcggatcactcttttctatattggtgcccttacgttggtaggggctggtggtccatacaatgacccccgacttaccacaggtctagtgatgcanatgcactgcgtcaccttttgntattgctattgaaaaagcgggtatccaagttnacctttgggtatgaacgcantcattctttgcgccgtctntntgttggaaa

SEQ ID NO: 244 - DNA, 644 bp, Fusarium venenatum
  misc_feature (1)...(644): n = A,T,C or G
caccacccaaaataatcaccaacctcacctcatctttgtttccacgagcacccaaatttcacactcacatctacagattatccacaaacaaacacgaccgcattcaaaatgtctgagtctacatctgttgagaagatctggctggcctccaacgacagcgccgtcatcgaagttgaccgcgttgtcgctgagcgatcaatgctgatcaagaacatgctcgaggatgttggcgacgactccatcacccaggccaaccccattcctattcccaacgtcaacgaggctgtcctccgcaaggttatcgagtggtgcgaccaccaccgaaacgaccctcctcaggctcaggatgatgaatccgacgctcgcaagaagactaccgacatcgaggagtgggaccagaagtttatgcaggtcgatcaggagatgctctttgagatcatcctcgcttccaactatctcgacattaagccccttctcgacgtcggatgcaagactgttgccaacatgatcaanggcaagtcgccagaggagatccgnaagaccttnaacatcaccaacgatttcncccccgaggaggaggagcagatccgncgtganaacgantgggcttgaggancggtaagttgcctcgtctttgcttcaaa

SEQ ID NO: 245 - DNA, 820 bp, Fusarium venenatum
  misc_feature (1)...(820): n = A,T,C or G
cgacgagataatccatcaacgcgatccccaatttctcacgctcattttccctttgcgggtcttccttgatctacctattctcaggtcatttcttctattctttatctttcttcttcaaatcgatacccctccaatcccacccatcatggcacccaagggaaacaagtactcggttatcttgccgacatacaacgagcgcaagaacctccccatcattacctggttgttgaaccgcaccttcactgagaacaacctcgattgggaactcatcatcgtcgacgacggatcccccgatggaacccaagaagtcgcccagcagctcgtcaaggtctactctccccacgtcctcctcaagccccgcgctggtaaactcggtctcggaacggcctacgttcacggtctcaagtttgtcactggcaactttgtcatcatcatggacgccgacttctnccaccaccccaagttcatccccgatatggtcgctcttcangagaagggcaactacgatatcgtcaccggtactcgctatgctggagatggaggcgtctttngctgggatctcaagcgaaagttgtcagccgtggcgccaacttgttcgccgacactgtctgcgggctggcgtgagcganctgacangcagtttccgtctgtacaagcgtgctggcctggagaangctattgntaccacaagagagtaagggttacaggtttccaaaatggagcttatggttcgtgccaaggntatnggctgnactggcgccgaggttccatttcnttgtcgaacgtttgtaccggaaagaagcaacttggcgganacaaa

SEQ ID NO: 246 - DNA, 657 bp, Fusarium venenatum
  misc_feature (1)...(657): n = A,T,C or G
aaagaagaaggatttgggtaaaatcgnccccaccgtcgaatgtcgatgcggttacagattctgctttggctgcccaaacccagatcaccaaccggccccttgtgatttggncaanaaatggttgaaaaagtgtgccgacgactcaaaaactgccaactggatttcggccaacaccaaggaatgcccaaagtgtaactcgaccattganaaaaacggaggctgcaaccatatgacatgccgaaagtgcaagtacgaattctgctggatgtgcatgggcctctggtccgagcatggaactagttggtacaattgtaacagatacgaggagaagagcggctccgaggctcgtgatgcccaggcaaaatctcgaacgtctcttgagcgctatctacactattacaaccgctacgcccaaccatgagcaatcggccaaactcgacagggatatcgctcanaaaaccgaaaagaagatggnccagctttcagagtgcttcaggcatgttctggatcgaagtccaataccttaacttnggngtcccaggttntttaaacctgncggcaaacccttaaggggacatatgcctttgncttntatnttgccagaaacaanctgncanaaaattttnganggtaaccaaaggcntgaatggtgnggat

SEQ ID NO: 247 - DNA, 476 bp, Fusarium venenatum
  misc_feature (1)...(476): n = A,T,C or G
gatgaatgggacattgccagcatttgccatactctgaccaaccgccgccatggnnagaagaccatcgcttatgctgagagtcatgaccaggcccttgnggganataaaacgctcatgatgcatctctgtgatgctgagatgtacaccaacatgtcgactctctcgcccttgactcctgttgttgatcgcggtatggccctccacaanatgatccgtctggtgacacacngncttggaggagagggatatcttaactttgagggtaacgagttcggtcaccctgaatggctcgacttccctngagagggcaacaataactttttttggtncgctcgacnacagcttaacctcacagatgatcctntgctccaatacaaagttcctttgacccctttgaccgntttgatgaaccaaaccganggccaantncgggtgggtggnttgcnccttagggcgtacatttcactgaancatga

SEQ ID NO: 248 - DNA, 711 bp, Fusarium venenatum
  misc_feature (1)...(711): n = A,T,C or G
tctttttgaccgtctcactacctctcaactcaacaagcatttgaccagctatatgaagggactaactgctaaggttttccgtacctacaacgcctccttcacaatgtcgactctgctcaacaagcttgctagtgaccctcgctctcgcggtacggctgcanagaaggtgaagctgtacaacgattgcaaccgtgaagttgctattctgtgtaaccacaagcgaaccgttggcgcctctcacgagcaacaaatggccaagctaggtgacaggattaaaggcctccgataccagcaatggcgtaccaagatgatgatacttgacattgactcgagctacaanaanaagaagggcgccgcctggttcgagaaggatgaggagctgaatgatgagtggatcaaagatcaccagcagttcttgctcgaggaacagcgcacaaagatccagaagaagttcgagaaggacaatgaaaagcgccaggctgacaaggagaancccctacctgagaaggagctccaggacgactcccggcttgtgaangaaatggaacccatnttcatgaaggggaaccagaaccacagaagtttggggctgaaggccaagccctnccgttgacaagtttttccagggtgttgacaattccataaccntcagaccctgactccnggccccgatcttatngttacaggagtngtctcgccccccaaatcaat

SEQ ID NO: 249 - DNA, 716 bp, Fusarium venenatum
  misc_feature (1)...(716): n = A,T,C or G
cagnatcaccacgccaaaccgacaagatgggccgtcttcacagcaacggaaagggcatttctgcctctgctctcccctactctcgatcctcccctgcgtggttgaagaccacccccgagcaggttgtcgagcagatctccaagctcgcccgtaagggtgccactccttctcagattggtgtcattctccgtgactctcacggtattgcccaggtcaagcacgtcactggtaaccgaatcctgcgaattctcaagtccagcggtctcgcccctgagctccccgaggatttgtacatgcttatcaagaaggctgttgctgtccgaaagcaccttgagcgcaaccgcaaggacaaggactccaagttccgtctcattctcattgagtcccgaattcaccgtctggcccgttactacaagaccgtcggtgtcctcccccccacctggaagtacgagtccgctactgccagcaccatcgtcgcttaagcgaacataaaaacgacggctggccaagttcggatggaagtgatggtttcccggatcacggagttagggacaaattatggggaaagcttgcatttagagccatgatgcttatgcgccctatctgggaggaccgacagcgaagtcgacggctcaatagaaagctcttcgatcgctgcaaaacgcatgtatgcaatgggtacactaaacccggtgacgataaaattcttaaacctg

SEQ ID NO: 250 - DNA, 906 bp, Fusarium venenatum
  misc_feature (1)...(906): n = A,T,C or G
cagaaattgaacccccccatcgctctctaatctttaaacgttgcaaatcataagcagcgttacttcttccctctcttttcctcctctctccttttccacaacctcataccatcatgcagtccgtcactagagccgctcgcgcttctgcgctgaagaacgttggccgccgcgcctactcttcatcgcagtacgccaagaccatcaacaacctgcgcatcaacagcgataccaaggtcatctaccagggattcactggaaagcagggaactttccacgctgagcaagctatcgaatacggcaccaaggttgtcggtggaacaaaccccaagaaggctggcagactcaccttggccttctgtcttcaagaacgtctcanaagccgcaaggagactggtgctaccgctactggtctcttcgtccctcctctctggccgntgccggtatcgaggaggccctcgagggcgagatccccctcgttgnctgnatcactganggnatccccagcatgacatggttcgcatcaccgacatgcttcaagacccaggacaagacccgtcttgtcggccccaactgcgccggtatcatcggccccgaacaagtgcaagaatggtattcatgcctggtttcatncacaagcgcgggcggattggtatcgtctnccgtttgggnaccctgactacganggtgtnaaccaaaccacccaagccggcctcggtaatnttttgtcgtcggtattggnggggaccccttntccggnaccaactttatcgatggcttaaggttttaccgaggaccccaacancgacggtttattatgattggngaaaatggaggttccnccgaggaggatcccncgagttcttnaagcanggccaaaaccgtnaacgggggnaanccgttgtaact

SEQ ID NO: 251 - DNA, 699 bp, Fusarium venenatum
  misc_feature (1)...(699): n = A,T,C or G
cttcgacaacctcacccaacgactaatctggcttcacccacccaaccacccaaccaataccgcaaaaatggccggcggagttactgttcgcgatgtcgatgcgcagaagttcatcactgcctactctgctttcttgaagcgtcagggcaagcttcccatccctgggttgggtcgacaccgtcaagactggtcctgccaaggagcttcctccccaggacattgactggttctacgtccgtgctgcctctatcgcccgccacgtctaccttcgcaagaccgtcggtgtcggccgtctccgcaaggtccacggtaccgccaagaaccgcggcagccgtccctccaagcacgtcgatgcttccggctccgtcgaccgaaaggtcatgcagtctcttgagaanatcggtgtccttgagcaggacgaaganaaaggtggccgccgcatcacccaggctggtcagcgtgatttggaccgtattgcccagaccaccgctgaggccgaggaggaggaggatgacgagtaaattttgtcttcaatcaaattaactcgaaaaaagtctggcggttctttacccggtcaatggtagcaatggcaatggatttgggcgttgggtcatagaatttgtcatgtatgaatganattcccctgatctctgggtcattcggtttggtcaaattggacccgtccaacttgtcgttcan

SEQ ID NO: 252 - DNA, 702 bp, Fusarium venenatum
  misc_feature (1)...(702): n = A,T,C or G
cgtcaaccgccaagtgacgaagtaaccagcagtcgcccatttcttcaaaatgcctcccaagaagaccgccacccgtgctccccagganaacatctccctcggaccctntgttcgcgatggcgagctggtcttcggcgttgcccgtatcttcgcttccttcaacgataccttcgtccacgtcaccgatctgagtggccgtgagactatcacccgtgttactggtggtatgaaggtcaaggccgaccgtgacgagtcctccccctacgctgccatgttggctgctcaggacgtcgctgcccgctgcaaggagcttggcatcaacgctcttcacatcaagatccgtgccactggtggtaacggtaccaagacccctggtcccggtgcccagtccgctctccgtgcccttgcccgtgctggcatgaagattggccgaattgaggacgttacccctactcttccgactctacccgnaaaaagggtggtcgccgtggtcgtcgtctctgaactgcttaccttttggtggcttggattggacaggagtttcgctatctggtttctctgtggcgttgagaatcacgaagagaacgggtttttcgcctggtcttcagtctacacttgcaaagcctggtcaggttatgggttangacgcattagacagttgaaaattcgtccgaagaaggcctattaatcattctgctcgtc

SEQ ID NO: 253 - DNA, 849 bp, Fusarium venenatum
  misc_feature (1)...(849): n = A,T,C or G
ctcacatcacctctatcttctctctcagttaacgctgagcctgaccttgcttctgagactgttcaactctccgataacataaactcttattcagccatgtctgttggaatctactctcttccggcgttgccgtacgcctatgatgcccttgaacctagcatctctgctcaaatcatggaacttcaccactccaagcatcaccaagcctatgtgacaaatctcaacgccgcactcaagaactacgccaccgctacttcgtccaacgacatcgccggccagatcgccctgcagtccgccatcaagttcaacggcggcggccacatcaaccactccctcttctgggagaacctcagtccctctagctctccagactccaagcccgaaagcgcccccacgctcggtgctgaaatctccaagacgtggggcagcatcgaggctttccaagagactttcaagaagactctgctgggtctgcagggcagcggctgggggtggctggtcaaggacgcccagggcttgcgtgtcgttaccaccaaggaccaggaccctgtcgtgggaggagaagtgcccattttcngngtcgatatgtgggagcatgcctactatcttgcagtaccttaatgggaaaggctggttatgttgataacatttnggaatgtcatcaactgggangacggccgaggctcgtttcaccggctcccgtgagggatgctttcaaaggtcctggcgnagcttcttntttaaacggagttgacatattgaanaacgagtttnnaaggcccaaccgactcttnataccatagnccatctcatttattttgngantggcanattaaaaacacccaactt

SEQ ID NO: 254 - DNA, 906 bp, Fusarium venenatum
  misc_feature (1)...(906): n = A,T,C or G
ctggaagaattcgcggcgcaggaattttttttgaatagagcttgatcatgcattaaattcagcgcaagaaatttttttattcctttccttaaggacccattccgatgcgttatgttaacctcattctgtcgttaaccatgagacagtgagaaatccttgaacaccatgccaggggccaacactcctttcttcatcagcttttaatgacaagcttacttgtggagcttgcgctggtagaaagcgagctcctcaccctccaggatgtaaccatcgacacggccggactgaccgggtcggctggaaacaacagcgtacaatcgaccggcctcgaactgcttctcgatggcgctcttcgaccttgccgcgggcagacatgcgagcagcntgctttttctcaacggcgttggacttcttgacctcctcctcggtcttgccctccttggcggcctgggccttctggcgtcttcggccaagagcctgaccgtagtgggcctcgtaccactgtcggaagggagcggcatcaacctggacgacggcgctcttggtagggtgttggttcggaccaactcgttgttggaagggtggtaggcgacggcaatgacacgggtcttgcgggtcaggccctcggaaccccaggcgaagttaccggagtcgagacggagggcacggtacttgtggttaccacctcgggttcggacggtgtggatgcgcttggggccaatacgggtgttggcaccctggcgaccagcctcgaaagcgcgcttcttcctgtagtaggcacgcttggcaccggaggcggagcgcttgtgtcgagagtcacgcgaaatacccatgattgcggtttctgatgatgttggcgctcaccaggcaatcgaattggcggatggtcgtaggagtgaacttttt

SEQ ID NO: 255 - DNA, 593 bp, Fusarium venenatum
  misc_feature (1)...(593): n = A,T,C or G
cctcactctaccagaaaaacatgtcttccgctcctctcaactcggaccccgtggccaccccacctcgtcctccgtctcccgtccacaacttcggtactctcgccgtccacgccggcgctccacatgaccccgccaccggagccgtgatcgagtctatctcattgtccaccacctttgctcagtccgctgttggcaaacccgttggcgagtacgantactctcgatcttccaaccctaaccgtaccaacttcgagactgctgttgctgctctcgagcatgccaagtacgctctcgccttctcctccggctccgccaccaccgccaccattcttcagantctggctgccggcagccatgtcatttccgtctccgatgtctacgggggtaccaccgttacttcacccangtcgccaaggccacggcgtcaaggtcactttcacaccagaaatcgaagtcganatcgccgaacacatcactcccgatactcgtctgatctggatcgaaantcctagcaacccacactgcgccttgtcgatatccgaactgtcgtcactgangccacaaacatggtgttcttgttgttgttgaaaana

SEQ ID NO: 256 - DNA, 631 bp, Fusarium venenatum
  misc_feature (1)...(631): n = A,T,C or G
acttcttaacgctggaaacaacaatcctagtgcctctcctttcgtcatcgcagcatccaacgctggactcaagggatacgactccttcatgaacgtcatcatcctcgtttccgtcctatctatcggcgtttcctgtgtgtacggtggtagccgaaccttggtagctttgtcgcagcagggttacgcacctaagatcttctctttcatcgacaagtccggacgacctcttcccgctgttgtctctatcatcgcaattggtgccctcggttatatcagtgtcaatggagaaggcactactgttttcatctggctacaggccctttcgggtttggctgctttgtttacctggggatctatctgcctgtgccatattcgcttncggccgcctggaaataccatggccacaccctcgacgaaattcccttcagcatgtctttggcgtttggggatcttggatggnctcatcatcattggtatcgtcctcatcgcgcaattctataccgccatgaccaacattgacggatctcttgggacngnagaagggttctttcaagcctacctggctattgctgnggggatctatttatataatcggatcctcttgnaaccggaaggctggangaanaacaan

SEQ ID NO: 257 - DNA, 645 bp, Fusarium venenatum
  misc_feature (1)...(645): n = A,T,C or G
tttgagcttaccggtatcccccctgcccctcgtggtgtccctcagatcgaggtctctttcgagctcgacgccaacggtatcctcaaggtttctgcccacgacaagggcactggcaagcaggagtctatcactatcaccaacgacaagggccgtctcactcctgaggagatcgagcgcatggtcgccgaggctgagaagtacgccgaggaggataaggctacccgtgagcgcatcgaggcccgaaacgcccttgagaactacgctttctccctcaagaaccaggccaacgatgaggagggtcttggtggcaagatcgatgaggaggacaaggagactatcctcgatgctgtcaaggagaccaacgagtggctcgatgagcacggcgctgacgccaccgccgaggacttcgaggagcagaaggagaagctgtccaacgtcgcttaccccatcacctccaagatgtaccagggaactggtggactcttggtagcgagaanggatgacaacatccacgatgaagttgtaaacgcataaactggatgtttgggaaaagaacataaataaaaccattctggtgtttggttggagcttccatgcccagtatgcaaaagtagataccgcaatgttatgatgaattttcagccc

SEQ ID NO: 258 - DNA, 702 bp, Fusarium venenatum
  misc_feature (1)...(702): n = A,T,C or G
cttcgcttctcttttcacctccttttctctttcttcaacaaatcttcccaaagaaagttcataatatccttccctattcattttactccaccatatcaaacaatcatgggcgttcaaactgttgagttcaagcccttccaggaccagaagcccggaacttctggtcttcgaaagaaggtcactgtcttccaacagcctcactacagcgagtccttcatcaccagcattctgctgtccatccctgagggtgttgagggctccaacctcgtcattggtggtgatggtcgctactacaaccccgaggctatccagctcattgccaagattggcgccgcatacggagtcaagaagctcattatcggccagaacggtatcctttctactcccgctgccagccatgtcatccgtatccgcaaggctactggaggtatcctcctgactgccagccacaaccctggtggtcccaagaacgacttcggtatcaagtacaaccttgccaacggtggccctgcccccgagtccgttaccaacaagatttacgagttctccaagactttgacctcatacaagattgccgacattcccgatgtcgacatcaccactgntggtactcanacctacggggaccttgaggncgaggttatcgacagcactggccactacgttgccattgcttaaggacattttcgactttgacctgaa

SEQ ID NO: 259 - DNA, 567 bp, Fusarium venenatum
  misc_feature (1)...(567): n = A,T,C or G
tcgacatccacctttttactatctacttcaactaccatacacagcaaacatggccgactcacttaccgaagagcaagtctccgagttcaaggaggccttctccctgtttgacaaggatggcgatggtcaaatcaccaccaaggagcttggaaccgtcatgcgctctctcggccagaacccctccgagtctgagcttcaggatatgatcaacgaggtcgacgctgacaataacggcaccatcgacttccctgagttccttaccatgatggcgcgcaagatgaaggacaccgactctgaggaggagatccgcgangctttcaaggttttcgaccgtgacaacaacggcttcatttccgctgccgaactccgacatgtcatgactccattggtgagaagctcaccgatgacaagttgatganatgatccgggaggtgacaagacgggatggcgaatcactacacattctccancttntgatccnaatanaaatatatcggatcctcncacaatccncggctggcctcctttgnctcccntcatacacaatttttggctacaagatggtgg

SEQ ID NO: 260 - DNA, 610 bp, Fusarium venenatum
acctgcggaggaaaacggttgcccaacggtccagtccaatggtgccaccatcgtggcatctttccttggctcaaagactggcatcggtggctacgtcgcgaccgactctgcacgcaaggaaaatcgtcctctcggttcgcggtagcaccaaacattcgcaactggcttaccaacctcgacttcgaccaggatgactgcagcttgaacctccggctgtggagttgcacggaggcttccagagaagcctggaatgagatctcggccgccagcaaccgccgctgtcgcaaaggcccgcaaggcgaacccttcgttcaaggtcctttgccacaggtcactcgttggttggtgctgttagctacactagcagttgcgaacctgcgatttggtggtacgccatttgacatctacaccctacggctcacccccgattttgaaacacgcaactcgctgccttcatctctaaccaggctggtggagatttccgcgtttacgaacgccaaggaccccgtgcctcgtctcccccctctgggttttttggataccggcacacttcccccgaattactggttgttctggtttcggaagtttacaaggttttgactacccctca

SEQ ID NO: 261 - DNA, 671 bp, Fusarium venenatum
  misc_feature (1)...(671): n = A,T,C or G
ccttcttctacgagccgctctttttacggccattttaaagaccgaattcccgcgcgcgacaacactcgaaatcgaaccccccacctcttcttgagaccccgaccgaatacctagaatattcgacaataccgccaacatgtcgttaacaaactgccgtttttatgaggagaagtatccggagatcgatagcttcgtcatggtcaatgtcaagcagatcgccgagatgggtgcctacgttaagcttctagagtacgatgacattgacggcatgattctgctctctgagctgtccagaagacgtattcgatctatccagaaactcatccgagttggtcgcaacgaggttgtcgtggtactccgtgtggacaaagagaagggttacatcgatctttccaagcgacgagtctcccccgaggatatcgtcaagtgtgaggagcgatacaacaaagagtaaagatggtccactcaagtcatgatccatcttgccaaggctaccgagatccccctcgagactctatatcaggccattgcttgggcccctgaacaagaaattcggccatgctctcgacgcttttaagctctccatcaccnacccttgaagtcttggaacgacataaccttcccgacganggtactggccangagctnaagaaatacattggnaagcgact

SEQ ID NO: 262 - DNA, 678 bp, Fusarium venenatum
  misc_feature (1)...(678): n = A,T,C or G
nctttaaggtacttcagctcccgctcaattcttctttttgctcttcccttcttcatcctcttttatctttcccgtccttaatcaactcttttcctgagtgactccttttctctcgtcacccaacagtcagacttccccgtgtctgtctacctttagccgtatcctttaccctcactttctcctttcacctcaatcttcacaatggctgccaacggtaccaacggcgtccacgctgatcctgcgtcatggaagcattacaacgagggctcgttcctcttcaccagtgagtcggtcggtgaaggtcaccccgacaagatcgccgatcaagtttccgacgctatcctcgatgcctgccttcgcgaggaccccctctccaaggttgcttgcgagactgccaccaagactggtatgatcatggtcttcggngagatcaccacccaggccaagctcgactaccagaaggttgtccgtgacgctatcaaggacatcggttacgatgactccgccaagggttttgactacaagacctgcaacttgttcgttgccatcgagcagcaagtcccccgatattgcccagggtctccactacnaaaaggcttttgaacaacttggtgctggtgaccanggtattattgttcggatttccaccgacnaaacccctgagcttttnccccttan

SEQ ID NO: 263 - DNA, 625 bp, Fusarium venenatum
  misc_feature (1)...(625): n = A,T,C or G
ctgggaacctctatgggttgcgtcggtcccaagtccgttatcgaggtccgtgatggcatgtccttcctcgacctttccgttcgacagatcgagtacctcaaccgcacatacgacgtcaatgtccctttcatcctcatgaactcgttcaacacaaacgaacgaacactgctgccattattaagaagtacgagggccacaatgtcgatatcctcacctttaaccagtcccgatacccccgaagtctacaaggactctctcctccccgtccccaagggacaacgactctcccattaacgagtggtacccccctggccacggtgatgttttcgagtctctgtacaactcctggcattctcgacaagcttctttatcgaggcatcgagattgtttttctgtccaacgttgacaacctgggcgctgtcggtcgatcttccgcattctccancacatgatggagacnaacgccgaatacatcatggaattgacaacaagacaaggtgatgtccagggtggtaccattatcgatacaaggctcgttcgcctgctcaaatcgtcaggttccaaggactgttaacaattcaattcctcaagaattcanttctcaacnccacaactctggtcactc

SEQ ID NO: 264 - DNA, 593 bp, Fusarium venenatum
  misc_feature (1)...(593): n = A,T,C or G
gccgtcaacctcgctctcaaggtcctcaagggtgagcagggtgttcccactgttctgtccgctcccgtctggggtttctacgatgtactctttaagggccaaaagttcgagttccagcgcccctacggaaagctatgtcatggaaaaacgttctcttcaaggtctcctaccctgccgagttccactctcaaaccgccgtcgaggcctctgaaaaaaattcaccacctcctcaagtctcagggcaagtctgctgccgacatcaagtccatcacttgccgaactcacgaagcttgcatccgaattatcgacaagcagttcaagcccatggacaactttgccgaccgtgaccactgcattcagtacatgtgcgctactatgctcgttttcggccgtcttgaagccaccgactacaccgacggtggtgaagctgctacttctcctctcgtcgaatctctccgtcaaaagatcaagtgtgttgaagatcctcagtacaccaaggattaccatgaacccaagctccgaaccatctccaacgctctcaccgtcnaactcaacnanggtactgtcctcnatnaagtccctgttgaaggctc

SEQ ID NO: 265 - DNA, 558 bp, Fusarium venenatum
  misc_feature (1)...(558): n = A,T,C or G
tacacggtgctcacactggtcgcgtcaagatgatggcgcagtgganaccagttgccatctctggtgtggcgaagcactggtggctatgttacccctatcggtgtcatccgcctgcatttcaagaaaagctactgatctccgaaactttgaagcatttggcaagtcggacccttacactcgaattctgctctctggtattgaaaaagcacgaactgttaccttccgaaatgatctgaaccctgagtgggacgaagtcctatatgtgcccattcattctgctcgagacagactcgccttggaagtcatggatacagaaaaggttggaaaagaccgcagtctcggaatgattgaactcttcgctgcggactatgttgcccaagatgaaactggcgagtatctagtccatgacaagaaacaactccgggaagacggcttcgtctccacaacaagggcatcgccaagggtacactgcattacacggttgccttttacccttgcttgaatgttgctgatcctgaggatgaagaanaagaagagaaggagaaggaagggggagcc

SEQ ID NO: 266 - DNA, 633 bp, Fusarium venenatum
  misc_feature (1)...(633): n = A,T,C or G
cgacctcgtcacggtctggaacaagctccgagtcgaaggtgttaccaactttgccctcgctcctggcagccagaaccatgccgtcgccgtctttgttcctgagcgcaagggtcagcccgctgccgtcaaggtcttcaacgttcctctcttcaacaaccccatctcccaaaaaacctttttcaagggagacaaggttcaactgaagtggaacaagcttggctccagccttctggtcctggcacagactgacgttgatcgctcaggcaagagctactacggcgagaccaccctgtatctgctcagtaccacaggtgccttcgatgctcgtgtgtccctggataaggagggccctatccatgatgtttcttggtcgccaactcgagagaagttggtgttgnctatggatacatgcctgccaaggncaccatctttcaaccaccgngccggtgcgactcactcgttcccgaatggcctcgaaacaccatcacattctnaccaactgggcgtttggtctnggtgcangaattcgcaacctggctggcagatcgattttacgactctagaaggatttnccaaanggcaccacttttgagagcggnaaccccantgtctgggnaatggagtcccnanagc

SEQ ID NO: 267 - DNA, 520 bp, Fusarium venenatum
  misc_feature (1)...(520): n = A,T,C or G
ctcgaggtccccgacaacgaagtcgatggtntgaagcaacgactaaaagacgagtacggcgcacaccctgtttttatcgacnatgancttgcagacanacattacaacggtttctcaaactcgatcctctggcctctattccattaccaccctggngagancacattcgacgaatccgnatgggctgnataccaggaggtcaaccgnctcttcgccaaaactgttatcaaagatgttcaggacggngaccttatttgggtccatgactaccatctgatgctgcttnctcagatgctncgtgaggaaattggcgaatcaaagaanaacgtcaagattggtttntttnttacacccattccccancagtgaaatntaccgaatnttgctgtacaaaagcactcctnctggctcttaactgngatctatcggttncacacatccantccctnggactttcttaccagtggtctcgatctngagtgcccacacccaaangngttgatggacggcgttttgtacc

SEQ ID NO: 268 - DNA, 508 bp, Fusarium venenatum
ctttgggtagtcatggagtttatggagggaggcagccttacggatgttgtcaccttcaacatcatgtccgagggtcagattgcttcagtgtgtcgtgagacacttttgggtctgcagcacctgcactccaagggtgtcatccaccgagacatcaagtctgacaacattctgctgtctatggagggcaagatcaaactgaccgatttcggattctgtgccactatcaacgaggcccagaacaagcgaacgaccatggtcggaacaccatactggatggctcccgaagttgtcacacgaaaagagtacggacgcaaagttgatatttggtctttgggtatcatggcgatcgaaatgatagaaggcgagccgccatacctgaccgaatctcctctgcgtgctctttggttgattgcgaccaacggcactcctcacattaagaatgagcaggactgtcgcccgttttcaaggacttcctctactttgccctcaaggtggaccccgagaagca

SEQ ID NO: 269 - DNA, 753 bp, Fusarium venenatum
  misc_feature (1)...(753): n = A,T,C or G
gctggtgacatcatccgcaaggatggctcccgtgttatactcatgaagaacccaacctggcagagtgagctttggggtctttgggaaacccttcgcttcgaaccttttgttgttcttctcttccccatgttcttctcctccaactggttttacgtctaccaacagaattccgttaatggcgcctacttcaacacccgaacaaaggcgctcaatggcctgctgtactggttggctcagattattgctgcagtcatctggggttatctccttgatatcgagagcatcaaacgtaccactcgtgccaaggccgcgtgggttggtctctttgtcttgacctttgtcatctggggtggcggatacgctttcgagaagacttacactcgcgagactgtcgctccagattcagattttgtcccgggtgactggacagactctggttacgctggacccatgttcctgtacatcttttacggtttttacgatgctgcttggcaagccaccatttactggtttatgggaaccttgtccaactctggtcgacgatctgccaactacgtcggcttctacaaaggtatccaatctgttggtgccgccgtcgtcaancatcttgatgcaaagaagatntcgtaccgatccgagttcatcagcaactgggttcttctttcggctctcttgcattgctgctcctgncatccttctcaagattaaagaccacgtaagcaccgaagaagatctcaagggcactgatgaaga

SEQ ID NO: 270 - DNA, 1041 bp, Fusarium venenatum
  misc_feature (1)...(1041): n = A,T,C or G
ctccatctgcatggtcgttgctgccgctctcatcggcgtcttctatacagttggaagcaactcttgggataagcacgagtactactatgagggggcattcagcctatttgcttccctcatcatctctgtcatgggtgctgctcttctccgtatcggcaagatgcagtctaagtggcgcgtcaagttagcaaaagctatcgagtccccaatcaaagctgggagtaagggctggttcaagcagtttgttgagagatacgccatgtttgtcctaccctttgttacagtcctccgagagggaattgaggccgttgtctttgttgctggagtatctttctcagcttcggccaagtctattcctctgcctactgttgtcggtctcttcgccggttgctgtgttggctacctcttgtacaagggtggtgcgagtaccaaactccagttcttncttggtctatccacctgcctcttgtaccttggtggtgcaggtctcttttctagggctgtatggagcttcgagaatggccaaatggaaccaagtatgtcggtggtgaagcagacaagttcggtaacgggcctggctcttacgatattgaccaaagtgttggcatgttaattgttgtacctctaccgacaagaattcagaatggctggggcatcttttaacgctattttgggctgggacaaattcggctacatatggctctgtcatttcttacaacttatactggatttgcgtcatggctggcttcattatcatgcgcttcaaagagacacatggtaggtatccattcggaaaggcaaaggctcatgccaacgctgttgatgatacccgagagtcacacgacctcttcttcaaggaacgtcccagaaaagaccacaacagcataatcggcatgagaaagaagtatgggcaacgaccgggcttgtcctgatgggaaactctgtacaatttcgtccacctgacaacngcgttataaggttatnctagtctacatccattttaacaaagtctaataagcaagtcttcgttatattttgctc

SEQ ID NO: 271 - DNA, 740 bp, Fusarium venenatum
  misc_feature (1)...(740): n = A,T,C or G
tttttcgtgaatcctttttttattcgcgattgcatctatagcacaaccatttgcaacgcaacntccggtgcccgaccnttcaggggaaactttccatttgccctgatgcttatcacgccgaaaaaatgccagaaggtaggatagtcccaacttaaaacttggagaacttcttaacagacttgccggttcggggcaggacgcgcaggacgttgaagcggacagtcttgctcagaggtcggcactggccaacggtaacctgatcaccctcctggacacggaaagcgggagaaacgtgggcggcaacgttcttgtgtcgcttctcgtatcgggagtacttggggatgaagtgcaggtactcgcggcggatgatgatggttcggtgcatcttggtggaaacgacggtaccggtcaagatacggccacggatagagacgagaccagtgaaggggcacttcttgtcaatgtagctgccctcaatggcggtcttgggggttcggaaacccagaccgacgtccttgtaccatcgtcggccacccttgcccggtcgggtggacttggtcttggtcttcgagttctggaagatgtgaggctgcttctggaaagcacgctccgactggacggtcaactcggtcgccatcttgaattatccttctcgggcaggtaccgtggggaaatggcgtataggttgagctgggagggcgaggttgagactgctaaggcggacagtagttttcnctgat

SEQ ID NO: 272 - DNA, 664 bp, Fusarium venenatum
  misc_feature (1)...(664): n = A,T,C or G
gtcgacaatcacccacagccgtcgccatgcctacccgtttgtcgaagacccgcaagcaccgcggccacgtttccgccggtaagggacgtgtcggaaagcaccgcaagcatcccggtggtcgtggtcttgctggtggtcagcaccaccaccgtaccaacatggacaagtaccatcccggttacttcggtaaggttggtatgcgatacttccacaagcagcaagcccacttgtggaagcccatcatcaacctcgacaagctctggtctctcgttccccaggagacccgtgacgcctacgtcaagggtgagaagaaggacaccgtccccgtcctngacctcctccctnttggttactccaaggtcctcggaaagggccgtctccctgagatccctctggtcgtccgcgcccgctgggtcaaccgcctttgctgaaganaaaatcaaacaggccggtggtgtcgttganctcgtcncttaaacnnaacatccaactgttctgtaaatcttgaagantcnggtgggcttgtntnggaaattctacaaacggaaaanaaaancttttccaccccngngaaaanaaaacctgcgggccctggaaaaaaaaaggtcttcctnccctccggaaaaaanggccanggactaagtcgcgntcgggtttgggcatt

SEQ ID NO: 273 - DNA, 801 bp, Fusarium venenatum
  misc_feature (1)...(801): n = A,T,C or G
ggtttacaacgagattgccgctcgcttggaggagaaggacgactacgacgatggcagttacggtcccgttctagtccgtcttgcctggcacgctagtggcacttacgacaaggagactggtactggtggcagtaatggagcgaccatgcgattcgctcctgaatctgaccatggtgccaacgccggtctggctgctgcccgcaaattccttgatcctgtncaaggaaaagttcccttggatcacctactctgatctctggatccttgccggcgtttgtgcaatccaggagatgcaaggtcccgttatcccttaccgacctggccgttccgaccgcgatgtttctggttgcacccctgatggtcgtcttcctgacgcttccaagcgccaagatcatctccgaggtatcttcggccgcatgggcttcaacgatcaagaaatcgttgcactgtctggtgcccacgctcttggccgatgccacgccgacccgatccggctacagtggtccttggactttctcttctactgtcatgacaaatgacttcttccgtcttcttgttgaggagaagtggcagtggaagaagtggaacgggcctgctcagtacgaaggaccaagtccaccaagtccctcatgatgcttcccagcgacattgctcttattgaggacaagaanttaagcattgggtcgagaantatgccaaggacaatgacctttcttcaaggactttctaacgtcgtcctccgactattcgagctcggcgttccttttgcccagggcaccgagaaccaacgatggaccttca

SEQ ID NO: 274 - DNA, 638 bp, Fusarium venenatum
  misc_feature (1)...(638): n = A,T,C or G
ggcatctaataaagcgactcggttgggcgaggagatctggaaaacccgaatcgataaggtcaacgcggagctcgtcaccttgacgtacggaactatcgtcgcacagctctgcaaagattacgaaagcgattatgcggaggtgaataaacagctcgacaagatgggctacaacatcggactgcggttgatcgaagactaccttgccaagtccaacaccatgaagcgatgcgccaacttccgngaaacagctgagatgatttctcgtgttgggttcaagatcttcctcaacatcactcctcaagtcctgaattggacaagcgaaaatgaccagttctcgctggtgtttgaagagaaccctctggccgactttgtcgagcttcccgacgatggacgagcgcaagaccagctntggtactccaacattctatgcggagtgctacgaggtgcactgganatggtgcaaatgcaggttgaggctcacttttgtcagtgatgtcttacgaggcaccgaaagcncaaagatgagggtttcgcttattcgatacctcgacnacaaattgcncctggggatgactgaganggttaanaggacnccttattttccaaccgtgacaccaatttggcnctttgccaaaana

SEQ ID NO: 275 - DNA, 726 bp, Fusarium venenatum
  misc_feature (1)...(726): n = A,T,C or G
caacgcgtcgactatgtcgacccgccatagcttccctcgacctccacaacatcaaccatcacctcgaatctcctcatttgaaacaggacaagttctttctgagcttcgctttctaatttaatccgatttcgaacatcaacaccacgaatcattcacaatgtcggccggcgcatacgatcgacacattaccatctttgctgacaatgggtcggctttaccaagttgagtacgccttcaaggcgatcacagcggccaacatcatgtctgtcggtgtgaggggcaaggactgtgctgtcgtcttgtcgcagaagaaggttcccgacaagcttatggaccctgattctgtcacccacatcttccagctctctccttcagttggttgcgtcatcacaggatccatcgcggatgcccgagcttttgctcaaagagctcagggcgaggctgccgagtttcgatacaagtacggctacgagatgccagctgatgccttggccaagcgtcttgccaacatcagccaagtctacactcagcgggcttatatgcgaccttacggcgttgcgaccacactgatttcgcttgactcggaatacggccccaactcttcaaatgcgaccctgctggatactacattggttacaagggaactgcagctgtgcccgaagcaacaggaggcgctgaaaccaccttgagaagaagctccgcaacaaggaccacccgaanggttct

SEQ ID NO: 276 - DNA, 579 bp, Fusarium venenatum
  misc_feature (1)...(579): n = A,T,C or G
cctgaagagcgattgggagctaatggctcagctgaaatcaaggcgcaccccttcttccatgctattgactggaggaagttgcttcagcgcaagtacgagcctacattcaagcctagtgtggccgacgctctggacacaaccaactttgaccccgaatttacatctgaagcgccccaagattcttacgtcgacggccccatgctgtcacagacgatgcagaatcaattccaaggattcagctacaaccgaccgattgctggacttggagatgctggcggcagtgttaaggacccgtcctttgttggtagcttgacggataaccgataaatcttgccaaagacggaaggcagaagttagacagcgagcgggctcgagtctgaactggctcgactcactcaggcaggacgccagtctttttgccagttaaaagagccatgtanctgggaggcgtgggaaacactggtcagccatganaagcacagcacaaaacaaaataagtctgggaaaatctagaggatgcngatgaaaatgaatgtaaataaaaancctacttttgtttttggcgtgttnggagttttg

SEQ ID NO: 277 - DNA, 611 bp, Fusarium venenatum
  misc_feature (1)...(611): n = A,T,C or G
ccgccgacaaaccagccaaccgacacaatggcccgcggaatcaagaagcaccagaagcgcctcagcgccccctcgcactggctgcttgacaagctgtccggcacctacgctcctaagccttctgccggtcctcacaagctccgcgactgcatgcccctgatcgtgttcatccgtaaccgactcaagtatgctctcaactaccgngagaccaaggccatnctgatgcancgactggtcaaggtcgacggcaaggtccgcaccgattccacctacccctccggcttnatggacgtcatcaccatcgagaagactggcgagaacttccgtnttgtctacnacaccaagggtcnattcaccgtccaccgaatccagaacgaggaggccgagtacaagctgggcaaggtcaagcgtgtccaacttggtcgcggnggaatcccattnttggtcacncacgatgcacaaacgtgagttntgtcanacatnattcagccggtggatnaactttggncgattcaagtcccccacaagacangagctttntttaacnggtgtntgtncctcccaaacccgttggtnacnaaaaattttttacattcgatccccgacccttt

SEQ ID NO: 278 - DNA, 405 bp, Fusarium venenatum
gcccgatttgccaacaacggtgccctgcccccggatctgtctctcatcatcaaggcccgtcacggtggctgtgactacatcttcagcttgctcactggttaccccgaggaggctcccgctggtgttcaggtcgcccccggcatgaatttcaacccttacttccccggtaccggtatcgccatggctcgtgtcctttacgatggtctcgtcgagtatgaggatggaactcccgccaccacctctcagatggccaaggacgtcgtcgagttcctcaactgggctgccgagcctgagatggacgaccgaaagcgaatgggcatgaaggttctggttgtctctgcctccctgtgggctgtcagtgtctgggtcaagcgataccaaaagttttggggggggggccccccc

SEQ ID NO: 279 - DNA, 999 bp, Fusarium venenatum
  misc_feature (1)...(999): n = A,T,C or G
cttcaactcgcaacagtgatcggcctctcgttgcgcaataggtcgtttctctattttcctaattgcttcgcgatcccttggcctggcagtctctttctgtaaaagcgcccgacgcgagcgcccctcattcccccgccatgaacgttttgaagcttcagaggaagtttcctcaattccaacaaaacgagatattcaccttgtccgatgccttccagcgacttgatgttgacgacaagggataccttgacgaagctaccgccatcaaggccacgcaacagagcgagaaccagccctacgatgtcgtacgccaagcgctaaaggaagtcgagctcgattcatcacgacgtgttgagctggaagattatgtcagcctcgttgccaagctccgcgattcctaacctgctcaaaagcgcatgtccacagggcctacttcatcctaagggagtggaagaggcgtcgttgcacagcgaaccggtggtcatgcctccaaaggcagcttaagcggcaagatccaggtccaaggctccaatgccaacattactcacactatcaatgaggatgagcgcactgagttcacccgccacatcaatgctgttctggctggtgatgccgatatcgacagtcgtctgccttccccacagatacgttcgaaatgttcgacgaatgcaaggatggtctggtcctggccaaactgatcaacgatagcgttcngacaccatcgacgaacgtgttcttacatacctggcaggaaatcaagaaccttcaatgcgtttcacatgagcgagacaacaacatttgtatntgatnttgccaaagnataggctgttccgtcgtcacaattgtgcggntgcatattgnggcagagagcatntatcttggnntgtttggagaatttntacgaggcttttggnaanacgaattancnccccctgggtttcccctgnttgcaggcnaaacttnggagttttnaatacttcggngaatttcnttntggttaan

SEQ ID NO: 280 - DNA, 606 bp, Fusarium venenatum
  misc_feature (1)...(606): n = A,T,C or G
ctcgagcaggccaagaaggctttccccgacacaacgctggtcgtcggcgtcacaggcgatcatgaaacacacaagcgcaagggtttgactgtcatgtctgccgctgagcgtgccgagaccctccgtcactgcaaatgggttgatgaggttatcgaagactgcccatgggtcgtcactcccgagttcctcgacgcgaacaagctcgattacgttgcccacgacnatctcccctacggtgctgacgaaggcgacgatatttaccagcccatcaaggccgctggcaagttccttgttactcagcgtncagagggcgtcagcacgactggcctcattacaagaatcgtgcgtgactacganaagtacattgctagacagttcaagcgcggtacatcccgtcaggaacttaacgtcagctggttgaagaagaacgaactggacctcaagcgtcncgtccaggacctgcgagagaacatcacaaaacaactggtccactactggccaagaactcggccgcganctgaagcngttctggcctgtcagccgtcctcaaagccctgcccggtttaacagctcggggtacccccgaaggactcgttcccctacgaa

SEQ ID NO: 281 - DNA, 711 bp, Fusarium venenatum
  misc_feature (1)...(711): n = A,T,C or G
cgacttaacccccccttccaacttttcctcgatacacatagaaatcttcgaggatcgcccgacgagaaaaaaatattcaagatgtcggacgtagaagacaacacccccgaggtcgccgatgttgttgaggtttccggcgatgcccccaagggccagatgtccattctcgatgctctcaagggtgtcctgaagctctctctcatgcacgatggtcttgctcgtggtctccgtgaggcttccaaggctcttgaccgtcgccaggctcacatgtgtgtcctgaacgagaactgcgaggaggaggcctacaagaagcttgttgtcgctctctgcaacgagcacaacatccctctcattcagatccccgacggcaagcaagctcggcgagtgggcccgtctntgcgttctcgaccgtganggtaacgctcgcaaggttgtcaactgctcttgcgtcgttgttaaggactggggtgaggagtctcaggagcgatctatcctcctgaactacttccagaccgagcagtaaatgtcttaagcggcgttggatgtgaggatgattagaggtgcggacttggtttcatgaccgcttgacacatacgtgctgtactctagccacttcgactggcatctaaaacggttttaaggccttacgtctcatggccattgagaggaataaaaaaaatttgggcatcatccgaaaaaaaaaaanaaaan

SEQ ID NO: 282 - DNA, 2409 bp, Fusarium venenatum
  misc_feature (1)...(2409): n = A,T,C or G
cgaccccatctctatcaattgatccgtataccacgatcaattgggccaccgttggcagaggctctttctctacgtccccaatcctcagtcaagatgttgtcgcgagccgccagaccagctctccgagctgctgttgcagctaatgctcgggccactgccgtccccagcaccgctgctacctatgcgactctccgtgagatcgaggaccgtctcaagtctatccgaaacatcgagaagatcacaaacaccatgaagattgtcgcctccaccaagctcaaccgagctcagcgcgccatgaacgactcccgcacctacggacagacctctaacgaggtttacgagtctgccgagaccaaggctgtcgagaccgaggacaagaagaagctcatcattgtctgctcttccgataagggtctttgcggtggtattcactctggtctgtcccgatacgtccgccgactctntgccagggtgagaccttcgacctcgtccttattggcgagaaggccaaggctaagcttttccgaaccaacgccaaggntattcagctcaccttcgctggtatcggaaangggtgttcccacctttgccgacgccccaagccattgccgaccaggtcatccagctccccactgagtacactgatgtaaagatcctgtacaacaacttcgtcaatgctcagacctacgaggcttctatgattgaggcattttctgaggaggctatccagcagtcccccaacttctccgctttcgangttgacnacgaagttgacggtggcaactctccagccagagtacagtcaagccaagctgcccatctacatggatagctaccatgcggatggtcaatgcctctcgagtcgcaaccaagcctgccgacaaaactgctaaggataacgcctccaggagaacaagcacagtgatatgntattcaacaagaaccagattcttttcaaccgattcagcatgagatcgacggaaagcagctcaacacttcagagcttgagaaacagttcaagcacgtctacgaggttgcccagcgtgttcctgctgttggcgctctcacctcagagaaccgagacatctggacggaagctcgtgatactctgctcaaggcaagcccgaaaaacaaggacgcgctcgaggctatcgagtcagcctcattcgtggtttgccttgacgacgcatcacccgtcactctcgaggagcgtgcccatcaatactggcacggcgatggtgccaaccgctggtatgacaagcctctgcagttcatcatcaacgataacggcacgtcttggattcattgggccaacactctatgatggacgggactcccactcatcgcctcaacgaattacgttnaacgatcttatctttcggaaacaaagctcgacttctcttgaccccaacattccgctcaaacctacccgaacctcagctcgtcaagtttgagatcacccangaagtccagacctcttcttcacaagatccttcacacccacacacaaaatgtctgctcctgctcttcgtctgggctctaccgcccccaacttccaggccgagaccacaaagggaaacattgacttccacgacttcatcggcgacagctgggtcatactcttctcccaccccgaggacttcactcccgtctgcaccactgagctcggtgcctttgccaagctccagcccgagttcaccaagcgcaatgtcaagctgattggtctctccgccaacaccatccagtctcacgagggatggatcaaggacattggtgaggttaccggcggtaacgttgagttccccatcattggcgacaaggagcgcaaggtttctctcctctacgacatgatcgaccagcaggatgctaccaacgttgatgagaagggcattgctttcaccatccgatccgtcttcatcatcgaccccaagaagaccatccgcaccatcttcttctaccctgccttcaccggccgnaacgccgncgaggtcttccgtgtcatcgacttccttcagaccggtgacaagtaccggatcaccacacctatcaactgggtccctggtgangacgtcattgtccaccccttccgtcaagaacgangaggccaagactttgttncctgagttccgatcgtcaagccttacctttgattnacccctnttgccaaggagaaggttttcccccagtaaattaattatattttactacaaagggacacagcaaaaagcatgagaantttatgataccttgcanatagaccgaaaaaggattgaaaggtctattgggaagttgggattagtacatttggacacacatgatggaaagaccagttttcccatatagatcattcacaacttgagccatctgcgattgctctgaaatgaagaataaatgaagaaatgaaccaan

SEQ ID NO: 283 - DNA, 614 bp, Fusarium venenatum
  misc_feature (1)...(614): n = A,T,C or G
cgacaacgaaacattacgactcacgacgcttgaccaaccgatcgtccgtcttcctacaacttcgaacaaattacctaaaaaatcggcataatggagtttggtaacgctggagtgttgaatgaggatggtatccatgtagatatggatcgtctcaagaagggagaggtcaacctgggaacatcgattatggcagttactttcaaggatggtgtcattctgggtgcggattcacgaacaacgaccggtgcctacatcgcaaaccgagtgacagacaagttgacgagagtacacgacaccatttggtgctgccgatctggctcagccgccgatactcaggctgtcgccgatattgttcaataccagcttgggctgttcgccatgaccaacggaaaacctcccatgacacagaccgctgcgttcaatcttccaagaaatttgtttaccccaacaaggaccgtctatctgccggtctgattattgctggttggaatgagcgaatccgtggccaatctactccattcctctgggtggttctcttcccaaccaggcatatgccattggtggatccggatcgacttacatctatgggttactggtaatcccactngccaaag

SEQ ID NO: 284 - DNA, 1036 bp, Fusarium venenatum
  misc_feature (1)...(1036): n = A,T,C or G
ccgtgattgtccaaaatgcggttcagtctcatcaccggcagttttctggcgctcggctcttttgncgaggctggtttcaaccagggcgccatcaaagccttcaaccgtcctcaccctcgtcattacnaccagaagcgcgcacctgtccctccaaagccgttttttgaaaagagagccaagtccaagttcttgaacaanaattcagaaaagtttgcantaaacggatctgctattcctgaagtggatttcgatgntggagagtcttatgctggacttttgcccatctctcaagaccctgatgaggagagggagttattcttttggttctttcccagtaccaatcccgatgctgganaagaggttctgatctggttgaacggcggcctggatgtaattcacttagcggcttttgactganaatggtcctttnttgnggcagcaaggcactctttgcttctgtagccaactcatacaggtggaccaacctgaccaacgtcattttggattgaacagcctgtcggtgtaggctacagcccaaggcgagccccacatcaccaacgaaagtagaactcggccttcaatttattggtttgtggcgcacctttttcgacacctttgattttaaaggtgccacaacctacatcaccggcgagtcctatgcgggctactatgtcccttacattgccgacgccttcatcacagctgccgatgatgactactacaagcttggcggtgttgccatcaacgaccaatcattggcgatggcacacttcagcagcaagctgtcatcctccccttcattgagtactgggagaagttgttctacctcaatgagacnacaatgaatgcactccgctggacacatcagcactgtggatcgacaagtatcttgagaagtacggacttccccccgcccgaaggaaattccgtcctgccgatcctatctggaccaagaataccttgtgatatgttgantggggtacgcgctccttgacaaaacctgcttcacatctatcaatcatgatatggcctacac

SEQ ID NO: 285 - DNA, 627 bp, Fusarium venenatum
  misc_feature (1)...(627): n = A,T,C or G
catcaagctggatcttctcattaccgaaaacctcttctacgaccgcaccgcaacaagaatctttgatctcaagggttctatgcgtaaccgcaagatccaatctactggtgagcaaaatgaggtccttcttgacgaaaacatggtcgagtacatctatgagtcgcctctctttgcaagagaacattcaaagaaactactccgtgcttcggtatggaacgatacactgttcttggcaagacagaacgtgatggattactccctcatgattgctgttgacgaggctcgtaaggagcttgtggttggtatcattgactgcattcgtacatacacatgggacaagaagctcgaaagttggatcaaagatcgtggatttgcaggtggaggtcgcaatcgaccactgttacaagtccaaggaatacaagtctcgtttccgagaggctatggcaagatcatcttgcaggcgcccaactgctggcatttgttcaacaattctcaatattccgcactactattggcgccctaggttcnaaaaagcccgaaatgctttcgttgaagcactttnttaaagacanataagaaanggggaaaagcncccatggaagaaagagggttncatgcccctcatga

SEQ ID NO: 286 - DNA, 669 bp, Fusarium venenatum
  misc_feature (1)...(669): n = A,T,C or G
actcgatcgaccctgagcaactggaccgccaaagttgcccatcatgtcgctcgtctcgggagagaagtcgaacttccagttcattctccgtcttctcaacaccaatgttgacggaaagcagaaggttatgtacgccttgaccaagatcaagggtgtcggtcgccgatactctaacttggtctgcaagaaggccgatgtcgatctgaacaagcgcgctggtgagctcacctccgaagagctcgagcgaatcgtcaccatcctccagaaccccacccagtacaagatccctacatggttcatcaaccgacagcgcgatatcgtcgatggcaaggactcccatattcttgccaacggtgtcgactccaagctccgtgaggatctcgagcgcctcaagaagatccgcgctcaccgtggtctccgacactactggggtctccgtgtccgtggtcagcacaccaagaccaccggtcgccgtggcaggaccgtcggtgtctccaanaagaagggtggttaaactatttatcggtgttggttatgggtggacaggcgtgacggctggtttctccatctttctgggcattctgagggatttgctttccagcatatgcagctatggctgtactctagatcagagtcacgaatcaaaagcattcaagtaaaaaaaaaaaa

SEQ ID NO: 287 - DNA, 778 bp, Fusarium venenatum
  misc_feature (1)...(778): n = A,T,C or G
cgtcccctttaaattgattgtctctctgttttccatactacttcctttcttcctcgacattccatttcatcacataaaatcgaaataatgtctaccgttggcaagcccattacctgtaaggccgctgtcgcctgggaggccggcaagcctctcaccattgaggacattgaggttgctcctcccagggccaacgaggtccgaattcagatctactacactggtgtttgccacacagatgcctacacactctctggcaaggaccccgagggtgcttttcccattgtctcggacacgaagggtgccggtatcgttgaattcattggcganggcgtcaccaacgtcaagcccggcgancacgtcgtcgctctctacacccccgaatgtaaggagtgcaagtttgnaagtccggaaagacaaccttgcggtaagatccgagccacccaggcaagggtctgatgcccgatgcacctntcgattcaagtgcaaggcaaggatctgntttacttcatgggcacttccaccttttccaatacaccgncgtcgccgatatctntgncgttgccattgagcacgatgttctatggaccgaacttgntgntcgggtgnggaataccnccggtacggggttgcaccataaccgcaacggtcaggttggganaacgttgccatttttggggntnggtgggtcggnttttaaatgtcaaggggcccgtgttnnaaggtggnaaaatatcgtgtgatgtaacccncaaaaggaaggggngaaaattnggggntt

SEQ ID NO: 288 - DNA, 608 bp, Fusarium venenatum
  misc_feature (1)...(608): n = A,T,C or G
cttgcttactgtattgtgcaattcctggaaaaggacgcatctctaactgaagatgttgttattggacttcttcgttattggcccaaggtcaacagcacaaaagaggtcatgttcctcaacgaagtcgaagatatttttgaggttatggatcccgcataattcnccaaggttcaagaacctctgttccatcagctggccaagtccgtanccagccctcacttccaggtggccgagcgtgccctttatttctggaacaatgagtatttctgtaaccttgcancgataatgtggagattattcttcccatcatgttngctcccctctatganaactcaaagggtnattggaacagaacaattcatgggatggtttataatgccatgaanctctttatgganacaaccctcaattgtttgacgactgctcccatgagtncacggaacagcagaacagtgcttggggccnccaacccttcncgagcgtaaatgggctgntctgagtgaaaagcgaaccncctaaaaaaagcaccgnaatggggtcnttatncccctgttaaanaccctatgcctgngtanacaaaaacacccccccccgnggacaatttgaag

SEQ ID NO: 289 - DNA, 576 bp, Fusarium venenatum
  misc_feature (1)...(576): n = A,T,C or G
gagtgtgatggtgcgctctttggagccgtgagctctcctactcaggccgtcaagggttactcatcacccatcgtcgccctgcgcaagaagctcgatctctacgccaacgtccgacctgtcaaaactgtcatgaccgccgctaagcctatcgacatggtcattgtccgcgagaacaccgaggatctctatgtcaagcaggaacagacccacgacactcccgagggcaaggtcgctgaggctatcaagcgcatttccgagaagcttcgttccgaattgccaccatggctggtgacattgctctgcgccgacagaagatccgagatgccggtgcctccagcatccacaagtctcctctcgtcaccattacccacaagtccaacgtcctgtcccagactgatggtctcttccgtgccacctccaaaagggccttgccgaccccaagttctcctccgtctcagttgaagancagatcgtcgattccatggtttacaagctcttccgtcagcctgaagantacnatgtgattgtcgcccccaacctgtacggtgacattctctccgatgggctgccgccctt

SEQ ID NO: 290 - DNA, 625 bp, Fusarium venenatum
  misc_feature (1)...(625): n = A,T,C or G
ctcaccctaactctgaatctctcgagataccccccaataccctctaacttttttttacctattctaatctaatcctgtcgaggtttcttccttcttttcaggacctcgctgctgtcgctctctgttctttacattcgctgttctgctagctactcttaccccctttgctcttagcacattcagcttagcttctcaataccggaatcatgaagggactcattcttgtcggtggctatggcacccgtcttcgacctctcaccttgagtgttcccaagcccctggtcgagtttgccaacaagcccatgattgtgcaccagattgaggcgctggtcgcagctggtgttactgacatcgtcctcgctgtcaactaccgacccgaggtcatggagaagttcctggcagagtatgaggaaaagttcggcatcaacatcgaattctccgtcgagactgagcctctngacaccggcggacccctgaagcttgccgagcgtattctcgccaaagacgactcttccttcttcgtcctcaactccgatggtatctgcgactttcccttcganggatcttctggggctttcacaagaaccacggcaatgangggaccattgncggtaccaangncgag

SEQ ID NO: 291 - DNA, 733 bp, Fusarium venenatum
  misc_feature (1)...(733): n = A,T,C or G
cttcactaaccttcgcagtcggaattgaccaacgtcacaatgggccgtcttcaggaatacgaggtcatcgggcgccacttgcccaccgaggctgaccctacacccgccctctaccgcatgactatcttcgcccctaacgagacggtcgctaagtcccgatactggtacttcttgcgcggtctcaagaaggtcaagaaggccactggtgagatcgtcagcgtcaagtcggtccacgagaagcaccccctcaaggtcaagaacttcggtatctggatccgatacgactctcgttccggcacgcacaacatgtacaaggagtaccgtgagctgtcccgaacagatgccgtcgagtncctttactccgacatggccgcccgccaccgtgctcgcttcaggtccatccacatcctccgcgtcgtcgagattgagaagaccgaggacatcaagcgaccttacatccgccagctcacccagaanaacctgagcttcccctcccccaccgtgtcaccaaggagaacacccagaagctcttcagcgcgaagcgacctttcactttcgcttaaatgatttcggtttagaggatggttaggcttctgcgggtgttaaacgggatcatggaaatatcaactgacttttcttaataaaaatgggcaatgaatgaacccaaatattctgagcatacaggatgctggccggtgtgatgcacaattgattgggtttataaaaaaaaaaa

SEQ ID NO: 292 - DNA, 575 bp, Fusarium venenatum
  misc_feature (1)...(575): n = A,T,C or G
gaaacttcaacggttgacgttgtgaccggtgtcgatgttcttgagtattacgcacatatggctgctggcagcttccctggccagaacacgcgtcttcggtccgacgcctttgttctcacaacccatgagcccctaggtgtttgcgctggtattggtgcttggaactatcccatacagattgctctctggaagtcagcgccatgcctggccgccggcaactgcatggtctacaagcccagtgaggtcacaccccttcatgccgaagcactcgccaaaatctatatcgaggcgggtgtccctccaggaagtattcaacgttgtgtacggtgatggtatcgccgtaggagcacccctcgtggcccatagtgggcattgctaaagtgagctttactggtcaagtaagcaccggcagcaaggttgccagccaagcagtcacagatatgaagggcgttactatgganctgggaggaaaaacccactcgttatcctgcccgatgccgacgtagaaaacccggcgacaccgccatggtcgccaacttcttctcgaccggtcaagtgtgcaccaacggaaccgt

SEQ ID NO: 293 - DNA, 636 bp, Fusarium venenatum
  misc_feature (1)...(636): n = A,T,C or G
gcagctgcaatgatcttcggatgtattggagctgcctatggcacagcgaagtccggcattggcattgctggtgtcggtacctttcgaccagatctcatcatgaagtgtctaattccagtcgttatgtccggtatcatcgccgtctattcgctagtcatctccgtcctcatcgctgaggatctcgacccttatcagaactacagcttgttttcgggctttatgcatcttggatgtggtattgcagtcggcatgactggtcttgccgctggttactgtatcggaattgttggcgacactggtgtccgtgcctatatggaacaagtccaggattttcgtcggcatggtcctgattcttattttcggcgaagttctcggtctctacggcctcattgntgccctgattctcaacaccaagagcaagggttaaatgagacacgattcgtatcgtaatcacacacctattcatataacctttctcangaggaaccgacgtgtacgttgagggagctctgagctggcatccagatccgggatnaaccattggttgtacatcnggcatggcgtattggacgtgtacaatatttttcaacgaggtagaanaacaaccggagaanttgacagtatctantttcgaga

SEQ ID NO: 294 - DNA, 804 bp, Fusarium venenatum
  misc_feature (1)...(804): n = A,T,C or G
cgagacccggcacgacacgacatcttcacgaagtaacgccacactaacccttcagacacaatggccaagatctcgcgtggtgcccctggtggcaagctcaagatgaccctgggtctccctgtcggtgccgtcatgaactgcgccgacaactccggtgcccgaaacctctacatcattgccgtcaagggtattggtgctcgcctgaaccgattgcccgctggtggtgtcggtgacatggttatggccaccgtcaagaagggaaagcctgagctccgaaagaaggtccaccccgccgttatcgtccgacagtccaagccctggaagcgattcgacggtgtcttcctgtacttcgaggacaacgccggtgttatcgtcaaccccaagggtgagatgaagggctccgccattaccggccccgtcggtaaggaggctgctgagttgtggccccgtattgccagcaactccggtgtcgtcatgtaaggtgcttgcttgcgaaaggaaatcaaggaaagacaaaaaggcctgcggtgcgtggtggttgggttttctgtcccnaatgcnatcagatagaacgcggtaaaaaaacattatcccccttcccaagactcttattcttttttcatctgcccgggtctaggggaaggcgaaaaggggaatgttctttttatctactacttttaaagtcgctggattggcccaaggctcttgcatttcggttgcggcgtgtaaggatgattcacataccaggcattcacatcaaggacaaaanaaaagtcacttcaaaaggattctccctgggaaaaa

SEQ ID NO: 295 - DNA, 392 bp, Fusarium venenatum
  misc_feature (1)...(392): n = A,T,C or G
agtttatcggccaacgatttggagaaccccgaaattaaaatgcttcaccgcatnaattcgcaaaccattcgntccatgtgctaccaattgaaccgccgcattcgggacaggnntgagagcattnggtgccattttcctgcgacaaatcggcangcganaaaccggntggatccggagaagtttttccattgcgcctcgtaccggtcgtnccagttgctgatgtccccattatggnggaagtncccttttgttgcgtcatcaaaataattgcccatataggttccattggtgtannagggcgccgctttccgnaaaggtggaatcgtttgccttaaaaggagtcgaatgattgggcacaaaggtagacaatcaccttgattccgttttggtga

SEQ ID NO: 296 - DNA, 703 bp, Fusarium venenatum
  misc_feature (1)...(703): n = A,T,C or G
cttcgtcaaagactcataatcttcaagataccaaacaccgcaatcatgtctgtccccgccttctccgacattgccaagccggccaacgatctcctcaacaaggatttctaccacctctctgccaccaccttcgagttcaaggacaccgcccccaacggcgttgcctttaaggtcactggcaagtccagccacgagaaggccacctctgctgctattgagggaaaatacaccgacaagcctaccggcctgaccctcacccagacctggaacaccgccaacgctctcgacaccaagatcgaggtcgccgactccctcgccaagggcctcaagctcgagggtctcttcaacttcctccctgccaccgccgctaagggtgccaagttcaacctccacttcaagcagcccggtttccacggccgtgctttcttcgatctcctcaagggccccgtcgccaacgttgatgctgttgtcggccacgaaggtttcctcgctggtgcttccgctggctacaatgccaacaagntgcctgactgcttacagcgccgctgttggctacgctgcttcccatacaagcgctggtatnaccgctttntgacaacctcagcgtcttcgccgntttttacttaccacaaaggcaacttttaaggtgangctggtggccaaggntactggaacttccaagaccgncaacgctttcggtttt

SEQ ID NO: 297 - DNA, 2113 bp, Fusarium venenatum
tcaaaagcccagtttcgttctgagtcctgtccggtccctcttctcctcctactccctccaattatcgccatccacatcgacatcgtcaattcacaacctcacccagacaagaagaaaagaacgactgaaggccttcgctcgccatcacccgattcttttccattctcttcgacttttgtttcgtaggaacaagagccagagaacttcttgtcatcctttcgaatttcggaaggttgtatgagaagcttctctcgcgccagcaaaagtcgcaaatctggactttgaggcacgcgtccccgttcccttcagcatcttcccatcgacatatcgggaatccgaatcccacacacagaccgttaccgaaacaaagatacacgaagaggttgagatcaaaccccaacagcccgaagccggacgggaaggtgaaatatcttctgtctccgtcaccgccgaacaggtccctcctcctcgtcaagagcaagagtttatcgaagaagaggtccatattacgcgtgaagaagaacattaccaccgtcccggtgtccaaaaattcgagcacgaagactttactatccgtgaagactcccgacgacctcaacctccctctcaataccaaccttcccagtaccaccaaccttcccactaccaaccacctcccaaattccaaacttctcacactcacgtagagatcgacacccaccgtcatccctactactccacccccattgatctcgctgaacgtgaataccgccagcgttaccgccctgcccaagctttttccacagaagacccttcttcccactctcatcctcactaccaacctcaagacaacttcaaagccaacaactacaccgttgaaggccgacccgctccccaattccattcctctgagaagactgaaatcaacaagtttactgttgacgaacactcctctcgccctcagtacaaccacaccgagaagaccgaattcaacaactacactgttgacagccgatcttcccgtcctcaatacaacacctgtgagaagactgagatcaacaatttcactgttgacgcccgctcttcccagccacggtaccgcgacaccaagacaactcaagtcaacagctacgccgttgacaagcccgtttctcgtccatcttacaagaaggacgtgagatttactgaacaaaccgtcgaagcttcaaagtccgacaagtccaagatgggttactacgacgacgagggttctttccgcaacggcggcatccacaagctcggtgacaagtcccgcgacattgaggttgacattcgcgagacttctcgtcctgccaatgactgcgctcccaacaccgtcagcatcccctgccaccacatccgtctgggtgatttcctcatgctccagggccgcccctgccaggtcatccgcatctccacctcctctgccactggccagtaccgctaccttggtgtcgacctcttcaccaagcagcttcatgaggagtcttctttcatctccaaccctgcccccagcgttgtcgttcagtccatgctcggccctgtcttcaagcagtaccgtgtcctcgatatgcaggagggtcagatcgttgccatgaccgagactggcgacgtcaagcagggtctccctgtcattgaccagtccaacctctactctcgcctccacaacgctttcgagtccggtcgtggctctgttcgcgtcctcgtcctcaacgacggtggccgtgagcttgccgttgacatgaaggtcatccacggctctcgcctgtaagcgtgttcaactgttttctgaattcgggcagccgcttgcaatgcgacttcttcccaatgtttaattgagtgaagggacagcactaccagtctcacctcaactgtggggagcgggtctgggctgtctctaatcttacctgtacaatgtcaagtttcataggggacctgttgtgtcaagatggttcgagttttgtttgtgtcaagattggataaatgatattggctagctggaaatactggagtcttttgtgtagatgggagagttctgtacatgaactatagtaattgacaattgattccgcatctcttagaaaaaaaaaaaaaaaaaaaatcacacctacggccg

SEQ ID NO: 298 - DNA, 424 bp, Fusarium venenatum
  misc_feature (1)...(424): n = A,T,C or G
caaaacgaacgaacgaccaaaaagacagaccgtcaatatgaaggttgttcttgtgagcggcggagtcatttccggtgttggcaaaggcattattgccagcagttctggtcttcttctcaagactcttggtcttcgcgttacagcgatcaaaaccgacccttacatcaacaccgatgctggtcttctgaaccctctcgagcacggcgagtgcttcgttctcgatgatggaggcgagaccgatctcgatctcggaaactacgagcgatacctcggcatncaattgagccgtgacagcaacatcactaccggcaagatctacaagcaggtcattgagaaagagcgcnaggagattatctgggnaagactgtccaagtcggttcttacatnacaaacgccattcaggattgattggacctgtcgccaa

SEQ ID NO: 299 - DNA, 546 bp, Fusarium venenatum
  misc_feature (1)...(546): n = A,T,C or G
agctcatgctcgtctttgaattcatggatggcgatctgaagaggtatatggacacgcatggcgagcgcggtgctcttaaaccaaccaccatcaagtcattcatgtaccagctcctcaagggtatcgacttttgccaccagaaccgtgttctccaccgtgatctcaagccccagaacctgctgatcaacaacaagggtattctgaagcttggtgatttcggtctcgcccgcgcctttggtattcctgtcaacacattctcaaacgaagtcgtcactctctggtatcgcgcccctgatgtcctactcggtagccgtacatacaacaccagcatcgacatctggtcagcgggctgnatcatggctgagatgttacgggtcggccgtattcccngaaccaccaatgaagaccaaatcgtcggaatttccnataagggcacacgacagangnactggcccggnattaccaattcccgagtccaagccaaacattccataggangctactaaggacctccggaatattttcaaaaaattggatccaacgggt

SEQ ID NO: 300 - DNA, 540 bp, Fusarium venenatum
  misc_feature (1)...(540): n = A,T,C or G
gccaaggagaggttcgaaaaggcagccaggttccaaggtagaatcgctgagcgcttggtcagtgccagtgatgactttaccatgtacctttgggatccttctcagagcactaagcccgtcgcacgtatgttgggtcatcagaagcaantgaaccatgtcactttctctcccgatggcactctcattgccagtgcaggctgggacaaccacaccaagctctggaacgccagggatggcaagttcattaacacactccgcggtcatgtanctcctgtgtaccagtgtgctttctcagcagactctagacttctcgtcacagcatcaaaggatacaacactcaaggtatggtcaatggcatctcacaagctctccaatgatctaccgggtcaccaggatnaantgtacgcggtggactgggcaccggacggcaagaagantcgcagtggtggaaaggacaaggcggttcgggtctggcaaaattagaatcccaaaatggtgtttgtnactctaaaagtcnagatacccctgaagtgattcccc

SEQ ID NO: 301 - DNA, 623 bp, Fusarium venenatum
  misc_feature (1)...(623): n = A,T,C or G
cttcgtcttaagcaaccgaaccgttaatcaacgacttcatctcccgacaattcagctcgcctgtcgttcccacgtacacttcgtatccttcaacacgacctttttcgattgatatctgtaccgttttcgcgtcacaatagtcaagatggttagcgaactttgccccgtttactcgcccttcttcggtgctatgggctgcacctgcgccattgtcttcacctgtctcggtgcctcttatggtaccgccaagtctggtgtcggtatcgccgctatgggtgtcctccgccctgacctgatcgtcaagaacattgttcccgtcattatggctggtatcattggtatctacggtctcgtcgtttcagtccttatctccgatggtctcaagcaggacttgcctctgttcaccagcttcattcagttcggtgctggtctttccgtcggtcttgctggtctcgctgccggtttcgccattggtattgtcggtgatgctggtgttcgaagcacttgcccaacagcctcgtctcttcctcggaaagaatctgaatctcaattttcgcttgaaatcctcgggctttacggcntattgntgctttgntnatgaactccaaggccntgtngacgct

SEQ ID NO: 302 - DNA, 926 bp, Fusarium venenatum
  misc_feature (1)...(926): n = A,T,C or G
nncttgtttnttgtgcattgnaatcttgagccttgcaacaacggatgcaacgggtgtggcgcaatgagaaattcgcgatgtgggatcagagtgtcctctttaatttttttttagtgagtggagagganaaggaaacaagtcaanttgacttggatgactcgattttgctgataacaagttggaaagcgacaccaatcctnagccaaggttgaaattccaaggcccaagggttgcgggctgctacttcgttgccttttatgtgaagaatgatgtagataccggtgataggcagtacccaangattanatagagagagaaaagacttttggtcttttgttcttgtgaaaaagggagctctnctcancnnnattctaaaaantgacntgcntgtgatcgcaacgccttttttcaaacgcacattctacaaccgtcaaaatggtcaagaagagaaagaacaacggccgaaacaagaagggccgcggccacgtcaagcccatccgatgcagcaactgctcgcgatgcacccccaaggataaggccatcaagagattcaccatccgcaacatggttgagtctgctgctatccgtgacatctccgatgcctccgtcttcgcggagtacaccgtccccaagatgtacctgaagctgcagtactgtgtctcttgcgccattcacggcaagattgtccgtgtccgatccgttgtcggccgacgcaaccgtgcccctcctcctcgcgtccgttacaacaaggacggcaagaagatcgttcccactacccctaaggtttagatgggttgatacttgggatggagtccggttatgatagcagcattcaaaaaatggatgggatgaatacctttgggattatgagactaagaaattccaaaaatcaactggacgacgtttgatgtctacgcgtctttgac

SEQ ID NO: 303 - DNA, 634 bp, Fusarium venenatum
  misc_feature (1)...(634): n = A,T,C or G
agtaaatcgacgataaggtgcagttctaggcttcgtgacccattcattttgctggattgttgttcaattcgagatctatacattcaacgtcctgcaaattttcatattcatcatgtctcgtcccgaggatacgcttgccgccgacgtccattatgacgataccgaagcgcgaaagtacacgacgagttctcgaatccaaaacattcaagcgtccatgacaagaagagcactagaacttctggatctcaagtcaccatcttttatcctcgatatcggatgcggtagtggtctctctggcgaaattctatcctctgtcgaaccggaggatggtggtcctcacacttggatcggaatggacctttcaccatccatgctggatattgcgctccaaagagatgtcgaaggcgatttgatgttggcggatattggccagggcgttcccttccgagcaggtccttcgacgcagccatcagtatttcggctattcaatggctctgcagtgccgaaacaagcgatacatnccctgtcgggccgtcttacccgcttcttcaacggactctacgcatctctcaagcgtggaggtcgagnccgtctggcaattctaccccaaaaacgacgaacagggcancattga

SEQ ID NO: 304 - DNA, 474 bp, Fusarium venenatum
  misc_feature (1)...(474): n = A,T,C or G
gttgttcccctggttgctaccttggttcacaagaacaacacacaggagactggtggtatctttgaggttggtggtggccacatggctaagcttcgatgggagcgctccagtggtctcctcctcaaggctgacgactcttacacccccggagctatcatcaagaactggggcaaggtcgtcgactactccaacccccaatatcccacgggccccaacgatttcctcacattgctcgaggactccatgaagatgggccctgctgagcaaggcgagaaccccgacttcactggccgcgtcgctcttgtgacaggtggtggtgctggtattggtcgcatttatgctctggctttcgccaagtatggcgcatcaatcgtcgtcaacgatctggccgaccttaaccccgtggttgccgaaacaaaaaacttggtggcaaggccgcggtgtnaaggcctaactgaagatggcaanaaggtc

SEQ ID NO: 305 - DNA, 593 bp, Fusarium venenatum
  misc_feature (1)...(593): n = A,T,C or G
tcgagactcttggcggtatcgacctgaacgctatgtacaaaatcaccaccgctgagcgcatgcttaccaaccttgctgtcgagtacgagcgtgtcgccgatccccgtcttcccgcttgctcccgcaaggctggtcacctcctcgagacatgctgcactgtcatggacctcaagggtgtctccatcggcaaggttcctcaggtttacgcctacgtcaagcaggcttccgtcatctcccagaactactaccccgagcgtctcggcaagttgtatatgatcaacgccccttggggtttctccactgtctggagcatcgttaagggctggttggaccccgtcaccgtttccaagatcaacattctcggatccggatacaagancgagctcctcaagcaaattcctgccgagaactccccaaggccttcggcggtgagtgccaatgtgagggtggctgtganancagcgaccctngtccttggcacgaggccgaatttgcccgccctgcttggtgggagaanaacangatgcccatgtcttganaacaagggctctganattgaagaaccccaaaggccctgaagccgctcctgttgc

SEQ ID NO: 306 - DNA, 650 bp, Fusarium venenatum
  misc_feature (1)...(650): n = A,T,C or G
cgtcatcacaaccaagcctttcgacactctcttccatctcacagtctttcagactcacaactccctttttaaccaccactcccccaaaccataactctttcaaaatgactggcggcggcaagtctggcggcaaggcctctggctccaagaacgcgcaatcgcgttcctccaaggctggtctcgctttccctgtcggtcgtgtccaccgcctcctccgaaagggcaactacgctcagcgtgtcggtgctggtgcccctgtttacctcgctgccgtcctcgagtacctcgctgccgaaatcctcgagttggctggtaacgctgcccgcgacaacaagaagacccgtatcattccccgtcatcttcagctcgccatccgaaacgatgaggagttgaacaagcttttgggtcacgtcaccatcgcccaaggtggtgttctccccaacattcaccagaaccttttgcccaagaagactggcaagactggcaagacctccagcatggagctgtaatcgggtctttttggttctgtttttccatgcnatggcaggttgtttcggttgtcatgacaaaagggtcacggtttaagggtttacacgggtgcntttatnaanttattcccccgtagggtgttgaaaatccccacgggtttg

SEQ ID NO: 307 - DNA, 831 bp, Fusarium venenatum
  misc_feature (1)...(831): n = A,T,C or G
gtcgccaagtcgatgctttccgtgctggattctcacaagtattcccttactcagcactcagtgcttttacacccgacgagcttgtcaccctgtttggccgcgttgatgaggactggtctctagagactctacttgattccatcagggccgatcatggctacaacatggacagtaagactgtcaagaatttgcttcatactatgagtgaattcaacgcatcagaacgccgagactttttacagttcacgactggaagccccaagcttcctatcggaggattcaagtctttgacacccatgttcactgtcgtctgcaaacccagcgaagagccatatacgtntgacgactacctacccagtgtcatgacatgtgtcaactatctgaagctcccagattactctaccattgaggccatgaggaaacaactctcaccgccagtcaaggaaggncagggagcattccacttgtcttagattggtctactttatgaagatactgcatgagatgatgccatgcccctgtcgaccttgtttacttcgacgaattaggcaggaaaaagttttcatttcccctttattgccctgatgaaacgatactaccccccgatggactggaatgatggaaataaaacangggcgtnttattttgtgtttacanaagcacaatattgcatggcttnaggagtggngcaggacttttatnttnttttttnatgacaantgctggtatgggcatggcaaacctttgaagtnttttccgtgggtcaatnagctggtgggnaaagatgatatttnaatatgaaaaaaaaaaaaaaaaaaattcctgcggccg

SEQ ID NO: 308 - DNA, 646 bp, Fusarium venenatum
  misc_feature (1)...(646): n = A,T,C or G
agaacaagcgagccgagaaggctgctaagtttgctgtcccattgcccaaggtccgcggaattgccgaggaagaaatgttcaaggtcgtcaagaccggaaagaagatccagaagaaggcctggaagcgcatggtcaccaagcccacctttgtcggacccgacttcactcgccgcaaccccaagcacgagcgcttcatccgacccatgggtcttcgttacaagaaggccaatgtcacacaccccgagcttggtgttaccgttcagctgccatcatcaagcgtcaagaagaacccccagaaccctctatacactcagctcggtgttctgacaaagggtaccgtcatcgaggtcaacgtcagcgaacttggtctggtcaccgccggtggaaaggttgtttggggtccgttacnctcaagttaccaacaaccccagagaacgagggcttgnattaacaagcgtccttctggtataatgcgctcaacaagcgtccacgcgtgatgttgaagagattcgtttgtcaaagttcgaatgcatgtattggcgccaaggcgtttttgggttaccgcgccaaaaanaaacaaggccgtgatggtagatggttggtaaacgggttgattgtcgactggaagattccaagttgtgatgaa

SEQ ID NO: 309 - DNA, 1133 bp, Fusarium venenatum
  misc_feature (1)...(1133): n = A,T,C or G
aatttctagggacagcccagcccatccnccatacatcgacaatctcgcatcacactgcctcacttatcgacgtcacaccctcgaattccaagcttctcaacgtcttcccagccgttgtgacttccaattctacgacacctacagcatactccacgtccctgtctccgccccgaccaccatcatgaaggctgctctgttcctttccgctctcgcctcagccgccgttggcgttgttgctgaggagctcaagatcgatgtgactcttcccgttgtttgcgagcgcaagacacagaggggagacaaggttcacatgcactaccgtggtaccctcaaggactcgggcaagcagttcgatgctagctacgatcgcggtactcccctttccttcaaggtcggttctggccaggttatcaagggatgggacgaaggtcttcttgacatgtgtattggtgagaagcgaatcctgaccattccccctganttcggctacggncagcganccattggccctatccccgccggctcaaccctagttttcgagacagaactcgtcggaattgacggtgtccccaaacccgagaagatcgaaaccaaggtcgtcgaaggcgccgagtctgctgccgaggccatcagcgaggctaccgaggctgccgcgacagcttctgagaaagttgccggcaaggttgctgaggccatcatcgatgctgctaaggctgccaagaccattatcgctgataccgatgacgctcccgaacacgangagctgtaaagacatgatgtataacgatttactttgtgcataccgcaaaacgccatgacatatcatatcatccattatacataaacctagaaggctggataacaaattccgtcgacgttgatgtcatatcgtgtgcaattcgatcgagtagggccccacgttgtccttgagtgacttgttggctgtagatgcatgactgaagatgtagtgagggtttgccatctacctggagtgtgattgaagggtttgtttagtcggtcttgacgtcatgatcgatactattattcttccttatccttttctgnagaaagaaatcgcttntagtggtcttaagtgtccaatcatgatggngggttntgncaaaatccntttt

SEQ ID NO: 310 - DNA, 607 bp, Fusarium venenatum
  misc_feature (1)...(607): n = A,T,C or G
tgtgtttcttgagaatgcgtacagtttagttcaccaggacaatgcggccgatgtccccaccgtttccgacctacgcatgcagttggagaaaggcaccgacgagagcaaggttgagaccatgaagcgcatcttgaccatcatgctcaatggcgatcctatgcccagtttgctaatgcacatcatccgttttgtcatgccttcaaagtacaagcctctcaagaagctcctctacttttactatgagatctgccccaagcttgacagcagcggcaagcttaagcaagaaatgattctggtttgtaacggtatccgaaacgatctccaacatcccaatgaatacatccgaggaaacactcttcgcttcctttgcaagctgagggaagctgagcttattgagcccctcctctcttcggcgagatcttgcctttgaacacagacatgcttatgtcccaaagaatgctgtcttcgccatctcctctatttacacacactcgccttctctgatcccgacgcttcagaacttattccaccttctcgaagganaaaatgacggtgtctgccgaccggaatgctttgccgccctgctagtnttcaacagangctgccc

SEQ ID NO: 311 - DNA, 1119 bp, Fusarium venenatum
atcaactgtcacaatgcctctcctacctcaaagcgtaaagccccgcgttatccttggtcttatgacctttggacctcccggtagtgagaagctcgacgctcgtatctttgactcggagaccttcaacaaggcgcttgacgtcttccagagcaagggttacagtgagattgacaccgcacgtgtgtatgtcggtggaaaccaagagggatggactggtaaagagaccaaatggaaagagaggggactcactctcgataccaaggtcaagtatcccaaggaacctcgcgaaaacacctacgacaaggtcatcgagtcagttgataccagtctgaaggagcttggaaccgactgcattgatctgctctacctccaccgtcctgatcgtggtgttccttttgctgagacccttgaggctatcaacaagctgcacaaggatggaaagtttgtaaactttggtattagtaacttcaccgcgtacgaggttgctgaggttgtcatgacctgcaagtacaataactgggtccgacctacagtttaccagggcatgttcaactgcctcactcgttctatcgaggcagaactctttgtggcctgcagaaggtacggtcttgatattgttgtttacaaccccattgctggcggtcttttgtccggcaagatcaagtcgatggacatcgagcctgaaagcggtcgcttctctgaccagtctggtatcggcaacacataccgacagcgttactttagagagagacacattcaaggctcttaacgtttatcgagcaggccgtggagaagaacggattgagtatgcttgagacagcgctgcgatggatggttcaccactccaagctgaagatcaaggacggcaacgatggcattattctcggcatgtccagggtggagcagctggaggagaacctggagatccttgagaagggccctcttcctgacgaagtggttgaggcacttgaccaggcctggctgtactccaaggcagacacgactaattactggcacggggagttggagtatacttatgatgtgcacgaggctctgtttggggcatcggccaagtaaattgcgagcaggtagacagtaatatctatcgtctgacccgag

SEQ ID NO: 312 - DNA, 587 bp, Fusarium venenatum
  misc_feature (1)...(587): n = A,T,C or G
cgacgccgaagttctccgtatcatcacagaagtatttgagggacttggctggaacggtggatacacgataaagctgaaccacagaaagatcctcgacggtatcttccaggtttgcggcgtgcctgaagacaagatccgtaccatctcctcggctgtcgacaagcttgacaaactgccctgggctgatgtgcgcaaggaaatgaccgaggaaaaaggactcgatggcgaagtcgccgatcgaattggagaatgggttgttctgaaaggcaagcaagatctgctccagaagctgcagancaccgagaaactggccgccaacgaatctatgaagaaaggtatggaagatcttgaacttctttttgaataccttgaagcattcaactgcctggaccgggtttcttttgatctcagcttggctcgaagtctcgattactacaccggtctcatctacnaagttgtcncccaaggttccgctcccgaagttacccccggncaggaaaaaacaaatcccagccttccaaagaaaaanggttagaaaggtggcgaagangaagaccgctctgatgatcccctgttggcgttngaat

SEQ ID NO: 313 - DNA, 623 bp, Fusarium venenatum
  misc_feature (1)...(623): n = A,T,C or G
cgctggtggtgttattttggtcgctcttattaccatttacggactgaactttattgcttcgttcatgtacctcgacccttggcacatgttccactccttcccttactacctggttctcatgtcaacttacatcaacattcttatggtttacgcattcaacaactggcacgatgtttcctggggtaccaagggttcggacaaggctgaggctcttccctctgcccacgttaccaagggtgagaagaacgaggttgttgttgaagaagttgagaaggagcaggaggatattgacagtcagtttgagcaaactgtccgccgtgctctcgctcctttcaaggaggaggaggaggtcgaggcggccgatgttgaggatggatacaagtctttccgaaccggtctcgtcgtctgctggttgtttggaaacattcttctcattgtttgcattaccagcaccaactttgacaacctcggatggggtgaacctgccacagaacgaaaggcgcattacttncagttccttctgtcgctactggcgngctctcgcttggtcgttttgccggtttcttgtgggtcctcgcaggactggtantatgtgctggtttctcaagaaattaanccggcgt

SEQ ID NO: 314 - DNA, 652 bp, Fusarium venenatum
  misc_feature (1)...(652): n = A,T,C or G
taacctcttacgtttctataggtttcgccgtcttcagagtcacattgttagcccatcatgtctttccaaccaacccaantttttgaggagggcaccaccgaggagaagggtgagaatgctcgccttgccgcctttgttggtgctatcgccgtcggcgatctcgtnaagagcactcttggtcccangggcatggacaagattctacagtcagcctccaccgccgaaatcatggttaccaacgacggtgccaccatcctgaagtcgatcgccctcnataacgccgccgcaaaggttctcgtcaatatttcaaaggttcaagatgacgaagtcggtgacggnnccacatccgttgctgtcctcgctgccgagttgttaagagaggcagagaagctggtcgacaagaagatccacccccaaactattattgagggttacagaatagcgagcaaggctgnattgaaggctttggaaggctcggccgtccaccacagnaagaaccccgaggcgttccgccaanatttgttcgttntcgcgcgaacaacttttaacttaaaaggtcctcgctnaagatcgcacgcagtttgcccaattggcttgtngatgcttgccttcccacttaagttttcaaacctaaaccncnttcaaatnatta

SEQ ID NO: 315 - DNA, 559 bp, Fusarium venenatum
  misc_feature (1)...(559): n = A,T,C or G
ctttctctctaacattaactggtgttgtgttgtcgatttcctccatcagacacttatcacttacacgcgatccaattcctcgatactcgcccacagccttcaacaaaattcacaatacagtcacaatggcgtcacanaatatgacgaacccttctgttaaccctgacattgaanacgagctcttccaaaaggaggttgaggccgtcaagacgtggnggtccgactcaagatggaaacacaccaaacgaccctttaccgctgaacagatcgtttcaaagcgcggataccttcctgttgactatgccagcaacgcccaggccaagaagttatggaagattcttgagcaccgtttcgagaaccgcgatgccagttatacctacgggtgcttanaacccacaatggtaactcagatggccaaatacctcgatacagtataccgtttccggntggcaaatcgtcgtcaacggccttttgtttccgacgagcctgggcctgatctnggctgactacccttacactaccggttcctaaaaaaggtnggccatttttttattggccc

SEQ ID NO: 316 - DNA, 894 bp, Fusarium venenatum
  misc_feature (1)...(894): n = A,T,C or G
ctttcagctttttttcttctcctcctcaacctcactcctttctcctcaagaccctcgatttcttgccaataccgtcaaaatgtccgcccctaacgacaacgagcatgagatgacattcgattccgccgatgccggcgcgtctctcaccttccctatgcagtgctctgctctgcgtaagaacggtttcgtcgtcatcaagggccgcccttgcaagattatcgacatgtccacctccaagactggaaagcacggtcacgccaaggttcatcttgttgctaccgacattttcactggcaagaagtacgaggatctctccccctctactcacaacatggacgtccccaacgtcacccgccgagagtaccagctgctcgacatctccgacgatggtttcctctccctcatgaccgacgatggtgacaccaaggacgatgttcctcttcccgacaacgaaattggccagaagatcaccaagctcttcaaggaggaagagaaggacaccaacgtcattgtcctcacctctatgggcgaagagtgcgctatggaggccaaggagctcccaaccagggctaaatcatttaaaccttgatccacgccctaccttaatggcacttggccctgaggatctacattgaaagatgatctggatcaggggatcttttttgtttttgatggacatttggcgcatcaatattcatgggccatgggtaggcgtcgtgcaaaaggacttctctacctggacagggttgcctgccttttatgatatacggcaaccctttagcaccccgagcctcaggctcgaaaatgttttcctttggttcctggcttacaagctgcgaataccatcatgtcaccgataccgtagcagcaattaaatgacgaaaaangggagag

SEQ ID NO: 317 - DNA, 884 bp, Fusarium venenatum
  misc_feature (1)...(884): n = A,T,C or G
caaccgaccaagtcaaaaaaaattttgaggtatgtatgacttacgcttgcagcgagtcgaatcaaaaaaaggatgatgcctttcaccatggcaaaagggtagcaatcgagggtattgtcgtcaaccgtgaagaaaagaccgatcttttcaacaagggccggaaatacttatcacaaactggcgactgtatccttgatacgcttctcttcagcactgggcggcagaaccctcgcgatcgatcgttgagggcactttccagtcttcatcaacggcccnnnnaagtcaaaaaaaattttgagatacctcatttccccgtcccgacttgagaatctcctcaaaacaccgcaaaaatggtccgcacttccgtcctccacgatgcgcttaacgccatgaacaacgccgagaaggctggcaagcgccaggtcctgatccgaccttcttccaaggtcatcatcaagttcctcactgtcatgcagcgacacggctatattggcgagttcgaagagatcgacgatcaccgatccggcaagatcgttgttcagctcaacggccgtctcaacaaggtcggagttatctctccccgctacaacgtccgcctctccgagctcgagaagtgggttgtcaagctgctccctgcccgtcagttcggctacgtcatcctcaccacctccgccggtatcatggaccacgaggaggcccgccgcaagcacgtctctggcaagatcattggcttcttctactagaaagggacgggaaaccaatcaaaaagtgatttaaaaacaaacaggcattctcggcgttaaggaggatgatgactaggaccgatgcgattatatagccaagttgcttgtcgcacacgcgaacataccaattgatacttttga

SEQ ID NO: 318 - DNA, 597 bp, Fusarium venenatum
  misc_feature (1)...(597): n = A,T,C or G
tgtcaacgctgcagctctggagatgcctacgcaatcaccacccacaacggagatggattctcctgccgctggattaacacctagcgtcagcgctggctctgaagagattcagctggatgttggcaacatggaccttgatttcatgcagggccatgatgagtttgactggaacgctgtggccggaactgatttcgacgttnaccagtggctccagttcccccccgagggcgtcaacaaccaagacgacaacttgatcgctggcgtattgggcgttgaagagcctacaatgtctgccgagcaagctctgacctgggccatgaacgctgagacagacgtagcagctcgtcagcctgaaaaccgcgacattaccgcgtcggcataganctccaaagttcgtgctgctatattcacataatgttggatgtatcactttttggattgggcgtcatatttagttctttcgtgttatctggtgtacatgcctgtactgcattanaaacgggcgttttttgaacgcnggctccgaacctaggtggcgtttgtttttttttctggcgtggaaacaannggtttgtcttggatatgggttgtgtttct

SEQ ID NO: 319 - DNA, 574 bp, Fusarium venenatum
  misc_feature (1)...(574): n = A,T,C or G
cccatgtttctaggcaaggatgacattcagttgggtgtgaacgaatcactctatgacacttcaaaggtcatctcatccatgacttcctgcatggttgctcgggtaggacctcattctgatgtcgctactctggccaagcactcaagtgtccctgttattaatgctttgtctgatgatttccaccctctccagactattgccgacttcctgactctccacgagactttcccttcatcaagctccaagggagctactctgggtctgaacggtctcaaggttgcctgggttggcgatgccaacaacgttcttttcgatctcgccattggctgcgtcaagatgggtggtgatatttcaagtcgctgctcccaaggatatgaaatccccgaaactatgaggcactcatcaccttcgttggcgaccggggtttctttgcccggaagcttatcgagactaatgtnctgaggaggccgcaaaggatgccaatgtcttggcacggatccatgggcttcatggccagaaacttgtncccaaaancgtttaaggactttntggatccaaatncaatgacctntta

SEQ ID NO: 320 - DNA, 590 bp, Fusarium venenatum
  misc_feature (1)...(590): n = A,T,C or G
atctggctcgaggtgcttaagaaggagggcactattcacaacgctcgattccctgagatccatgaggttgatgcttccctatcggcgaagcgcgactacgtgcgaaacactgcttccaacattaactcggctgagggtcatcagttgaagaaaaaagccaaggggcaaggagacatcattcgaccccaagaagcccaagaagctcacgatctttgtcgccgacaagttccccgcatggcaggccaagtacattgaccttcttaagggagatgtggaacaccgagaccaagtcngtcaacgacaaggaactcaacggcaagattgcaagatgggagagatgaaaaaagccatgccttttgtgcagaacctcaagagacaactccaggctggcgaaccggcaagcgcggtgctggagcaaaagcttgctttcgacgaaaaaggagactctcctgcaaatggttcctggactgaaaccaactggaagcctggctgtttgcgaaatgatctcagtagancagggaactccaaagggcgtttctctgacggatggcgataaacaanttganatctcagcacctgttgcagaacac

SEQ ID NO: 321 - DNA, 478 bp, Fusarium venenatum
  misc_feature (1)...(478): n = A,T,C or G
cgactggngggtttccaagcatctgaagaagcctatccgcagcaccatcaccagtgttgcctggcaccccaactcggtccttctggctgctggatctactgatgctcatgcgcgagtcttctccgccttcatcaagggtatggatgctcgncctcctcctggagtttggggcgagcgtctcccattcaacaccgtttgcggagagtatctgaacaactcggctggatgggtgcactcggtttctttctctcccagcggagatagtcttgcctttgcagctcacgacagcagcatcactgttgtttacccatctggccccnaacagccccctcgtgctgttgttaccgtctctactcagcagcttnctttcaagagcctgatctggaccagtgaagatganattatcgctgctggttacgattgcgaggctttccgcttcaagggtgatgagggcggctggcaattaactggtcctatc

SEQ ID NO: 322 - DNA, 682 bp, Fusarium venenatum
  misc_feature (1)...(682): n = A,T,C or G
ggccactggccaggaccctgctcaggttgtcgagagcgccaactgtatcaccatcatgaagaacctcaacggagctctccaaatctctgtttccatgccttctcttgaggtcggaaccctcggtggtggtactatccttgagccccaaagcgccatgcttgatctcctcggtgtccgagggtctaccccactaaccctggtgacaacgcccgccggctggctcgcatcatcggtgcctctgtccttgctggagagctgtctctctgcagtgctttggctgctggtcaccttgtcagagctcacatgcagcacaaccgaagtgccgctccctctcgcagcactactcccgcttccatgacacccggtctatccatgaccacttcggggtcaacaacatcaatgagcgctgctggcatccagaggtcaaagcgataaatgacgagcgtttgcattttgaaggagtagtttgacgaaagttttaaaagaatagagatgagcatgtacgacatatggtctgggatggatgatgggtcatacaacatgggaggttttttcgcattgggacattctggaaaggtcgggcaaaggggtacatacatatacaagtcgtcgnaaagatgcnaaatattggtangcatggagtttaataccgctncaatagtcaatttnantccttttttgt

SEQ ID NO: 323 - DNA, 587 bp, Fusarium venenatum
  misc_feature (1)...(587): n = A,T,C or G
gatacccaaatcattcacaatggctcccaagatcgctatcgtctactactccatgtacggccacatcaagcagttggccgaggctgagaagccggtatcgagaagctggcggtactgccgacctcttccaggtccccgagaccctccccgaggacgtcctcgccaagatgcatgctcctcctaagtccaccgacgttcctaccctcgacgacccttccatccttgagggctacgatgccttcctccttggtatccccacccgttacggaaacttccccgcccagtggaagctttctgggacaagaccggcaagcagtgggcttccggtggtttctggggcaagatggccggtatcttcgtctccaccgcctcccagggtggtggtcaggagaccactgctcagaacgccatctctaccctcacccaccacggcatcatctacgttcccttcggttacgccaaggctttcggtacctgactgacctctccgaagttcgcggtggtacncctgggggtgccggtaccttcnctggtggtgatggttccgtcaaccctcggccaaggactcaacttgctcaggtcangga

SEQ ID NO: 324 - DNA, 360 bp, Fusarium venenatum
  misc_feature (1)...(360): n = A,T,C or G
aggttgagcgcgaaaccttgacagctcctcctcaccaccacaacaacaaccgtcatcacccttactttggtcacggaatgcacagctctcgaggccacctgcctacgctttcttcttaccatatggctcgttctcactcaggcgacgacgacnaccactactccggctctatgcgccatgctaagcgctcaaggcctaactcccctaactccacagctccttcatcaccaacattttctcacgactccttgtcacctacacctgaacacaccccaatcgccacccctgctcactctcctcgcctanggccttttcttggctacaaactgctaattctccnaaacctttcgcttcaaaaaa

SEQ ID NO: 325 - DNA, 623 bp, Fusarium venenatum
  misc_feature (1)...(623): n = A,T,C or G
aagaactctcctgttcttcagctaaacgctcgcaactatgataagatcattgcaaagtccaactacacctctattgtcgagttttacgctccttggtgtggtcactgtcagaatctcaagcccgcttatgagaaagctgccaaaaacctcgatggccttgctcaagttgctgcaattgactgtgatgatgacgccaacaagcagctctgtggctccatgggcgtccagggctttcccactctcaagattgtccgccctggcaagaagtctggtaagcccatcgttgaggattaccagggccagcgaactgctggtgctatccaggaggctgtcctgagcaagatcaacaaccacgttacacgtgtgagtgacaaggacctggactctttccttaagggtgacaaagcccaagntgtcctgtcactcaaaagggactctagtgcgcntattcgaacatagcnttggctttctcgatgncatctctgngggcagaatcntgataaggaancggtgctgtaaaaggttggcattganaagttccccggtttnggtctgatcctggngaaggaaggncctntggcnttacggganaaggccaaaaggcttggcaanttctncttaac

SEQ ID NO: 326 - DNA, 588 bp, Fusarium venenatum
  misc_feature (1)...(588): n = A,T,C or G
atgggttccgctctcatgtccctccagaaccagcgccccgagatcggtactcagaagatcgatgagctccttgccgctgtcgacgagtggatccctacccccgagcgtgaccttgacaagcctttcctcatgtccgttgaagatgtcttctccattgctggccgtggtaccgtcgtctctggccgtgtcgagcgtggtatcctcaagcgtgaccaggagatcgagcttgtcggtaagggccaggaggttatgaagaccaaggtcaccgatatcgagaccttcaagaagtcttgcgagcagtcccaggctggtgacaactccggtctcctcatccgcggtatccgccgtgaggatgtccgccgtggtatggtccgtctgcgcccctggcactgtcaaagtctacactcagttcctcgcttctctctacgtcctcaccaaggaggagggtggccgacacactggttttcangagcactaccgacccagctataccttcgaactgctgatgagtcgatcgacctgacctttcccgagggtacccgaggatgccttcagcaagatgatcatgcccggtgacaacaccgagat

SEQ ID NO: 327 - DNA, 658 bp, Fusarium venenatum
  misc_feature (1)...(658): n = A,T,C or G
gaatccgctcgccccagcggcaaatcgttcattctctctcttacttcctttgttcttctacatcgtctcgcctgcgaaagtacacaacctgccttcttccaactccatcttcatctccatttccgctgtgctgtcgtcctcggttgttggcctttcaatccggtttactcgcgacttgccttgcatcatcttgaatttacgacaactcgcctcgagcaaaagataatacaggaagtgcaactcaaacgctaattcacaatggctgcgaacacaaagttcctacgagagtacaagctcgtccttgtcggtggcggtggtgtccgtaaatcttgtttgaacattcagttgatccagaaccacttcgtcgacgaatatgatcctacaattgaagactcgtaccgaaagcagtgcgttatcgacgaaaaagtcgccctgctcgatgttctcgacacagctggccaggaagaatatagcgccatgcgcgagcagtacatgcgaaacggaaaaggatttcttctagtctactccattacttcgcgacaaaagcttcgaagaaatcaccacattccaacaacaaaattctgcgaatcaanggataaggactacttncccatgggncgttggtggcaacaagtgccaatttggaaggggaaccaat

SEQ ID NO: 328 - DNA, 591 bp, Fusarium venenatum
  misc_feature (1)...(591): n = A,T,C or G
ttggccgattttggcgtctcaggtcagctctcagcaaccatgaccaagaagaacacttttgtcggaacccctttttggatggccccagaagtcatcaagcaatctgggtacgaccacaaggctgatatttggtctcttggcatcacggcacttgaattggcaaatggggaacccccttatgctgatattcaccccatgaaggttctcttcctcatccccaagaaccctccaccacggcttgaaggcaactttaccaaggcctttaaagattttatcgagtcatgtctgcagcgggatcccaaagacagaccaacagccaaagaaatgctgcgccatccatttattagacgggcaaagcggacaacgtacctgactgagctcatcgaaagacactcgcgttgggcagctgcgcataagggcgaagatgatgataactgggaatctgtccacgatggccgacttcccgctgaacgtgagcgaatcnatgaaaanatgttggattttggcaccgtcagacttttcngtgaacgaaggggtnttgtttaacgaacaagcctcaataccctggatganaatgcaacaaatgctccc

SEQ ID NO: 329 - DNA, 613 bp, Fusarium venenatum
  misc_feature (1)...(613): n = A,T,C or G
ctctaatgcactcgagaagcaactggacccagcaaatctctccgagagagaccgtgtcagcatatccgccgaacctcgagacttcagcttccgcaattacgtgggctatgccatctatgggcccctttacctggccggacctattattacgttcaatgattacatctcgcaatcaaagtaccgatctgccagcattgagacaaaccgaactattcgctacggtatacgtttcctcctggtgctgctgtccatggaggtcattctgcactacgactgggtgggcgcaatcagcaagggaaagcctgattggagttcttacacggcagcacagctatctatgctgtcattcatgaacctccacatcatctggctcaagctcctgctccctggcgaatgttccgactttggtcattggttgatggaatggacccgcctgagaacatggtccgttgtgtaagcaacaactacagcacgcagctnttctggcgagcatggnaccgctcgtacaacgatgggtgatcangtcatttacattcccctttggcgggtcatcggtncgcaactggggaaccactgggcgactatcttgacctttctcatgggggttaccttg

SEQ ID NO: 330 - DNA, 590 bp, Fusarium venenatum
  misc_feature (1)...(590): n = A,T,C or G
ctttactttgaggattcaagcgaccgttaatttattctcaaaaatgtctgcaccggccgtggcttctgcatctgcagcaggtgcttccagcaatgctacttttcgtgataaggagaagcccatggcggtgcgctcctccaacatcgtcgctgcccgagccgtcgccgatgccgtcagaacttccctcggtcctcgaggtatggataaaatgattcgaggtggaaagggcgaaactatcatcaccaacgatggaaacactatgctgaagagcatggctgtcatgcatcccacggcaaagatgcttgtcaacctttccggtgctcaggatgtcgaagctggtgacggaacaacctctgtcgtcgtcatttgtggcagtctgctcggtgctgctgaccgactcctctccaagggtattcacccttccgttatttcggantcgttccaaagactgccgccgctgccgtcgaagttcttcacgatatgtcccttcctatcacccttagcgacacttcttcgcttcttcaagccgccaacacatctctgtcatccaagattgtgtcacaatattcgaacctgctcggaaccatggc

SEQ ID NO: 331 - DNA, 668 bp, Fusarium venenatum
  misc_feature (1)...(668): n = A,T,C or G
cacacacccacttcagccttccacccccacaaccatcaacacaacaacaacaactttctacatcatatcaatcatcaacaatggctcgcactaagcaaaccgcccgcaagtccactggtggcaaggcccctcgcaagcagctcgcttccaaggctgcccgcaagtccgccccctctaccggtggtgtcaagaagcctcaccgctacaagcccggtaccgtcgctctccgtgagattcgacgataccagaagtccactgagcttctcatccgaaagctccccttccagcgtctcgtccgtgagattgcccaggacttcaagtctgatctccgattccagtcctccgccatcggtgctctccaggagtccgttgagtcctaccttgtctctctcttcgaggacaccaacctctgcgccatccacgccaagcgtgtcaccattcagagcaaggatatccagcttgcccgccgcctccgaggcgagcgcaactaancgcttggggtgatggaaggataacgaattttttgctttgacacganggaatatcatgggtatggggataatcaaggcgttcactaggaacatgttttatacacangcttgnacactaaatggcaagcgagtttagctgccctttcacaatcgaccaaaaggtctttnatngttttt

SEQ ID NO: 332 - DNA, 1027 bp, Fusarium venenatum
  misc_feature (1)...(1027): n = A,T,C or G
ctagacccttctttgaactccgaccaacgctctcacgaccaaccttttagacttccgccgcgcaacctttttcgagttaacctttctttcgacttgctaaatatataagaaggactacagcttgccttctgttgtcttgtccaagatctcctcttagcagcgcatacgacacagcccaccttgggcccccacgttcataatgttgaagatatggtcgatgaaaaaggagcagaaagatgcagagaacgctgaaggtcaagcttctggcggtaagaagaagaaggngaccgcagcccagttgcgcgtgcaaaaggatctttcagaactttcctcggctcgacgatgaagacagagttcctgatcctgacgatattctcaactttgtccttaccatcgaccctgatganggcatgtcccgaaacnggcggtcacattcgactttaccattnaccagaacttccccacgagcctcccaaagttcgatgccgagaaaagatttaccattccaacatcgatcttgaggggaaggtgtgcctgaatattctgcgagaggactggaagcctgtgttgaacttgaacgcagtgattgttggcctacagttccttttcctcgaacccaacgcatcggacccgctgaataaggaggccgctgaggatctacgaaacaaccgggaaggcttcaagcgcaatgtgaggactgctatgggaggtggagtggttaaaggcacgaattacgacagggtcctcaaatagagagcgtgccgaagaacgaataccaacacgattttgggatgaacaactacggaggcaaagagcccaatcggggatcttgagatgatagaacgacttcaatgagcgttttgatacgacgaacgacatcatcggagacgaaagagcatcacgtggcgtcctatgggtctataatccggacaggctttgcttattatccccaaggcgttctatgtatggcttgatgangggtgtgtcttgttgaanaatcggacggaggcggggtagaattggagat

SEQ ID NO: 333 - DNA, 799 bp, Fusarium venenatum
  misc_feature (1)...(799): n = A,T,C or G
caaacatcctcgcgaatacagntattaataacacagtattcgtcaacaatnatgtcaacaataacccctgatgcgcttcagtcgggacaggctcctgttattcccttatccttcaatggtaaccagccggagaaggtgacgctctacccgntttccaactacacatttggtgtcaaagagactcancccgaggaggacccatcagttattgctcgcctaaagcgactcgaggagcactacacagagcatggcatgcgccgtacgtgtgaaggcattctcgtctgccatgaaaacaaccacccgcacattctnatgctacaaatcgcaaatgccttntttaagctcccaggcgattacctgcgccccgaagatgacgaaattcaaggcttcaagtcgcgactcgacgagagattggcacccgttggtcgtttgggggagggcgaaaaagctggcgactggcaaagtaggcgactgcttaccccagtggnggaggcccaactttgaaacatttatgtatccgttcatccctgcgcatgtgaccaagacccaaaggagtgcaaaaagctttatttnattcagctgcccaancaaaaggttttgagcgtccctaaaaacatgaagctccttgccgtccctctcttcgagctctacnacaatactgcgcgatatggcccccagctttctgcgattcctnatctgctgagccgatataactttgagtttgnggacaanaatggcaacgttgttgcggccactccangttctgccncccaaganggttttgtccccacacaaagtg

SEQ ID NO: 334 - DNA, 800 bp, Fusarium venenatum
cttcatccaacatccatcgaggacccggccgtcaccactaacgacaatcaagatggtcaacctgcgaactcagaagcgcctggcctcatcggtcatcggctgtggcaagcgcaagatctggctcgaccccaacgagcagagcgagatctccaacgccaactctcgtcagaccatccgaaagctcatctccgatggcctcatcatccgaaagcccgtcacccagcactcgcgatcgcgagcccgcgagctgaacctcgcccgacgagagggccgacaccgtggctacggtaagcgtaagggtaccgccgatgctcgtatgcccagccaggtcctctggatgcgccgcctccgagtcctccgccgtcttttggtcaagtaccgtgccagcggaaagatcgacaagcacctctatcacgagctgtaccacagcagcaagggtaacgccttcaagcacaagcgtgccctcgtagagcacattcaccgtgccaaggctgagaaggcccgcgagactgccctccaggaagagatggatgccaagcgtgcgaagaacaaggctgcccgtgagcgcaagcaggagcgtgcggtggcgaagcgaaatgccctccttgccgaggaataaatgtaagcccagtggacaacgacaacatttcggtcttaggaggaggctgcatacggagtctacgggttgggtctttttttatgcccttctggtttctacacttgtaccggcggggttcaggcatgtagcattgaaaatggaatcgatgatgctcggatgcttggatgttttcccatttacg

SEQ ID NO: 335 - DNA, 763 bp, Fusarium venenatum
  misc_feature (1)...(763): n = A,T,C or G
cccatcttttgcctcaatatccatcgtcaaattttcacgctttgtgtcggtcaaggcgttttgcgagtttggagacaattttttcacttccatttgtctttttcctccgtctctctttatcttgtaccttattgcttctccggtttcaccggctgactcggccaggttttttgtgaggtgcatctatccatctgctatcatattccactcgacaagttacccccgcagttgttctgattagcgatcttgactgccgccttcctcctcccccacgcgaccctccctcatttctaccgcgggctcgctctcgccagcaaatactctcgaaatggcagaccaacacgaggtcgatctcgactccataatcgaccgcctactcgaggtgcgaggcagccggcctggcaagcaagtccagcttcttgaagctgagattcgatacctttgcaccaaggcccgtgagatcttcatttctcagcctatcctccttgagcttgaggctcctatcaagatctgnggtgatatccacgggcagtactacgatcttnttcgactnttcgagtacgggggcttnccttctgangccaactacctntttttgggtgattacgtccaccgaagaaagcaatctcttganacatctgcttgctcctcgcctacaanatcaantacccgaaaactcttcatccttcgaagcaaccacaaatgccctctatcaaccgtatttatngatctacaanaaatgcaangtcctataacatcnagc

SEQ ID NO: 336 - DNA, 657 bp, Fusarium venenatum
  misc_feature (1)...(657): n = A,T,C or G
catcgccgtccgttgactccgaaaagcttcaaagctacgactccatcacccatcgctccctgggttttccgaccaccatttttgaccgtcaatctttcacccgcaagaaagatttaattgcaatatttcaaaatggctggcgctgcacgagccctcggtttcatgtaccgcatggcggnccccgcctcagctgctgtcttcctaggcagccaggctctatacgacgtcaagggaggaactcgggctgttatatttgacagactgtctggtgtcaaggaggatgttatcaacgagggaacccatttcctcattccctggctgcagaagagcatcatcttcgatgtacgcaccaagcccaggaatatcgcaactaccactggtagtaaggatttgcagatggtcagcttgacactgagagtgttgcaccgacctaatgtcaaggcccttcccaagatctaccagaacctcggtgctgattacgatgancgagtcctcccctctattggtaacgaantcctcaaggccattgtcgcccaattttgatgccgcaaaactcatccccacgaganggtgtttccaccgtnttcgnaacaaccttacccttcgngccggcgaattnaaaatngccctcgangatgtttcatttnccacatgacn

SEQ ID NO: 337 - DNA, 658 bp, Fusarium venenatum
  misc_feature (1)...(658): n = A,T,C or G
ctcgaaatccacccaggatcgcgaatntttctcttcagcccgttaaccctcagctcgccaacagactcaagacaagacacctgtagtcacgtccagtcccgacaacacaagtcaattttttcaagatggctcaccccggatctcagatctccaagaggagaaagttcgtcgctgacggtgtcttctacgccgagctcaacgagttcttccagcgcgagctcgctgaggagggttactccggcgtcgaggtccgcgtcacccccaccgttaccgacatcatcatccgagccacccacacccaggaggttctcggcgagcagggccgccgcattcgtgagctcacctcgctcatccagaagcgattcaagttccccgagaactccgtcttcctctacgccgccaaggtccaagaaccgtggtctctccgtgcgctcagtggggagtccttccgatacaagctttttaacggtcttgccgttcgacgngcctgttntggggtcctccgtttcatcatggagtctggtgccaagggttgtgaggttgttgttttcggtaagctccgtgctgcccgtgccaagtccatgaaattcaccgacggcttcatgaatcactctggtcagcctgccaaggacttcattgaacacgccacccgtcacgt

SEQ ID NO: 338 - DNA, 577 bp, Fusarium venenatum
  misc_feature (1)...(577): n = A,T,C or G
cttggcttggaagctgcgctcctttggtcgtttctcttccggattatcgtcgacaaccactttgtcatcaacctttggttcgtcgtcaacaactaggcgtgtgaatggcttccgccagaagctccatgccgatagcccaagtgctttcgtaactgaatgcgttgaactccatcctagtggcaagactgcaatgcctgccagccactacggcataacttgcactgatattacccatcagggggttcaaggtcaatgtcgcggataanggtgtcccttgtgcgtgggtaacgtcgcgaatcgtgttccaacgctgattcctcctgacttattcagcgtgccgtaatagatttctccaccagtgctaaaccgcccgtagactctctccctatcactgtctgcangggcttggtcttccggcttctcaacatcaccgccgaaattatatacacccctgaagccgaacaatcctccatctgaagangccaaancttcgancgcgtactgcccacgtcatattgtgccaatcccantactgtgccgcccgttcttaangtgctgtgcanaaacacactgaatt

SEQ ID NO: 339 - DNA, 662 bp, Fusarium venenatum
  misc_feature (1)...(662): n = A,T,C or G
tnttctttcactcaagacgacgatttgaccatacataccacatctacaacgctgtacccagctcccttcaaactcttcttatacccactaacaagccaacaccgacataatggctgacaccggtcttcctgctggctgggaggtccgacactccaactccaagaacctcccctactacttcaactcggccgaaaagctgtcgcgatgggaacccccctccggcaccgacaccgagaagctcaagcactacatggccacgaaccatagcgctggttcgcgtcctggtgcagttcccggtgtccccgagggcaaaattcgcgctgcccatcttctcgtcaagcatcgcgacagccgacggcccaacagctggagagaggccgagattactcgctccaaggaggaggctttcgagatcatcaaggagcacgagcaaaagatcaagtctggaagtgtcagccttggcgaagcttgctctcaccgagtccgactgctcctcactcgcaagcgtgggggatttgggatacttttggcagggggagatatgcaaaaggagtttgaagatgcttcttttggtctttcttcaagccacatgagcgagattgtcgaaacaaccaagnggtctgcacttgaatgagcgtttggaataattggnaaaaaaagtt

SEQ ID NO: 340 - DNA, 570 bp, Fusarium venenatum
  misc_feature (1)...(570): n = A,T,C or G
tgacgagccggcaggctgatgagctgcataaatccatcatcgcctacctcgccgcaaataacctgcaagatagcgccaatgccatgaggacngagcttggtcttggagaggatgctttcgatccggccaccgctaagaagtacganaccctgctggagaagaaatggaccagtgtcgtgcgcctactaaaaaagatcatggatctagaagcgcagacccagaaccttcagacagaacttaatagcgctacaccgacatccctcgcgaatcgtagaggagattccgcatcttggcttccgtctggccctccacgacacntccttcaatcgcatcgaacgccaattaactgcgtcgctttccaccctattttctcttctatcgcgtccggagatgaagatgctaccatcaagatttgggattgggagtttggtgagcttgaaacgacngtaaaatgtcacaccaaagcggttctcgatctccgattatggtggtccaaaanggcacacantacttgcctcttgcagtnccgatttgacaaattaagcnttgggatccttcgaacgagtacca

SEQ ID NO: 341 - DNA, 623 bp, Fusarium venenatum
  misc_feature (1)...(623): n = A,T,C or G
ccccaagttaataccccaggtcgccgaacagatcagggaggagatgggtgtactagaagtattagaccaccccaacgtcgtctcatattatggtatcgaagttcatcgcgatcgagtatacatttttatggagttctgctcgggagggtcgttggccagtcttttggagcatggtcgaatcgaggacgagcaagtcatcatggtttacgcgctccaacttctcgagggtcttgtctacctgcacnaaagtggcattgcccaccgagacatcaagcccgaaaatattttactcgaccataacggaatcatcaagtatgtggactttggtgccgccaaggtgattgctcgacaagggcgcacacttgccggagatgtacaggcgtccatgccgaaccgatccatgacaggaacgccgatgtacatgtcacctgaggtgatcaagggcgaaaaccctggtaagcccgggtctgtcgacatttggtccttgggctgngtcatcctaaaaatggctacggcaggangccttgggcgcaactggacaacgagtgggcaatcatgtacaatattgntcaanggaacccccccagcttgcncccccggataactnaacccttangactcgn

SEQ ID NO: 342 - DNA, 1007 bp, Fusarium venenatum
  misc_feature (1)...(1007): n = A,T,C or G
aatgtctggagtcgacgagggttatgacatcnactcatctggcagnggtgcccttnaaaacagccttttcaaggtcgatgatcccgatctgcgcaagggcatgganacacttgttgtcaagtccatgcagagggccaagtnctacatctcaggaaagaccaacaagcaactgtggcctnantatgccctcaacctgcctttctacactcacttcaccagccccacccgccggtacgccgatataattgtgcatcgccagttggaggctgttctctccgagggcaagattgagttcactgatgacttggagaacctcgtcaagactgccgagtcctgcaacaccaagaaggactccggtcagaatgctcaggagcaaagtgttcacattgagtcttgccgaaccatggacaagaagcgacaggaagccaacggtgatctcatcgctgagggtattgtcctgtgcgtttacgagtcagcctttgatgtcctcattcccgaatggggattcgagaagcgagtccactgcnatcagctgcctttgaanaaggccgagttccgtaaggagaagcgtgtcctcgagctttactgggaaaagggtgtccctagctccgcgtttgtgcccgaagatgagcgacccaaggctgcggcattcattcgacacttcaacgccatcgctgctcagcgacaggctgaaggaggttgaacgtgcccgaaaggagcgcgaggaggcttgcccgtaagcaaaccgacaccggtaccatctctactgacgatgttgatgccttgttcgacgacnatgatgacaacacatcggatgttaccgangctatggccggagcttcactggctgaacgcccaactcagantgtcccggttccccaacccgatcttcatctaccgctggcaacctgcaccgcactcgctctgactcaaaggtaccgtggcagaacctgttganactcgcctcaccaacaagganaantatctcaacctgttctcgctccgtg

SEQ ID NO: 343 - DNA, 407 bp, Fusarium venenatum
  misc_feature (1)...(407): n = A,T,C or G
cgtacggttgcgtcggtggctatatcgctggtagcgccaagttcattgacgtgatccgatcgttggcccccggcttcatcttcactacttctttgcctcctgctaccatggctggtgcccaaacctctattgagtaccagatggagtacgatggcgaccgacgactccagcagctgcacactcgtgctgtcaaggaggctatgaacgctcgcgacatccctgtcatccccaatccctntacatnattcctgnactagttggcaacgccganaccgccaaggnggtttccgacatgnttttaacgactacggattttntgtcnatccataaattccccacgttcaaggngggnaggagcgttttttataccntacccccgccatgaaaggaatnccnaccatttttgc

SEQ ID NO: 344 - DNA, 628 bp, Fusarium venenatum
  misc_feature (1)...(628): n = A,T,C or G
tctcgatacgccttcgcgctatgcaaaggcgcttctattcctgaccaaggggtaccaggtcaacgccgaagacattgtcaacaacgctctgttcagagaaggacacagcgagatggtcattgtcaaggacattgaagtcttctctctctgcgaacaccatcttgtaccattcaccggcaagatgcacatcggttacatccctaacgagaccgtcattggcctttccaagctcccccgaatcgccgagatgtttgctcgacgtcttcagatccaggagccgtctgaccaaggaagtcgccatgccatcatggagatcctcaagccccagggtgttgctgtggtcatggagtcgagccacctgtgcatggtgatgcgtggcgtcgaaaagactaccaccagcaccattaccagctgcgttctcggctgttcgagcgcaagtccaagacacgcaacgagttcctcaactcatcggattacaagagattagangnagaaaccaaangtcggggactgncaaagtncgaacaattcttnaacatgctcatgatggaaatactnttacctatgaacacgcacatnacattntaggaaggnccttgctggtggattaccaggnncataccttgtt

SEQ ID NO: 345 - DNA, 573 bp, Fusarium venenatum
  misc_feature (1)...(573): n = A,T,C or G
gagactcaggtgccaagatcgctattcgtggcaaaggctccgtcaaggagggcaagggccggtccgacgccgcgcatgccagcaaccaggaagaagatctgcattgtctcatcatggccgatactgaagacaaggtcaacaaggccaagaagctcattcacaacgtcatcgagactgctgcatctattcctgaaggtcagaacgaactcaagcgcaaccagctccgtgagctcgccgccctcaacggtaccctccgagacgacnagaaccaggcttgccagaactgtggcaagatcggccaccgcaagtncgactgccctgagaagcagaactacactgccagtatcatctgtcgcgtctgtggtaacgccggccacatggctcgtgattgtcccgaccgccaacgtggtgccagctggcgcaacaccgatggtgcagcccgccctgctggtcgtatcgatagcggagatgccgttgatcgtgaatacaacaactcatgcnanaacttggtggaagatcttctggacccctgcgcgtntcnaggccngcctggcgctcaggacaacggcagcg

SEQ ID NO: 346 - DNA, 590 bp, Fusarium venenatum
  misc_feature (1)...(590): n = A,T,C or G
aatattttcccgatttgctggtctcgatggctcccaaggacgcaatcaccgatatggctgttgtgactgatgcgtttgttcctattatcaagtttgagtacttcggcatcagtatcgatttgattttctccaggatcatccagaagcaattggcaccggactttaaggatctcaaggactctggcttgctgcgcggactggatgaagcagagctgcggtctctcaacggcacgcgagtaacggatgaaattctcaccctggtaccggagcaaagcactttcaaaaacgctttacgagcgatcaaactatgggcgcaacgccgcgccgtttatgccaacattatgggcttccctggtggtgtagcatgggccatgcttgtcgcgcgcgtctggcaactttattccaaagctacgccagcagttatcgtcaacaaaatttttctgggtattagtcagtggcgcttggccggaacctggtcttntnaaaccaaatganggcnggccttttgcccgttcgtggtttggnacccccaagntatatnaaaggggacactttttaatcttatgccagncattaattcccgcctattc

SEQ ID NO: 347 - DNA, 561 bp, Fusarium venenatum
  misc_feature (1)...(561): n = A,T,C or G
gttcgatatacaccagcgaaccagatgggcgacaactccaagaagcaagaccgtnttatgaagattgttgagcgacagcgtgatcctatggaacccccgaaattcaagcacaagaagatccctngaggacccccttcgccgcctccgcccgtcatgcactcaccaccccgaaaactcacagccgaanacaacgagatgtggaggattccacccccagtttcaaactggaagaatcccaagggttttacagtgccattggacaagcgtttggctgcagatgggcgtggactgcaggatctggccattagtgataaacatgctcaatttgctgaagctgtcaagatggctgagcgtcaccctcgtgaagaggttcaacaaccgtgctatgatgcaacagcgtctancagaaaaggaaaaggcncagaaggaagacaaccttcgagacttggcccaaaaggctcgtgcggagcgatccgctgctggccgggggccgtanggattnccgcggttcttacgattntagggacttttanaactncgaggccncnatcgcgaagtttt

SEQ ID NO: 348 - DNA, 612 bp, Fusarium venenatum
  misc_feature (1)...(612): n = A,T,C or G
cgcatccacctccatacccagcatcgccaaatttcacagcgacaaccgccgccatgggtatcgatctcgaccgccaccacgttaagggcactcaccgcactgcccccaagagcgacaatgtctacctcaagctcttggtgaagctttaccgcttcctggctcgccgaaccgatgcctctttcaacaaggttgttcttcgacgtctgtttacttccaagatcaaccgacctcccgtctccttgtcccgtattgtcgccaacatcaacaaggagggcgagaagcgaaccgttgttgttgtcggtaccatcactgatgacaaccgtctgctcgagtgccccaaggtgaccgtcgctgctctgcgattcaccgctactgcccgtgcccgcattctcgctgctggtggtgaagctatcaccctggaccaacttgctctccgtgctcctaccggaagcaacaccttgatcctccgtggccccaanaacgcccgtgaagctgtcaacatttcggcttcggtcccacagccacaaaaaccttatttcnattccaagggtccaattcnaacgtgcccgtggcgaaaanttctcgtggttcaagtctaagcgtttatggtga

SEQ ID NO: 349 - DNA, 608 bp, Fusarium venenatum
  misc_feature (1)...(608): n = A,T,C or G
cttcgagttgagttgtatcgatgctctgctcagcattgtggagcttacgaacgcttccctcgatacggtgatgtttggcgattattgcaaactcgacgaggacgtgttggtgaatgggccaactgctttagcatgctctgccgagctgtcggtggtcgtgttcgctgggtttggaacgccgaagaccatgtctggaccgaggtttactctgaccaccagaagcgatgggttcatgtggacgcttgtgaggaagcatgggacaaccctcgtctctatgccgagggctggggtaagaagatgtcttactgcatcgccttttctattgatggcgctaccgacgttactcgacgatatgttcgtaagaaccaacacgcttctgagcgtaacccgatgccctgaggagggtcttctctacgttatgcaagagattaaaaacatgcgtcgctccaacatgaacaaaggaccaagcgcttccgattggagaaggaagacacccgcnaagataaggagctttcaagnttccgttgtggcttcaaattgacaaaccgtgactgacctcgtccccggttccctggnggatccaacncacaacaancagtggaagcgat

SEQ ID NO: 350 - DNA, 601 bp, Fusarium venenatum
  misc_feature (1)...(601): n = A,T,C or G
gagcagcttgcncntgccctccgtgacgaggtcgtcgaccttgagaaggccggcatcgacgtcatccaggtcgatgaacccgctctccgtgagggtcttcccctccgctccggtgaggagcgtgacgcctacctcaagtgggctgtccaggctttccgcctgtccaccgctggtgtcgaggatgccactcagatacactctcacttctgttactctgagttccaggacttcttccacgccattgctgctcttgatgccgatgtcctctccatcgagaacagcaagtctgatgccaagctcctccgtgtctttgtcgactctgagtacccccgccacatcggacctggtgtctacgacatccactctcctcgtgtcccagcgaagcaggagatcaaggaccgcatcgaggagatgcttcagttcctcaagcctgagcagctctggatcgaccctgattgtggtcttaagaccgtcaatggaaggagactaaggangcgcttaccaacatggttaacgccgccaagtacttccgaaaacaagttactccaaatnaatgtcgaccaacactatgtgttgtaagggttgatgtttctgggaatgt

SEQ ID NO: 351 - DNA, 567 bp, Fusarium venenatum
  misc_feature (1)...(567): n = A,T,C or G
ggctcacgtccacgcctttggacaagttgcccctgctgccgctggtatcatccactacggcgcaacaagctgctacgtcaccgacaacacagagctcatcctcatgagagacgccctcgatattctcatccccaagctggccaaggtcctctccaaccttcagtctttcgccctcgagtggaagaacgagcccactctctccttcacacatctccagcccgctcagatcagcacagtcggcaagcgagctgccgcctgggcccaggatctcctcatggaccttcaggagttcgagcgcgtccgatctgagctcaagttccgtggtgcccagggtaccaccggtactcaagccagtttcctcgagattttcgctggtgatcatgacaagtgcgacaagatcaacgagcttctctgcaaaaaggctggtttcgaagaatgctacnatatttctacccagacatacacccgaaaagtcgactgtcttgttgccaacgccgtcactggtctcggcaccagtgctaccaagaatgcttctgatctgcganatcttgccaccatgaaagaagt

SEQ ID NO: 352 - DNA, 880 bp, Fusarium venenatum
  misc_feature (1)...(880): n = A,T,C or G
gctgcaactactgcccaaacaaccgcaagaggggcaagctggccgagctgacgaacacagacgttagtcaaaatcgccaaaggagaaagcacaactgggtcctacgctgatgaccgtgctgggttttgatgctctcaaaggtgggcaacaatgtgaagctacctttcctcggactgtttgcgcccagcgacatccccttcgagattgaccgccgaaaccacaacgatatctacccttcgctgagcgagatggccaagactgcccttcgtgctcttgagaaggctactgagaagagtgacaagggtttctttatcatgattgagggcagtcgaattgatcatgctggccacatcaacgatcccgccgctcaagttcacgaggttcttgagtacgacaagaccttccgagctgtcctcgacttcatcaaggagagcaagaccgagactgtcctggtcgcaaccagtgatcacgaaacaagcggtctcgctaccgcgcttcaggaacctggtcacctccctgtttacaactggtaccctaaggtcctcgccaacgcgactgcctcagctgagtggctccacgccgaagctcaacgcccatatcgcctctaattccgaagccaagaagaacaaggaaaagctcaaggagtatatcaacgaggaactcatcattccgtggtctcggcatcttcaatgcttcggacaaagagattaccactattgccgagcaccccgagagcgcacttggtctcttcttngntcttatttctnttcgcgcccacattgggttggagcactcacngncattaccgccggtgatgtcaacatttacagcttcgggtggaccacgaacaagagaacattcgcgggaacgtggagaacan

SEQ ID NO: 353 - DNA, 857 bp, Fusarium venenatum
  misc_feature (1)...(857): n = A,T,C or G
gccgagtttgcaggccagacagctgaacgaggtggtctcatgtggcttctcttctggcaattcctcatcttcacttgtacctttgcgcacgccgccatcgcgattaccgatacagctgaagcgggtggtaacttggccaacgtcgtcttcatgctctcgctcttcttctgtggtgttttggcttcgcccgataacatgcccggtttctggatctggatgtaccgagtttcgccattcacctatctcgtgtcagcgatcttgtcaactggtatcggaaacgcagaggttacatgcacagcgcaagagttgaccacatttaaccctcccaacggaactacctgcggagaatatctggagtcgtacatggcgcaagctggtggttacttgactaactacgacgccacatccgactgcaagttctgcaccatcaaggacaccaacgtttacctcgaggcactcagctctagctatgataaccgttggagagactttggtattggaatggtgtacatcgtcgtcaacattgttggtgctctgttcttgtactggcttgnccgcatgcctaagaacaagaacaagaagcagaagaaggcgtaaacaattcatagtttgggctctaccttctcttcttattttgacttgatctttctcttcttttctcttcttttttgggtaatggtttggagattgttatagaagtggtggaattgtatttagaatcgcaataatagaatagaaaatggtgtttgtggggataatgattagtttctcttatgagttatgcgtccttgctctccgaattaatgttttctgggaatgaaaattgatcaaattgactgactcattgcgaatggaga

SEQ ID NO: 354 - DNA, 1941 bp, Fusarium venenatum
  misc_feature (1)...(1941): n = A,T,C or G
catccatcatcaactgtcaaaatggccaaccttccccccgtctacatcgtctctaccgcccgtacgcctatcggctctttccttggctctttgtcaagccagaccgctgttcaactgggctcagtcgccatcaagggagccgtcgagcgtgccggtattaagcctgaggatgtcgacgaggtcttctttggcaatgttctctctgctggtgtcggtcagggccctgcccgccaatgtgcccttggcgctggtctccctcaaactgtcatcgccacaaccgtgaacaaggtctgcgcttcttcgctcaaggccatcatccttggtgcccagaacatcatgctcggcacctccgatatcgtcgttgctggtggaaccgagtccatgtccaacactcctcactacctccccaacctccgaaacggtgccaagtacggcgaccagaccctcgtcgacggtgtcctcaaggacggtctgaccgacttcttcaagaaggaccacatgggtatctctgctgagctctgtgtcgatgaccacgaagctnacccngtgangcttcagagacgaagtctccatcaactttacaaaataatgctgctcctgaggtcggcttttgctgaaatgacactcgtgtcaagcactgaggaaggcccagattcggggcaaaacctacaagtacattgtcggtgaacctgagggtacccctctagaaaccatggttctcatccatggtttcccggatcttggttttggctggcgctaccaagttccctacttcatgtctctgggattccgagtcattgtccctgatatggtggggatacgcaggcactgatgccccagagtccctcgaggagtacacatacaagagcctctctgcagacatcaacgagctggctcgcaagtatgtcggcgaaggacggacagatcgttctcggtggccacgattggggtggcatgatcgtctggaaggtctctacctggtaccctgagttgatcaagtgcgtcttcagtgtctgcacaccctacatgcagcccagagaaacttcctccctctcgaagccattatcgcaagcggtcaccttctcaactttagctacaactgcgactcaagggtttgacttcgagccatcaatactntcantcatggcgaactggcnagcagtataatccctttggaaaaagggactctcactcgaacaatacgatcctcacctacaagattctgacccttatcacctggatcctgtcccttgtcgttaccgtttactatacccttcaccgtcccgacgatggccacactcgaaaccgaaagatctgggagcagaaccacatgtaccgcactgctttcactctgaacccaatcatcacctccatctactggattgtcctcttcatcctccaggctggttacatcggacatcttttctcgagcaactctgacatcgttcacgctgctgccagcgttggaagccacttcatcttcaacaacctcttccacttcgcctttgtcatgctctttgttcgctctcacttccactgggctgaggttatcctgattctcaacttcatcaatctttcctcgctctacttccgccacaacacctacccccgatttatccacactcccgttgtttctggacctttggcctggacttttgttgccattactggaacggtgctctgatgattccgcatcctcacaacttgtccctcgtatctttggnaacatcttcatctggtccatcctcgcctaatggactcttcttcatcatggtttacaaggattacacaatgggtttctcgctcagcgtctttgctgccgctattggagtttcccaattccttcaccaggtgattgccttccagtggatctttgcctttatcaatatggctcttctctttatcgccactgncgtcggtgctgccctgctgcaacaagca

SEQ ID NO: 355 - DNA, 796 bp, Fusarium venenatum
  misc_feature (1)...(796): n = A,T,C or G
caacaaaagtcctattcctccgccacccgaggatatcgttaaatcccacccttcgattctccccgcggatgcagtttggtcttggtcattgtgactttagttgatgatggcttcttctatggcaatgaggaagttggccctcggccctgccttcacaagggccgccaggttccctacccgagctttctctacaacccgacctgtttcccgagttatcactggaaaccgcccctctacgagccaaggaggcctctcctttcgtgagcaacaaatacgctgtctatccaccaccaaaatgatgctatcgttgttggtgctgggggtgcccgtctgagagctgccttcgagcctcgccgaggatggtaaaaacactgcctgtatctacaaactattgccgacccgatctacaatgacgctgctcagggtggcattaacgctgctctaggtaacatgcacgaagacgactggcgatggcacatgtacgataccgtcangggttcgactggctgggtgaccaagacgctattcactacatgacccgagangcttccgttttattatcgagctttgaaactacnggtggccttttacgaactgaggacggnaagaattaccaacgagcttttggngggcagtccaaggagtaccggaaagggngggcaagcctaccgatgcttggcttgccgttgacnaaccgggcacgccntttttaaanttttttacggcnagtccttccgccacaaaaacaactatttattngagtntttccccctcaacctgattttgcaggaagggg

SEQ ID NO: 356 - DNA, 633 bp, Fusarium venenatum
tttttattttcttctactgtgccgttctgttttgtcttgttacatcttgataccccacaatctcccccgaaatgcctattacacaacttagatccgctggccggctggcccagcttgctggacatgtgaatggcgcacgacagttctctacacgcccagctctgcgcaaggaacttaaagatgcctatattctaagcgctgcccgaactcccactgcaaagttcaatggctcgttcctgtcagtgtcggctcccaagcttggcgctgttgctatcaagtccgccctaaaaaagtcaaaggtccccgtcgagaagatcaccgatgtgtatatgggcaacgtcctccagggctctgtcggccaagcgcctgcgcgacaggctgccatctttgctggtctacccaaggaggttgaggcgacaactattaacaaggtctgcgcatctggacttaaggccgttactttggctgctcaaaaaatccaaatgggtctctctgaggctcaaatcgctggtggaatggaaaacatgtcccaaagtcccatactatgtgtcgcgggccaacgggcctcctgcctttgggccacgtcaaagatggaggatgggcctaacaaaggatgggttaaccgatgtgtac

SEQ ID NO: 357 - DNA, 695 bp, Fusarium venenatum
  misc_feature (1)...(695): n = A,T,C or G
cctcttttcaccgccttcttcaagcctttcccctccagtccccgtttgtcattctactgtttcctcctctgttcctacatctcaagtcataccagacaagaatatcgccaaaatgtcctcctccgagcagaccttcattgctatcaagcccgacggtgtccagcgtggactcgttggccccatcatctctcgtttcgagaaccgaggcttcaagcttgctgccatcaagcttgtcacccccggcaaggagcacctcgagaagcactacgctgacctcgctggcaagcctttcttcgctggtctgattgagtacatgaactctggccccatctgcgccatggtctgggagggccgtgacgccgtcaagactggccgttccatcctcggtgccaccaacccccttgcctcttctcccggtaccatccgtggcgactacgccatcgacgtcggccgcaacgtctgccacggttccgactccgtcgagaaacgcccagaaaggagattgctctctggttcaaggacggcgaggttgtctcctggaaagtccgcccagttcaactgggtctacgaaaaggcttaaatctgtcattgatatgacaccctaaatgacggaatggaaaagcacatataagtgggatgacttcatctntgngggtatatcaaaatcaaagacaaaatcttctcaaaaaaaaaaa

SEQ ID NO: 358 - DNA, 541 bp, Fusarium venenatum
gtgtgaatttcatgaaccttcaactttgccatgcaggctaatcgaatcaggttatcaactctgccgccaagaaccctctacatttctgggaaggtatccagccctgcaaacatcaccttccgtggtcccaatgggttccctgctggttttgccgctcaccactcccaggaatactccgcctggtacggcagtattcccggtcttaaggtcgtttctccctggaagtgccgaagatgccaagggtctcttgaaggccgccatccgtgaccccaaccctgtcgttgtcctcgagaacgaattgatgtacggtcagagcttccccatgtccgaagccgcccagaaggacgacttcgttattcccttcggcaaggccaagattgagcgatccggcaaggacttgaacatcgtgtccctcagccgcactgttggccaatctctgattgccgctgaaaaactcaagaagaaatacggtgttgaagccgaagtcatcaacctgcgatccatcaagcctcttgatgttgaaaacatcatccagtccgtt

SEQ ID NO: 359 - DNA, 819 bp, Fusarium venenatum
  misc_feature (1)...(819): n = A,T,C or G
cagaaaatgagtattaacttaagatctagctattcatgataaaatcactcactctcacgtgatacccctcactccacgccacgtgccttcataaaatccaccatatcgaagaaactcttcttatatcgcctctcctgcgtcgtcctgttcactgtttggatcccaaactgagcagaataatctccaaattcccaattatcactgaaagaccacgcataggctcctataacttcaactccgtcttcccagatcgccttgagagtctcggacaagaagctcaagtagtagatgcttcggggtgtatcaaacagctgatcagatagctccttctctgcctcgccgaaaacagggaagccaaactctgttagagctacgggggttctccatgtgttgtgcagatagttgaggtagcttcggaggtaggtgggtgtgatgtacacgtagctgtaagaccggtagcccgatgttccacccgtgacngtcgtagtagtttgattgacgcagtaccgtccggaagtagaagatgagtttgatgcgcatctanaatactgnccttgncgtctnggaacangtggngcgataccgnggcagtatatggatcgatgccataaagcagccgngcccgccatgtacttganacttcctcnttaacgggacaaagtcatcaaaagctttttaaatgactcgggtaatcttggccaggtanataggatgcaaaagggnccanttggatggattgaatgggccggaacatatcattcncctacttttngganccgagggaaccnaagtnttggtggaacttgacncaatnttcct

SEQ ID NO: 360 - DNA, 546 bp, Fusarium venenatum
  misc_feature (1)...(546): n = A,T,C or G
ctctggtttcccctttgccggtgctgatgttggaggcttcttcggcaaccctgagaaagacctacttgtccgttggtaccagaccggtgtgtggtatcccttcttccgagctcatgcgcacctcgatgcccgacgtcgagagccttatctcctaggcgagccttacactcagatctcgaccgccgntatccgactccgatacactctcctgcccgcttggtacactgcgttccacagcgcggcacaggacggaagccccattatccggcccatgttctggacgcaccccactgaagaggctggctttgctgttgaggatcaattcttcgttggttcaaccggtcttntggtgaagccggtcacggagcagggcaaggaatcaagttgacatctggattcctgatgatgaaatctactatgactactttacctacgatgttcaaaaaacaaagcaagggcaagcatnttacagngagcgcaccactagaaaaaattccattctacttccgagggggacatattattccttgacgcgacacttcttga

SEQ ID NO: 361 - DNA, 611 bp, Fusarium venenatum
  misc_feature (1)...(611): n = A,T,C or G
aaagagtcactgagcatcgtccattttcaacccaaaacaaacaccatcaaattcacctacgacatcgttgcccagcatgtcgatggacttggatgaccagcctatctccatagcccctgtcgctcagcagcagggtgctgcaactattctgtgctgcaactgtggtgccccgatcgatggaactgcatcatctggcgctctctgctatgactgcatcaagctcactgtcgacatttcccagggcgtccagcgagaggcgacgctcaacttctgccgagactgcgaccgatggctcatgccccccaccagttggattgtcgccgctcccgaatctcgcnaactgttggcactgtgcctcaagaaacttcgaggactgaacaaagtccgtatcgtcgacgctagtttcatntggaccgaccccattcgcgaagagtcagggtcaagatcaccattcaagatgaagtacaggacgggntgctgctccaacaaactttcgangncgtgtatgttgnggcgtaccaacagtgccctgattgngccaagtcatacacttgcaacntntggggaacccgttntccaagtcccccnaaanggtttttanaagcgaaacn

SEQ ID NO: 362 - DNA, 434 bp, Fusarium venenatum
  misc_feature (1)...(434): n = A,T,C or G
gaactaccccctcagtcgtcgctttcgccgaggatggtgagcgactcgtcggtgtcgctgccaagcgtcaggccgtcgtcaacccagagaacaccctcttcgctaccaagcgattaataggacgaaagttcaaggatgctgaggttcagcgcgatatcaaggaggttcttacaagatcgttcagcacaccaacggagacgcctgggtcgctgccgtggccagaactactctccctcccagattggtggnttcgcctcaacaagatgaaggagaccgccgaggcttacctctctaagcccatcaagaacgcccgtcgtcaccgttcccgcctacttnaacgacttntnagcgacagagcaccaanggtgctggtcaaattggcggcctcaacgtncttcgtggcgtcaacgagcctatggcgccggttttgctta

SEQ ID NO: 363 - DNA, 589 bp, Fusarium venenatum
  misc_feature (1)...(589): n = A,T,C or G
gnaggaagcagccaaggctgccgaggctaagcgcgccgaatacaacctgcctgccgtctctggcgtccagcacaagaagtccgacaaggttgctaagcttcaagatctcgaggaggctgttggtgacaacgccgcaganaanaacgtgctcttgtccttgacaagacccgaggtttcaagatgtacaagcgccgtcaggagaagtaccgacctgtcaacgcccgtctcaaggactgggctgagctgagttcccgtcttgaggaggatgagcttaagtaccaatctgctcgttgtatggattgtggtgttcctttctgtcaatctgagactggctgtcctatctcgaacatcattcccaaatggaacgaattagtcttccaaaaccagtggaaggatgctctcaaccgtctcctcatgactaataacttccccgaattcaccggtcgtgtctgccctgctccttgtgaaagtgcttgtgttctgggttatcaatgaaaaccctggtggcatcaaaatctatcgagtgttgcaatcatcgaccgaggtttccaaaatgggctggatggggcctcaacctcccaaggttcgc

SEQ ID NO: 364 - DNA, 568 bp, Fusarium venenatum
  misc_feature (1)...(568): n = A,T,C or G
caacgaggatgttgacaacaactntctctacactcagcccgaggacattctcaacatctacaacaccctctctcccatctccccctacttctccatcgccgctggctttggcaacgtccacggtgtttacaagcctggcaacgtcaagctccaccccgagcttctcggcaagcaccaggctcatgtcaaggaggccctcaagtccgacaacnacaagcctgtnttntttgtcttccatgggggctccggctcctccaagaaggagtacctcgacgccatcggctacggtgttgtcaaggttaacgtcgacactgacatgcagttcgcctactgctctggtatccgagactacatggtcaacaagcgcgagtacgtcaacaccaccgtcggcaacccagatggcgaggacaagcccaacaagaagtnctttgacccccgtgtctgggtccgngagggtgaaaanaccatgtctaagcgtgttgnttgangctttngangactttaaccccgccaaccagnttntaatgcccccggaaacacctcaanggntttaaatgatatncccaat

SEQ ID NO: 365 - DNA, 630 bp, Fusarium venenatum
  misc_feature (1)...(630): n = A,T,C or G
ctttcttggtggcgaggccacttcaaaggacgagaggaagcttgtcanaaaattagatttcttcattcttacctactgttgtttcagttacttcttcaacttcttggatcgctctgcgtttgctaatgcctatgttgctggtcttcgtgagtcactcaacatgagtggccatgactacaacaacgttntttctgtcactaccgctggaatggccatcggccaactacccaacggtatcatcatccaaaaggtcaggcctcgcatttggctaccttcgatggttgttttatgggccgccatgactatgctgagtgctgctgtcacaaacgtcacccaactctgcgtcatccgtttcttccttggtctcgctgaagccagtacatactctggcgccatgtacatcatcggagcatggtacaagcctgaggaaatccaaaananaactgccctgtttggtgtatctggacaaatggnaccatgttcgctggcgtgatgatgacgccattcataagggcatgaaaagaatggctggactacaaggttggcagngggtattcatcatcganggaatcattactcttnccattggcgctttgggttcctctacttccctgatacacctgaaaacnt

SEQ ID NO: 366 - DNA, 505 bp, Fusarium venenatum
  misc_feature (1)...(505): n = A,T,C or G
ctcccatttctcaatccacctacttcatgcacaccgaccccaagatcttccctgagccctccaagttcaggcctgaacgatggatcgaagctgcagagaaacagattccactcaagaagcatatcaccaacttttctcagggctcaaggcagtgcatcggttacacaatggcctttgctgagatgtatcttgctctttctcgcattgttcggggttacgaggttgagctttatgacaccaccaaagcccgacattgacatgactcacgcccgcattgttggctatccnaaggcaattcaggcaagaccgagcatgttggtgaaattngantcaaaggttctcaaagctttggaaactacaatcgggactgtcttactatcatgctggatatctcactgaatcaacgggtgttctctttgtncaagttaatttcggtatgcgaaggatgaaaagttcataatantnacatttaaatattgaaatcaaagtnctttatttaaactcg

SEQ ID NO: 367 - DNA, 589 bp, Fusarium venenatum
  misc_feature (1)...(589): n = A,T,C or G
gccttgagggcggcagaacaacctccagagcaagatgaagtactccctctttgtcggcgcctcggcaggttccgagacggagaaccgatgggctgctctcgacatgatcaacagacgaagccctcaccaggtcggcaaggatattgccaagggaatcaactctggacgcatcaacttcttcgacaagcatctgtccatgttcccctctgatctcgtttatggtttctacaccaaggaccgtcccaacagcaaccttgatgtcactgttgtcgaagctaccgacattctcgangatggcagcttcgttcctggtgcctctgttggtgctactcctgagctgatccaaatggccgataagatcatcatcgaggtcaacactgctatcccctccttcaagggtcccacgatatcacctttaccgactcctccccacgcacacttacaacatcaccgccgttgaagacgaatggtccattcgtcaanatgaccctccaagtctcctatctcattcgatatgggagcacggtccacccctatggacanactctcccanatgcggcattgataatctcacacaagtcccaggtnc

SEQ ID NO: 368 - DNA, 622 bp, Fusarium venenatum
  misc_feature (1)...(622): n = A,T,C or G
ttcgagaaccaagatattgctctcctccgcaagccttactctcttgatgcctccttcctgtctgccattgaggaggatccctgggagaacctgtccgagacaaacgacctcttcaacaagaagctgaacttgaagtgcacacaacccgagcttgagcttatccgcagaaccgccgagctcatcggcacacgagctgcccgcctctcggcctgtggtgttgctgctatctgcaagaanaanaactaccaatcttgccatgtcggtgctgacggttccgtattcaacaagtacccccacttcaaggagcgtggtgccaaggctctgcgggagattctcgactggcccgagaaggccaacaagaaggacgaggaccctattgaagtcctgactgctgaggacggtagcggtgtcggcgccccctgattgccgcctgaccttaagcgaatcaacgagggtaacatggngggtattcttcccccgagaacttnaaataaactcaaagcggaatcnatttaacaaaggngngagggaaacacaacngtttaaaaatggaccggaaaatgganaaaggggtgtcttgnatatanccngataacacgangggatctcanggctacgaang

SEQ ID NO: 369 - DNA, 615 bp, Fusarium venenatum
  misc_feature (1)...(615): n = A,T,C or G
gctccttaccggtgacaacgatggtctcatctacgtgacaacacgcaccgacggaggtggctgggtcactgacaaccgacctttccagggccaccagagcagtgttgaggagttgcagtggtcgccgtccgaggcttctgtatttgcctctgcctcaagtgacggcaccgttcgcatctgggacgtgcgatccaagtctcgcaaggctgccatcaccatgcaggtgtcaaatgttgatgtcaacgtcatgtcttggtcgcgccagcaaactcacctcctcgcctccggtgacgacaacggtacctgggccgtgtgggatctccgccagtggaaggccagctctgacaagccccaggccatcgccagcttcaacttcaacaaggagcagatcaccaagtgtcgaatggatcccaccgacgactctattgttgccgttgccgccgccgacaacactgttaccctgtgggatctggccgtcgagctggatgatgaggagagcaaggacacagccggcgtcaaggatgtgccgccccanctcctgttcgtgcactacctgaaggacgttaaggaggtacactggcacccccatatcacgggaagcttggtcgccacggg

SEQ ID NO: 370 - DNA, 720 bp, Fusarium venenatum
  misc_feature (1)...(720): n = A,T,C or G
aaacaactacggctccagcatcgacaattcgactctcattctcccacatagatatctcgtcatcgcccacactcccagatatcaacaaatcttatacttgcagaagttttagacgataggagacttgcggatttcatcatgccttccgcaaccggctcaaactgggagaagtaccagaagacttttgccgacgatgaggtagaagagaagaagatcacacctctaacagatgaggatatccaggtcctcaagacctacggtgcggcgccttatggaacgtctatcaagaagcttgaaaagcaaattaaggagaaacaacaaagcgtcgatganaagattggagtcaaggaatccgacacaggacttgcgccaccgcatctatgggatatcgctgccgatcgccaacgaatgtccgaagagcanccctttcaagtagctcgctgtacgaanattatcgccgacgagaagggcgatgagtccaagaacaagtntgtcatcaacgtcaaacagatcgcaaagtttgtcgtacagcttgganaacgggtcaccccccggatatcgaggagggcatgcgggtcggtgtctataggaacaaagtccagattatgctttccgctgcccccaagatccgacgcgagtgtacgattatgcccgtggaaaaaaaagcctggcctnccctacggcgatnttggtngttgcaangaacaggtnaaaaaggnn

SEQ ID NO: 371 - DNA, 745 bp, Fusarium venenatum
  misc_feature (1)...(745): n = A,T,C or G
taaaatctttgattttgcttctcttttctccttttcaattgaactcttccaagtttattgtcttgctattcacaagtgcccaacatgcaggcgcgaagacaactaatcacatcaacgcagcgcatggctgctagtgcccgggctcgatcagtccggccacttacacgagtaatcgcaacacaacctttaagaccaacatcccttcgcttaataccaagcattgcagtcaggacatatgccaatggccgacctcatcctccaggcggtactcaccgcatgaatatgggtggtgatgaggagaaacctgctctggaacaatttggtgtcgacctgactgctcgagccaaagacggcaagctggatccagttattggcagagatgccgagattcagcgaacgatccaaattttgtcgagacgtaccaagaataacccagttctcatcggtaatgcaggaactggaaagacagcaattcttgagggccttgccttcgtattgttcgtggcgacgtncccgaaagtgtcaagaacaagagggtcatcagtcttgatctcgnttccttaatcgccgggccaaagtttaaaggagatttcgaagagagactgaagaaggtctttgacagaagnggagcanggccgaagggagaagtaattctattcatcgatgagttacacaccctcttgggccttngnaaagggtgaaggttccttcgatgccttnaaccttttgaanctgnttttacttg

SEQ ID NO: 372 - DNA, 735 bp, Fusarium venenatum
  misc_feature (1)...(735): n = A,T,C or G
cttcatctcccttttctcccccttcttcccttcttcctcaaccacaactttccaactatttcgctgcctgaaacccaacagtcattgcgacacttgaattccaccactcttgacagcacacttaccgcctccacaacaaccatcaccgtcaacatgcgcagcaaattcaaggacgagcaccctttcgagaagcgcaaggctgaggccgagcgcatccgacagaaatacgctgaccgtattccggttatctgcgagaaggtcgagaagagcgatatcgcgaccatcgacaagaagaagtacctggttcctgccgatctgaccgtcggccagttcgtctacgtcattcgcaagcgaatcaagctatcccccgagaaggctatcttcatcttcgtcgacgaaggttcttccccaaacagctgccctgatgagcagcatttacgaggagcacaaggatgaaggacgggttcctatacatcacctactccggcgagaatacctttggcgaaacgtaaggccgatgatgcaggatcggtttatcttccaagtcnggaatgacgaaggcgttacggncgtattttgggtgaatgttttgatggncacttgncatgttcttatcaactttccggggccaaaaaaccggactcgaataaaatgcttaatggcccattatgggaacaatacatccttcggngttgncccatagggcaccaccacntnttgtaccnccaaaaaaaa

SEQ ID NO: 373 - DNA, 593 bp, Fusarium venenatum
  misc_feature (1)...(593): n = A,T,C or G
agatccaccacgagtcagcagcccgtattggagtgctcgcgtccggctgaanaaagtcgttggtaggggtatgtggtaaaggtaaggtgcggttcgtcacgtcgtcctgcattcgctaatagtcgaactcaagangggcgtctttagctctcgaattcgangggcaatatagtcgttcgaacgcagatggtatagaggccgcgagcacgtactggcattcatatatccanacaaatagtttcatggtcgcgaacgacaattagtaagcccanattttaagcaaagaatcccatgatcctgtgcacaggcttgtaccgtnattgctcactcccaagcagctgacacggttctngtggccaaccagagagccaaccttttcacctngggtgatatcccagaccttgcactcaaagtcatnataaccggcgaaaaggagaccgccccacacaaaagtagcgacggaagtgataccgcaaanaatggactccnacccgtagagggtgagctcgccatccccacngatattaaaaagtcgacaagtaccatngtcggaccggtaacnaaagagtggccatcanggaaaaactggatgg

SEQ ID NO: 374 - DNA, 601 bp, Fusarium venenatum
  misc_feature (1)...(601): n = A,T,C or G
cacaaggtcaacggtgttgcagagctgcattcagatctcataaagaccacaatcttcaaagacttcgtcgaaaatctatggtccagacaagttcattaatgtcaccaacggcatcactcctcgccgttggctccaccaagccaaccctcggctttcggagctcatcgcttccaaggttggaggcaacggtttcctcaaggatcttacacaccttaaccaactcgagaagtatgccgaagacaaagagttccgaaaggaatggtcggagatcaagtacgccaacaaggtccgactcgctaagctcatcaagtctaccgtgggtgtcactgtgaatccttccgcgttgttcgatgtccaagtcaagcgaatccacgagtacaagcgccagcagctcaacatctttggcgtaattcaccgatacctttaccttaagtctctatctcccgaagagcgtaagaaggtcgtccctcgtgtttccatctttggaggcaaagctgcaccgggctattggatggcgaancagaatattcatctagtcaatgctgtcgggctccgtagttaaacaacgaangaggatattggtgaccttctcaaaggtgat

SEQ ID NO: 375 - DNA, 794 bp, Fusarium venenatum
  misc_feature (1)...(794): n = A,T,C or G
gctctagataccctcaaccccccgacatcaacaccacagccggcaggatgaagtacattcactcccaggagcttctcgagatccccgagggggtcaaggttgccattaagtcgcgaattgtcactgtcgagggtccctgcggcaagctggtcaagggatctcagccacttggccgtcaacttcaccagcaccaagaagaaccagatctccatcgagatccaccacggtgtccgcaagaacgtcgctaccctccgaactgtccgaacccttatcaacaacctgatcattggtgtcaccaagggcttcaagtacaagatgcgatacgtctacgcccatttccccatcaacgtcaacgtctcccagaactccgagaccgacttgtacgaggttgagatccgaaacttcatcggcgagaagctcgtccgccgaattgtcatgcaccccggtgttgatgttgaggcttccaccacccagaaggatgagcttgtcctctctggtaactctcttgagaacgtttcgcaaagtgctgccgatatccagcagatctgccgggtgcgaaacaaggatatccgaaagttcttggatggtctgtaccgtcttccgagaagggcaacgttgtccaggatgaataaacgcgaacacggacaccggatcttgtttcttttggcgtttctgggtctcaggagtggcgaaaggttcatcttgcatgtcatgtagcaaaaaagaaagggctaccaaacaaaatttcaaaaagcaaaagagatgatgaattttggtggcccgananaaaaaaa

SEQ ID NO: 376 - DNA, 627 bp, Fusarium venenatum
  misc_feature (1)...(627): n = A,T,C or G
gcttatccatgccaccttaactatcgcaatcctctactttctcaaacaacccccgttttaaacctttagccttgcttaatcaatatgctttcttttatcctcattcaaaaccgacagggcaagactcgtctcgccaaatggtatgccccttttagtgacgagcaaaagatcaagctcangggcgaagtccaccgtctcgttgcgccccgcgatcaaaaataccagtccaactttgtcgagttccgcaacaacaagatcgtctaccgccgctacgccggtctnttnttctgcgcctgcgtcgacacaaacgataacgagctggcattcctngaggctattcacttcttcgtcgaagttctcgatgcctttttcggaaatgtctgcgagcttgaccttgtcttcaacttctacaaggtctatgccatcctcgacgaggtgttcctagcgggcgagatcgaagagacgagtaaagcnggttgtgctcacgcnggtggagcatctcgacaaattaaaataaacccgcncttccacgtttggaggctcgaaaaaatatgaaaataaccaaggccntttttntttntttttttttnccccgcatatcaaaagtggaatttggatctaatataa

SEQ ID NO: 377 - DNA, 646 bp, Fusarium venenatum
  misc_feature (1)...(646): n = A,T,C or G
ggcccgcggagcactcaagactgtacataattttcaacacgactacaaccttcaataatcatatccgggtcgcttcagtatcttcaaaatgtcattcggtggccaaacgccaacgattatcgtcctcaaggaaggaaccgatacttctcaaggaaagggacaaatcatctccaacatcaatgcctgtctcgctgttcaggctaccatcaagtccaccctgggtccctacggcggtgaccttttgatggttgatgagaatggccgccagactattaccaacgatggtgctaccgtcatgaagcttctcgatattgtccatcccgccgccagaattctcggcgatatcgcccggtcgcaagacgccgaagtcggtgatggaacaacatcagtcgttgtgctcgccggtgagatcctcaaggaggttaaggagcacgtcgagcaaggcgttagctctcagatcatcattaagggcctgcgaagggcgtctcaaatggcaagtcaacaagatcaanggaaattggcatcagcacgaatgangctaaccaagcgtgatactctcatcaagctggctggcactggcatgaccaagaagctatcaagcgaaacattctttttaccaaatgntgcatgctgttttcgttcgatn

SEQ ID NO: 378 - DNA, 639 bp, Fusarium venenatum
  misc_feature (1)...(639): n = A,T,C or G
gatcaagattatcagcccagcaatgttactctatccctcggaaacgacgatcaaggcttctggggcatgtctgccatgttggctgccgagttggcatttcccaaccctccttcanatcagcctggctggctagctctcgctcaagctgttttcaacactcaagccaatcctgaccgacacgacgatacttgcggtggtggtctccgatggcagatccctcgaacaaacaacggttacgattacaagaacagtatcgccaacggttgtttcttcaacctgggtgcccgacttgctcgatacacgggcaacaagacctatgccgactgggctganaagacatgggactggattgagggcgttggtttccttgaccccaccagttataagatttatgatggcggtcacgtcggaaagaactgtcccgatatcaacaaggcccagttcttctacaactccggtgtctttcttcagggcgcttgcctttatgtacaaccccaccgatggctcgcaaaagtgggaaccacccctcgaataagttgggtgatgccccatctnaaacttntttcctaaagacattggtgttgaaatccctgggaaaaccacnacacttgcctaaaanatgtcttctttaagggctac

SEQ ID NO: 379 - DNA, 590 bp, Fusarium venenatum
  misc_feature (1)...(590): n = A,T,C or G
ctgactttgacctgccgcctcgacgcaggcttgataaatcatcatggcgatccactaccttattctcctatctcgccaaggcaaagtgcgccttgccaaatggttctcaaccctctcacccaaggataaggccaagatcgtcaaggatgtttcccagcttgtgctcgctcgtagaacgcgcatgtgcaacttcctcgaatacaaggataccaagatcgtctaccgccgatatgcatcgcttttcttcatcgccggctgctcctccgatgacaacgagctgatcaccctcgagattattcaccgatacgtcgaacagatggataaatactatggcaatgtgtgcgagcttgatattatcttctccttcaccaaagcatactatattctcgacgaaatccttctcgcgggcgagctgcaagagacgagcaaaaagaacattcttcgctgcatcggtcagcaagactctcttgaagatatggaagtcgaggangaaattaccaagattatgttnaattccccacaatcttgttattgctgtccggcactaattcnaactcnctcncgaaacatcagatgaaaccgtccaantt

SEQ ID NO: 380 - DNA, 654 bp, Fusarium venenatum
  misc_feature (1)...(654): n = A,T,C or G
ccaaaactgaacaaaccatcacaatggctgataaagaacctacacctgccgagaccgctgccgctacggccaaggaggccgaggagcaggctgctcttccctacaagtggactcagaccatcgctgagctcaacgtcacctttgacgtgcccggaaacctcaagtcgagggatttcgtcattaccatcaagaagatgagcctacaggcgggtatcaagggtcaggatccaatcatccagggcgatctccctcaagccgtccacgttgacgattccacctggactcttagcaccaactcagatggcaccaagactgtcgagatccatctcgacaaggtcaacaagatggaatggtggcctcacgttgtcacttctgctcccaagatcgacgtgaccaagatccagcccgacaactctaagctgtccgatctcgacggcgaaacccgcggcatggttganaanatgatgttcgaccagcagcagaaggagaanggtctacccagctntgacaacaaaacaagggggacatnctcaanaagttncaggcgcngcaccccgagatggacttttagcaaggccaagatccagtgaacaaaaaaagttttttatgcctaaaattatattaaaaaagaaaacgttcgtttnttgtgcgggn

SEQ ID NO: 381 - DNA, 543 bp, Fusarium venenatum
  misc_feature (1)...(543): n = A,T,C or G
gacgagaaccgacgacttggtgcccgagccggtgcatcagacattaaggcgcatccattctttagaacgacacaatgggcactgattcgacacatgaagccaccgattgttccccatgccggacgaggagttgataccgtcaacttccgaaacgtgaaggagagcgagagtgtcgacctttcaggatcaagggcgatgaacctaaagggagtacctttggacagtggtctagctactcctggcggtgaaattcccgacccattccttgagtttaacagtgtcaccttgcatcatgatggtgatgatgatcaccaccgctgattttgaaataccgacttctatttaggaagttcgggacactgctgttatcggttgacctcgatcattaattggacatgtcgtcgtacgtatacgcatgggtttacgatctgaaattcttgcaatggggcgtctttttttgctttttttcccatcactccacacacttgacactccttangacntctgctgcttanaanggaaggaagaaaaaatcgagaaatt

SEQ ID NO: 382 - DNA, 522 bp, Fusarium venenatum
  misc_feature (1)...(522): n = A,T,C or G
aggagattgagaagctcaagcacgaccccaatgtcgagtacattgagcaggatgctgtcatcaccatcaaggctactgtcgatcaggacaatgctccttggggtatcgcccgtctttccagctccaagcccggtagcaagacctacacctacgacgagagcgctggtgagggtacttgctcttacgtcattgacaccggtatcgatgttgagcatcccgactttgatggacgcgccaagttcctcaagaactttgctggtggccgtgatggcgacggtcaaggtcacggtacccacgttgctggaactatcggctctaccacctacggtgtcgccaagaagccaccctttacgccgtcaaaggtcttggtgatgacggttcagnaccaactnttgctgtaattgtggcatggactttgncgctggcacnccgatccgaaactgcccaacggnccgttgtnaacatgtttttgggngggaaactccatgctgnaaagcgctgcaaaacattgnangtggctgt

SEQ ID NO: 383 - DNA, 590 bp, Fusarium venenatum
  misc_feature (1)...(590): n = A,T,C or G
acatattcaattcccaccatgatgaggtcttcgcgatctctcgctgcgtcaactcgccagctaagatctgcctttaaaatccaacctcatactctcccaaaaccatcatgtcttgttctcggaactcgcaagcttcactgctctacgatccggaagtcgggcgtggcttctaacccagccatgtccttcccctgccttgatgccctagaatcacgctctgcgaaactcacagacgacgataccgaaccctcttatacatccggcgcgactctaaattaccaccacaaggaacctttcttctcgactggggtggtattctaccagagttcaacatcgcttacganacgtggggtgagctcaacgccgacaagtccaacgctattctattacacaccggcctatccgcctcgtcgcatgcgcattctacagaaacaaacccaagccaggatggtgggaaaagtcattggaactggtggtcctcttgatacgaacaagtaccacgttatctgcacaaatgtcatcngcggttgcaatggttctacaggaccagtaacgtcnatnctggaaatggtgaacgctacgccactang

SEQ ID NO: 384 - DNA, 624 bp, Fusarium venenatum
  misc_feature (1)...(624): n = A,T,C or G
cgccttcatcatgtctaccaacgacgaccctaaatacgacgacatcgggtccgagtctgactctggagagtctgtcggccacaacgaggctgccgatgagaagcctctcaagtcggctctcaagaagtccaacccagctgtcgccgagcccgccactcaaaaacctcctctgcctccccaaaccgaccccaaagacctcgatgtcgccagcttgactcctttgacggccgagattatcgcccgacaagccacaatcaacatcggtactattggccatgtcgctcacggaaagtccaccgtcgtcaaggctatctctggtgtccagactgttcgtttcaagaacgagctgatccgaaacattaccatcaagttgggttacgccaacgccaagatctacaagtgtgataaccaagcttgccctcgacctggatgctaccgaagttacaagagtgataaggagggtgacccttcttgtgaacgagatggatgtggcggtacttatagactattgcgacacgtctnattcggcgattgncctggtcacgatattctcatgagtactatggtggcaggagctgntggcatggacgccggcctttncttatcggtggnaacgaancttgg

SEQ ID NO: 385 - DNA, 1088 bp, Fusarium venenatum
gcaacagcgccgtactcggaggctggtctggtatccagtacgttcccgactttaccctctcatccaccagcattttcaagattgccaccgctatcaagggcgagggctgcactcctggagctatgtgctcttacgcctgccctgctggttaccaaaagacccaatggccctccgctcagggtgccgataaggagtctgttggtggtctttactgtaacgagaacggcaagctcgagctgacccgtgaggacttcgacactctttgcgatgctggtgttggtggtgtctccatccagaacgacctcgacgaggatgtcgtcacttgccgaactgattaccccggaactgagaacatggtcatccccgctcttgccagcgctggtagctccgtcaacatctgcaaccctgcccaggacaagtactatgtctgggatggctctggcacctctgctcagtactatgtcaacaagaagggctacagcattgaggacgcttgtgtttgggacaaccccaagggcaaggacgctggcaactggtctcctgttgtcctcggtgtcggccaagctgccgatggcaacacctacatctctatcttccagaacctgcctactagcactgcattgctcgatttcaacattgagatcaagggagatgttaacactaagtgctcttacgttaatggaaagtggagcgagggcggatctggctgcactaccaccatccccaagggtggcaaggctgttatccgatacttctaaacaaaagtaatttttacttgtcgagtaagatgtgcgttttggaacttctttgtcaatattctgggtggcagagctcaaggcctttcggctgcaggtcacggacgaacccgagtagcggaatatccggctgctcgcacgagcgaagctccccccttttgagctggttaaaatattttaagtgctgtctggataacgaaaaggaccgatatttgatttgatggccgatcttgggtgtctttttgatgtcgggtcttttgccacccgtacttgtttttgcgaattattttcataccgtcagcacctacttatacattgcatttttggattggg

SEQ ID NO: 386 - DNA, 591 bp, Fusarium venenatum
  misc_feature (1)...(591): n = A,T,C or G
ctcttttaccctcaacttctccaagggtgcatcacaagtcatcggccaatactaccagctcatccgcctcggcaagcacggttaccgcgccatcatgagtaacctcacccgaacagcagactacctgacagaaacactagagaatctaggtttcgtcatcatgtcagaacgttcaggcgctggtctccccctcgttgctttccgcttcaagaccaccgacgagggcggcgaccctgaccgttactacgacnagttcgcccttgctcaccacctgcgctctcgaggctgggttgtccctgcttacaccatggctcccaattctggtgtaaagatgttgcgtgttgttgtccgagangactttacaaagagtcgatgtgaccagcttatctgcgatgtcaagctgtgccatggtcttcttaaggagacagatcaggagtcgatcaagaacgtgaaaattacatcaagaaccatattgttgccatggggcttggaaancacctcaccccgttttacaaggacaacaacatctcttcagggcnagcatgcaaganacacnctattgctaaancgcataaaaagatgaatattgga

SEQ ID NO: 387 - DNA, 577 bp, Fusarium venenatum
  misc_feature (1)...(577): n = A,T,C or G
atcttctacaagaaaaggcaactgtgaaaagggcaagaagtgcaagttctcgcacgacctttccgtggagcgcaagacagagaagaagaacctgtncaccgatcaacgaggagatgaagaagaaacgaagaagccgagacttcagcagattgggacgaagacaagctccgaagtgttgtcttgtcaaagaagggcaaccagcagaccaccactgacaaagtatgcaaattcttcatcgaggcaattgaggatggcaaatatggttggttctggatctgccccaacggaggagataagtgcaagttcaagcacgctcttccacctggatttgttctccagactaaggaacagagagcagcaganaaggcgctcatggataaatcaccgcttaagactctgacactggaagatttcttggaatctgaacgaancaaattgacaggaaccctgaccctgtgacacctgagtctttcccccagtggaanaangatcgacttgaccagaaaggccctgaagaacaggcnccnctgcttagganaacctggtcgtgctatgttcnaaanccgaaaatggaagg

SEQ ID NO: 388 - DNA, 632 bp, Fusarium venenatum
  misc_feature (1)...(632): n = A,T,C or G
ggttgngggggtccacgacagcaatatcgccagaaacctgtaaaaactcttgcgactcggattttaaaatctcaccgaggaagtatcagccatgggtgtccanaaaaagactcgcaagttcgcagaggtcaagcgagttatcggtcgtcgcgatgccaggttgaagganaacaagctcaaggctgagttggcgcagaaggagaaggaaaagaanaccatcantggcgagattatccgagaagctccccaaatgcctagcaacatgttcttccagcacaacacagntcttgtcccgccctacagcgttctcgtcgataccaacttcctcagtcactcagtccagcgaaagctctctcttctcgactccatgatggattgcctctatgcaaagtgtaaccccatcatcacatcatgtgtcatggctgagttggaaaagcttggacccaagtaccgactggcgttgagggttgcgcganacgagcgatggacaccacttgagtgcgaccacaagggtgtatacncanatgactgntttggnggaccgagttgcaaaaggacaaaattttcattggngggcacaaacgatagggggcttaaacaacgactacgcaagattcctggngngcccatta

SEQ ID NO: 389 - DNA, 722 bp, Fusarium venenatum
  misc_feature (1)...(722): n = A,T,C or G
cgatctattccacgtctttggctaacgcccctcgttgtaatcactactacctttaacttcttaatcaacaacccacattcacaatggctggcggcgatctcaagaagggtgccaacctcttcaagacccgatgtgctcagtgccacactgttgagaaggacggcggcaacaagattggacctgctctgcacggtctcttcggccgcaagagtggtaccgtcgatggttactcttacaccgatgccaacaagcagaagggtgttgagtnggaacgacaagaccctctttgactacctcgagaaccccaagaagtacatccccggtaccaagatggctttcggtggcctgaagaaggagaaggaccgcaacgacctcattgcctacctcaaggactctaccaaataagcgactacaaatcgcgtgtaatgttacgactttcgatagatgggaaccgccaaggggcgactgtactatagatttttacacaagcacttgttaagacatgccacgtgcttacccattcctatctcctctttatgcgtctccgtccgatacactttttttaaagaaaagcccggcgttggacgaggcaaacgggaatgaacatgagacattagaacatgagatgtccgcctctctgcattcagagattattgttttattatgattagacagagattaaaagcttctcgaattctcacctnttaccgcaaaaaaaaaaa

SEQ ID NO: 390 - DNA, 755 bp, Fusarium venenatum
  misc_feature (1)...(755): n = A,T,C or G
ctcgacacggccgatcgctcattcccctccggcatcacgacaaccgcaatcatgagcgccaccaactccgttcagtgcttcggtaagaagaagacggctactgctgtcgcccactgcaaggccggtaagggtctcatcaaggtcaacggacgtcccctccagctcgtccagcctgagatcctccgcttcaaggtctacgagcctctcctcgttgttggcctcgacaagttcgccaacattgacatcagagtgagggtcacgggaggaggtcatgtctcccaggtttacgctatccgacaagctatcgccaagtccctggttgcctactaccagaagttcgtcgatgagcactccaagaacctcctgaagcaggctctcgtccagttcgaccgaacccttctcgttgccgacaaccgccggtgcgaagcccaagaagttcggtggtcccggtgcccgtgccccgctttcagaagtcttaccgttaaacggttcaagatgtttgtcgggatggggcacaaaagcgtcgagtcggancgatgttgcagtggaggatacaacgggcagtgcnaaaaaggaaccggagtcacaaatttccctggntttgggaatgggttacctattgacatttggcatggccttgcttttggcggattgtacaggatctggcaggcaaatgaaatctttcaagttaactatgcggctcacgctgtaatggttgtgatgtcaatgaactgtcctcccgtggacttgctccg

SEQ ID NO: 391 - DNA, 281 bp, Fusarium venenatum
  misc_feature (1)...(281): n = A,T,C or G
ctggntcttttaccgtcacatgccttattcttttccttatgaaccttattccaggactacgcctacgtgtcgacggggaggctgaaattcagggcatcgacgacgctgagattggagagtttgcctatgattatgtcgagctcacccgagaagttgtcagcgacatggacaacgagtctggaagccgatactcagctgatcctacggcgttccaacactacgagaagaaccatatncccatgatcgatgctcgnatgnttggtggccaacctgnccatgct

SEQ ID NO: 392 - DNA, 705 bp, Fusarium venenatum
  misc_feature (1)...(705): n = A,T,C or G
ctgggttgaccaagcccgtatccccgaccctgaggccaagaagcccgaggactgggatgaggaagcccccttcgagatagttgacgaagaggccaccaagcctgaggactggctcgaggacgaggccgttaccattcccgaccccgaggctgagaagcctgatgactgggatgacgaggaggatggtgattggattgcacccactgttcccaaccccaagtgtgccgatgcctctggctgtggcccctggactcagcccatgaagcgcaaccctgactacaagggcaagtggaccgcgccttacgtcngagaaccctgcatacaagggcacctgggctccccgcaagatcaagaaccccaactactttgaggacaagacccctgccaacttttgagcccatgggagctattggcttcgagatctggactatgcaaaacgacatcctcttctgacaacatctacatcggtcactccatttggaagatgccaacaagcttcgccgaagagaacttttggtgtcaagcacccttgttgagaaaggccttcgctgaaggccgataggcccaagcaggaaggacaagnccccgatcttctaacgaacttgaacttnatgganggatcctnttcatttcaattacccgagnaaaattgacctttttaaagggcanttgttggccaagnaccccatttcangntttttaaan

SEQ ID NO: 393 - DNA, 632 bp, Fusarium venenatum
  misc_feature (1)...(632): n = A,T,C or G
gccatncgtcacttcaacaacgcccacggtgttaatgtcccccgtcgacgattcttgcccgtcaagacctgctctgacctcatgcttgtcaagtctgatctctacacattgaagcacggccagcttcaaatgagcgccgcccgcttcggtgacgcccccttgattaagcttggtggtgatttcaagaaggtctcagacttccagaagcgaatcccctccatccccaaggtgttggagctggaccacctaccatcactggtgccgtcaacctcggccgtggtgtgacgctcaagggcaccgttatcatcgttgccacagaaggcagcactatcgacatcccacctggatctatccttgagaacgttgtcgtgcagggtagcttgcgtctgcttgagcattaaagtgggggcatgttggaatttgtgcgcctatgtcgcgcatgttggctctngagttccattgncaanggcttttgaagtggatangataaggnggngatacattggtagacatttttaagcaaatttttganggaaaaggatatttntgctatngcattggangaatggcttccgcgtcangnggggggtnaagggaggtcgnaattctancgtcgactttttacgcttngg

SEQ ID NO: 394 - DNA, 620 bp, Fusarium venenatum
  misc_feature (1)...(620): n = A,T,C or G
gagaccctgggcggagtttttacgagacttatcaaccgtaataccactattcctaccaagaagtcccaggtcttctccaccgccgccgatttccagaccgccgtcgagatcaaggtctaccagggtgagcgtgagctcgtcaaggataacaagcttcttggaaacttccagcttgttggtatccctcctgcccaccgtggtgttcctcaagtcgaggttacctttgacattgacgccgactccattgtccacgttcacgccaaggacaagtccaccaacaaggaccagtctattaccattgcttccggttccggtctctctgagagcgagattgagcagatggttgaggactctgagaagtacgccgagacttgcaaggagcgcaagagtgctatcgaggctgccaancgtgccgacagcgtcttgaacgacacttgagcgtgctctaacgagatgctgacaactngacaagaccgaggccgcttnatcaaggaaagatcacactttcgggagtcgttgcaaaactttttgggaaggcattgttccgttncggattaagggaanacngtgactcaggtncagttgacttttatagatccaaggccgaagacacaggggnn

SEQ ID NO: 395 - DNA, 596 bp, Fusarium venenatum
  misc_feature (1)...(596): n = A,T,C or G
cgaaggtagccttgagaaattcagcaggggtgctgaaaagttcggattcaacgtcgatgccaacaacaacattgtgtaccgcgaatgggcacccaatgctactgcggcgtacctgatcggcgactttaatggctggaaccgtggcgctcaccccatgaanaanaatgatttggtgtctttgaaattacgatccctgcccaaaangggcaaactggtnttctcacaactccaagctcaagatttctctttgacttgcccggnggtgagcatgtagatcgacttcctgcttggatcaagtacgtgacacangacttgtccgtatctcccgcatacgatgccccgtttntggaatcctccacttcccgagacctacaaagttcaagaactctcgaccaaanaagcctgccagtgcttcgtgtatacnaagcacacgttggcatttncagccccgaccagngggtcnttcttacaaggagtttacccaaaaacatgctcccttcgcataanggccttggctacaatgngattcaattggatggctggtatggaacatgcgtacttatgccnagtttnggattataaaatnacaacttttt

SEQ ID NO: 396 - DNA, 624 bp, Fusarium venenatum
  misc_feature (1)...(624): n = A,T,C or G
ggcgtcttttgagtccttccagaaacacagaatcaccatcatccagtccacgacgtcatggcaatcgtcgacctcctcttcacctggtgggtcgctccccatcgccgcaggtctcgtggtcgcttcatacctctactcatattttataacatacggccatcttcgaaacatccctgcgcctttccccgcgcaattctcaaatctatggcttctctacgtctgcagacgcggcgaacgatatcgcgtcgtggacaagattcacaaagagctcggccccgtcattcgtatccagccaaatcatacttccatcgctgacgcggaagccatcgcgacaatttatggtcacggaaatgggttcttaaagtctgaattttatgacgcgttcgtctccattcgaagaagtcttttcaacaaccgcgatcgcgcagaacacacgcgcaagcgcaagcttatctcgcatgtgttttccgcaaagtccatcagtcaattcgaaccatacatccaccccaatcttgaactttttgttcaacaagcttgataagctcggcgcatcgggtcaaaccagggacaaggagggaagngaaaggcctatggatggggtcccanggtaaataccnccctttg

SEQ ID NO: 397 - DNA, 815 bp, Fusarium venenatum
  misc_feature (1)...(815): n = A,T,C or G
caaatgaatgagcaacaagacccacagtccgcaaacaccgcgggttacgagtttgaaggtgtaaaggaacaagaccgctggctccctatagccaatgttgctcgcattatgaagaatgcccttcctgaaaatgccaaaatcgcaaaagaggccaaggaatgcatgcaagaatgtgtcagcgagttcatctccttcatcacaagtgaagcatcggaaaagtgccaacaggaaaagcgcaagaccgtcaatggtgaagacattctttttgccatgacatccctcggctttgagaactatgctgaagccctcaaggtttacttgagcaagtaccgagagcaacagaaccaatccaaccgagagagggtaaacatggataacggacaatggggttccggtactatgatgggcgatgccaaggccgaatctggcgccggcgagtttggacatgaaggcaatagcgttgaaggtgctgaccccaactacatgtatcagcccggcacaacggtaatgccgccgaagggtattagtggaatcgaatggcttggtggccgcattttcgaatgatgaaccagacgagacaggcgaagcccaagcttatacgataagcccanccaatacaacagtgctgacaagatgaagtcgacaaccagtcatcgatcccntnttacctaancgtttccaagccatanaagccgaccttnttgnctgaactaaacaatcgtntggctacgtcaaatttggatgatnggatgataatggaaaaacacctggaccttggangggatganaatgaaaccacntctttttcaaaaaga

SEQ ID NO: 398 - DNA, 640 bp, Fusarium venenatum
  misc_feature (1)...(640): n = A,T,C or G
agaaggctggagaggtcaatgttcaggttatccatgaccgacattacaacaagaacgtcaaggttgatgacnacgatggtcattacattgttatccctgaagctgaactcacggacaaataccaaatcgtccgtcttctgggccaaggaacctttggcaaagttgttgaagcccgcgaccgcaaacgtaacaaggccgtggctgtcaaaatcattcgatcagtccagaaatacagagatgcctcgagaattgaacttcgcgttcttgagaccctcaaacgaaatgacgaggagaaccgtaaccgatgcattcatctgcgagactgttttgattaccgcggccacatctgtatcgttatggacttgctggaccaaagtgtttttgactttctcaagggtaatggttttgttccattccccaacaagtcaagattcaagagtttcgcgcgacaactctttaccagcgttgcctttttgcacgatctcaatctaatccacacagatctgaagcctgagaacattttgttctgcgaccacgcctattaaacgtttacctacaatcgccagatccttcttctctncactgttaacgccaggcccgcacnccgtgttgtnctcnaactgaatccggttaaccattt

SEQ ID NO: 399 - DNA, 592 bp, Fusarium venenatum
  misc_feature (1)...(592): n = A,T,C or G
atctgctctttctcgcgtccgcaccatctgggtcgccactcacaactccatcggtctcggcgaaggaatggtcctactcaccancctattgaaaactcttgctcacttccgcgctctccccaacaacatggtctggcnactgctgacggtaacnagaccagcggtgcttactacgtctgcttgactgccaagcacacccctagcatcattgctctgtctcgtcagaaccttccccagctcgagggctctaccattgaaaagctgccaagggtggttacgtcctgcgcgaagttgaaggtgccgacattaccctggtttccaccggttctgaagtttctatcgccgtcgacgccgccaagtactcgaagancanaaaaacatcaaggctcgcattgtctccatgccctgctttgaagctttcgacctccaagacaaggaataccgcctctctgtcttcccgacggcatccctctctgtccattgaggtgataacacatggctgggacgctacctcacaacattcngtatcaacgatccgtgctctngtgctacaaggactctacaaaaattcaattcaccccnaaggtncccc

SEQ ID NO: 400 - DNA, 618 bp, Fusarium venenatum
  misc_feature (1)...(618): n = A,T,C or G
tgacaggagaatcagaagccaagcacgttcaattctctggcctggaagcttacggtgcatcaatccccatcaaaaaagctattgacccccaaggcgatgtgatactcgcctatggaatgaacggccaggcgcttccgcgcgatcatggattcccattacgtgcgattgttccaggacatgttgctgcgcggtcagtgaaatggttgaaccatgtcacactcagtgatgaagagagcacatctcaatggcagcgacgcgattacaagtgctttggaccaaaccaaacacaggtagactgggataccgcaccttctatccaggaaatgcctgtccagagtgctataacgacttgcaaacttggtgattgggcgaagagcaatgatacttatgccaagcctgcttcattgacaggctatgcatactcgggcggcggccgtgccatagtccgcgttgatatctctgcagacaacggcaagacttggtcccaggcttccatcattcccgattgctcgacgaaaganggtgaacaatctccctgctttggtcacgccgnctgggcttggcgaagatggaagttcgatggacctgtccgntgagcgctttcgagacatcagagcn

SEQ ID NO: 401 - DNA, 584 bp, Fusarium venenatum
  misc_feature (1)...(584): n = A,T,C or G
caaactaccaacaaaacaccacatctttcaacaacaatgcctcggataaagaagaaaggtcaggccggtgcctccaagaactacgttacccgaaatcaggcgattcggaaactacagattagccttcccgacttccgaaagctatgcatttggaagggaatctaccctcgcgagccccgaagcagaaagaagtttccaagtcatctaccagctcgaccaccttttactacaccaaggacatccagtacctgctccatgagcctctgcttcagaagttccgcgaccagaaggttctcgagaagaagatctctcgtgcgctcggtcgaagagatgtcnctgatgccgctcgtctcgaaggtaacgctgcgcgccctgagaanatggaaagcctcgctacactcttgatcatgtctccgcgagcgctatcctaccttcatcgatgctatccgcgatctcgangactgtctgtcaatgctcttcctcttcgccaatctgccttcaacaagctcagtcctgctaagangatgcccgttggaacgcctctgctcaattccacactatcttatgtntcaagaactcncaat

SEQ ID NO: 402 - DNA, 587 bp, Fusarium venenatum
  misc_feature (1)...(587): n = A,T,C or G
cttatctggatcgttggtgaatacgctgagaagatcaacaatgcagatgagatcttggagagctttgtcgagtctttcatggaagagttcacacagacacaattgcaaatattgacagctgtggtgaagctattcttgaaaaagcctggcagtagccaaaatctggttcaaaaggttcttcaggcagctacagcggagaacgataaccccgatatccgcgatagggcatatgtgtactggcgtcttctttcctcggaccccgaagttgccaagagcattgtcctatcccaaaagcctaccatcacaactacgatgacaagtcttccacccgctctcttggagcagctccttaccgaactttctactcttgcttcagtctaccacaagcctccagantcattcgttggcaanggtcgcttcggtgccgacganatccagcgagctgctatccaggagcagcgacaaaacgctgccgaaaaccctatcgccgcttcagtggccactgcttcacccaacgggtctggcggtgctgcacagaacaacattganaacttgctcgacattgatttcgatggtgccgcgcctgc

SEQ ID NO: 403 - DNA, 514 bp, Fusarium venenatum
  misc_feature (1)...(514): n = A,T,C or G
ctaccatctagccaagatgagtggaaaccaggttctagtctgcgcaccctccaacgtcgccgtggatcagctttgcgagcgcgtccaccgcactgggctcaaggtggtccgtctcacagccaaatcccgtgaggatgtcgaatcgtctgttagcttcttggctctccatgaacaggtccgtatgtcggagcacaacagcgagctcgtcaagctctcgcagctcaagaacgagctgggtgagctttcaagtcaggatgagaaaaagtacaagcaactcaccaagattgccgagcgtgacattctcaacaatgccgacgttgtctgctgcacttgtgtgggtgctggtgatccccgcctgtccaagatgaaagttcagaaacgttctgatcgaccagtaactcaatcaagcagagcccgagtgttgatcccgttcgtcttcgatgcaacaggtggccttgtggtgacacaagcacttggtctggcatcatgacaanaagnttgccaaggccggcnt

SEQ ID NO: 404 - DNA, 678 bp, Fusarium venenatum
  misc_feature (1)...(678): n = A,T,C or G
nggggaaatgatgcccattttcntcctnttaccananaagatctgagagagcgctttgttgatctcaaccccgatgatcctgaaggtctgggtcatgctgttatgggtcaaggcgcttctatcaacattcgttcgagcggatgtttcggtggtcacggtctaacaatgtccgctacaaactacatcggaatccttcaatccatcctctcaaacgatggaaagctcctcaagcctgaaactgtagacgacatgtttcagaatcatctcagtcccgaagcagccgctggtcatcaagtcatgctggcaagccctatgggtcctttcttcagggttggaattgatgagaataccaaacttgggcatggtcttggaggtgctgtgacgcttgaggatatagacgggtggtatggtgctcacacaatgagttgggggggaggtttgactttgacttggtttattgaccggaaagaatgatatttggtgccattggagctatttgtgctgctctacctctggatgacgtggttacccaaaacagcctcagacttgaangatgttattaggaaggacgtctatcntaaatacgctgattggaaagagggtaaccagtgatggtgtcagatcanngtggatacggaaatggtccgacaattaattttctctacttnttnaaacatg

SEQ ID NO: 405 - DNA, 685 bp, Fusarium venenatum
  misc_feature (1)...(685): n = A,T,C or G
atcgtgtcctctgatagtagccaccttttataagtcatccctcttctgattgtttctttttgcgctgtaactctggtgtgaaatcaaacaaaatgtcggcgcaagttatctccaactccggtcatgaggacatgattcatgacgctgtcctcgactactacggccgcaagctagctacttgctctggcgacaagacgatcaagatctttgagattgagggcgagacccagcgattggtcgagactctgaagggtcatgagggtgctgtttggtgtgtcgcctgggcgcatcccaagtacggcaacatcctggcatcggctggctacgatggaaaggttttcatctggaaggagcagggtggacagagcaacggatggcagcgaatctacgactttcccctacacaaggcctcggtcaacatcgtctcttggtctccccacgaggctggctgcctgctagcatgcgcctcttccgacggcaatgtcagcgttctcgagttcaaggacaacagcatcgaccacaccacctttgccgctcacggtctcggcgtcaactccgtttcttggggccccagctacaacccccggcagcattggtagcagcgcttctggncctggtgctatggtacccgcgattcgtcactggtggnagcgacacgtncttcaaancttggcctttgaccttg

SEQ ID NO: 406 - DNA, 598 bp, Fusarium venenatum
  misc_feature (1)...(598): n = A,T,C or G
gtcctctccaaggccggtgttcaagtcactgttgcttgccgtactctcgcttcggccaanaacctcgccggtacttacgacaacaccaaggccatcagcctcgacgttaacgattccgccgctctcgagcaggccgtctctgagcacgatgtcaccatctctctgatcccttacacattccatgctgccgtcatcaaggccgctatcaaggctaanaanaatgtcgtcaccacctcctacgtctctcctgccatggaggagctccacgaggaggccaaggccgctggtattaccgtcctcaacgagattggtgttgaccctggtgtcgaccacctctacgctgtcgacttcatcgaccgtatccaacaggagggaggcaagatcaagtccttcaagagctactgnggtggtctccccgcccctganaactccaacaaccctntaggatacaagttcaactggagcagccgnggtgtcttntggccctnaaaaacaacnccnagtctacgangacaacaagctggttgaaattctccggngtcnacctgatgaacactggtnaacccttaccacangggataccngggattnaactttt

SEQ ID NO: 407 - DNA, 602 bp, Fusarium venenatum
  misc_feature (1)...(602): n = A,T,C or G
tnctcactccgcatctcaaacgcgtcttccaaccaaacggcatttaaacatctcgataacgcgccacattcatctcttttcatcaaatacttatctcatctatcaacatgactggacgcggcaagggcggcaagggcctcggcaagggtggtgctaagcgtcaccgaaagattttgcgagacaacattcagggtatcacaaagcccgctatccgacgtctcgctcgtcgtggtggtgtcaagcgtatctctgccatgatctacgaggagacccgcggtgttctcaagaccttcctcgagggtgtcatccgtgatgctgtcacctacactgagcacgccaagcgcaagaccgtcacttctctcgacgtcgtctacgccctgaagcgacagggccgtaccctctacggtttcggtggttaagcatttacttgcacaccgggtggctcttttggctttgaaaaggattgtacaagtcgcacatttgcagatactgggatggatgtatttgacacggcgttggggaaacacggatatgatattaccattaggcgtcatggaagacnaccttgcgaaatgaataccacattgaacatttaacttccg

SEQ ID NO: 408 - DNA, 496 bp, Fusarium venenatum
  misc_feature (1)...(496): n = A,T,C or G
acgaaccgagattcaacttatttctttgcgacattttgcgcccccaacgcctacttttctctcttctttcgaccttttcttctctcttttttttttttaattaaaccacacacacatcacacgattcgatacaatgcctgctctttgtggaggatccaagaccgttcagcgaaagctggttctactaggtgatggtgcttgcggaaagacatcattgctcaacgtctttactagaggctacttcccaacggtttacgaacctaccgttttcgagaattacgttcacgacatctttgttgacaatgtccacatcgaactctctctctgggacacagccggccaagaagaattcgaccgattacgatccctttcctacgatgacacagatctcatcatgctctgctactcagtcgacagcaaagaccactcgaaaacgtagaatccaaatgggttngcgaaatcgccgacactgcccaggcacaaaactcgtcctcgt

SEQ ID NO: 409 - DNA, 929 bp, Fusarium venenatum
  misc_feature (1)...(929): n = A,T,C or G
ctatccatctccaaaaggtccaacagactcaaaccgccatcatgcttatctacaaggtacgatcccgccactagggcctttgctttttattatcttcaggctctatcttcatctccctctgctgtgctcctctgttgccagtcttttctacttctcgcgcttggttgtggtatccatctccaaaaggtccaacagactcaaaccgccatcatgcttatctacaaggacatcctcaacggtgacgagctcatctccgactcctacgacctcaaggaggtcgatggcatcgtctacgaggccgactgcgccatgatcgaggagggtggtgtcaacgttgatatcggtgccaacgcttccgctgaggaggctgctgaggatctcgacgacaccgtggtcaaggtcaacaacattgtcagctccttccgtcttcagagcaccttcttcgacaagaagagctacctgacctacctcaagggttacatgaagcgcgttaaggctgccctccaggagaagaatgcttccaagacnaggtcaaggccttngagaccggcgctttcaagttcgtcaaggacaagcttcttcccaacttcaaggatttcgagttctacactggcgagtctatggaccccgatgccatggttgtcctcctcaactaccgtgangacggtgttaccccttacatcatcgtctggaagcacggcgtcactgagatgaangtctaagttngcaataatgccacggtgatgnttttggntctgctccatcccgtctgcaatgacaaacaggcgagcagttgtttagattacgagccacacgaatctcgatttcgacgctggtacatccctcgagatgcagcgacgagacgaaataaaagaaagaaagaaagaaagaaagaagctacgaagttccaactatgttattttgtcgat

SEQ ID NO: 410 - DNA, 640 bp, Fusarium venenatum
  misc_feature (1)...(640): n = A,T,C or G
gttggtgacaatggcgccttagcagagcagtttgacaagaacaacggacgttccctttctgccacagacctgacctggtcgtatgctgctttcctctctgctgctgaccgccgagccggtattgtccctccttcttgggcgagcggcgcagctgttgttcctcagcagtgtggaactcagaccgtcgctggctcgtactcgctcgccactgcaacctcgttcccgccatcgcagactcccaagggcggcgttccatcccccacgggcacccagcctacaacttcacctacttcttgtgctatcgcgacttcagttgctgttacattcgttgagacggtcaccaccaacttcggcgagaccatcaagattgttggcaacatccctgctcttggtaactgggacacttcgaangctgttgctctgantgcctctgactacacctcttccaaccctgtgtggaaggcaaccatctctcttgcgacaggacaagatatccagtncaagtncatcaacgttaaaaaagatggctctgtcacctggggaaaaagacccaaccgcacctacactgtcccaaganatgcgctacaaaggcaccaaganggataattgcatcgtaagaactgcatcattccactcantt

SEQ ID NO: 411 - DNA, 587 bp, Fusarium venenatum
  misc_feature (1)...(587): n = A,T,C or G
ggctgatcacaagcctgcctcactctacttcgacgacgtcgcttataatctcaatggtaaacagattctcacaggaatccgtggtatttgcaaaccgggagaagtaactgccatcatgggtgcttctggagcaggaaaaacgacattcctcgacatactcgcccgaaagaataagcgcggacaggttcatggtaatttctatgtcaacggagaaaaggtcgacgatggcgactacaagaatgttgttggattcgtggatcaggaggatactatgctccctactcttaccgttcatgaaacgattcttaccagtgccctacttcgacttccccgcgacatgggacgtgctgccaaggagcaacgantnctcgaagtcgagaaagaacttggcattcaccacattcgtgactcccttatcggttctgaanaaagcaagggccgtggtatctccggtggtgagaananacgtgttggaattgcctgcgaactggtgaccacccctcgatcttgttcctggatgaanccaccagtggcctcgatgcctacaacgcctacaacgttattgaatgtcttgtgactcctgcgaa

SEQ ID NO: 412 - DNA, 717 bp, Fusarium venenatum
  misc_feature (1)...(717): n = A,T,C or G
ttctttttcttcttcaagaattttacaatnaacccaaacaaacaccatcacaatgtctcaagctttcgttcagcgccctgcgcccgagttcactgccactaccctcttccccggaggcgagttcagagacattaagctctctgacttcaagggacaatgggtcgtcctcctcttctaccccatggacttcaccttcgtctgccctaccgagatcatccagtacaacaacgctctcgaccgcttcaaggagatcaacaccaccgtcctcggtgtctccaccgactcccacttcacccatcttgcctgggttgagaagccccgcaagcagggtggtctcggtcccgacctggagctccccctcatcgccgacaagtccaccaagatctctcgcaactacggtgtcctgatcgaggacgagggtatcgctctccgtggtctcttcatcatcgaccccaagggtgtcctccgccagatcaccgtcaacgacctttccgtcggncgcgacgtcgangagaccatccgtctcgtcaagggctttcagttcaccgacgagtaccgngaagngtgcccttnttggctggcaggaagggcggaaanacattaaaggccgancccaagggcagncttgantctttttccnccaaggaganaatggagctaagggatanatgttagaaaccttccaaggaaacccgaattncattaacacccgtttta

SEQ ID NO: 413 - DNA, 631 bp, Fusarium venenatum
gacaaggagaaagaagatgctcagttcaatccagaagaggaggcagtgaacggaatggcaaacggggccagtggcgagtcgctggacgccaacaacattggaactcatcacaataccatccgtatcaacaagtccgtccactctaaaaaccaaaaggtcaacccagttgccgcttggaaattatccaaccatcgaatcaatgctttctcattctcaccagataaccgacatctggcggtggtctcagaggatggtacgctaaggatcattgattatctgaaggaggagctccttgacgttttctactcctattatggcgggctcacatgcgtttgctggtctccagatggtcaatacgtgctgactggtggtcaagatgacttgatatctatctggtcactatcagaatcagcgctagtagccagatgccagggacaccagtcttgggtgtcaagctgttgcatttgacccttggagatgtgacgaacgaaactaccgatttggtagccgtaggagaagatggacgcctgtgtttgtgggactttagtggtggcatgcttcaccgacccaaagcgcaatctgtgagacaccgcgggtcgattcgtacgctataccggcgttgcaaaaggct

SEQ ID NO: 414 - DNA, 566 bp, Fusarium venenatum
  misc_feature (1)...(566): n = A,T,C or G
ggtggctttcctacctggtacggcgaactctactttgagctacacagaggaacgtacaccacacaagccaacaacaagtattacaaccgaaaggccgaggtgatgctacgggacatcgaacaattggccacgtatgcatcaatcaagaacaagaagtacaagtncccaaccaaggatcttgatgatatgtgggaatctgtccttctctgccagttccatgactgtctaccaggaagtagcattgagatgtgttacgacgattccgataaggtctacgctgaagtttttgaaactggcaaacgtcttctgaacgatctctacgattcactcaatattgccagccaattctcatcaagccttaacgaatcggnggccatcaacacactgccttggcaccgaaaagagctcgnggagctctccgatagtgaagtcggtatcgcatgtggtgatggcaactattgccctccgctcgtcaagggcaagaaganaagcctgcanttccgtgatggaacagtccacccgacgtatntgtnttgcaaaacgaccaacttccgtgtcgttggtga

SEQ ID NO: 415 - DNA, 683 bp, Fusarium venenatum
  misc_feature (1)...(683): n = A,T,C or G
aagaaccctcacagggcaagaaccatcacccttgaaggtcgaattcctcagaacactaatcgaacaaatgttcaagttccaagaatccaggaacaaanggaaaggcattccctccctgaaccagccagcgaactggaatttttcgcctgggttaagccagctttgagggaatgggccgcaccctctccgactacaacatccaaaaggagtcaacccttcatctcgtcctccgccttcgtggtggtatgcagatcttcgtcaagaccctcacaggcaagaccatcacccttgaggtcgagtcctcagacactatcgacaatgtcaagtccaagatccaggacaaggaaggcattcctcctgaccagcagcgactgattttcgctggtaagcagcttgaggatggccgcaccctctccgactacaacatccaaaaggagtcaacccttcatctcgtcctccgccttcgtggtgggtcagtaggggcttttattactaggtggctagtggctattatgagacacagtttatgaaggcgtttgggaccggctatagcatagcataacatancttacttcgcaaggcagcatttttaatagactcgattgaagtctangtggctgtnttacccgatccctttgccttccggctggnactttcctgcggacgtcaagcatgnatctaga

SEQ ID NO: 416 - DNA, 628 bp, Fusarium venenatum
  misc_feature (1)...(628): n = A,T,C or G
ctcgaacagctggagaagagtcctcctctgtctatcgcggcgtactgcctgtcctcgatcagcatgaccgttgtgaacaagtatgttgtttcgggcagtttctggaacctcaactttttctacttgactgttcaggctattgtttgtataggcacgattactttgtgcaagcagctgggtctgatcaaggttctcgctccttttgatgctgaccgagcaaggaaatggttccccatctctcttctcctcgncggcatgatttataccagcaccaagtcgctccagttcctctcggtacccgtttatacgatcttcaagaacctgacaattatcgtgatcgcatatggagaggtgctttggtttggtggtagcgttacccctctggccctactttcgtttggtcttatggcctgagctcaatcggtgccgcttgggctgatattcaaagngccatcaacggcgattttggtactggngactctgctgccgctgtgtctacgcttaacgctggttacncttggatgggcataaatgtgttctgcagngcggcctacgtgctcggtatgcncaagggtatcaaaaaaaagaactttaaggactgggacccatgtntacaacaatnttntca

SEQ ID NO: 417 - DNA, 689 bp, Fusarium venenatum
  misc_feature (1)...(689): n = A,T,C or G
ccgacggtaccgttactgctcccaacgctgcccccatcaacgatggtgccgccgctgttgtcctcgtttctgaggccaagctcaaggagctcaacctcaagcccgttgccaagattcttggttggggtgatgctgagcgtgagcctgagcgtttcactattgctcctgctctggccattcccaaggccatcaagcacgctggtttgaccgctgagcagattgagtactacgagatcaacgaggccttctctgctgttgccctcgccaacatgaagatccttggtcttaagcctgagcaggttaacgtctatggtggtccgttgccatcggcaccctcttggctgctctggtgctcgtattgtcaccacccttgcctccgtgctcaaggagaagaaggccaagaatggtgccgttggtatttgcaacggtggcggtgggcttncgctttggtcattgagaacctgcaataaaaagggcgacggattgataattgatgattttggacgacataaatatgaatgggcatgcaatgcaatgaattgcaaaaagttagatcgactgccaaatcaggcgtatatcgatgcggcttatgaatttcttgctcgaagaaataccacttgcataaccattagagtagatataaatacttttaatcaagaacaggagatcagcataatctctgtatttga

SEQ ID NO: 418 - DNA, 604 bp, Fusarium venenatum
  misc_feature (1)...(604): n = A,T,C or G
cttccatcccacgactctatacccatcaaactacagtatacacctagcgtgtatatctctatccacaactttcacacctcaaaccatcaacatgactggacgcggcaagggcggaaagggtctcggcaagggcggtgccaagcgtcaccgaaagatcttgcgagacaacatccagggtatcacaaagcccgctatccgacgtctcgctcgtcgtggtggtgtcaagcgtatctctgccatgatctatgaggagacccgtggtgtcctgaagaccttccttgagggtgtcatccgtgacgccgtcacctacaccgagcacgccaagcgaaagaccgtcacatctctcgacgttgtctacgccctgaagcgacagggacgtaccctctacggtttcggtggttaagcgctttttgttttacatgcctgttacgaatctttgcggtcgactgcttgctgcgcaggaccttgtagggtgtttcatgatgacatatgggtccggttattgtttttgggtgttttgtaccataagggatttgggggattacattcggggataatcgaaaatgccctcgaggcgatattgatcacaaanaaaaaatttaat

SEQ ID NO: 419 - DNA, 976 bp, Fusarium venenatum
  misc_feature (1)...(976): n = A,T,C or G
gccgagggctgcgatcgacatttatatgctttgttctcggtttggcaacggagcttagatgaggacctcgattacagtaacggctactccagccccggcgacgaatactcagaccagagcggatcaccagtggggagccctgcgcaagattcacaccattcagttgatggtgtcgaggtgaggcctacgcgagatcgtggctatagtatcaactctcgatctcgagaccaaacccctcttcccgctctgttcgccgatgctggatgggataaactcaacaacaccattcttttcaacttccaactgtggcaatcctgcccttcgccaatttcgggtttggtcctacttcaaggagatggattcggtattggggtncattatcaaggatgaanggacttgctatctgtgtcgctngcaagcaccgccagacaaagcgattcgtcgacactttcgagagttaccttctagagatccgtcgtatcctacgcatcggtaaccgcaagatgtctactggcaaagcaagccgtgctcgtgaggtagaagtagaacgaaccaaacttctcaatcgtatcaagtctcgaagacgtcccattaccgcagttgaaagcttgcgctcggccacaggtaccacgtcacccacaaacgagagcagcacatttagcgaggatgatgaaatgggtggatatggctttttcgatgctggcatgcttttgcaagctctaaaggctcgcagcgagaatttcgaattatctgacagtcgtgtctcggagagagctgctgctgcacaggcccgccgccgtgatattggaaagaaattganactgagtgattattgagtatcatgtcatacatattgaatagcatagccgtggtcatggatctggcatggagttaaaggggctcatgtattatatcaagaggcggaagccttggatatggtgaatcaacaattctcttcgtgcctgaagaaaaaaaa

SEQ ID NO: 420 - DNA, 390 bp, Fusarium venenatum
  misc_feature (1)...(390): n = A,T,C or G
ggtgcctgtgtggagggtcgccgttctgtgcctatcgaacttcttgatgttgctggcctggttcctggtgctcacnagggtcgtggcttaggcaacaagttccttgacgacttgcgtcatgcagatgcccttatccacgttgttgatgtttccggtactgttgatgcggaaggtaaggagacaagaagttntgacccctcagtggatattgcatggctgcgcagcgagattgtagcttgggttctcggtaatcttatgcagaaatggggatctatccgacgaagacaccaagccatcaaagcgacagctacagaaactttgcagggtcagttctctggttacggatcaacatcgacnactgtgaatcgtgctttggaccgttgcggtgtc

SEQ ID NO: 421 - DNA, 565 bp, Fusarium venenatum
  misc_feature (1)...(565): n = A,T,C or G
cacgacatgatgaagcaccttatgaactctacctacaagaacggtacccgcgtccctgaccacgaggttgcccacatgatgattgctctccttatggctggccagcactcttcttcttctaccagctcttggatcatgctccgtctcgctcagtaccctcacatcatggaagagctctaccaggagcaggtcaagaacctcggtgctgatctgcctcccctgacttacgaagacctcgccaagctgccccttaaccaggctatcgtcaaggagaccttcgtctccacgctcctatccactccatcatgcgcgccgtcaagtctcccatgcccgtccctggcaccaagtatgtcattcccacttcgcacactcttctcgctgctccggtgtcagcgccaccgattctacttcttcccaaccctgatnatgggacctcacgatggaggcgatctccaacttccccgaaggttcaagatgaggacaaganaagatnatacgttatggctgtcgcaaggtcactctcctactgctttggtgcngtcgcacgatcttggtgacattgcaa

SEQ ID NO: 422 - DNA, 632 bp, Fusarium venenatum
  misc_feature (1)...(632): n = A,T,C or G
cgagcgcttgactgagtcgaacaccgaactctataagcccgccttggaagcaatgaagacttcgataaaaacatcgacgtcatccatgacagcagttccaaagcccctgaaattcttacgaccacactacgagactttgacgaagctttacgaacaatggcctcagagtgaagacaagacctcgctggctgatgtcctctccgtcataggcatgacgttctcagacgaggatcgacaagacacacttcattaccgacttctcgcccctacatccgacatcagctcatggggccatgagtataccagacatcttgccctagagattggagaggtgtatatcaagcgaatcaataacgaggaacagaccaaagacctgatcgatcttgcgcttgtcttgatccctcttttcctcaagagcaacgcttgaggccgacgcccgtggatctcatgagcgagctcgaaattatcgaggagatgcccaaattgtggacgaaaacacatacgctcgtgtgtgcctgtacatgtccttcatggcaacctctnacttaccccgacaacgagacctttcntaagactgngcacgatatctacatggaatcaagccaatttgcgcaggncattggtcttgcaat

SEQ ID NO: 423 - DNA, 606 bp, Fusarium venenatum
  misc_feature (1)...(606): n = A,T,C or G
ntgtcatctctcgacagcaaancatgttccnattntttcaacncatccgagagaactgggaccgtctcgctgacaacattactctcgagcngggcaaganttttgctgatgccaagggtgacgtcctccgaggtcttcaggnnggacgaatctnccgttgccgcccctgagctcctcaagggcgangntctcgaggtcgntaaggatatggacacccaaacctaccncgagcccctgggtgttactgntgctatcngcccatttaacttccntgncatgattcccctctgggcattcccatcgccaccatcactggtaacncgcttatcctcaagccctccgagcgtgatcctggcgctgccatgaatattgccgagcttgtcgagaaggctggtttccctgccggtgttgtcaacatcatccatggtgctcaccgcactgtcgatttcatccttgatgagcccgctatcaaagccatcagcttcgttggtggtaacaaggccggcgagtcatnttcagccgnggatccgccaacggcaagcgtgttnaggccaactnggtgccaanaatacgctggngtttacccgacncaaaaaaaccagttat

SEQ ID NO: 424 - DNA, 528 bp, Fusarium venenatum
  misc_feature (1)...(528): n = A,T,C or G
aagagtcctcatcctttttttcatcgntggcgcagntatctccagtcgtctcttttctgtgattcgctttgagagcatcattcacgaattcgacccgtggttcaacttccgtgcgaccaagtacctcgtcgccaatgggttctacaacttctgggattggtttgatgaccgaacatggcatcctcttggacgagtcactggaggtaccctctaccctggtctgatggtgaccagcggcgttatctaccacgctctccgtaccctcactgtccccgtcgatattcgaaacatctgcgttcttctcgcgcccgctttttggattgacggcctatgccgcttatcttctcactaatgagatgaccactacgcactccggtggtctccttgctgcggncttatgggaatcgcccctggctacatttacgatccgcgttggtagttaccacaacgaaccatggcatttcctctcgcttncctntactttggggcaagnttttaaaaangtcganggtatnggggttctgcctt

SEQ ID NO: 425 - DNA, 773 bp, Fusarium venenatum
  misc_feature (1)...(773): n = A,T,C or G
gagatcctccagactaactgggagtccgctgtcgacgagctcaagaacgtgagagaaaacatcgactcaaagctcttcaacaacccccgtgctcagctcgaccaccgaacaatgcttctccactggtccctcttccctctcttcaactgggagggtgcccgggaacccatcctggaaatgttcttctccgctccttatatcaacaccatccagacctcttgcccctggatcctgcgatacctgatcgctgctgttatcaccggccgtggtcgcgctcgcaacagctcaatccaacaaaagcagatcaaggacattattcgctacgtccgccaagagcctacgagtacaccgaccccatcacccagttcgtcaacgctctctacatcgcccacgacttcgaggctgcccgtgaggctctttccatggccgccgaggtttgccgaagcgacttcttccttgcctcttctgccgatgcctttgtcgatgccgcccgacaccttatctgcgagagctactgcaagatcttcagccgaatgaacattcgcgacctcagcgccaagctcggcctgaaccccgacgacggtgagaagtggattgttaacctgatccgcgagactcgattagatgccaagatcgatagccaggacggcactgtgatcatgaaccaccctcccaacaatgtctaccagcaggtcattgaaaaaaacaagggtggcttcttcaggacacaggtactcaacgctgctgtttcaaagttaaaaacatgacnagtt

SEQ ID NO: 426 - DNA, 586 bp, Fusarium venenatum
  misc_feature (1)...(586): n = A,T,C or G
gtgaagcctgctgatattggtgtcattaccccatacgaaggccagcgaagctacattgtgactactatgcaaaactcgggaacttataagaaggagtactacaaggaggtcgaggtcgcttcggttgatgctttccagggccgtgagaaggattttattgtcctctcctgtgtccgatccaacgacaaccaaggcattggtttcttgtccgacccccgccgtttgaacgtggccttaactcgagccaaatacggtcttgtcattcttggcaaccccaaggtcctgtccaagcacgagctctggcacaacttgcttgtccatttcaaggatcgcaagtgcttcgtcgaaggtcccttgaccaacctccaggcatgtctgctccagttcagtcgccccaaagttagtttccgacagaagaaccaacagccgcagttcggaacagggagctactccaacggagggcgtttcaacccgcccccctcagccgggacttcgattcaagctccacggtgtcgtatattnccgacgatgtatcttccgttcatgggtctgcgttttggcggcgctttttnttaacancgccttn

SEQ ID NO: 427 - DNA, 635 bp, Fusarium venenatum
  misc_feature (1)...(635): n = A,T,C or G
ccgtgacttgatgctacagggaattattacacaatgctgctttccacagctctctacagtatcacgcgaagtccaggagcagctcaagattgatttccttgctgcacttnctaccgaactctcctacaagatcttatcctacctcgatacagtctccctctgcaaagccgcccaggtcagccgtcgatggcgaagccttgccgacgatgatgtagtctggcatcgtatgtgtgaacaacatattgaccgcaaatgcacaaagtgcggttggggtctgcccttgctcgaaaggaaaaaacttcaggcgtggagccgncatcaacaaaaccaccgcaaccgaatgccgccgacgtggntgagatccgacaccgaggttgagacacaacctagcgactcacgaaaacgtcaggccaccgacgacgaacacgaagattgcgatcgatctgttaagcgctctcgggccaatccttncaaatcgngacaacagcttgaagcagacgcaagtttcgaccatggaaagatgtataccgngacgcttcangtggggacactggagacaggccgtgtttatcaaaccttnanggtacgaaatggctgacatgcttcagtcgcgntacatcttgcnaaggttctac

SEQ ID NO: 428 - DNA, 589 bp, Fusarium venenatum
  misc_feature (1)...(589): n = A,T,C or G
cggccctcaaacgtctagtgactacgagcgattacttctgggacagcctgactcatcagagctgtggatcgcttacctcgcattccaaatgcaagttgctgagctttccaaggcacgagaggttgctgagcgagccattaagaccatcaacatccgtgaagagaccgagaagctcaacgtctgggtcgcctatctcaacttggaggttgcctacggaaccaagcaaactgtggaggaggttttcaagcgggcttgccaatacaacgatcagcaggagattcacgagcgactggccagtgtctacatccagtccgagaagctcaaggatgccgaagccttgtttgagacaatggtcaagaagttcggtgccaagtctcctaatgtctggctgaactacgcccacttcctgcacgccactcgaaacaagcctgacggactcgtgctctactaccgagagctacccagcaactcggcaagactcatcacacaaaccttatgactcgcttcgctgctctggagttcagatctccccacggcgaacctgancgtggacgaactatgttcgcgggtcttctagaagctttcccca

SEQ ID NO: 429 - DNA, 621 bp, Fusarium venenatum
  misc_feature (1)...(621): n = A,T,C or G
cttcaactttctatttaatcccgcaaaacatagcaaaaatgtccgtcgaaactgcctacgatcccaaggacatgctgttccgccacctgggacctactggtctcaaggttagtgtcttcagtctgggtggctggttgacatacggtggaacacaaaagggagacattgtcaagcaaatcttgcaaaaggcctgggatcacggtgtcaacacctttgacactgccgaggtctatgccaacggtgaatctgagattgagatgggccgagcccttaaggagctcaactggcctcgagacgaatacgtcctcacgaccaagttttcttcggcacaagtcgcaaggagcctaacacccgcggtctctcccgcaagcacgtcgtcgagggtctcaagaactccctcaagcgantgggacaaccttacgtcgatgttgtcntcgcccaacgcccgactacgctactcctatgaaggagattgttgangganttaccaagtcaatcgcaacctaaccttgcctacactgggnacccaaatggacgctgccaaataccgaggtacncaaattgctgacgttaaacccatgnccgtttcaacaaccataaancttcacgtgnggnttcaaa

SEQ ID NO: 430 - DNA, 815 bp, Fusarium venenatum
  misc_feature (1)...(815): n = A,T,C or G
taataacatagctaagttttattttctcagcatggttctagttccagccctggttgttgttgtagctcaactgctcttctgcatgttgccttccatgacgcttggccttctctgcgtcgacgtaatccaatcccttcgtctcaatctctcgatcaacaaaggcaccaacaaaacctgccaagatctcctttgcttgagcgtggctatcaggctctccattccgagcaacatggttctcataggccttggcagcctcgtaggctgcagctccacctatcagttcgtgtgaccactctgcctcatgaggacgttgcctgaattaacatcagcagcaaccgtcaaaatggtcaagaagagaaagaacaacggccgaaacaagaagggccgcggccacgtcaagcccatccgatgcagcaactgctcgcgatgcacccccaaggataaggccatcaagagattcaccatccgcaacatggttgagtctgctgctatccgtgacatctccgatgcctccgtcttcgcggagtacaccgtcccaagatgtacctgaagctgcagtactgtgtctcttgcgccattcacggcaagatggtccgtgtccgatccgtgtccggccgacgcaaccggcccttcttcttgcgtccgtacaacaaggacggnaagaagatcgttcccactaccctaaggttaaaangggtggatacttgggatggagtccggttatgaataccacatttaaaaaatgggtgggatgaatccctttgggatatgagactaagaaattccaaaaatcactggggccacgttggatgntt

SEQ ID NO: 431 - DNA, 840 bp, Fusarium venenatum
  misc_feature (1)...(840): n = A,T,C or G
ccgacctttctcttcttttccgactcaactcttcacatccttcaaaatgggcttcaccgacctcctttccgaaactggagctcacgtgctcaacagctggttgagcacccgctcttacattgtcggccaatctgcctctcaggctgatgtcgctgccttcaaggctctctctggcgctcccgacggccagagctacccccacgccgcccgatggtacaagcacatcgccagctacgagagccagttcgctaccctccccggtgatgcttctgctccctacagcacctacggtcctggcaccgctgangtgaccatcaaccccgctcaggcccctgagaaagctgaactgctgctgctgctgctgaggaagangacnactcgacctgttcggcagcgacgaagaagaagatgctgaagccgtccgcgtccgtgaagaacgccttgctgagtaccgccagaagaaagaagccaagcccaagacatcgccaagttcgtcgtcctcttgacgtcaagccttgggatgacgagactgacatggctgctcttgaggctgccgttcgttctattgagaaggacggtctgacctggggtgcttccaagctcgtccccgttggtttcggtgtcaagaagctccagattaaccttgttgtcgaggacganaagatctccgtcgccgacctcgaggaggagatccaggagttcgaggactacgtccagtccactgacgttgctgccatgcanaagctgtaaaaagcctgcattagctatgtcaacttatgatgaggcacgacggcgaggattgatgaccaatgggatcttatgattttcaaaaattngggn

SEQ ID NO: 432 - DNA, 631 bp, Fusarium venenatum
  misc_feature (1)...(631): n = A,T,C or G
aatcaattatagcttcaaccatggcttccgctcttcttcgatcaactcccgccctccgcgcaggccttcgcgcccgctctactcccctcgcggccatggccagcaccagcttcgtccgcggcaaggccactcttcccgatcttccttacnactacggcgctcttgagccctacatctctggccagatcatggagctccaccactccaagcaccaccagacctacgttaccggcttnaacaacgcagccgacgccctcgccgaggccaaccacaagggcgacgccaaggctgctgccgctcaggcacctnttctcaacttccacgggggtggtcacgtcaaccactccctgttctgggagaaccttgctcccaacggtaagggcggtggtggtgagcccgagggcaagcttctgacctccatcaacgaggactttggttctttcgaggcttttaagaagcaaaccaacgctaccctcgccggtatacaagggctccggctgggcttggctcgtcaaggacaaaaacgctggtacttntgtccatcgttacccgacctaaccaaggaccccgtcantggcaacctttgancccttctttgtatttgacnctgggagcacccctattanctcct

SEQ ID NO: 433 - DNA, 516 bp, Fusarium venenatum
caaatatttcgcaaacatcgacgcaaaatctacttacagcctacagaagttcatctaaccactggctgcgactactaactgcctataatggcctccaaatcaccaatcctccccgtggagggcaagcgcaacatcctcatcacctctgcccttccatacgtcaacaacatcccacatttgggtaacatcatcggcagtgttctttctgctgatgtgttttctcgctactgtaaagccagagattacaacaccatctacatttgtggctctgacgaatatggtaccgctaccgaaacaaaggctctcgaggaaggtctttcgcccgccgacctttgcgccaagtaccacgcccttcacaagggagtctacgactggtccgaatcgactttgacattttcggccgaacacccacccagcaacaaacacagattgtgcagcagatcttcaaggaactctggaagaatggtacattgaggagcgggagactacccagcccttctgtcacatgccaaccac

SEQ ID NO: 434 - DNA, 628 bp, Fusarium venenatum
  misc_feature (1)...(628): n = A,T,C or G
cttgagggtggcatggacgaccgcttggccacccatttcgctcatctntttatccgngaccctattgtcgtctttgaagaggatctccaagaattagatctcaacaagacggaccatttcnaaaacatccagtcaactaactggcagcatatgcgttttaagccgccacccgctgacaacagcatcggntggcgagtcgagttccgctctatggagatccaaattacagactttgagaatgccgccttttcggtgtttatggtcctagtcacgcgtgccattctgtcatttgacctgaacttttacatccccattaagaaggttgacgagaacatggagcgcgcacacgaggtggatgccgtcttgaagganaagttttacttccgacgcaaccctttccctagccgccgtntagggcaaacactacgttcggcgacgacagccgacccggatcaagctnattctagccgacctcaacccccggtggtcctgtggagcacgagtttgaggagatgaccgcaacgatattatcaacggctcaaagtcgggcgagtttcctggcctgatcccatcgnggagagctcctngacagngtgaatgtcgatgtttcaaccaaatgccncctgct

SEQ ID NO: 435 - DNA, 1072 bp, Fusarium venenatum
  misc_feature (1)...(1072): n = A,T,C or G
ctcgaatttctgcgaattatttccgacctgtgacgctgattttcgcctttcgcacaaacagggcagtcaaaccctaaggcctctttcccaaaggagtggggaaagcgagtttgtggtccctccgacctgttagggcaagagcttcagaatttctcaatttcagcccgccaacccacgtcccgtcgtcgaaaccgtcactcaccacccaagtcgccgagatggttcgatacgctgccaccgagatccagcccgcgaagtcggcccgcgcccgcggtgcctacctccgagtgtccttcaagaacacccgcgagaccgcccaggccatcaacggctggaagcttcagcgcgctgttaccttcctcgagaacgtcaaggagcacaaggaggccgtccccatgcgacgatacgccggcagcactggccgcaccgcccaaggcaagcagttcggtgtctccaaggctcgatggcccaccaagtccgccgagttccttctcggtctcctcaagaacgctgaggccaacgctgatgccaagggtctcgacaccggtgccctcgttgtcaagcacatccaggtcaaccaggcccctaagcagcgacgaaggacataccgtgctcacggtcgtatcaacccttacatgtccaacccctgccacatcgagctcatcctgaccgaggctgaggaggttgtccanaagtccgatgctgttgctgagcgtgagcaccttactcgcgccagcgtggtgcccgcctccgcaaggctatcacctctgcttaagccaatcaacaaccttcttctcaaatagacaaaatttaagcgctggttgaaaactgggtttacgtcgggcatcttctgtgttgtagctgtgactcttgacaagtctcttgaacaaagagacacaaacaccaagattacaaacaaaactcgatcaattgttctagggtttttgcgagggtggttcgtggcttttcatctcctggtgtatggcaggctacggtaagcatggnattaaagggaaacgcatgcaaaaattcgcaaggtttcttgacnaaataaaatctttcaagtcctaaa

SEQ ID NO: 436 - DNA, 763 bp, Fusarium venenatum
  misc_feature (1)...(763): n = A,T,C or G
tgtcatcgagcttcaaccacatcgnataccaacatcgacaacattctcaatacacgaccccatcgcaatcccctgctccgtcttcaattcgcaaactgagcaattcctgcaaatctttcgacctttaccttccgaaccacatttagcagctcgtttccctgacgtcaagggagctacnccaagatggcgctcgacgagtactaccacaacaagatcgaggcgatgaagctcgagatcctcangggtcaagccgcgcttcgtcgtcttgaagcccagagaaacgactacaactcccgagtacgattgttgagagaagagctgggtctgttgcaacagcctggatcctatgttggtgaggtcgtcaaggtcatgagcaccanagaagattcttgtcaaggtcacccagaaggcaaatatgttgtcgatgtgtcggatagcgtcgatgtcgccaaactcacccccggaaaagcgagttactctactgctgatagctcaaactcgaaaagatgctaccttcgtccgcgatcccctcgtctntctcatgatggtggagaaggttccgacagcacatacgacatgattggtggtctagaccagcagatcaaggaaatcaaggaagttntcgaactgggtnttaagcacctgagctttttgagtctnttggtatccacanccnaagggggtttgntatacggtcnttccggtcaaggaaananacttacttgnaagaactggtgcccccacactgctggaaattcatcca

SEQ ID NO: 437 - DNA, 571 bp, Fusarium venenatum
  misc_feature (1)...(571): n = A,T,C or G
cttgagtctggacatcgtcccccctctgatccacctcctgcagaacggtgacctcaagactcgcaaggaagcctgctgggccattagcaatgccacttccggtggtctgcagaagcctgagcaaatccgttacctggttgcccaaggctgcatcaagcccctttgcgacctactcggttgccccgataataagatcatccaggttgccctggatggccttgagaacatcctcaagattggtgaccttgacaagcaggctgctggcgagtctggcgactctatcaaccgatacgctctcttcattgaggagtgtggtggcatggagaagatccacgactgccagaacaacgccaacgaggagatctacatgaaggcttacaacatcattgagaagtacttctccgatgatgaggagaatgccgatgatggtatggctcagcaacccgccggccccaacggtncattcggctttggcaccaacggtgctgctccttcaggaagattcgactttgccaagggtaacgacccatggacatgttaagagcttcttgatcgaagatcggaatatcgg

SEQ ID NO: 438 - DNA, 726 bp, Fusarium venenatum
  misc_feature (1)...(726): n = A,T,C or G
ctcaattcactactttcgtcttcccatcactttcatagtatacatagcataccgaacgtttagaacgttcggaaaaggcgctctcttccttctttttatactttctttccccaagcgacgatccctttaaactaggtcttctttcaacgtcttgcgactcacgcgacccgcaatctgtcccattcactttggtatttcccaacacttcttcgtcgtcagcatggctagtaaagccgccaccaagcgtttgacacgcgaatacaaaaccatctctgagaacccccctccttatatcgttgcccatccttccgaatcaaacatcctggaatggcactatattatcaccggccctgaggaaacaccgtatcatggcggccagtactggggtactctcatgttccccccgaactatccatttgcccctcccgccattcgcatgcacacaccctccggccgattccaatcctcaacgcgactatgtctctcgatttccgatttccacccaaagtctttcaacccggcatgggaagctcgaccattctgattggactactgcattcatgacaaggtgaagaaatgacgactggttccgtttttgcacaagccgccgagcgaaaactactttgntggtaaacgcgtggtggaactcgatggcgggggtttaatcnaanagcacccacgacaaaggnatgnaaggtgtgatgcggcgcncgantcggcaaaagg

SEQ ID NO: 439 - DNA, 1184 bp, Fusarium venenatum
  misc_feature (1)...(1184): n = A,T,C or G
cgcccagcgtcccccaggaaaaggctatacaacagacaagtttggactttgatccacgtccgcctttactcgattatcttttcgcgcttggaatacttctcgacaacgatctatcgtcgtctctaatatcttcaacttcactcaattcctctctaatcgaacaagatggctcctttcactcctcgaggtggtgcccgtggaggtcgtggcggcgctcgtggaggcggccgtggtggtttcggtggtgatcgcggcggcttcggcggtggccgtggtggtgcgcgcggtggacaaagtggtggtcgtggcggtttcggtgatcgaagcggtcgtggcggacncggtggacnaagtggtgctcgcggcggtcgcggtggtgctgctggcgcaaaaggcggtgccaaggtcattgtcgaacctcaccgtcaccccggtgtcttcgttgtccgtggtggtaaagaaaatggtcttgctacccgcaacacaacccccggggagtctgtctacgganaaaaaaagatcagcgtcaatgaatcggtcaccaatgaaanacggtactaccccnctaccaaggtcgagtaccgcatgtggaaccctttccnaaacaancttntgtgctgccgttgnccggtggtgctgatgagatctacatcaagcctggctctcgtgtcctctacctcggtggtgcctctggtacttccgtctctcacgtcgccgacattgtcngacctaccggctacagtctaccgccgtcgaagttctctttccgatccggtcngtgacctcatcaccatgggcttccaaagcgacccaacgttgtccncattgttgaggatgcccgtcagcctgctcgttaccgcatgaatcgtncccatggtccgacgtcatctttgccgatgttgnccagcccgatcaggcccgtatcgtccncatgaacnnccaactggttnctcaagggcggaggtggtgtccttatctccatcaaagccaactgtattganagtnccggttccngntgccgangttttcnctgcgagggtccagaagatgcgagcttgagtcantcagcccaagntccagcttaccttggaaccctttcgaggcgtgaccatttgtntggttggccggcgaatactttgcncctacaagnaataaatggcttaaaggangcatacttacttggg

SEQ ID NO: 440 - DNA, 596 bp, Fusarium venenatum
  misc_feature (1)...(596): n = A,T,C or G
tgatattttaccgcaaaaaagaagcttcttgtcctgaccagagaaccattacctgttctcacgtctctacaagatggcatctctgcggtcgttgactgccccccttcgctgggcagcccccgcgaggggcgtcgccgctgtgcgatatagctcttcctcgacctctgccattgcctacaaggcccttcgtcgtcgctcggctcctctccccgtgcgcgacaaccctcccgcctggtccgcccagtccgctgtctccaacatcctctacgagacccccgttccatctaccgttcctcccaagcgacacatccttaactgtcttgttcagaacgagcccggtgttctgtctcgcgtctctggtattctggctgctcgcggtttcaacattgactctcttgtcgtgtgtaacaccgaggttgangatctgtcccgcatgaccattgttctcacaggccaagacggcgttgtcaagcaggctcgccgacagctcgaagatctgggtcctgtctgggccgtccttgantacaccaacgctgctctcgtccagcgcgaacttctcctcgccaagatcaacattcttggaactgantactttg

SEQ ID NO: 441 - DNA, 628 bp, Fusarium venenatum
  misc_feature (1)...(628): n = A,T,C or G
ctcaaaccaacaccatanatatattacaaccacacactcgaaacaatcgcaatcatgtctttcggtcgcactgtcaccctcaacttcnggatggaagattccccagatcggttacggcacatggcaagctgnccctggtgaggtcggcaacggtgtctacgaggccctcaaggctggctaccgccacctcgatcttgccaagatctaccagaaccagcgtgaggttggtgagggcatcaagaaggccctcagcgaggtccctggcctcaagcgtgaggacatcttcatcaccggaaagctttggaacaacaaacaccgcctgaggaggttgctggtgccctcgatgacacccttgaggagctcggccttgagtacattgacctctggttgatccactggcccgttgctttcaagaacnggaacgagctattcccnttgaagganggtgatgatggcaagactgctnttgaccaggangtcaccctcttncagacatgggaggccgtcaacaaactggccaaagagaaagtaccgctccgttggtgtctccaacttcaaccaggagatgcttgagcaaatcatcaaggacactggcgtganccccgccatgaacaaaattgagcgtact

SEQ ID NO: 442 - DNA, 606 bp, Fusarium venenatum
  misc_feature (1)...(606): n = A,T,C or G
tgaacttttttccgcatcgcccgtgcggctctccgagctcgccctgtcgccgtccgagttcccctccagcgaanaacctacgccgaggccgtccccgacaagatcaagctgagccttgccctccctcaccagtctgtctacaagtcccacgatgtcgtccaggtcaacatccccgccgagtctggagagatgggtgttctcgccaaccacgttccttccattgagcagctgaagcctggtctggttgaggttgtcgaggagtccgctggctccaagcagttcttcctctctggtggattcgctaccgttcagcccaactccgtctttagcatcaacgccgtcgagggttacccccttgaggacttcagcgctgaggccatccgagctcanatcgccgaggcccanaaggtcgccaacggcagcggaagcgagcangatattgctgangccaanatcgagttggaggttctcgagtccctgtctgctcatgtgaaataagcgtgcanttagtttgtggtgacggaggcccttgnacatcaaaatattctacccatattancacaaaagctgngacaattgataccaagtcctggttgngctacctct

SEQ ID NO: 443 - DNA, 639 bp, Fusarium venenatum
  misc_feature (1)...(639): n = A,T,C or G
ctccactggtctcggagaatgtccaagcagatgcttccgttggagttgatgttggggtggtagatgcgtgtggtgaagttgaccttgggaggcttgaaggggtagtcggtagggaagtgaatcgcaaggaagaagacaccgccggagtaaggggagtcagaaggacccataatcgtagcttgccagtgaaacagatcctcgccaacagggccagcggagcaggaagagggaggatctcggccgcgatcagaacaaagacatggatttacttcttgtacacaacaaaattttcgtcttttctctacacagattggtctcctcggcatttgacccccgcccacgcgggattggccagagttgagcgaaatttcggctcactttcggtgatctggagttggtgagacgaagttcgganaacactcccggtggaggagtcattgtatttgttgacaggagtttggctggcactcangaccggcangaacagaacattgaggtcggcgaattttggaaggattttttattttttattgagcaggactggtaattttactggtacatatacacanatttacaaccgcccttttgaaatggcgagacnaatgggccccaacaacaccggaaggcattgagcggtnt

SEQ ID NO: 444 - DNA, 797 bp, Fusarium venenatum
  misc_feature (1)...(797): n = A,T,C or G
tctgnccccgncgcacttttatatactctttctttctctctctcctctttcgcgactctcgatatatccccggaaacttcaaatttcttcaataccgtcaaaatggtcgagaagctctacgtcacctacaacgatgtgcacaagatgtgccaaaagtcagctgagaagcttctcctcgacttccagcccacgctcttgatcgccatcggtggtggtggttacgtccctgctcgaatcctccgatctttcctcaagaagggcggcgctcccaacatccccattcaggctatcggcctctccctctacgagtctctcggcaacgatgaggtcgaggcccccggtaccaaggtcacccgaacacagtggctcgacatgagcgctctcggcgagatgcagaaccttgtcggaaagaagatcctcatcgtcgacgaggttgacgacacccgaacaactctcgagtcgccgtcaaggacttgagaaggatgttgagattgcccgccagaagatgggtggtactgctccaagactgagttcagcatntttgtcttcacaacaaggacaagcccaagaangggaaanttccccgatgagatgctcgccacccgttactacgctgctgagaaccgtcggtgatgcctggatcaactacccctgggaggccatcgattatcgactagcacgacaggaacgctagcctgcagactaagagcaactaaatgtgttatgagaatttggagttgggaaaatggcgcacagatttaatgcgagatatcatataaacatacatcacgaatgag

SEQ ID NO: 445 - DNA, 647 bp, Fusarium venenatum
  misc_feature (1)...(647): n = A,T,C or G
acgatttttccctgagtacgacctcgaatggctctcttccgagatggacgtttcccttcctaaggagttggacttccaagaagaggctaacaatgcccgtcgtatgaaggagcactttgcgaagattccacagttgccgctgattattcccgaggtcatctgggccaagcaaaggattatcgttatggcttgtgaagctggaagtcggcttgacgatcttgagtacctggacaaaaacggaattgatcgcgacgaagtctcggccaccttgtcccgcattttcaacgaaatgatttttggcgatggcgcaccattacactgcgatcctcatggtggcaacatcgcgatccgcaagaacaccagtcgtcgaggtctcggccgtgggccaaactttgatgtcatactgtcgaccatggactgtatcgcgatattgaacttctatgcgaagatcgtacgcccagatgtggctcgcggttatcgatggtgatatggaccgtattaaagaaatatgctcacgaangttgcttggtattgagggacaaaggacttttcctcttttcgcctcggcaattactggtcnggactacagtatcggcaagcaaggtcttggaactattnttganaaaccgaacagnccgacgagccag

SEQ ID NO: 446 - DNA, 641 bp, Fusarium venenatum
  misc_feature (1)...(641): n = A,T,C or G
cgaggccccaccgagaagttcttccaggagaacaactactttggcctgagcgaggagaacgtcaagatcttcgagcagggtgttctgccttgcatctccaacgatggcaagattctcctcgagaccaagggcaaggttgctgttgctcctgatggaaacggtggtctctacaatgctcttgttctttctggtgttgtcgacgatatgcgaaagcgtggcatccagcacatccacgcctactgcgttgacaactgccttgtcaaggttgccgaccccgtcttcattggcttctctgccgctctcgatgtcgacattgctaccaaggtcgtgcgtaagcgcaacgctccgagtccgtcggtctgattctntcaanaacggcaagcccgatgtcgttgagtactccgagatcaaccagtccactgccgaggagacccgaccccaaagcagcctgatcttcttcggttccgngctgcaacatngtcaaccactactacttntttccgntttcttcgactntnttccccagggggtcacaagctttncccacacattcgcccgcaagaaaanccccttntgccgatcttgnanagcggggganacaatcaancctgaaaagcccaacgggtnttaagctctaccnn

SEQ ID NO: 447 - DNA, 575 bp, Fusarium venenatum
  misc_feature (1)...(575): n = A,T,C or G
agagtcgtccgagacaaaccagactgccgggtcccataatgaggacgtggtcgctgaaaagcagcccgtccctgttgatcccaaccggttcagtttcttttcttcggcatgggaatcaaccatccacgctgcggatttcggcgatcttgtgcttccgggcgaanatatccgtgggcttttcgagctacccgatgaaaaaaaaaatggtgtttggtggctgaacgttaacgcggccactaaggaagaagtgcagagcatttgcaagtctttcggtattcatcctctcacaattgaggatattattactcaggaagctcgcgagaagattgagctcttcccgtcatactaccttgcctgtttccgatccttctctgttgtcgaagaagatgacggcatcgagtacgaacccttcaacacatatgtcattgtattcagggagggtactctcagcttcagttttgagcccaactctcacgcagctcaagtccgcaagcgaatcactgctttgaaagattacgtctctcttagcantgactggatctgctatgctttaattgacnatattgtcgattcct

SEQ ID NO: 448 - DNA, 707 bp, Fusarium venenatum
  misc_feature (1)...(707): n = A,T,C or G
tcggccagcggtgacaggtggtatcagaagagatatgatcttcgctggacgaatcganggataaattatgctcatggtcagccctcactgccctccttgcctccaatgacaacagtgacgacggtgtcattaagcttgttgctctctttgatgatgaagagattggctctctccttcgtcagggggcgcggggtaactttctcccctctgtcatcgagcgcactgttgaagctctcaaccccaacaaatttggaccagaacttgtaggaagaacctattcctcctcattcttctgctcctcagacgtaactcattctggaaaccctaacttcctcgagaaatatctcggagagcatgttcccgagctaaatgttggtgtggtcatcgccaacgactcgaatggccatatgaccacagacagcatctcgactgcaatcatgcagcgtgcaaggcgaactaggcggctgccgaactcagaccttccagattcgaaacgacagtcgcagtggtggtactattgggcctgccctgtcaaatatgattgggtgtccgagccgccgacgttggacttccccagctcagcatgcactctatccgcgcgactactggctcactagacctggtctgggcgtcaagttcttcaagagcttncttgacaactgggagaagattgatgcngantggcactagagacagnagtagagaag

SEQ ID NO: 449 - DNA, 802 bp, Fusarium venenatum
  misc_feature (1)...(802): n = A,T,C or G
ctgaccgtgaatgaggccgttctcaagcaccttacttgacatcccgcatggagtaccttgacaagcccggtttccgcctcatcttcgagttcgctcccaacgacttnttcagcaacaccaccgtcaccaagacatactactaccagaacgagagcggctacggnggtgacttnatctacgaccacgccgagggtgacaagattgattggtcacctggcaaggacttgactgtccgtgtcgagagcaagaagcagcgcaacaagaacaccaagcaaactcgaattgtcaagaagaccgttcctactgagtctttcttcaacttcttctcaccacccaaggctcccaccgatgacgatgacgaggatgccgagtccgacatcgaggagcgtcttgagcttgactaccagctcggtgaggacatcaaggagaagctcattccccgtgccatcgactggttcaccggtgaggctctcgctttcgaggagctctctgacgatgacctcgacggtgccgacttcgacgatgacgatgatgaggacgaggatgacttgagcgaggagaacgacgacgaggaggagtccgacgacgatgacgaatccggcaagcctaagcaggaagctgccgagtgcaaacagagctgagcgaagcgatagagcgcgacgcaacgcacatttacactatcatgacatgattggcttttatcgggtttgaagattttatctgagccaccaaccttcctccgaaaaaaggagaggcggtgaacgacgggaagaaaaaggctacaaaaacgggaagcggtcga

SEQ ID NO: 450 - DNA, 578 bp, Fusarium venenatum
  misc_feature (1)...(578): n = A,T,C or G
aaagacaccggcgtcgtcctaagcttcaatggaagcttggtcagttgggcgcacacaaccgtcgcgtacactgccttcttcagcgcattggttatcggcctctgccttcactatcacaagatcgtccagaacgagttctacggttatccgcaagaatggtttccctnggtgtccgcaacaatcggcgatcgatacccagagcgatccttcttcatgatctttatcgccatcacatccggtcctcgattcgctcttgtcggcctatggtatcttctcacgcgcaagcccggccagaagctacccacgttcgtcgctgttatgggacttgtgcgaacactaacctgcggnggatggacgtacattacctctacagatgaccatgactggcacgatatcctgatgatttcctacattgntgcgacgcttccgnggacgactggntgnatcgcactcagccccgcaatccccaggccattaaataccgaaagtacctggcctcggntttcttcggacccttgggccattgatttacttttttattcancacaaggttcatcggggttgntgggagcttacac

SEQ ID NO: 451 - DNA, 715 bp, Fusarium venenatum
  misc_feature (1)...(715): n = A,T,C or G
cgcaaactcaaccagtcgcttaacgttgaacaaanaaatcccgccgaaaatgcctgttggaaccgttctcgttaccggnggtaccggctacatcggctctttcacctcgctcactctccttgagcacggttacgatgtcgttattgtcgattccctctacaactcctnagaggtcgccctcgaccgcattgagctgatttgcggtcgccgtcccgccttttacaaactcgatatcacagatgagaaggctatcgatgaggtctttgccaagcaccctgccattgatagcgtcattcactttgctgcgctcaaggccgtcggcgaagtctggcgttatccctctcgagtactaccgtgtcaatgtcggtggtagcatctctctcctccgctccatggagcgcaacaacgtcaacaatattgttttctcctcctccgctaccgtttacggcgatgctacccgattccccaacatgattcccatccccgagcactgccctatcggacctaccaacacctacggtcgcaccaagtccatgatcgaggacgttatcaccgactttgtcaatgctcagcgcaccaacttggaaaaagagggcaaggagttcaaaccagtggggaacggtgctcttctgcgaaactttaaccctttgcggtgctaccccactggtatcatgggtgaggacctcagggtattcctttcaaccttctgccctct

SEQ ID NO: 452 - DNA, 506 bp, Fusarium venenatum
  misc_feature (1)...(506): n = A,T,C or G
aaaagangagaaaaaagttgctgttactttaagacttacaacagaagaaaatgagatattaaatagaatcaaagaaaaatataatattagcaaatcagatgcaaccggtattctaataaaaaaatatgcaaaggaggaatccggtgcattttaaacaaaaaaagatagacagcactggcatgctgcctatctatgactaaattttgttaagtgtattagcacccgttattatatcatgagcgaaaatgtaataaaagaaactgaaaacaagaaaaattcaagaggacgtaattggacatttgttttatatccagaatcagcaaaagcccgagtggttagagtatttaaaagagttacacattcaatttgtagtgtctccattacatgatagggatactgatcccgaaggtaggatgaaaaaagagcattatcatattctagtgatgtatganggtaataaatcttatgaacngattaaaattattcccgaagaattggatgcgact

SEQ ID NO: 453 - DNA, 655 bp, Fusarium venenatum
  misc_feature (1)...(655): n = A,T,C or G
cgcaacgccacaccccacgatccctcacgatggcgaccctcgcgaccgcttctcgcctctgcctgcgcgcggctgctaagcccgtcgctcccgccgtccgcgccctcagcaccaccgccgttcgtaccgacagcgcgtccgcctctggatactccagccccttcaagttccaaggagagtccaagggctcccagatccctgacttcggaaagtacgtctctaccggcagcgagggcaanaacaagctctactcgtacttcatggttggcgctctcggtgccgtcagtgctgctggtgccaagagcacagttcaggagttcctggtcaacatgtctgcttctgccgacgtcctggccatggccaaggtcgaggttgaccttgcctctatccctgagggcaagaacgttatcattaagtggcgaagcaagcccgtnttnatccggcaccgaacccaggacgagatcgaccaggccaacaaagtcaacatnttttttnttcganatcccgaagangatagcccccgtgccaaanaacccaaagtggcttgtcatgttgggtgtctnccccacttgggttgggccccattggnganggcggtgactaccgggggtggtttttnccttgcncngtttttaatacaaatntttgggccaaa

SEQ ID NO: 454 - DNA, 649 bp, Fusarium venenatum
  misc_feature (1)...(649): n = A,T,C or G
gagctcaagaccaaggttgaatctcttgccgcgagcctcaagttccccctgcacgagctctacgtcatcgatggaagcaagcgaagcgcccactcaaacgcctatttctttggtcttccctggaagaagcacattgtgatctacgatactctgattganaagagcgagcccgatgaggtcgtcgccgttcttgcgcacgagttgggtcactggaagcttggccatactaccagtctcttcggtatctctcaggctcactctttctacatcttccttctcttctctgtcttcatcaacaaccactctctgtactcatctttcggtttcctcaaagagcatcccattattatcggattcatcctcttctccgatgctcttgcccccatggatctcgtcatcaatctgcttatgcacattgtcagtcgcaagttcgagttccaggccgatgcttttgccaaggggcttggttaccccgangcagcttgcccgctccctcctcaagctccagatccagaaccttancactatggatgccgactggatgtatgccaactaccacttttttttaaccttacttgggctgaagcgactcaacgccctttgggctggaangggtccganggtgtacccganggcttacttgacaaag

SEQ ID NO: 455 - DNA, 631 bp, Fusarium venenatum
  misc_feature (1)...(631): n = A,T,C or G
gaggggttgcgatgtccccattccatccatccaaggacgccctccagggaacattttacagcccactctcagcaacaaaccgcactccatatcaggctcgcgctgaactctttcccatccattcctccgtcattgaagatgccaagggtaaagctaagcagctgagcgctgaagcaacagccgantttgaaaaggcgagcgcaaaagctcaagccaagactgggaagatcgaattatactctggcagatactatgctgcctgtacctttggcggtttgatggcctgtggactcactcacgctgctgtaactcctctagatcttgtaaagactcgtcgtcaagttgattccaagctctacacaagcaacttccaggcctggggtaagatctatcgcggcgaggggatccgnggtatctttactggctggagtcctacgctttttggttattctgctcagggtgccttcaagtatgggtggtatgagtacttcaaaaagacctactcggatatggctggcccagaggcggccaccaagtacaaaactggtctgtatcttgccgccttntgcctnaaccgagtttcttgccgaccttgtttttgncctttgaagctgcaaggtcgatgcagggt

SEQ ID NO: 456 - DNA, 701 bp, Fusarium venenatum
  misc_feature (1)...(701): n = A,T,C or G
nttttataaagcgctcaaaanacatgancctacccagttgacaccatggttgatgtactgggttgncctcagctgttgctcctcgttgagtcttgggtctggtttattatttcatggatccccttctatggatactttcgtttgcttttcctcctntacctcatcctcccccaaacgcaaggcgcccgactcntgtatgaggaatacgtccacccgtaccttgaaaagaacgagacgcagattgacgacttcatcgcgagcgcacatgagcgcttgactgctgccggaatatcatacctcaagctcgccatcgagcagttcaaaatcaaggtcctcggtctgccaccctccgaacccgagtcgcctcctcccgagacaaaccagggttacacgcagtcgcttctctcgcgcttcaacgttccatccgcgcgatgggccggcaacaacagcggcagtacaggtaccgacttttacagtctgctttccagcgctgtagcagctgctaccaacgcgggtgctcagtcagctggtacaggacagtgggtgggaaaaacctaccaacccccangcgttgattcccccgcatctgcgcgagtctggaccaagatggactttatttccactcagcgcgaccgtctaaacgttcttctctcngcactcgatcgcgaaacacagatnttcgctccgaccccaacgcgctc

SEQ ID NO: 457 - DNA, 559 bp, Fusarium venenatum
  misc_feature (1)...(559): n = A,T,C or G
caacccagcggaggatgtctccgactgtcttactaaaaggtataccgttgaggacaccatgcccgccagaaatgaagactgcgatgtaaggtgtatcttaagtaaacccgtctccccacacatcggaaagattaagcggactgcgaagcttttgcttatacttgttgtgaattgacttgacagcctcgtcctctttggggaaagcccacatctcgaacttgacgggatctcccgagagtgtggctacatcaatgtcaaaacctgcagcgtcgaggtggtacattggtagaaacatctcaactgggtggttgccagtggaaaanaactttccgtctgccatcttngagataacgctcttgggtgccgatcatgaagatcttccatttgccgccggtgtacttgtttggatagtcggcgccgtcaaagtccgtctttgaggtgacctactgcgtgagggaaaatggtgaagggaagtatgcgtcgtcttccgccatgtcgcggacgggtgccttgtcgttttggtctgacattatgtggatttgtatggagtaagttgttt

SEQ ID NO: 458 - DNA, 620 bp, Fusarium venenatum
  misc_feature (1)...(620): n = A,T,C or G
tcatcctggcccatgtcgtcctttcggtgttcactctaacggtttctctcttgctcgccgtatcgtcactcacgctggtctgagctacactgacgccgctccttgggatcaatccaccacagttggcgagtctctcctcacccctactcgaatctacgtcaaggctctcctccccatcctttctgagatcaagggtcttgctcacatcactggtggcggtctcgtcgagaacgtaccccgcatgatccccgaatctcttgccgccgagatcgagtttggctcatgggagatcccccctgtcttcaagtggctccgtgaggctggcaacgtcgagcctatcgagatgtgtcgcaccttcaactctggtgttggtatggttatcgccgttgatgccacaaaggccgatgccgttgcccagaccctcactgatggcggcgagaaggtgtaccgcatcggcgctcacccgacgtgaccaaagcgangcttggctcattcacaacgtngactcgtggaanggctgaagaccacggtgcctagcaagcgaaaagaatattggaacgtgattgggataagaaaaatatgcgaattatgggagtccaatttcggtttatgaatgggaa

SEQ ID NO: 459 - DNA, 624 bp, Fusarium venenatum
  misc_feature (1)...(624): n = A,T,C or G
aaacgctacggcactaccaacaagcttgcgccttcgcaatccctaccaaagtccactggcgcctggacctaaagatctcctgcgacggctacggtgacctggaactatcttacgcattcaaaatggcggtttccggttctgtggacagtcccgtcaagcagcagcttgtggacaagctgccgaagcgattcaagggcattaaatttggtatccaatctaaccaagacattgccaaccaagctgttctcgaggtttccgatcgcctattgtatgacatcgagaacaatcgcgctccatatcgccacggccctctagactctcgattgggtacctccagtaagcaaggaagatgttcgacctgccaagagtctctcaaagactgcaatggccattttggccatgttcgcctgccgctgnctgcgttccatgttggatatnttcgnttcatcatgtcgattctgcaagaaatatgcaaggactgtggtcgagttttgcttgangagcccgaacgacaacagttnctgaaggagctacgacgaccattnctagacaatttacgacggacccaaatatgcaagaggatcaacgaacaatgccgaaaagtaanaacttgtccttattgng

SEQ ID NO: 460 - DNA, 641 bp, Fusarium venenatum
  misc_feature (1)...(641): n = A,T,C or G
ctcaacaccaacatcgacgaggttcagtacgatggtgacaaggctgttggcatcaaggccactatgactggcgtcgaagagatgaagtttgagactaaggccaagatgatcctcggtgacccctcctacttccccaacaaggccaaggttattggccacgttctccgagctatctgcatcctgaagcaccctcttgctggcacgaatgatgccgactccgcccagcttatcattccccaatctcaagttggccgaaagaacgacatctacatcgcctgcgtttcttccgctcataacgtctgccccaagggctactggatcgctatcgtctcaaccattgcggaagaacacagccaaccaccacgtcgagctccaggctggtctagaccgcatcggcaagattgaggagcagttcatgggccctcctatccccatctacgagcctcttgangatggttccaaggacaacatcttcatctccaagagctacgatgctactagccacttcgaagacaaccacagacgacgtcaaggatatctaccgccgcgccactggcgaagagcntaaggtananggtttgagggaaaggtatccaaggttgctgaaggagcaattaaaagtctcacgancagtaaacagg

SEQ ID NO: 461 - DNA, 572 bp, Fusarium venenatum
  misc_feature (1)...(572): n = A,T,C or G
cgccttcgctttgtctcgcttctttttccatctcatctcttttctcttctctataccttgacaagtcggaagtgctttcgctccgccataaacagtccttcgttcttctcgtcacgacctgcgagcattgttaataactaacgtcgacggctttagcccagaccatatcttgcgacatcgacgacacagcaaatactgtgtcgttcacctcatttaatcaatttcagtaattcttttttgccgttccgaagaaaaaccaaacttccgtcacaatgggttgcggaatgagcacagangagaaaganggcaaggcccgtnacgaggagatcgagaaccagctcaagcgcgacaagatgatgcagcgaaacgagatcaanatgctgctgctcggtgccggtgaatccggaaagtctactatcctgaagcagatgaagctcatccacgaaggtggctactcncgcgatgagcganaatccttcnagggaaatcatcttcagcaacaccgttcaatcaatgcgcgttatcctcnangctatggantctctcgaacttcctcttgaagaccagcgcat

SEQ ID NO: 462 - DNA, 647 bp, Fusarium venenatum
  misc_feature (1)...(647): n = A,T,C or G
cattcaatcaaccccagacctagagtttatctactccgacttcctcatatctaactctttcattcctactttcgcctattgcgcccttcaacccacttacaatcccatcctccctacaaactcggccaagcaatcatgaagctgcattacatcggtgtcctccgcaacgagagccagccggctcatgagattgtcgctgaaaaggagctcagcagctactcgcgatttacccgcaataactatggcgaattcatgacactattcgcaaagactgtcgccgagcgcacccgtcctggacagcgacaggatgtcgaggagcaagactacactttccacgcctacggccgtacagagggtgtctgcggcatcatcatctccgatcaccagtaccctgcccttgtggctcaccaacttctcagcaagggtgtcgacgagtttctctccaagaacccccgctccagctgggcaaccggaacacccactctcgccatgcctgagctgaaggagtacctcaccaagtaccaaggatncccagcaggctgacagcatcctcaagattcaagaaggagctggacgagaaccaagattgttctccataagaacattgagagggtgctacagcgtgggagagaaaaatcgacgattta

SEQ ID NO: 463 - DNA, 541 bp, Fusarium venenatum
tctacacctacttgaaataagctatattccccgaacatttttatcagccaataattcaagaacatccatatcaaataacttagaacattgggcttggttttcaacaaagccaacatgcttgggccctctccgttctttacttttaatgggcttaccaagctccggccattggctgcccccgggatgaacgcggggtttgggtcgccagcaccagcaattggcaaatccctcagtatccgggctcttccgggactctccaagcggcggttatgcgccaaaagtggttgactgtccctcgacgcgcccgaaaatccgacttgccgatggactttcagaccaggaagaacctgggttcgtcgccgaagaaacaacacaatagatccaatgaaagacttgttatcccgagtcaacatctcgggtttcgacgccgaaaagtggattgagaaaaacaaaaacaatgcgactgcgctacctaacatcgccatcgcagcttctggtggtggataccgagccctcatgaacggaacaggcttcatctctg

SEQ ID NO: 464 - DNA, 847 bp, Fusarium venenatum
  misc_feature (1)...(847): n = A,T,C or G
gcggtggtgtcaccactgtggttgacatgcctctcaatgccatccctcctaccactacccttcatggcttcgaggagaagcttcgagcaagccagggtcagtgctgggttgatgttggtttctacggtggtgtcatccctggaaatgccaatgagcttcttcccctcatcgaggctggtgttcgaggattcaagggattcttgatcgagtctggtgttgatgagttccccgccgtctcttctcaggatatcgccctggccatggaaaccctcaaggatagcaagacactctcatgttccacgccgagatgatccctcccatcaccgaatccgtcggcgacacagtccagacctcagaagcaaccctcgctcccgccggtcaactcgatgcctacaagacattcctcgaatctcgacctcctgctttcgaaacatacgccgtcgaggagattctcagccaggcacacattgctcctcaagctccaccttcatatcgtccatctctccgctacccagtgcattcctctcctcaaggncgctcgccaatccggaatcaacatcactgccgagaactgcttccactacctcgggttgaccgccgaggagaatgagaagggcgacactcgacacaagtgctgcccacctattcgagagggcaagaaccgcgatggctttgggaagagctcgtcgctgangattcatgcatcagaactgttgtgtcggatnactcaacttgcacacccaactgaagctccttcctcaagaactcgagacacgcganccgacttgcacataacgactcaggatcgtgattcctgtcccgagatnagaacctgtcnccgaaggaa

SEQ ID NO: 465 - DNA, 934 bp, Fusarium venenatum
  misc_feature (1)...(934): n = A,T,C or G
aatcaccagaccttgaccgcaacccacttccaccatctaccatcatcacataaattcccaaccaccccttgctttctcgaagcatattcataaccacatttcgcttatcttgtagactcaaaccatattcacaaccgatcatatcaaccgccaaaatgtctgcttccgagcccaccgagcccaaggtcgaggagaccaagcctgaggagaccaagcctgtcgaggctgaggttgctgctgagaagcctgttacatcctcctccgtcttctccatgttcggcggcggtgccaagaaggagaagaaggaagacgaggagcgcggcgataactctggcagcgctaaggctcagcgagaggctgctgaggccgccaagggcgatgaggaggatgctcccgagtccgaggacgttcacttcgagcccgtcatcaagctgaccgagaaggntgacaccaagaccaacgaggaggctgaggagcagactttcaagatgcgcgccaagcttttcaagttcgtcaaggagagcagcgagtggaaggagcgtggtactggtgacgttcgcctgctcaagcacaaggagaacggcaagacccgactggtgatgcgacgcgacaagaccctcaaggtctgcgccaaccactacatcgtccccgagatgaagctttcccccaacgttggctccgaccgcagctgggtctggaacgcccgcttgccgatgtcagcgagggtgagcccgaagcttgttaccctggccattcgattcgccaacgctgagaacgccaacaacttcaaggattctttcatgaaggctcagaaggagaacgaagagatcttccacaaggnttcaggacgccgaggttcttccttcctaaacagcttgcacttagaanccttccnaatcccctgccctttcggaattcatctcaatatttccac

SEQ ID NO: 466 - DNA, 270 bp, Fusarium venenatum
aagcgcttcttctgtcgctacccagagtgttctcaatcaactcaagacctacaggaagtgggcaccaaaggcttcgcgactcggaaggaccgtgctcgccatgagtccaaacacaaaccaacagtgcggtgcccttggcacgaccaggaaggacaacaatgtctaagggtcttcagccgtgtggataacatgcgggaccactacaggcggatacacaagtgttgacgagggatcgatgtaaataattactaataaaaggcaacttttgcg

SEQ ID NO: 467 - DNA, 495 bp, Fusarium venenatum
  misc_feature (1)...(495): n = A,T,C or G
gtcntcaaaatggtcaacattcccaagacccgtaacacctactgcaagggcaaggagtgccgnaagcacacccagnacaaggtcacccagtacaaggctggaaaggcctccctgttcgcccagggaaagcgtcnatatgaccgcaancagtccggttatggtggtcagaccaancccgtcttccacaanaaggccaagaccaccaagaaggttgtccttcgattggagtgtgtcaagtgcaagaccaagctccagttggcgctgaacgatncaagcacttcnagcttggtggtgacaagaaacaaagggtgctgtctcgttttctaagtgctttgtgtttggggtctcagggtcaccatttctatgcttacctcnccngcatttgggcatcatggatggacacaggcgaaangaggtacacgccntcggtttgangcatgtttcatanggaatgaatgaaaanaaaaaatntctgtgttgcaccaacacactttt

SEQ ID NO: 468 - DNA, 626 bp, Fusarium venenatum
  misc_feature (1)...(626): n = A,T,C or G
ccgagatctcttctaccgacctgagagaatggtcgtggcatatgctggtgttgagcacagcgaggctgtcagactaacagagaagttctttggcgatatgcaaaagggcacacagcagaccacagagacaactggttccgagaccagcgaaagcgaactatcagatagcgaagctagcgcatcctcagtctcttcatcaccacagtcatcctccgggcttctttcacggttctttaagaacacaccttccgctccccagaatctcaacattctcccctctcaagccgatattgcacgcccctccaaatatacgggcggtttctcctggctccccgctcaaccacctaacctgagcggtctccctactttcacacatatccacctcgccttcgaaggcctccctgtctcttcggacgatatctacgccctcgccacactccaaactctccttggtggtgggtggttccttctctgctggtggacctggtaaaggcatgtactctcgcctatacaccaatgtcctgaaccagcacggttgggtcgagtcatgcatggccttcaaccaatcctacaatngactccggtncttttcggcatctcaacaagctgccttgccccggacgaaa

SEQ ID NO: 469 - DNA, 655 bp, Fusarium venenatum
  misc_feature (1)...(655): n = A,T,C or G
ggagaacagaaatctccagtagaacaaaagggtaaaagtccccttgattttgattttcagtgtgaatacaaaccatgaaagtgtggcctatcgatcctttagtccctcgacatttgaggctagaggtgccagaaaagttaccacagggataactggcttgtggcggccaagcgtgcatagcgacgtcgctttttgatccttcgatgtcggctcttcctatcataccgaagcagaattcggtaagcgttggattgttcacccactaatagggaacgtgagctgggtttagaccgtcgtgagacaggttagttttaccctactgatgacctcaccgcaatggtaattgagcttagtacgagaggaaccgctcattcagataattggtttttgcggctgtccgaccgggcagtgccgcgaagctaccatctgctggataatggctgaacgcctctaagtcagaatccatgccagaaacgcggtgataccacccgcacgtatagatggacangaataggcctcggnttagcgtcttagcaggcgattcntccacaggcgctcnaagcgcgtcgtggnatttcctgtattgtaatttnaacacngagcnggggtcaaattcttttgcagacgacttagctgtgcgaaacnggnctggtaa

SEQ ID NO: 470 - DNA, 606 bp, Fusarium venenatum
  misc_feature (1)...(606): n = A,T,C or G
cggctccgttgtcatgggctcaaccctcaagctcggccatgacgccaagactcaccaggaggtcaacatccccttccacaacatncttcccatggtccaccccaatgacttggtcatcggcgggngggacatcagcaagatgaacctggcacaggccatggaccgcgctcaggttcttgagcccactcttaaggcccaggtcaagaaggagatggcggaaatggttcccctcccctccatctactaccctgacttnattgctgccaaccaggaggatcgtgccgacaacgtncttgagggaaccaangcccgctgggagcatgttganaanatccgtcaggatattcgtgacttcaaagccaanaatagtcttgacaaggtcatnatnatgtggactgccaacactgagcgatacgccgacttgatcaagggtgtcaacgatctgccgacaaccttntnaaggccattgagcagggacatgangagggttccccttctactgtntttgccggcgnttgtattcttgaacaagcccctttnattaatggntcttcccaaaanaccttcgccctgggccattgactttgntganaaacacaacncttt

SEQ ID NO: 471 - DNA, 666 bp, Fusarium venenatum
  misc_feature (1)...(666): n = A,T,C or G
catgtcgtcccaagcggccaaagccgccagcaacgtggtcagcatcgccaagaancaaaccctccagtcgactggtatctgggaggccttccgtcgtttcctggccatcgaccctgagcgctccaacggtgtccctctgaaccctcacttccgtaaccctccccccggcgccaacgaccctctccagtacgacgaccccgttacgctgccagctggcgacatcgccgacaatncttactggaagcgcgacaaccgccgnggctacccccagctcagcgtcgtcgaccagtcccagttcgcccagctccttaccgttggtagcgctgaagctcccaaggtcgatcttatcggcgaggctggcganaagcagctcgttgctgtgaagcaggagtccgagactggcctggcaaaggctcttgataaggcgggcaacgcgactaaggatgtttttgtcaacggcatgccttctctgcccagcggccagactctgaacactggaaagngggatgtgcacaagtacgagcttgaggagtcatcttatggtgaaggatacccttgcgggtcattcaaataaattagaagcgaactgaagatgtgttgataccacattatgaggtattgagggtatataatttccattgacagcagatgactttntttttttcc

SEQ ID NO: 472 - DNA, 615 bp, Fusarium venenatum
  misc_feature (1)...(615): n = A,T,C or G
gtcttgacaactcctcgcaacttcactaaccagcagacaacacaccgccggacaagatgaagttcctcaaggtcggccgagtcgccatcatcacccgcggcagatacgccggaaagaaggttgtcatcatccagcccgttgacaacggcaacaagcctcaccctttcggtcacgccctggttgccggcattgagcgatacccctccaagatcacccgccgtatgtccaagacccgccaggagaagcgaaacaagatcaagcccttcatcaaggtcatcaactacaaccacttgatgcccactcgctacactctcgagctcgagggtctcaagggtgccgtctccaacgacaccttcaaggaggtttctcagcgcgaggacgccaagaagactgtcaagaaggtgctcgaggagcgatacaccagcggcaagaaccgatggttcttcacccctctcaagttttaaaaaaggaatcgtttctccatcacggttagggagttggcgggatgtaaagagcatcgatggcattaaggaaccccggnttttatgggctcaatacgaagtttcttaaaacaaaaatcaattttantttgcccgngatggacgncaattccac

SEQ ID NO: 473 - DNA, 453 bp, Fusarium venenatum
  misc_feature (1)...(453): n = A,T,C or G
agagcagaaaccaggtattattgtcggcgctggcttggctggccttgtcgcagcctttgaattgtcagaaaaaaacatcccagtccttctcctggatcaagaaaatgagcaaaacctaggtggtcaggccttttggtcacttgggggcgtttttatggtcgactcgtcttaccaacgcagaatgggaatcaaagactctcgagagctggccatgagagactggttcggttcggcgaggtttgatcgcgaagaagaagattactggccaaggaagtgggccaaggcttttgtcgactttgcaacagacgagatggaagattatgtcaaagctcgaggactggctttctgtataacgttgctggcccanaagggagacggtctgctnccggccccggaaatctgtgcctaggttccacgtcagttgggtacaggaccagaggttgcanggttttc

SEQ ID NO: 474 - DNA, 591 bp, Fusarium venenatum
  misc_feature (1)...(591): n = A,T,C or G
tcttattggtgttggtacccgtatcgaccctacgctttgccgagccgatcgtctcgtcggtttcgtgctgggtctcaagggccgcctgcccgagatttacagcgagattgaggttaacttctacctcctccgtcgccttctcggtgtcagaactgccgacggcaagcaggccaaggttgctaagctggccaagaacgaggttatcatggtcaacatcggttccacctctactggtgccaaggttgccgctatcaagaacgatgctgccaagcttgtcttgaccagccccgcctgtaccaacattggtgagaagttgctctcagccgacgtatcgagaacattggcgtcttattggttgggctaccattgctgctggtgtgacactcgacctagcactgcttaaaagatcatgtagacaacgaaagattaaacaaaattccgcacnatttcgctactgatatacgaatcnagacccagttccanacaaacctcgaagcttgataanggtgcctgacaagcatgtttaaatgtctttcggactgggggcagaaagggttaanatctgtcaacgctgacctgtacnacganaat

SEQ ID NO: 475 - DNA, 817 bp, Fusarium venenatum
  misc_feature (1)...(817): n = A,T,C or G
gcaaggctgggctaaatggtagctctctctcaacttcatcatcaccatcaaccccccgacgacgacggatttttaactccatcgccagcgatacttttcaccactacagaagtcattgatctcatccattacactccacctcccctacacaaaccatggatcaccgtccacaagcttggggccgtcccagagacgatgtttacggcgcctatgatgcctcattcatgaacgataatggccccaagcaaaacacccagcagcccatcgttactggtacctccgtcatcgccgtcaagttcaaggatggtgttgtcattgctgctgataacctggcttcatatggctctctcgctcgttttacagatgtcaagcgactccgtcccttcgccaactcatcggttgtaggcttcagcggcgacatctccgacatgcagtatctcgaccgccacctcattgagctttctctcgacgaggcttacacctnccccgatgccccgcgtctcaacgccgcaaacctncatcgctatctcgccaagcttctctaccggcgncgttccaaattcgaccccttgnggaaccatcttcttggtgctggtctcgacgatgacgacaagcccttnctcgctgncgncgaccttctcggcagcacctacagtgcccccagtctggccaccnggttttgggtccatgctggcccaanctatnatgcgtcgccatngtcctcgatgaaggaggcctcccaaaaccttgacaaaggagggctgctatnaacattatnaaggagtgtatgaangntctatacttaccgtgacgctcg

SEQ ID NO: 476 - DNA, 649 bp, Fusarium venenatum
  misc_feature (1)...(649): n = A,T,C or G
caactaactaccttgacaactcctccacaacacctnttctacttccggcaggctgaacacactacactaccttgccaaactcgtccagctatatcacatctactgtccgctactacttacagggtactgactattctccgacatggagaatactcatcggaattactgggaaaaggacttcactatcatcgcaggatccaaggctgcgatgcgaggtgccactatcctcaagacatctgatgataagactcgagctcttaacaaacacaccctcttggcattctctggagaagccggtgacacagtgcaattcgccgaatacatccaacgaaatgcccagctctactcgatgcgaaacgagtccgacttgtcaccctctgctcttgcccacttcgtccgcggagagctcgctaccagcttgcgatctcgaaagccctacaatgttaacctccttatgggtggtgttgaccccattactggcaagccagccctctactggctcgactacctagcgtcgctggccgaagttccttatgctgcacatggctaccccagtactactgcctctccatcctcgacaagcatcaccacccgatatcctctccaccagggctcaagatctgacatttttncgacaaataaacgggct

SEQ ID NO: 477 - DNA, 1115 bp, Fusarium venenatum
  misc_feature (1)...(1115): n = A,T,C or G
ggcaagagcagcatgaaggactctggttactctacccaggccgagttcttcaaggactactctgtccccgttttcttcgctgagtacggctgcaacgagcccgatggtgctgccaaccgtatctttgacgagaccactgctctctacgaggagaaggagatgactgatgtcttcagcggtggtatcgtctacatgtaccaccaggaggccaacgactacggtcttgtcaagatcagcaagaacggtgacgctgtcaagcagaaggatttcgctcagctcaagaagaaggctaccgctgctcagccccagggtgttgaggaggacgactacaagcccactggaaagactcccacctgccccacccagtccaagacctggagggttaacgcccttctcccccctacccccgacaagtccctctgtgactgcatggtcaagagtcgaanctgtgttcccgccgacgacctcaaggctaaggactttaacgagatctttggttacatctgcggcgagaacaagaagatctgcactgccatcaacgccaacgctaccgccggtatctacggtgcctacagcatgtgtgacaacgaggccaagctcgcctacattctcgatgcctactacaaggagcagaacagcaacgccaacgcctgtgactttaangggcaaggccaccacccagaaggctcaagaaccaggacttttgcaaggctaagctcgagtctggttgcaaagaatcaaacgaagggaagggttggctactgctacttgctgntggttggccccctttccaccggcgaagtttaagaaccgaggacgacgatgagtccttcggtctcaagcccgctacatcgcccgcgtcttctctctcggcgactacctgtcggcgcctacatggcttgtcgccggtgttgtcngtgcccggtatggtccttctgtaaagtgatttttggatggatcatggtatgactcgtatcttcttagcggnggcctttttggaatgtgcgttattcccacattgtgtccttttttcttgtgtatctagcatcgctttcatggcttgtaattaagaacgattatagatgtctaataccatcttgcgcgaatgatatgcc

SEQ ID NO: 478 - DNA, 631 bp, Fusarium venenatum
  misc_feature (1)...(631): n = A,T,C or G
aaaagatgacattcttgctgccaacgcaaaggatcttgagcttgcaaaaaaagctgctgccgagggtggtcttagccaagctcttgtatcacgattggatttggggaagaagggaaaatgggaggatatgctcaagggaatcttggatgtcagggatctagatgaccctgttggtcaaattcagatgaggacaaagcttgatgatgatctcatgatggagcgtgtctcatgccccatcggtgttcttctcatcatctttgaggctcgtcccgaggtcatcgccaacattgcttctcttgctatcaagtctggcaacgctgccattctcaagggtggaaaggaatccacagaatcctttgtcgccatctcaaaggtcatctcatcagctcttgagaccacaaaggtccccaactcagctatccagcttggcacaacccgcgatgccatcgccgacttntccccaggaccgntatattgacctcgtcattcctcgnggctaaacgagctggtccgttcattaaaactcaccaanattcctgttctcggcnccctgatggctctgcccatttacctgatgtttngncgaaaggacaaggntttactgcatcgtgctccaaantantaccccncn

SEQ ID NO: 479 - DNA, 558 bp, Fusarium venenatum
  misc_feature (1)...(558): n = A,T,C or G
aacgaatacaagtcgcttcgatcacctagtccacccccggcttcatctggacctattgtcggcacatgcgaggtgctggagaagaagtaccttcgccttaccgcccctccagttccatccaaagtccggcctgaacgtattttgcgtcagacactagatcttctgaaaaagaagtggaagcgggagagcaactactcgtacatttgtgaccagttcaagtccatgagacaagatttgactgtgcaacatatcaagaacgactttaccgtttctgtttatgaaatccatgcgcgcattgccttagaaaanggggatattggtgagtataatcagtgccagaccagctacgatcgttatacgggatgggcctgaagggcaacccattgaatcaaggcatatcgcattctatattttatccataccgccnaccgaactggcctgaacaaactttggcagatttacttcngccgaaaaggagaaaaggcnataacctgccctggatntcgatcactttggcgcnggaaacatctaggtctccactctcttggatacccaaca

SEQ ID NO: 480 - DNA, 632 bp, Fusarium venenatum
  misc_feature (1)...(632): n = A,T,C or G
ttgaatcgcgtccctcaatttgtacgtcgattgctataaacacggcctatgccctcaattggctctacaacgaagtaacaaacgcaacgatcgtaacgagcgccgagaacaaatactccaacatgtctgaaaagaaggcggacgcaccaacaaccaaaatgctctggggtggcaggttaaaaggtgggaatggatccgcttatgcacaagtacaatgcctctatcggatacaacaaggctctctataaagaggatattcttggatcgattgctttcgccaganccaactcaaaggtcggcattattaccgaagatgaattcaagacaatcgagcagggtctgcttaaagtaatggaagaatggaagcagggaacctttgctattatgccgaatgacgaagacattcatactgcaaacgancgtcgattaggagaggtcatcggaaaggacaccgctggcaagctgcacacaggtcgcanccgcaacgagcaagtcgtctgtgatatgcacatgtggctacgtgaccgcatccgtgaaatcgacagccaacttgtttactttccttcaagtcctcaccaaacgcgccgangatgaaatcgactacctcatgcccggttacnctcacctacaac

SEQ ID NO: 481 - DNA, 564 bp, Fusarium venenatum
  misc_feature (1)...(564): n = A,T,C or G
gttaatgctgtccttgtcggtgaagccatcatgaaggcgcccgacgccagtgttttcatcagtcagctgtgctctggaactgagcccgcagccaagacagatgccgtatcgtctctatacgtcaagatctgtggcactcgaagtgctgaagctgcacgcagggccgccgantcaggancagactttgtgggcatctgtcttgttcccaatgccaagcggtgcatctctcacaagactgcccttgccatttcagaagctgtgcacacttaccccagcactcaaaagtacgagacacaggtggcagcagtagacaacaaaaccaaggactttttcgaggctgcaactcagaaactccgctgccccgaactcagcttgtcggcatcttccanaaccagcccctgaacgaggttcttganaaacaaaacaatacaaccttgacctcctacaactacatggtgataacctattgagtgggccaacctcatcctgttccagttgttcgatcttcaanccaagtcaggttggcattggtcgtcncggatacacacagtcctctcctcaatc

SEQ ID NO: 482 - DNA, 432 bp, Fusarium venenatum
  misc_feature (1)...(432): n = A,T,C or G
atcacancccctgaaataatcggtgtcaagttgacgggtcagttgagcggttgggctantcccaaagatgtcatcaacgcagttgcagggatccttggagttaagggtggcactggcaaaatcatcgaatactttggccctggtgcagagacaatatcagccacagggatgtnttctattaccaacatgggcgctgagacaggagcaaccacatcaatcttcccatactctgaggctatgtctgcctacttgcgcgcgactagccgacctgagttagcgcaagctctggaagtggccaaacatgagctgcaagcagacgagggtgtcaaagtatgatcatgttatcgaaatcgacctatctacactagagccacgcatnaacggnccgttcactcccgaattatcgaccccgatcttttaagcttgacgagg

SEQ ID NO: 483 - DNA, 406 bp, Fusarium venenatum
  misc_feature (1)...(406): n = A,T,C or G
nacaacgccnacttccgacagaaggaggtntttgagtggcgcgacaccacccaggaggaccccgatgaggtccgcgccgccgagtccaacctcaacttcatcaagcttgacggtgatatcggctgcctcgtcaatggtgccggtcttgccatggccaccatggacatcatcaagctgaacggtggtcagcccgccaacttcctcgacgttggtggtggcgccacccctgctgccatcaaggaggntttcgagctcatcaccagcgacgccaaggtcactgccatctttgncaacatctttggtggtatcgtccgatgtgacgccatcccactggtcttatcaagaccgcgagagctttgaaccttaagatccccatnattgcccgtcttcagggtaccaacgttga

SEQ ID NO: 484 - DNA, 590 bp, Fusarium venenatum
  misc_feature (1)...(590): n = A,T,C or G
atcgccaaaatggatgcatccgtctttcccatcagtcactttcccaaaccattacactctggcgaccggcctgtatcctgagagccatggtatcattagcaatacattctgggatcccgaacttcaatcacaattctattacacccatccggatcagagtctggacccaaaatggtggggaggagagcctttctgggtgacagcagagagacaaggaatccgaagtgccattcacatgtggccggggagtgaagcgcatgttcttcataccgagccaagtttgatggataaattcaatggcaaggagacgctcgacaacaaggtctcaaggattatggaatttctggatctgcctgggtttgaagacaagactctggatgcgagcgatgtgcgacctcaactgattgcccgcctacgtacctcatgttgaccgtgatggccataagtttgggcccaataccacccgagattcgcaaaacaattcaaagatgtcgacggtattgatagggaaagaattttcacnggctttgaagaacgccacttggcaaatattggnaatgtaatccgttgtttcaaaatcacggnatggg

SEQ ID NO: 485 - DNA, 545 bp, Fusarium venenatum
  misc_feature (1)...(545): n = A,T,C or G
tgatctaaacttttcacgtctcgtcatctcttagcgatagtagctcccaacatttgttccaatacagcttatctgtcccgccatcatatactatctatctgattgtactttcattcatcaacttcagagcaaaacagaacaaatcaaagccatcacgatgccttacgtatctgctgctcgctacggaaaggacaatgtccgcgtctgcaaagtcgatcgcgatgcttctaccggtgttcagaccgtcacagagatgaccgtttgctgtctcctcgagggcgagattgagacctcatacacccaggccgataacaagtgtcgtcgttgcccccagactctatcaagaacaccatctacatcaccgccaagcagaatcctgttaacccccctgagttgnacgcctcaatcctcggcagccactttattgaaaagtacaagcacatccacgttgccaacgtcagcgtcaanactgttcgctgggcgcgtctttgatgttgatggcaaacctnatcctcacagnttttttaanggtggngangagaccc

SEQ ID NO: 486 - DNA, 631 bp, Fusarium venenatum
  misc_feature (1)...(631): n = A,T,C or G
cgccaactacacctaaccttacaccatgtccggccctttctctagccctttnggggagaatagcaacccctttggaacagacaggggcaagaggacgaacaatgccatccatcgtgttgtcgaggaagaggatgaaaacgacaccatcacatcgcctacgaacgctcgttttggagcatcaccaaactctgcctctatgttctcgggcccctttggcgggggggttggtggcgactcttctgctgaagcaccttctgcgtcgngaaacgtcccaaaccctgatagctacccggcccagtataacttcggtcgccgaacttcagtatctgccgaatctctgaaacccagtgccgattcctacgataattggtcaccccctttccatganaagaccccggatcagatcgagcgtctcaagcacgccatcgaaggcaatttccttttcagtcatctggaggatgaacagagcgctcanattttgggtgcacttgtcnaaaagccgataccagcaaggggcatcaaggtaatcaagtcagggagatgctggcgactacttntacgtagtcgaagaagggatcttttgacgtntatgtcaacccttagcgggtngntacaacccggtcccgatggn

SEQ ID NO: 487 - DNA, 890 bp, Fusarium venenatum
  misc_feature (1)...(890): n = A,T,C or G
ctaaccgtttgcttccaaacttcccattctaccatcacaaacctcacgatgtcgtcgtcgtttactcgggtcgtgcgtcctgcgctcagaggtggacgagttctcacacagcgcatcgccccgctagccactgctcctcattccatgacgagaacaagccttaacactgctcgttccctctctacaacatcatcccgccgcagcgagcatgtcgatatctccgagatccctcctacacctattacccacctctctgagctcgagaccgccatggttgacaccgtctccaaatttgccacagatgtgattcttcctcgcgcgcgtgacatggacgaggcagaggaaatggacccagctgttgtcgagcagctgttcgagcagggtctaatgggtattgagatccccgaagagtatgggggcgctggtatgaacttcactgccgccattattggcattgaggagcttgcgcgcgcanacccttccgtctcagtgttggtagatgtgcacaataccctctgtaacacagctatcatcaagcacggntccactgctatcaanaaaaagtggcttncacgtctggcgacaaacactgncgncttntttctgtctctccgagcccgtctntggttccgatgcctttgccatggctacaagggccacccgaaaccgccgacggtttaaagatctctggcagcaaaaagtggatcacaaactccaaggaggctgatctctttattgnctttgctaccttgaccccacnagggttacaagggtatctttgcctttcttgtcganaaaggcaccaanggcttnttcatcccaaaaaangaaaaaaaactgggtattccgngccctnaacanatgcgttatcaacttttgacaatgtcgaa

SEQ ID NO: 488 - DNA, 691 bp, Fusarium venenatum
  misc_feature (1)...(691): n = A,T,C or G
actaaccccaaccctcccgcgaccgggagatcacacgattcgagatgggtcactcatacggaaagagagcgggcacccgntatgccttcagccgggacttccgccagangggtatgattgccctgaacacctacctccgacaataccgngtnggagatatcgtcgacattaaggcgaacggtgccgtccanaagggtatgcccttcaaggtctaccacggaaagactggtgtnatctacaacgtcaccaagtccgntgtnggtgtcatnatctacaagcaggtcaagcaccgatacatcgagaagcgaatcaacgtccgaatcgagcacatctcgcagtcccgatctngngaggacttctnaagcgtgtcaaggctaacgctgaggccaagcgtgaggccaaggccaacggcaccgtcgtccaagtcaaagcgtcagcccctgggaccccggggcgcccacacactgtcgctctccgagaacccccccatgaccgttacccctcttgcctacgagaccacgatctaaaagaaaagatattgcgggggttggtggtgcttgcttctatttatttggggtattgcgtccggatgggaaagaattctgcatggcaagggcttgccttttgatgtctgtacggcatagaaccaaaaaaaaagacatcgtttgaagcntgaataanaaaataaaat

SEQ ID NO: 489 - DNA, 658 bp, Fusarium venenatum
  misc_feature (1)...(658): n = A,T,C or G
tgccgccgtggcgaacttgctgcaagtccgaggagtaccgggccangatcgcgaagggcgataccggcgaccttccttttagcgaggttatttctgccaacattggcaaccctcagcagctcgaccagaagcccatcaccttcttccgacaggtcggcagtcttctcgagaaccccatcctgctcgagaacgaggaggctcttactaagcactttggctacaagaccgatgtcattgagcgcgccaagttcctcctgagcaagattggatccgttggtgcctacagcgccagcactggtgttcctgctatccgcgatagcatcgcacagtttattgagcgtcgcgatggcttccctgctgaccccaatcacatttacctgtccggtggtgcctcttccggtgttaacactctccttaacgttatctgcgcctcttctaagaccggtattcttatccctattcctcagtaccctttttacaccgccaccctgtctttttttgacgccaccggtgttcctacctggtcgacgaagtcaaagaactggggtactgatgtcgatacttttcgcgcttnttacaaaaaggccaangccgacggcgttgatgttcgctttatcgtatnatcaaccctggnaccccactggggcttccttcctga

SEQ ID NO: 490 - DNA, 1020 bp, Fusarium venenatum
  misc_feature (1)...(1020): n = A,T,C or G
gagtnccccctcctctctttcctttaaaccgtccaaagaactcaacagctttctttccacccccgcagaaacccacctcgtgtctggtctgggtataacgtacagaacagcacagcacatttttttgtctgtgtgacctctgaggctcaattgaattgctcatcacaagagcaagagcgagagcttcacctcctcanagaatagagagcattgtgtgtttccaaggcggggaactnaaaaagctccaccatgtcctctcctgccgacaacgactcgnttctcgcgaagcactacatcgactatgtctacgcgcctggtctgctcctgattgttggcactttgattgtcaagaaggaatggactccttacgctgcccttatcgctatcgcgttcggcatctacaacttcatggccttccaggtcaagaagactcttaagcctgatgttttccaggacttcgagctcgaggagaaaaccattgtgtcgcacaacgtcgccatttaccgcttcaagcttcccagccccaagcacattctcggtcttcctatcggtcancacatctccattggtgctccttgcccccancccgatggttctgtcaaggagattgttcgctcgtacacccccatctctggtgaccaccagcccggccatgtcgacctcctgatcaagtcttaccctcagggcaacatttctaagcacatggcttctcttgtcgttggccagaccatcaaggtccgtggccccaagggcgccttcgtttacacacccaacatggtccgacactttggtatgattgctggtggtactggaataactctatgctccaagtnatccgngtatcgttcgnggcnaacccgccggtgacagaccaaggttgacctgatctttgcaacgttagccccaagaaatttttttaaggaggatttcgaacttttggttgccaagangctgggatccgggacactagttttnaaaagcctcggagggttggactgggggcttgggtaacgtactggc

SEQ ID NO: 491 - DNA, 600 bp, Fusarium venenatum
  misc_feature (1)...(600): n = A,T,C or G
ttagaccgaggcngtcttcttgcagaaaaagagaatgcttcccttgccccaatcgcaacaaatggatggaggcaagaagacagagtatatgagcgcatcatggagaacggctacaacgaaagagatgaagtgcttcgtgcagagtttcgagaaacagaaacaatgctcgattcctctatcttgatcgctcctcttgtcttcttcatctcgccctgcgacccacgcttccttaacactctcgatcgtatcctcttaccccctgagaaaggaggtctgacaagcaccggtttagtataccgctacgacactgagctttccaacgatggagtaggcggagaagaagcgcattcagtatgtgcacattctggctagttgaggccatgaccagagcagctgtgtacgagccaaagtatctggtccgggctgtcaacttgtttgagaatatgcttggtttctccaaccacctatgcatgttctcagaggagattgcaagaagtggtgagcagcttggtaacacaccccaagcttttagtcatcttgccttgatcagttgcggctttcaaccttgaacgtgttgcaaggtgagacttttgacagtat

SEQ ID NO: 492 - DNA, 660 bp, Fusarium venenatum
  misc_feature (1)...(660): n = A,T,C or G
ctccgactccgagaaacgacgtccccatctcgccgcctcacattcgatcgcagcagtgacggtctagctcgcccataatgtttgctaggtcgtgtttgcgctcgacgcgcaccctcaatggccttcgcaacggcccttccgctatcgccaagcgtgccgcttcctcaagcgccaacgccgccggtgatgccactgccactcgactgaacctggccgccgccgcctcgaccactctcgccctcggctccatggcctggtactaccatctttatggacctgtggcttttgccatgactcccgctgaggagggtcttcaccctaccaagtacccttgggtccacaaccagatgttcaagancttcgaccaccangctctccgcgnggtttccaggtctaccaagaggtctgcagtcctgcactcccttagccgagtccctaccgaactctcgtcggttccatcttgancgttgacaangncaaggccttggccgaagaaaacaaatacccggtgagcctgatgaacagggcgagatccaaaggcgtcccggaaagctgggcgactacatgcttccccttacaaaaaaaagaggtgcccgattggnaacaacgggggcctgccccggattgttttnatantaaggcccgaacgggggtgggata

SEQ ID NO: 493 - DNA, 634 bp, Fusarium venenatum
  misc_feature (1)...(634): n = A,T,C or G
atcgccgtcatggttgtcaaaatccgtctcgcccgcttcgggcgtcgaaaccagcccttttacaacatcgttgttgcccacgctcgaacggctcgtaactccaagccgctcgaagtcatcggcacatatgacccgattcccaaggccgacccttacgacaattctggaaaacttcacaaggatatccaactcgatcgtgcgcgcgtgatgtactgggtcggtgttggtgcacagcctacggatacggcatggcgattactctccatgattggcattctaccaaagaagcagttcggtcccaagaaggacgagttaaaaggtgttttggacaagaacgaagtncagattcgataaaaaagcaagaaaggtccggaagctgtatgataatgnataaaaagacatttcgaggcgttggttcggggatcgatatcacccgattggatgancagcaaaaatngagagcaaggcaggacaacacagacatcaccggggatctttggcaggtgataaaggccatgccgttttaagaggagacggaattntnctatgctngaacggttgntcacccagccaancatttggtctttcnaattggntgaacgntaccaatccatgttaaccaattaaagtggtt

SEQ ID NO: 494 - DNA, 625 bp, Fusarium venenatum
  misc_feature (1)...(625): n = A,T,C or G
catgaacgtcctgcccctcatcaacaaggccttggctctcttccagtggaagcaagacttcaaggaggccgaggccctttgcaagaaggctnttattattgaccccgaatgcgatatcgccgttgctactatggctcagctcctcctccagcaaaacaatgttcctgctgccctcaagtacttcgagcgtgccgccgagcttgcccgaaccgaaggcgagattgtaaatgctttgtcctatgctgaggccacacgaacacaagtccaagttacggagaagtaccccaagctggcagcaaagttggcaggtggtgccggacctggaggccttcgcatgggacctcaataaatgcgtatgagacaaaatatcaacggccagaacggcgtgtaaagtgtacgaatttggagcanacgaaaaaaaggaaggcgttgaattaggatgggatgcgggacacgatcacaccaccctntgtccaatgagggagctcactcagcgacgaactgtctcgcctcaccaacaagtgaagtccattgcaatgctttgcagctgggaactataatgcacacatttgaccctactgncctgtatataataacacttcttttatctntttgtangnatatg

SEQ ID NO: 495 - DNA, 646 bp, Fusarium venenatum
  misc_feature (1)...(646): n = A,T,C or G
tctgaccccgatggncccgccgaggctctcttccagaagagctacttccagctcctccacgacgctcttngtgagggcggtgtcattactactcaagccgagagcccctggcttcacctccccctcatcactcgtctcaagaaggactgcggagccatcttccccgtcgncgagtacgcttacaccaccatgcccacctacccctccggccagatcggattcatggtctgcttcaaggaccccaaggccgatgtcaagaaccccctccgatcctggaccaaggaggaggaggatgctaancttccgatactactcttctgagatccacaagggccgncttcgttcttccaaagttcgatgccaaggctcttgagtaaagtcgtctacacacaaaggattgatgcagattggtttangtggctacgtttatgagtttacgcagaaaagggatcantggggacaaaaaaggccatggccacatagattcatcncggacgcaaaggtntatatgctccgagttggaaaatntattgnttttnctgccaaaaaactcgacatgcntctagagggccaattcgnctatattgagtctattacnatcanttggcggngtttaaacgtcgtgnctgggaaacctgcgtaccca

SEQ ID NO: 496 - DNA, 532 bp, Fusarium venenatum
  misc_feature (1)...(532): n = A,T,C or G
gcgcaaccatcctttcaagtatccgccatgccaccccagatcaagcaagatcttaatcgttcaggatgggagaccaccgatttcccctccgtttgcgagacgtgtctccccgaaaatccttacgttaaaatgctcaaagaagactatggtgcggaatgcaaattgtgcactagacctttcactgtatttgcttggagcgctacgcgtgcgaacggtcgcaagaagcgaaccaacatttgcctgacgtgcgcgcggctcaagaattgctgtcagtgttgcatgctcgatctttcctttggccttcctatcgtcgtacgcgatgctgccctcaagatggtcgcccccggacccagtccgacatcaaccgagaatacttcgcccnaaataacgaacaattgattgaagaaggaaaggttggaccagaanaatacgaaaagacagacganaaagcgcgtgagctgtttcgaaaactcgcaaatagttaaccctacttccgcaaaggaaggactatccaagaaggtgaaaatttcca

SEQ ID NO: 497 - DNA, 629 bp, Fusarium venenatum
  misc_feature (1)...(629): n = A,T,C or G
caactatgttcttcagggctgcctcaagttcggcgctccctacaatgattttatctttgagaccatgcttgctcgcatgtgggaggtcgcccagggccgctacggtgctcgtgctatgagagcctgtcttgaaagtcaccactccaccaaggaccagcagcgaatgctagctgccgccatcgccctaaacagtgtccagttggcaaccaatgctaacggcgcccttctcttgacttggttcctggacacctgcactttccctcagcgtcgaacagttttgtcgccccagcttgtgccttacctagtccatctctgtacccacaaggttgcctatctcaccgtgctgaaggtcatcaatcagaaggcagaggcagacgccagagacgccattctccaggccttgtttttcacgcccaacgatcaggttctggaggccattctgaaagatnaccagtgcggtgctactctcatcttcaaggtgcttacgacgcccttcctcgatgagtctatccgcaatcaaggttgttgagaatgttaagaatgtccntgtcaagatnaaagctcaacccaaccaagggtacaaacgcctgatggatnaggtcggcttgtcaatcccaacgctggnaaca

SEQ ID NO: 498 - DNA, 853 bp, Fusarium venenatum
  misc_feature (1)...(853): n = A,T,C or G
ttcgaggttctgaatgagctcgtcatcgatcgtggcccttctccctatgtttctaacctcgagttgtatggcgatgactagcttcttactgttgtgcaagctgatggttgtattttctctactccaactggttctacagcatactccttgtcagctggtggtgcccttggccaccctgatatccctgccatccttctcacccccatttgtcctcacactctctcctttagacctatggtcctctccgataccatggcccttcgtgtcgttgttcctcgcaactcacgagccactgcctactgtgctttcgatggtaagggccgtctggagctgcgacaaggagaatgtgtcaacatcactggcctctaagtacccttcnctaatggaacccgcaccgacaccgagtggttggacagtgccagccgaactctcngntggaacgtccgcgcttttgctcanaanccttttgacgctgaagttggtgaagatggcaaggacgaatgatgagatcggctgggatatcgacaccgatagcgcatgctacgctagcgaagatgggaatgtcaagtgccagtcccatccgtcgacaaatgagcctcctgggtctatgatgcggagtgccaccatatacaagagaagaacaaatgattaaggcaaggtgttggcggcgtttggcttttttgcaccaccatttaattggaatacaaacatttgatagatcangcccccgattgttgattaaaggaggaccagtcaagggataattcaagcatgatggcgaacaaggtacttaaacattctagattcagaagacatatcgtctttggctatgcaatatacacaatgcatgact

SEQ ID NO: 499 - DNA, 576 bp, Fusarium venenatum
  misc_feature (1)...(576): n = A,T,C or G
ctcctcgcagcttgcgtagtggtgtctttacctttgacctcgtccgcgatcagctcgtttatggattctgctcaggctctctttgtctggccgctttcatgattgtcaactacgcttcgtctggtcaaggttactacaacatggtccctcactgtaatgagagcggaaccgagggctgtgaccttgtttaccgtgctcgtgccacaaccttttccaccttggcctgtttgttgttggtcaccgcttgggangtcaagcacttccaccgcagtctgtttaacatggacgaacgtgcttcgggtcctttctccgtgttcaagancatctaccacaacaagtcctcttctggtctgtcattgctggtttcgtcatgatcttccccatcgtgtacatcccctacctcaacactgaagtcttcaagcacaaaggtctcacttgggaatngggaattgtccctggctgcgtgatctctacnttgctctcatcgaaactggaanggcatgaaaaaacggtcaactggggtatgaaccacctatacngtcaggtgactctaatccataaacaaatgattaaaac

SEQ ID NO: 500 - DNA, 594 bp, Fusarium venenatum
  misc_feature (1)...(594): n = A,T,C or G
agcgatactatgatgaggagcacaagcaaatgtctgagcgtccgtacgatttcaacagctggcaagacagcgagacggcgcaggctcttgccgctaagatgggccctgacgacattcttctcgagggctatgccgaaatgcctacataccgaatgctcatggcgtacctggcgaccgaaggcggcgatcgcaacatgctcttaccactcgatggcgttgggggtactgccctcctagttaaggccgacgttcatcgtgacggtgccatgtttcctccattctctttctaccacctgattgagaccgagggattcgccaagatgcgaagcgattaggctggcagtcatggggtcttcccaactataaggtctaccactacaacgagtanagattgccgtatcaactttgcatcggcaacttatttcactgccttgccattccctttcacaacttctagtgttgaaaaaggtnatggcgtattggaaaaagcaacggaatgctgctttgttttnccatggacaatcataatcaattgggcnggttttggtcccgcttttattatncaccttggaacaattcttttccaaacaagga

SEQ ID NO: 501 - DNA, 848 bp, Fusarium venenatum
  misc_feature (1)...(848): n = A,T,C or G
agcatcttctcgccttccagcaacttgaccaacgcacgagttctaactcaaccgaatcaatcaactacacttttcaccaactctcaaatctttcgaaatggctcccaaggctgctgacaagaagcccgcctccaaggctcccgctgctactgcctccaaggctcctgagaagaaggacgccggcaagaagaccgccgcttctggcgacaagaagaagcgctccaagacccgcaaggagacttactcttcttacatctacaaggtcctcaagcaggtccatcccgacactggtatctccaaccgcgccatgtccatcctgaactccttcgtcaacgacatcttcgagcgtgtcgcttctgaggcttccaagcttgccgnctacaacaagaagtccaccatctncttccgagagatccagacctctgtccgcctcatcctncccggtgagcttgncaagcacgctgtctctgagggtaccaanggccggtaccaagtactcttcctcgacgaaataggtggtttgatagcttgatttgttttgggcatttagtttttcacgcgtggcatcagggtgtcatgaatctgaggtttcacggggatccagccctgtttttgggggcctcataatgcgttacggatggttttgttttttttttatcctgggggcaatgtcttcacacacgggcaacggggttcgcggttgtacaataaacatcgagaatagggtctcgatcaaatgaattcgtgcacattagctttctgtcatctttctattgngtatcccattccttaatgtaaatccacaatctcttgcagtcacagtggattccgattaccctaactcatac

SEQ ID NO: 502 - DNA, 622 bp, Fusarium venenatum
  misc_feature (1)...(622): n = A,T,C or G
cgcgagggaggcactggtgttgagctgtgggcctggttggatgctgaaactgatgccgaagctgatgagaagtggttgattctgacaaacgctctgtctggactattctgtgccagtctgaactttatcgacgagacccgaacgattcgacccgtcatgtccttccagcccgatggccaccactccaattcctcgttggccaacacaagacttctccatggcgtcttaccacatgaagtcgtatgcaccgaaaacttgacacctttcctcaagttactgccatgtaagggcaaggctggaattgcaacgctactggatggacacaagctctttgatgcctcttatcagagcatggcaattgacgtcagacccaagtgtgatgcggatggcgaatgcttcctggaaatggaggagactgtggacatggttctcgatattaaccgctccaagagacctcaaaacaatcctatcccaagaccccctnctgctcacgagcttctctgcgatacctncaaatcgtaccactccgatacacttgcttncccgncgacagcctcgatggccaagactggagtttatctcaagtatttgggcgatccattaaanggaacatgcccattgn

SEQ ID NO: 503 - DNA, 477 bp, Fusarium venenatum
  misc_feature (1)...(477): n = A,T,C or G
gtctacggtatcaacctccagcagcaccgcaacgatgttganatcacccccaagcacttcagcaccatcatcacccctaaggacactgcttccctccccgagagcgctgctcgcgaccttaccatcgctaccatcactctnaaatacactcagagtaactctgtgtgctacncctacaacggacaggtcgttggtctcggtgctggacagcagtcccnaatccactgcactcntcttgccggcgacaaggccgacaactggtggatgcnattccacgagcgcgttctcggnattaaatggaagaagggtaccaagcgtcccgacaagancaacgccatcgacctgctcgtcaagcggccanctttctaangatggccctgagcgtgaggctttcgagggtgttttcgaagaggtccctggttcttttacttgccnaggagcgtgnggcttggataaacactnaanacgttgcgtttc

SEQ ID NO: 504 - DNA, 2036 bp, Fusarium venenatum
  misc_feature (1)...(2036): n = A,T,C or G
cctccctctctcctctctgtctcctctctcacacacacacacactctcattcactctgtcaatcatgtccaaacacgactcgggcagcaccagcaccggtgccatggaagcccgcaattgatcaaaaagcctcgacgaaaactccaaaagcctctggcgcaggcaacccagaaagctgcccgatcagctcctcgagaaccttggctacaaggctgagctgtcgcgaaaccgttctactttccaggtcgctttcatgtccttcgtcctcgcttctattccctacggtctcgctacaaccttggcttaccctctgattggcggtggccctgtcaacgttatctggggatggctcgccgtctctctcattattgtctgtgtcgctgcttctcttggtgaaatcaccagtgtttatcctacaactggaagtgtctactaccaagctttcatgctctcccctcctcgatggcgtcgcattgcaagctggatctgtggctggctctacattgtcggaaacattaccattaccctcgctgtcaacttcggtaccgccctcttcattgacacgtgtgtcaatgtctttgagtcgagccctggtgtcggtgtcatgtctggagaggcctaccaggtcttcctcgtcttcctcggtctcacattcctttgcaacgccatctctgcgctcggaaacaaatacctcccatggattgataccgctgctgtgttctggactttcgctggtgttattgccattgtcgtctgtgtccttgctatggccaagggaggccgtcgcgatgccgcttatgtctttggtcatttcgaggccaactctggatggcccaagggctggtctttctgtgtcggtctcctccacgctgcctacgctacctcttccactggaatgatcatctccatgtgtgaggaagttcagaacccttcggtccaggtccccaaggccatggtcgctaccatcttcatcaacaccttcgctggtctcctcttcatcatcccgttgatgttcgtcctccccgatcttcaagaagtcatcctttccgcccagccagtgcccttcatcatcaagaccgctgttggtagctccggtggtgcctttggactcctcttccctctcatcgtcctcgccatcatctgcggtattgggttgcacaactggccacttctcgatgcacatgggctttcgctcgtgacggtgctatccctgggtgctaagtggtgggccaaggtcaacacttcgctcgacnttcctctcaacgctatgatgctcacatggttgtccanatcatcctcggtatcatctacttcggttcctctnccgcctttcaacgccttctctggtgtcggtgtcatttgnttctgacaggaaagcaccctagaccaatagcncnnagaacgctgccagcccaaagatgtaactttgtcaagcctgaataactggtttgtcttggcgaaaccctttccggcgtcgtananaaggtgcttgacaccgctgatggcgtggtagncaaaggggaaaccngagagtgaacttgagaccacccttgacggcaaggggaagaccggcgacgaagctagcgatgctcaaactctcgaggtggagaccgacgatgggagcggcgaggtaggcgatggagaagccgtagagggtgacggagagagtagagccggtgatacggttccaggcggagctaccgaaccatgtctgctcgatcttgtagatggccagatggggagagacgggtcggttgaggcgctggttaacgaggatctgttgaccttcctcttgagagaccttgacagaaccagtagaggcgcggttgggagaagaggtagagatgccagcagccagagcactcttggagatgttctgagcaaagaaaggcttggccgcgcctgagcggagggcgttgacgccaacacgttgagcgagcatcgtggagaggattatttgttcggatttgagggagggaggttcgtccaaggttcgtccaacgatattgtcggcgtcgttactccaaagagggcag

SEQ ID NO: 505 - DNA, 826 bp, Fusarium venenatum
  misc_feature (1)...(826): n = A,T,C or G
acgacgatgaggagaagaagcgcgaggttattcgtctggagcaggatatcctgtccgatatggccgacagtaagcagttctacgtctacgagaccaaggacttttggcgccagatcaagactgctggctccgctgttcccgccaacgctctctaccttcagaaggccgcacagtccgaatccagctcggagctcgccacccccagcgccaacatcgtcccccctgttttcattcaccctaccgctcaagttcaccccactgccaagctcggccccaacgtgagcattggacctcgcgtcgttgttggcgctggtgcccgtatcaaggagagtattgtccttgaggactctgagatcaagcatgacgcctgtgtcctctactctatcattggctggggtagccgcgttggtgcctgggctcgtgtcgagggtactcctacccctgttggcagccactcaaccagcatcatcaagaacggtgtcaaggtgcagagcattaccatcctgggcaaggactgtggtgttggcgaacgaagtccggcgtccagaactgtgtctgcttgccgtacaaggagctgaaagagggatgttggtcaatgaagtcattatgtaaaggaatttgtctctacactagattagattagcgcaaaaagtttgcgatcgttcccgcatgctaggcgtcggatatctacaagctgaggccatcaaaaacgtaatggangatgtatataggagtaatttccggggactatcagggaacaaataaacatggtccttttgggactgctgaagcgggacgactgacgcctcaccaagtaagaaacacg

SEQ ID NO: 506 - DNA, 595 bp, Fusarium venenatum
  misc_feature (1)...(595): n = A,T,C or G
ggacaatgagccggcagctcgtcttgtgggtgacaaggcagctggcaacgatggacattgcaatcatacgttcttccacaactattctcgcagctgaaggatccctcgaaccaagaacagttggcatcatcatatgaatcacacacgtcatcctgcttggagcattgcatctccttctcaactcgtccacagtagcatttcgtctccactgttacttcgcaagtaccacacacgcctgggtggcatatctgagtgcattcatgctgtgagcacggaagcagatcaccacatagctctcgacagctccatccgttgtagtaatcggtgtctctgcagttttttcgctgagagttctttccacaatagcacggctccggtgggctaagaacggtacaaggtgggcatggcccaaggtgacactggagaagtgcatgggtgagagcatgtcgatctggatttggnacangtctggccacaaaaatganggggtaggagactattncngctgagttgcggttctttggcgcaccagcatgaactattacctggctcgtcggtcaanggttgaattgcattcaagacaacgcctgacttg

SEQ ID NO: 507 - DNA, 651 bp, Fusarium venenatum
  misc_feature (1)...(651): n = A,T,C or G
ctccagggtctataactagcctccattatattggactagccctgtaaactccttcgctttagttatatctacagcaagaaaccgacaagatgaaggccaattggcttgccgcagccgtttatttggctgctggcagtgatactgcagctgctgcccaagtccctgatactttggcaggagtcaatctcgttgcgcgagacacactcgcttattctcctcctcactatccttcaccatggatggaccctgaagctcctggttgggaggaagcctacgccaaggcaaaggactttgtgtcccagctgactcttttggaaaaggtcaacttgaccactggtgttggatggcaaggcgaacgctgtgtaggaaacgtgggatctattcctcgtcttggtatgcgaagtctctgtcttcaggatggtcctctcggaatccgcttctccgactacaacagcgctttccccactggtgtcacccgcgggcgcttctttggagtaaggttctctggtatgaaaaaaggacaattgcttgggtaccgaatttaaggaaaaaggcatcaacattgcttcttgggcctgctacngggcctcttgggccgtcacgcttgccggtgggcgaaactgggaaagctttnaccgtnganccctattn

SEQ ID NO: 508 - DNA, 507 bp, Fusarium venenatum
  misc_feature (1)...(507): n = A,T,C or G
ttcttgatctttcagctcctactnttccagccganaaacaactctttgtgattaatcgctattatcacaatcgagatggatactgttatcaacatggccgatgccgcacacgcactggatcttgctcgaatccggttccagctaattcgactngaggataccatcactttccatttgattgaaagagtgcagtttgcattgaatagnacaatctatgtccctggagctgtcgagcttccagaagcgaacctgagcttcctcgactggtacttccgcgagcaagaaaagctgcaatctntaatccgacgtttcnaatcccctgacgagtccctttctttcccgacnctctgcagaagccaattctcaangcctntcacttccccagantcttatatganaacgacgtcatgtgaacgacaatattnagntttttncacggaaagttctttccggagngtgcccgctttnggcgggaggngggggngagcccaaaaaactccggtcccc

SEQ ID NO: 509 - DNA, 574 bp, Fusarium venenatum
cgtcgctcgtctcatgcaagttatcggtcttgctctcatcctggccctcttcttcgctccctttgacaacgactactactctgtccagagccgaatgggttttgttcaggaaatcggcgcgttctactttgtcggcatgttgcaaaatacagccatctaccccagcgagcgcgatgtgttttaccgagaagacgacgacggcgtctatagcgtcaatgcttttctcgcttcctacaccatcctcgaggtcccctttgaggtgataagctgtatgatattcggtgttctgggcgtcatcgcggtagacctccctcgcacggcaacgctctacttcacatccgtctttgcgtgcttcggcatcgtatcctgcggcgaagagtctcggtatcatgttcaacacgctctttggtcacactggtttcgccgtcaacataatgggcgtgttcctggctcttgctaataccatggctggcgtgctctccattgacatgcccgagctgttcaaggccttcaactacctctcgcccatccggtacggacaccgctgtggcgccgtattccctgcgtggtatcg

SEQ ID NO: 510 - DNA, 590 bp, Fusarium venenatum
  misc_feature (1)...(590): n = A,T,C or G
caaatctgttagatttttctcagcttcatccgcagtcatgggtaacaaggttttcttcgatatcacctgggagggtcccgtcttccagaacggcaagcccacctccaccgttaaggagcagactggccgcatcaacttcaacctcttcgacgacaaggtccccaagaccgccgagaacttccgtgctctctgcactggcgagaaaggtttcggctacaaaggctcttctttccaccgaatcatccctgacttcatgcttcagggtggtgacttcacccgtggcaacggcactggtggccccaacaccaacggctctcagtgcttcatcaccaccgtcgtcacctcttggctcaacggacgccacgttgtctttggtgaggtcgctgaccagcagtcccttgatgtcgtcaangcccttgaagctactggctccggcagtggtgccgtcnagtacaacaagaaagccaccatcntcgactgcggtgagctgtaaacagctcaatccgtacnactngcgaacgggaatttggaattgcataacaaaacctcactgaaggctggcganatggaactaattagtccaggctaat

SEQ ID NO: 511 - DNA, 443 bp, Fusarium venenatum
  misc_feature (1)...(443): n = A,T,C or G
caacgccgtcaacctctttttgcaggtctttttcactattatgtacagtgacttggaatgtgactacattaaccctattgacctctgcaaccgactcaacacctacatcatcccagaggctgccgtacacggtttcttgacattcctcttccttatcaacggatactgggtgcctcttattctcaacctgcctctccttggctggaacgtcaagaagatcgttgacaacactcacctcctcgatgcgactgagatcttccgcaagcttaacgtccacaagaaggaatcttttttcaagctgggcttccacttgatcatggtcntcttctacctctacagcatgattgttgctcttatccgagacgagtctttctaagtggtactctttacccagcccgggatccgaatattcccgatgttaggcattgctacgtcagatagaa

SEQ ID NO: 512 - DNA, 389 bp, Fusarium venenatum
  misc_feature (1)...(389): n = A,T,C or G
gcaccaacgatgcgcccgctctcaaaatggctgatgttggcttctcaatgggtatcgctggtacagaggttgcaaaggaagcttcggctatcattcttatggacgacaacttcaacagtattgtcaaggccctgaaatggggtcgcgcagtcaatgacgcagtcaagcgattcctacagttccagctcacagtcaacgtcactgctgttatcctcacctttgcactgctgtttccaatgatgaanagtcgtcaagtnttgacggntggcaacttntntgggcaacctgatcatggacaccctcgccgtttggntttggtaccganctcccaccaaagggtttccnccnaaagcctgacccaagggatcgaccttnttttttgncccatg

SEQ ID NO: 513 - DNA, 722 bp, Fusarium venenatum
  misc_feature (1)...(722): n = A,T,C or G
ctttctgaccagtgtcaactggtangctnacgtcccatncttntacgtcgtgtccatacacaccgtctttcgttactcctgttgtctaccacttcattcgttttttaatatttataataatcctctttacttttcaactattctaataaatcccatttgcaacatccgcaaacatggtctctatgtggtccagaattatgctggctgccagccttgcagcttcagttactgcgcagacgtattcgagctgcaatcccatgaagcagtcgtgtgatgccaaccccggtcttgcttcttcatcttactcggtagactttaccaagggcagcgacgacaacaactgggaaggaaccggtcacggagacgtcaaatatacctcggaaggtgctgagtttacgatcaacaaacagggccagtcacctactatccagaccaagtggtacatgttctttggtcgtgttgagatccatatgaaagcagcccctgggcaaggcattgtttcgtctattgtcttgctgtctgatattcttgacnaagttgactgggagtttctgggaagcagaaatccgaaacccagaccaatttctacgcaaaaggaagcacggataacactcagagtcttacattcccggtcgaaaacactcattcagaatttcacaactataccgttcattggacccaagantcatgttgcgtggtatatcaacngtgtttctgtccaa

SEQ ID NO: 514 - DNA, 512 bp, Fusarium venenatum
  misc_feature (1)...(512): n = A,T,C or G
gtttgccacccttggtgacttgaaggtggtcgagagacctaccacacaaaacctaggtcctcatgacttccataacgtccaatgcacaatcaaggtctcatcaacagataccggtgtcatctttggtaacgttgtctatgacggtgctcactccaccgacaccaatgttgttattctcaatgacctgcatgtcgacattatggattacatacagcctgccacttgcactgagacccagttccgcaccatgtggactgagtttgaatgggagaataangtcaacatcaattccaaggccaagacactccgcgacttccttgatcagttaatggcttgcacaaatatgaactgcctgacaccagaagctaccttnaaggcgantgccattcccgagtgccacttgttcgcaanaaacnttttngggaagangctctcnccanccgancatgaaaagaaggtaagaaggacnatnctgggttgttaaaanagaatcatacaagcctggcccgacc

SEQ ID NO: 515 - DNA, 632 bp, Fusarium venenatum
  misc_feature (1)...(632): n = A,T,C or G
ctgacaccttggcttttacaacgccgtattcttctaatcctcttgttggcctatctcttcactgtttggatcacaactctactatacagcaaccatgcgagcttacttctacgatggtcttccaggtgaccagcgcctcccccacaactctggaaagcccgtcagcgtcgacgatcttatgaacattggcgtttactattaccatcttcctgagctcgaccaggtcgacaatcttgcgaatgagcgcgaatacaagaaccgtgacgagatcaccgtctctccccaggctatgggcgacatctacgagacaaaagtcaagtctttcttcgctgagcatctacatgaggacggggagatccgctacattcttggtggacgtggatactttgatgttcgaagcaaggacgacgactgggtgcgcgttttgcttgagaagaatgacttgcttattctcccttctggcatttaccaccgnttcaccaccgacgagaccaacttcgtccatgccatgagactggtcaaggaggaccccaagtggacgccactgaaccgngggcccgaagtcgacaagaacgagcaccggaccagaatacgtgaagcacttcattgggcgaagctaccgagtaagaagc

SEQ ID NO: 516 - DNA, 1058 bp, Fusarium venenatum
  misc_feature (1)...(1058): n = A,T,C or G
ttgtgttgtcgctttcattcctgagggtatgcctgtggctgtcgcgttgacacttatgatggtggctcgccgcatgaaggctgtcaacgtcctccccaaaggtctatcaactgttgagacattgggctgtgtcaacgtcatctgctctgacaagactggtactctcactcaaaaccagatgtttgtcagctctgttgcctttgtcgacaagaagtttgagtcttcggatgagtttgagtaccttgtcaatagcaaggaagcgggtgagccttcaatggctctgcagcgtgctgctcttctctgcaatgatgcatcatttgacccaacaaccgtccatcttcccattcaagagcgttctatcatgggtaacgccacagacagcgctgtcttccgcttctctgcatctggacccactggagatagcctccgaaagaccatgcctcgcgtctttgaagttcccttcaactccaagaacaaatggatgttgaccgtcttncagtccggcaatgagagaggtgcttaccgggttatcatcaagggtgctcctgatatcctcctcgctggttgcactaaagtactggtccgctgagtccaacttcgttgtcacccttacccgcgacgcacgcatcaagttccagcagatccaagatgaagcctcttgctgtgcggaacgtgtcatcgtcctttgtgaaaagttcatcacacctcgctctgttgccggtaccaacagttttagtgacgagatnacacactctgccatccaagacctcaccatcgttggtatgctcggtatcatcgaccctcaacgtcccgagattcctgccacagttgancaatgtcgacgcgctggaactcgtttctcatggtactggtgactacgccttgaccgctgctgcaantgccncaacactggtacctccatgcancaggacctgacacatcgatcntcnacctgganacttaagtaanaggaaagagacaaganccagaaaggngtctgcgaattacaangaatccgttcttaggngcaactnaaaancatcaaagntggantcttt

SEQ ID NO: 517 - DNA, 633 bp, Fusarium venenatum
  misc_feature (1)...(633): n = A,T,C or G
gttgcccacctcatcaccggccccaatatgggnggtaaatcctctttcgttcgcgctctagccctcattgttcttntttcacaggtcggctcgtatgttccancagactcattgtctctcactctctgtgatgccatccatacccgaacaggtgcccgcnataacctgtttgctggcnaatctacctttatggtcgaggtctccnaaacagcgcgcattttacgctctgntggtccccgaagccttgtcattctcgatgagttgggccgaggtaccagcactcatgacggcgccgccattgcccaagccgtgctggagcatgtcgttaccganacacagtgcctaacgctcttcattacacattatcaaaacctggcgcgggtcgccgaaggtcttgacggcgtcaaaaatgttcacatgaaattcaaggcaaaaaaaggggaggatggggaggaanaagtcacgttcttgtacaaaatcggnganggcgttgcccatcgctcgtacnggttgaacgtcnnaaactcgcgcgttttcctaaaaaaagtgattgatggtgctgctttgaagncnagtcaaattganccaaaaaatgaaaaatncgcccctganggggtgtttgccggccctttn

SEQ ID NO: 518 - DNA, 647 bp, Fusarium venenatum
  misc_feature (1)...(647): n = A,T,C or G
atctgccctgtcaacgacctcggagccaacatctttacaggcctcaagtgcgaccccaacccggtcttccttcccaagacatacgagctgcccgagctgttcttccttcctgacaccgccaacttctccttcaccattgctcctatgcagattcacgctctcaatctggccacatttgcttcgctcatcgctcctttcggtggtttctttgcttccggcctcaagcgtaccttcaagatcaaggactttggcgactctattcctggacacggagggatcactgatcgcatggactgccagtttatcatgggtttctttcgcctacatgtacttccacaccttcgttgctatccacaagggcaagccttggataagggctcgagacggcaatcaacaagcctaaaccccgatgaagaaagtcgagctcgttaaaaagtatgggccattacctccgaaaacaangggtatcgggacagaaaaaacaaacgttcatgcattgatcaactccggccgttgcgaactntttgcaataagaaaaagccggacaaccatagcatctcgactccgacacatattttcatatccgactggggctatccacactaagtccctcntccaatcaacctggcgttctcctttggtaaaaa

SEQ ID NO: 519 - DNA, 940 bp, Fusarium venenatum
  misc_feature (1)...(940): n = A,T,C or G
cctacccaaagctctactctcttatataatccggcttctagaccatcaccaaacctctagcttacctgccttgcgctgttcgattgtccctccaatttgacctcatctcgaaccttataacaacctcttgtcaccccttcgacttataccggctgcaaacatcaccatgtctcaccaagtcaacggcgacgtgagccccgctcagtactctgctttcatccagcatctcctcaactatccttttatcagcgacggcgtccacaccttcaagtccaacgaactcggccagcgctccatcagacttagtgacgccgcctaccaaacctttgctgctcccgtcgttccctacttctccaaaggctaccaatatgtctcaccttatgtccagaaggtcgacagcctaggcgacaagaccctcgatcgcatcgacgagaagtttcctgctgtcaaaaagcccaccgacgagctctaccaagatacccgcgctctcatcatgtttcctctccagaagggtcttgagggcaaggaccacgtcttccaggtctacaactccgagatcaagaaggttgagcagggaggtctcgtcgcccatggaaaaggccgccgtcaccaccgttctcgtcgttagcaacgaaactctttttttgggtgagctctttcttgcaccagaagaaggccgacaccaccaatgccatcaacgagaagattaaccagtaaacatctcgctcacacgactatggcgtcattagtttgatggctgtagtcagcaagcacatttataccctccttgnttcttttnaataagggatggtttaaaacacggngtttctcgtcgnatttctctttccttatgctttccggggtttagatgccaggaaantccgaatagcgtgtntngaactgtcactctcgccgtccatctgcgcctctcctggcctgt

SEQ ID NO: 520 - DNA, 580 bp, Fusarium venenatum
  misc_feature (1)...(580): n = A,T,C or G
gtaaacccccccccatacaaatggaaaatcgnaaccctgttttttttgcagtccgccctgctacccccncaaggggtatcacctttgtgcccaacgatgcccgagtctttnattttgccgnaagcaagtgccacaagaacttnaagatgaagcgtaaccctcgcaagctgaagtggacaaaggccttccgcaaggccgccggcaaggagatgacggtcgactctactctgcagttcgccgcccnccgcaacgttcccgtccgctacgaccgagagctcatgggcaagaccctnaaggccatggagcgtgtctntganatccgccaacgtcgcgagcgcgtnttntacaaaaagcgcatggctggcaagcgtgagccgtgangctcgccacccgccccgtaagcttgtcgcttgagaacgagcatttcctgccccgcatgcgcgggaancgaaaaaaaancgtntgcgcnaacttgggtntggggagaanggagganatttgagganatgggagccccgaccgccacaatttccaaggttttttggngggcgaanaaaaaaaaaaantccccatttgntnt

SEQ ID NO: 521 - DNA, 590 bp, Fusarium venenatum
  misc_feature (1)...(590): n = A,T,C or G
ggcancgagacatggatctaccagatgagcaacaactcgggtatctcatgggacagtgacaaagatctttacaaagagaccgagtatagctacgatgaaattgtgccgcctcccaactggcaaaagcgctaccccgatggatacaccaaagatactcctcctcctaacctcaaagaatgggaagctttccaggtctggatgcgtacagcgggtcttcccacctttagcaagctttaccagcgtaacaacacccaggctatgtggccaggaacctatgatcttatcatcgatgaccatttcccgactcgagagtacaagggttccaagtcatcattatctctacccgaaccgntattggaggacgcaaccccttctcggcatcgcttatgttgtcgtcggnggggttgcattcttctcggactgncttcacagtcactcatcttatccgaccanaaaaatgggtgatcacacttatctnttgtggaacaacgccctggcgccaagtctggtcccagtaccnggtgcgctttcggncgcgaacttccgtccttggnganggctaantcaantttgngacgaatgctcgcgct

SEQ ID NO: 522 - DNA, 563 bp, Fusarium venenatum
  misc_feature (1)...(563): n = A,T,C or G
ggcacaccaaattcgatcttggcatcatacaataggaacttcactggccgtcttgatggaaatcctgctacccatacattcctctcttcaccggacatggttatggccaagattttctctgacgatcttggtttcaaccctctgaaagatgctcttgtcactgaaatctggcgaagaaattccgcttcaaacctcctagcggcaacgcactcccgtcagangggtatgaaaacacagatcacgtttacgatgcggcttccacagaccctcaggtccgacaggccgtcactgtgcaaatatcgccagactcccaacgtttacaacggttagcgccattcaagccttggtctggacaggattcatcnaatgtctatcttataaagactatgggtaaatgcacaacagaccatatactacagctggccatggatgcnattccgtggtcatctcaaaactttccacaataccttatcggggctgtgacgcngataaccagaagtcacaaggtacttaaccaattcncggatctttnggggtttccngaaccgccaggattacaaaac

SEQ ID NO: 523 - DNA, 595 bp, Fusarium venenatum
  misc_feature (1)...(595): n = A,T,C or G
cttcaacttcatgggtcccgtcatccacgaagcctccttcaagaagctttctggtgccattgatgaggccaggagcgacaaggacctcgagcttgtcgttggtggcaagtacgactcttccaagggctactacgtccaccctaccatctacgccactaccaaccctaaccacaagttcttctctaccgagttctttggtcctatcctcaccacctacatctacgatgacgccgcccctaacgccatggccgatgtctgcaagctcattgagaccacctctgactacggtctgactggtgctgtctttgctgctgaccgtgaggcttcccgcttcgctgangancatctccgcnacgccgctggtaacttctacgtcaactgcaanaacactggtgccgttgtcggccancaaccctttggtggntctcgtgcctccggcaccaaccaaaaagntggtggcnagaactcctaacccgtttcgtcaatgttcgagccatcaangaagaattcgttcctaccaccaaggtcncttaccccngccaagaaggtcttaanttccgnacacaccnttccccaattggaaaggaaaaaatgg

SEQ ID NO: 524 - DNA, 773 bp, Fusarium venenatum
  misc_feature (1)...(773): n = A,T,C or G
ctctcaacaaacaaatacttcaccacagaaactatacaacgtccaacatggcctctgctactagcttttacgactttaagccgcttgacaagcgtggccaagaggttcccctcgccgactacaagggcaaggtcgtcctcatcgttaatactgcctntaagtgcggcttcacccctcagtatgccggccttganaagctctggaccgacctgaagggcaagtaccctgacgactttgtcatcctcggcttcccctgcaaccagttcggcggccaggagcccggcaccgacgatgacattcaggagttctgccagctcaactacggcgtgagcttccccatcatgcaaaaaaccgaggtcaacggtgacggcaccaacccccttttgggtttggctcaaggaccaacaaagccggtcttctcggcctcaagcgcatcaagtggaactttgaaaagttcctcgtcggccgtgatggcaaggtcaagggtcgatggccagcactaccaagcctgagagccttganaagcccattctcgaggcccttgctgaaaagcctgcggcttaagatcatgatgaatgacgaaacaaggaaaaggcncccacgtcaatccccatcaatctaaaacgaaatacccagtngggggggaacataggtgcagtgtttaatgagaggcttccagaatcatggaaaacagctagataaaataatacaatgatcgggcatagcctggtcaatatttgatggcattcatattctactcggaaaaaaaaaan

SEQ ID NO: 525 - DNA, 601 bp, Fusarium venenatum
  misc_feature (1)...(601): n = A,T,C or G
caacatgcagctgaccaacctcttctgtctcgccagtgtcctgacatccgtgtcagcagtgaccgtatcctacgatccaggctatggagaagctggtcgtgccatgacatccgtcgcctgctccgacggttcaaacggtctcatcacacgctacaagtggcagactcaaggccagattcccaagttcccctacatcggcggcgcgcaggccatcgctggatggaactccaagagctgtggtacatgctggaagcttacctacaagggcaagagcatcaatgtcttggccattgaccatacggatgctggcttcaacatttctcctgcggcgatgaatgctcttaccaacaaccaggctgttaagcttggccgggttgatgcgactgctactcaggtagctgttaccaactgtggtttgaagaantagatgtttgggagaaggtcggtcattgaatcggatgaagcttcaggaataacgagatgggatgagatatgattcaggattttaatgtttagtagtattcgttaattcttactactgttatgttcttccaaaaaaaaaaaaatacttatttataatatttggtcgccgnggcaagaa

SEQ ID NO: 526 - DNA, 938 bp, Fusarium venenatum
  misc_feature (1)...(938): n = A,T,C or G
aaggttgcatctttgccttgttacataaaccgacattctttttaaacaaaaaatagctactacatattccaagacaagaaacccgccacagtcaacatcatgtccagagatcgccgtatattgaaagagcttaaggatattgaacttgatcatgacaactcgggtgtaaatgcgactcttgcttccgacggggtcatgacacgcctcaaagggacatttcctgctcctccagacacgccttactctgggggtacctacacggtcgacattcagatccctgatcaatatccattcaaggcaccaaagatgacgtttgacacaaagatttggcaccccaatgtcagcagtcagacgggcgctatctgtctcgacacactcagctccaactggtctcccgtccagaccatcaaaaccgctcttctcttccttcgaatgcttctcgaatgtccaaacccaaaagatccccaagacgcagaggttgcaaagatgatgatcgaaagtcctgaacggttcgctgtcaagggccacgactgggcagttcaatacgcttggagcttcacgaaaagaagtcgatcttcagtcaatacaaacaagaaagcgcttcttgagaactcccaaagctgatcccgcccggtatatgggatacaataaggacctcgttgagaagttcgtcagcatgggctttgctctcgacagtgtcgttgaagccttcattgctatcggcattgancgtaacggggggacgggactacgtattggaagaagcatacatggggcgacattgtcgccagactcctcggcgancaataattcatcatcacgttacgtctaaagaagaagaacatcgtttctgataaataactttcagcatggtatggggaattagantgcgttcccgaattgtttccnttcctttaattcctttatccgttccacat

SEQ ID NO: 527 - DNA, 480 bp, Fusarium venenatum
  misc_feature (1)...(480): n = A,T,C or G
gcagtttcttcgcagccaagaacaagaagaaggctgccgccatggaagcccctccccctactctaaaggcttcaggtactctatcagagcgcgagaacatcgaagtcgaggtcatcaagctgctcatttcttcttactacaacattgtcaagcgtaccatgattgacatggttcccaaggccgtcatgctgaaccttgtgcaatttaccaaggacgagatgcaacgagagctgctggagaatatgtaccgaaccgacacattagacgatcttctcaaggagagtgatttcaccatccgaagaagaaaggagtgccagcagatggttgagtctcttttcaaggctagtgagattgcagccaagtacagtgatgtcgttcatgaacaangcttcttatnatcacgtccaattngcgtcagagtcaggnttgggnccatctgcagcctcttttttcccgcgaccaccgcttaaaggatcactg

SEQ ID NO: 528 - DNA, 611 bp, Fusarium venenatum
  misc_feature (1)...(611): n = A,T,C or G
cccgaataaactcatctcgtccgtcttcctctacgaactaccactccgcgctcacgacgcaccaattgagctccctccctcctcgccctcccgacgaccaaaattagaatatatacgcccgccatgctgcgcacatcggccaccaacctgctgcgcaagagccttgtgcgcagcactcccgccctggcctcgcgagctgcctcgactcacgccatctccaaccctaccctcgccaacatcgagaagcgatgggagggtatgcccctccaggagcaggccgagctctggatggctctgcgtgaccgcatgcagtccaactggaccgagatgaccctccaggagaagaaagctgcttactggattgccttcggccctcacggtccccgcgctgaggacccccctggaaccaacgcccgcgtcgcctggggtgtcttcattggtattgctgccagtgtcggtctcttcggcctggtccgccttgtcgctaagcctgctccttacaccatgactcaggagtaccaggaaggagaccaacgagttctcaagaaccaaaaatccgatcccttcactggtatnacctctgctggttacgcttggcaagggtatggtcc

SEQ ID NO: 529 - DNA, 609 bp, Fusarium venenatum
  misc_feature (1)...(609): n = A,T,C or G
cctaaaacttcatcgattatcaacaccacagattagccatcatggatgagattgcccccgaatatgacgttgtcgtgctgggtactggtttgaccgagtgtattctttctggtgttctgagtgtcaagggcaagaaggtcctacacatcgaccgaaacgaccactatggcggagaggccgcttccgtgaaccttgagactctcttcaagaagtacggaaacttccgtgagggcgaggagccctggaagcaatatggccgctcaacgactggaacatcgacctcgttcctaagttccttatgtcctcgggcgagttgaccaatattctcgtctctaccgatgttacacgatacctcgagttcaagcaagtcgccggcagttacgtccagcagggtncctccacaaggccaccgtcgccaaggtccctnttgatgctgtgaggccctgcgatcccccttatgggactnttcnaaagcgacgcatgaagtccttcttcgagnggttgggagttccacccaangatcccacacacacanggccttgantgacaactgccaatgaaggacgttntnaaattcggctcnaanaacaaaaggattttngcccccct

SEQ ID NO: 530 - DNA, 484 bp, Fusarium venenatum
  misc_feature (1)...(484): n = A,T,C or G
gcgtcgacagccccaaatcatggaacaagttcgagaagcaaacccttacacccaagacctggggagaccgcgatattgacgtcgagatcgaatgctgcggtgtctgcggttctgatgttcacaccgtcactggcggctggggagactttgagggtcctctctgcgttggtcacnaagtcgttggcaaggctgtccgagtcggcgacaaggttagcgagatcaaggttggcgaccgtgttggtgttggtgctcangtttcttcttgcctcaagtgcaagctctgcaataacaagaacgaaaactactgccctgatatggtcgacacttataactgcaaatacccgatggtagtgttgctcatggcggtttcgcttctcatatccgtgctcatgagtactttacctttaagatcctgatgctctcaagaatgaagaagtcgctcctcttctctgcgccggtatcaccacttactctcctcttgtga

SEQ ID NO: 531 - DNA, 484 bp, Fusarium venenatum
  misc_feature (1)...(484): n = A,T,C or G
cttctgatttccttcgngggcatgttcgttctggagagcttcnactttacacgcactgtggccggtatgattgcngtgatttcgatccaccgtttctgatgtcaagttgattgtttcgacatgtctcactcgcgnaattcaagggcgatgcttctgnacattgccttctggagcgganagtggtactcgatgggatggcacncantctctcagcctgctcgtgagttcctttgccagattactgagctgtccatgttctctgccgatttcgttntgggccactggctgctcttttttatggcgccgtcatcttgatccccnaggttganatgcttcactccntgatgttgtnntggctccgtcccagtcgacaaattgaactcctatctactcgatgaaacatctaacttagacaaaaactttgatccgttatnccanccgctgttttaccccccggtcgtgttcattgctcncttgctggact

SEQ ID NO: 532 - DNA, 892 bp, Fusarium venenatum
  misc_feature (1)...(892): n = A,T,C or G
gatcggntcagtcnaaaccaagaaattgtacctcacccagccacaaacccncaaagctcgaccgcccacactttcagaattcaggggctattcagtgcaatctggctctcccgccatcgtaggcttaagtcattcctttcatgccccatgctccatcgccaagcttccaaagtgtctcctaaagttagagagtggcttcgacgcgaataacgacgaagataatccatcaacgcgatccccaatttctcacgctcattttccctttgcgggttcttccttgatctacctattctcaggtcatttcttctattctttatgctttcttcttcaaatcgatacccctccaatcccacccatcatggcacccaagggaaacaagtactcggttatcttgccgacatacaacgagcgcaagaacctccccatcattacctggttggttgaaccgcaccttcactgagaagtncgnaacanatcgatagtaataattggattttggaaaactaactagatcaagcaacctcgattgggaactcatcatcggcgacgacggatcccccgatggaacccaagaagtcgcccaagcagctcgtcaaggtctactcttccccacgtccttctctaagccccgcgctgggtaaacttcggtctcggaacggcctacgttcacggtctcaagtttgtcactggcaactttgtcatcatcatggacgccgacttctcccaccaccccaagttcatccccgatatggtngctctccaggagaagggcaactacgatatcgtcaccggtactcgctatgctggagatggaggcgttttggctgggatctcaagcgaaagtttgtnagccgtggcgccnacttgttcggncacactgnctgcgggctgg

SEQ ID NO: 533 - DNA, 657 bp, Fusarium venenatum
  misc_feature (1)...(657): n = A,T,C or G
tttttttttttttgaggttgggtgttttttatttgtgcaatctcaaaatagatgagatggtactatggtatgaaggagtcgtgtggcgtcataactcgttcttcattatgtcaactccgtctagatagaagctcgcaggaccttgaaagcatcctcacgggagccggtgaaacgagcctcggccgtcttccagttgatgacattccaaatgttatcaacataagcagcctttccattgaggtactgcagatagtaggcatgctcccacatatcgacaccgaaaatgggcacttctcctcccacgacagggtcctggtccttggtggtaacgacacgcaagccctgggcgtccttgaccagccacccccagccgctgcctgcaaacccagcagagtcttctttgaaagtctcttggaaagcctcgatgctgcccacgtcttggagatttcgtcgaagagttcttccaccttcgcccactgngcgaccgttgcgccgntcccaaagctntgggcttaactnaaggtaaattaacattaccggggttatcggttcctacgacgantggaatggctacatacaccgtcgaaaagatacctgaaccggaacgaggcaggacttttcactaccggaaagctgctttcttggacgaatgctcat

SEQ ID NO: 534 - DNA, 410 bp, Fusarium venenatum
  misc_feature (1)...(410): n = A,T,C or G
cctatggacactgncacggagcacgagatggncatccacatggctctccagggtggtctgggtgntattcaccacaactgctcccccgaggctcangccgacatggtccgcanggtcaagcgatacgagaacggtttnattaacgaccctatcgtcnttgaccaaaacaccactgttggtgaggccaaggctctgaagganaagtggggtttcggcggtttcccagtcactgaggatggcaagcttggatccaaanttgttggtattgttaccaaccgataccttcagttcgaggaggaccttnaccaccccntctataatgncatggttaaggaccttgttantgctcctgagaccgnctntctcctagaagccaacaagatnctttccaagtncaagaagggcaagct

SEQ ID NO: 535 - DNA, 621 bp, Fusarium venenatum
  misc_feature (1)...(621): n = A,T,C or G
gcccggcaaggttaaccccactcagtgtgaggccttgaccatggtttgcgcccaggttatgggtaaccatgttgccaccactatcggaggcatgaacggccagtttgagctcaacgtttacaagcctntagtnattcgcaacctactccacagctcccgtcttctaactgacggcatgcgctctttcgagaanaacctggttgccggcctcaatgctaacgaggagaanattgccagcatcatgaaggagtcactcatgcttgcacctgcttgaaccccaagatcnggatatgacatggccagcaaggttgccaagaaacgttcacaagaaagggccttaccctcaaggagtagtgccctcgagcttaacgcgcttactgaaggaggaattctatactcttgttaagcctgaagctgatggtcggtcccagcccctacaagggttagatactcgcctgaccttatgtatgatcgtggcccatgtttttaaaagaaacaaaagcgctgctagttcccattgtacctatgaaaacgatgttgatactggtgttcgaaaatccaaggggcactatttaaacgatacagataaaaataaaaacatcataattcacgcgtgaaaaa

SEQ ID NO: 536 - DNA, 797 bp, Fusarium venenatum
  misc_feature (1)...(797): n = A,T,C or G
cggctcactgccatctttgactcgtgtcactccggtaccgccctcgatttgccctacatctactcgacacaaggtatcctcaaggagcccaacctggccaaggagctggtcaaggcttgctcagcgtcatctcctcatacagccaaggcgatctcggtggtgttgccagcaacatcttcggcttcatcaagaagctgccaacggtgacgaggctcgcgagcgtaccatgaggacaaagacctctcctgctgatgttattatgtggtccggcagtaaagacnaccaaacttctgccgatgctactatcgcctcccaggctactggcgccatgtcctgggcatttgtcactgcgctcaagaaaagtccccagcaaagttacgtccagttgttaaacagtattcgtgacgaacttgcgacgcgctatactcagaagcctcagctatcatgttagtcaccctctcgacacaaatcttttgttcgtcatgttaatgtttatgccccactctcgaaattttcatgtgccgaatctacataaaagtcaaccaagcccgtatcaaagattaggaaacaatgggagagctaggttggctgtgcgagtgttgtttgacgacaatgggcggaccacacatagtatgacttgatgttaacatgatgggaggttgtttgcaaggtttangtgttgggttagtctttaaggacngnctcaagatactcaaacgtctttctttttacttctcatgcagtgtgggggagaacatttgaagntcaaatcaaaatgctcataatttgatgcttat

SEQ ID NO: 537 - DNA, 583 bp, Fusarium venenatum
  misc_feature (1)...(583): n = A,T,C or G
gcctctttcctacgaccaccgacatccccnccacaagcgatacctcaagcgattccaccattgttttgcgatatcttgttatctttttggggatcagtgctacatatcagcttcgacatctcgaattggggaatcataggtcttacaaaatgcctgggcttcgacttctccaactacaaccgcaatgcggctctccacgctcgaggtgtgcctctccccaaggccaccagcaccggaacaactatcgtggggatgcatattcgatggtggtgttgtgattgccgccnatactcgaaccacatccggtccatcgtcgccgacaagaatgtgagaagcttcactacatttccccccanatntggtgcgctggtgccggtacagccgccnatactgagttcaccaccgccctcatctcctctcagctcgagctgcactccctatccacaggccgcaagccccgcgtcgtccctgcatgaccttctgaacacatcttttccgctaccaaggtcacattggtgcttaccttgtcgtttctggtgtcaacctaccggcactcacctgttcactgtccatgctcacggtg

SEQ ID NO: 538 - DNA, 540 bp, Fusarium venenatum
  misc_feature (1)...(540): n = A,T,C or G
atgctatctctttcctcttccacaagggctacacccctaaccagccccctttcatgctcaaccgcgaccagatggccaagaccgcccagctctctcagttcgacganganctgtaccgtgtctctgaaggccctacaccctccgagtctgaccgatacctgatcgccaccagcgagcagcccctttccgccctccacgccgaanantggattcagcctgccgagcttcccatcaagtactgtggttacagcacttgcttccgaaaggangctggtagccacngccgtgatgcttggggtgtgttccgtgttcaccagttcgagaaagtcgancagttcgttctttgtggtcccgatgacagctgggaacagtttgacagatgatggccaactctgaagattctacaagtctcttggtctccctaccagttgttggcatcntaactgggccctgaanaacctgctgccnaaaattanatttggaacatggtncccctccaaaaganttaaaggactgtttctgctccactgcccgactacc

SEQ ID NO: 539 - DNA, 631 bp, Fusarium venenatum
  misc_feature (1)...(631): n = A,T,C or G
cgacaaggtcattcctcttacaaagctcaaggtctttaccgagcacaagtctgacatccgacgtaagggtgttgccagcactataaagaacgctgctttcgaggtcaagtcccatccgtctttcttggctgacgatgcgattgatatccttccctacatcctcctccctatcatgggtaacgaggagtacgatgttgatgaaactatggacatgctgcctgatctccaactcctaccacccgacaagaagcgagactcagacaaccagaacatacagacacatgtggagacgattaccctgttaacgacgacacgcgagggacgtgagcttatgcgccgtgtcaagggttaccctgtcattcgagagacacatcagcgagtcaatgatgaaggcgtccaanaagcatgccaacggttggtgcaggtactggcacaagataaggaangcaaggaagaagatgatgtcaaagaggcaaacngagtcaaaagctatcgaggataagcctgacactggcaatggccaagtgggaaaaagtccaaatgaagatgatcaactttgttgagggttnaacccattttnttaaagaaggtggatgctatgggggtttttatgnaacggattttggcaaag

SEQ ID NO: 540 - DNA, 369 bp, Fusarium venenatum
  misc_feature (1)...(369): n = A,T,C or G
gccatctgccttctcatccccgtgttgtggctcatccccattggtgttgttcaggccatcaccaacattcagctcggtctcaacgttttgacagagtttatcattgggtacatgggtcctggcccgnccatggctatgatgaatgttcaagaactacggnttcatntggatngggcaagcacntttantttgcccaagaacctnaagctcggtcattacatgaagggccctcctcgggttatgttttnttcgcagctcgtcgcgtntatttggtcggctattgnacagatttgtgtgatgaactgggctcttggtcatatccccgacgtttgtgccattgaccaacccaacaactacacctgcccagga

SEQ ID NO: 541 - DNA, 251 bp, Fusarium venenatum
caaggagttccccaactgttggaagcctttcggcaacggtaagagagcttgtatcggaagacctttcgcgtggcaagaaagtctcctcgcaatggccctcttgttccaaaacttcaactttacacagaccgatcctaactacgaattgcaaattaagcaaaacctcaccatcaagcctgacaacttcttcttcaactgtactctgcgacatggcatgacccccacggccttgagggtcaactggctggaaa

SEQ ID NO: 542 - DNA, 545 bp, Fusarium venenatum
  misc_feature (1)...(545): n = A,T,C or G
gtcaacggtcgcattggcgattctgcgctttaccatgtcgttcgacaacaagtacgacaaccttctccaggccgtcaaggaggccactaacgctggtattgccgaggccggtattgacgcccgcgttggcgagattggaggtgttatccaggagaccatggagagtttcgaggttgagatcgacggaaccacctaccccgtcaagagtatccgcaacctcacgggtcacaacattctgccctacagcatccacgggnaccaaggccgtacccattgtaaagagttaacgaccagaccaagatggaagagggcgacgtcttcgcatttgagaacntttggcagtaccggaacggatacgtccgggacgatatggagacgtcgcactacgcgaaacgaggagactctcgcacgttgatctgngcttgagctttgccaagtcggttttnaacgggattaanaagaantttggaccctgcttttntggcganacctggaccgattggtagganaagncctgttggaatnanaaactggtnaangctggg

SEQ ID NO: 543 - DNA, 560 bp, Fusarium venenatum
cttgccagttgcggaattgtctgcacctgtactgtacataaacaacatcctactcgcccccctgctcctacgatagcatctctcttctggtgttctcttgttttatcatcatctcttgatttcccaagtaaccatcgccatcaacatcacacaatggagtacaatatggaagacagccagaaccttgctccccaggctgccaagctcaactctggttccaagggtcctgattctcagagcaccaccaagagactccagaccgagttgatgcagctcatgacatcgcccgcccctggtgtttctgcctttccctctgcagacggcaacctcctatcatggactgccactatcgagggccctgaagacaccccttactctggtctgaccttcaagctcagcttcgctttcccctccaactatccttatgcggcacccacggtgctcttcaagacacccatctaccaccctaatgtcgacttctccggccgtatctgcttggacatcctcaaggacaagtggactgccgcttacaacatccagactggttctcctcagtctgc

SEQ ID NO: 544 - DNA, 549 bp, Fusarium venenatum
  misc_feature (1)...(549): n = A,T,C or G
catcatcgaatcatcctactttgacggtgctgatgagttgcccaatggtatctctgctaccgtcaagcgtggcgatactcaactcgntattnggcgtatcangggtgtttactacgctactcaacaaatgtgccctcacaagcgtgcattcattctatctgacggtctcatcggccaggagcctnataaggcggancaaaacggcgacaaggctgctacttcaccctgggtctcatgtcctcaccacaagcgcaatttcgatctcggaaacggtgcttgcaaaacggatgagtccatgtcaatcgccacgttccccaccgagtctcgttccgacggtatgctgtatctcaagcttccccctgtggacgagctcnacagcgccttgggcactaanaagtggatgattaaaaagggtgaggctggtgaagcaccgntggccaagctcgatagcaagancaagtttgggggtattcgggggaanaaccatatgtcaagcctactggtcancccaagatgactaccaancccgatggatctcatgatggcttt

SEQ ID NO: 545 - DNA, 587 bp, Fusarium venenatum
  misc_feature (1)...(587): n = A,T,C or G
atcatacctcacacctcgacctccactttacaaaacatcaccacgagcctctttttactcccattgcgcctgctgccaacctttgaatctaacgctcttgatcgcccatatatataacacttcataatttaagctcacctctgcaacgttgccactatggcgtccgatcaggacaactccagcctcgatcggacgccaggctcgcaattccaccgaccaattctacaatccatgcccgacacgcgccagcagagctttgacgaaatctacggacctcctgagaacttcctagagattgaggtccgcaacccaagaacgcacggcatgggccgccacatgtatacagattatgaaattctctgccgcacaaacataccggcgttcaagcttgcgccagancagcgtccgtcgtcgctactctgactttgagtacttccgcgacatcctcgagcgcgaaagcgcccgaataaccattccacccctgcctggcaaggtcttcaccaaccgctttagcgacgangtcatcnaaggtcgtcccgctggccttgaaaattcctcaagatcgttgttggtcatcccctgttgca

SEQ ID NO: 546 - DNA, 841 bp, Fusarium venenatum
  misc_feature (1)...(841): n = A,T,C or G
cgatctgactgtatatgtcacaaattacccccctgctgcggatcaaaactatatccgtgatctcttcagggattgcggtgagatcctcagcatacgctggccgagtctgaaggtcaacgcccaccgacggttctgttacgtttcgttccgagaccaagaaacatcagcaaagctgtggactgggtggtacgctccttgaaaagagcttcaaactcgttgccaagtattccgacccaggacacaaaaaagctcgagagggcgctcttgcggaagggtcgagaaattcacattagcaatctnggatcgatcgacaagcgagacagagctgaaagatgttttttccaagtatggcaatatcacacngggtcaacatccctacaactctgggctggaaaaaacaaggggtttgccttcattgactttgcaactacagaagangctgcgaaagctgtgacggaaatgaacaataccaaagtttagaagccaaattctcgcagtcgctctctctaaagaagtccaggatcaagccagcagccaagactattggtactgataatgccagaggttcaccagcaccttcgtctcatgaatgtcgatggcgaccaagctatgcaaggtgttgaggttcaggccaaaccaactgcagcggaaatntcagcaaaaaccatcgctctgatgggtctttctgatactgnnaaacaagcgcgaatccggtcgctcgtcgaacctttcgngcgatagtnaaatgacggcnaaacccggnatggcggaccnaaaatcgaatttgncgacccaacctgggaggcaaggccagtntacaactaatagcntggagttngag

SEQ ID NO: 547 - DNA, 586 bp, Fusarium venenatum
  misc_feature (1)...(586): n = A,T,C or G
atcggtgtcttgttgacatcgcaagctctatccgggctatcatggggtgtcatcgaaattttagctgccacatatgcagctgaagtcgttccaaatgctctgcgtccttttgttctaagcagcatcaatatgtgctggcttgtaggacaggtgatcggcacaggcattcttcgttcgcttgttcatgaaacttcacaatggtcttatcgccttccctttgcacttcaatgggcgtgggcgataccgttgttattcggcgtgtggttcgcacccgacagcccatggtggcttattcgtcatgaacgaaccgaagacgcaaagagggctctcacacgactttgcaacaagaaccataccgacatcgaagacaccatctcactgatgaaacacaccaacaagatggaaaagcactgtaactatggaggagccagctataaggatctcttcaaaggagtcaaccgacgcaggaccganattgcatgtctcgcatggngctctcaggccctcagngggtggncgcttacatcgnacncaccatatttnttcaaacangntggcttnagcgcattcattttttttaaccttt

SEQ ID NO: 548 - DNA, 576 bp, Fusarium venenatum
  misc_feature (1)...(576): n = A,T,C or G
ctggacctctgcaaggccattatggagctccccctcctcagcagcagccgtacggccaccactctcctgcgccgccaggtcctccaccgggacagtacggcgcgcctcctcctcagcagtatggcgcaccaccagttcagcctactcctccctcgatgggctacggaccacctcagatcattcaatggaacggcgaaacctgacgctgacggcctgcgaaaggccatgaagggttttggaactgatgagaagcattgatcgccattcttgcaaacaaggatcctctgcagattgacacaattcgacaagcatacgagcgcaagcaccgtcgcagcctaattgccgatattcagantgagactagttcgtggtttgagaaagctttggtctcactagcccgtggcccgctcctgtctgacgttcacgctctacacgatgccatgtctggccctggaacaaaggaaattgttctnaacgacttctactcgggcggtcaaatgcggatctcaaggccattaanaacgcgtactaccacactttccatgacaagctcgaggatatattcaagggcgattg

SEQ ID NO: 549 - DNA, 712 bp, Fusarium venenatum
  misc_feature (1)...(712): n = A,T,C or G
catgcccaacagctggctcccccccacgaaacagcgctccaacggagcaatccttctcggtgacgctatgaacatgcgccacccgcttacgggcggtggtatgactgttgcattcaacgacgttgtcatcctgtcagagctgctgcaccctgataaggtcgctgatcttggcgatcccaagctgatcaacaatgctctcgatgagctttactggaagcgcaagcctttgactggcattatcaacgttctggcccaggctctctactctctgttcgctgccaatgaccgccaactacgtgctctccagtacggatgcttcacttacttcaagcgcggtgacactgacggccccgtcgctctccttgccggtattctccagcgtcctttcatccttgcctatcacttcttctctggtgccttccttgctatctggctcaacgcatgctccgtcgttggctggggaatctttggcattttcaagttccctctcgctattatcgacgccgtcctcattctctgggaaggcatgcattggcttcattcccaatatggggcgcgagtccttccagtagaaaaatgaagtattagaagggaaagaaaacgagcatggtgatttttatataccgaaagctgnggcgttacngactttgcttgggactttacgnaaggtttaaaagatccatgtctttggctnttaagattnaagagaagg

SEQ ID NO: 550 - DNA, 636 bp, Fusarium venenatum
  misc_feature (1)...(636): n = A,T,C or G
gaaatatctcaggataagaatgaaaacgttgagccggaggatgatgatgatgacnacgatgaagagttgaagagagtactgtctaccatcacggcgccctctcgaattaagcgaaatgttcaaacggagacaaagaaagttcaagcaaagcctgtagtcgcacccaaaaactcgattcaagctcctaccgacccaaacaccactttctccgccctcaatgtacagccatggctggttcaatcgctaggaaatatggctatcaagcgacccacgggcattcagaagggctgtattcccganatcttgaaggggagagattgcattggtggcagtanaacaggttcaggtaaaacggttgctttcgcggtgcctattctgcagaagtggtctgaagatcctactgccatctttgctgtcgtcttgacgccaacccganaactggcacttcagattttcgagcagttcaaggctatctcttctcctcaaagtctcaaggctatcttggtgactggaggctcanacatgcgaacacaggcaattgaaattggaaggcgaccncccctttttaatcccaacttcagggnggttggnaaaacacattcccactttcngagaagacacaatctggggattgag

SEQ ID NO: 551 - DNA, 579 bp, Fusarium venenatum
  misc_feature (1)...(579): n = A,T,C or G
tatcacgatgctcaaaccgacatcgatctgccgcgtggttggaagtaccgacnactccgtctcttcggcaagactcttccctggtatgcttcgccgcgtatccagctcggaatggtcgctttcgtctgtttcatgtgtcccggcatgttcaacgctctcggtggtcttggtggaggtggcaaaactgacccaaccttggctgacaacatgaacaccgcgctctacggcactttcgctgtggttggtatctttggtggcacttttgtcaacaagctcggtatcaaagcttgtctgancttcggtggcgtangctatggtttgtacgccatcagtcttcttgtttctgttcacaagcatgttcctggcttcaacatttttgctggtgtttggcttggtctatgcgctgctctgctctggaccgcacagggtaccatcatgatctcatatcctcatgaaaacaaaaagggaaagtactcgcttggttctggggtatttcaacatgggtgctgttattggcagttgaatccctaggtgaaaacatcaacatcaaggaaaacaanacgtcacganngaactaca

SEQ ID NO: 552 - DNA, 1074 bp, Fusarium venenatum
  misc_feature (1)...(1074): n = A,T,C or G
tttcaccctgatctagttgttgattgaatcgccattctcacccggtttcttcgtaacaatatatcgttcggattgttcgttgctgctctttctctcaagcgttgccccggctgacatcctcacaccccctggtaatatccacccgtgtgggcccacctatcctcactttcttcccggctccagacgctttctctcttcccttttccttttcccactaccgccctgtctcgtgctgagctccgtatctcttttctttaaacctcccatcagcctctccctctttcaaccatcaaccatctcccctcacaaatcaatcacaatggcctcttctcgtgtcttcgcctctcgcctggcctcccagatggccgtcaaggccgctcgccctgctgtccgcgcccccgtcgctgctgccagcaagcgaaccatctctggcgccagccccctccaggccatgaagcgtcagactcttctccaggccaccacccgcaacgccttccaggtccagcgccgtgcctactcctccgagatcgcccaggccatggttgaggtctccaagaacttgggtatgggtgccgccgccatcggtcttaccggtgctggtatcggtatcggtcttgtcttcgccgctcttatcaacggtgttgcccgcaaccctgccctccgtggtcagctcttctcttacgccattctgggtttcgctttcgtcgaggccatcggtcttttcgatctgatggttgcctcatggccaagttcacttaagttactacccaacccaatgggtagactcgtgccgaatgatcgagtcaacgacacggaggaggctgccgagcgttgtgcattataccgtgtcttgaaaaattcgacatgggtgcacttgatgccggcttgcacgatagaggggaggttgtcttgtaatagacgggatagagaactgggatggacattgatcatggacacttgctatgattagagttggggaaattctgcataattcctcccagggatcgactttgtaaaataaaaagcctcattcattccgcttctttccatgcattaaggatatttcnttttttc

SEQ ID NO: 553 - DNA, 439 bp, Fusarium venenatum
  misc_feature (1)...(439): n = A,T,C or G
aatgtgatttctgcccagtgctctgaatgtcaaagtgaagtaattcaaccaagcgcgggtaaacggcgggagtaactatgactctcttaaggtagccaaatgcctcgtcatctaattagtgacgcgcatgaatggattaacgagattcccactgtccctatctactatctagcgaaaccacagccaagggaacgggcttggcanaatcagcggggaaagaagaccctgttgagcttgactctagtttgacattgtgaaaagacataggaggtgtanaataggtgggagcttcggcgccggtgaaataccactactcctattgtttttttacttattcaatgaagcggggctggatttacgtccaacttctggttttaaggtccttcgcgggccgacccgggttgaanacattgtcagcaggggcgctgggggcggcaca

SEQ ID NO: 554 - DNA, 871 bp, Fusarium venenatum
  misc_feature (1)...(871): n = A,T,C or G
cccccatcacgaactatcccacaatggcgtcacgcttggcacgaagcgccgtcggcgctcccctcctccgacccgtcctcgcccgccgagctgcccctgccttctccgttgccgctgcgcgatacaacagcaatgttcccgccgaggaccccaagaagaaggctcagagcatcatcgacgctcttcccggtaacagccttctcagcaagagcgccatcctcagctccgccgccgctctctccatctacggcatctccagcgagtactacgtcatgaacgaggagaccatcatcgccatctcccttctttccgtctggactgctctgatcaagtacggtggccctgcctacaaggagtgggctgaggcgcagaacaacaagatcaagaacatccttaacagcgcccgtgccgaccacaccgaggctgtcaagggccgtattgaggacgtcaagcagatgggtagcgttgttgagatcaccaagaactgttcgaggtttccaaggagactgccaagcttgagtctgaggctttcgaagctcgagcaaaagactgctctggctgctgaggccaaggccgtccttgaagtcctggggtccgatacgagggccaggttaagcagcgccagcagaaggagcttgctcagtccattatcgctaaggtccagaaggagctcgagaaccccaaggtccttcagcagatcctccacagagtgttgctgacgtttgaaaanatcgttgccctccaagcccaatanataattacatgcccgttagagtctcgatcaccggattccacggtttttnttttgtacccccttgtgtcttaacaacacctgtgcattanccgaatcaatcaanaaccttnttcttct

SEQ ID NO: 555 - DNA, 587 bp, Fusarium venenatum
  misc_feature (1)...(587): n = A,T,C or G
gccttcctcaagtccattgcctccttcaatggcgacctatcttcgctcactgcgccaccctttatcctctcttctcagtctcttaccgaatttctctgcctactgggctacgcaccctcccgtcctaaccgctcctgctgccaagtctgatcccgccaagcgtgctatgctcgtcctcaagtggttcctctccactctcaaacaccaatacgccagccgaaagtgagcagtttgaaaatgaaaagaagcctctgaaacccttttctngggcaaacttttcctcggcacctggtccgaataaagctggcgagaccacccttgtctcagagcaggtcagccaccatcctcctgccaccgcatactgcattcgcaacaacaaaactggtgttgaactcgaagggttataacgcccagaaagccaccttccaaaagcaccatcatcgttaagcaaattggccatgccgtcctacgaatccctcttgcctcngggtgagatcaaatcctaactgatcacccttcctgggcctgcacattgaagggtctgattttcggtgctccctttgttgaacttgatggctcgaatcaca

SEQ ID NO: 556 - DNA, 572 bp, Fusarium venenatum
  misc_feature (1)...(572): n = A,T,C or G
tgtacgggccngacggtattcatttcttaacctatcatgattccttctctttaccctgggccgtttaagcctggtaagtagaggcgnagacgttacctccacgaccagtccagttgaaggaatttgctcccaagttcgacagcgcgcgtgaggcggcacgcaacatcaccctcaagaccttcgccgaggacgcgagtgccagcgtgcaagccaccatgtacaagatgtcaggccaaatcctcgaatctgtgcccgaggtcgcgacggtcacttattcactacctaacaagcattactttgagattgaccttagctggcataagggaatcaagaacacagggaaggacgccgaagtctatgctcctcagtccagccctaacggccttatcaagtgcgaagtctctcgagacaatctgcaatcgaagctttaggttggaacgaaaaagattgtgtgtttcttaacgatagaggtcaagatgcgaaacatgatgcacccatgaagaggattgataccaagcgactggcttagattctataatagatatgagataatcaattgcgtntttttgacc

SEQ ID NO: 557 - DNA, 762 bp, Fusarium venenatum
  misc_feature (1)...(762): n = A,T,C or G
cctgaagcgcatcataaggacgtgcgaggtcgaacatccaagacaaagttgatcgccatgcccgccgagtatccccctctggaccaacactgcttccgaacactgtttcaccgaccttacttccacgtccagatggtttccgacgtcgctggtgtatctctgagcggtgcgttgaagaacgttgttgctctggcagctggtttcgtcgatggtcgaggttggggtgacaacgccaaggcagccattatgcgagtcggactcatggagatggtcaagtttggcaaggagtttttcggagagactgtgcacactgctacctttacagagtcatcttctggtgtcgccgatcttgatcacatttttgctcttggaggccgtaactttcgatgtgccaagatggctgtccagaagggcatcagcgtccaagaagtcgagaaacaggagctgaacggtcaaaagatccagggtaccactcctgctgaagaggtgaacagtttcctcaaggctcgaggtcttgagtcggagtttctttgttacagccgtcaacgccatttttaacggcgaggctcaggtggatgatattcctactcttattcaggattcttgattacactttactagccggntaggaattggatcatgggactggagtggcgtttntnaattggttntacaggccaacacattggangatgacaaccggntgtgttaaggtntgcttcggngatnaaaaagggncccttccaaattaaaaggaatnta

SEQ ID NO: 558 - DNA, 797 bp, Fusarium venenatum
  misc_feature (1)...(797): n = A,T,C or G
aatatcttagtctcataccaagacatatcacatacacttataccacatcctcccacttatacacatacattttacatattcatcatggccaagacagctgttcactttggcgccggcaatatcggccgtggctttgtcgcctgcttcctccacaactctggttacgacgtcatcttcgccgatgtcaacgacaccatcgtcaacctcatcaacgaaactccctcctacaaggtcatcgaggtcggatctgaaggaaccacagagaacacaatcacaaactacaaggccatcaactcccgaacacacgagcaggatcttatcgaggccatccgcacagctgacattgcacttgctccgtcggcccaacatcctcaagttcatcgctcccgcatcgccaanggtatcgacgcccgcttaacagacagcgctcctntacatgtcatcgctgcgagaacgcatcggggctcagatactctgntgagcacatnaaggaccctngcaacactgaccctntcgtnttgaggccaccactggagagctcgctttgccaactntgntattgacaggaatcgttccgccaggacccaacgctggacttgatgtacactggganaagtttttcgagngggtgtgancggacttcctttcaagangctgggntcctganatccanggnattaatngggtggcaaccttgttccnttattgaggccaagtttttaacggnaaaaattgggcaccccnttggcggttaccccgggttnaaccganaaaagnggtccggtttcaagcccttt

SEQ ID NO: 559 - DNA, 625 bp, Fusarium venenatum
  misc_feature (1)...(625): n = A,T,C or G
cgccataatgacttttgacgccgagaagatcggcgctgccgacttnaagagccttggtcccctcgttgccgagctcgacaagcaccttaccctccgaacttacctcaacggctacactctgggagaggaagatggcaagatctggactgctcttcnaaccaacaaggtcgccattggccttgttcgaangggtgcctacaccaatatcactcgatggttcaacctgatcgagcaggcacaccctgagttcaacgagaagctcaatgctggaaagganaagaagtctggaggcgccaattacaacattggtctctccaacaccgagaatggtgttgtcacccgattccctcctgagcctagtggttaccttcacattggtcacgccaaggccgctctccttaacgattacttcgcaaagacctcccccgacggaaacggaaagctnatcgtttcnattcgacgacacaaaccccgccaanganaaacangagttcgaggatgctntcctnaaagatctcgagctgntggacatcaagtaccacaagggcncccactccagtgactnctttcanganaattacgatctcccganaanattatccaagacggnaaccccctcccccga

SEQ ID NO: 560 - DNA, 443 bp, Fusarium venenatum
  misc_feature (1)...(443): n = A,T,C or G
cagcctgcctgctatgaccagcctcaagagcctggtcaagaagccaagagttgctattctccgagagcaaggtgtcaacggccacgccgaaatggcatttgccttccgagctgctggcttcgatgctgttgatgtccatatgtccgacatccttggcggcctctccttggagggattccgaggtcttgctgcctgcggtggcttctcctacggtgatgttcttggcgccggttatggttgggcacagtctatcctgatgcatgatggtgctcgtaaggcgtttgangccttcttcaaccgtcctgacactttctcattcggtgtctgcaacggttgccagatgctgactcnacttaaagaattgaatcctggaactgaacactgggcaacattcgttgaaaacgccncncccaattcgagggtnaaactcaatggttaccatc

SEQ ID NO: 561 - DNA, 601 bp, Fusarium venenatum
  misc_feature (1)...(601): n = A,T,C or G
cagcctgagactggctactatgaacaatccacaacggatatctggcaatgcatctgcgagtgcgtccgtcgcgttgtcagcgagtccacagtcaacccctccagcatcaaaggcattggcttcnatgccacatgctctcttgccgtcttcactcacnacaccgacgagccactccctgtcactgggcctgacttcacaaatgatggcaacgaccgcaacgtcatcttgtggctcgaccaccgaccggtcgaagagaccgaagaaattaacantacagaccacaagctcctcaagtacgttggtggaaagatgagcatcgagatggagatgcccaangtcctctggctcaagaaccatatgcctccagaagtgtttgagcgtgccaagttctacgatcttgcanacgctcctaccacttggctactggcaacgagacccaactactgcagtgttgtttgaancaagntatgttcctgttggcgtgatggaactcaagggtggnanaagacttttacaagaaattggctcgggacttacaaggatgactnaacaatggtgggtcacgggttacggaccattnattctggcaaccgtgggaact

SEQ ID NO: 562 - DNA, 383 bp, Fusarium venenatum
  misc_feature (1)...(383): n = A,T,C or G
cgcgcctctcaatccggcctactttgcgctttcatctccgccatccccgttcacctgcgtgttcgcaacaacgtagtcacttgttccgaggtcaacttccttgccatccacaanaagcttcgaggcaagcgtctcacgccagtgcttatcaaggaaatcacacgacgcagtaaccttgacggtatctggcaaggtctttacactgctggtgtcgtccttcccaagcctgtcagcacctgcagatacttccatcgtgccattaactggcaaaagctctacgaatgcggtttcagccctcttcccgctaacagcaagcctcaataccaagtccgcaagtatgcgctgccgacnacacaagcatnaagggtctgcgaccgctacaa

SEQ ID NO: 563 - DNA, 459 bp, Fusarium venenatum
  misc_feature (1)...(459): n = A,T,C or G
ccagcgaaaaggcacctcttggcgctgctaaattcgctgagctcattcacaaagccggtttccctcctggagtcttcaatgttgtgtctggccatggtancccctctggagccgcacttgcgtcgcacatggacgtacgggctatcagcttcactggatctggtcctactggccgcgcaatccaagaagcagctgccaagtccaacctgaagaaggtcatcctcgagctcggcggtaaatcgcccgtnattatcttcgacgatgcanaccttgagcaggctgctaaggataccatgcacagtatccagtggaacagtggtcaggtctgcatggctaattctcgtgtttacgtgcaagattctatcgccgataacttcgtccaagcttgcaanaaaacatttgtctgccgnaaagccggttatccacagagaanggcattattatggncctcagccgaca

SEQ ID NO: 564 - DNA, 567 bp, Fusarium venenatum
  misc_feature (1)...(567): n = A,T,C or G
catctctccaacggttcacacacaagccagcaaacatggcggttggaaagaacaagagactctccaagggcaagaagggcctcaagaaagaagacggtcgaccccttctcccgaaaggactggtactcgatcaaggcccctaaccctttcaacgttcgagagtgagttgcgaccacgaatccgatttaaaatcgtcaacttttttgtgggatatggcgattaaccaatttacagtgtcggcaagacccttgtgaaccgaaccactggtctcaagaacgccaacgacgctcttaagggccgtatcctcgaagtctctctggccgatctccagaaggatgaggaccactccttccgcaaggtccgcctccgtgtcgacgaagtccaggcaagaactgcttgactgctttccacggtctcgacttcacctccgacaagctccgatctctcgtccgcaagtggcaaactctgattgaagccaacgtcctgtcaagactaccgacgactacctcatccgcctcttccgccattggtttcaccaancgacgaggaaaccaggtcnagaaaaca

SEQ ID NO: 565 - DNA, 1860 bp, Fusarium venenatum
  misc_feature (1)...(1860): n = A,T,C or G
cggtcctaagggcgaggagtactgttggtncncctgcacaatcaagggtggccgngaaactcgggatatggatgtagtcgagcttgtgcaanccgtcgaggcgatgggaaccgganagattctcctcaactgcattgacaaggacggcaccaacagtgggttcgacttcgagctcatcaaccaggtcaagggagctgtcaagatccccgtcatcgcctcaagtggtgctggcaacccggctcactttgaggatgtattccaaaagacttcaacagatgccgntttgggtgctggaatgtttcaccgcggcgagtacacagtcaagcaagtgaaggattacctacaacaaaagggtctcaaagtgagacagttcgaagcaggaattttagggctttttgaaataaaacaaagaataaggttagacaaattcttgaattcggtaaatatcgttttggtataattttaactaaaaggcatgtactggataaagagtcataaccataagagcttcggtntaacacagagacaccaatacgctccaacacctgagaaatcctttaacnggaagatgcgccaaaatgggtgtgttgaacttgcgactcaacgccaatgctaacagacttttcgagcatagctgagcaagtcgccgagcgagcttccaggttaaattttggaaaacaccaacgaaagtaaaatgacatgagacaaagaacacaaccactcccaaactccataaaggaagcaactcattgtctatagctccatgcccatcaacatccacttcttgctcgtaacatcaagatcatgggcccagtgatccaaggtaaccatgtcgaagccaacccactgaaggctctttgacagagagtgaacgtcatccgcggggatacgcctgtcaatgcaggtaacaatgtgggcacagtccaaaggaccgtcggccaattcgataagggccatgagagcctttttcaggtntcggccgaggacgccttcaacgtcgaagaagacaaagagagatttctcctctccatcatcagcaacaaaggcacggaagctcgcaccgccggcatagtcccaaacctccagccaagcggtaatgtcgtaggcagatagcttgtcatcggaaacaggcttgaagtgttcgggaagccggtcatcggacggcggcgttggtaaaaaagcaccagacaggccgaagccattcatggacgaattcctctcaccgtggaacgtcgcctttcatggactcgcaaaagaatctctcacattcttccctgatcgaaagtgctgccccccttcgtcgggcccaggcgccggcntgggatttctcgnttcttgttcttgggcaagagagcgagctcgttagacgaggttaatgcggcgagggggggcttgttggaggggagggtaatcctgaggaagggacctcaggaataccactcggcccctgcaaccccggtagtgcagtagtggaggcccttgaggttggcggcagagtcgacgaggtagcaagaggcaaggacattgaccttctgggcagtggcctcgccgtaattactactgtaattcaaattctgattattcattggtgccattgctgttgatgtttcctgggtgtcgactaaagtggtgatagttgggaaagggccgaggttgttgatcgacggagagaggttgactggtaacgtttgattgaggtgactcgaaataaacgggttggaaatcctttttcaagatttgtgttgtttatttggaggcaaaagtgtggatacgtgcggcgacgtttagtttcgtgtcttggtaaacgtgtggagaatgtcttcaacttggggtagagtagaagtcaagattgtggcagcg

SEQ ID NO: 566 - DNA, 378 bp, Fusarium venenatum
gaccgatccaaccccaactgtcccatcaagatcgctcacggaaccaccactctcgccttccgcttccagggtggtatcatcgtcgctaccgactcccgagccacagccggcaactggatcgcctcgcaaaccgtcaagaaggtcattgagatcaacagcgtcctgctaggaaccatggctggcggtgctgccgactgccagtactggctcgcctggctcggcatgcagtgccgcctccacgagctccgacacaagcgccgcatcagcgttgccgccgcagcaagatcctcgcaacctcgtctacagctcaagggtatgggcctcacatgggcaccatgtgcgccggagttccaagggagaaggtccgcctttactatg

SEQ ID NO: 567 - DNA, 512 bp, Fusarium venenatum
  misc_feature (1)...(512): n = A,T,C or G
catccatattgtctcctaccgctcctatgaaatactcttagtgtcccttcttactaacacactcaggtgaaccgcttggccgcatcacctttgaactcttcaacgatgtcgtccccaaaacagcagagaacttccgccagttttgcactggcgagagtaagaaccccgtaggtcgtcctcagggctacaagggctccaagttccaccgcataattcccaactttatgtgtcaaggtggtgactttctcaacggtgacggcactggatcgacatgcatctggggcttcaagtctttcgaggatgagaactttacgctaaagcatgatcagcctggctgtcttcatggncaatgctggacccaacaccaacggatctcaattcttnatcaccactgtcccacacctttctngatacaagcacgttgctttggcaaggnctttgaaggattggtttggcaanaagatggagnttccaanatgggtaccgcgcangattgcccaacctgactgggc

SEQ ID NO: 568 - DNA, 1104 bp, Fusarium venenatum
  misc_feature (1)...(1104): n = A,T,C or G
gcagatggacgctggcgatgagtctctccagcgatacaaggagtcccttggtcttggaggtggcaccgatatctctgatcctaacgatccccgagtctgcatcattctctccttgaccatggactcccccggccgtcctcccgtcaccatcgatctctctacccctggaagcgagaccaccctcaaggacaagcccttcaacatcaaggaaggtgccaagttcaccatgagcgccaagttcaaggttcagcacgagattctcagcggcctccactacgttcaggttgttaagcgaaagggtatccgcgtctccaaggactctgagatgattggcagctacgcccccagcaccgacaagcagcccacttacatcaagaagttccaggaggaggaggctcccagcggcatgctcgctcgtggccactacaacgccatctctagcttcgtggacgacgataagaagaagcatcttgagtttgagtggagtttcgatatcgccaaggactggtagacagcggcgccttggtagcacggaccgacgacataactcaaaattacatatcacaagtcatgagataatgagatacctggacatttggggagggacattcacccccaaaaatttcacataaactcaaatcaaaagaaaacctcactcggttggagaaaggtcttgctctgtttcctgtcacctgcttgtcgatgacaggccggtcggtacctgtggctaaatctagagcttcgatactgcaggagaataaaaatgcctatatacatcaaaaaaaaaagtcctctgggtctttctccaagaaggtcggagaagacattgccaagctactggtgactgggaaangcttgcgcgtacttgtcaactcaccatccagaaaccgtcaggctgntggttccgcgttccactgnttttttccttatnatnaaggccttaaggaaccccccagggcccgaaanaagggaanaacttnaagcncaacaagtttgtccccttacnanatcattganatcccccnaccatgcgancaagntttttgccaaggcctttttggtnccggangggnaatttnggaccccttcgggttggttgccngg

SEQ ID NO: 569 - DNA, 617 bp, Fusarium venenatum
  misc_feature (1)...(617): n = A,T,C or G
cacgtttcatcaagttaatcttagtcctcagggcgagccaacgcaaggaaccctgaattaccatcttaatctttcctaaacacaaacctcggttttaatctccaatatgtctgaaagcgctgcctggccccttgccgatcagaagctcgagcaggagcttctcgatcttgttcagtcttctcagcatgcccgccagctgaagaagggtgccaacgaggccaccaagaccctgaaccgtggtgtttctgagcttgtcatcctcgctgccgacactcagcctcttgccattctcctccacctccctcttctgtgcgaggacaagaacgttccctacgtttacgtcagcagcaagatgcacctcggccgtgcctgtggtgtcagccgtgctgtcattgctgctagcatcaccagcaacgacccagcgaagcttgccggccagatccgagccatgcgcgaaaaggtcgaccgtctcgccatctaaaataccaacgaaccgaggaggaaagcaaaagatggaaacctttttcgtctgtgggcagccggcttcaaaagtctgtttgttgctgctganatctgccgccgaactttgataatcggccaatatttggggaaattgg

SEQ ID NO: 570 - DNA, 718 bp, Fusarium venenatum
  misc_feature (1)...(718): n = A,T,C or G
cttcttcattcaacatagtactgagccatacactctacatctataatgaagttctctcaagcttctctcctggcggcttgtctgcctgccgtgtcggctcgcttcattgaaatcgccgaggtcgacaacgttgttcttcagccagacganctttttctcgtcnaaaccgctcctggcaagacacaatggattactgaggaagagaagtgggagatgcgtcgtaacggccagaacttcatggacatcaccgagacgactacgcttggctccaagggtctcaacgccgaaagcactgtcacgtttcccaagaagtgcgtaaagcaagacgaggtcgcaaagctctcgaagaagctcgaaaagaanaacatggaggccaacctcgagaagttgaccanntttcacacccgatncttcaagtccgattacggcctccagtcttctgactgggttcttgaaaaggtcaatcagatcatcaaagacgctggtgcccgaggataccgtgtttgccgagagctttcctcacacatggaagcaacactcggttatcgcgactattcctggncaatccaacagcaccattgtaattggcgcccaccaggactccatcaaccttttccttccttccattctcgctgcccctggtgccgacgatgatggcagcggttcaagcaccatcatggagggngttccgngctctcctgaactcaagggatgttgt

SEQ ID NO: 571 - DNA, 487 bp, Fusarium venenatum
  misc_feature (1)...(487): n = A,T,C or G
ngccaaagagttctactgatgatcctcttgtatggatcgactgtgagatgactggtctcgaccaggacaatgatgaaatcatagagatctactgcatcatcacaacgggaaaccttgagattctcgacgaagaaggctttcacgccatcatccacttcccccagtctcgtcttgaccagatggacgagtggtgcacaaagacacacgcagactctggtctcaccgccgctgttcttgagtcgacgactaccccggagcaagctgccgatgctctctacgagtacatcacgcggttcatccccgagcgcaagcgtggtctcctcgcaggcaacagcgtgcactgcgatagagcatttctgaggcgagagccctacaagcgtgtgatgagacacctgcaccaccgaattctggacgttagctctatcaaggaggctgcgagacgctgggcggccaagangattgtgaacaaggttcctaataagaaggg

SEQ ID NO: 572 - DNA, 692 bp, Fusarium venenatum
  misc_feature (1)...(692): n = A,T,C or G
ggcgactcgaagcgcagctctcaagcttgactggaccaaggtcaccagctccctcggtctccgtggccagaccgttgcctccctccaggccttcaagaagcgcaacgaggacgtccgccgcaaggtccagcagctccaggagcagcccaccaccgtcgatttctcccagtaccgatccgtcctcaagaaccaggccatcatcgatgagatcgagaagcgattcaacgccttcaagcccgttacctacgatgttagccgacagctgaaggccatcgacgctttcgaggctgaagccgtgaagaacgcagaggccaccaagcaggccgtcgacctcgagctcaaggacctcgccgctaccctcaagaacatcgaggaggcccgaccattcgaggacctcactgtcgacgaagttgctgctgctgagaatctatcgacgagaagaccgaccagctcgtttccaagggccgatggatggtgccaggctacaaggagaagtttggcgacttggctatggtttagacaaattgcgacttccctttccgccttcgcgttgtgtnctctagcattgttgataaaaaaaactggggtctgaaccagatttcctcatacccaaacatctacaaaatttcctctgtgcttcataatatcttattatctgaacatttcnttcaaacggtgtctgaaggttnnta

SEQ ID NO: 573 - DNA, 557 bp, Fusarium venenatum
  misc_feature (1)...(557): n = A,T,C or G
naaaaaaagacnccgccaaaaaaaccgccgtttctggcgacaagaaaaagcgctcaaagacccgcaaggagacttactcttcttacatctacaagggcctcaagcaggtccatcccgacactggtatctccaacccgcgccatgtccatcctgaactccttcgtcaacgacatcttcgagcgtggcgcttctgaggcttccaagcttgccgcctacaacaagaagtncaccatntnctnccgagagatccanacctntgtccgcctnatcctncccggtgagcttgccaagcacgctgntntgagggtaccaaggccgtnaccaagtactcttnctcgacnnaataggtggtttgatagctngatttgtttngggcatttannttttnacncgnggcatcangggtgtatgaatctgaggttcacngggatcaccctgtttgggggcctataangcgtacngatggtttggtttttttttctgggggcatgtttaaccggccaacggggtccgggggacaanaacatcaaaaagggttggncaaggattggcccttt

SEQ ID NO: 574 - DNA, 609 bp, Fusarium venenatum
  misc_feature (1)...(609): n = A,T,C or G
cttcaagacaactatcaacaccaatacctaaatccaacaactactatagaacaaataacgaacttatnatgtttaccggaattgtagaggaagtaggagttgtctccaagcttgacaacaatgattctactggcggcacttctttgaccatctctatcccttctggctctcagctcctctccgactgccatgatggcgattccatctctgtcaatggtgtttgtctcaccgtcacctctttcacgcctgaagccttcacaattggtgtagcccccgagactctgagaatcaccaacctgggtgacctcaaggagaacagcaacgtcaaccttgagcgcgctgtccgtgctgatacacgcatgggcggncactttgtcagggccacgtcgataccaccgccaagatcctgtctgtcaccaaggacggnaacgccctgactttcgnttcancctgccgcaaagacatgctgnggtacgttgtgtacaaaggctacatcgcattgacggnactagcttgaccgtcaccaaagtcaatgaccangaaggctggtgggangngaagctgatcnctacactcagganaaaagttgttgtggcccnanaaaaaaag

SEQ ID NO: 575 - DNA, 1014 bp, Fusarium venenatum
ctcatcaacaccaagtgtcttcctttccttcaccacctaaccccaagtcaaccagccaggagagtcaacatgtcggcgcccacgagcaagaccttcggaaagtcgacccgagaggtccctgcctcttcggagaaggctaagaagtggtaccccgctgatgatgatgccgagaacaagaaggttcgcaaggctgtccgatcttggactcctcgcaagtctctccagcccggtaccgtcctcatcctcctcgctggccgcttccgtggcaagcgtgtcatcctcctgaagtccctcgaccagggcgtcctcttggtcaccggccccttcaagatcaacggtgtccctctgcgacgagtcaactcccgatacgtcatcgccacctcttacaaggtcgacatctctggcctcgacgagagcaagattgaggagatctctcagcccaagtacttcaccgccgagaaggccaaggagaaggctggtgaggaggctttcttcaagcagggagagaagccccagaagaaggaggtcaacagcagccgcgccgccgaccagaaggccatcgacaaggctctgattgccaacatcaagaaggtcgacatgcttgcctcttacctctccagctctttcagcttgaggaagggagacaagccccacgagatggcctggtaaatgtgcaatcttgtgtgccggggtgatgggagtaccggggttgcgatacaaagggttgtagaacggcaagggtctccgaaatgggctggtttggccaattgcatttgaaagtcgacgggcatcggtcacattttggcgtctgtaatcaggttttacagtcaaaaacaaacgagcatacaaaattctagaggcttccggtgagaggccgatgatgatgaacttcactcggatgtcccatctccctgggtgaaaagaaaagcaactggtgtgagcgatcatggtctttcccggtctgaactcgtcaaaaatggacattgttttacgaatcataaaaaaagtttcaat

SEQ ID NO: 576 - DNA, 632 bp, Fusarium venenatum
  misc_feature (1)...(632): n = A,T,C or G
atgaagttcaacgctgtcgcagccgccgtgtcggctgctgtccttacgggcaacgttcatgctgaggacgttaaggaggcttctcccgccgtccccgaaaagcttcccacctttactcctacaaacatcaaggctgacttccttgaacaattcaccgacgattgggaccagcgatggcaaccctctcacgcaaagaaggacacgaccggctctgaggaggagtgggcatacgttggcgagtgggcagttgaggagcccgtcaagtacaagggaattgatggcgacaagggtcttgttgtcaagaaccccgccgctcaccacgccatctccgccaagttccccaagaagattgacaacaagggcaagactcttgttgttcagtacgaggtcaagctccagaatggcctcgagtgtggtggtgcttacatgaagctccttcgcgacaacaaggctcttcancaaggaagagttcgccaacacaaccccctacgtgatcatgttcggtcccgacaagtgtggncacaccaacaagggtcactttatcctcaaccacaagaacccaagacaggcgantacaaggagaaacacctgaactctcctcctactggcaagatnacaaagaccacagagct

SEQ ID NO: 577 - DNA, 335 bp, Fusarium venenatum
  misc_feature (1)...(335): n = A,T,C or G
cagaaggagagagttacggttggcgatgtcatctatatngaagcgaacaccggcgcttgcaaacgagttggacgatctgacgcctatgctacggaattcgacctcgaggcggaagagtatgtgcccattcccaagggtgaggtgcacaagaagaangaaatcgtgcaggatgttactntgcatgacttggatgtggcaaactctcgtcccaaggnggccaanatattatgagcatgatgggccactgatgaancccaanatgacgganattacggcaaactgggtagcgagacaacaaagnggtagcaagtcattcaccagggngttgtgaactt

SEQ ID NO: 578 - DNA, 515 bp, Fusarium venenatum
  misc_feature (1)...(515): n = A,T,C or G
caagacttcgctagagcgtttcaaggaggtgattcgagattccaagggtctgggcctccgtgttcgancctacatctctgtagttctgggatgtccttttgagggatttgatgtcgacccccatcaggtagcggagatcgctacagatcttctggaggcgggagccgatganatttctctcggtgacactacaggtatgggtncagcccctcgaacggcaactctccttcagtgtatgtcngcggcaggcatccgaactgaanacattgccatgcacttccacgacacctacggccaagctttagtgaacactgccgtttctctagaacacggcatccgaacgtttgataacaatgttggtggtctgggtggttgcccttacaccctggtgcgactggcaatgtctcaaccgaaaacatggtttatttcatgganactccgggtatgaatacaggtatcagcctaaatgccatgtctgatattggagcatggatcacaangganctgggccagga

SEQ ID NO: 579 - DNA, 1511 bp, Fusarium venenatum
  misc_feature (1)...(1511): n = A,T,C or G
ctttcctcttgatcagtttgcattcggcatctcgactttctcttttgtcggccgtataccttccttcaaaatggcgtcnacttcggctctgcctaagcagaaccctgctcttagacgcaccgtcacctccaccaccgtgacggacactgagtctgctgctgtctctccttcagactctccccgccactcggcctcttccacctcgctctcatttttctccgaggtcgacattgccaagcccaaggccgaatatggtgttatgcttgacacctacggcaacaagttcgaggttcccgacttcacttatcaaggaaatctacaatgccattcccaagcacttgtttcaagcgctccgccttcaagggatacggatacatccttcgcgacattgtcctccttgctaccacctttagcatctggcacaactatgtgacccccgaattacttccccagcacttcccgcccgcgctggtctctggggccgtctacaccattctcccagggtctttttcgctaccggtatttgggtcattgctcacgaattgtgggcacggtgctttctctgactctcgcctcatcaacgacatcaccgggtgggttcttcactcttctcttctcgtcccctacttcagctggcagatctcccaccgaaagcaccacaaggctaccggaaacatagagcgtgacatggtctttgttccccgaactcgcgagcagcaggctactcgtctcggcaagatgacccacgagcttgctcacctcactgaggagactcccgcctttactctgatcatgcttgttctccagcagctcgtcggctggcccaactacctcatgaccaacgttaccggccacaactaccacgagcgtcagaaggagggccgtggtaagggcaagcacaacggtctcggtggcggtgtcaaccacttcgatccccgcagccctctttacgagcacagcgatgccaagctgatcgtcctgagcgatattggtatcggcctgatgggtaccgctctgtacttcctcgtccagaagtttggcttctacaacatggccatctggtacttcgttccctacctttgggtcaaccactggctcgttgccattactttcctccagcacaccgaacctactcttccccactacaccaacgacgantggaactttgttcgcggtgccgctgccaccatcgatcgtganatgggtttcatcggncgacancttctccacggtatcatcgagactcacgtcctccaccactacgtcagcagcattcccttctacaacgccgacnaagctaccgaagctatcaagcctgtcatgggcaagcactaccgtgccgacgtccaaganggccccgtggtttcattcgtgccatgtaccgcagcgcccgtatgtgccagtgggttgancccagtgctgaaacccaaggtgctggcaaaggngttctgttcttccgcaaccgcnacaangttgggactgcccctgccgtcatcaaacccgttgcttaa

SEQ ID NO: 580 - DNA, 365 bp, Fusarium venenatum
  misc_feature (1)...(365): n = A,T,C or G
atcggtctggtgtcgaaactccctggtgttggcgatggattcgcctcccaggctagggacctcaaggccagctccgaggctcaggagcagcgtaaccgaggctatgagcagagccgcggtgatttgactcgtgataacgccaaccaagtccccggtatgagccctgacttcgaccccgttgaaaccgcacgcaagatctaccctatcctcgagttccgcgacaagatcgtcaaggccatcagccgcggtatttccaaggttcctggactggagaaagcttcttgagaagatcagtgagacacttactgntttcatcttgggcctttntcgccccttcattcgacccatnatcaaacaggtntaaa

SEQ ID NO: 581 - DNA, 659 bp, Fusarium venenatum
  misc_feature (1)...(659): n = A,T,C or G
atcgacttccaggacaagggtgtcaaccagttctacatgcgcgttcgcgagtggtacggctggcacttccctgagctcgtcaagattgtctccgacaactacacctactgcaagctcgtcctcgccatcggcgacaagaagagcttgaacgacgacaagctccacgacattgccgccctcgttgaggaggacggtgagaaggcccaggccatcattgacgccgccaaggtctctatgggtatcgaaatctccgaggccgatcacgagagtatcaaggcattcgccgaggccgtcgtcaagcaggccgacaaccgcaagtccaccaacctctaccttgagaagaagatgggcgacatcgcccccaacctgcagaccctnatcggcactcctgtcgccgccgcctcatctttacgctggttctctgaccaacctttctaagtaccctggctcttacttttcagattctcggggctgagaaggttnttttcggctttnaagaacaanacaacacccccaagtacgggnttattttaccanaagaagttttatnggaanggccgggggtcccgcaacaangggtcggattttttnggaacctngcccaacaaagngcagttttggccaggtggttttgnanaacttttttccgnngagccctt

SEQ ID NO: 582 - DNA, 389 bp, Fusarium venenatum
  misc_feature (1)...(389): n = A,T,C or G
catgggatccttccaggccaagaagatgggactggaagagcgtgaggccgtntacgagcctatctttgccatcaacgagcgtgacgacctgacccctgaagtcaatgaagtntatctnggtgaacccaacaagctgcatcttgaaggcactgccaagggtnccttcaattctcacaacccctacattgcccccattgccgagncttacnagctcttctctgcaaggacaggaactgccttcacatggaagtcgacattagcggttttaacctcaaatacgaaactggtgatcacattgctatctggcccacaaaccctggtgaggagggcaacccgtttcttagatattctcgatctctctggnaagcagcacaccgtcattaccgcaa

SEQ ID NO: 583 - DNA, 583 bp, Fusarium venenatum
  misc_feature (1)...(583): n = A,T,C or G
cgttaaacctatatccaatgcgcttctctccattcctgtcaaacatcatctttacattctcaaacattacccgtgtgagacctccactgacctcacacttggcctatcgacctattcctcttcgatctatgtctggaattcccatcttgggcgctttatttggcacttcatctagcaacaagtccaacatgtcttatcctgaccagcgttcaagcgacnagtggcgtgctgtcctcaacaaggagcaattccgtattctccgtgagaagggtaccgagcctcccggttcaggaaagttcgataagcactaccccgacgaagcgtctacacttgcgcaggctgtgatacgcctctctacaaggctactcacaagttcaagtctggctgtggctggccagcttactttgacagcatccccggtgcagttgaacgtcacgaagatcgcgccttcggtatggcacgaactgagatgtgtgctccaactgcggcggccatctaagtcatgtttcaagggcgaaggctttgacccccactgatgaactcatgtgttaacagcgtcatcttaactctctcccaatganag

SEQ ID NO: 584 - DNA, 596 bp, Fusarium venenatum
  misc_feature (1)...(596): n = A,T,C or G
gccgctggccaagcccccgagtacctctggatcggatgcgccgactctcgcatccccgccgagcagatctgcggcctcgaacccggcgaggcatttatccaccgcaacattgccaaccttgtctgcaacaccgacctcaacgccatgggcgtcattaactatgccgtgaagcacctcggcgtcaagcacattattgtctgcggccactacggctgcggaggtgtcaaggccgccatgactcctcaagatcttggtctgctgaaccctggttgcgaaacatccgcgacgtgtaccgtcttcacganaangactcgatgccattgccgacgaaaatgagcgatacgaccgactcgtcgagctcaacgtcgttgaacaatgtcgcaacgtcatcaatttgccgacgttcagcagtcatggcatgaaaaacaatnccccntcctccnccgatgggtttcggattcaaggacggctctccagatcttaaaatgacttnaagcgngccgggtgatatcccaaaatttacaaccttgttgaaaaaaaataatgggaaacaanttnctttanaaaaaaaaaaatanaaaaccgnttcaattggt

SEQ ID NO: 585 - DNA, 447 bp, Fusarium venenatum
  misc_feature (1)...(447): n = A,T,C or G
attaacatataacagaaatggctgagcacaacatcgtcgtcctgggtggtgaccactgcggtcctgaggttgtggccgaggctatccgagtcctcaagactctcgaggagaacaagcccagtgttggcaagttcaacttcaaggaccatcttatgggtggttgctcaattgacgcccacggttcccctntgaccgacaanaccctcnctgcgccaagggagccgacgccgtcctnctnggtgccatcggcggcccaaatggggtaccggcgctgccccctgaacaaggtcttntgaagctccgtaaggagatgggcacatacggnaacctgcgaccttngtttttcccttccacttccttgnnaacccttntcccttaanggccaaattgccnggccccaatttttatttngccaaaactcctgggggaattncttttgccacccca

SEQ ID NO: 586 - DNA, 635 bp, Fusarium venenatum
  misc_feature (1)...(635): n = A,T,C or G
actcggtgagaatggagatactcggctgcaacttcagacacagctcgaaacctttatcctcgactttcggctcgacaacaatttcgtctacagagaccaacttcgagagaatgcgcttctcaagaggtacttctgcgacgttaacatcaacgacttgattagcttcaacgaggagctggcacaccgactggcttatgaacctgccgacatcatccctatattcgaaaatgccctaaagaaatgcacacatcgcattgtcttccctcacgaacccaagattgagatccccgaacatcaacttctccttcactcaaacgccgacgatgtctcgatcccgcaatctcgactccgaaaccatctcacggctggtacgtgggccaggtattgtcattggtgcctcagtcatgtcatcaaaggcaacaaaactccatatccaatgccgcaactgcgggcacactaaaaacattcctgtcttgggaggttcacgggtgtcactcctccccaaaaatgctctcgaaatcgagtccccaatgaccaacancaaaatgtccatggnccctaattcgttgccacgagaagtctcaatttgtccaccaacaaattatcaaacttcaaagaaacgccccgaccaantt

SEQ ID NO: 587 - DNA, 564 bp, Fusarium venenatum
  misc_feature (1)...(564): n = A,T,C or G
cgggcagccaagactagcttagctgccacaactctcaaggcctgcttcctcaggtcgctaggaatggctcggatcatttctgagttgtagaggtaaccctgttgtcgaacgccgatatttgtagccattcctgagtgcttcctcttggagccccaactggcgatattgcaggcaggcgtctttgagagacccgtgagtccgcctgctgcgttgagaagctgggcagcagtaagggaaccgatgagagcggtcaaattaggcgcaaagatgttcatgcgcgactggacgtattctgccaacgtttgcttggcgttatttagagatatagtcatctcacacgctctgtagacgcgctgaagctcctctgaagtcatttcatgacctttagacgtcgtggcttcgaccgtcacaatcatgancgaaggtccatcgagaacagacttganaattattcccagaagattgtcngtcgaagtctgcagtgctttgatgctctccgagtccaaaggcccattcctatgatggcgacaacttggcatatctagtggtgtcgtgacaatcgtc

SEQ ID NO: 588 - DNA, 796 bp, Fusarium venenatum
  misc_feature (1)...(796): n = A,T,C or G
gcgcacccacgggaacggtctttttgtttaagaacaaattccctccagctcccactaactaacttgcaggttgtttgagaggacggaagtcataccacagtcaagatgccttcagaagccggtcaccgactatacgtcaagggacgtcacctgagctaccagcgctctcgtcacaccacccgccctgctaccagcctgatcaagatcgagggtgttgacgacaccaacgccgccaacttctacctcggcaagaaggtcgctttcgtctaccgtggccagaaggagatccgcggtaccaagatccgtgtcatctggggcaaggtcacccgtcctcacggaaactctggcgtcgtccgcgccaagttcacctctcctcttcccaccaagtctttcggtgcttccgttcgcgtcatgttgtacccttcgtcgatataaaaaaagggcttcgggctggagttggtagtgangggcggctttcatttggctgcattggtcgagcaaggataaaacatactgccttgctttgaggcattcaattcaaaaagacgtcaaatcccanaccccgaaaaaggctctttacacctgagctactcgttttgatgacataaactttattcccctttcatgcaacggttatcggaaatcgatcccgcccagagcattccactgggaggggagcttcagtgatggaacactttctggcggttgggattgggaccggtgttcggaacaggtcgtgaatagggtacaagcgaatcatcgatgaaatgccaggtccagggcctctattacggca

SEQ ID NO: 589 - DNA, 558 bp, Fusarium venenatum
ccaagacgtcggaactggcccttgacctgctcgagaagctcctcgcattcaaccctgttaagcgcattactgtggaggaagctctgaagcacccatacctcgagccttaccacgaccctgaggacgagccaacagcgccccctatccccgaggagttcttcgactttgacaagcacaaggacaacctgagcaaggagcagttgaagcagttgatctaccaggagatcatgaggtaaacgtggagactccgtaaaaagatggcctgcgaattcggggatgtcaaatagactacatcacatacctatgggcacgcaagcaagcaagcgcatgcagaactaccggtcgagtttattctgcatatcatgtatctggcatgaatcttttgtcaatcttgctgataggagtggttgaatgtaaggaaacaggatcgaagatatgaaatggagactgagatccagaccggtgataaagatgatttcatgaattgcacattgcaaccatttcttactagttgttatatcccaaaagaaaattcataataagtgtttatttgtaaaa

SEQ ID NO: 590 - DNA, 556 bp, Fusarium venenatum
  misc_feature (1)...(556): n = A,T,C or G
agaccgatgtggtcatcaacaacaataacgatgtccagatgaacctgcagaaactcaacaagctggttgagacgttcgctccaggcttcggtcagctggctaataagaagggagacttgggcgatctggtcgattcagaactcagcaaggctgcggatgccatcgcggctgccgctgcacgactggccaagctcaggaacaagcctcgtgatggctactcaacctatgagctcaaggtaaacgattcgatcctggatgcggccacggcgatcaccaacgccattacgcaactgatccaagcggccactgtgacacagcaggagatcgtccaggctggacgtggatcgacgtccaggacagcgttctacaagaagaacaaccgatggacggagggtctcatttctgccgccaaggctgtggcgtcgtcgaccaacactctgattgagacagcagacggtgtcatttctggccgcaacaagtccaaaacagctcatcgtggcctcgaacgatgtggctgcctcgactggccancttgttggnttgcaagcagagtcaa

SEQ ID NO: 591 - DNA, 633 bp, Fusarium venenatum
  misc_feature (1)...(633): n = A,T,C or G
caccgccctcatctccaccgaggacgccctcgagccctctctccagtcactcctcgaccagcgtagcctccgctggatctttgttggcggaaaaggtggtgtcggaaagacaaccacttcttgctctctcgccattcagctcgcaaaggtccgccggtctgtacttctcatctcgaccgatcctgcccacaacctgtcagatgccttttcccagaantttggcaaggaggcccgccttgtaaatggattcgacaacctgagcgccatggagatcgaccccaacggcagtatacaggatatgctggccggtcagaacgaaggccgatgacttaatgctgctgctggcggncctctaggaggcatgatgcaggacctcgcttttgcgattccggtatcgacaggccatgtcatttgccgaagtctcaagcaggtcaagtctctttcctacgaaaccattgtctttgaactgcgcccacangccatacctgcgctttctccaattccccaccgttcttgaaaaggtctcgccaggggtacaactntcatctcaaacgggccatactgaacgtttccttggtccggggatcgatccccatggcnaactanaaatatgcnaataaatttgcgnaaatg

SEQ ID NO: 592 - DNA, 469 bp, Fusarium venenatum
caagtttatcaacagtggcgatcggggacgatcattcttatctacattgtccaaagtcattgactccaagatccaagtcttgatctgggctggtgatgccgactggatctgcaactggatgggcaattaccgcgctctcaactcaattgctcccaagtcattcgtctcagctcctcttcagtcctttactgttgatggaaccaagtacggagaatttaagacatctggaaatttgagctggctgcgagtttatggtgctggtcatgaggtcccggcttatcagcctcaagctgcattggctgcttttgttgccacactttccaagaagcctatttcatcaacatgattaatgaactgcttgttgaattccagtatattagctttatcttccataccccagacgattcatgtatcctgtatgtagtagctatacactaacaaaactacctctcacgcttcgctttctttc

SEQ ID NO: 593 - DNA, 451 bp, Fusarium venenatum
  misc_feature (1)...(451): n = A,T,C or G
cagtctcgtaccatcggaaagtacttgatggagattagcctcttggaccatcgatttatggcctacagaccgagtcacgtcgctgctggtgccatgtacttggcgcgactaatgcttgaccgcggtgaatgggatgccaccctatcttactatgcgggttacactgaagatgangtcgagcccgtcgtccacctcatggtcgactaccttgctcgccctgttgcgcatgangcatttgacaagaagtatgctgccaagaatttttgaaggctcactcctcgctcgccaatgggccaagaanatgctgttcttttcggcattaccgatgttgaactgagtcttgaccaaatatcatagatgctatcgacactcgcngcatttactgcatctcttattcgataacctgaacaacaggatatccgccgcggttggaataaaatgtacgccgctc

SEQ ID NO: 594 - DNA, 575 bp, Fusarium venenatum
  misc_feature (1)...(575): n = A,T,C or G
ttccttctgttttcctcttctctaaaacgatatcttctatacgctttcgtctgttcaacaatcctccgccagtattttacgacccaaataataaactacaaaccccagcaatcagttcaaaatgggcgagtcgagacaagaacttgttgcatggctcaacagccttttgcaactcaacatcacaaagattgagcaatgcggtactggtgctgctctttgccaagttttcgacagtatctacatggacgtccccatgtccaaggtcaagttcaacgtgaactctgaatacctgtacatccaaaatttcaaggttctgcagaacacgttcgccaagcatcagatcgacaagccgatccccgtcccttcactcataaaatgcaagatgcaggacaacctcgagttcctccaatggacaaagcgttctgggactcaacttccctgatcacgagtacgatgccgttgcccgacnaanggtggtgcaagctccgccgctgcgtctcgaccgcggtacaatggngccgccntctggaggaanantccaacgggggacccgtgtacaaaggtgcgggcctgca

SEQ ID NO: 595 - DNA, 641 bp, Fusarium venenatum
  misc_feature (1)...(641): n = A,T,C or G
gtcaccaactaaatcctttccccatccactggcttcaatgagctatggtgatgccgatgccaaggggacttgataaacaaatttcgtacgcaaacgctgcatcttgatcccgtcagcccgctctggggctttcaactcctttccaggcttcgtattccgttcagttatctctggtcagagacgttgatacccaaaccatctgactgggacgaccacctgaacattacaggcttctctttcctaccacttgccagctcttacacgcctcctacagaccttgtaaacttccttaacaatgggccaacaccaatttacattgggtttggatctatcgtcggggacgacccccaagcactcacgactatgatctatgaagctatcaagattgccggcattcgaaccattggttcgaaaggatgggggggtgttggtgcttggagaagtccccgatagcctttatctcattgggaaactgtccttcacgactggnctggtccaancatgttgaactggtgnccaccatggngggntggcacgacagttgccgnataccggtggtcgacgatggcgttgtccgtctttgagacagcctttggggncaaatatggctcgtcagtgccggacnagtncagtcatacaaa

SEQ ID NO: 596 - DNA, 610 bp, Fusarium venenatum
  misc_feature (1)...(610): n = A,T,C or G
gattgggtaccaactcaagttccaggtccgagaacgactcgcaaagggccttgtcgacaagggcatcctccgtaccgagaagcgcaatttcctcctcttcgacatggccacccatcccgtcgctgatggcggtgccaaggaggagatccgccgccgcgtccgcactgtccttacccaacgaaccgtcgtcctcaacggtagccagttcctacccgagtcgctcgagtttcgttatatgcgcaccatcgccatggtttgcgccgcttacgccgctaatgtcctcgagaatgccctcgcatcccttggtcatgaggctcgcgagagagcctttgcgcagaccgacgacctgctcgctgactacagtcaatggccattcggcaagaaaggccacacagaacggtattggggccaacttgcctcaacttatcaacgaggaggtcaacaacggtaaanacaaggagctccacttgaggtggtttcacttgcttgagggtctttactcgaatcgacttcctttntataaatggaccgacccaggtggatgcggatcccttttcncaaacacgatgcttgggatacattnctcgaacgactntntgccgtcttagtg

SEQ ID NO: 597 - DNA, 788 bp, Fusarium venenatum
tcattgcccgactaactttccagcgccgtcctcgccaaaccaccgccaaaatggtcaagatcaacccttccctcgcttcttctcgccgcaagagccgtgccgctcacttcaaggctccctctgaccagcgccgtgttatcatgagcgctcccctctccaaggagctccgcgagcagtacaacgtccgctctattcccatccgaaaggacgacgaggtcaccattgtccgtggttccaacaagggccgcgagggcaagatcacctccgtgtaccgtctcaagtacgtcgtccacgttgagcgtgtcacccgtgacaaggccaacggccagtccgttcccctgggcatccacccctccaactgtgtcatcaccaagctcaagcttgacaaggaccgcgaggacatccttgcccgctccaagactggccgtgagctcgctgccaacaacaaggtcaccgcttaagcgatgagtttgtcgagcaacaacaaaaatcaaaattcggaactttcaagacggcatgatcaaaccttccttccaggcgaggacgaatcttttcttttttcaccactcacgattacggcaccaatgtgagcaacatcaagggcaaaagttgatgaggaaatgggcataatactccggcgttttacgatacctgcgtgctttccttcggtcggcgcggtacccggtctacagcagggtagatgaattgagaatttttagggttctcaatggccatttcactcactggtgaaatgctccatgggaggtttatcccgaagtcttgacctg

SEQ ID NO: 598 - DNA, 1257 bp, Fusarium venenatum
  misc_feature (1)...(1257): n = A,T,C or G
gggatnangtttttttttcnttgttcatttctgccaacctanatgatnccacgttgataacatacaaccaaacataaaaaagacctcatcatgcctgctgttcctnaagatgcgcccgagtccgntggacaaatccccgcgcccgaaaagtcaactcctaccttcaaacccgaagatgtgaccgtcatntttgttctcggcggccctggtgccggtaagggtacccagtgctccaagctcgtntctgagcacggcttcacccacctttctgccggcgacttgctgcgcgctgagcangagaggcccggttcccagtatggcgacctcatcaaggactatatccgcaacggcctcatcgttcccatggaggtgactattgctctcctnganaacgccatgtccgctgtcctcaaggagacaggatcgcagaagggccgcttctnattgacggtttccctcgtaaganggaccaggctgtcaaagttcgangagaccgtctgccccgcaagcttgtctttttttcgactgncccgaanatgttatggagtcccgtttcttgagcgcggnaaaacagcggccggaagaaattttttttttttttttttaaaaanaaaagcattcatcataaaacgacaccctaaataacagagacaaaaggcaggtttgaagaaccattgcattactttttggtatcccccatgcacctcccaaagggatccaggcgcagaggatttgccccgaagccctgtcatgtggcccagtcgggatctcctccccatgtgtcgtcttccggactggtggcagcgcaatatggtataaaatgcccgccacccttccaggcgaaactctagaaacgagatctatcaacaactgccacaaagagatttccccgtaaaaccttcccaaagatgtcaggctgccctgcgtcgtctggtcgtaaaaagctggcgggacattttgccacaaaaccgagagtttggacgaaccgggaaatatacaagccctagatcactttttnttgcctcaatggcttaaaaaagatcggcaacgttcaaaggcatctcaatcaaccagagttgctggagttaacgcttntatttccctgagcatgcggatatcttcggntgntacgaagttgatggcgacaccctttcgggcgaaacgtncttcacgaccgatgcggggggatgtagtttctcacnggtgggnggggagatcgtanttgatgaccanggacacctgntggacatcgatacc

SEQ ID NO: 599 - DNA, 616 bp, Fusarium venenatum
  misc_feature (1)...(616): n = A,T,C or G
ccgagcaacgcaccactaacgccgcctgtggagagcgtacccagcgcccagccgnttttattacgcggtacttgtgtggcgataagagcattagcgttggggacaaatccgccaagtaacccaagaagcgcccgcaggatcaaaaactgccagatattttgtgccagccccatcaacaccatcacgatgcccatgccgagggcagagcgtaatagcatgagttttcggcaagaatttcctattttcaagcacttgcaatgctgcctttccacctgcttcagccttgcgcttaccaacaccacatgccatgaatttgcctgtttctccccacccgtcaagataaactccaatagcaaacagngggaggcctgtgtccttgtcttttttcttgcattccatatcttcgnacccgaattttgattccggcccgctatcgctgcgctcanacnacctttggcattttgctctgtcaagggtatcacctttggcttcgggctgngtanggtgttcttganccatatgctgngttttgagctattgtttncaaacaactttctgggttttctttgaacctgggcntttgattggaccaccccncancatttttgagccaagn

SEQ ID NO: 600 - DNA, 651 bp, Fusarium venenatum
  misc_feature (1)...(651): n = A,T,C or G
cgaatggctgaagtcgttcatggtcatatcactcttgacggagaggatatctctgttatacctagacatctcattcgccaacgcttgagttgcttgacccaggatcctttcgtctttggagacagcatcagagccaacctcgacccttgcaacgtatcatcagacgacgagatcagaaacgcactggagcgtgtggggattttgtccgttatccaagccaagactgacaacaacaaagacttccttgttgagaagatggacgagaacttcttgtctcacggccaacgacaattgttctgcctcgcaagagctcttctcaagaaaaagccccttgctcatcctcgatgaagccaacaagcagcgtcgatacacagacagacgccaggatgcaggaagttattcgcacagaaattctcagattgtaccatcatcatgatcgcccaccgtattgatacgctacttgactttgacaaggttgttgttctggataggggctctctggtggagtttggagcaccacaggagttgttggcggattcgggtggtgcttttacgaaattgtatcgtgcgaacaaagggaagaanaccganggctaaattgttgtgatgtagtataatatttttgtgaatgggagttcatttctctttcga

SEQ ID NO: 601 - DNA, 786 bp, Fusarium venenatum
  misc_feature (1)...(786): n = A,T,C or G
cttagtcgatggggaaaaatgacccccattcagaagccgacatcagcccagccggcgctggaatccccggcatctcctcccgcgtcttctactccgtcttctgactcttctacttctgcttctgcttccaccccagccacagcagcaatggcaaagacatttcctcctgtgcagcctggaggcagtttaattctggcatggcaaatcaagcacaagaaggtgcttgttgtcggcggtggtgaggtcgccgctggtcggatcctcaactgcctcaatgccgatgccaacgtcactgtcgtgtgccccaagtctggcctcaaccctgaagtcgctttccgagttagtgaaggtcaagtcgcgcatatcgaccgagtattcgaacccgaagacctggatggcgccagcatggtcctggtcgccatcgacgaccctgccgcctcgaccgtcatctggaagctttgcaaggagcgaaaggtccctgccaatatcgncgacgtgcccccaagaatgcganttctattttggtagcatccatcgcgaatggtcccgctccagattatnggtcaagcaccaatggcaaggggccaanggttggcggctgctattcggcaatttaattgcaagcaactgccgaagaatgcnggtacgcttcgagacgattggtgagcttcggctaaattaaggaanatggntccaacctgangatggaccaacgcatgctctggatgtaaaggtcannatcctacaatgggatgaatgttngcttacagacnaaanttgacactc

SEQ ID NO: 602 - DNA, 337 bp, Fusarium venenatum
  misc_feature (1)...(337): n = A,T,C or G
cttcaaaagtatcagcaccaagttcagtgcaaaccttgcgcttntcttcaccaccatccagagctgtcacacgcagccccatagccttggcgtactggattgcaaaaacaccaagaccaccacctgcgccagcaatgactacgctctgtccagggcgaacgttggaggacttgagagctttgtaaacggttagtccggcgcagaggataggtgctactccagcgagatcgcagtccttaggaatacgcgctacatgcgctgctttgccgacggcgtattgctgaaatgagccatcgactgtgtagccggatagtgaagcgtggngaaaaacccnaaa

SEQ ID NO: 603 - DNA, 552 bp, Fusarium venenatum
  misc_feature (1)...(552): n = A,T,C or G
cgatatgacaccacagatgtcgcgtgaggaagctcttcactggttcttgcccaagactggacccaatgagcagcaggctgtgtggacctacgttgttgaagatgagaacaacaagatcactgacttcttttctttcttctgcattgagtctactgctattggcaacactaagcacaacgttattaaggttgcttacatgttttactatggcacagaggtcggtctgcaggagaagttcgacaaggctgcctcaagaagcgcctcaacgatctggtgcacgatgcccttattgtctccaagcgctacaaagtttgacgtttttaacgctctgacgctgatggacaatgcgctcttcttggagcagcagaagtttggcgctggtgatggncaacttcactactacctgtcaactaccgnggtnaccccatcgccgnnggtgtgtcgcaagaacaacttcgacgangagaacctgagcgggttggactatgatgccttgaggnaatgtttggntggctatnaggggtgaaagaaaaaaanttggaaggngaggat

SEQ ID NO: 604 - DNA, 639 bp, Fusarium venenatum
  misc_feature (1)...(639): n = A,T,C or G
cgctcatacacatacacgcccttcaaccaactatatcgcctactctcttgccgactccacacaatggctccttcgaccttcaagctcaacaccggacaggaaattcctgctgtcggactcggtacttggcagtcccccgctggcgaggtcgagaaggctgttgcatatgctcttaaggacggctacaagctgatcgactgcgcctactgttatgggaacgaagaggaggttggcgctggcctcaaggctgcctttgaggctggtgtcaagcgcaaagacatctttgtcgttaccaaagcctgggctacctacaacacccgtgtcgagctagctctcgacaagagcttgaaggccctcggcctcgactacgtcgaccttttcctaagtacactggcctcttcttctcaaccccgagggcaacgacgacaagtttcccaagaagcctgatggttcccgagatgttattcgagactataaccacgtcgatggctggnagctcatggagaaactccccgctacgggcaaagacaaaggctgtccgtgtttgcaactacagcaagaantacctttgangagcttctgcctcaagcaaccatccgtaccaactgttaaccaaaatcgaaaancaacctgagcttc

SEQ ID NO: 605 - DNA, 417 bp, Fusarium venenatum
  misc_feature (1)...(417): n = A,T,C or G
atggtagagtcgaccctgactcaatgaacggtaactgtgtcatgtatgatgccgtcgatggcaagattctcacctatggaggcgccactagctaccagcaagctcccgctactgctaacgcccatgtcctcgctattgctgagccaggatctgttgctcagacatacctcgttggaaacaatggcgctggtaacttcgcccgtgtcttccatacttctgttgttctccccgatggcaatgtcttcattactggtggacaatcatactccaaccctttcaccgataccaacgctcagttcacacccgagatgtacattcccacaacccacgagttcaagaatcagcaacctaacaccattccccgaacctaccacagtatgtntctgctgctgcagacgctactgtgttcaacggcgg

SEQ ID NO: 606 - DNA, 519 bp, Fusarium venenatum
  misc_feature (1)...(519): n = A,T,C or G
cgcctgatgaaggcttaccgtgaagttcccgagtggtggtacatggtttgccttctctgtgctatggcattcggtgtttctggtatcgctggctgggatacgcacacttctcctggcgtcatcttttacggtcttgccctttgcttggtctttgtcattcctgtcggaatcatcaaggccatgactggtatcgaggtcactttgactgtccttgccgagttcattggaggatccttcgttgagggtaatgcgttggccatgaactacttcaagtcgttcggctatgttacttgtgctcacgctgtcatgttctccaacgatctgaagcttgctcactacgtcaagatcccaccgcgacacaccttctttgctcagatcattgccacctttatcagcacctttgtttgcgttggtgttctcaacttccaaatgacacaaatccctggtgtttgtaccgangatgctcgatggaagatgacatgccccagtgtcacactttcttcactgcctctgtcctct

SEQ ID NO: 607 - DNA, 608 bp, Fusarium venenatum
  misc_feature (1)...(608): n = A,T,C or G
gctgatcgagattaccgaaaagacacttacacaagaggagggatatacgagggaggaagttgccaaggtactgaacgttacagtagaggatcttgagaagcgctttatgtccaagctccccgtacgtgccgaacgcttcaagctccgccagcgcgccctgcacgtttttagagaggctcaccgagttattcgtttnatgaagctcctnnaaaaccctgtccacaccggcgcttcggatacaaccaagttcaacacagaactagggtccntattgaacgagacacaagcatcatgccgcgacctttatgagtgcagctcccctgaattggatgagatttgtgccatctctcttcgggaaggttcttacggagcgcgagtgactggtgcgggatggggaggttgcagtgtgcacatggtgccagcggataaagtagcagcaagtgacgccgtgctctaaanaaggagtnttttgccaaaaaggaccttacggaanatcaaaaaaagggggcttgtggtggtgaatcnaccaacgacagggaagtgccatntactacgtccaaaaatgggggtgaaaccttgangggtngatcacctgaacacacacgtgg

SEQ ID NO: 608 - DNA, 577 bp, Fusarium venenatum
  misc_feature (1)...(577): n = A,T,C or G
aacaactactgactgacccgtacccgtactcgtaccttaatactgtctgctttacttttttactttactgcactaatcactcgagaacgttgacgcctcatacctcgcgcttatcgctcgcattcgcttcccaaaccgaaaactttcatcaattctaatcacaatggccgacgctcacgctcccaaggcagagtctcccgttccccgggagaagctcgangctcagatcaagtccgccgatatgacggaggatatgcaacaagaatccatcgaagttgctcaggaagccatggccaagttcaccattgagaaggatattgcacagcacatcaagcgaaccttcgacgaacgaaaaggactacttggcactgcattgttggacgcaactttggcagctttgtcactcacgaaaacaancacttcatctacttctaccttggccactgcgcaatttactattcaaacccataggcatgggagcatgctcaccattggggccttggaagatntgctgtacgcagaagacantgggttggacgaanaaaaaaagcaaggattcggcatggcacaaaactca

SEQ ID NO: 609 - DNA, 601 bp, Fusarium venenatum
  misc_feature (1)...(601): n = A,T,C or G
gcgtcacctctcagtcaaccaggttgtgaaggataaggagtgccatgaaggatggagcgatgagttccacagctggatcgtggatgaagacaagctgcttgatgctattgaagacgatgtcaaggctggtggatgcatcattgattggcacgcatgtgatcttttcccccagagctggatagatctagtcgtggttctacgagttgattcctcgacgctctatgaccgtctcacagcaagaaactatcctgattccaagcttcaagagaaccttgactctgaaatcatggaggttcttctccaggaagcgcatgaagcattcgatcaggagattgtcatcgagttgacaagcaacaattcagatgagatggacacaaacattgatcgcatagtcgcctgctcgaccaatggaagaaggacaacagcgaataagaaggttcttctaaaaacaagtttganganaaacaaattcgcttcangagtttgcaactacgttgangcctggactacnggtaccgtatggatggacatgggttgggggaaaatanatttttgataaaaacctagggcangctacgttatgaaatggcatgaatcgttn

SEQ ID NO: 610 - DNA, 444 bp, Fusarium venenatum
  misc_feature (1)...(444): n = A,T,C or G
cgccatcacttcttttatggtgacctgtggggtaaccgctcgcccatcgccgatcccaacatgaagggtagcatgatcgggttagacagcgacaagagcaccgacaacatggctctgtggtactatgccaccatggagtttatcgctatgcagactcgccagattatcgagcagatgaacaattctggtcatgagatttcatccatcttcatgtctggttctcagtgccaaaatcctgtcctcatgaaccttttagccactgcctgcggaatgcctgtcctgatcccacgatacgtcaacgcggctgtcgttcacggcgctgccatgctcggcgcaaangcagcaagccatacaaggaagatggcagtgacccgaatctctctggacatcntggatcncatgagttancaagtcgantggtcgatcctaccacgacnaagatga

SEQ ID NO: 611 - DNA, 623 bp, Fusarium venenatum
  misc_feature (1)...(623): n = A,T,C or G
gcaaaagactctgaatgcaggccaagtttgcatgtctcataactacatcctcgtcgagagaagtgtcctttctccattccttggagaacttaacaatcaactgcgaacctttttccccaagggtgccaagaacagtaccgatctcgcgcatatcgtcagtgctagtcacttcaaccgtctcaagaagatgctggacggaactaagggcaagattgttcttggaggatctatggacgagtctaccctgttcatggagccaacggcggttcttgttgatgatgttgaggatagcatgatggttgacgaggcatttggccccatctttgcaatcatggcagtcgattctctagaccaggctatcaacatcgccaactcggttgacccaacacctctctcactcagcacctttggaagcaaggatgaaaacaagaaggttctggacaatgtcacttcaggtggcgctacatgcaacgacgccttctttcactcccagattccccagtctccgctgggaggtgtaggccantccggaatgggcaactatcacggcatctactccatcaggaccttcanccaacaagcgcaactatcgccgaggtcccttactggggctgatgccctgt

SEQ ID NO: 612 - DNA, 872 bp, Fusarium venenatum
ggaaagtttcccgtcctgcctgatccttatctggacaccaagaactacacttgtgatatgtttgactggggttacgctgctgctcttgaccagaacccttgcttcaacatctatcacatcactgatacttgccctaccacttacagccatctcggaatagtcaactcgggcgactattctcctcctggtgctgaagtctacttcaaccgcacagacgtcaagaaagctctccacgctcctgtagacactacctggtaccaatgcactcgtaacaatgtctttggtttcggcaaccccaattccactcgcagcgacacatctctcgctcccgcccaaaacggcgtcctcaagcgcgttattgagcacaccaacaacaccatcatcggtgtaggtcgcttggattacattcttcctcccaacggaacactttttgctctgcagaatgtaacctggaacggaaagcaaggataccagaagtatcctcaagacaagcagttctacgtacccttccacccggaagcacaatggtggacggctcagcgaggcgggcattgttggacagtggggatatgagccgtggcttgacctactacgaagttcagctcgccggacatgagcttcctggatacagcgccggtgcgggataccgtgttgttgaggctctgcttggaaggatcaagaacctgggagttatcgaaaactttaccacacaaaagggtgattatcagggtaatggtacatcgatgagtatgaggggtttgaacccgctggaacatccttatggacccaactactattaagagggcgtctagtttaatggaagtctatctaaataattaaaagaaacgaatcatgttttccaaagaaaaaaa

SEQ ID NO: 613 - DNA, 633 bp, Fusarium venenatum
  misc_feature (1)...(633): n = A,T,C or G
cagaattcgtcctgacggcccttggcaagtccaagtcatgtcaactctgcccctaaaagccatctctagactttggggccgattcaatgagttgaccattccttactatcttcgagttcctggttttaagctgtattcttggatctttggtgtcaatcttgacgaagtcgccgaacccgatctccatgtctatcctaacctcgcatccttcttctaccgcactctcaagcccggtgcgagaccgctcgaccaagatcctcatactctcgtttgcccctccgatggcaaggtcctccaatacggtcagatccaaggcggtgacatcgagcaagtcaagggtatgacttacagcatcgatgctctccttggaaagaacacacctcctgcaagcatttcgggcacttgtggcactactacacctgcgactagcctaacttcaccgacgtatcggacgaagaagcccttatcaagcaggatgcggaattcctcaggtcaatggcatttngtacactntttccgatcttcttttcngnactggaaaacgtggtccttcantaaaaggatgagtncatgcccncattttctggnacaagtttntgaagttggcncccaactcctttgggngaaccacct

SEQ ID NO: 614 - DNA, 685 bp, Fusarium venenatum
  misc_feature (1)...(685): n = A,T,C or G
ctaccactcaaaaccacccaaaaccactcctnttcaaatcagccaaaatggagaacgaccgcggcgagattgtggacctttacgtcccccgcaagtgcagtgccaccaaccgcatcatcaaggccaaggatcacggntctgtccagatctccatcgccaaggttgatganaacggccgtgccgtccagggcganaaccacgtctacnccctctgcggtttcgtccgagccatgggcgagagcgacnactccctcaaccgactggcccagcgcgatggccttctnaagagcgtctggagcggacagcgataaatcaataaagcgaatggaaaaaagggttttgggttcgggcacgaaggcaatgggtgaaagaaactagggttggctgcatctaacaaatccacttcgaggcgttcggctcgattttgagacaacattacgatatcccgaatccgtgtttgaagatgtgatgaactggttacactcccccccgatacggctggcgaagtctcctcggacagacttcacaagtcaacccactccgaggattctggggctactccgatagtctccatgccgcagattgactaggctctgaaaaagccgtagcgctcaagtcgtttgctatggtacagatcgggtctaacatgaattttcaattatgtgattatcttgngaaaaaaaaa

SEQ ID NO: 615 - DNA, 517 bp, Fusarium venenatum
  misc_feature (1)...(517): n = A,T,C or G
cgacaagatcgagacacataaggccaacgcttggctcctcaacaccggttgggtcggtgccggtttcgctcagggcggcaagcgatgccccctcaagtacacccgtgccatcctcgacgccatccactctggcgagctcgccaacgttgagtacgagaactacggtgtcttcaacctccaggtccccaagacctgccccaacgttccttcagagctcctcaacccttccaaggcttggaccgctggcgaggacagcttcaacaccgaggttgtcaagctcggcaagctcttccgcgagaacttcgccaagtacgagagcgaggccaccgaggatgtcgtcaaggctggccccgttgtntaaggaaaaggataagaaggggaaaaaagggaaagcgatcttttttttgngatgaatttgagcaactgtttaccatttgggtccngcgtcattacatggnggncattaaccggntgccctttttttttaattttatatttttgaangggtttttttttt

SEQ ID NO: 616 - DNA, 605 bp, Fusarium venenatum
  misc_feature (1)...(605): n = A,T,C or G
atcatctcaaccgactccaccgcccgccaatacctcaatcgcaacctcttcctttcgactcacacataaccgcaaatatgttccgatccgccgttctccgatctctccgcgtcgccgcccgaccggccgccatccgctccttcgctgctccccgcgtcgcttccgttgccgttcccaanatccagagcttccaggccgtgcggttctacagtgccggnggtgcgctcaacaaggaggaggtcgagggccgaattatgagcttgttgcagggcttcgataaggtcaacgatgtttccaacatcaagtcctccgctcacttcgccaacgacctcggcctcgactctcttgacaccgtcgaggttgtcatggctatcgaggaggagttcagcattgagatccccgacaaggacgccgactccatccactctgttaaccaggctggtgagtacatcctgaaccagcccgacgccaactaaacgggttaatctcccatatacccccaattaccgcgcatccaacaacctcttttttctggtcttttccnccctncattcttggacaattatnttaacctnttcatccaatccaataacgccgaaccccgg

SEQ ID NO: 617 - DNA, 577 bp, Fusarium venenatum
  misc_feature (1)...(577): n = A,T,C or G
ggaaacagcttaggtatgaggacctgatctgaaagcaaaatacaagacaacatcatttcccctcttcttcttaaaccctccttttctctctttcccttctatattccccatcctcatccatatatcgataaaatggctcctgcaaacactctccccgcctggtctgacctccagtcgcaccgcgacagcgttggcaagtccttcgtcctcaaggaagcctttgcttctgaccctcagcgcttcgaccgattcacccgcacctttacctctggtggcgtcagctccgagatcctcttcgacttttccaagaacttcctcaccgatgagaccctcgacctcctcgtcaagctcgctgagcaggctggcgttgagaaaaagcgcgatgccatgtttgctggcganaagattaacttcaccgaagaccgcgccgtctaccacactgcctgcgaaacgttggtggttgggacatgaaagttgaaggcgttgatgttatgaacacacagggcggngtcaacaatgtcctccaacacatgaaggagttttctgaacaggttcccagcggaaagtggaaaggatc

SEQ ID NO: 618 - DNA, 619 bp, Fusarium venenatum
  misc_feature (1)...(619): n = A,T,C or G
aagtccttgtccccatccaggagcacatcaaccgcctcgttgcaattcgagcgcaggctgacatcatgggctctgaccttctcgccattgcccgtactgacgccgaggccgccaccctcctttccaccaacattgacccccgcgatcatgccttcatcctaggctccacgaacccgacactcaagcctctcaacgatcttatgatcgctgctgaggctagtggtaaatctggtgttgagctgcaacgtattgaggacgagtggcttgcccaaggcccaatcttagcaagtttcgacgatgctggtgctggccgccattggggcggggttcttttcttntgataagacttggcctctaagaaaaaaaatattattttccaaggtaanggggggaaagaagcaacttttgagggccaggggcttgtccccccngcaagcttgaatccggncaggggaatattttcttttttggaatnggggaatggcttcccccggaaaancccaaggctacttccgcttaaagtggatgtnattgcccatgaaccggncatacatatgcacctttattggaacccncttggatgagncaantgcccaatccccnnacccaaangtcccga

SEQ ID NO: 619 - DNA, 450 bp, Fusarium venenatum
  misc_feature (1)...(450): n = A,T,C or G
gatactgtgaagcgcaagatgactgaaggcgatggaatgtcactgggtgaatttatgtatcctctccttcaaggatgggacttttggcacatgtacaacaaactcggnattcagatgcagattggaggctccgaccagtatggaaatatcaccgctggtattgatgccctcaagaccattcgcgaaaccgaggaggctccccacctgaagatgccgtcgacatgggaccatgagccagcggnttcactgttcctttattgactgatgcttctggngccaagtttggcaagagtgcaagaaatgctgtctggctcgatgagttcaaaacaacgccattcgatctgacngatctttgcccaccctcaaccacgagggggagaggcttttaagctgttaccttcttcctttggaacaatctccaaatatggnggancccgaccattnccaaga

SEQ ID NO: 620 - DNA, 553 bp, Fusarium venenatum
  misc_feature (1)...(553): n = A,T,C or G
cgccaagagggctgacccttggctccagaatctctaggtcctctaaaacctcccgctttggcatttccacagactcgtaccgcatacacgctcctttgtcaagagctcgtccacnaattcgtccatgtatgacaactttacaccttcccttcctctccgtctnagtttgcgcctatcctcgagaaacggttccagcatctcgtaaacattctttgcttgccgtgtgagtcggaagtaaaaacacgcaagtgcgcgcagatatttgaaggcttcaccgccgaatttgagatattccagtaataccgcgtcgctaggcgaaagctcgagaagcttgaaggcgaggcacaaaaacggactgggtacttgtgtggtccatatgtacctccaataaactttgacatcctcgacaacgcgatcgacaatatcggcttngttgcacccaaaacattgcattttgtaatatatcgagtcgacnatgcggnccctgacnggctttttccattataatcncaagggttgaaggccgtttggccccacccnaaatattggaccc

SEQ ID NO: 621 - DNA, 650 bp, Fusarium venenatum
  misc_feature (1)...(650): n = A,T,C or G
ccgcagcccaccgtcaaggtcgaaaaaaaaatcaccaaatctatcatactaacccgaccaggaataccgcagcccaccgtcaagatggtttccgccaagaagcacgtccctatcgtcaagaagcgcaccaagcgcttcgaacgacaccagtcggatcgtttcatgagagtagacccctcatggcgtaagcccaagggtattgacagccgagtccgccgtcgattccgtggcaccattgccatgccctctatcgggtacggatccaaccagaagacccgttacatggccccctccggcttcaaggccttctcgtcagcaacaaatcagatgttgaactcctccttatgcataacaggacccatgctgccgagatcggccacaaacgtctctttccngaaagcgagttgagatcatcgctcgtgccaagcaacttgggagtcaaagncaccaaccccaaggccaagggtaccaccgagggttaaaangaaatggatcgggtttttgggctggtttacnggtatgcattcgaagggggattgggttacttgggggtctggccataaatcatgcatgctagaaaataaaaacccccggtgaacgacanggcactggnatttaaaccgttnaacagcaaattttttggagtntaa

SEQ ID NO: 622 - DNA, 610 bp, Fusarium venenatum
  misc_feature (1)...(610): n = A,T,C or G
cttcaattgggtttcaccactctcgcatatataggggacattgacccttggtcacttcaacttcacatcatacacaatgtctacacacgaaaaggaacacaacgtcgctcaggcgtcttcanaaaccgcagactcagattcacctgctcccggctttcgtcccaaaggatggatgtacaagactattcgcctcggccgtctagagctctggtacgcctcacctaaagtccaactcttcatggtctccatcgtctgcttcctatgtcccggcatgttcaacgccctgacgggtcttggtggcggcggccaggtctctaacgaggcccaagatcacgccaacacagctctttacagcacatttgctgtcgttggtttctttgccggaacttttgccaataggctgggactgagactgactctatccattggagggctgggttattgngttnacgctgcttcgttcttgngttactcgcatactcaaaacatgccctttgtcgtctttgctggtgccctgcttggcgtttgtgctggactttgngggctgctaaggctntatcatgatgtttatcctctgacaaaacaagggacaaacatctctggtttgggn

SEQ ID NO: 623 - DNA, 660 bp, Fusarium venenatum
  misc_feature (1)...(660): n = A,T,C or G
cactctcacctccaatctccatctctctcttttttgtattattctccattggcgtgggagtctaatctgctgtgtcttgaatcattctcttcctcgtataccctccacataacaatacacatacacaacaatggctcctagagtgattgtcgtaggcggtggcctctctggtctttctgctgcgcacaccatctacctggctggcggcaacgtcgttgtcctcgacaagcagggcttcttcggtggaaactctaccaaggctacttccggtatcaacggtgctctcacaagaacgcaagtcgacactggcattcccgacagcgtcaagcagttctacgatgatactctcaagtctgcccgtgacaaggcccgtcccgacctcatcaaggtcctcacctacaagtctgctgctgccgttgaatggcttcaggatgagttcaacctcgaactcactctcgtttctcgtctcggtggtcactcccagccccgaacccaccgaggacacgatgccaagttccccggtatggccatcacctacgccctgatgcancgctcgaggacttgccagagcaacccggccgcgtcgagatcatcaagaaggctcgcgtnaccgagcttaacaaggagggtaacaaggncactgggtgtcaagtaccaacn

SEQ ID NO: 624 - DNA, 750 bp, Fusarium venenatum
  misc_feature (1)...(750): n = A,T,C or G
ctttgattcacaaggagcgacgacccatccgattcaccgagcatcgaaacgcgagtatgatgttggttggtgacgtttcgaaccgcatctgcatcctggtcgacgacattatcgacaccggtaacaccatcacacgagcggcgaaacttttgaagaaggagggcgctactaaggtttacgccctcgtcacacatggtgtcttcagcggcgactccattgctcgaatcaatgcttcctctattgacaaaatgctggttaccaactccgttccccaagaagagcatcgtcgactatgccccaagctcgaagtacttgatatctcgcccgtatttgccgaagccattcgccgcgttcaccatggagagtccatcagcgtgttgttccagcacaactaangtgtcggtatcgcacttacggtttgtctacaaaagtcccgcctcgattacttangggcgtgaagaatgtttgaaagatctgaccgcggaacangcaaataccgctttttgccattgatgtcgcaggatcttatccctccttgcaacacatttaaatgaactgggatgttcttatttggaatttattggggcacatccatactatattgcatatgtcattcgncagatatngcttactgggcattttcttttcttgacgttttncatttacactcgtctacgtatnctgataaggaatggggtatcacacaaccntgtgtgaanagggtatnggangaaagggattnttnaccgt

SEQ ID NO: 625 - DNA, 414 bp, Fusarium venenatum
tggagttgccacacccgccgacgcggcgctcatgatgcagctcggctgcgacggtgtctttgtcggaagcggaattttcaagtctggagaccctgccaagcgagccaaggctatagtgcgagccacgacacactttaaggatgccaaggttcttgcagagactagcacgggacttggcgaggccatggttggaatcaactgcgatagcatgaagccagaggagaagcttgctggacgaggatggtaaagaaaaaaaaattgtttattggcgttgcaggagagggtttattcaacatgaaaaggaaatgaatggttaaagaaaatagtgcatgttggagaggatacaacatctctggttgatgcataagacttagcgggtgtatttgcaccataatgaatactttttaagacgaa

SEQ ID NO: 626 - DNA, 548 bp, Fusarium venenatum
  misc_feature (1)...(548): n = A,T,C or G
cttcaactcgacatctgtctctgactcaagtcctatgtatagactcgcagcaagccgatcgtttctcaaacaaaagattggatatttatcaactgctcttgttgcatctcgcgccatgcatatccagtcgattcctatgtgggagggaagctccaacaactacgcctacttggtagttgacgacaagtccaatgatgctgtcatcattgatcccgccaaccctccagaagttgcaccgattctgaaggatgctattcaagcgggcaagatcaacttgacagctattgtcaatacccatcaccattgggatcatgctggaggcaacaagaagcttcttgccgaactcggcacccccaagttggatatcatcggcggcaaagactgcgaaggcgtgaccaagaccctggtcacggcgagaacttcaagctgggtgacatcactttcaaaggtgtgcacacgccgtgccacactcaaganagcatctgcttcttcgtgcaagatggaaacgacaagntgtttttactggtgaaactttgttcatccgaaga

SEQ ID NO: 627 - DNA, 627 bp, Fusarium venenatum
  misc_feature (1)...(627): n = A,T,C or G
ctttcctcatttcttttcggcgcccaaaatggctaaaaccaaggtcaaaggcatcaagaacaaagttgttaggaaacccaatgttcctttaaaggcattgcctgtgacactcctttctggattcctaggagccggtaaaacaactcttcttcaacacatcctccgaagtgaacacggccttcgcattgcagtggtggtcaacgacataggagctatcaatgttgatgcatctctcatcaagcaaacccatcgtgtcaacaaaacacaagagaaagtcattgcccttcagaatggctgcatttgctgtaccttacgaagagacctcctagaagagctggttcgactcgctcagttacaagagtttgactacatcatcatcgagagcagcgggattagtgagcctgagcaggtcgctgagacgtttgactcgcgggtggcggancaaatggatgccatggggtctatcgaaggtgcacctgggcttgacgctgacatgatcaaagttctcaatcagctaaaagaaactggtggtcttggaaaagtttgccaggctcgataccccgttactggcattgatgcattcactatgctccatgactttgacacaagtgaccttgttttcttttn

SEQ ID NO: 628 - DNA, 517 bp, Fusarium venenatum
  misc_feature (1)...(517): n = A,T,C or G
tgaaggagaagacttgactcaacagttcattgtcaatcatggaggctttcaagactcacggaggcgtcagtcccattcccactgtcatccctgaaccaactcactaccaaaccatcggccacaatggcgttcgcgctctatgggttctcttcgtcgccatgaccgtcgtctccgccatcttcgccattatgtcatggaacgtcgccgtccagcgccgcattttctacttcctgtccaccttgaccaccatcatctctgcccttgcctacttcgccatggcttccggtcaaacctcgtacttcaactgcaccagcgtgcgcgaccaccacaagcacgtccccgacaccaacacgatgtctgtcgccaagtcntctgggcgcgctacgttgactgggctctctccacaccantctgattgttgagcttgcttgttggtggtgttgatggtggcacacatcatggcgtcattgctaatgtcaccttgtcctcgctggggcttctctgcgtcgncatgcaa

SEQ ID NO: 629 - DNA, 435 bp, Fusarium venenatum
  misc_feature (1)...(435): n = A,T,C or G
aggaaaaggaccgctgcaagcagtgtaacggaaagaagaccactgtcgaccgcanggttctccacgtccacgtcgacaagggtgtccgcagcggcaccaaggtcgagttccgaggcgagggtgatcaancaccgggtgttcaggctggcgacgtcnttttcgagatcgagcanaanccccatgctcgtttcacccgtcgngaanacgatctgctttacaactgcgatatcgagcttgttacagctctggctggtggtaccatctacattgancacctcgatgaccgatggctggctgttgatatccttcctggggaggctatctctcaagacgctgtcaaaatnattcgcggcaangtatccttccccaagcaccacgactttnggcaacatgtacatcaagttcacgtcaaagttcccgaaaanaactgaccgt

SEQ ID NO: 630 - DNA, 359 bp, Fusarium venenatum
  misc_feature (1)...(359): n = A,T,C or G
gtcgggaccaggaaggtcgtccagactgnctaccctctcattgacaacgaccctcacttcaagcgagtcgttggatatgcccgaacctccgattacctngccggcaccgccgctgccgcttttgctcctgcagccctctatgctcttgagaagtttgccccgtcacacgtaggaaaaggtggtttcgctaaggctatgcgattggccggaggcatcggtgtcttgggcggntttctctacttntaccaaagatcggccctccgatctacggtgctactgagaactnccgcgaaattcanatngacatncgcnagatggttgncaangttaagaanggngagcctctgtatggagttagt

SEQ ID NO: 631 - DNA, 647 bp, Fusarium venenatum
  misc_feature (1)...(647): n = A,T,C or G
ccaaaatttcccatttctctccttgacttcaccttctctctttttttcctaaaccccccgtttctagcatcatcattggctacttcttctatctcgaatcgccaatttatcgtgcgtgagaattcggtcctgtgttgataaaaccgtgacctccttcttaatcttcgtctactctcgttacgacacctattgacacgcgtctcctggtatatccaacccgcactttcctacaagtccttccacttcgaacgttcttgatatttcaatatggcttctcctggcagcgnagtccccagcgttggncccttctgcctcgcccaccaacgttccttctcagccacccccngctgctgacaacaggaacattgtccgaagaaagctcacgggctatgtcgggttcgccaacctgcccaaccaatggcaccgaaagagtgtgcgcaaaggntttaactttaatgtctggtcgttggtgaatctggccttggcaaatctacactgggtcaacaccctgttcaacaactctctctaacccccccaaggaaacgcaaggggccccagcctcgacattattcccaagacgttaccatccantccatcagcgccgatatcgaagaagctggtgttcgtcttcgcctcactgtcgtcga

SEQ ID NO: 632 - DNA, 1044 bp, Fusarium venenatum
  misc_feature (1)...(1044): n = A,T,C or G
ncgtctggaacatnattggnggtttcggnatcggntgccctcctcttatgaagntnggcaagaaggcactcanggaccgcatcatgcccggtattctcagnggcagagaagcnaatctgcttggctatcactgagcctgatgctggcagtgatgttgncaacttgacatgcnaggccaagttgagtgaggatggaaagcactatattganaacggngagaagaagtggatcaccaacggtatctggtaccgactactttaccgttgctgnacgaactggagaggctggaatgaacggcgngtctctgcttctnattgagcgtancgagggtgnctagncccgacgtatgccctgccaaggtgtcctttcttcaggcacaacatatatcacctttgaggacgtcaaggtccctgtcgagaacctccttggaaaggaaaaccaaggcttcaaggttatcatgaccaacttcaaccatgagcgtatgggtattatcatccagtcactccgattctctcgtgtttgctacgaggagtccgtcaagtacggcagcaagcggcgcacctttggcaaaaaactcatcgaccaccctgtcatccgtatgaagcttgcgcatatggcccgccaaatagaggcttcgtataactggcttgagaatctcatctaccagtgcgagcgcatgggggagaccgaggctatgctgcgacttggaggtcccatcgctggtctcaaggcacagtctacactcacttttgagttctgcgcccgagaggccagtcagatctttggaggcctgagctactctcgtggtggacagggcgccaaggtagagcgactctaccgtgatgtgagagcgtacgctatcccaagtggcagtgaagagaatatgcttgatctcaacatgcgacagagctttgagaatggcgaaggcggtaagcatgaaactctaaaagaagttgggattaaatgtcctgtatgaatactgnacctcattgnggagttttnaagtatttattggaatattaaccatggcttggaatatgaagg

SEQ ID NO: 633 - DNA, 573 bp, Fusarium venenatum
  misc_feature (1)...(573): n = A,T,C or G
cgaactctacaaagaatccccaactctacccaggaacccgaactcttcctccgcatcatgaaccgaacgaacagcgaantccctgttgccgcttcagcatgaaattttgggtgctgccatgggaacaccaccgaagggtctcctccgcccctgggccaaaggaaccttgggtctcaacgttgtttgggcgttcagcttccacgttggctctgggtgcctccgaccctctcccttctacaaaggccgttcgcgacgcccacgccgttttccaacaggcacgcgactttggggtncgccatgcacacccttgacnttggtggtggcttctgtggcgaaacctttgaagccatggccaacgtcctccgtggcgctctcgatgaattcttcccgcctcacagcggcgtcganatcatcgccgaanctggtcgctactatgttgctacgggcttcaccatcgcctgcaacatcatcgctcgccgcaccgttgaagacctactctcnatggaaaaggttacatgctctacgtcaacaacngtgtctatggaaacttctccaacatcatgtttgaacaac

SEQ ID NO: 634 - DNA, 361 bp, Fusarium venenatum
  misc_feature (1)...(361): n = A,T,C or G
attgccatcactaaggctcatatgaagctgccagaacttgctgagagtgtcaaggctgggcgactggtgcccgatggcaaagtgtgcctgaacgatcagggtgaattggctgtcaccaagtttgcggtcgagccggtctggtatctgcctggcgtggcagaacgatttggtatcgatgaggccactcttcgacgttcgctgttcgaacacactggtggaagttacccagagctcattactcgnggagacatcaaagtcttnctccacccattgggggtctcaccgngtctgtttcggaaccctgnaaaatgtcggacnatcggtcaattgttntgaaaatcacaacagggcacggggccac

SEQ ID NO: 635 - DNA, 316 bp, Fusarium venenatum
  misc_feature (1)...(316): n = A,T,C or G
agattacaacctcactcanctggatcgtccgccaaactgtagaggncganactaacatngtatcggnggagcgtgtccttgaatatgcnnccctacccagcgaggcncccgaaattattaccaagaaccgaccccctgtctnttggcctgtcaagggcgaggttgattttgtnaactatagcacacgttatcgngagggcctggacttagtgctcaanaatattagcctcaacatcaagtcncacganaagatcggcgttgttggtcgcactggggcgggcaagtcatctctcacactcnccttgttccgtctcat

SEQ ID NO: 636 - DNA, 468 bp, Fusarium venenatum
  misc_feature (1)...(468): n = A,T,C or G
gcaattnaaccatataccntggagcgcgcatttgcaaattactgccaaaaaatcactcaatcaagacgagaaagctctttttataaacataatatttnaacatgtcgtgggcggggttnaagaagaatgtnaaccgcgcgacgacgcaggttatgatgaagacggggcacgtggaaaagacaaacgatcgcgattatgaagtcgaagaaaggcgattcaagaccatggaagcagctgctttgcgactacaaaaggaatcaaagggttatctngattctctncgagctatgactgcttngcaaaagcgaattgncgaaacgatagatgcattntatggcgacgcangtgccgaaagancggngttagcaggagttacaaaacangcagtntgaagatntaacgccgaaacatcaaagccttagacgggcnataccggaacactntcttgaccccatcacacgaatttgg

SEQ ID NO: 637 - DNA, 650 bp, Fusarium venenatum
  misc_feature (1)...(650): n = A,T,C or G
agcaggactggaacgaaccaaacacaatgaacggcacacaatcggttgtttgttcagattgcattggctccgccattattttcattcatcatcagacccttgccttcgtgcgctgatatttgccgcataccaagatacattctgggccatcactaacctcttttctcctattctagatctcaccaactctcggccatggcccactccccctcatcctcgtccgtcgaagacgccgccgaaaacactgcagacgaggaagattctgaagactactgcaaaggtggttaccacccagtacaggttggagagaagtttaaagacggaaaatacacagtcgttcgcaagctangatggggccatttctcaaccgtctggctttcccgagacaacaccaacggcaaacatgttgctctcaaggtcgtccgctccgccgcccactatnccgagaccgccatcgacganatcaagcttctcaataagantgttcangccaagcccgaccacccangtcgcaagcatgttgtgantcttttggactcgtttgagcacaanggaactcatggcnccacctntgtttggttttcgangtcctanganaaaacttgctccggctcatcaaggtttggaaccatcgtggtatcccatgccct

SEQ ID NO: 638 - DNA, 589 bp, Fusarium venenatum
  misc_feature (1)...(589): n = A,T,C or G
ctaaagacgcacatcaagcgcagcgaagcctttgaggtcgatttcgccgaatttctggatgatgctctggtagaggcctttgatcttcgagaaagtatggatcgtaacgaagagcaatcagatcccagctctaaggagtggtggatcttgaagccaggcatgagtgatcgaggccagggtatcaaactcttcagttcgatggacgagctccagaacatcttcgatatctgggaggaggaccagcccgatactgacgatgaagaggaggtcgctgacaatgacaacaatggtgacggcattacaacctcacatctccgacatttcgtcgcgcagccatatatccacccacctctacttgttgatggcgaaaagcgtaagttccatatccgcacatacgtaatgtgcaccggaagccttgatgtctgggtctacaagcatatgcttgcgctcttcgctggcaagccatacactgcacccgcagatgcacagaagacattgagtctttcctgaccaacacatgtcttcnagactcgccaaacnanaacactgttcgtcnnttcctggggacctgcctctatcaagcgacatg

SEQ ID NO: 639 - DNA, 582 bp, Fusarium venenatum
  misc_feature (1)...(582): n = A,T,C or G
gttgctttatcttcgacgagaaggtcgaggcccctgcactcaaggaggagctccagaagccttaccgcgagatccaggccaaggcccgaattattgccaaggtcagccaggagtgcaagcttgacgtcaacgaggaggaatatgcgcagaagcttaagtggcagcttatggagacggtttacacatgggcccaaggtcgtccatttgtcgagatttgcaaaatgacaaatgtctacgaaggctcacttatccgtcttttccgtcgtctggaagagcttctgcgacagatggcccaggctgccaaggtcatgggcaacgaggatctgaccaagaagttcgaggagagtctgtccaagatccgcagagacattgttgccgcccagagtctgtactataaagtcccctttgctcgtagaataaaatgctacaaggggcagccacgaaaagggggatgatatgtagattctganttatcattactggtaaggagttggcgctcnggaaaagatgttcaattanctgtgatccggtancaattccttctggccatgttgggaacaaaccggtcaaanccaggaatcc

SEQ ID NO: 640 - DNA, 639 bp, Fusarium venenatum
  misc_feature (1)...(639): n = A,T,C or G
gaacctgggttttttcaataagatcagtttccgtcnacccaaantggaggaagacagacgacagaccgatctcggcacagcagccgatatcgaagaggcccagctcgctcaggctagcccatcccccgccattgaaaatgagacagagtcagcaacaccacagaacggggccacgccgntgaagcngcccaanaagagatttgtaggaaaaagaatcgctaatgaggttgctgcaaanaatggatcgtcgggggctgctggtgcaagcggcactgtcgcaactgccaaaccccgaagagcgcccagactattgaatcaagttcctaaggaaattctcgagaatcctgatctgaaggctgctattgctttgctaccggccaactacaactttgagattccaaagacgattcatcgtatccagacctcagactccaagagagttgcgctccagatgcccgaaggcctccttntttttgctactaccatctccgacattctgacccaattctgcccgggtatcgagactctnatnatgggagatgtgacctacggngcatgctgtatcgatgattacactgngagggcccttgattgcgacttgntgggngcactatgctcacaagnttgtcttatnccttg

SEQ ID NO: 641 - DNA, 634 bp, Fusarium venenatum
  misc_feature (1)...(634): n = A,T,C or G
gatgatgatatcantgctncccccggatcgataattgccgaaggagctgccaagaagaagaaaaagagaangccaaagaagaagaagaagactgctncccagcaatcttcacctcccagggttcccctgagtgagctctttgcaaacaaggattatcccgtnggtgaactccagagctattctgatgactttaacacggctcgtactactgctgaggaagttcgctacaagagtcgtcgacagctngaggaccctgnttttctgaacgattatcgcaaagcggctgaagtccatcgtcagattcgacagtggactcaggagaacgtcaagcctggtcacactctcaatgagatcgccaatggtgttgaggatggtgtacgtgcgcttctgggaaaccagggaattgaacctggtgacaacatcaagtctggantgggctttccgacgggtctttgtctgaaccatgaaactgcgcactacacgcctaatcctgccaaaaggacgttgttctcaagtatgangatgtcatgaaggttgatttcggcgtgcaaatcaatggatggattgganacngggcgtttacccatgtnttttgatcccaccgtatgataatctnctancggtggcaaagatn

SEQ ID NO: 642 - DNA, 609 bp, Fusarium venenatum
  misc_feature (1)...(609): n = A,T,C or G
acgatttcatcatcaaatccaacgagttaaggagtcgtgcgcgtcgnccccatcgtatcctggctctcctatctcttcggcaaacccgcagttgcctgtacctattatgctagttggcaacaagagcgatctgagtcaccgagagagaggtttctacacaagaaggtcacgccctcgcccgcgaactcggctgcgagtttgtggaagctttcagcgaagaactgcatcaacgtcnaaaaggcgttctacgacgtcgttaggattctacgccggcagcgacaacaagcctctcgtncttcggaaagatcaagtggacggacacnaacaggcaatggcgatgcacggggcggcgatcgagacgaaagacacagaaataggaacaaggccgaaacaagtccaaatgcgtggtattatgagtggatcataccatcatggattaaagggatccatatgttaaagaggaggaaaaataaggnggacgaacaaattgagacccaacaacgacaacaggccagggtaangaccacatataangggatccttttggcgaacangatntccccatgattttaaaaatgattggcaanatccgggggaagacaaaaaaaa

SEQ ID NO: 643 - DNA, 488 bp, Fusarium venenatum
atgcacttcaagaagactgccttcatcgtcgagcacgatttcatcatggccacctatctcgctgaccgagtcattgtctttgacggacagcctggtattgatgctcacgccaacaagcccgagtctcttctcactggctgcaacaccttcttgaagaaccttaacgtcactttccgccgtgaccctaccaactaccgcccccgcatcaacaagaacggatctcagctcgaccaagagcagaagctgggcggcaactacttcttcttggaggagaaccctgaccagagctaaaggcgtttataacgagactctgcctccccttgatggtgcatctcccggcgtttgtggcgttcaaaatgggaatcggcgaaagcagcgggacttaggaatatatgatgagcgcagcgccggcgaggatgacgatccagacgaataacgatggtgacggcagcgtatcccctgttgtctggtcctacgaaagccgttgg

SEQ ID NO: 644 - DNA, 596 bp, Fusarium venenatum
  misc_feature (1)...(596): n = A,T,C or G
gtctttgccgtcactccctctcgacaatcacctcacaatcttccaaaaatgctgtcaagaagtatagctaccgccagcccgtatggtgcccgctcgggtgctgaggccccgtgcgcaccctcttgtcatgcttccttccatgatgcagaccgttcgtacctacgccgattccgtcatcaaggtcccccagatggccgagtccatttctgagggtacccttaaacagttctccaagagcgttggcgactatgttgcccaggatgaggagattgctacaattgagaccgacaagattgacgttgccgtcaacgctaccgaggccggcactattaaagagttccttgtcgcggaagaagacaccgttactgtcggccaggatctcgttcgcatcgagcttggtggtgagccatctggcgacaagaaggatgccctaaggaaaaactacaaattccgaattccaagcaaacctacccctaagcaagatcnccccganctaaaaagaagcgtcccgctcccacaanccgaagntcccgacgccgaaaaaacatcaatcgatctcnctcacngcctcttggtacgcaaaactcctcaaataa

SEQ ID NO: 645 - DNA, 637 bp, Fusarium venenatum
  misc_feature (1)...(637): n = A,T,C or G
ggcggattcatcctcttgtgcgacatcatcaatctcttcactgtctcattacccaacatgattctccggagtaaaacacttgctgctggctcancgctggtcgctgtagctagtgcttcgcaacctggagctccggcgcctgtaccaggtcccatgagagaacttacttggggtcagattaactttatccacacaacggatacacatggctggattggcggccacttacaagagcctcaatattctgccgattggggtgactacatctccttcaccaagcacatgcgcgacgaagccgacaagaagggagccgacctactagtcatcgataccggcgatcgcatcgaaggaaacggactatacgacgcctcaacccccaagggcctctttcaatatgatatctacgccgaagccgacgtcgacatcatgtctactggcaaccatgaactttacaaagtctactcggccgatatggaacacaacactaccgttcccaactacaagaacagctaccttgcatcaaacctcgactacatcagtttcgaaaccggtgatcgcgttccacaagccccacgctacaagaagttcaagacaaaagaaccaagggtctcaacgttgtggctttcggctttcnttt

SEQ ID NO: 646 - DNA, 602 bp, Fusarium venenatum
  misc_feature (1)...(602): n = A,T,C or G
aaaacatactcgctttcctcttctctacgcattagcgatttaaccgacccgaacaggtccccagatttcaaaatggccggaaactttgaggatgtcgccaagcaatttgttgagttctactacaacaccttcgacactgatcgcaagggcctcgcttctctctaccgacctcactccatgctgacctttgagtctgcttccgtcctcggtgccgaagctgttgttgagaagcttgccggcctccccttccagaaagtcaagcaccaggtttctaccatcgatgcccagccctccaacgagcagggnggcatcatcatcctcatcactggtgctcttctcatcgacgaggagcagaaccccatgaacttctcccagaccttccagcttcaccgcgaccaatctggacaatacttcgtctacaaccgatcttttcaagcttgttctcggttaaagagcgtattgagttggactgaaacatgaaaatgaaagtctacaccaaggggggcgaaagaggaggggaaattaaaccaggaatggcaatgggaatagtgttttttttgacnatncgatgaaatttaaaaaattgtcccngttgaaaaaaa

SEQ ID NO: 647 - DNA, 546 bp, Fusarium venenatum
  misc_feature (1)...(546): n = A,T,C or G
tgcccttgtcactcaaacccaggataccatcaaacaccatctttcactccatcaaagcatgctcaccagcgcaagtatgccactccaactacacacccgggtcagaaggagtacgcctttgagatggctgcttcgtccatcaggtttggtcctggtgttactcaggaagttggtatggacttgaagaacatgggagctcagcgtgtttgcgtcgtgaccgatgagactgtcaacaagttggatgccatgagacaagtccgtgaagctctcactcggganggcattcctttcgaagtgtactccaaggttcgtgttgaaccaaaggatagctccatcaaagaagcaattgcttgggcccgtccatatgcaccagatgccttcctggccgttggaagtggttcagttatggacacagccaaacttatgaacctttacacagcgtacctgacgctgacttcctggactttgtcaacgctcctctangcaagggccgtcccattgataagaagctaacaccactcatcgccgtccctacaacagccggca

SEQ ID NO: 648 - DNA, 591 bp, Fusarium venenatum
  misc_feature (1)...(591): n = A,T,C or G
ttcttggtnnntgatcaaaatgttcgttctgttattcatgctatacaaaatcataaaaactcataaactagggctatacacaaaactgtaaccaagattcatctggctacctcgacaacaccaccagaaaaccgaaatcaacacccgcctgaactcctcttagtagggtatcaatcacccttttcgtaacggatggccctttacttttggggcgtgctttcccgcactgcccaagcgacagccgcgcgcttatcgggctggtgtcaacgacatagcgaccgacaacttggccagccttcatgagcttgaagacgtcgttgagctcagagagaccaacagtcttgaagggaaccttgatgaggccacggcggtagaagtcgatggcctcagcagtatcggcacggttaccgacgtaggatcccttgatctggatcatgcgaacgacagtgtcgaacacgggagcagagaattgagcaccagcggggagaccgatgcagacgactgtgcccttagatcggatgtactgggtagcctgttggaagggcttntcggcagcagccgacaaaaanaagcagcgnggagggccgaaac

SEQ ID NO: 649 - DNA, 338 bp, Fusarium venenatum
  misc_feature (1)...(338): n = A,T,C or G
cggcaacttgccaaagtggagtgatcccaagttcaagatccccgatattgctattcagtactggaagatgccaaaggagcaccgcacgatgaaggacttgatcctgtacatccgggccgatgaggcaacacatcgaggagtcaaccatacactgggcaacctcaaccagaacgacgacccaaacccattcgtcagtgaattcaaggatcgcgaaccaccaagacctgntttgaaggcagccggttacgatcgagctgaagtcatctaaagacggtcaatgccgaaataagagcgacatgcctcaaggtctgttgcaggttatattggaaaaaaaaaat

SEQ ID NO: 650 - DNA, 599 bp, Fusarium venenatum
  misc_feature (1)...(599): n = A,T,C or G
gtcgccgatatcgattgagtccattgtcagttttgcgcgccgtcccacgccccattttaacaaacgagttcataagccgacgaagctcaattcagttcacaatgcctactcccgagtccgagcaattcaaggcccagaagcctaccgtcgctcccacctttaacggcgtcgactacgatgataccaaggccttcaaggccgccgaggatgccctcattcgggaacaatgggtcggcgccatgatgacccgacttgttggtgaggagctgaacaagtgctacgttcgtgagggtgtcaaccacctcgagaactgcggccacctccgagagcgatatcttcaattgctcaagacaaacaagatcaagggcaccaagttcttgcaacaaaactatgtcgaccagaaggaacaagatcttgacctggcgggcaaggtccacacaagcgacaagatcgccaagatgaaccatgaccgattctttttgtaaaagggaaatgaatttaagtcatgcttgggatggaagtgaacgggatttggttatcttaaacgggaaggacttttancttgatatcccacatgattgtgaccactcgcttgctat

SEQ ID NO: 651 - DNA, 596 bp, Fusarium venenatum
  misc_feature (1)...(596): n = A,T,C or G
tgcagacttaaccgtgctatctcaacctctcatatcattacacttgcccttggcatccatgttctcacgcatctctcagatcactcgccatctctcagttcccatctcgaacaacaccagacgatttgctcttggacgaatcatggctcccgtatcggcggatgagcgcaactcgcgcactatttccacagcagcctgcttgatcattggagatgaggtcctaggcggaaagacggttgataccaactctgcctaccttgccaaatggtgctttaacctcggaattagtcttaaacgaatcgaggtcattgcggatgatgaaagtgagattattgaggcagttcgaanaatgagtgacggctatgatttcgttgtgacaagtggtgggattggacctacacacgacgacatcacctatcaatctattgccacagccttcaacctacctctcaagcttcaccaggagacctttgagaagatgaagcttctttcaaagcctcaccccaaccaacccaagttcgattgggaagttgaatcccccgccagaanaaccaagcttcgcatggcagaactgccaccggacgaatcccgggatc

SEQ ID NO: 652 - DNA, 617 bp, Fusarium venenatum
  misc_feature (1)...(617): n = A,T,C or G
gagaatctnaaaaatcccccaaacctgtcgcgactgagagcgaagttatcacagaggacttccttaccaaattcttggccaaaaacacagctgatccaaatgtcttcacacagtaccatgttcttatgggatgtacatcgaacatggttgcaggctctgataccacagctatcagcctgtccgcggtcctctactacctactcaagaacccagcctgtttggaaaagcttcgaaacgagatcgatcaaatggcatctcgaggggaactatcaaagttgcccacgttcaaagaaagccagcagctggtgtatttacaggctgccatcaaggaagcgctgcgtatgcatccagctacaggcttgccgctcgagcgagtcgttccagaaggtggtgcgacaatggctgggcgattcttccctgacgatactattgtcggcatcaactggtgggtagcccatagaaacacccacgtctttggagaagatgccgacatcttcaaccctgagagatggcttacgcaggattncgtgaggnttttctgcaatgnatcggtattacatgccgttcggactangctcacgaagttgtattcggnccgacatgtggtcgcttnttca

SEQ ID NO: 653 - DNA, 611 bp, Fusarium venenatum
  misc_feature (1)...(611): n = A,T,C or G
caaaaaacaacaacatctacaagattaatcatggagaacgacagagactacttgctttccctccgggccgtccgagagcatgccaacaaagtcttgcaggctgcgaagcagggagatctgaagcatttcgactacgatgagagccgcatgactgaggttgcagattacgtatccaaggtcattgatcgtgactttggtcccgacaagtaccacacaattccgccgcatggtcgctggcagcatttcgatgttgggggtgttgctcgtgtccactccctgatcaagcagtggtctagcgaagccgaagtcgacaagactgagatcacaagacgattggnggatctgttctttgtgtcggttcttctaaatgccggtgcaggcgatgtctggcgctcaaggagtccggntctggtcaaaaantcctccccagngaggggatcgctggcccctcnctttatatgtttcaagctgggcctttcagttctgatgaatcaaaaaaaaaacaaggttgaccggaaagggtttgntcaatttcaaaaattaagtttnacacacactttcaagtnttgggtgaaaaccttatngggnggggttcattcnggggtcaactt

SEQ ID NO: 654 - DNA, 464 bp, Fusarium venenatum
  misc_feature (1)...(464): n = A,T,C or G
tctgagcgcattgccagtcttgcccgtgtcctgcaaggaaaggctgccaacttccagagcactcactctactcagnggatggagcgatctctggatgattccgcttgccgacgcatggatatccccgagatgttcctcctcgccgacgccatcaccatcacccttcaaaacgtcaccgagggtctcgttgtcttccccctcaagatccattccaacatcatggntgagctaccattcatgatcacagagaacgtcatcatgcgcctagtagccatgggcgtgtcccgccaagaggcccacgagcaaatccgtgtcctctncttngaggcctctcaccaggtccaaagtctcggcaagcccaacgacatggtcgagcgaatcaagaacaccgagttcttcaagcccatctgggctgacctcgacgacatgatgaagcccgagctttacatcggtcgcagcgctca

SEQ ID NO: 655 - DNA, 937 bp, Fusarium venenatum
  misc_feature (1)...(937): n = A,T,C or G
cttctccctacaacgtcaccaacacaaatacccgcaaactcccaaagactttgcatctcgcaaaccgtcgcaagacatattcatccctcatacccaaatcagtactctagatacctatacagcgaggcgctattctagccagcggtcgctgaacacatcctcaacccttttacaaaacccatttcccaaggtaaccccagtacctccgagtttatgtccatcgaaaatctcaagacctacgaccccttcgccgaagccgacgaggacaccggagaaaccaagcagacgcagaattacatccatatacgcattcagcagcgtaatggacgtaagactttgaccactgttcagggtctccccaagaagtttgaccagaagaagattcttaaggtcatcaagaagaaatttgcctgcaatggcaccatcgttaacgactccgagatgggagaggtgatccagctccagggtgatcagcgtaaagatgttcaggattttcttgtcgataagaaggaaggcctcgagctagatgccaagaccattaaggtccacggtttctaaagctctgcatgccccgtcgtcctgtcagtcgccgttcccgggcgtcttgacgtagagggacagggatgcatggccacctcggcttgtgccttttccggacgtgttctcttgctctcgcaacagacacaccgaggctcggctccgattactctaggacgacgggcattcacttagggtgagcttttgctcctggtggctttttggaagagtatttattctatgctgcacggttctgcggcgggtaggaaccgtattcgacaactaccttgctcgcgtgcaccaaggacgaggcttcgggccaaagcatttggttatcaaacatatggcttgttgtcgtcgtagcagaatgttacttggcaaccncgcanagtttagcaaa

SEQ ID NO: 656 - DNA, 454 bp, Fusarium venenatum
  misc_feature (1)...(454): n = A,T,C or G
gcagtacatctgggagtccagcgctggtggtactttctctatcaccgaggacaccgacagcgagcagctcggccgcggtacctccatcatcctccacctcaagggaggagcagaccgactacctgaacgagagcaagatcaaggaggtcatcaagaagcactccgagttcatctcttaccccatctacctccacgtcgagaaggagaccgagaaggaggtccccgatgaggangccgangangtcaccganganggtgatgacaagaagcccaagatcgaagaggtcgatgatgatgaggaggagaagcccaagcgaggactgtcgaaggccaaggctactactaccaaggccaaggcgaagaagtagagcatggctatcattgcatgaaacgggtatgtaaataatatttcnggcgncgggtcggttttgtcgggttagctactatggaccaa

SEQ ID NO: 657 - DNA, 593 bp, Fusarium venenatum
  misc_feature (1)...(593): n = A,T,C or G
ttattgagtgaggttcttggaaagcaagttggccctgtggcctatggcctcatgggcttcacatggcgcccaaatgctacccctctggaccaggctattgaaagccatgcgcgctgcctctaacaatggctgcacgctctggagcggcgccgagttctacggacccccagaantacaatagcatgaccctgctcaaggcgtntttcacaaagtatcccgaagacgccaacaagatccccatagttatgaaaggtacctataatctcgaaaagttccagctcgatggatctccaganaacgttcgaaggtcgatcgacaacgtgatcaaccagctcgggggaaccaaaaaacttgacatctttgcgccttcaagacnanaccacaaagtccctttcgagacgacctcagcgtcattcagaangagtacgtcgatactggcaaaattgggggcattgctctttcaaaatgcagcgccganactatcgaagaagntgtcaagattgccnagatcagccncnttgaagttganctcaacttgntttagcacananatcttgcgccacggcgttnctgccgcttgtngcttaacacaa

SEQ ID NO: 658 - DNA, 613 bp, Fusarium venenatum
  misc_feature (1)...(613): n = A,T,C or G
gcctcagtcggctcctactgacaacgacattctgcctgttgagttcttgaccctctatatctcttatgcgcggtctaanatccagcctgtcatctcgcaggaggctgcccaagagcttgtcgaatgctatgtcgccatgcgtgctctcggacaagatgttcgctctgctgacaaacgtatcactgctacaacccgtcaactcgagagcatgatccgtctgtcanaagctcatgccaagatgcgtctttccnaaacaagttactcgtgacgatgtccgngaggccaaccgtnttattcagagcgcctngaanactgctgctacagacgccaatggtcgcattgacatgagtcttctcaccgagggaactagtgctgctgatcgcaagcgtcgtgaggacctccgtactgctattctgcgtctttggacnacatgacccgccggangtaacacaagttcgatggggcgacctctctccccgctgagtganggggccagcntcccggtgnacaatctgagttcaaccaaatgatganggctctggaggctgaaaatctnttattatcatnggccnaaggcccaanaaggcccctccgnagggggaatttccggtgc

SEQ ID NO: 659 - DNA, 611 bp, Fusarium venenatum
  misc_feature (1)...(611): n = A,T,C or G
cttggccatatctttcttgacgttttcaaaaacacgcccttgagtcatccaacgcttctctttttatattgtatttaacagtcatagtttctttctactaagacgaatctcaagcctccattctccaatcttctttacatatattcaagagcaagatgcccaccgtgcacctattagattatgttgccggcaacatcaggagtctggtgaatgccattgaaaagtgtggctacgaggtcgaatgggttcgatctccagaggacgttcccaatgcagagaaactcatnctccccggtgtcggccacttcggccattgtctttcccagctttctcaagccggctacctagagcctatcaagaagcacattgccgatgggaagccctttttcggtgtttgcgttggcctacaggctctcttccagggttctgtcgaggatcctgacatccccggtctcggagtcgtaccagctgcttttggatagattcgacgactcaaggaaatcggtgcctcacattggtttggaacaatgccttcactgctggtaaggcccatgtncgacctttnaacccgactcaaagtattactaatgtcactcctacaaggtgcccgc

SEQ ID NO: 660 - DNA, 446 bp, Fusarium venenatum
  misc_feature (1)...(446): n = A,T,C or G
tggagaacgaccgnggcgagattgtggncctttacgnnccccgcaagtgcagtgccaccaaccgnatnatcaaggccaaggatcacggntntgttcagatcttcatcgccaaggttgatgagaacggccgtgccgtccagggcgagaaccacgtctacgccctntgnggtttcgtccgagccatgggctanagcgacgactccctcaaccgactggcccancgcgatggccttctcaagagcgtntggagcggacagcgataaatcaataaagcgtgggaaaaaggtactcgacatctggttctgagaatcctcgacaaggaattctgatacgaatggaccacagggttttgggttcgggcacgaaggcaatgggtgaaagaaactagggttggctgcatctagcaaatccacttcgaggcgttcggctcgattttgagacnccan

SEQ ID NO: 661 - DNA, 336 bp, Fusarium venenatum
  misc_feature (1)...(336): n = A,T,C or G
gacggtgcactggtagctgccgcaactctatctaaccgctacatcaccgatcgattcttaccagacaaagccattgacctcatggacgaggcagccagtcatctcaagctgcagcacgagtccaagcctgaagacatcatgcgccttgaccacaagatcatgacgattcagattgagctcgagagtttgaggaaggagtctgatgtggcaagtaaggagcgccgagagaagctggaaaacgatctcaagaaattgaacgaggaaatttctgggctcaacgcgcgctgggagaaggaacgtgctgagattgaatcggttaaagaaggggttnccccc

SEQ ID NO: 662 - DNA, 553 bp, Fusarium venenatum
  misc_feature (1)...(553): n = A,T,C or G
tatcaacgtgccctccaatgatcccgccctcgacagnggtgctcaggatgcttctgcttctcctcttgtcgttgnggctacccgcgctggtgtcaaggtcctccctgacatcatcaacgccgttctcctctccgccatcctcacagctgccaactccaacgtctactccagcagtcgtatcatggttgctctcgctgaggatggtcttgcccctgntttcatgaagcgaaccaacaagtacggcnccccctacttcgccgttgcctcatgctccgtcatgggtctnattgcctacatcaacctctcctccagnggaaaaaaggtcttcaactggcttctcaatgtcagttccaccttatgcttcatcacctgggtcctgatcaatgngngccatatcccgcttccaaaanatcatggctgcacagggtatccctcgagangaagcttccctaccttgcacctttncagccttacctgncgnactacggggntttcttnggggctctcatcactattacttggggnttcacccgtntttatcgagngggatacc

SEQ ID NO: 663 - DNA, 575 bp, Fusarium venenatum
cttccgtttcggatcactttcttgtcttcggacgatcattcctttgattcaaagcttctcattccttttgggaagtcgaatctacacaatccctgaacaacatccacgaagctagttctcgatcatcaccaatctactccatcactcggagtaactttgactaccacgtcttgattcagtctttcatcagacgctgcacaaatttatcactcttgtcttgacgacaatcgagaaaccttgacaatccaattctcaatccaaaccaaaaaccgcaaaaatgaagttcgctaccgctttcattggcctcgttgcctctgctacctatgctgctgctgccaccgtcacctttgttactctcgatgacaaggagcgcaccatcatcttcacccctgacctggcttcgagggaccgagtccgtcactgtcagcagtgctaaggaagttactgtcgatttccctgacaagtacatcggtaacttctacgctgtccagaagggccatgaggacaagcccggtatgctcggtgaggtcaccttcggtggctggaacggcaagactacttcgacgtctctgcta

SEQ ID NO: 664 - DNA, 603 bp, Fusarium venenatum
  misc_feature (1)...(603): n = A,T,C or G
caaggctctccgtgtgtggatgcaagatcatgcttctcctcaacgactgttggtcggtcatgatacggccatctcggcgctgacatggcatcctaacggtctttacgtgttttcggcctcggatgagaccgacaagtcaatccgtatgtggtctgtgttgagcggctcttgcgtgcgtgtctttacaggtcataacgactacatcagcgccatggaatgcgcgccaaatggcaagatcctagcaagtgccgattgtgcaggtaacatcttcttttgggaccttgctaaaggaacacgcatcaagcggtcacgtggtcatggtaaaggtggtatctggtcgctgagcttcagtgttgaatccaacgttcttgcgtctggtggtcaagatggcacagttcgactatgggatgtcgaactgcccgctgatccacaaaaggccagccagcancagactggaaatgacgccgacaacaacgggagcggatggcacgaatactggaggtccgttggcgaaggttctcgtgttgcagctgctacttcagggcaaagtggaagcagtggtacaaccggaacacntaagaaaaagaacaaggaggtatgata

SEQ ID NO: 665 - DNA, 649 bp, Fusarium venenatum
  misc_feature (1)...(649): n = A,T,C or G
gcggaaccaaggggtgatcggatcggcggaaatgaaggcctgcggcagagtgcgggccttctgttttgaggattataatcagagtatattgaaagtttcgcgatcttttcgtataattgttttaggcatagtgcaatcgataagcttggctgcaggtcgacggatccccgcggcccagcccacggccggggtggccgggccacccagcgcttcgagcaggccgtcatagcgcccgccgcccagcacggtgccctgcgcgcccagccggtcggtgatgaattcgaacgcggtgtggcgatagtaatccagcccgcgcaccagcgccggcgcgcgcacccaagcaacgccggcggcatcgaggccggccgtcaccttgccaaagaaatcctgcgcctcatcagtaagatattcgtcaatctggggcgcagtctgagtaagtgccttgtcgcgcgggtccttggaatcgagaatccggagcgggtttttctcaagccgctccttcgattcgtcggaaagatctgcttcataacgccggaaataacggatnanggcctcacgccaggcttcgcggctcggcgcatcgcccaaggtattgaggttgagcgtcacgccatcggcaatgcccanttcgcgcancaactgatcgggt

SEQ ID NO: 666 - DNA, 594 bp, Fusarium venenatum
  misc_feature (1)...(594): n = A,T,C or G
ctctgatttcaccaccgagggcaatttgactggaccttctcaatacgatctaattcccaagggcgcaccatcagtcggaagtgatccaaaggatagccaaatctggtactacaatggcactcctgctgcgtgcacatttgttgctctcgactatgttctcccccgatacgccaactttagcgttcctgaccttgtcgtgactggtcctaactatggcaccaacttgggcggtttcgtatggactctatccggtactgctggtgctgcatacgccgctacaaaccgtggaattcccgcaattgccatatcagcgagcaaccaggaagttccctacttcgaactgacaaaccgcaccaacccagctacgtgggctgcccaagcctctgtaaaattcgtcgagaactttatttcgacagctggcaagaacggtccccttttgcccatcggttacggcgtcaatgtcaatcttcccgtgttgacgaagaaagatcacgaccccgaattcgtgcagacgaggttcacgggcaatgcgcacgttaacgaancggtgcttgatccgaanaagggaacgtttacgtgggccaacatcaagcc

SEQ ID NO: 667 - DNA, 837 bp, Fusarium venenatum
  misc_feature (1)...(837): n = A,T,C or G
gccgcaggaattttttttttttttttttgtggaaaccattgtgaatttcgcaaaagcacagtgaccatcctccgctacccactgcacttgggtataaagcgatcatcaagaaacggttccacgtcctcatgtccagccgacccgttgggaccagcatggacactcgtgtaaaggctttctcagctttccacccatgcagtgcttttttttccttcctgcctccagacgactctttggtacaaggcgcgtaacggaaaaacaaaagagaaatgatgtgccatgcaagatatccggagaccccaaacgcccctattntgggtgttccatcttctatctgcaaagattttttggtaagtgttcgcaacgtcggctgttctatccgtccatgtcgatgttgtgttttgcagatccgagatggccaccatgagatgaaccgtaagagtcatgagtgcccaaggaaataaaccgccgcgaggcgtttacttccttcggaaagagcagccctcagtcagacgagccttaccaccggtaggctggcagaggacagtggtgcatccctggcagatgacaacggtctgggcgtgagagaagacggtggtgatggtgaagcaaccggggcacttgacgtccatgaagaaggatcgaggggcgggcacaagggtcttgagcttgtgcttcttggcctcggcggccggggaagggttcagaagatcaacggcgagaaccatcttgtctgattttctcgaaaatttcttgtcggtgacttgcgagaatgggaaagcttgacgaaatccggcaacagatttgaggctcgcaaggtgggtgggaggaggtaag

SEQ ID NO: 668 - DNA, 360 bp, Fusarium venenatum
  misc_feature (1)...(360): n = A,T,C or G
gcgagactaaccccgacttcgatacacaagtgcatacgcccgaggtgttcttgttcgattacggtgtcgtagtcatatggggaatgaccgaggctcaagaaggctcggttcctcaaagagattgctaaattcgaaactgagaaagcttgcgcctgacgatgtcgagacagagctatttaacttctattataccaaggactaccaggcccgcatctacaatgatttcattactcttcgcgacaagaaacaactacatgacaaaactggcaatttctcatgctttngcgcagancgtcaagacttctcttttcgaggaattgattgcatcaacagtcgatacatgcaaagacatccccccgc

SEQ ID NO: 669 - DNA, 1068 bp, Fusarium venenatum
  misc_feature (1)...(1068): n = A,T,C or G
ttcggttcggggaaatctacctcgtcggacaatggtagtaaagacgagatagtcctcctccctgtccagtccaaagccatccttcgtgtcacagaaatcgagacaaaggtacacgacccagaaggaaaccaagtccctgtccaagatgcatccaccaccttcgaccttccagataaccaccccaacaagaatgctgtcgagatattatggcttcctcgtggatcacacagctccgacgacacaggcgagaaagtgcgtcgtgcgcttaataatgaaaaggacatgaccatcataggctgctgtaaacaattccccaaagctatcttctggtctctacttcttttcctcactgntgtcatggaggggtacgacaagagtcttgttgctggctttgttgctttccctgcctttcgagaacgctatggcgagttgtttgagacgccaacggggccaatctacgagatctcaccgctttggcagacagcattgcaagtatctgccattgctttgtgaaagtcatttggtctgttgttgcatggatnggatcacatcacagtanttgggtacaagaagatgatgcttatcagtcttgccttggatggtgtattggccgctttttccggttttctttgcacacaacattgctgtactggttgcttctcaggctctttgtggtatctctnggggtgtcattcaaacactggcagccacatatgctgccgaggttgtaccatcagccatccgtgcctgtcttctcagcaatgtcaacatgtgtngggtcatcggncaactgcttggtactggtgtcttgcgatccctcgtccacaacgattctgagtggtcctaccgtttacccttcgcccttnantgggcctttgccatccctcttcttattgcatcatgtttgctcctganagtccttggnggcttatccccgngaacgtaagggtgangccanacatctnttcagcgtctcaccaagcaatcccagnttgacattgatgataccattgntggcatgggaacacaccaaccgtntcnaacgtaancttnacttccggggggtca

SEQ ID NO: 670 - DNA, 545 bp, Fusarium venenatum
tcacaaacctctcaacgaccgaccttgaagagacgagccgcagccatgtcgtcgaccaagaagccctccggcaagactcagcgctccgccattgcggatgtcgtcgcccgcgagtacaccatccacatgcacaagcgactccatggtgtttccttcaagaagagggctcccaaggccatcaaggagatcaaggcctttgcctacaagtctatgggtaccaccgatgtccgcatcgaccctcagctcaacaagaaggtctgggagcagggtgtcaagggtgtcgactaccgaatccgcgtgcgaatttcccgacgacgaaacgacgaggagggtgccaaggagaagctgtacagctacgtccaggccgtgaacgtcaaggaccccaagggcctccccacggttgttgttgaggaataaatataaaaattttctcttgggacaaggttctagggtggcatggcatttggagttgcattcggcattctggctttcgacgctgaaaatacacagagggaaaaaatgtgatcaaagcttgaagtcaaact

SEQ ID NO: 671 - DNA, 695 bp, Fusarium venenatum
  misc_feature (1)...(695): n = A,T,C or G
caaattgagaatttctcgatcgccatccaactaaccgcccaaacaccacagccaagatgacgaagggtacctccagcttcggtaagcgtcacaacaagacgcacaccctgtgccgacgatgcggtcgccgctctcttcacgtccagaagcatgagtgctcttcttgcggttaccctgctgccaagatccgcaagtacaactggtccgagaaggctaagcgaagaaagaccgtcggtaccggccgcactcgctacctcaaggatgtgtcccgacgattcaagaacggtttccagactggcacacccaagggtgcccgtggcgctactgccgagaaggcctaaacggggactgcatcccttctgatcccctccaccacctctccggccctatccctcttcaaccacggacgttcgaaacacccattctttcgagcacgcgcatatcaacaataacggttctctcataacatgaactgagaccgcaggggaatctggttggaactggagtaaggtggtggctggggcggttgtgtttgttggttcgtggatgaaggacctctaaagggacgggttggagcatgggcacggtgttttacatgtttgagcaaggaagtaaaaaaaagaacccctttgctcttctgagattcnatagggtttcggttacgaggttctgaaatggcatcttgattctgcatg

SEQ ID NO: 672 - DNA, 1014 bp, Fusarium venenatum
  misc_feature (1)...(1014): n = A,T,C or G
aacatcatcaacactcgcccttcttttcccccttccatcgccctctctcctccagccgccgaaatgttctcgcgacaggtcatccgcgccgcccgagtcgccgctccccagcgagccctcgccctccgagccgcccccgtccgatccttcgccgccgctgctcagtccgatgtcaagtctccggtttccgtcttcggcgttgatggcacctatgcctctgctctgtacactgccgccgtcaagacttccagcgtcgacgccgcttccgatgccctcatcaagctcggtgctctcatcgagaaggaccccaagctcgtctccgtcctgaggacccctaccctcgccgatgccgacaagaaggccattgtcgatgagcttgtcaagcaaatcaacaccaaggacgagaccgtcaagaacttcctcgccaccctcgccgagaacaaccgacttggtctcatccccggtgttgtcgacaagttctccaccatcatctccgccgcccgtggtgaggtcganctcactgttaccagcgctcagcctctcgacaagcgaacactcaaccgacttgagactgntgtcgccaagtcctnttacgtcggncagggcaaagaactcaaggtcaccaacgaggttaaccccgatatcgttggtggactcgtcgtcgaggtcggcgaccgaaccatcgacctcagcgtctcttcccgcatcgccaagatgaacaagctcctcacggacactctgtaaaaaaccacccatagtataaattctatttagtgtctcctttgcgtcgtctcgtggagtttttttctcatcaccacgcaaaaaaacggtatacccccctcctatgagtgtgggtttcccaaggggtttttctcgtcccccttggattgttacaaccctcccggaatcaaacgttcttgtcatccctggctaggggagaagaaaggggagagtgtcgatggaaagaatagtgtaggaggatttgaactgggtacgcaataaatgcagtccccc

SEQ ID NO: 673 - DNA, 523 bp, Fusarium venenatum
  misc_feature (1)...(523): n = A,T,C or G
caggcgggctgcatcaacctccactggcccctngaactccacttcagccgccggtcatgtccatgtccctnattttgtcgctccgtcatcctaccttcgacgcaggacttnnattcggagcccaatggcacctaccgagccgaaacctttgagtcctntggacananatcagttgcagggtctgaatgctattcgcgatttcctcaaagngcgcactagctacgatgttctgccactctcgttccgactcatcgtcctcgataacgaactcctcataaaaaaagcgatcaacatactaacacagaactcgatagtatcggctcctntatggaactccaaaacctccagattcgccggnattnttacgagcaccgatttcatcaatgttatccagtactattgccagtttcctgacgagttccataaactcgatcaattccggntaaagtagtttaaaaaatattgaaaagtcgattggcgcganacccatcgagacagtttggggtnattctttnaaaccgtt

SEQ ID NO: 674 - DNA, 729 bp, Fusarium venenatum
  misc_feature (1)...(729): n = A,T,C or G
ccacgcctcacgacccgacatcgacaatcggagcacggtaagcagacaaaatgacgatccggtacaaccagaagctcgtcagtaaccatttccgcaaggattggcagcgccgggttaaaacccacttcgaccaggccggcaagaagtccagaagacgtgtcgctcgcaaggccaaggctgctgctcttgctccccgtcctgtcgacaagctccgacccgttgtccgatgccctaccatcaagtacaaccgtcgtgtccgctccggccgtggtttcaccctggctgagctcaaggaggccggtatccccaaggctttcgctcccaccatcggcattgccgtcgacttccgccgccagaaccttagcgaggagtcccttgccgccaacgtcgcccgctcaaggcttaccaggagcgactgatcctcctcccccgccgatctaacgccctcaagaagggtgacaccaaggccgacgccttcgtcgagaagatctctcacgtcgccgccgcttcctatcgccctaccgatatcgccgtcaaggagatctcaagagcgacatgccttcaacatcgaggctgggcttaccgaactcttcctgtcgttcgtgccaacgcccgatacganggtggccggcagaagcgtattccgtgatgctgccgaggctgagactgccaagaaataaacttgcnaaaangggaacaaggggttgangggtttgctntttattgtca

SEQ ID NO: 675 - DNA, 574 bp, Fusarium venenatum
  misc_feature (1)...(574): n = A,T,C or G
ttttctcccatcacagaaaccgcaatcatgggtatttcgcgtgactctcgacacaagcgctccgcctccggtgccaagcgtgcctactacagtgcgtaataattccgaaagcccgtatgatcctttggacatacgttctgacctttcacaacagggaagaagcgcgctttcgaggctggtcgccagggtgccaacacccgtattggccccaagcgcatccacaccgtccgaacccgaggtggtaaccacaagtaccgtgccctccgtctcgactccggtaacttcgcctggggttccgaaggcctgacccgcaagaccgtgtcattgccgtcgcctaccacccttccaacaacgaattggtccgaacaacaccctcaccaagancgccgtcgtccaggttgatgccgctcccttccgacagtggtacaagcccactacggtcaggctcttggncgaagacccagaaggccaggccgccaaggaaggcaagacgaagaagaagtcnagaaatccaacgccgttgaaaaaaacagntgctcgcatgtctgcccgcngcaaggtcaaaacgccatca

SEQ ID NO: 676 - DNA, 616 bp, Fusarium venenatum
  misc_feature (1)...(616): n = A,T,C or G
gtcggttttatgccccgtggttcttcgttccgtgacganggatgctgctttcgaggatatgttccgtaacctctgggctgacaatgccgatgttgtctccaactcctactctggcactggcgccatgaagacagatgtcacccgtacaggaaacagaacaaaggtcggggctcttcaagatgctcgtattggtgtcacacgttacttccgtaacaacttcttcgacggccctcgtcaggattcttttgatctcttccttggaacctaccgaccaggctctgccaacatcggtactaccctggtctttactgatcgtcgtccgatcttgatccagtctattccctacattctcgccttcagtgtcttattattctcactggcctgttcactcgtcgtgcacctgatgcgagcgccttacccctccgtatcttccttttcttctggatggccatcgctgcctggtctttctactttatctggaaccacggcatgctttacgtcaactggccccgcctcaaccccaaggcatttgccgttgaagggctacaacgagcacttcgccaaaggcacgcaaaggactctgtcattggnacatatgttggcgaaagcacganaa

SEQ ID NO: 677 - DNA, 599 bp, Fusarium venenatum
  misc_feature (1)...(599): n = A,T,C or G
cggacgaccaaatcttgacgaagcgacccaaaacccccagctacgggcattaatcgaaacaaggacaacgagcgttcggatcgcgaatccttaattcatcaaattcatcacaattggcgactaagcgcaaactcgattattcttcatcatcatgtctttccgaggaggttcgcgaggacgcggcggcggtggatttggaggtggccgtggcggtggccgcggtggtttccagcagcgagacatgggccctcctgcccagatccttgaaatgggcaagttcatgcacgcctgtgagggcgagatggtctgcgagtccatcaaccccaaggtcccccacttcaacgcccagatcttcctcgagaacaagacggccgtcggcaaggtcgacgaggtccttggccccatcaaacaggtcttcttcaccatcaagcccaacgagggcatccaggccacctctttcaaggagggcgacaagttctacattggctccgagaaactcctgcccctcgacaagttccttcccaagcctaagcccccgcctggntgctcccaaacccaagccccctggcggnggtcgtggcggtncccgtggtggtcgc

SEQ ID NO: 678 - DNA, 639 bp, Fusarium venenatum
  misc_feature (1)...(639): n = A,T,C or G
gcccggcacactanaagagacccttcgcgatggacttcgtcgcgcagacctactcattactactggcggtgtgtccatgggtgaattggatcttctcaagccgacaatcgagcgttctctgggtggcacgatccactttggtcgagtcgccatgaagcctggaaagccgactacctttgctacggtccctgtcaaggacaactcaggacagcgggttaccaagactatattttcactacctggtaacccggcatctgctctagttacctttcacctgtttgtgcttccgtcactccacaagctatctggtgcctctactacaggcctcccaagagttccagccgttatctcgcacgatttccctctggaccctaggcccgagtatcaccgtgctgtggtgacggttggcaaggatggcctctttaacaacaagcacaggcggccaacgaagttccaaggtgggcagtatgaggcagccaacgccttaattatctgccagtgggaanggtaaactggaaaaaggctcaaaggttgangtcctgctgttgaatgcccgtccaagctgcttaagaaacccaataataatcaaggncgaaaaggcacaaactaggtnttcagcggtataacaacttgcaaaat

SEQ ID NO: 679 - DNA, 631 bp, Fusarium venenatum
  misc_feature (1)...(631): n = A,T,C or G
gttatcggctgtgaaaaggcctacaaaaaccagaacggcctcaagtaccacaagacgcacggtcatcaaactnaacagctccacgaaaacggngatggcactttctccattgttnaccccgaaacaggtgcgccttatncaggaaccctgggtatggaaaaaganaagccgttcagctgcgacacatgcggaaagcgctataagaacttanatgggttgaaatatcacagggcgcattctnttccgtgcaatncggatttcaagctccaggctcttgcagcgggcatgaacctgcggggantaggagangatcanatgatgcctttgggtgncggcaacactaccaaaacgtggcaagctctttctccatattaagcgggggcgttctgaatttcanccccagtttcaacatgatgctggtcttaattcgactcgggccngaccggganatanattctgcttcattatctgcgnctttttccctgccatccctgtgtaggcatntgcttcagcctttgcctaaaaattataccgcttatggnggctttggagacttnaatcangggggnctcnattgattcaaaatcgngggncacaaactcgttttttgggtnttnaaaccaacccaaaa

SEQ ID NO: 680 - DNA, 678 bp, Fusarium venenatum
  misc_feature (1)...(678): n = A,T,C or G
ctgaaccagcgcaacgtctcataatcaacttccctcttccaacctctcgctacgccaacctccttctttcgcatacaatatcccaacaacacggcacgaaacgacaacgacttcttgatctcgaaacctcttctcgtccatcgtccatttttcgcgcttcttcgattgatacccattgctattttctagcgctccgacagcttcacaaaacacagccaaaatgcctgagcaggaagccccctacgacccctatatccccagcggccaggctggagcccagcagcagcagggtgccggcggcaatgctaggacgcaggcgctgcaagctcaaatcgacgacaccgtgggtgtgatgcgtgacaatatcaacaaggtatctcaacgtggtgagcgactcgatgctcttcaggataagaccgacaacttggctgtntnancacaaggtttccgccgaggagccaacanggtccgaaagcagatgtggtggaaggacatgaagatgcncatgtgcctgantattggnatcantattctgntggcatnatcattgtccctcttgtgnggttacccgntanagactaaaaaaantttgggtacttngnnctcacnatgcacaccctttggactgacgaatcataaatcgaatattgntgaccttcgacctnggatatggacntt

SEQ ID NO: 681 - DNA, 603 bp, Fusarium venenatum
  misc_feature (1)...(603): n = A,T,C or G
tccacactnaaaatgactccctcactacaagacgcaaagatcaccttcctcggcggtggcaacatggccgccgccattattggcggtctcctcgccaagaacaccaacaagcaaaacatttatgtctctgaaccctgggacgtcaaccgcaacaagatggccgacctcggcgtccgcaccaccgccgacaacaaggaggcctctgctgacgctgatgttatcatcctcgctgtcaagcctcaggttgccaagggtgtgtgcgaagagctcagctcagcttggtctggacgcgatagcctgcctgttgtcatctctatcgctgctggcatcacccttgctagcattgcacaatggttcaagggcgatagtgggaaggccctcacatcgtccgtatcatgcccaatacacctgccctagtcggaaaaggcgcttcaggcctgtatgctgccgaagatgttactggtgctgagaaagaattgacttctgctctcttgggcagtgtcagtaaggctactgaatgggttgacaaggaagaacttctcgatgttgtcaccggtatttctggttctggtcctgcatacttcttcgcttttgttgaacatc

SEQ ID NO: 682 - DNA, 499 bp, Fusarium venenatum
  misc_feature (1)...(499): n = A,T,C or G
caagaaagctcctcaagttcgcaatgtccaagaccttgaaactatcgcgaagcgaatccaggagctcggtcccaagtgggtgcttgtcaagggtgggcacagtcctatgaaggaggaccttactgtagcagagaccgaggatgagaggcaatttgtctttgatgtgcttgttggaggaaacggagagccctgagggtcaanagtccgtaccaagcaagctccagtacccatggtacagggtgctctttggcatctgctattgcttcgaacttggccaaaggaatcgatacgcctgctgctgttcagtcagcgtgtcgatacattgaagctgcgattcncactgcgccangactgggcaaagggcatggtcctctgaaccacttccattcaacctacactcttcccttcgctcctggctactttatcgaatggctccttgancgcccgaagttcntgatttctggaaagaatttgttttatcaccctttgtcatggccat

SEQ ID NO: 683 - DNA, 634 bp, Fusarium venenatum
  misc_feature (1)...(634): n = A,T,C or G
agatcacagtcttttcccacgtcattgtcgactctcccatcaatcccgcgatcgattcaacaatggccatgtccctcgcgcgggtggccctcagggcaccgcaatcgcaatcgaggcttgctgccgccgccgccactatcacggctcgaaccattgccgcccacggacgacccttcagcaccacgaaccgagctcttatcccctccggcttcggatctccgattgttccctcttacttttctaagcctcggctcccggccaacacggttattcgattcgtgcctcagcagacggcttggattgttgagcgtatgggaaagtttaaccgtattctcgaccctggtctggctgtccttatgccctttatcgatcgaatcgcatacgtcaagagtctcaaggaaagtcgccattgagattcctagccagagtgccatcactgcggacaacgttactttggaacttgacggngttttgttcacgcgtgtctttgatgcgtataaaagcaagctattgggtcgaggatgccgaatatgctatttntnagcttggccagacgactatgcgatccgagancggcaactggacccttgaccatgtnctcaaggaacggctgggcttcaaaacaacattacaa

SEQ ID NO: 684 - DNA, 514 bp, Fusarium venenatum
  misc_feature (1)...(514): n = A,T,C or G
ntttgtccaagactgtctcaaggcattcctcccctcgtacattcccatcattganaaacgaaaggacatgccttacaccgaggcggaaaaagactggcagcagcttcgccgnggcaagtacgttgagttcaaccttgttcacgatcgnggtacaagcgtttggtctcaacacacccggctcaagggttgagagtattctcatgagtttgcccgttgactgctgggtggaaatatatgcatgaacccgagccgaaaagcagggagcaccgcctttgtaaatgtcctcagagaccccaaggagtgggtctaagattcttgtcttgaattaaaacacaagcatgatgcatgttggagcatgaggtagagcgattgtttagtgtatcataggtatgtgaggaccatagatgagatggggacgcccatggtggtacatgctacaaaaaccaaacagcaggtgcngtntactaagacgcaatcaaagaantcaaatataattttaaatgaaacccttgtt

SEQ ID NO: 685 - DNA, 595 bp, Fusarium venenatum
  misc_feature (1)...(595): n = A,T,C or G
gaaaaggcaacgttcgagttgtcgtttctccctacacccaatctcacctctatccattgagcttctacaatatatacatttcctatcggccactcgactgctgcagtttttgtcgaatcaagatcctgtctgtacaactattaaaccgccaagatgtcaatgtggttgacagatacccaaaaaattggagttgtcttttgctccggcggaggcttcttcctgataggaggtgttatgctcttctttgatcgatctatgcttgctatgggaaacattctcttcctcatcggcttgaccatcattattggacctcaaaagactcttctcttcttcgctcgcaaacagaaacaaagggtacggcggcgttcttcctgggcttaatacttatcttcatgaagtggacctttatcgggttccttgtggaacgtatggtatantcatcttgtttggagattcctagggacaatgccngcttcgcgcgaagcttgcctgttgtgggacctatatcngaatggttgtcacagaatagtcttggaagacaaacccaactcctgtctattctcnggactaaattccncaaaaactaatantccaa

SEQ ID NO: 686 - DNA, 602 bp, Fusarium venenatum
  misc_feature (1)...(602): n = A,T,C or G
ctccactccaggcaactttcaacaaacctttctactcaaccatcgacatctctcctgcctgttagatctctcacttctacgttacgtgtctgtccccgaggacgacattgctatttcacttgtctatccaggccttgacaacccaatccatcagtcaactcatctccgagcgatcccgcgacaatggccgattctaccaacgcccccaagccaagcagtagcgtcaagctggtgcttcttggtgaagctgctgtcggaaagtcatctctcgtattgcgcttcgttaacaatgacttccaagaaaacaaggagcccactattggtgctgcttcttgactcagaaatgcaatctcccaacaaggaccatcaaatttgagatctgggatactgctggtcaagaacgttttgcctcgctggctcctatgtattatcgaaacgcccaggccgcctcgtcgctacgatctaccaaacccacatcctcatcaaagccaacactgggttgctgagctgaacgacagcttctccggatcgtatcgcactggtaggtacaagctggatcttacaggcgactcatcatgccgaggtncgatgganagaggcac

SEQ ID NO: 687 - DNA, 432 bp, Fusarium venenatum
  misc_feature (1)...(432): n = A,T,C or G
aaaacacccnaggaacnctcgccgcacaaacaacccttcacttatccacctcnacacagccgttnaaaaggatggcctcaacttctcgctcggccaacnacaactcatggctcttgcgagagctcttgtccgaggtgcccagatcatcgtctgtgacgaagccacctcctcagtcgacatggaaacagacgacaagatccaggctaccatggcggttggcttccgangcaagacattattgtgtattgctcaccgattgcgcaccatcattggctacgatcgcatctgtgtcttggatgcgggacgtatcgctgaattggatacgccattgcagctttggaaacanggaagcatcttccgcagcatgtgtgaccgtagtggtattagaatggaagatattcacngccnagggaagaactcggtagtgcgata

SEQ ID NO: 688 - DNA, 621 bp, Fusarium venenatum
  misc_feature (1)...(621): n = A,T,C or G
tttcactctcacctcaacatcaaaagcgatctctttctcttcatcttccacccaatctatccttactccttcatctcacctcccacctgataccccctaacttacccctccaaaacacacagccaaaatgacacaacgcctaaagctcaccagcgccaacctctccaccattgcttcgcagcagggagagcaaagagtccaggtcccatcctacgaccgcaagtctctcaaggagggcatcgtccacgtcggagttggcggtttccacagagctcacttggctgtctacgtcgacaagctgcttgagaagcacggtgagcgcgattgggccatctgcggtatcggcctgcgtcccaacgatgctgccatgcgcgatgttctcaacgcacaggaccacctctacaccgtaattgagcgatcccnaaagggtagcttcgccgatgtcgtcggcagcatcaactccttncttttcgccctgatgaccgtgaggctggcattgcaaagatggntcatccgacactcacattgtttttttactattactgagagnggntactactacaacgagaacacccatcaattggaagctgagcattctggcattcagcacgacttcaagaa

SEQ ID NO: 689 - DNA, 591 bp, Fusarium venenatum
  misc_feature (1)...(591): n = A,T,C or G
aggcccgtatgactgaggctggcctattgggtgacacacccgaccacccagtcgttgacgtcctaggctatggccacatgggcgattccaacctgcatctcaacattcccgtgcgcagatacgatcccgccgtcgagaaagccttggagccttgggtatacgagtggattcagaagcgcaacggcagcatcagtgctgagcatggcttgggaatcgccaagaagaattcatcggctacagccgagacgacaccactatcggtgtgatgaagcagatcaagaactatttgatcctaatggcatcatgaacccctacaagtatatctgatacccctgtctcttggtttcgtatacgaatgccagcatatacatatcttacccccttgctctgcagcgtcatgcattgcatgctgcttgctcaactgattacacccccgtttganctatagtaattgtggttgttacggagcgaatcagaatgcgcagacttttgaataatggtgccaaaacatgattnancaatgctgtgccgtattgcactgtgggactagganaatattgtntatcgatnttaagccatgaaacntcnttg

SEQ ID NO: 690 - DNA, 591 bp, Fusarium venenatum
  misc_feature (1)...(591): n = A,T,C or G
gcagggtgcaaggtggcagacatgttacctagcacgtttgttcctacttgcgggaggtgctctaccccagccccaggtctcgtctcagtacgaggatcatcagtgacaaatgtctgccgagactgtcacggtcattttacctttaaaattcccgaagtcaagttcttgttcatcaccccggggtctcgccccccaccaacctccggtcctcgtcggaaacaagagaagcttggtctgcatgcgggagaccaactgcccgacaagggtacatgctcgcactaccgaaagtcataccgatggtttcgcttctcatgctgcagccgcgtacacccctgcgacaagtgccatgacaaggcaggaagaccatataaacgaatgggccaaccgcatcatctgcggctggtgtagcccgcgagcagaattactcgtcggctgtcgaggcgtgtagattctgcggccgctacctgataggtaaaaagggaanggggtttctgggaaggtggaaagggaacgatgagacaggacgacgattgagtcggaaggatcccagaaaagacaagaggattggtactttggcggccaaagaaaaga

SEQ ID NO: 691 - DNA, 630 bp, Fusarium venenatum
  misc_feature (1)...(630): n = A,T,C or G
ctctgttgctgaacaatttggtaacttgagagatactttgggttcagtattgggcatcttcactttgatgcgatggatccgaactttgatcgctaagatcactggtcgcccgccgcctgccgatgcgactgctctcacaccggctgcctttgctcgtttcgaaggccgcagtattggtcccgatggtaaccctcttcctgccaaggccagcaggaagcctctcattttctttgttctggccgcgttcggtattccttatctcatgtccaagatgattagatcacttgctgcttcacaagaacaggagcagaggcgtctccaagcacaggccattgaatcacagcagcccgtcgacccctccaagctcgagttctgccgacttaccttcgacttcctgcctcagcccaacaccggcatggaacttgaggctcgcaagggcgacctcgtcgctgttctcaacaagaatgacccatccggtaaccccagcgagtggtggcaatgcagggctcgcgatggccgncaagggtatctacccttactatctcgagggcatcaagcgtctgcgcaagancccaagaaacttaagggcggccctagcgagagtangccggacaaacttnattggcaagg

SEQ ID NO: 692 - DNA, 523 bp, Fusarium venenatum
  misc_feature (1)...(523): n = A,T,C or G
cgcccgaccatcttctcgtcttcatctctcccaagacgtcccacacataaccttcaagatgaccaagcgaacaaagaaggtcggtgttaccggtaaatacggnacccgttacggtgcttccctgcgaaagcaggtcaagaagatggaaatcacccagcacgccaagtacacttgcaccttctgcggaaagactaccgtcaagcgccaggctaccggtatctgggactgcaagtcttgcaagcgcaccgtcgctggtggtgcttacgtcgttgccacccccgctgccgctgccatgcgatcaactctgcgacgactccgagagattgctgaggtttaagggtggactttagcgaaacgggaaaatggctttgcttttcggtatggtgtacggggggatatgatttcgtgcctacattacgaggtgacgatctggacgtcgacacccgaacttcggtcacatagaagccgatcgaatagcaataaacaaaaagaattgcatggtttcggatccaaaanaaaaaaa

SEQ ID NO: 693 - DNA, 948 bp, Fusarium venenatum
  misc_feature (1)...(948): n = A,T,C or G
ttgnnacgactttcatcaatatctttgaccacttcgcatcatttcgtaatcgactaacggtccagaaatcattcgaatcccaacaaattccaggcgccatgcgattctctactgtcaccgcctgtctgactgcctgtttggcgccagcggcggcttttagtgttctcaatggcaaggcttccgaacttaccattagcgacgaccttaagatttctggtgattctcctcttgagttctgccccggagaccacgcagccgatcttattaagattgaccgtgttgatttgtctcccaaccctcccaaggctggccaggaactcttgattaaggccaagggatcagttaaacagaagatcgaagagggcgcttatgtcctcttgaccgtcaagtatggcctcatccgcctcatcagcaccaaggccgatctctgcgagcagattggcaatgtcnacctcaagtgtccccgtcnaaaaagggcgaagtcgaggttattaagagcgtanacctttctgctgagatttcatctgggcaagtacaccgtgctggccgatgttttcactggcgatgatgtacagattacattgtttgacggcacccgtcaccttttttttgtagcagcaagggntttttttgggcagcgatctgtgattggaattatggcgcacacaacatacgcatgatggcatgacttacagctgggcacggtctaatggatttctttgtcgactttggtttttggtgaatttatagctcaagtagagcatattgcagcggctttagaatctatttagcatacttgacaaacgagtccatcgcattgtactccacctcgttccactgtatacgcatcgccctgcagtcctgcacaacgttaccacgtcnataaaacacaatactggctcgcgagtcattcggccagattgatcgccncccntatgctattcgctt

SEQ ID NO: 694 - DNA, 808 bp, Fusarium venenatum
  misc_feature (1)...(808): n = A,T,C or G
aggctatgtgggacaagctcagccttgttcgagtgtacacaaagcccaagggcaagcagccagattactctcaacctgtcgtgctccgagcctcgcgctgcaccgttgaagatttctgtaacgccattcatcgaagtatcacggaggttttcaagacagccatcgtttacggcaagtctgtcaagcatcagcctcagcgcgttggcttggcccatgaattatgtgacgaggatgttgtaacaattgtcaagcgatgaaaggataacttgcggagattgaaggggacgatcccacggcaacgcgagaagcttggtgaactagattgcttggactgccgctttcgcatcagggtgtcaccacaagccatggcacagtcgaccaccctctagtacgcgactctggttttgctccgagtggctcaagaaaatagagggagaaacccgcgcggaccggggggatgtcgaatgcaatagaagtcaataaggacagggctgacactggatgcacgggtacgagcacgtntggctggcaacaagaatcgacctgctcaancaggcacgataatgatcggcgcaagtttncgggggagttaaaaatggggtgcctactnacaaacaggctgatgggttaanaaaagggggcaaaatattaggtcaacgggcagacgacaatgancaagggacagacccnatttaaaagacaatggaaagcaagacgggtacttcggccggaccggaattacacnaaatttttntccggttggcnaccggatgaacaaaaagcaccnctgtggtggaatttaacccca

SEQ ID NO: 695 - DNA, 895 bp, Fusarium venenatum
  misc_feature (1)...(895): n = A,T,C or G
agacattcttctttttcaaccttcttcccttattgcgtgggaacatctcgtttttctctcctctctgcgtatccccgagcgctcttatcgatcgtctccttctccccctccacttattcgaattttagagagccaaaactcgccgcagcgtagccccgccgtcggaaacccaagatacgcttttcaggacaagagtccttaccttatcttctgcaacacgataataaaaaacaactccaaaaaccgcaaaaatggttaaggaaaccaagtactatgacacactgggtgtcgcccctactgccactgagcaggagctgaagaagcctacaaggtcggagccctcaagtaccaccctgacaagaacgcacacaaccccgatgccgaggaaaagttcaaggaggtctcgcatgcctacgaaatcctctccgatccccagaagcgacaagtttacgatcagtatggtgaggccggcctccaaggcggtgccggaagtggtggcatggccgccgaagacttgtttgctcagttcttcggaagtggtggtttcggtggcatgggcggcatgtttggcggtggcggtatnaaccgcggcccccccaaggcccgaaccattcaccacacccacaaggtctccctggaagatatctaccgngggaagatctntaagctcgctnttcaacggcaatcatctgccccaagtgcnaagcctgggtggaaagganggcccttgnaaacnctcactggctgngatggccacggtatgaaaacnatgatgcgcagatgggtccatgaccanccttccaaactgttgccccgactgaacgggaggggaaatatnaagaaaagacngttcaanagtgtacggaaaaaaccctgncaccgaggttttccctca

SEQ ID NO: 696 - DNA, 583 bp, Fusarium venenatum
  misc_feature (1)...(583): n = A,T,C or G
gatgcggcctttctcctttgcatccatccctcgcgctactcgcatcaccactcgaatcaacccgttttttactcaacctcgcaacttctcctttacacaagcaatcatgggtgtcgaaaagactatcatcacggagggtaacggcccttcccccaaggttggccagacggtcagcatggagtacactggctggctccaggagaacggcggcaagggcaagcagttcgatagctctgtcggacgtggtgacttcgatgtcaagattggcgtcggtcaggtcatcaagggttgggacgagggtgttgtccagatgaagcttggcgagaaggctactctttttatcacccctgactacggctacggtgctcgcggcttccccggtgccatccctcccaactccactctcatcttcgatgttgagctcaagaaaatccgataaatgtgctctttaactcccgtcacctttcgatcgatctcggagcatccaggccctgacgagcccgttataagctagcaatgttcaacaaaaccttataaaaatcaacccggngttcattatacccctacatacatgcagcactta

SEQ ID NO: 697 - DNA, 622 bp, Fusarium venenatum
  misc_feature (1)...(622): n = A,T,C or G
ctcttcacctcttactccctcaactcttttcttcccctcccccaccaatcatccctacggcatccgaagctgtctgctatattccctcccccttcgcattcgcgccgcccacattatcaccagtaaccatgtctctcgccgacnaatccaaccgcatcgtcnaacaattcgacttctccgacgatgatctcaacagaagtgtgaaagaattcttgaggcaaatggacgagggcctccaaaatgagggcacaagtctccagcaaattcctacctacgtcaccggcgttcccaacggcacaaaaaagggcctttacctagctgntgatctgggaggcacaaacttcaaaagtctgctccattatgctgaatggcgacaccaccttnaacctcacttacaacaagggtgctattccaaaaaccttatggncgcaagcacctnaacaaacctgttnttttttctcgccaagcaaancnaaatcttctggagggacaccccgcccgagcacttttaacttccacttgngccggcggaacaccttcagcgccccctttgggttattgnggaagaacacaattttccggttgggcttcactttaatttccccgcaagcagctttgttat

SEQ ID NO: 698 - DNA, 577 bp, Fusarium venenatum
  misc_feature (1)...(577): n = A,T,C or G
aaaaacctattgccagatacagattaaacttcatctatcttttgtcttccctttccccctccacttaatttttcacatctcatcttgaagaagagcaaaatcatcatgccagtgattgacctgggcgaatccatcccttctgatacagcacatgctgtcagtgtctcccttccaacttggaaagccaatgttgggtacgaggagggtgaagattgggttgtgaaccgtatgaccacaggttaccctcgctttttcgttcacagaggcatccaggcatttgccaaagaaatcgtggatcgttatggcagccccggccagcaagctatgctcttccctacaccgcgagtagcaaatcggtgtctggattttatagtccaacggatctcccctgagctggcgagtcaggtccgcatcttcgactttgctcttgacaagtcaaagganctctctcctgtattaaagaaactcacttctactatctctgctgtgctttatccctctgaggtatttctattgcgaaacaatactggcnacatactggaaaagggtacttccagcaggcgtgccgagttttgtc

SEQ ID NO: 699 - DNA, 628 bp, Fusarium venenatum
  misc_feature (1)...(628): n = A,T,C or G
cgatattgcattgcagttggttgttgactcttattgattgtctcctttaacgtcgtctttatcgtctttaatcctttttcacttcgccgttttaccgttgtactcgagtaatcaaccgacaagatggcttctgcagctgccgagaacgcttcaccgattggtattgccaatctgcccaaccagcgacacaagattgtcgcgaagcgtggcgccggcttcactattatggttgctggcgagtctggtctgggcaagactaccttcatcaacactctcttctccaccaccattaagaactacgccgaccacaagcgacgccaccagaagcaggttgcaagaccggtgagattgagataccaangctgacttgaggagaagtcttcaaggcccattgaccgtattgatacccccggattcggcgactattgtaacaaccgcgactcttggatgcccatcatcgagttctngacgancagacgagtctacatgcttaagagcagaagcccgccgtaaggacagatcgacttcgngtcatgctgctgnncttatcgccttacggccaaccttaagctttgcattgnggcatgaacncnttgttcggcgtaactggatcctggtnttgcaagng

SEQ ID NO: 700 - DNA, 1034 bp, Fusarium venenatum
  misc_feature (1)...(1034): n = A,T,C or G
ggtgctgatgtcgatgaggtcgccaaggccgtcggtgttgacccccgtattggtaacaagttcttgatggctggtatcggtttcggtggcagctgcttcaagaaggatgttctcaaccttgtctaccttgccgagaccatgggtcttcccgaggtcgctgagtactggcgccaggttgtcaagatgaacgagtacgcccgtgaccgtttctccaacccgtgtcatcaagtgcctcaacaacacgcttgtcggtaagaaggtcactatccttggctttgccttcaagaagaacaccttcgacacccgtgaggctcccgctcttgagatgatcaagaccctcctcgaggagcgtcctcgtgagatcgccgtctttgacccctgctgtaaccctctggttatcaaggctgagatcaaggagcttctcggtccccttgctgagggccacaacatcaccgtccacggcaatgcctacgacgcctgtgagaagaataccgccatcatcatcgctactgagttcgacgaagttccgcaacaagcctcctccccctcctgctcctcaacctaccgtcaagcccaagactatttggccgcaagcctaaccccaagtctgacccccgtcccttcaaggagggtggcagccccaacgagctcctcgctctccacaagcatctcgtccagcgacccgacgtcaccacccacgaccctctcgagcgcttcaacattgagcccagctgtgaggacgactgccctgactgcatccaggagcgtgagagcaaggagagcggcttcgccactggtatgggaagcntccgaggagtacaagcccaaggagcgtgttgactgggtccgcatctctgagagcatggccaagcctcgctgggtctttgatggccgnggtgtcatcgattctcgggagatggttaanctgggcgtccgcgtcnagaggtgtcngtcgtcagcaccgnttctagatggcctaattggatttaagnnttattttcaacnggcgaccttttaaaattttntttgnatgn

SEQ ID NO: 701 - DNA, 871 bp, Fusarium venenatum
  misc_feature (1)...(871): n = A,T,C or G
ctggtatgaacctcgacccctacgatcgcagttgaatccgaatacacactgcgcttcgcgactttcaaggtccgcggctccagcaaacaaccaactaacgggacagcataatcgacaactgatcaccgtcacaatgggcgacgcagtcattgagggttcgaactggcgcctcgttgaggttggccgagtcgttgttatcaacggcgaccaccccttcgctggccacctggccacgatcgtcgagatcatcgaccacaagcgaattctcgtcgacggtccttccgcgaacgctagcctcgccactccccgacaagctgttcccctcaacaaggttctcctctcctctctctctgttgagggcctgaaccgtggttcccgaactggtgtcgtccgaaagctctgggagaagtccgagatcgactccaagtgggagcagaccaactgggccaagaagcgggaccagatggagcgaangaaggctcttaccgacttcgagcgtttccaggttctccgactcaagaagcagcgacgattcgaaaagcgcaaggctctggccaangtcaaggcctccgcataaatgggttatttagctggagtcacgggaggtgcttgaaagtcgggtttaaatcaagtggcacggaacagggtacnaaacacaatcaccggttgtatagaggctgctggattctcttttcgttccgttctggaaggctgtatgccacatttcgtntttttcaagatgaacggcgtcaatacggaaattctgagatcaactgaattcaaagcatgaggagcaccaaaaagaacatggattcattgtgaagtgtagccaaaataaaaatgaaatgaataccccctannaaaaaaaaaa

SEQ ID NO: 702 - DNA, 846 bp, Fusarium venenatum
  misc_feature (1)...(846): n = A,T,C or G
cgcaccattgaaantcggtccttacttttgtggtataaaaccagacatgtgcgaagcaacttctcttttcacccacaaaattctcgagcacactagatggttcggtgaaccaccttgcggaagaaaacagctatcaattgcgagagaaccagttgctaaccatgttgcttgcaatgttaccagccaggttacctgtgccaaaggcgcttccagcaatgctggangcgttgctgaacttgtcgcaccgagagaagccagggtgttcatgattgtaagaacaagggcgatgacaacgagaggcagccataggaactgtagtcgcacgagagcaagaatacccatnagaacccacagcataggctggatatacagagcgagccacaaaaaccgctgtccgtanggttgatggtcttggttccaggctcactgctctcaaacacccactgcgactcgcccgactgggcatcaacctcgttccacnaacgcagaccaacgagacaacaaccagcaatgttcttgatgtagtaaaagtcgccggcgaagaaaaaaatggtaatgatgaaaatcatgatcatgctttgtatgatccacaggccgagaaagtagataaggacacttgatattctgaagccgaggaaagtgaggagcgtaatgggatgcgcgctgaggcgccagctaagagcgcccggcgcggcgggctgtggttgcgtggcatccatgatagatggaataagttgcagatgttcaggaattcgtcagggtatctcgatttctctccgtttcaagggaaccgtagtcgtggagaaaaattgccaaactagaaaaggagcgttgtttcgattcttc

SEQ ID NO: 703 - DNA, 1149 bp, Fusarium venenatum
  misc_feature (1)...(1149): n = A,T,C or G
catcaaaggggaaaacgttacctatcaactctccttcctataaagctaactggctcctcctctgtttttgtaaaagattctgaaacctaatccaagttattgtagtacctatagaacaaacactccctttttccaatctcattccttgtctatccttgtttagctttatttactatttttcgacacaaacaccaacacaaatagacatcatggctgaggctcagttgaacgatttcccttcgcttttctccctcaaaggcaaggtcgctgtcgttaccggtggctctcgtggtctaggtcttcacgcagcttcggctttcctacaagcaggcgcatcaaaagtcttcatctcatcccgcaaggcctccgcctgtgaggaagcttgcaaggctctcaatgcgcttcccaacctttcacccggcgctatcgccatctcagtccctgccgactcctccaagttcgaaggcgtananagtctgctcgcgcaggtcaagaagcacactgatcgcgtggatatcctctttgccaacgctggcgcgacatggggcgagtcttttgatacgcccctgactctgcctttgccaaggtcatggatctcaacgtcaaggctgttttcaacaccatccgtctcttcacaccaatgctcgagaagagcgcatccatccaggaccccagccgcgtcatcatcacagctagtgttgcaggactcgctgtcggcaccattggaaagcagggcacttacggttactccgccagcaaggctgccgtgctacatctcggacgcaacctggctatggagctgggaccccgacacatcaccgtcaactccatctgccctggtttcttccccagcaagatgtccaacggactgctggagatgtcgggtggtgccgaccagtttgccgcttccaaccccatgcgcagacttggtcagcctgaggatattgctggtgtcgttgtttatttggctagtcgggcccggatcgcatgtcaacggcgagacggttgctattgatggtggtgccctgtggcaacgtggagagctcatgattgcggagaaggccaagctataagtgttttcggcgaacaatttattataaaggcaaccactaatttatagcatttgaatcgaaatacaatatcatatgt

SEQ ID NO: 704 - DNA, 742 bp, Fusarium venenatum
  misc_feature (1)...(742): n = A,T,C or G
ggtcgctcccatttccgatatccacggcgcccctcataaaaatcatccaaaatggctgctcttatcaaggctgcgaacgccaagatccggtccaacccggtatctgactacatttgctcgacccacttctggggccctgtctccaactttggtatccctctggctgccatcatggacacacagaagagccccgagttgatctcgggacagatgactggtgctcttatcatctatgccggtacctttatgcgatactctctcgctgtcacccccagaaactaccttctcttcgcctgtcacttcgtcaacgctggtgctcagctcacccaaggataccgatacctgaactaccactactggggcggaaaggagaacatgcccaaggagcagctggtgcaagcggctgaagctgccaagggcaaggtagagaagccacggagaaagttcagaacgctgtcagtaaataaagaagatgctagacagacggccactgggcggatcggtatatcgggctgtaagccgtccatataatgggancgccccccggttggggttcgggattccgaaaatttcatcancacacaactaccgcaccatgactttgtncctttacaataatttgttcctccatcgtctagaattggcactctgaaaccgggtactgcagtacttgtgccggaaaaagtgctggaaggatcaaattgganaccnaatcatccaaatggttaaacaaaatatntct

SEQ ID NO: 705 - DNA, 408 bp, Fusarium venenatum
  misc_feature (1)...(408): n = A,T,C or G
cgaggatggccctcanntgtttcacgctgagcccagtggtaccttctaccgctacgacgccaaggccatcggttntggctcagaaggtgcacaggctgagctccagaacgaataccacaagtctttgactctcacagatgcagagactcttgttctcaaaacattgaagcaggtgatggagganaagttggacgccaagaacgtacagttggctagcgtaaccaaggagaagggcttcagaatatacacagacgaggagatggccgcagtcgtggagcggctgccagccaactaaggagatgttacccacgaatcaagagaaattacgaatagacacaaaggcacccaagttgggggcattaacggtattaatacaatgatccgaaacatgtttgnaggaaaaaaaaa

SEQ ID NO: 706 - DNA, 253 bp, Fusarium venenatum
  misc_feature (1)...(253): n = A,T,C or G
tgacaagatccccgttcttatctacgctggtgatgctgacttcatctgcaactggctcggaaaccaggcctggaccgataagcttcagtggtctggccagaaggacttcagccacgccgacctcaagccttttgagcacgccggcaaggagtacggcaaggtcaagtccagcggcaactttacctttatgcagatctacggtgctggccacatggttcccatggaccagcccgaggcttnttctgacttcttc

SEQ ID NO: 707 - DNA, 535 bp, Fusarium venenatum
  misc_feature (1)...(535): n = A,T,C or G
caaaatggaggcatcggctctcaaagcatgggagttggacaacaatgtccagttagttgaccccaaacgcgacgctntctacaacttcgatgccgatgctcaaaaggtcatcaataaggaacaaccgnggaagcaagatcccagtcacttcaagcatgtacnaataagtgccaccgccctcataaaaatgaccatgcatgcccgctccggcggcaatctcgaggtcatgggcttaatgcaaggctacacccaaggcgacnntttcatcgtcaccgacgcattccgacttnctgtcgaaggaacagagactcgagtcaacgcccaagacgaagcgaacgaatntttggcgaatatntaacctatgccgacccaagggcccaagaaaacgtnggggcttgtaccacagcacccggctntggntgtggtgagtgnatcacgggacctgaacctgcacacaattcaggatcctttnttgttgggggancacccgacgacattactnggnaaggtgaatnggcccttaaactcccgcgat

SEQ ID NO: 708 - DNA, 385 bp, Fusarium venenatum
  misc_feature (1)...(385): n = A,T,C or G
agcnngactgctgctgcggaaagcggcgacatgttactgagggccaatttcctccgccgagcattgcctaatgtgcccatatccggttattccgaagcgactcgcgcaatcattcagacttcagaacaaaatacccatactgntctcgttgaaggctatggtcttcgtgaatgtatgactacggagggtgtgattggcaccaaggcaagcaccaacaacgtcatggaatgtagggacgtgcttggtatcgaagctgcaagaacaacaatcgctgncgaaatggctctgtcatgggtgatatgaatattgatccccgccacatgcaacttcttggcgacgtgatgacctacaagggngagggtcttggcatcacacgtttcgggtt

SEQ ID NO: 709 - DNA, 547 bp, Fusarium venenatum
  misc_feature (1)...(547): n = A,T,C or G
ccctctgtttctacactgtcgcaacgcgtttgatgatttcgtcgagacaatgacctcatacatggagaagctaccccgcggtggattagtacacagctttgttggaagcgcatctcanatgganaaacttgtatccatgggtttcggagtgagcgtnaatggattcantttccagaccacanaaagtctagagatggtatccaanattcctctcgatgcgctacaactcgagacggatgccccgtggggtgaactcaagagcacatctgaagtantcaaacaatactgcgccaacgccaggcctctgccggcgtcgaagaagagggataagtgggatgttaagtgcatggttaaagagaggaatgagagttgcaccattgagagggttgctctgattgtggcggggttgaagggtgttgctgttgatgaagttgctgaagcggcgtggangaatagtgtgaggatgtttggacttgnacgacgatnaatgttcaagagtaaataatagttatacgaatgaagcgatcaantcgccaattttgttgag

SEQ ID NO: 710 - DNA, 533 bp, Fusarium venenatum
  misc_feature (1)...(533): n = A,T,C or G
naagaactaacagccncacccacncccatctccagacactttacatcatcagccgataactactactacatgatcaccatgatcgacaatgtcttccgatcagcagattgtcttcaccaaaaacgcccctgcggcgcttggcccctactctaaagccatcaaaaccccccacatgatctactgctctggtcagatccctctcactcctgagggcgagcttgttcagggtatcactgagcaaacccgtcaggcttgcaagaacgtccaggctgtcgtcgaggaggctggttcttctctttccaaggtcggcaaaactactggcttcatttctgacatggcctactttgctgagaatcaacacaaaatacgagaagtggttctctcacaagccagcccgtagctgtgttgctgttaanactctccccaanaacgtcgatgttgagggtgaggtcattgctcttcttaaaccccgaaatgattaaaagaaaagaagggtgatcatatagaacccaataaaagaaattatcccagtc

SEQ ID NO: 711 - DNA, 505 bp, Fusarium venenatum
  misc_feature (1)...(505): n = A,T,C or G
ctccacttgctttgcatttcgcccatttcaatccatctaccatcctcagccggccgagctcctgttttcgtccatcgtcaatttctcttctnnaaagtcgctcttttctgctctgttcccttgancccgacttggacctaagcatcgtcgttcctcttcacgattctcatctcgacaccgcctnttggnccccggaatctcgtttaatctctcctgtcgcgcgtcaaccacccgacaccactcacccggccgatcacgatgaattctcanggcaacaacgatgtctcccccgaggctatgcaatcgcnaattcagcaggctcgtcgcgaagccgaaactctgaaggaccgaattaagaggaagaaggatgaccttgccgacacaactcttcgcgcagtcgcgcaacaggcacatgagcctattcccaanaccagctcatgaaggctaagcgaacgctgaagggtcacttggccaagatttacgctatgcactggtcaacccgaca

SEQ ID NO: 712 - DNA, 556 bp, Fusarium venenatum
  misc_feature (1)...(556): n = A,T,C or G
caaggactgctgcacagttcaaactgactgtatgggattatgactttgcggacaagcccgactttttgggtggagccgacatcaatctcgagtctctggatccgttcagaccgtctgagactaaatatattctcgacggcaagtcgggaagcgtgcgcatccgacttctattccgacccgcctatgttcagcgagcacgtcagggcacatccacctttggcggcactttctcgtcagctcctgggcgtatcgtcactggtgtcgccggtgcacctatcaagggcggtgccgctgtggcgggagttgttggccacggcgttggtaggggtgcttcattcctccgtcgtggtatcttcaacaagaaggacaacaacaatgacgttatcgaagaagacaatgaaagttgttgagcctcaaggattaaaccctaatggtaacgcttgnggccaatggcggacttcgncgatcgcctgctattaacgaggaaggtacttcgaatggnaagtcgaacccctaccagcaatggncatgttangtccnaaaagttttggccagt

SEQ ID NO: 713 - DNA, 643 bp, Fusarium venenatum
  misc_feature (1)...(643): n = A,T,C or G
cactgacgacgacgattttaaacgaaacataccgagtacctaaactttctctcctttatcaaacccaaaagccctggatactgtataggtgacgctgtgaaccgtaaccctctttcagcctgaccccactacccgacactgagtcgagactcgctacgctattttcctgcttcaacaacatcagacgagaccgactctacaagaggaacaggacggttactcctcatcctcatttattttaatctttcccctcatcaaccttagcgatcaacaaccgtagacatgtggggttggttcggtggcgccgcggcccagaagcgcaaggatactcccaagaatgcgatcctcggtctgcgagcgcagcttgatatgctgcagaagcgcgagaggcatctccagaatcagattgatgagcaggatggcatcgcgcgcaagaacgtgagcacaaacaagaatgcggncaaggcggncttgaggcgcaagaagacacacgagcattcgctcgaccaaaccgtttcgcaaattggtactttggagcagcagatcaacgccatcgagtcggncaacatcaacaaggagacattgggccggcattgagcgacgccaacgcngnaatgaaacatatccacaagggtcntacang

SEQ ID NO: 714 - DNA, 590 bp, Fusarium venenatum
cctcccaggccgtcatcacgttaccgttgcagtcgcctttgccgagtcttgacagcctattcacaatgtctcaccagaagaacgagaaggaagtcggtgatgctcccaagagccaccgcatccgaattaccctgaccagccgaaaggtccagtctcttgagaaggtcagcgctgagcttattgagcgagctcgcagcaagggcctcaccattaagggccccgtgcgtctccccaccaagaacctcaagatcaccacccgaaagaccccttgtggtgaaggttccaagacttgggactcttacgagctccgcgtccacaagcgcctcatcgacctccacgcccccaccgaggttgtcaagtccgtcatcgtcaacatcgaggccggtgtcgaggttgaggtcaccatcgctgcttaaatgtggtcacggtcctaatcagtggtaaaaaagcccggtggtgtcctggcattgtgagggaagggaatgatgggaacatcaggatcttggcccgcaacaagagtggtggatataggatactcagtcatgattaatgaatatcttgagaaccgcgtgttctaccattcaaaactt

SEQ ID NO: 715 - DNA, 496 bp, Fusarium venenatum
  misc_feature (1)...(496): n = A,T,C or G
ngttgatgcttgtgagagaatctactgcgggctccttcggtgtttgaagttcaatccaacatccctgatcgtgacaaagttgcgaactggctcccgtgaagcgtctcgaagttcccaaccctttcaaagtactccgtcgatgagaagcgtcgtgttctcgaccgtcttatctggagttccagcttcgagtccttcttgtctaccaagtacccaacgacaagcgattcggtctcganggttgcgaaanccttgttcccggtatgaangccttatcgancgcagtgttgactaaggtgtcaaggatatcgtcatcggtatgccccancgtgggtcgtcctaaagtcctctccaacgtcgtcccgaaaagccaacgagtcaatcctcaacgaattcgcctggtaaatcctggtggtgaaggatgaaggctcctgggtgacttcaagttaccaaccccggtaatgaaactttcgagcggccccaaagcccttctgggaaa

SEQ ID NO: 716 - DNA, 586 bp, Fusarium venenatum
  misc_feature (1)...(586): n = A,T,C or G
ctgagtactaactgtaagaggtacctgacttccaggtcgactctcaccttttaccccatcttcatgacaaggtccctttaattaacccacatcccactctcatctttctttgcccataattctctaataatgcttcatgcaaatctaccattttcttaatctaagtatcttgtttattgattgaccattagaaacaacaggacgacagttagtcaaccagtaattgcacttctactacctgcgccgcatcttgtatcataccctcatcatggcaactgatcgcgtaaaagcctccgtcctacacggtgagaaggacctgcgcttggaagaccgtgaactccccaagccttccaacaacgaagttcaagtggccgtacaatctactggtctttgcggctcagatcttcactactacaaccactttcgcaatggcgatattatcgtgcgagagcctctcaccctcggtcatgagtctgcaggaacagtcgtagctgttggttcagaagtcacacacctcaagcccggtgaccatgttgcccttgaagttggtcttccttgcnaaacctgcgaactctgtggcgaaggg

SEQ ID NO: 717 - DNA, 559 bp, Fusarium venenatum
  misc_feature (1)...(559): n = A,T,C or G
ccaaacccatccgacgcggaatcattcccaattgcggcaccaccagggaacgaaatcatgtcgcacatcgactacgccctttacnaaagccccgtgggctatgccatcttcaaggtggtgcatcagcaggatgcggttggcttgaagttgaaggatacccaggctgctactaacgatctcgccaagtttggcaagatggttcaactgaccaacttcagccctttcaggggtcacgtcgaggctcttganaacatcaacctcgtcactgagggtatcgtctctgactacctcaagtctgtcctcgaactcaaccttccccagacgagcggnaagaaaccaaggtcgtcctcggtgtttccganaanaacctcgctggtgcgatcaangctnaattccccggcctcgagtgcgaaaccgccgatcttttgacatngttggcgacgtgattcgcggtatccgactgcccccgataacttntcggnggactcaaataccgngatgtcaaaaangccggtctgggtatggtcacccctactcccggccaaggnaaanttaaggt

SEQ ID NO: 718 - DNA, 643 bp, Fusarium venenatum
  misc_feature (1)...(643): n = A,T,C or G
gttccgaataatgggacgaccaaacccccaagttgttctgggccctgttgactgctctgtcgcccttgttgtttgcgatatggccagagctgatgctcccgtcatctatgtctcggactctttcactgatcttaccggatactcttctcgtgaagctgtaggccgaaactgccgcttcctacaagcaccacctggacaagagcgtcgctccgataggaagggcgcagacaaggtcgcctcgcatcgcatgcgtcaggccctcatggctggaatggagattcagacttctgtcaccaactacaaaaaatacggacagccattcaacaatctcctgaccatcattccagtccctgacgacaacagtggcacctgtcactgcattggctttctatgcgagatggattaaatacagctattcataatagctgcgatattcgacgacacgacgatatgacacaatatgacncttgaagctacncctacgttttttggctntacacgatgcttggaaggnggccctcgccaacaacatantttcaaattgcagtccgaggccaactnatttactanttttcgggttcaancngccttggttntnatttatccggatacngttaagggttccaatttttacaaacccttn

SEQ ID NO: 719 - DNA, 416 bp, Fusarium venenatum
  misc_feature (1)...(416): n = A,T,C or G
gcaacaagccacccggagagcttccccgtgaatgccctggttcctatcaagggtacaccacttggtgacagacccgtggtggagtttacgagcatgctacgcaccatcgcgacggcgcgcatcatcatgccctctaccatcatccgnatcgcagcgggtcgcaagaccatgtcagaggagaagcaagcgctgtgctttcatggcaggtgccaacgccatntttacgggagaaaagatgctcacgaccgattgtaatggctgggatgaggattcacccatgtttgggtcgatggggtttggagcctttgaaggccttttgaaaaagtccntttaagccttgcacccganacgaggggttcttnanaataatgatttcatnnaaaaaattataaaatcggaaaatccgntngtcgttt

SEQ ID NO: 720 - DNA, 644 bp, Fusarium venenatum
  misc_feature (1)...(644): n = A,T,C or G
aaagccgaagacggcatccccatcactacctctacaaccaatttcttccaagaaagaactctcgctcagtcgtcgcaatgactgctatcgagagttttgataacatctacttggatctctccaaggagagcggaaagtgcagatttgccgagaccggtttcggatggaagcctgttggcggcggcgataccttcaccctcgatcacaacaacatcgcctctgcgcaatggagtcgcgccgccaaggggtacgagatcaagattgtccagcgttcaaaatcaggcatcatccagctcgatggattccagcaggaagactacgatcgacttgccaaggtgttcaagaactggtatagcactgccctagagagcaaggagcatgctctgcgcggatggaattggggcaaggctgaattctccaaatccgagcttacctttagcgtccaaaaccgacctgctttcgagctaacatattcggaaatcggcaacaccaaacctggctgggtccaaatgangtttgcagtcganatggctcctgccaaaatcgggtgctaatgcccaacntggtggcgcccggtccaanggctccaaaactgccgccgggccggggatnanccttgtccaagatgcgaantcctacaatcc

SEQ ID NO: 721 - DNA, 632 bp, Fusarium venenatum
  misc_feature (1)...(632): n = A,T,C or G
cggtgaggcacgtaagccttngccgcgcgacgtctggaagctgtttatcttcaagggccaagacattgtcgacacgatagagctgagcgcgaggagttgctggctcgtcggacgggaaatgtcggttgtcgatttgcccgcagagcacccaagtatcagcaagcagcacgccgtgatccagttccgctatgttgagaagaggaatgagtttggcgataagatcggcaaggtcaagccgtatcttatcgatcttgagagtgccaatggaaccaagttgaatgatggcaagattgccgacagtagatatctggagttgagggacaaggatatgattcaattcgggcacagcactcnagaatatgtcgtcatgcttgcaccacgggattgggcatcaatccaaaaataaccaaaacgattggcgggccaacctaccaggcctacgcaagcagaaccttatnatgggactgaccacctgaagaagaatcgatgcccaaaagagcctttttggaatcgatattggctttttnattacagacgcccagagtgnctgattatgtgacttaacttaagantttggataanggactcacaanggaatttcggcngantcgtaaaaanccagaacaataaag

SEQ ID NO: 722 - DNA, 638 bp, Fusarium venenatum
  misc_feature (1)...(638): n = A,T,C or G
attcttcttctctctacacaaaccaatcacactaccgcaaaaatggttcagcaaatccccaaggccaaccacattctcgacctccttagcctcaagggcaaggttgtcgtcgtcaccggcgcttccggtccccgaggcatgggtatcgaggccgcccgaggtgctgctgagatgggtgccgacgtcgccatcacctacgcttcccgcaaggagggcgccgacaagaacgtcgaggagctcgtcaaggagtacggtgtcaaggccaaggcctacaagctcaacgctgccgactacaacgatgttgagcgatttgttggtgaggttgtcaaggactttggcaagattgacggtttcgtcgccaacgctggtgctaccgccgatgctggtgtcattgacggctccgctgccgactgggaccacgttatccagatcgacctcaacggtaccgctactgcgccaaggccgtcggtgctntnttccgaaagcanggccacggntctttcgttatcaccgncttcatgttccggcacatcgccaacttncctnaagancagacctnttacaacgtggccaaggccggctgnatccacatggttcgntttnttcgccaacnagtgggcgccacttttgcccgggtt

SEQ ID NO: 723 - DNA, 711 bp, Fusarium venenatum
  misc_feature (1)...(711): n = A,T,C or G
tccgaaaaactgccaccttccaacatcgacccttccgacgagcagcaaataccgccacgatgttgattcccaaggccgaccgcaagaagatccacgagtacctcttccgtgagggtgtcctcgtcgcccagaaggacttcaaccttcccaagcatcccgatatcgacaccaagaacctgttcgttatcaaggctctgcagtcgctcaactctcgcggctatgtcaagactcagttctcttggcaatactactactacaccctgacccccgagggtctcgactacctccgcgagtggcttcacctccccgctgagatcgttcccgctacccacatcaagcaacaacgatcgcacgctcctccccgtggcatgctcggtgagggcgagcgcgagcgacgacctttcggccgtggccgtggtggtgaccgangtgaccgtgagggtggataccgacnaanggatgctggcgagggcaaggagggtggtgctcccggcgaagttcgctcctcanttccgtggtggatttggccgtggccgtggtgctgctccccttcttaaacgaaaccattttatcatctagggggtcataaatgaaaaacatggcgaaaggtatcggcattnctcataaaaatggagggcaatttctaccatgggtttcgctcatgtgacaagggttgcgtgggggatccntggaattttaagggtttaaaac

SEQ ID NO: 724 - DNA, 983 bp, Fusarium venenatum
  misc_feature (1)...(983): n = A,T,C or G
cgggtagttcccgggcgttgttgtatctgtagctatttaaacggcgccattgcccatctcctgtctctacatactccaaaccatcccagcaagtttgatatcttgtcttcatcatgtcagccaaactccacaccgtgcctttcctcatcaatggcagcaaccacatcagcgaaaacaccgctgatgtcgtttccccctcaagcggngaggttactcaccgttacagcagcgccaatgtcaaggatgccaacgctgcagtagatgctgccactgaggctttcaagtcgtggcgcaagacgaggccctcggagcgtcgtgatcgacgctcctcaaggctgctgcaatcatggaaaagcggcaagatgagctacgcgagtacgccatgacagagtgcggcagtgatgctgcctgggccagctttgatatcaacactggcattagccatatcaaggagattgctggtccgtgtaagaacacttgagggttcaatccccactgtttcggatcccaacaacaaccgctctcgtcttgagagaaccatatggtgtcgttgtaaccattgccccctggaatgcgccttatatcctgggaacaagatcccggtctcttcctatcgctgcttggaaacaccggtgttttcaangntagcgagagntgccttcgaacattgtgggcaattggcgatattttagaagaagcaagggttcccgatggcgttcttnacggtatctttcatgagcgagcaacgccggatntggcacgacagntnttattgagcacccttcaagtcaagaaaaataactttactggnagcacttcaagttggncnggttatcgggaagaatggtggggagaacctggagcctggtattctaaancttggnggnaagggttctgggaattgttngggaggaagccgactttaacnttgccggttttaaaggggacgcttnggngcctttaattaaatnttgggcaaagtt

SEQ ID NO: 725 - DNA, 595 bp, Fusarium venenatum
  misc_feature (1)...(595): n = A,T,C or G
gctccatggtggacacccggtacagcttctgggtatcatgctttgacttatggtcatcttcttggagagctcgttcgtcgagtttctggcaaatcgctgcgtgagtttgtcgccaccgagatctcaggtcctttggacgccgacttccagatcggcgcctcgaaggagacgttggaccgggttacccccatcgtacctccggacgcttcgggtatctcaatcgattttgaggctgggtctgtacaagcaagaacattgctcaacccgcccgtagatcccaactgcgcaaacagtgaaggctggaggaacgcagaaataggctctgccaacggtcacggcaactcacgatcgctcgcacgtatcctgtctgttgttactttgggaggtgaaactggaggcaagcgcatcttgaangaagaaacggtcaatttgatctttgaagaacagcaatccgggactgacttggttttgcaaatgcctttcanaattggaattgggttcggattgacccatgtgtcgcactagactggctcccaaaaagcaaggttncttttgggggtggctggggaagttcttttattgtcatggatcttga

SEQ ID NO: 726 - DNA, 578 bp, Fusarium venenatum
ccttttccttctttcgcaccaattcaatccagcgaaactatagtcgctgtctcccacgcacgatcagactcgaagttctggttggcacttgcgacatcttcactgagaaacgacctacctcgatcaacagccgcgaatcgatacactctattcaaaatgaatgcgccagagcctgagcagacccccttcgaggctgtcagtgtccacacctcaaggatccagcgaaaataccaagctttgctagaccagtcaacccctttcgttctctatagatgggtcggcacagttgtctgcctcgtgcttttcttcctgcgaatcttggttgcgcagggctggtacatcgttgcctatgcgctcggcatctaccttctgaatctgtttcttgctttcctgcagcccaaattcgatccctccaatgaagaagccgacaatgatatggaggacggctctgtaggcaccctgcctaccaagtccgacgaagagtcaagcccttcatccgccgacttcccgagttcaagttctggtactgggccacccgagccattgtcatcggctttacctgcagttggttcgaaggt

SEQ ID NO: 727 - DNA, 653 bp, Fusarium venenatum
  misc_feature (1)...(653): n = A,T,C or G
accttcaccaccgaactcgaagtttcagtctccgcccaacttgcggttaaattgattgatttctcttgttctcgtcgactctaaacaaaccacattcaaaatgaagcacctcgcagcttaccttctgctcagccttggaggcaacacctccccctctgccgctgatatcaaggccgtccttgagtccgttggcattgaggctgactctggtcgcttggatactctgatttccgagcttgagggcaaggacattcagcagctcatcgctgagggttccgagaagcttgcttccgttccttctggtggtgccggtgctgccgctggtggtgccgccgccgctggtggtgccgccgaggaggccaaggaggaggagaaggaagaggagaaggaggagtccgacgaggatatgggcttcggtctcttcgactaagcgatctctacccagagatttgcaaagtaacgatacctcacgaatttcgaagatgccacgcacgggttgttcaccagttcttacatgtcttttgcgtggatggattggccgctcatggctggattgggtctctctaaggatgggataacatacnggtatggaaattaaaaaaaaggcggtcggctcttcgaaaaanattttttctcntatttttntatatttt

SEQ ID NO: 728 - DNA, 639 bp, Fusarium venenatum
  misc_feature (1)...(639): n = A,T,C or G
cgactcgacttcgtgcagactttacaatctcccacccgcacgccaaaatccattcacaatgtctcacgccgagctcgcttcgtcctacgcggccctgatcctcgccgacgacggtcttgagatcaccgccgacaagctccagaccctcatcaaggccgctaaggtcgaggaggttgagcccatctggacttccatcttcgccaaggctctcgagggcaaggatgtcaaggaccttctcgtgaacgtcggctccggtggcgctgctgcccctgccgccggtggtgccgccgctgctggtggtgccgctgacgaggctgctcctgaggaggccaaggaggaggagaaggaggagtctgacgaggatatgggcttcggtctcttcgactaagaagttacgccgctacgactgtttccttgttctttgtacttcgactgcatggcttcggggtttccaatcaatcgatcataaaggatggaatgcgggcactataccctgcgccctggacagaagtccgcttntttcatacnacgctatgatgaatgcgctcaacggagtttcgcggagggagaattggtcaattcaaaggctntgataaaaaaaaagtcccgccatgggtggtttgagttccnaaaaaaaaa

SEQ ID NO: 729 - DNA, 632 bp, Fusarium venenatum
  misc_feature (1)...(632): n = A,T,C or G
gccctttccaaattccctaaaattagagctatcgagagagagctcgagaacccagctctcaacaccgaggaccgccaaaagaaggacgaagagctgcagcaattggccaaccaggccacgtcattcatgcaactggctaatgagacacttgaaatgatgaagctcttcactgacgccatgagcgaggcctttactatgcctgagattgtgtctcgtctcgcgagcatgcttaactacaacctggaaacacttgccggtaagaaggccgcagccgaactcagtgttagtaacagggacaagtaccacttccgccctattcagatcatctcggatatcgtggacatttacctcaatctcggtacctcgtctgtcttcatcgacgccgtagctgcggatggtcgttcttacaagcctgaagtgctcgagcgtgtctcacgcatcctcacatcaaagaaccaagaaggacccggctgtaattgctcgctgggacaaagctgaaagtcaagtttgaggaggcaaagacaattctagatnaggccgaactgggaccntggtgatatcccggccgagttcgaggatccatcatgggagacctcatgaagggttctgtcctgctgccaacaagcacattg

SEQ ID NO: 730 - DNA, 617 bp, Fusarium venenatum
  misc_feature (1)...(617): n = A,T,C or G
ggaaaggacggccgaacaatcctctttgttggtgacggatctttccaattgactgcccaggagctgagcaccatgatccgacatggcctcaagcccacgattttcgttatctgcaacgatggtttcactattgagcgattcattcacggcatggatgctgtctacaacgacattaacaactggaagtacaaggacctcgtcagcgttttcggtggtgagaagacttgcaagacgttccagatcaagaccaagaacgagctcaacgagctacttaccaacaaggagttcaacgctgctgagtgcttacaatttgtcgagctctatatgcccagggaagacgctcctcgcgctctggttttgaccgccgaggccagcgccaggaacaacgccaagaagcactaaatgcttacaacaattgatagacgatatattgggaagtgtgttctcagtcaacagatattcaggatgtgtctggctgcatttggcacactggttgggggttcctgtttggctaattataacggtttaaatggtttacactatagaatgggcacgattctttatgttttatgtattttcaattgaaaagcgatttctcataatataattcnattctt

SEQ ID NO: 731 - DNA, 495 bp, Fusarium venenatum
  misc_feature (1)...(495): n = A,T,C or G
ctctcgatggccgacttctctcagttacacaggcagtcaacaagcaagaggccaccagccttgccgagaactctcttgccaagcgcaatgaaaaggacaagcgtaagcttttcctgctgggcgagggtgttatcgacaagaactcgcctctgttcaacctcctctcagagcctgagcatcgtatgcgacaggctagtgctgctcaacgtaggaagcttgtacaaggcaaccccagtcttcacttgagtttaactcgactggccctgcgtaacattccccgcaacatggattcgaaggatcttaaggagcttgcgcgaaaggctgttgtcggattcgccagggatgtcaaggctggactccgacaacccctttcaaaggaggagaacgcccgagacggaaaggatccaaggagaaagaacatgaacgcaggccaagggtaagggtattattcgccangccaagattgtgttcgagagtggagaaggacagaagatc

SEQ ID NO: 732 - DNA, 620 bp, Fusarium venenatum
  misc_feature (1)...(620): n = A,T,C or G
cagcggtgccgtcaactggggtgccaagatgcgaaccgaccgtgttcttgagcaatacgatgaggtcacggatttcacattcaatganaagaatggaatcgactgcagcttcacacttgagtttgactcggccattcccaaaatccttatgctcaaccttgtccaagatgctgtcaagaagaccgtgatccaagagatctctggtgtcagatcctgcgacttccatgaggagaaaaaggacaataagacgatcagagtcatccacacagaaggtgtcaacttgcaggctatgcagcgatacagcgatttcatcgaccccaatcgtatccagaccaacgacatcgcagctgtcttggaggtttacggtgtcgaggcaactcgacanaacattgtgcaagagctggctggcgtcttcggctttacggnattaaggncgacaaccgccacttgaacctgatcggtgaccacatgacaangaacggnggtttcacaccattcaacccgaatgggtctnaagggcaacgtcangtccgtttaccaanatgaatttcnanaccacattgggattcctcaaggatgctgtgttggatnggngactgggatatctctttacccctacg

SEQ ID NO: 733 - DNA, 521 bp, Fusarium venenatum
  misc_feature (1)...(521): n = A,T,C or G
aattgacccaaaaacaccccttgaggagtcaattggtgcgctcgatgagattcgcaagcagaataaaaccaagtacatcggcttgtcagagtgctctgctgcaactcttcgaaaggccaactctattgccaagatcgatgccctccaggccgagtactctgcgtttgaaacactgcacgaaaccgatggcctcatcgacactgctagagaattgggcgttgcatatgttgcctatagccccctcggtcatggctggctagttgatgatttcccttaccagagtcctgaagatttctctgctaatgactttcgtcgcggatcgccaaaattccaaggtgacaacttctatcataacaaagaagatcgttgaggagatcaagaagcttgtgnccgaaaangtgtcacatggcccaaatgcacttcatgggtagcggttaaggattatgctttcnaggacacgaancttganccctgaacaaaatttgctttaacatgttgagtgaccacaaaaaaaaaggatt

SEQ ID NO: 734 - DNA, 974 bp, Fusarium venenatum
  misc_feature (1)...(974): n = A,T,C or G
cgccaatccacggtcaactacacaacaccttgtcgcctttaacgcacaaccagcgacaagatgcgaacctacgaggacaccttctccggcgcgagaatctaccctggcaagggtaagctctacgtccgtggcgacagcaagatctttccgattccagaacgggcaagtcggagtctctcttcctccaaaggaagaacccccgccgtatcgcatggaccgtcctctaccgccgacagcaccgaaagggtatctctgagganggttgccaagaagcgaaccccgccgcactgtcaaggctaagcgtggtatcgttggtgcttctcttcgacgtgatcaaaggagaagcgcaacattccgacccganggcccgttccgctgcccgcgcccaaggccatcaaaggagagcaaaggagaanaancaggccganggctgctaccaagaagtccgagaaggctaagctcgctgcccaggcctncaagggccaagctgtncgaacaggtcaacaagcagggtgccaagggctttngnttcccaaggtccaggccaagacccgttaaattaaggaatggaacttgagcgaagatgaaaatgggagaatggaagtccgtgggttcttgtgtctttgtccggccggttcttctacaatctcgggtgcatggaatgncaatagggtgcattgatagttgaaatgcaaaatggtcaaacaaacaaacagacaacgcatctgattcttgtcgtgacgaacaagggatgtgcagatatgcggtggctggataaatacctcacgggcgttattcaggaaactagcaacttancttgttagataacgacacaatgccttacgatgcaagaccagacgtcacgggaatcgcttcaattagattgtgttcaatggtattcatgtantttgtctctattctatngntgtctcatacgctcgtgaaaaaaaaanaaaaaaaaanaaaaattcctg

SEQ ID NO: 735 - DNA, 632 bp, Fusarium venenatum
  misc_feature (1)...(632): n = A,T,C or G
tgccctcgtagtcaacatggggacagtcactccggatggcctgaagaactacctccaagccatcaaggcatacaacgaagctgaccgacctatagttcttgatcccgttggtgccggtgccactgtcgttcgtcgcaacgccgtcaaaactcttcttgaagctggccatttcactatcatcaagggtaatgagggcgagatccaaactatcgccggtgcgaccatcacccaacgtggagttgactccacatcatcccttagttttgcccagaaagcttctctcgtgcgctccgtcgccttacaccgacgaaacgtcgttatcctcacgggcgctatcgaccttataagcgatggaacccgcactctggcaattagcaacgggcattcttatctttggtgaaagtcacaggtactgggtgcactctgggcaccacaagtcagcgctatggttgctgcatatggcgccgatccttttnttgccgccgtggcaggaaccgncatgtttggacttggcttgccgaacttgcttttcaagaaacctgagggtcgtnggccgggggactttcgtaccgggctttcttcgatgagttgtaccgccctttagggaagtnaacttggccaacaagtgactt

SEQ ID NO: 736 - DNA, 533 bp, Fusarium venenatum
  misc_feature (1)...(533): n = A,T,C or G
ggtgattcgatcgctatatttccacgctttcatataaacacgacatcatgtctgcccagaactcggccggcatcaaacagctcctcgacgctgagcaagatgcttccaagattgtccagaaggcccgagagtaccgcaccaagcgcgtcagggaagctcgtgatgaagccaagcaagagatagccgactacaaggcccagaaggaggaggaatacaagaagttcgaggccgagcacagcaagggcaacgagcaggccgaggccgaagccaacaaggacgctgagactcaaatcaagggcattcaggaggctggtaagaagggtcaagctggggttatcaagaaccttctcagcgctgttttcgatgtcaaccccgttcctcccaccaacaccaagtcttgagcggtttcccggcggagtcacggtgtttataatcacgaaccgttgttagctcctgcactttggaagacaattagattaggtacgaggaggatttgttataagaanagcaagaccatgcgttcttaaaaaaaa

SEQ ID NO: 737 - DNA, 688 bp, Fusarium venenatum
  misc_feature (1)...(688): n = A,T,C or G
gtcctgtcgttcatctccactattcaaaagttacggaatctatcttatcatccaagcccaaacccgataagacgaaagacacaccaccaaaaacaaatccctccactctccggtccggccttcgctcggagctcgccatcttcccttccgttagctaatctcgacttgacttgttcttctgtcaactcgcgacaactctccactcaacctcgtcttcttgttcattcttcctgtctttgctcctcttcatccggtcgccagtacaatcgtcgcaatgtctgctgatcagcccctccccttcatgtaccagttcgccgcaggcgccattgctggtgtctcggagattcttggtgatgtaccctctttgacgttgtcaagacccgagtccaactgcagactggttccggcgccaccgctgagtacaatggcatgcttgattgctttccgcaagatcatcaagcaggaagggtttctcccgactctaccggggtatctccgcccccatccttatggaggctcctaagcgagctaccaagttcgctgcaacgatgaatggggcaaggtctaccgaaagatgtttggcattggaaaanatgaaccagcctntttcagtcctcaccggtgccactgntggtgccaccgagtctttcgcgtcgntccctttgagctcggnaagattcgtctgcaa

SEQ ID NO: 738 - DNA, 589 bp, Fusarium venenatum
  misc_feature (1)...(589): n = A,T,C or G
ctgaagaagcccgagatctggaagctcgttgagaacgccgaggtctactacgttggtggtttccacttcactgtctgccctcctgccattatggagctcgccaagcaggctgctaagaacaacaagccattcgtcctctcgctctctgctcccttcattccccaattcttcaaggaggtcgtcgatgccagcgccccctactgggattacatcnttggtaacgagactgangctgccgcctacgccgagtcccacgaactccccagcaaggancctaaggatgttgccaagcaccttgccaaccttcccaaggagaacagccaganaaagcgaattgccatcatcaccagggcaccgacctacctggtcgctatccanggtgaggatgagatcaaggaatccccgtccacccattganactgagaagatcaatgacacaacggtgccgtgatgcctttgctggtngtctcctggcaggtttctccaagacaanctctcganacancattgacttggacaatgctcctctttgacatccagaatcgaacttctacctcccancaactacangcgctaattgtacacctct

SEQ ID NO: 739 - DNA, 694 bp, Fusarium venenatum
  misc_feature (1)...(694): n = A,T,C or G
gcaggaaatagtagacggatatcaagttgaggtgcctgattactgggcttgacttcaacccctgggagtttcctcgacacgacgttgttgtcgatattcaattcnttggtcatgttagaaagaccacgggttccaacggtaagaacgttgccatttgggaaggtggcgaaatcgtccaagccgtcgcctacgacgtccctatcccaagctatgacacaaccaacacaaacaanctgagactccggtccaattaaagcttctggtgggagaantttgacttccaaaaaattcaacaatggcgattacgaaaagctccgttgccgttnaacaancgggctgagaccatcagcgccgtactgtatcccaatgataacctaaattcgccggaaaggagccttcgtcctgaagcaacaagtacttccggggttgcgggcctcccttatacgataaccgtccggccgctttaaagaaatccaaaccgcccttggagggnaatttcccgaccaaaggttgggccaattcaactcaaatgacaaccaacccaangctnggccaattgtccaanttgcaaccgaatcctcanccgacaattgagcaatcctcnaatngggaatttgggcctgggganaatcgtcntcaaagaacttttaanctacaaccaaccaaaactggttttgccctgnaaactcctggg

SEQ ID NO: 740 - DNA, 619 bp, Fusarium venenatum
  misc_feature (1)...(619): n = A,T,C or G
cgattatcgatgactgaagttggcagcaccaatccccttcgagccctggatcttttttttttcacctcataattataaacatggaggaagagcgtctctggaagttccgaaggcccgaatggcttaacagcgtctgggctcgcaacgctggtgtctatggcgcgggagctattttctccgtcgctttctacattatgctcgactccgccgtctggtccaaatctccacgcaacggctctgatatccacgtcaagtttgttgactggctgcccttcatcttctccagctngggcatgctcatcatcaattcggtcganaancaacgtttaagcgccgattctttcagttatagtggaaatggggtggcatggaaggctcgcgtcgtcttgttccttggctttgcanccctactggtggaatggctggcggtgttaccgtctttgttctcaagtttattgtcccaagtgtctcaatgcctgcgttgggtatgggtattgaaaacttactcaacaaccctttggtgggcgtgagttctgtccttctttggatcagcccacaaacatggaanaaaaaatactcctacaacctttccctgtaaacaccataaatcgccccaatc

SEQ ID NO: 741 - DNA, 575 bp, Fusarium venenatum
  misc_feature (1)...(575): n = A,T,C or G
catcgggcctgttctggcctcgcctgatctggcaggcaagcttatgcctgccttgatcgaccgatacaaccgtgtatcggatcagtcacgggagctgttccctctgctagagtgcctctcttatgtggctatggcactcggtgatgcgttcgctccctacgctgagcctatcttcctgcgatgcgtcaacatcatccacacgaaccttgagcagacattggctgctgccaacaacccggtactcgaccagcccgataaggacttcctcgttacaagtctggatctgctcagtgcaatcatccaggctcttaatgatgacaagtccgccgctttggtcaagaactctcagcaatccttctttgagcttctcagcttgtgtatggaagacctactgatgaagtccgacagtctgcctatgcgttgttgggagactgcgccagatatgtctatcctttattacagcaatacctcccccaaatccttaccatcttgctcaagcagctgggacatggatagtgttcttgatgaanatatggatagcggtttcggtgttgtcaaaacgcttgctggtcngt

SEQ ID NO: 742 - DNA, 650 bp, Fusarium venenatum
  misc_feature (1)...(650): n = A,T,C or G
gcatggtgtcaacaaagtccgtctccagtcccagagcangggaggcgccgttatcgataccaagtccctctcacttcacgacgatgccgcccatcacctcgacccctcatactgtggtggctgctacggtgctcaatcccccgccaatggtcaaaaggcaggctgttgtcagacttgtgacnaagtccgngaagcttatgctcaggcctcgtgggcctttggtcgcggcgagggtgttgagcagtgtgagcgcnancactatggcgagaagttggatgcgcaacgtgaggagggctgccgnattgagggaggtctacgcgtgaacaaggtcattggtaacttccatttcgctcccggacnaagtttcagcagcggtaacatgcacgttcacgatcttaanaactactgggatgtgcccaagggtttctcgcacgacttcactcaccatgtccactccctccgtnttggccctcaactccccgaccacattgctcgcaaggtcggcacaanaacacgctntgaccaaccaccaccaaaattcttttcgacgacactacccaagaaaacccacgaccccactacaantttatgtctttggcaaaaatgggcccactttatatcttcctnntgggggggataacaagggcatn

SEQ ID NO: 743 - DNA, 525 bp, Fusarium venenatum
  misc_feature (1)...(525): n = A,T,C or G
agcacaagttccctcaaattaagcctcatcccttcaacaaagtcttccgaaaggcggacgccaacgccattgacctcattgctcgcctgctcgagtacacccccaccgagcgacaatctgcaattgatgctatggttcaccccttcttcgacgagcttcgtgaccccaacaccaagcttcccgactcgcgacacggaactggccagctccgtgagctccccgctctctttgacttcactcgtcacgaactctcaatcgctcctagcctgaaccagaagcttgtcccagcacatattcgccccgttctcgcatcgcaaggccttgatatcgaccacttcacacccttgacggagcaggagatgatggcgaaactggattgagccggcctcgcgtcgaggcaaagggtagttggcatatgcttttacccttctccggctctccgtggctctnggaagagacctgcctcgtccactcccagaccganctgacaaaagtggctgggagcaagggccaacaaanctgaca

SEQ ID NO: 744 - DNA, 621 bp, Fusarium venenatum
  misc_feature (1)...(621): n = A,T,C or G
ctcgggcaaggttgacatcggcgccttcagaacctacccagccgactataagcccagcagcgctgtcacctcagatggcacccaagcagtacccctcgccaaggccgccgaattcggtgctcacgcaagccgatactacagcctagaagtctcccacttcaagagctctctcgactcccacctcctagagctactttggcacaagtactgggtccagacactcagccagaacccgctcattacgaaccgagactacggcaataagcagttgcttgatctgagttccaagatcaaggaggcgacgacaggtattacccggagccgagctggccagggcatgatgatgggaacaagcacaaaaagttccgacaaggnagtggacaagctagccaaggaagcgaatttgattgcttncaangagcgatcaggtcttattgnaaatcaagtcaanggtaggccttttcaacgatctanggtcgcgtcgaatcctgcgccnggaatgaagcatgatggactcactttatggnaatgcatgtagcacaacaaaatcggnataaatggnggtaaganggcaataagcaatcttttacttttctttagactaaatattncgaaaaaaaa

SEQ ID NO: 745 - DNA, 1021 bp, Fusarium venenatum
  misc_feature (1)...(1021): n = A,T,C or G
taccactcacactatctcttcaacaactatttcataaactcaattcccaatcaacatcatgtctgacagctacggaggcaacgacagctacggctccagccgtcgcgacaatgataacgacaactcctacggctccagccgccgtgacaatgataacgacaactcctacggctctggcaacaacgacagctacggttccagccgtcgtgacgacgacaacgacaactcctacggctcctctcgccgtgacaacaacgagagctcgtacggatctggcaacactggtattggtggcaacgccagctatggctcatccgacagagacaacaacgacagctacggctccagcaacaaggactcctacggctccagcaacaaggactcctacggctccagcaacaaggactcctacggctccagccgcaacgacaacgacaactcctatggctctggcaccggcgctggcgctggcctcggaggtggaaacaccacctatggctctcgtgacaacgacaatgacaacagctttggctctagccgtcgggacaatgacaacgacaactcttacggntctagcaaccgtgacaacaacgactcctatggttccagcaacacatacggntcttccggtaacaatgactcctacggctccagccgcaaggacaacgactcgtttggaactggcaacacatatggctcttccagtggtaacacatacgactccgaacgtgttaaaaacgacgacggttcttacggacagagtaaccctgcctacggtgacgatgacaacaacaagaagtctggtggcttcatggacaagatcaaggacaaggttgaggagaaggtcaagggacacaagaaccgtgacgataacgactactaattgtaatatggggggtcgggctctagtgtattagttgacaatagttgagtgagatgagatattccttgctcttgaattgaagtttcttttgtttcgaaaaaaaaaaanaaaaaaaannttttcctgcggccgtcgagc

SEQ ID NO: 746 - DNA, 939 bp, Fusarium venenatum
  misc_feature (1)...(939): n = A,T,C or G
ttcaccatctcacgagggacattgaatattccggttcggcttcccatcccctctcatctcgtacagtccttccacattgattcctttcttgataccttttccagttacatcacatcaaacccatcttcattaactgatactggcttgcgccgttaccacgtctgactgacttaacttctgttctcattatacagcatcaaacatacaaacaaagccactctntttgcccttgcattcgcccccagacgccatcccgtgacatcattngggggaaacatccaactacgactcttnttttagtcccaattcaaaaagaaatactatcatccaccaacaacgctcgaaccctgagcgtccgttggcctcagcctcaaacccgtcgatcatccccttccatccgttcgactgacgcttatttttcatcttcaccccgtcaataccgccaagctgtcttccccaattctacttcagcgcaccgtcttctacgacgcggngaacaaacctccgcgccggggtagcatctatctcaacatgcccgagcgaaacacaagagaaggagctgctggagctcgaaggaggagatctagcagtatcctccaagtctaccatgagcctcctgagactctcgagcaaatcagtgatcaggctgncctgctaatctcaacgccaactggacaaacgccaaaggngcctgganaatccacattgtcttgattctcgctgccaaaattatcttcgacgccgatccctggtgtcttacaggagacttcatggacccttaccaacatgtcctacatgtttggcttctacattatgttncatcatgtccgnggnggtccttttgatttcaacagtggcgctttcnacaaccttcaacatgtgggagcagattgataacggggcccaatacacaccaaccaagaagttcttnttnagtgt

SEQ ID NO: 747 - DNA, 624 bp, Fusarium venenatum
  misc_feature (1)...(624): n = A,T,C or G
gtcgagtggtggaccggtgatgacaagtctccgatcgtacgattgaagaacgagcaggatgaggattcaatgcatactatctggaacgtctatggccgaatcaatggcatggagcaaacgtccaagtctattatcatcggtaatcagcgtgactcttgggcttttggtgcgacagacccgcattcaggcactgccgtcatgatcgagatggccagaatcttcggggaccttgtgcagcgaggctggagacccttgaggactatcgagttcatgtcctgggacgcttccgcatacaacctaatcggttcaacagagtatgttgagcataactctgacgcgttgcgcgacaacgcctttgcctatatcaatcttgatgcagccgttgtgggcaacgaattgcatgcctctggctcgcccgtgtttagaaaatctcttctgcacgctatggccgagtcatcgatcccagtactaattctaccttaaaggactctgggaccagagtcatgccgagctnaaacagctgaagaagggtaccatattccgtccaagatatcgctggactanttccttgacctgcgttcagggaagccaagtcctatcatcaactccacagatgattggggt

SEQ ID NO: 748 - DNA, 430 bp, Fusarium venenatum
aacgcccagtctctccaccgtcaacacacccagagaccatcacgacaatcggcaaaaatggcggacaacgactctcccgtcaccctccgaactcgcaagttcatccgcaaccctctgctgggccgtaagcagatggtcgttgacatcctccaccccaaccgtgccaacatcttcaaggaggagctccgtgagaagctcggttctctctacaaggcccagaaggaccagatctccgtcttcggtctccgaacccagttcggtggtggcaagaccactggcttcgctctcgtttatgactcccccgaggccatgaaagaagtttggagccttagttccgattggtgcgccgttggcctcgccaccaaggccgagcgtgcttccgacagcagcgcaagcagcgcaagaaccgacaaaagaccttccgaggtac

SEQ ID NO: 749 - DNA, 525 bp, Fusarium venenatum
  misc_feature (1)...(525): n = A,T,C or G
tgacggtcatctcaactcttcccggacgctgccgctcattttcttgataaatctgcgatcttaccgccccgctcgccatggctgacgcgcccaactctggcgatgagctgtaccctatcgccgtactcattgacgagctaaagcacgatgatgttttgctccgtctcaacgccatccaccgtctctcaaccattgctcttgctctcggcgctgaacgaactcgggaggagcttatccccttcctcgatgagtctgtggaagatgaagacgaggtccttgttgccctgagcgaggagctcggcggctttgtcgagtatgttggcggtctcagtggggcacgtccttctgtctcccttgagacctcgctgctatcgangagcccgtcgtccgtgacaaggccgcgagtncttgaacaagatttgctccnactttccctcacaagtgaggagtttttattccctcaaatccgcctcgccaaggcgatgggttaaatnnaggttttggatnggcttttaaaactcctnt

SEQ ID NO: 750 - DNA, 547 bp, Fusarium venenatum
  misc_feature (1)...(547): n = A,T,C or G
naaagtacgctttcncaaaatctctccncgaggtgcgattcctcttttgncagacttcggagcaaagcgcggccctccgatcattcnttactngatcgtatcctaccatgaagcgcaacaaccccaacattcctatcctcattcgngaagccgncggcactcaacccaaggtcttcgcccgatacgagcgaggtgtngaaaagtcacagatcctcgagggtctttccgacaaggagattgangacactggtactagctggccaacctgctcaatagacgattattgcttgttatttgcgaaaganacttgnacttgagagtggnggccttgaantcnggttccgcgatgatgaantttacataanggtcaaaatcagcatgccacaaaagantattgcntcaccataaaaccaatctntngtctcatgggtctatgacttttggngaccnactgncgtgntatacagaaggngtttttcanaaacccgcgtggttgantaggaganaatacttgccaccaacanaactaanttantttgacttttgg

SEQ ID NO: 751 - DNA, 440 bp, Fusarium venenatum
  misc_feature (1)...(440): n = A,T,C or G
tacgtgcagaagaagaacgcagcgccgggatggaaagcgcctgttacgcatatggctgctgctagcgcaggcgagattgctgcttgtgctgtgcgtgtgccgaccgangttgttaagcagcgtgctcaggcgggacagcatggtggttcctcggctgctgcgctgcgagctattctgtcgaggtactcgagccatgggttcgttcccatgtggcgcgagctctaccgtggttggggaattacagtctttcgtgaggtgcccttcactgtgatccaattcccgctatgggaggctatgaaatcctggggacgtcgccgtcgtggtggtcgcgaagtcactggtgctganancgctctttatggaagtatggctggtggattctctgcggcgcttactacgccgcttgacgtgctcaagacaagaatcatgttgtccaaaga

SEQ ID NO: 752 - DNA, 577 bp, Fusarium venenatum
  misc_feature (1)...(577): n = A,T,C or G
ctatctcggccttggcaccaagactctgctccctgtggtagagtcggttcagaagggcgccaaccccaaactccgcatcatgtcggttgagtttagatccgttcagatgtcccaagcatcggtcatgggtgtttcagatgaatggatcaaaaaggtcacccaggccaacagatcccaccatcagctcttcatggttagcaagcgaacattcgagcgcgtcaaccagccggtatccctacttgaaggagatatcattctcactctaaatggcaagatctgcactaccatctcggatttcgatttgatgtactcacatgaattgctcgatgtcgttatcgtccgcgaatgcgaagagatgcaccttcaaatccctactgtttctgcngacgatatggagacggatcatgcagtttcgttctgtggcgctatccttcacagacccatcaagctgttcgacaacagatcagcaagctacacagtgaagtgtttgtgtctagtcnaattaaaaggtctcctgcctaccantatggagttgcaccaaccaacttcatcactcatgtnaacggtactcccaccc

SEQ ID NO: 753 - DNA, 505 bp, Fusarium venenatum
  misc_feature (1)...(505): n = A,T,C or G
caaggttgccaacttggaaatctattaccgtgctatcaagttctacgttgagcagcacccttctcttctcaccgatctcctcgccactctcactcctcgtattgatgtcaaccgcgttgtcaagatctttcagaagaacgacgatcttcccctgatcaagcctttcttgctgaacgtgcaatctcagaacaagcgtgttgtgaacgaggccgcaacgatcttttgatcgaggaggaggactacaagaccctcgtgactctgtcagaactacgacaactacgatgccacagagctggtagccgctggaaaacatgatctcattttttccgccanatggttgnttcatttccggaanaanaagcgtngggaaagtnaatcncctntccaagcaananaagctttanagggcccanttgaacccgtgccctttcccaaggggnaattngagagancccttttaaaaattntgnaatttgggccccggaaagtttacccggggtttttt

SEQ ID NO: 754 - DNA, 1140 bp, Fusarium venenatum
  misc_feature (1)...(1140): n = A,T,C or G
aattccggggctctttggnatccgnccgccaactgtanatgaacccgatcgaaggtgccaattttttgtgngnaccaaagtctctcattccagtccaaggaggcaatacccgcttgactggggtcgtcttnactgaagtaggcgtgactgtagtcttgtctggagtagcagtcgtgccacgagtttcagcctgcttttcacctaaaagctctctcacgaggtcctcaaattcttcgcaagagccgtagcagtccgttctttattcgatccggggtggtgtcttgttggaaaagggactagcgtttcgtgatcgccttcgctctccttccttacggagattttcgattattcgcatcatttccttacgcccgcggtagctatcaaccatcttcccacccatgttcatcgatnccttctcncgggcattggcgcacanaaggcgcttnacaaggagatgtcgcatcaaaaggcacacaaagccccgcaatcgcttcccattttcttgctgggggcattcgtccaagttgataaatcggaggggtcggccgagtatgttggcaagcttgcgtgaagcgacattggcctcagagtagttggcgccgccaagcgagtcgtaatgaaaggctaccccatcaagagtcgagacgagaagcagcgaccaatggctaccgccctcancgacgctcacattacgattatcgttgatgggtagnaagatatgcgtaaccttgnagaaatcggnaanagcggattggattgatcgagtgtccggttccttcatgagaanaaatgtcatgctggggcggagcagaacgatgcgagcttgggggtacttgggaagagtttcgcgctccaaatactcttcccagaaagcgatattgttgtcggttaaccagtcatgcttgagagccttaatatcttcggctgtcaacaaaacgtcgtagtaactgagatatggcttctcaggggcgagcgaatcgccaaagtggcgcgccatcctctgacgaaacggcatcctgtttttggtatttgtagaggatgttgatgaagttgatgaggtagaagaacgaggtgttatttctgtggataangtngaatctgcaggcgtcgnctngtagtcagagtnngcggttgagtcct

SEQ ID NO: 755 - DNA, 1156 bp, Fusarium venenatum
  misc_feature (1)...(1156): n = A,T,C or G
ctccaggacaacaagctcactgttgtttgcgagaanattggtctcaccaagggcgacaccatgctcgacattggctgtggttggggtactcttgcccgcttcgctagcgagcagtatggtgccaacgtcactggtgtcactctcggccgtaaccagaccgcttggggcaacagcagcatgcgcaaggttggtatccctgaggagcagagccgaattgtctgcaaggactaccgagatattcccgttcccgtgggtggctacaagaagatcaccagtcttgagatgtctgagcacgttggtatccgtcacttctccagcttccttaagcaggttcacgacatgcttgatgacgatggtgttttcttcctccagtacgctggtatccgcaaggcttggcagtacgaggatttgacctggggcctcttcatgaacaagtacatcttccctggtgctgacgcttctactcctctcggctgggttgtcgacaagctcgagggtaccggtttcgagatcaagcacattgatactattggtgttcactactctgccactctctggagatggtaccgcaactggatggacaacagggacaaggtcgaggccaagtacggcaaacgctggttccgcatctgggagttcttccttgcctactccaccattatctcccgccagggcagtgctacttgcttccaaatcactctcgtcaagaacatcaactctactcaccgtattgatggtgttgagacccagttcaaccttcacggcgctcttgacaactgccgtgctgacctccagtcttgggccgccaagaacaacgtcaagactccctctgancttctgtaaagttttggctgagtgtctaacgccnattgggattttcctgaaccgtgcccagaaaaagtatagctttaaaaggatgcctcctaatgaagaggccaacattgtgattagtcacacaatngacaaccaagggcgaaaatgataacttgattcatctccggcattgtttaacccggaatgccgccccctgtccgatgaactcgntcgaggctgcctagaccgaaacgggcaaagtttcatagtttattgatagatgcgtaacagcaagccttgggggcnaagaaataagacattggaatttttatatagatgtctt

SEQ ID NO: 756 - DNA, 606 bp, Fusarium venenatum
  misc_feature (1)...(606): n = A,T,C or G
tgcgcccagaacctatctaggctcgctgcgagaacatgaacgaagtcctgcgttgccaggcggttggtttggttggatgggtaccttttggaagattcctgatgcctacgcccttcagcatcagagtctcgacgcctacttgttcatccgattccttcgcatctgctgcaccatctgcttcgtgagtctttgcatcacatggcccgtcctctttcctgtcaatgccactggcggcaacggaaagaccgagctggagcttctctcctacagcaacatcaacattcagagctcaaaggagaggaacaggctgtacgcccactgcttcatcgcctggatcgtttatggtttcgtcatgtacaccatcatgcgcgagtgtctnttctacgtcagcgtgcgacaagcattcctcctcactcctcagtacgccaagcgcatctcgtctcgcaccgtctnttccttcagtgcccaaggactatctcgacgaggctcgcatccgtactntntttaacgattctgtcaaaaacgtttggatncctggtgaaaccaangaggnggaccanattgtcnaaaaaccccacganggtgccatgaaactcnaaangggaa

SEQ ID NO: 757 - DNA, 1913 bp, Fusarium venenatum
  misc_feature (1)...(1913): n = A,T,C or G
acaatcaaccactctcatctctcaaacaactctcaccaccaccaacaccactcacctcttcaacttacacacaaaacccacaaccgccaacatgaagttcactggtatcctctctgctctcgctctcacctccgccgtctcggccaccactgtctcttacgacactggctacgatgacaagtctcgccccatgacctccgtcgcctgctctgacggctccaacggtctcatcaccaagtacggntggaagacccagggcaacatccccactccctacgttggtggtgtcaacatcattgctggctggaactcccccaactgtggtggctgctaccgcctcgagttcaagggccgcaagatcaacgtccttgccatcgaccacgccgcctccggcttcaacattggccttgatgccatgaacgccctcaccggtggccaggccactcagctcggccgcatcaacgctcaggtctaccacgccgacgcttccgcttgtggcctcaagaagtaaacggcgcaactctacgactttttatgagatgcattacggacgggggttttggacagcggacattttatgattcttcctctccttagaactatgggtttaatacttggcattggatggcgtttagactatgattttaccaccacataatctaactagatacttacacttacagtatgaatgaacatagagcttaattgccttgtatcaaaatcataaaaaccaacaatgtaccaccagaaaagacaacccaacacttagacgtccaaaggctttccaaggaatgtatgcccaaccaaaaacaagagaattgaatcaattgtagatttccgccccgagcagtgttgcaagaagctgataagcgttttcacacgcttatagcatgccaaagccggcgaacatggtgcttaggacaatagtcagaccccatgttcggccaacctcgatgacagcagcgccattgctcttagttgactctgcggtgtcagaatcgtcgtcgttgttttcacttccgggtgtgtcggtgtaaaccgtgttggcgtcgtcagtagcgctagctgtggccttaacagtaccagtgcctgtagctgtggaagttgtgttgtatttcttggggtcttcagcaccgcatgggttgttctctcggcagtcagaggcacaagaggctttgccggcacaatccgtgacacactggttaccccattcttggcagacgtaaaagggaagggtgagggagtattcggacacgttaggttgctttccgtcaccgcagatgcagccataagtgagggttttgggattgcattcgttgaccttggtatctcccttactagtttgaccacagatcatgggacatgtctctatttcgttctggcaccaaaccttgcgtagggacagaggcacgctctcagggtcgatcacgtagtcggcgttgacaagagtgacagccgaagccgcagtagcgaggacgattgttcgaagagaaggcattataatggcgtatcggtgcttgaaaacaaaaattgattgtgttttatgctggtaggtatatacaccggtttatatcagatgttcaaaagttggtaaacggtgaagattgacagaagatggtttgcttaaagcaaattggaacttcaacggaaatgggagcgacagtatgaatagaatatcggaatgaaaagttagcgactgttcaagaccaggtctgatatagcgagtgtatcaactgaggtgaggagaggaaagaagaagctgagaaaaaaaaggtcgaggaggtccgagacatatcaacgatgcttgacttacaaagcaaattggaacttcaacggaaatgggagcgacagtatgaatagaatatcggaatgaaaagttagcgactgttcaagaccaggtctgatatagcgag

SEQ ID NO: 758 - DNA, 599 bp, Fusarium venenatum
  misc_feature (1)...(599): n = A,T,C or G
caatcggtttccatcgattcctatcctctcagcacacttttaaaactgctccatcggtttctcttgttataatcttctagaagcacgtctttcgcaacacgacaatgtctcgcggcggcaccaccctttacgtgaccggcttcagccacggtacccgcgctcgcgacctcgcctacgagttcgaacgctatggccgactggttcgctgtgacattcctgcacccaggtctacgtccagccgtctcttcgcctttgttgagtatgaggaccgacgtgatgctgatgatgcttatcatgagatgcacaacaaacgtattggtcgtgatgacattctaaagatcgagtgggctcgcactcctccttctgcatcttggcgcttcgagtcaggccgcgatcgtgatcggcgtggtggggcccgctctcctagacgtggacgtnctccttctcctcgtcgcagcactcgtgaatnatctcctccgcaagggacaaccgcaagggaccgngacngaagactatgatcgcgaagagccgacgtgacagggatcgctcccgcagtctgaccaccggggaccgtgagcgggactcttaaggatgatcgc

SEQ ID NO: 759 - DNA, 624 bp, Fusarium venenatum
agcctctactttctccgaaatggagaagcagaacgagtatcttagccagaacgcagagaccaagggagcaggaagaaggcctatcgacagcttattagagattgtcaaggaggatctagataactacggagagtgcatgattcccgttgacgaggccaacaccatcaatatgaagctcttcccccatcatattgaccctcccagggttcgaggctggcatgtccccgtacccaaagccaaatttgccgacattatggaccctacgtgggatctcaccctgcaaaaggtcatttcccatatcgatggtgtctctgacgttcgacgcatcgctcacgcagcttccgtctcactcgagctagccaagactgcactccggcatcttctttactatgatactatccttcttctcgacatgttctttttcaagtgcatgttacgcacctcgtcccggcatccatgactttattcgaaacattgacggaatggttgacgaagtgtgcttcgtatgtgtctcacggccgtggacttgtgagcaactatcatcttatcaaactcatgtcgacgtttactcctggcaagtccgtcatggagtggctaaagggccatcaaaaactcaggcttcga

SEQ ID NO: 760 - DNA, 589 bp, Fusarium venenatum
  misc_feature (1)...(589): n = A,T,C or G
cattgatatccgatcatcccttcatactatctgctttcacctcgctttactttattcccatggctggtagaattcgacagcccgtcgacgaggcggcgcttcagaagttcatttctgaaaatgtacctgacatcaaaacaccaattgacctcaaacaatttggctttggtcagtccaacccaacatatcaaatcaccgcttccgatggccagcgcttcgtgatgcgaaagaagccacctggaaagctcctctccaagacagcccacaaagttgagcgcgagtaccgcatcatgcatgctcttgaaaacactgatgttgccgtccccaagacgtactgcttatgcgaggatgactctgtaatcggaacaccgttttacataatggagtttctcgatggtcgtatttttgaggacttcacgatgcctggtgtagagccagccgaacgtgaggccatgtggcgcgatgctgtgttaaccctggctcgattccatgcagttgattacaaaaaggttgggctggaaaanttggtaaaccatcnggtttctatcatcgacagatcaatacttgggtgacaaattgcggaagccag

SEQ ID NO: 761 - DNA, 570 bp, Fusarium venenatum
  misc_feature (1)...(570): n = A,T,C or G
ncaatccgctcgcagaagccatcatcatcccttcaaagcccaaatntctcaccgtcacctacgccaacctcgaatccgacgtctcanctttccagcgcaagctcgctgatctgggcatnacaaaagctgcccccgtctccatcgcgctcgtcaattcctacgagttcatcgnctcttttctcgccgcttcctggcagcgtggaattgccgcncctntcaacccggcttacaagcaggatgagtttgagttttatatcgacgacgtcaagagcgccatcgtcctcgttcccanaggcgcttgggcggccggtgcacctagcgtaaaggcggccaagaagttcaacgcccgctgcgctgagtgctattgggatgaagcccagggggagggtcccctcnatgacaaaggactatggtctnttgaanggcaanaangaaaanggtnttactggttgacctgacnatgtccttttattctacacactagnggcactacattncgccccanggnggttcccttacttattggaacctggncccgaaccatgaacaacattaagaacccttccgact

SEQ ID NO: 762 - DNA, 571 bp, Fusarium venenatum
  misc_feature (1)...(571): n = A,T,C or G
caattttcagtatataccaagctccagctcagcctcggcctcgtacacgcgacaaattcgatatcaacgcagccgcaatcatgacttccacaatcggtattcccatcaagctcctgaacgaagcacagggccacattgttaccctcgaaatcacctctggtcagacctaccgcggcaagctcctcgatgctgaggacaacatgaacgtccaactcaaggacatcaccgtcaccgcccgcgacgggcgcgtctcccatctcgaccaggtctacatccgcggctcccacgtgcgtttcttcatcgttcccgacatgctccgcaacgcgcccatgttccncagccgcaacgtccgtggccgtggtgtcggtctcgctagaagtcgcgcaaccgtcagccgaacgcgcgcaggcggtcgaagaagangataaacctagaaaaaggaagaagagagacaataatngagagacaaatgcntgttttggcgttcangcttatttggatttttcatgaacttcaaacgaagggtctatcatcttcctttttttggtnaaagtgaatcataaggaaaagg

SEQ ID NO: 763 - DNA, 605 bp, Fusarium venenatum
  misc_feature (1)...(605): n = A,T,C or G
ctcgtcctcatctgcctcacttttttcatcacatacccaacttttctaacctttacccatattattatacactaattgcccatcatggctcgcaagttcttcgtcggcggcaacttcaagatgaacggctccaagtcgtccatcaaggagattgtcgacaacctcaacaacgctgaccttgacaagaacgccgaggtcgttgtctctcctcctgccctctacctccccctcgtccgcgagactctccgcaaggatgtcgaggttgccgctcagaacgtctacgacaagcccaacggtgctttcactggtgagantctccgtcttcccactcaaggacagcgagattcacctgggccattctcggtcactcctgacgccgaaccatcattgggaattctgacaagttttctcctcccaaaacaantncctaccgaaaaaaggctccaagtcatctggtggctgcgngaatcccccgaaacccgcgaaggctggcaaaacatgatttcctctccgccaattnaattcccccattcccaatttccnaacggtccacatgtcnccctanaaccctttnggcattgncatggcagggtgccncccctaac

SEQ ID NO: 764 - DNA, 377 bp, Fusarium venenatum
gaaagcttcaacactctgcttttcttcgcggcaaacgaggtcattaacgacgagaagacagctgaagatgctcctcagtacatccgtgctctgacccgcgacctcaagaactacgtcaagaacaacttgaagcggaagattcctattgggtattctgccgccgatgtccgtgatgttctgtgggacacctggaactatttgcagtgctccgatcctgatgatgaagatgacatgagccgagctgatcttttcgccctcaactcgtactcatggtgtggtcctgaaccacttatgaaacttcctcatacgacgacctcgtcgccggttttgaatcatcgtctgtccctatcttcttcagtgaatatggttgcatcgag

SEQ ID NO: 765 - DNA, 661 bp, Fusarium venenatum
  misc_feature (1)...(661): n = A,T,C or G
tccaattccacgtccgggccctatcctgttcctatcccttcatctagctttacctcactccctactatcactactagtagtcgacgaagttggacattgtcatagattgaaacgagcctctctcctcatactttactttctacatcgttctaaccccgcttcgtctcctgtcaacaggtctgataattcaactctgacaccatggccgcgccctctggtcaccgctctcgcggttctgatgatctgggcgtctttgatgacgccaaaagctactatactgcagagcgtcattagaaccgtgctggccctcgcacccgaacttactcccaggttggtgttaccgacatcgtcgtgttgttacctgaattgatattggaaacagaacaagtttgatgtcacgctttgagcgagtcaatctttgagagcccttcagacgtgggagttatgacgagaactcacaacagaaccgccgctttttgatccaagttgattcgacattggaaagtctttcactccaagaagatcccaatgggaacatgccgattacaattgaggacaatgggcccaagggtttttttttgcgtaccggcgtttagttggcacaaccgtttcgatgtgcgaggaacttatatgctgnccaacctcttgcaggagttgacct

SEQ ID NO: 766 - DNA, 659 bp, Fusarium venenatum
  misc_feature (1)...(659): n = A,T,C or G
tacagaaccaatntcatcaacatcgaacatcatccaagagatgagtagtcgcggtggtaaattagccccagaagtcaatcgagctctgttcgtaaagaacttgagttacaacgtcactccagaagagttgttcgatctctttggaaaattcggccccattcgccaagttcgacagggtatcgccaacaacaccaagggaactgcattcgttgtctatgaagacgtagccgacgcgaagcaggcctgcgacaagctcaacggcttcaacttccaaaaccgatacctngttgttctataccaccagcccgacaagatggccaagtcaaaagaggacctcgaagctcgccgcgaatctttagctcagctcaagacccagcatggtatcgattgacaatccgaccggtctgtggatagcctgctaggaagtcgacttcctcgtctgcaggccggtcttcgtcttcttctaaatctccgtcacccgatccgaagacgatccttcgaaaaggcagagccccgatcaaganggtagccaccaaagagccccgcattccccccgagtcgtccgttttgacgacggacttcgacctgcacttgcctgtgcatgatgtatcaaccctttttatcacaccacttttttgganggggcttttaaaacaagg

SEQ ID NO: 767 - DNA, 726 bp, Fusarium venenatum
  misc_feature (1)...(726): n = A,T,C or G
ggacgaggtttcaacaaaacggctatccctattcttgtgggtaccaagtacgaccactttgtcaactttccccctcaagaccaagaagagatctcaaatcaggcgagacgatttgccaaagccatgagggctgcattaatcttttcaagtncaagtcatagcatcaatggtgcaaaagatcttcaanatngttctatcaaaggcattcgacctaaagtggtnccattcccgaaatcgaaaatgttggcgaggcttttctggtatatcagtctgataatggaaccaccggccgttaccaagccttaacatgttgaacctggacaccatggaacgacgaattctaacttacatatggcgatttcagcatcgcacaacagtcccagcaaaaaatggttgctacccccttttcaaagcactttcttttggtcattacataacatacaaactggatcgtctcctgtttctttttcactcacacacacaacaaacttgacactttattacggatttcacgggaaagaggtcaggatcacctctgggaaatagataaacatgggggttattggcgcaggaccgcatgtgattgacgtggacacttggagagggtatttgagacaaagatacaaatcgacttggtaatcgtgtgaaaaaaaaatttgtgtgggggagatgtatgcttcctagacgtagatgacggttgtaagatttctctcatttcgagttacc

SEQ ID NO: 768 - DNA, 439 bp, Fusarium venenatum
  misc_feature (1)...(439): n = A,T,C or G
caaacaattaactatctaaagccgaattaacaatcgattaaccanacacctttttatacccgcaaaatcaaatcgcaaccatggctactggagcgcantcnttctacgagctgtaccgacgaagcagcattggtcttgctttgacagacacactcgatgatcttatcagcgaagagcgcatcaacccccaactggccatgaagattctgggcaacttcgatcaggccatcaccgaggcgctccaaaagaatgtcaaggcccgtctccanttcaagggaagcctngatacataccgattttgcgatgaggtttgggaccttcttgatcaaaaatgtgacgttcaagatggacagcggaagccaatcnatcacagcgaacaagncaagattgcagctgcatgctaanaacctggngaaaggacaatanacactngagatgc

SEQ ID NO: 769 - DNA, 600 bp, Fusarium venenatum
  misc_feature (1)...(600): n = A,T,C or G
ctttgtctgatacttaacacaaggccatctgacttgaagttgatcgacatcaanataccttattagcttcgcttgntaatgatcgacaccccggacaacctttaacacacactccaacgttggcccatttcggatttcttcacacaacttcaattcaccacttcaacaatggatgaggatcaaggaccacaatccattgcgcctgaacatgcaccgtccaagacaattgctcagcgttgcaatggtcttgttaaagcgttcacaactagacacggtctgatcggcgattacgactatggcttctctttcggccaaacctgctttcatgaagaagagcgttaacccaagccctttctttggactcaacgacaagatgccagttcttcttggtttactcttggggtccaacattgcattggccatgttagcaggtgtnattacgccacccattatcatcaagtggcagcgccaatctattgcctgaacaacaacaataccttgnctcgactgcccttatggctnangcatcttttccgctgtncagatactcgtttaaactttttgcccacaatattatnttggactggagactgcagncgt

SEQ ID NO: 770 - DNA, 610 bp, Fusarium venenatum
  misc_feature (1)...(610): n = A,T,C or G
caagaatttcctccgatcccgactctttctctccctctccttctcacgaacagaagctgcatcactctccgtccttgacctcttacctccgctctcgatctcttttccgtgatctcacgtcacgtatctgaataattcttctttcaattgccaatccggccgaaggaccttaatatcttccacaatgctcagcgccgctctccgaaggcgtgttctcacccctacacacagcgctctgtgaaccggcttcgctgcccacgttgtgcgacactatgcctctttccctgagcaccaaggtcattcaagatgcctgctctgtcttccactaatgcaggctggcaacanttggcggtctggcagaagaagatcggtgactccatcgcccccggtgacgttcttgttgagatcganaccgataaaggctcagatggacttcgaattccaggaagaaggtgttattgccaagatcctgaaggatgctggcganaaagatattcctgttggcagccccattgccgttctcgttgaagaaggtaccgatgtcccgctttcgaaaattctccgttgaagaccccgtggtgatgccgctnancccgctgcctccaaggaa

SEQ ID NO: 771 - DNA, 322 bp, Fusarium venenatum
  misc_feature (1)...(322): n = A,T,C or G
ntcgatcttgnccgcaactgtggtgctttctntgccgaggaggcggaggactaccttaagatgggtgttctcaacggtctcttctccttggccgaacattggtcttattgcccatttcctcgaccanaancgtctgcnaactggtctctaccgtcatccctgggacgacattacttaccttctccccaacctccgggaggctggtgcccctggtgctgagggccgtgttgaggtttctctgtaagaaatggggaatggtaatgcaatcggaaagggaananataaggcgtcnagcatttgatgatnttgtgcccgcctggac

SEQ ID NO: 772 - DNA, 625 bp, Fusarium venenatum
  misc_feature (1)...(625): n = A,T,C or G
ctgacccaaacacaattgtgcaggtggttgtggagatcacaccaaccatcacccactgctcattggctactgtcattgggcttggagttcgagttagacttgaacaagcactgccgcccaactaccgcgtcgatgtgacctgcaaggagaacagtcacaaccaagacgatcaagtcaacaagcagttaggcgacaaggagcgagttgctgccgctctggaaaatgataccctgaagggagttctggacaagatgctggagacatgcgcttagtcatggcctaccatcatcgaccctcactcttttagaagcttccaaagtcgcatggataatgcttgctgatcttcgttgcccactatcgactggtgtcattgctactttgatagccaaaacgcgacatcgttttcgtaccgaagcttgatggcaaacgcgaaaataccacccttccatcgatgtcttgaatctcggcattcaagacggggtattcattaagtcttggatagactgaaccggtgaactggtaataaacatacaactggggaaaataccgactcgtgattggagaagaagaataaggacatcaatcaagggccctcattcatctaaataagggtcaagctccaccn

SEQ ID NO: 773 - DNA, 648 bp, Fusarium venenatum
  misc_feature (1)...(648): n = A,T,C or G
gaaactccaagccagtagctgtattccgtaagaagccatgtccctgccgtcaactatgaaaggccgtcatttttgacggcctgtacaagatctcggtccaggatcgatctgtgccccagatccgtgatggcagagatatcattgtcaaagttcatgccgcgggattgtgcggatccgagcttcacatctaccgtggccaccaaccgtcgggcaccgggttcgtcatgggccatgagtttactggaacagttgttcaagttggttcggatgtcaaaaccatcgacatcggtgacaaggtcgtcgccccattcacagcttcttgcggcaattgcttcttctgtaacaacgggtgttcccccccttgtgttaaaaacccagccgtttggcggtgaaactcttaacggagaacaggctgaatacgtccgaattcctatggctgatgggactgctgtcaaggctcccgagactatatcggacgaaactntnttactcatggcggacatcttccccactgnatttctacggtgtcaagaagtgctatggagcttgtgccttcccaaaacatccaagaagctacgatggtcatcggggggctgggncctgntgggctctgcccatnttggcagncactnatttnaagccttgttt

SEQ ID NO: 774 - DNA, 487 bp, Fusarium venenatum
  misc_feature (1)...(487): n = A,T,C or G
tcgacaagtacctgcgcatggctcgcaagacccaccgggaggctgccattgacacagctctcgccttctgttacgctcgtctcgagcagctatccgaacttgaggactttcttcgngccaccaatgttgccaacattgaggagtctggtgacaaggcttacgaggaaggcttgtacgaggcctccaagatnttctacaccagcatctccaactgggctaagctggccaccactntcgtccatctnggngactaccaagccgcgttgagtgcgctcgcaaggccaacaacatcaaggtgtggaagcaggtccacgaggcttgtgtgganaanaaggagtccgcttgctcaaatttgcggcttaatctgatggcgatgctgancaactccaaatttgggcaangagtatgancncaccggtnctttgatgactnatcacctttttgagcaggtttggcctcgancgtctcnatgggaatgttactgact

SEQ ID NO: 775 - DNA, 564 bp, Fusarium venenatum
  misc_feature (1)...(564): n = A,T,C or G
caaacactcgcatcacagactcagaaatattcgaaagacgataccctgttctcctcctcgaattttctatccgctctggatcaggaggacaaggtcagcaccgcggcggtgatggtgtcatccgcgacatcgagtttcgcattcctcttcaagtatccatcctcagcgagcgtcgcgtctatcgtccctatggcttgaacggcggaggtgacggagaatgtggtctcaacctttgggtccgaaaggttgaaaaggcaaactgggaggtatccctgaagcagtttcacaccagggatgacgcggccgaggtagagtatgaggagagacatgtcaacatgggagccaagaacacggctgcgatgaaggctggagatcgcatcatcatctgcacacctggaggaggtgcgtggggagcncgagggaacncgagagtgtanccaaaaagaaggtcgatcatactgaagcgtggaggaagggaaagtggtagtgccaaggatgaaactgccttaagcttagacaaggtgatgggattatttacaagactaagtgatgaagttatctaag

SEQ ID NO: 776 - DNA, 675 bp, Fusarium venenatum
  misc_feature (1)...(675): n = A,T,C or G
ctttgacttatcaccactgattcgaagccgacggcgacaaacagctaattaaccaagcctaactactgtttcgatcgagtcccccgatcccccgcaatcgaatttcgcccatcatgtccgacgtccaagaacgcctcaagaagctcggcctcggtgcccgaactggtggaaagggtaccccccgacnaaaggtcaagcgcgcacctgcccgctccggtgccgacnacaagaagcttcagctcgcccttaagaagctgaacacccagcccatccaggccatcgaggaggtcaacatgttcaagcaggacggaaacgtcatccactttgctgcccccaaggtccacgccgntgtcccctccaacaccttcgccatctacggtaacggtgaggacaaggagctcactgagcttgtccccggcatccttaaccaagctcggccccgactcccttgcttntctccgcaagctcgctgagagctaccanaacctccagaaggagaagggtgaggacnacgacnagatccccgaccttgtcgagggtganaacttcgagggagaacccaaggtcgagtnaatttccttcaaaaaaactcgagggcgatggggcantgaaatcgtaggcatgtccggncaaaaaggttggctagtttctcctgcgangcgggttttatgtttt

SEQ ID NO: 777 - DNA, 1565 bp, Fusarium venenatum
ctgcctgagaaatacaaattgtccccatccgcccatcctgaggctttcttttttccctctcttcctttcctcaccccaaacttttatacaaacacaattacatcaagatttacagcccaaggcaatcaagatgttctaaacaaccccccttccccgttgttccccccaagcctcagtcaaaattacgtctcaggaccctaacaagttaatccccactcttcaaccaacccgttcagctcacctcacggtcgacctgaacttcagcactgctttgaatagcttcggctccagttccctcacaaccgccaacatttcaggccaagacttcccagtcttcaccacggatccccaatcaccatggcttctctccaccagtcccagcctgccggcacaatccgcgcaacagttacagagtcccgaatcaccgcgtcaggactttgtcttgttcgatcagccccctaatcgctctacaacaacatcgctgccaaaccagcgtcgtcactcgtctcatctgcaaaaccgccaacagcctgtctcccctgctgttcagaatcaacgagtagcccagttgctccaggcttttggtcgtccttcgtctactgtaaacaacaaccgccccacgaaccagttttacgcttcttcggccccttcgtcatctactgcattgaaccagcagaaccgtgctgctcgacccccagtaccttttttttccagagtacaggtagcgtcccgcaacaaaccgccaggatgatgaacgctgcagacgtcgaactcgaagagttcactgccttcgagggcggggcccacacggccttttcctcacctgctgttgcttctgtctttgactttagcagcagtgcgtctagctctattgccaacttggcgaccatctcgcctcaggatcttcttgttcaagaacctttcatgtctgctcccaactcgtcggccctcacggctttgacctctccatccatctacaatgagtctccggactttgaccagtatgatgtgtctcccaactttggcaatgccgatttcgacacacctgctggagattggttcctctgttccctacggaaccctcagctgttccccagctgagtgttgagacctctcctgagatgaagtctgatgagttggactctgatgctcagtctcctcccatgccccgtcgcaagtcgggtacatcgccttccactcgccactcttctgtggctggtgttaatgcccgcaagcgagacaagcctctgcctcccatcatcatcgatgaccctagtgacatcattgctatgaagcgtgctcgtaacactcttgccgcacgaaagtctcgggagcgcaaggcaatgaagatggaggaactggaagacaagattgccaagttggaagaagaacgtgatcactggaagaagatcgctcttgcgcaatcaggtgcgcaataatggattaaaagtggaattactttctttcgccaatatcgggatatcgttggtttcgtttattgagttttaatcaagtttcattgattcctatcagtcaaatcagtcaatcaaattgtttatgaaata

SEQ ID NO: 778 - DNA, 585 bp, Fusarium venenatum
  misc_feature (1)...(585): n = A,T,C or G
ttttgcgccagtttgaagtaacactctcaacagccgaggaatcatctttgctaccagtaactcaacctcgcaactatacacaaacttcaaaatgggcaagaagcgtgcgcgtgaaganggcaaggacgtcccgcctgcggacgttaacatgatggatgaggacagttcagatgacgaggatttcgatatggtcaacgtcgacttcgagtggttcaacttcgatcctgaggttgatttccatggaaccaagacgcttttgcgacaactattcgatgttgatgcgaatcttttcaatatgtctgccctcgccgatctcgttctttcacaacccaccattggttcaaccatcaaggttgatggcaagggcaacgangcctacgcccttctcaccgtccttaatacagctgttcatcnagataaggagccaatgaaggatatcntccaataccttgtggagaangcgcaaaccaattcgtccctagcgccattgcagatgtcctcagcagcnacaacatgtcggaccatgttctccgaacgtctcatcaatatgccttccgaactagcaccgccactctattcgatgcc

SEQ ID NO: 779 - DNA, 475 bp, Fusarium venenatum
  misc_feature (1)...(475): n = A,T,C or G
gaccaacctcaagaagcagggtatgctgcccctgaccttctctgaccctgccgactacgacaagatccgacctgatgacaaggtcgacatcctctgcactcagctcgaggttggcaagcccctccccctcgttgtccaccctgccgacggcagcaagtccttcgaggtgcccctgtcccacaccttcaacgaggcccagatcgagtggttcaagaatggctctgctcttaacaccatggccaagactagcaactaaagaaagaacgaacnaagacgancaatttgatttttattgggtcacaaacggcgtacatcctgatgctctcatgttgggttttgagantaacagtanaagggcttatcaatggaagttaaatgtcttttacattgactgcccatgttttattacatnattgtnccagggagtaccatgcttcattaattgtacaaaatcaaaatgtttaatcacttcnat

SEQ ID NO: 780 - DNA, 485 bp, Fusarium venenatum
  misc_feature (1)...(485): n = A,T,C or G
agttngggtatcttnggtctagagactatacttcaaaatgaagcaaagattctcttcgntggatgtgaaaatcattgcacatgagctccaggagcgcctggtgactcttcgactctccaatgtatacgacctttcctccaaaattcttctcctcaagtttgcgaaacccgacaataagaagcagcttgttattgacactggattccgttgtcatctgacaaagttcgcacgcacaaccggtgnggcccctnnatattcgttgcgcgcctccggaagtttctcaagaccanacggttgacggnagttaggcaagtaggcaccgatagagtcctcgaatttgagttcagcgatggcaatatcgcatgttcttagagttntttgntggcgggaacatcatcctcacagatgccgatttaaacatcttggcctnggganaaccgtnttcgaagngaaaggnangaaccccaacgagttggactgcaata

SEQ ID NO: 781 - DNA, 470 bp, Fusarium venenatum
gttgtgtgctgctgttggcatcatctttatcgttgcatctgtactgttaggctcagtactcacggcgcttgtggtatctgtaacagttgtgatgagtgttgtggacattatgggcagcatggctttgttcaatgtttccttgaatgccgtttcccttgtcaacctcatcatctgcgtgggtatctcggttgagttctgtgctcacattgcacgagctttcatgtatccatcgcgcaccgtgatggagggcaatagcaacgccttccgtggtcgtgatgctcgagcttggaccgctcttgttaatgtcggtggattcgtgttctctggtatcacagtcactaaacttttgggtgtttctgtgctcgcctttacacgattcaagattttgagatctactacttccgagtttggctgtctcttgtcgtattgccgcccttcatgcccaatctcctgcccgttgctccgagtat

SEQ ID NO: 782 - DNA, 600 bp, Fusarium venenatum
acggcttcgcgagaaagatcagaagacccggcccggcctcacccatttctccgcatacatcatctacatcttctcttaatatatccagctccaagttgcccagtatggccgctgctgcttctgagagcttcatccacctggcgaggcctttggcgcccaataccgtcggcctccagactaaccttgccccgctcactgtcaacatccagcctcaggctgtcctttccatcctcgaccacgccgtccgacgagacatccgagatacccaatccacccgagtcatcggcgctcttgttggcacccgatctgaagatggcaccgaagtcgaggtccgctcatgctttgccatcccccacaccgaggaggaggaccaggtcgaggtcgatgttgagtaccagaagaacatgcttgctttgactctcaaggccaaccgcggcgagtcctcctcggctggtacaccacctctcacgagcttaacagcttcagcgccctcatccagaacttcttcggcagccctgacaccggcactttccccaccccgccattcacatgaccatctctaccgaagcctgggcgaagatattcagtctcgatgctaca

SEQ ID NO: 783 - DNA, 516 bp, Fusarium venenatum
  misc_feature (1)...(516): n = A,T,C or G
acttacgagaccgctcaaaaccagttcatcactgtagatggcatcaaattcgcctacagacgcttcggccaaaccaatggtgtgcccctcacattacttatgcactttaggggaacaatggatcattgggatccagccctcataaatcccctcgctgctaagcgacccatcatcatgatcgataatgctggcgtaggtcgttcagaaggacaagttcccaaacagtacttcttatgggcgcagtactacataaatgttctgcgagcactcggcgttgacaagactgatgtaatgggttnctcaatgggcggatgcgctgcgcaacttgtcgcctnacggcanggncttgtacgtcgctgatttttgcggaaccatgcccagcagnggcgaaggtccgnaccagcacccgcttncacctttaaccttttaattggggccaagacagaggnggaccnaaaantgccttcatgataanatgttggacatcaccatagcanagcccaggcaagttcnttg

SEQ ID NO: 784 - DNA, 588 bp, Fusarium venenatum
  misc_feature (1)...(588): n = A,T,C or G
agaatcaacccctctgcgagatattcaaccacttcttcttcgtcttcatcgcattcactttcatcacttaagccctgtgatatctaaagtcatctcattgaaacatacactgacacccctctctgaaagtcactgggaacattgagctcccaacttactcaattgattcacctacttcatcccagctgcgaactcgctcctccgttcggcacctcgtcgactagctgcagcttcacgcttatcgtcacgccgttgggacttcatctgaaaccatggccaaactcgattctacttccaggctcacccacctgaagggcttgatgaangaacgtaacgtccaagtttacattattccttctgaagacagccactcatctgaatacatcgcagaatgcgatgccagganagcttacatctcgggattcactggctctgctggatgtgccgtcgtgaccatggaatctgctgcccttgctactgatggccgttacttcaaccaagccgcatctcaactcgacganaattggacctacttnaacaagggcttcaanatgttctacttggcaggattggtcngnggacaatctc

SEQ ID NO: 785 - DNA, 615 bp, Fusarium venenatum
  misc_feature (1)...(615): n = A,T,C or G
agtacgaccgcatcatggagaagaagatgactacccccactgaggtcctttgccgtggtttccctaacgagtttgccatctacctgaactacactcgatcccttcgcttcgatgacaagcccgactacagctacctccgcaagatcttccgagacctcttcgttcgtgagggtttccagtacgactacgtcttcgattggaccgtatacaagtaccagaagaacgctcaggctatcgccaggctgctggcaagccaaccccgaggatgacgagaaggctcgtgccagcccgcaccaatgccgctactgccggccagtctgctgctaagcccaacgctattccagcactcgccgcaagatgcttgagcgangctctggcgcttggcgttgacactccgacaccaaccgtgccattggtgggaagcacaggatgtgagtatatggncataacaggcttcntnacttcaaggaccggacatgcctcggcagtntcggcgaatgattcaaaccgataccctttttttttnggatcttatatgggaccgttnttgcgatcaaccaaattgnatcggtnaagttttgaagtggtgatttgtgcatatttgccatgacgtnc

SEQ ID NO: 786 - DNA, 2096 bp, Fusarium venenatum
  misc_feature (1)...(2096): n = A,T,C or G
cgatctttcgcgaaaggcaaggaaggtccatatccccatcacattttccacatcatcaagtataaagcaagccgtctcttcccccaaagctggactttactcttcaccagatcagacacaaacaagcacaagaaaacaacactcgcaacaaccaccactttaaaactcattctcaaatactatcaacctgaaacacttcacttccaaatccatcaccaacacaacaaacacantggctttcttcccccgcaacttctacaactccgacgcttccttcacccctctcttccgcctccttgacgactacgacagctactctcgccagggaaccaacggaaatggcactcgtcgcagcggccttagccactggcagcccaagttcgatgtccgcgagactggagagtcctacgagcttcatggcgaactccctggtatgaagaagtctgatgttcacatcgagttcaccgagcctcagactatgctcatccgcggcaagaccgagcgcacttacactgccggcacacctcccgctggcctcgtcgaggacactgaagcccgaggcgctatcaccgacaacaacgaggaacacaacaactcccaccacgccactgtcgaagatgaggagcaggccaaggctcacganaccagcactgaggtcactcaccacaaaaagccccanganggtnganaanaagcctgncgaccaagtccaagtctggctcaccgagcgcaagtttcggggaagttcttttcgcagnttcaacttttcctactcgtgtagaccaagataacgtatttagagtccttaaattcatacgatggtagtcttgagcatcgtggtccacaaaggccaaaaagcacgaatcaagaacagtaacgagaggagttcattaacctcggcacaaaacaatcaatcacattatagattaaaaaataatacatacttgcttctaaaggccctagtttatgcaaatacaaacatcgcttacttgcggcggttctgctgcatcatgagaatctggaccatgcggatgaagatgttgaggaagtcaagctcaagagagatactctcattaacggggtcacggcgcatgacaccagcctgagcgagacgggcgtggtgcaggaccttctggacatcgaacagagtgaaaccaccgaagacagcgagacccaccgtacaaccagaggttttcagtgaaagcaagagttcggacagcagtggcggggatgatgagaggagcaagaccggaggcagcaacgatagcggcaccagcaagaagaggaccaccaatgtagaggtacttctcctgcttagcagtggcgccgacaatagcaagaccacccatcatggcaatggtgtanagaccagcccgccccaaaagaacgggaggaacgaaggcgagaanagggncgacaaagncagcctgggtggcgttgaagcagtccaaagagcgtactttgggaatatagttgtcagggctgatagaccgagttccaatcatggtagcaaagctgagagcaagccaccaatgccaaccaacccaagggttggtaaccataattcggtacacaaagccagtttgaaccatttgtcgagccgtcaatccaatgataccaattccaagtccagtgtgcaagaaggtgttgttcaggtattcgcgctcgtagacgggcatgccgccatcctcacgagtctcacggttgaagacagcgttaatggcgacaagagtaccaccaaagatggcacctccgaccaagagtcgtcggctggttgactgaggggctgttgcgacaccagtagggggaccctggtggtaataacgaccgccggcgcgactcgttcgctggaaggcattgcggatggcagtgggtgtgatgcgcgaggtgaagaagttggctgtgggcttggcctggacgtggaagcttcgggcggatgcggagttgcggaaagcagtctttgagagctcaggaagcctctgcgcaagacgcgcagggccctggcggacagtgagggtgaatgacatcgtcgttcgttctgtcggtgcagtcgtcgatcgataatgcaggcgtttacaaaggaaaatggtgaagcg

SEQ ID NO: 787 - DNA, 544 bp, Fusarium venenatum
  misc_feature (1)...(544): n = A,T,C or G
aaaacggtctgccaacgacagcggcaacacctccgccgagagttctatctagcacaacgggaagcgactcgttgacgataacgtttgacaacagcagggtgacaagaacccaatgctttccacggtttaacaacttgagcacacggttcgcgttcttagactgcgattccgcagggtcgccggataaaacctggaggtaaatactgtcttgtcccatcaacgcaattgtcaatccagcaaaagcaccaccgagaagaaccaaaaccatcgaggcgacggcgaggacccaaaggctggtaccctcgccctcctcttcatgatggcctttggtgtcgattggaaaggcggacacagntgttaagctggcgccaaaaactcgacccatgccaatgacagccggccgtattgagcccatattatatnttcggagcgtgtgccatgatgacagtatgattgactcgagagtcgtgccccccgtatcgatgatagatctcgcacccaaangcgaaacgggaaagcgaanagtcgtgtgtcaanaataaaa

SEQ ID NO: 788 - DNA, 620 bp, Fusarium venenatum
  misc_feature (1)...(620): n = A,T,C or G
cttcgcccagccgtcaccaccaaattttccacgtcgacaacctcaaccgccgcaaagatggtcaacatgcgcgttcagtaccgncgacgcaacggctacaacaccagctccaaccgaacccgagtcaatcaagactcccggtggtgatatccgtctgcttcacatcaagaagcgaggcactgtccccaagtgtgggtgactgcggctccaagctctctggtatccccgctctccgaccccgcgagtactcccagatctccaagcccaanaagaccgtccagcgcgcctacggnggttctcgatgcggtaactgngtccgngaccgnattgtcgagcttttcttatcgaggacanaaaatcgtcaagaaggtgttgaaggagcaggagcagagccagaagaagaaataaatgcaatcctaatcggatttggctttctgcgtgggaatggcaaggacctcttggggattcggttcattgctttggtgttcattaggcaaaaagggactgaatgcatgatacatcgggccgcggccagaatggatggccctctgctgtcttaggactgctactatcctcttggtgacttgaatgacaaaagaacatcaagctgggaaaaaaaa

SEQ ID NO: 789 - DNA, 524 bp, Fusarium venenatum
  misc_feature (1)...(524): n = A,T,C or G
ggccatgagagcttcgtttacagtatcacaagtctccctacaggcgaactggtcagcgcaggagaggatcgcactgtaagagtatggaaaggcaacgagtgtgtacagaccattactcaccccgccatntntgtatggacagtggcggcnaaccccgaaactgganatatcgttacaggcgccagcgatagcattgctcgcgttttcacaanaagccctgaacgtactggtgacnacgcgatgcttaaggagttcnaanaatccgtcaagtcgtcatcnattccccaacaacaagtnggaggcatcaacaaggagaagctccccggacccgacttctgacttcaaggntggtccaaggngggtcaagttcaaatgatcaaggaggacaatggtgcccgtgacttgttacacatggtncattgaccnacaacaatggggtaattgtcgnaacatcttnattctttcgggatttcttggaaaaaggtcnatacacggaaaaaagtncantttttttttntgtttat

SEQ ID NO: 790 - DNA, 490 bp, Fusarium venenatum
gttattctgtacaagttgctcgatgagacatggggacatgaaggatacctgagatggctgatgaacttgcggctggagtataccaagaagcgaaatgccctcctggccgcgtgcgaagatcatctacccagtgacctcgccagctggacgcctcctgtagccggcatgtttatgtggatcaatattgattatacaaagcatcccgaggcaggaaagcgaagtatcatggatatagaggaggaggttttcaactcatgcattgagaacggcgtgctcatcgctagaggctcatggttcttgactgaaaaggacaaggcaccaccaggactgttcttccgggcgacgtatgcatccgccacacctgagaacatgaacaaggccatcgagaagtttggaaaagctgttagggatagctttgggcgaaagtgaagtacttaggtagatctatatcgcttgaaattataagcatgcaccgagtttgatatggcgc

SEQ ID NO: 791 - DNA, 356 bp, Fusarium venenatum
  misc_feature (1)...(356): n = A,T,C or G
agacgagcagaaagttgttgagggccgtcaaaagtacnacgccgnattggcaganaaaatcctatcagcagaggtgaagcctgaactgattgttctcgctggttggatgcacgttttctcgactgctttccttgatcccatcaaaaaggcgggcatcaacatcattaatcttcatcctgcgcttcctgganaatttgacggagctagtgccattgagcgagcctatgatgaattcaaggccggacgactaacacgctcgggtatcatggcccactacgtaattgctgaggttgacaggggtnctcctatctggtcaaggagatcgagtggaagggtgagagtctaaaaaantataa

SEQ ID NO: 792 - DNA, 608 bp, Fusarium venenatum
  misc_feature (1)...(608): n = A,T,C or G
gttattgcagaggcgtgatttatcacaagtcaacattctttgcgcctgagacctgattgtcttaaggccttatattcttcatctagaaggcgagacacggaccctgttctgtcgctttcccctccattcagactcttgatctccagctgtctccaaaatccaacgggttgctatctgactaccccgccaacatgagtttcgccggcatgctaaacaggcttcacggccagcctgagagctacgataagaaatccaagtacaagttcggtcgaaccctcggtgctggaacatatggagttgttcgcgaggccgatggcctaccggcaaggttgcagtaaagatcatcctcagcgaaatgtcaanggcaacgagcagatggctatgacgaactcgagatgctgaanaactcaagcaccctatatcgcaagttgtcnctggttgagtcnaggacaagtctacatcgtnccagttgntctggcggcaacttttgaccgattncaacaggnaagttaccaaaagatccccnaacctnaacaagtctttgntgcaattctcccagacacatgtcatangattaagctgnaactttttactaanaaaacctgatn

SEQ ID NO: 793 - DNA, 660 bp, Fusarium venenatum
  misc_feature (1)...(660): n = A,T,C or G
cgcatccccgagtcatcctcattgccaggcgcaaacccgatccgataagaactacaacaatgttcctgcaacgctccgccatcactgcggctcgccgcgtcgccgcccgacctgctgtcgctcgcacctttgtcacctccgtcgctcgccgtgatgccagccgccctgccacccccagcgagcaggctgctgctcttgctggcactgccgagaagaaggttggatcctacaaggtcctgaaggagatccagactgaggaggatctcttcggtcctggtgccgcccccggtaccgtccctaccgatctcgagcaggccaccggtctcgagcgtctggagattctcggtaagatggagggtgtcgacatcttcgacatgcgccctctcgaggccacccgcctcggaacgatgaaggaccccatcatggtccgatctgctggtgaagagcagtttgctggttgcactggtttccctgtcgactctcacagtgttacctggctcggcatcacccgcgagcgccctatcgancgatgccccgagtgcggcagcgtctacaanatggactacgtcggtccttgaggacgatcacaccacaccaccttctgagtttgaggagcccaaaattttggcgattacattaagccttgagtacgatcaataa

SEQ ID NO: 794 - DNA, 699 bp, Fusarium venenatum
  misc_feature (1)...(699): n = A,T,C or G
cttctacaagacattgactcatacatttgaatacttgtacatcaccaaatacccaatttcatatactctttacaaatctgaatatgctatcctccagtaatatgatgcgaactagcattcttcggccagttaggctggtcactcaaaacacaacacttctcgcacgctcaacaacagcaataatccagacaagtcgccaaaacttttcatctaccagaagaacgccttgtacaagctgcgtagcttctgggtgtcagccatgtgctcgtcacggctcgaaaagtcgtggcagtgcaagtagcatcaccacaagcttcaacgctaaaaacctacgcaaaggtgcagcttatgccactacagcaagtccgatccctactgagcagtgggcacaggttttagaaaagactgggggagctgttcaatataaaaagatcccagtccctacaccaggatcagatgaggttttgatcaacatcaagtacagcggtgtttgtcatacagatcttacgcggtcaacggcgactggcccctttgctgccaagatccctntagtggggggtcatgaaggtgcaggcgttggtaatagcacgaggtgaagctgggtcaaaagacgtcgaaaataggtgaccatgtaggtctcaagtggcttcatgggctcatgcatgattggngagcaatggtccccagtccaacgaatct

SEQ ID NO: 795 - DNA, 632 bp, Fusarium venenatum
  misc_feature (1)...(632): n = A,T,C or G
ctcactctcgttcgtcaacatgaagtactctaccgtccttgccttggctggcctcgccgccgcttccaccaagaagcctctcgtcaatgagctcaagctccaaaaggacatcaccctcaagggtctcatggctggcgctcagaagcttcaggacattgcagaggccaacgacgatacccgtgtctttggaggcaagggtcacaacgccaccgtcgactacctctacaacaccctcaagtccctcaactactacaatgtcaagaagcagcccttcactgagctgtactctgccggtaccgcctccctcaaggctgacggtgatgacattactgccgccatcatgacctacacccccgctggtgagtcttctggtgctctcgttgttgcctccaacctcggatgtgcggccagcgatttccccgccgagtccactggcaaggttgttcttgttaagcgangagaagtgtgctttctctgccaagtccaccaacggnaaaggctgctggcgctgctgccgtcatcgtctacaacaacgttcctggcgaactcaacggtaccctcggggagcctttcggngaatttcgctcccaatggcggcatcagcctcgaggatggtgaagntatccttgcca

SEQ ID NO: 796 - DNA, 470 bp, Fusarium venenatum
  misc_feature (1)...(470): n = A,T,C or G
nacaaggacggtatccccgacggctggcagggacttgactgcggcgaggagtctgtcaagctctacaaggaggccatcgccgaggccaagactatcctctggaaccggtccccgccngtgttttcgagttcgagaagttcgccaagcggcaccaaaaggccnaccctcgacgccgtcggtggacgcttgtncagaaggaccggcaaagattgntatcattcgggtgggtggtgacaccggcaccggngccaagaantncggtgtttgaggacaagaataagccangtcttttancggcggtggtgccagcttggacttctntaaggtaaagancttcccggcgttactgctcttgtcaagttgggcaagccaaggtttgtctgnagcaaaccagaaaaaaaggtaattgaataccaaaatacccattanangcgtaaaaccgnaacaaaaaaccacancgtgtncaaagg

SEQ ID NO: 797 - DNA, 452 bp, Fusarium venenatum
  misc_feature (1)...(452): n = A,T,C or G
aaanacacgacacatcatcanccgcgacaccatctctctgatgaaggaggacgctatgttggtcaacacctcgcggggcggtctgctcgacaccgaagctgttattcatgcncttaagacgaaccatattggtggtcttgccctcgatgtntatgaggcagaaggaganctcttctataangatcattcgtccaccatcatccaagacnataagcttatgcgtctcatgaccttccccaatgtggtagtgtgtggccaccaggccttcttcactgaggaggcccntactganattgccgagtgtnctctcatcaatctcgaggaatggatagagagcaagacgagcaagaactctctgaccaaggatcctaagctgcgacgtcgtgactcactgcccgtccgcgccatttaaatgtggncttgttncttccaattgctattgtttgtcttgc

SEQ ID NO: 798 - DNA, 566 bp, Fusarium venenatum
  misc_feature (1)...(566): n = A,T,C or G
acctcccaacatcgtgtttttttcactttaacataaaaaacaaccttttaacattaaaaacccaatntttatttatttgtttggacaatggacaatgggacacctaggggggaggtcgtagtacccccctatgttttctcccctaaataaccccaaaaatctaagaaaaaaagacctcaaaaaggtctttaattaacatctcaaatttcgcatttattccaatttcctttttgcgtgtgatgcgctgcgtccattaaaaatcctagagctttgcaaccgaaagttaatagctgtcgctactactttcgcttacgctctaagtatattttaaggactgtcacacgcaaaaagttttctcggcataaaagtacctctacatctctaaatcgtctgnacgctgnttctcacgctttctatcgaccttctggacattatcctgggacaacatccataaactgtcccacacgctcgaatttggaatcattaaagaatttctctttaagcctattaaaccctttctcaaacccaggggaaattcggcctcgcagcacgatataaaggtcact

SEQ ID NO: 799 - DNA, 307 bp, Fusarium venenatum
  misc_feature (1)...(307): n = A,T,C or G
nccaacctcgcatctacctatncacttttacgaggccatcatgtcgtctcccttctnnataaacggnggtgcctgtgtcgccatggtcggcaaggactgtgtcgccatcgcatgcgatcttcgccttggtcttcaggcccttaccgtttccaacgactttcccaagatcttccagtacggcgacgtcttcctcggtctgactggcctgctaccgatgtgaacaccgggagcgacctnttccgctacaaggttaacatgtaccgcctgcgtgaggagcgcgatatcgcacctcgtacatttgcaacct

SEQ ID NO: 800 - DNA, 621 bp, Fusarium venenatum
  misc_feature (1)...(621): n = A,T,C or G
cgaagatgttgccaaggttcttgacgagcagatcaaggccaacggcggtcttgctagccagcaggatctcttcaagcaggctcgtccctacatctccgacatggtcgctattgatgtcaactaccgctatgttaaccgtatttctggacgaattgctccttacattacaagctttatgaaggatgctgaggcttgccagaaggttgccgatgctgttcagaagcactacgtcgaggaggatgagcgcaaatacggtgttcccgaaaaggaggatgacggtgaggttgagatcgtcaacgccgacttctctctcgcctacggtggtatgcttctcctgtcgcataccaacttgcgacttctcaagggccaccgctacggtctttgcggccgaaatggtgctggaaagtcaactcttatgcgaagtatcgcgaacggcaagcttgagggcttccctccccaggatgttctccgcacttgttatgtcnaacataaccagggcgaggatgctgtatcacattcttgagttcgttgcaaggaccccganaattgcccacaaggccttgagcgtattttccgaggttttngccganttcggtttccttgtngccctnaggntcaaca

SEQ ID NO: 801 - DNA, 861 bp, Fusarium venenatum
  misc_feature (1)...(861): n = A,T,C or G
ctgaactctacaacattcaagcttttatcataaggcagaccttgaaagactcaataactttcaatcctcctctctctcccaacctttctccttcttcgacacatctccgcaacatcatcttggcttaagcctgcacccaagcgagacgaatccatccatccgcctaaacccaggtcgccgttcgccgttcgcctcccacctccccaccttacacaacaacggcagactcttcgcccatcatgaaggtcactttcaaagatctcaagcagcaaaagtttacgctcgatgtcgagccctcagagttgatctctgccgtcaagcagaagatttccgccgagaagggatgggaacctcagctgcagaagcttatctactctggcaaaattctcaaggacgatgagactgtcggatcctacaatatcgaggagaagggctttgtggtctgcatggtgaacaagcccaagcccaagcctgccgaatcaagcgctgctcctcctgctacacccgccgctcctcctacccgcactcccgctgcccagctgctcccgcgcagtcttcatctcagcaggctgccgttcccgcaacacccacccctcagcgctctgctgataccggacctgaagagccttcgggcctggctatgggatctcagcgtaccgaggcgattgcgaatatggaggctatgggttttgagaggagtcaaatcgaggcggttatgcgcgctgcctttaaaaccccgaccggctgaaaaatacctgnttaatggnattccgacaacatccgnnaagaacagcaacaacgcgaggccgncccnggagntcctgctttttaaccatttaaacccgtggccgccgttcttaa

SEQ ID NO: 802 - DNA, 583 bp, Fusarium venenatum
  misc_feature (1)...(583): n = A,T,C or G
attctttcgcatcaaacttcaactttttttctttgggtttggaaataaaacagttttcctctttccttcatagcgattcgctccttcctctctctttcttatagaatggcttcctccaacaaggtgttttccctcgagggaaagggtctcaagctcgacactgctgaggatatcgaggctcacattgcccctcttcgatctcaagatgtcgaggaggttcgcattttgggcaacaccctaggtgttggcgcctgtcagcgcctgggtgaggttctcgcgacaaagaagaacattcgtatcgccaactttgccgacatcttcaccggccgacttctgagcgaaatccccgacgctatctcctccctcctgacctccgtctcaacctccctaagctcaacactgtcaacctcaacgacaacgcattcggcttaaacgtcaagcgcctctcgtggcattcctttccgacacgttcctcttcagcacctgtacctgaacaacaacggcatgggtcctcatgctggtattcttatcgccgatgccctgtccgagcttcacggcaagaangaaggccgcccgaaaggaa

SEQ ID NO: 803 - DNA, 500 bp, Fusarium venenatum
  misc_feature (1)...(500): n = A,T,C or G
caacccttcgactaacccatccagcaacaatggccgctgatactcccgcgaagtccggtctggccgttggcctcaacaagggccacaaaaccaccccccgtgttgtcaagccccgtgtttcccgaaccaagggccacctgagcaagcgaactgctttcgttcgcgaggttgtcaaggaggttgccggccttgctccctacgagcgccgagtcatcgagttgctccgcaactccaaggacaagcgtgcccgtaagctcgccaagaagagacttggtaccttcggccgtgccaaggccaaggtcgacgagctccagcgtgtcatcgctgagtctcgccgtgctggtcattaaatcgcttaatctgatttctgggaatctggcaccaaatgggtttcgcatggattggcgtggtcacggtatgatcaattaaaaaataacggctttgatgctccgtggcagggaaagctgcggctnaccggaataccaacactttcaagcaaa

SEQ ID NO: 804 - DNA, 663 bp, Fusarium venenatum
  misc_feature (1)...(663): n = A,T,C or G
cgcgttgccaccacaacgacttttcgacgattcatctcacaaattcgaaatcatggccgacacagcagaagcagaacaagttgagatggcgccggtcgctgagcaagagaaccaggagatgacagtagcgacaacaaataacgaagtcgtggcgcctactggaaagaaggtcgtcaagaagattatccgcaagaagaagcggcctgcgcgagcccaagtcgaccccgatttcttcacaacagaaccccctccccaaaccggtacgatcttcaacatctggtacaacaagtggtctggcggcgatagagaagacaagtatctatccaagaccaaggccaagagtcgctgcaatgtctcgaaagacagtggatataccaaagccgacgcgataccggggagctttttctgcttgcgttttgcgcgtggaatttgccccaagggtcaagactgcgactatcttcatcgacttcccggaacatacgaacatttcaaccctaacgtcgattgcttcggaagcgacaaggtctccgactaccgagatgaaatggggtggcgtgggaaggttcatgaaggcacaaccgaacagtttacgttggggagaattcacgtcctgntgatattgaagagatcgnggcgccgacatttcncaaaatggggtctggt

SEQ ID NO: 805 - DNA, 622 bp, Fusarium venenatum
  misc_feature (1)...(622): n = A,T,C or G
aaaaaccgacaaacacntattacgtgtcgncgagcttaaaaaccgaaacaatatccataacattatctactaccgcactcagcatcttntttctccaagtcaagcttatcaacaaccatgtcgtcatcggcaccnccacccacggtcgatgcncctgacgagcancagancgatacctccaagttgnnaacatttctgggtatctngaagaagttcatgggcgtttcggaccttgcagcagtcatattctcactgccgncgcagttgctcnagcccaccccgaatntggaatactggacctatatngatgctcccaatgccttcgttgccatgggcacctcggacgaaccttttgatcgcatgctcgaggnggccgtttctggttgaccaaagacctgaagtacgccaaaggaaggccatgcaaaccttacaactcatgccttggngaattntttnggtgcaattggnaaactgaanacaaccccccanagatcgacacatccaccttaaacaaaaaaaangcatcaccgagggcggactttnagccttgaaggcttcctnttagaacacaaaaacaattcaaacctttcgtttttgngcctaacatggcnctacaacggan

SEQ ID NO: 806 - DNA, 481 bp, Fusarium venenatum
  misc_feature (1)...(481): n = A,T,C or G
aggaccactgcgacttcaagaagctccgctccattctgatccgaaacacacatgctcgaccttatccacaccaccgagganttgcattacgangcctaccgcgcccagcagatggagaccgcaagttcggcgaggccgtccccgcaagctcgacaaccccaagttcaaggaggaggangaggcctccgaaagcgattcaccgagcaggtcnagatcnaagagcagcgcttccgacaatgggagcagaanctcatttccgancgcgaccgtctcnacaaggatctcgagcaaacccacgctcagatctagcanctcgagcaggactggacanatcanggcagtgctgtcgcagtcatggacgccgctaagcgacatcnagtagacgtaatgcntgcatgcatggctgcagttggacagtccttcnatttcttttactgganctcantttgggggttggagtggaaaaatgaaangtcgagaa

SEQ ID NO: 807 - DNA, 644 bp, Fusarium venenatum
  misc_feature (1)...(644): n = A,T,C or G
ctcacttcgaacaacgtcgagattaaaccatacgacgctatctttgaggattctcaagcactccacgccgctgttgccgcaaagaccaaggctgatgataaagcccccaagggaaacttcctgatctctaacaaaggctcatgggcacttaagcgagctcttggaggtgactcttcggttgatgagatcagaagtcttattggtgatgcaaaggccatcaagaccgaggccgaactcaagggtatgagggactgccacgtgcgggacggtgcttcgctcattcaatattttgcttggctcgaggatcagctggtgaacaagaagggtacacttgatgaagtcaagcttnccgacaagcttgaggagcttcgcaaagaaaagaaggactttgttggcttatcggtcccgactatttctctactggtgcaaacgctgcgatcattcantaccggcccgagcgtggnaaatgtgccataattgacccgaagccatctacctttgcgaatctgggctcaataccgngacgggacccagacaccactcgnacactggactttggaacgccaccggttcttgaaagggaagcgtnccttttggttntgaangggcacattttttttaaaccaagcctcttttcttaaggn

SEQ ID NO: 808 - DNA, 476 bp, Fusarium venenatum
  misc_feature (1)...(476): n = A,T,C or G
cgcccacaacgtcaattgaaagccgaagccttgcaataatggccgccctccgatctcagagtgcggctcgtatgctgcgaancgccgctgttcctcgagtcgccctctccgccgctccccgacnattccagagcaacatcacctcggccantggtaccatcactggtcccgtttccaacgagcccgactacaacatccangctgataaggctacctccacctatacccccgtccctcgatcgatccaagatggtagcgaagagatccttcccgcagccattatctcaggcgctcccatggagctccaggcccgaacagttcgcatctaccaggaagccaagcccgctacgcactccggtgactggcgcggtcgacctggcgaatggactgggatattctccccagggacaccgatgggagaacctctgatnggctggcaatcttcagtgattcatgcagggaaatctctcaacttc

SEQ ID NO: 809 - DNA, 271 bp, Fusarium venenatum
  misc_feature (1)...(271): n = A,T,C or G
nactcacantccaatccatattnaagtcgacagaatgggaaaatcttnanaagataagcgcgacgcttactaccgtttcgccaaagaacanngatggcgtgcgcgaagtgcatttaagctgctacagctcgacgaggaattcgatctcttcgccgatgtcactcgagtcgncgacctntgcgccgctcccggaagttggtcgcaagtactttcccgtgtactaattaagggagagaagtttggcggggntgcttgncaggataaggaagcc

SEQ ID NO: 810 - DNA, 647 bp, Fusarium venenatum
  misc_feature (1)...(647): n = A,T,C or G
ctacagcaagttccactcagtcctatttcctgtgaaaaatttcttcgctggctcaaaaggctcgggtcgggcgtacgtgatttcatttacccaggatcgacttgccgagcaactggcaagattcgagacggtggatgaaaaggatatcatgactgcagancccttcatggccaagtttataactagcagccaanaacaaccagagagatttacacgtcgacatgtcaccatgggttgcgttgctaatatggtggctgggtctgatacaacaggcataaccctttctgcaatcctttactacctcctnaaaacgccagacagcttgcggaaattaagggaatagattgacgcattcacacgtgaaggaaggttatctgaacatccaacattccatggaactcagcagatgccttacctccaggcgatcatcaaagaaggattgcgtcttcacccggcagtaggactccccctggaacgtgaggttcctgcaggcggagcgaaaattaacggacactacttncctgccggtacaattgcggaataaacgcttgggttccacacanggatgaagagcgtntttggnccanatgtcgacgtattcaacccanaacgatggttccttgaaaaanaaaatgtcacaattatna

SEQ ID NO: 811 - DNA, 627 bp, Fusarium venenatum
  misc_feature (1)...(627): n = A,T,C or G
gcctaactggaagagacgagctcaactattggctgcctacaccagagactatcagttgttttatgatagcaggctcttggtaagagcattaccggaccaaacttntttaccgtcgaatctttgtcatttaaatcctcacaatggcctcccaactgctacccctcgagcttatcgacaagtgtgttggctcgagaatttgggtcatcatgaagggcgataaggaattcagtggaacactcgttggattcgatgactaccgtcaacatggttctggaggacgtgactgagtttgattactcgggaaaccacaccaagctacccaagattctactcaacggtaacaacatttgcatgttgatccccggtggtgagggcccanaaggggctgcttcaggttgagaaggaaaagccaaagaaacaccgcaagccaattcaatcaatcaagactcatgacgagcatttcccccaacacggaatcaaaacttcgcgcccttatcttaatattggnggtgggacatttgcatcaaaaagaattagggtcgcagtgngcngctcaaaaaagtcctaagcattgagctcatcccanttacatntggcaaaaataaatacagtattctacnnccccca

SEQ ID NO: 812 - DNA, 288 bp, Fusarium venenatum
  misc_feature (1)...(288): n = A,T,C or G
tggttggaagggtatcaaaggttttgtgaaccaagcgctggtccccgagcaaatggcgttgcccaaaccaagtggtgaaggtgatgagttggtgctcgtctgcggacctccgctaatggttaaagctgccgaggcaacatttataggtttaggctttaagtcggacgatttggtatttttctgattgaataagcgtaaatagggaaaggttattaaaagcatagaaatataatgctttgcatnaaggcgttgcatgtgttaatagaataaatgattttgagttccttc

SEQ ID NO: 813 - DNA, 577 bp, Fusarium venenatum
  misc_feature (1)...(577): n = A,T,C or G
ctctcgaagccgtccgaggttggctagctgccaacctaaatacttcaacacgaagtccttcagatcatctctcttcttcgcttcttcctttcctcttgcaccccgcgcagccagctctgcagctcttggaaacgttccattcacgcgttccggtctattgggcacgtggttcctcaagcttcgtcctaccgctggaggcaaggaagaactttacacgtggaaaaaagttacctcttcagtcatcggtattattaccggaaacccaacagttgacaactatggtgttatggagattaagaactggacgacaggcgaagtggctcatgtcgaatttaagccacgtggctggaangcatctagcgcatatcaagtatctggaaangtcactgatgcttccggcaaagtgcgcgtcagtctcggtggtcgctggaactccaagctgtacgctcgcctaacaccgggttacgaagcagcaatcgatgaatcaaaggagaatggtgccgatatggcacacagcggtctctccgaacccaaccgggcgtatctcatctggaaagnaaacnaacgggcaactgga

SEQ ID NO: 814 - DNA, 666 bp, Fusarium venenatum
  misc_feature (1)...(666): n = A,T,C or G
gtcttgttcatggcctatgaaaacatgccaatgcttcaacttcaactcttaaaccacttatcctcggcaattggaaagccggggagaggcaganacagaanatactgaagcatgaggcgcatagactccatgatgtacatacatcgatgtctggtactaacattgttgtgctacaatggccacctccatcaagtccatccgagctcttgctcccctccttgaccgtgtcctcgtccagcgtgtcaaggctganactaanaccgccagcggcatnttcctgcccgagtccagcgtcgagaagctcaacgaggccaaggtcctggctgttggccccggtgccctcgacaaaaagggtaaccgtctacccatgggtgttaccgttggtgaccgtgtcctgatcccccaattcggnggctctcccgtcaaggccggcgaggaggagttccanctnttccgcgacagngagatcctggccaagatcaacgaataagatacccntatatcaaaccaaacaataaccagcctgtatcatactgtccatatcacaagcgggggcgtgagaataaaactctactganttgcttganaagggaaaanatcggagttatttgtnatgtangcncaaaaaaccacagaccattntgcaagagatntcttcattttaat

SEQ ID NO: 815 - DNA, 536 bp, Fusarium venenatum
  misc_feature (1)...(536): n = A,T,C or G
agtgaagtcacgcgtcttcaaaaaggtgatcgcgtctgcgtgcaacctatcatctacgacaatgagtgccgctcgtgcaagcgcggccttcagaactgctgtgataaaaacggtttcatcgggttgagtggctggggaggtgggttggccgaatcaactgttgtgccgcaggatgctgtcaagaagctgcccgacaatgtgtccctagaagtcggcgctttagtcgaaccgcttgctgttggatggcacgcaatcaagatctcaccctacgaggaaggcaactcggcttttgttgttggtggcggaccaattggactggctgttgtgcaggctctcataggacgtggatgcaagaacatcatgctgagcgaggtcagctccaagagacgcgagtttgccaagaagtttggtgcgcatcacgtgttcgatcctacaaangacgatgtcgtggcgaatgttgaaaaaatttgacaggagggctgggaacagatgtttggtttttgacgctgcangctcgcaacaagctatttgatgta

SEQ ID NO: 816 - DNA, 541 bp, Fusarium venenatum
  misc_feature (1)...(541): n = A,T,C or G
cccagcttgtccgcgcgggaaaacgtcatggacctggcctcattatcctcgctatcattcccataacggcattcatcttggggacatggcaagtccaacgcctaggctggaagtcagagctccttgccaaatttgaagaccgtcttatccgcgaccctctacctctaccacccaccatcgaccctgatgccattcacgacttcgattaccgccgcgtgctagcaacaggtcatttcagacatgaccaggagatgcttatcgggcctcgcatgcgttgatggcacagacggatacatggttgtttacgcccttggagcgaganaatggcacaacaattctattcaacagaagttggattcgaaccagaaaccccganaccagaagacgaaaacccgattgattgccactggtgaaattcncatccnaaggactcctgaaaaaacccatgaaaaaaaaatatnttttcnccccgaaaaccancccnaaaaggcatnttttatttcccgaatntttaaccnaaaggctncnttgaaccggcccc

SEQ ID NO: 817 - DNA, 1053 bp, Fusarium venenatum
  misc_feature (1)...(1053): n = A,T,C or G
acaatnttttttatcttgnctccatagccaatcgctaaaaaaaaatgccttcaaacaatgctgcatggctcgttgccgcaaagacntcaccattcgaggtgaaggaagctcccctctctgaagtcgctcaaggccacatcctagtcaagaactcagccgtggccatcaaccccgtcgacattgcnaaccagcatgttggtatttttatttccgagtctcaataccctgtcatcctcgganaanatgtcgctggtactgtagaggcagtcggctctgatgtcaccaatttccagccgggtgacagagtcttaggctacgccacttcgctcgccagcaaggacaatgcgaacagcgctttccaggagtatacatctattcgagccgattgcgcctccaagattcccgacggcctttcttttgaacaggctgctgttctgcccctctctctcgctacagctgcatgggctttgttcggcgatgccacgctcaagatgaaattccccagtctcaaccccgagcctactggtgaaacagtcctcatctggggcggtgccgccagtgtcggtggaactgcaattcaactggctaaagcagctggctacgaaagtcatcaccactgcatcaaccaagaaccacgaatacgtcaagagcctcggcgctgaccacgtctttgattacaagtccccacatgtgaccaaggacatctgctcactgctcatgagcaagaagctcgcaggagcattggaggccagcggtaacgaagaagccatgaatagcgccagccaatccattgctcacggcgatggtttgcgcaaggttatttgtgtccgcggtcctcaatcgcagctgccagaagttaaggctcagccgatcatgtcaacaagtattattggtacaccagttgcaaaggctgtttttggagattacatacctgatgctctggaacagggcaagttcagggcggttccggaagcggaagtcgttggaaaaagntttggagtctgttcaagttgggtattaatacttttggccaaanggggtttcaacaaagaa

SEQ ID NO: 818 - DNA, 660 bp, Fusarium venenatum
  misc_feature (1)...(660): n = A,T,C or G
caatatcataaattcaagatgaaggttcaggatcgtacgttcatagtctctggcggtgcatcgggccttggtcaggcttgtgtagaggatatatgcgccaacggcggtaatgtggccatcttggacatgaacgaagaatccggccaagaactagtcaagaaactctccacctcaaccaagttttttgagtgcaatgttttggagacggagagtgttaccaaggcagtccaagatgctgccaagtgggcaaaggagacgggcaagcctttgggaggcgtgatagcagcagctggtgtttctacacccgcaacgattcttgaccggaatggcgctgcctttagcttggatgattttgattttgttctcaatgtcaacctccgcggtaccatcgacctcgtccgccagactctagagcatctcgccaaggtagaacctcaaggactcgacggcgaaagaagcgttgtaatcatggtagcatcatcggcagcatttgatggtcaaaagggccaagtttcttactctgccantaagggcgctgtgacggccatgactttcccatggcaaganacctcgccgatttggaattcgagttngngacaattgcttccaagtcttttttanaacccaatganaaaccgttttccccaaaaangncaaaat

SEQ ID NO: 819 - DNA, 547 bp, Fusarium venenatum
  misc_feature (1)...(547): n = A,T,C or G
cggcttcacaagccccccaaactcaattcaaaatggcacaaaacgatcaactgcccgagtttcagcaatcttacacaaatgatctccctcacgattcanacaagactnttgagcgtcanacaacagctgctcaccaagctgctcaccctcatntctaccccaatcctcaacacatccatcccgcattcggnggtgctatgcaaccaggtntttggaagcctgtagaggcncaccgnaagttcgccaaccctgctcctcttggactatgcgctttcgctctcaccacttttgtcctgtcatgcatcaacatgcacactcgnggagaaacgtctcccgctattgctattcccgtggcttttgcttatggaggtcttgccagcttttggctggaatgngggaaatggccgttggaaacacttttggtgctaccgccctgtcatnttacggaggtttctggatctcctacggtctnttgctgactcccncctggaacgtcttggnggtgatggaccttaatgangggngacacacgcttggtcatgggttt

SEQ ID NO: 820 - DNA, 590 bp, Fusarium venenatum
aacatagcttccgaaacgaatgcttaatatctccaatagaaagcctgtcatttacagatgaactgcttgtttccaatgcccgtcacgtgatatgatttccatgctgaactctgtcaggtagcttccatcaccaaagcatcaactttacactcaccaatcccccaattaatcgcacactaaataacacagtcaaaatggccgatgttgaaatggacgtcgatgtcgaggcgggctctccccctccccccgcgcgcaacgaatccgacatgcaaacacacactaaagccacggccgtccgctccatcgaaggctggatcatcattgtaacaaatgtccacgaagaagccgacgaggaggctctgcaagatctctttggagaatacggagagatcaagaacatgcacctgaacctcgaccgaagaagcggttatgtcaagggatatgcccttatcgagtatacaacgctggaggaagcccgagctgccatagacgggcgcacgaacacaaacttctcgaccagaccatctcggtggactttgctttcgtgcgaactcctcccggcaagcctggtcgtggaagaagcgctggtg

SEQ ID NO: 821 - DNA, 494 bp, Fusarium venenatum
aacgcattcactctctccatccaaaacgcaccgagctccatactcgccgtcattgaccaatctcccctcccttaagtcaattcctcatcaatcaattcaaaatgtcggacgacggtcaggagcttgttaccaagcccttcaagtttgtcactgctggtactgatgctcgtttccccaacatgaaccagaccaagcactgctggcaaaactacgtcgattaccacaagtgcattatcgccaagggcgaggactttgcgccctgccgccagttctggctgtcttaccgatccctctgcccctccggctggtaccagcgttgggatgagcagcgcgaggccggcaacttccctgtcaagctcgacgcttaagctcaacttgtagatatggaatagtggatgatgttagaagattcagagcagacacactgcaattgtatcatttgtgaaaatgctttaaaagctaaccccaaatattgactgttgtgctttgaaaaa

SEQ ID NO: 822 - DNA, 586 bp, Fusarium venenatum
  misc_feature (1)...(586): n = A,T,C or G
ggagattgcccaggatcacaacaaggagggcgctgagggcgttcaggtcattgatgcccgacctcaaaatcgcttcactggcgaggctcccgagccccgcgaaggtctctcatctggtcacatgcctggatctatcaacattcccttcagttctgtgctggatcccaagactaaggctttccttcctagggatgaactcaagaaactttttgctgagaagggtgtcgattcgcaacatcctattgtctcaagctgcggtactggtgtgacagcttgtgttatcgacactgctcttgaggaggccggagttggatcacccgaattcaggaaggtctacgatggtagctggacccgagtgggcccaacgggtgcaaccttcanaaaacctgattatcaaaacagcaaaagagtaatacgacctggtagtttatctgtaaaaagtcngnatacctggtagttgagctgcgatccctcattaatgatggcctggagntgctaggcgccgtacgaagaacatgcatccccatncctctatnggttcaaggcactctgctgngcaacgactttngttttttgcgatgggaag

SEQ ID NO: 823 - DNA, 225 bp, Fusarium venenatum
  misc_feature (1)...(225): n = A,T,C or G
ncacctgtcccgtggacagnnctgatatcanatcccttgngtntgagataacaagggggctgaccttaanatttttcagggccganccgtnttcngctgggtgcgtgacaatntaaactacagnttntactataatacgaagtaccgcgcaatgggnncactcaaaaacaggacacgttactgtgtggaccacacacaccttcttgnttgncttggnaaggctgc

SEQ ID NO: 824 - DNA, 620 bp, Fusarium venenatum
  misc_feature (1)...(620): n = A,T,C or G
cggccttggcaagatccccgcctttgttggcgaggacggcttcgccctctccgagtgcatcgccattgccatctacatcacctcccagaacgagaagaccactcttctcggtaagaccaagcaggactatgcctccattctgaagtggatgtccttcttcaactctgaggtccttcccaacctcatttcttggttcagccccctcaagggcgagtctccttacaacaagaagaacgtcgacgatgccatcaaggctaccgagaagaacttcgccgttgtcgaggcgtacctcctccacaacaccttccttgtcagcgagcgtatcactcttgccgatctcttcgctgttgccatcgccacccgtggcttcagtacttctttgataagcaatggcgctccgagcaccctgccgtcacccgatggttcgagactgtcgcagccagcccattttctctgaggttgctgagaaggttgacctnctcgacaccgttactctgaccaaccctccaagaaggccgaccagcctaagaaggaggccaagaaggaggctaagaaggaagccaagaaggaggccgctnccgctgccgntnccgctgctgctnccgangctgacgaggcct

SEQ ID NO: 825 - DNA, 650 bp, Fusarium venenatum
  misc_feature (1)...(650): n = A,T,C or G
tttttttttcaagannccncaatcaatacatatcattgattattttctacatagacgcacatcatatgagtcaaacatgatatttcaaatcatctctttacgccgagccaacaatctcagtaccagcagtccgcccgtacacgacacattccagcagcgaagatcctcccaggcgattatcaccatgaataccaccagtaatctcaccagcagcgaataaaccaggaataggcacaagcttatcgccgctcttcttcaacacacgagccttctcatcgatagcaactcctcccatggtgaagtgtgtaatgggcgtcactctgccgacgtaaatatcttgggctcgatttttctctccgggtggaagtgtccaccttccacgttgtgtacgaacaaactcatccgctgacccggcagcgacagtttgggcatacttatccacagcaacgatttgagcgttgggtagatcgcgcattttgacctttttgaggagacctttccattcgtagaaactgatgtggttggccgacgcttcaaaagcaccgggatcgagaagaatggttatgtcccactgtttgatcataccgtcgccatcagtggcagttggaagcttcataatggcattgctaacgtgttcgcgggtattcttc

SEQ ID NO: 826 - DNA, 671 bp, Fusarium venenatum
  misc_feature (1)...(671): n = A,T,C or G
cccaaattcgtccaactgttttcctatattgaacacngtaaaaaaaaaagcccatcgcaagttcaagctgcatcggtctatcgcatcatcacctacacattgctggtcgcgcaatagcttgacactacttgagctaccctgaatcgcattactagactacatcaacaccaccaatctctatttctcaaaaccatccctcagaacaccgtcaaaatgcctaaggctgctgcctaccggaaagcgtgctaccagaaccaccaagcgtgccaagaaggaccccaacgcccccaagcgtggtctctcagcctacatgttcttcgccaacgagcagcgtgagaacgtccgtgaggagaaccctggtatctctttcggtcaggtcggcaagctcctcggtgagcgatggaaggccctcaacgagaagcagcgtgctccttatgaagccaaggctgccgccgataagaagcgatacgaggatgagaagcaggcttacaacgccgaccaggaggagaagaagtcttcctagaaagaagtttccgatatcaaaccaagcgtcctcgcagaaggtgaaatctgattcgatantcccaacaccantgccgntttgcaagttctggcaggaagtccctctttttgatctcgtctggcggntttttttgatggncaagaaaaat

SEQ ID NO: 827 - DNA, 706 bp, Fusarium venenatum
aatttagcaaacgtcaacggccactgctgctttctcaacttcctttcatcactctcctctcaacctcacctcttttccccccaaagacgtttattccaagcgcttcttcgcattcttttcatatcagacactatggccgagcctatccgtggaaagcgtgctcaggacgccgtggctcctacgcctcagaacactcccgcaaccgcggctcctatctcttctcacgcccagcagcctggtgtcgctagcattaaggaggaggatcttgaccgtgctgccgcggcctctgttttcgcccaaaaccccaagcttatccagatgattcaaggtcgcctcggctccctcgtgggccaatcttcgggctacatcgagtcccttcccgcccctgtccggcgacgtgtcgctggtctcaagggtatccagaaggaccacttcaagctcgaggccgagttccaggaggaggttcttcagcttgagaagaagtacttcgccaagttctctcctttttacgagaagcgttccgccatcatcaatggaaagtccgagcccactgaggacgagatcaaggccggcgaggagggcgatgagcccgagactgaggatgcccccaagtctgagacaaagtccgatgttcccgacaatgtttccggtatccccgagttctggctttctgccatgaaaaaccagatctctctcgccgagatga

SEQ ID NO: 828 - DNA, 584 bp, Fusarium venenatum
  misc_feature (1)...(584): n = A,T,C or G
tgcgatctctactacataacccccagtttgccaacaccaatgctatgcaagaaattcctgagcggcgagcccattaccccaacggaacgatgatgttgaggatatcattcgcaggaaggctctgggatgagaagcgcatgcaagagcaaaagcaattctatgaaatcgcgaggaacgagctgccgaacttgacgagtacatggaacagttccgccgcgacatcgtggagcgcaacgggacttactatgctgttccaggaaataaaggaaaaggagaccattcaggatcttagcatccagtatcgaaagtttgccgagtggcttcgtatcgagattgccgccgtcatctatcatcttttccttgccgaaagacaactcccctgagcttttcgcccaggccagacgcattcactctcttatcccatactcagtcatcaagaacttattangatcgcaaaccagcngccgttatgtcaggcgttctcgatatctttctggctcaccatttggtacacgatcgttgatgcagaagatcttttnctgacactgaacgatggaatcnagactcccaaaatcgatcgatnt

SEQ ID NO: 829 - DNA, 572 bp, Fusarium venenatum
  misc_feature (1)...(572): n = A,T,C or G
gcctgcagtggacaagtgggggattaagggtctgcagacgttaatgcataactaccccgactaccacgccatggttgtcggcatggacccttcttcgttgggacttgacataagttctccagagttgttttctacacaaaactactcgctttttgacgactcacctccccgggtaccacttgctaatggcaaatttcgattgccggactgttacaatgtgacaaatgtgcagccaatcgagagcaaaattgctagcttcaacgaagagactctattttggatcttttacagttgtacagcggatgtaaagcagcaaatggccgcggtcgagctacattcgagaaactggagatggcacagaaaaatggaaatctggctgaccaaagatgagcatatgactcctcaaatactgagccccaaccacgancgaagtttctacatagtctgggaccaaacaattggcgaaaagatcgcaagganttcacactgcactatggcgacctagatacacattgaaccaggcgcaagtcggaacatgaangggtgtgttgccctgcctgganacaattttc

SEQ ID NO: 830 - DNA, 237 bp, Fusarium venenatum
  misc_feature (1)...(237): n = A,T,C or G
ngcntttaaccntnagatgcanaaactgggctataccaaagcctctggtttgccacctgcacatacccgggtnggctctgattcctgtcaatgtaanggcttcagtgaatnggccgctgcaagtatntgctcccttgtgaaccctgaatngccactggcagcatcgatnctgcccggaattgctactggtgggtgtggaggatttcacanaatttactgcgttcagtttgatgtggt

SEQ ID NO: 831 - DNA, 586 bp, Fusarium venenatum
  misc_feature (1)...(586): n = A,T,C or G
caatattctcacaagtacgcgtatcgcggtctcatacccatggacaaggccatcgaggctgtcggcgaggagagagcccgaaatgcgtgcatgcatatgggacctgatggccatatattgacattccaagtcaaccatggcgagaagttgaacattgtcgccttccggacagacccaaacgagtgggacaaccccagcaagatgaccaagactgctcatcgccaagatgctcttgatgactttaagggctataacagccttgtgcgaaatctcctcgcacttacagaggagacgctaagcatttgggccatctttgacactggtgataatcccgtccctacattctacaaaggcaggatggccatcctcggtgacgctgcccacgcctcaagtccccatcatggcgctggagcanggttctgcatagaagacagcgcagtcatggcaganctattggccgatgaaaaagtgcagaaccgctctgacctanaagcggtgtttgcagcctttgacgcctccagaaaggagaggacacaatggctggtgcagaatanccgattcgttgganatgcttacgaattggcga

SEQ ID NO: 832 - DNA, 560 bp, Fusarium venenatum
  misc_feature (1)...(560): n = A,T,C or G
cctacccttattgtccctcccatccctgagaagcacaccatggctgattatgctgccaacccaaccaatgcgaagcaagatcaacagatcattgatttgcgtaagcgcatgttggccgtgtttctgaaccgttgtcgccggatggaagagattcgaacagatggagtctggtggcgattccttgacccgaatgccagctggagcgaggtcctccactctcatcccgtggcctcaatccccaaatcaatcttgaaggcgcctccactgaaccctgcgaacccaactcctgcgcataattacttacccatcccggctgcgtcggcaaagttgaagacagtggccggtaccaatcatgacaacagctcaggtcatatccaagcaggaccccatgcctttgggtcgatttccacctgaaggacataatctcggcgaacaggagctcgaccttacttcatatcttacgaatcctcgantaaggatcttgacaacttttgaccggaccatgggaaaagggngatcgacgaaccttaacctttttcataatagcanccatcnttgca

SEQ ID NO: 833 - DNA, 590 bp, Fusarium venenatum
  misc_feature (1)...(590): n = A,T,C or G
tcgccttctaaaagctcttatgatgattccgaaaagagttggaagaagtggtgccacaaaagagccattgagaagaagggcaaatggtatcggacaatcacagtcattctagtactgcacttgattgttcttgtttcagagttcgccgacgagccgtggtggtggacgagataccgtgactttgttttcttcgccttcattgtggcctatactatcaacatcgcgattcgcatcattggtctaggctgggtacgatttagacgaagctcatgggacctctactctcttttcattgtctttggcgcttttgtttcgacctttgccctcttgatttcggataccgacctgggaagcatacgttcagcttcacaaggttttcttagtagccattgtgctgttgcttattccccggaacgacgcgctagatcaacttttcaagactgccgcagccagtctgacggtaattggcaacttgcttgcgacctggctgggtattctttcttgtttttgccattgcaatgacccaagctttcagcttgacacggtttgggagangagacagatggaaatattnatttcagaaccgttcc

SEQ ID NO: 834 - DNA, 589 bp, Fusarium venenatum
  misc_feature (1)...(589): n = A,T,C or G
gccatttgcattttcttgttgcgcatcccaaccatgactgccgtcgcagactttttcgagaaacgtaccgcagcctctgcaatggggtcttgctggtgttggtgctctcttcctgggctccaagatcctgagctatctccaacttgtcctcagcgctttcgtgctcggaggtaccaacctacgcaagtacggaaagcctggcacttgggctgttatcaccggtgcctctgatggcctcggcaaagantatgctctgcagctcgctgccaagggcttcaacctggtcctcgtttcccgaactctgtccaagctagaaggcctcgccgccgagattcaacagaagtaccctggaaaagccttcaagtcaaggtcctcgacatggacttttccaagaacaacgatgccgattacgancgcctgancgaacttatctacggtcttgattcggtatcctcatcaacaactcggccagaaccacagcattcccgttcctttcctcganacgacaagaagacttcaaacatcatcactatcaactgcactggcactctccganttactcanaccgttgctcctattataaagcaca

SEQ ID NO: 835 - DNA, 533 bp, Fusarium venenatum
  misc_feature (1)...(533): n = A,T,C or G
ccttggaatgaanggcttggtggtccccaacagcactcgttccttcaagctcaactgggcttttggaggtggcctggtcgaccgacgggatgatcgttgccctgagtacagcattttcgtgggcgaccttggccctgaagtcaacgagtacgtcctggtttctctcttccaggctcgtttcccttcgtgcaagtctgccaanatcatgaccgatgctatgagcggtcagagccgcggctacggcttcgttcgcttctccgacnanaatgaccagcagcgcgctcttgttgagatgcagggagtctactgtggtaaccgacccatgcnaatctctaccgctncccccaagaaccgtggcaaccacggtttcggtggtcagggacaccancntggcggtcctatgatgccggcatgcccagcagcanatgtggaacagtggtggcatgcanggtttcccttacggaagcttntaccctgctacccagatgaaccngttcactgaaccccacaaaccaccgactttgtcggtggtt

SEQ ID NO: 836 - DNA, 956 bp, Fusarium venenatum
  misc_feature (1)...(956): n = A,T,C or G
ggaattttttttttttttttttttaacatcctcaagcgtaccgttgcatctcaacaattacaagggctagacgtgtctcatccatatttgttcgttgaacccaacccttctntgcaggagaattactctacataacctgtacgagtaaaaaacaactacctattccgagagatctcctgaacctggaatttgaatttccgaaactccctccttttacgcagcaaatgcgtccagttttaatccagagttccacaaccggcacctgttaagatgctgcagggtgtggggattagaaaccatgagatatgtccggtagagacgttaatttacggccattgtcttgtttgtcgaagctcaagggtggatttaaggcttaacctcccggatggctcctttggcatcggccttgatgtcctcaacgacaccgtgtagcccttcttcttctcggactcgtacttgagaattcgggagacttgaacgacaccaaccagtccgaggaagaagttgacggcagcaaggaggtagttcttgggcttgatgatcaagcaccagcgagtccagatgataccagtgcaggtaagggcgaggttctgggtgaaggagagcttctcggcgggacgagcgaaatcggagataccggcaaggacaagagcccacttcatgacaggagcccagaagtgcacagtcttgaagccaatctcgctctcatacatgcgcttgaaccagccctgctgctgctgttgggcgccatcggtgctctgccatcgacggccgctgccctggtagaagttctgtcggaaggtctgctggcggaaagcctggcgagcaggctgagcaatggtggcctggcggaagagagggcgcgaggcgcggaagagagtgtttgcggacgaggccatggttgatcttttggtggagaggagatgcttcttcggacgggacgagttgtataggta

SEQ ID NO: 837 - DNA, 626 bp, Fusarium venenatum
  misc_feature (1)...(626): n = A,T,C or G
ccgaacgtcccttgttgctcacccatccaacgattctcttaccaaaaattccgttcgaaaaaaataaggggtcctaaatctcgttaacgacacttctctcaccgaaccgaatccccaaatatctccattgtcactctcctgaactcaatccatcctcatccccatcggcttgacttagcttgttcctgctcttatcaccgcgacgacgccctctcgatcgctgtaacccgctacatttccacccatattcaatcgacgacaacgacatcccgacgcaatacccagatctggggcccgtagcagactccagatccgacattatttccaatcgctttcgagatcataagcaatctcgaagctatataattgattcattatgagcgcaaatccaagcaacgttatccgcaggaagttggtcattattggtgatggtgcctgcggcaagaccagtttgttgagcgtatttacgctagggtactttcctacacattatattcctacagtggttgagaactacgtgacggattgcaaagtggaccgcaaggctgtccagctcgctcttttgggatactgccggacanggaagactaccagcggattacgaccccttgcatatttnaaaggnc

SEQ ID NO: 838 - DNA, 615 bp, Fusarium venenatum
  misc_feature (1)...(615): n = A,T,C or G
gcgaggcgctattctagccagcggtcgctgaacacatcctcaacccttttacaaaacccatttcccaaggtaaccccagtacctccgagtttatgtccatcgaaaatctcaagacctacgaccccttcgccgaagccgacgaggacaccgganaaaccaagcagacgcagaattacatccatatacgcattcagcagcgtaatggacgtaagactttgaccactgttcagggtctccccaagaagtttgaccanaagaagattcttaaggtcatcaagaanaaatttgcctgcaatggcaccatcgttaacgactccgagatgggagaggtgatccagcgcttnttgcaccaccaactgcctggctcctctcgccaaggtcatcaacgacaagttcggtatcgttgagggtctcatgaccaccgtccactcctacactgccacccanaanaccgtcgatggtccctccccaaagactggcgaggtggccgtggtgcttcccaaaanattattcccttcacaccggtgccgcaagggtgtcggnaaggtcatncctgaacttaacggnaagcttaccggnntgtttatgcgtgtcctaccgccaacntcttcgttg

SEQ ID NO: 839 - DNA, 558 bp, Fusarium venenatum
  misc_feature (1)...(558): n = A,T,C or G
ctggaaagggagtggttgttcctgctgtagagcatgctctcaaaggcggctatcgtcacatcgatactgcccttatctggcgcaacgaagaagcgattggcaagggtatcaaagcctcaagcgtatcacgcgatgaaatctgggtaaccggtaaactatggaacacagatcatcgtcctgagttagtacgcaaggctatcgaaacctccatcgcgaatctcgacgttgagtatctggacctgtacctcatccactaccctgtggcttgggttcctgagacacgagaagtagataacaatacttctcttatcgacacatggaaagctatggaagatctcgttcgcgctggtctgacgcgtcatattggcttctccaactttgctccaaaggactcaagaatattttcaaattgctagcatcaaccctacctcacaattgaaccatccttactccagcaacatccttgtggattccagaaaaaactcaatgatccgcatcgcctccaacccaaccgacttgggatataccanntctccaccttctgacaccccgagaaaa

SEQ ID NO: 840 - DNA, 758 bp, Fusarium venenatum
  misc_feature (1)...(758): n = A,T,C or G
ggaggaacatcactcctcccctttcttgataggtacttaaccgcctcatcttacatccgaacaacacgacctttgtcccatcgccagtttcccttccgcttttttcttcaacaaaacgtaaactttcgtcgctcatcaaaatggatcgcatcaaggagaaaatgaaccagcttcgcctggaggccgacgaggccagctccaaggttgaggagctccagaccaaggtcaaggctctcgagcaggagaacctgtccaaggagcaagagatcacctccctgcagcataagaacaacctcctcgagggtgaggtcgagaagctcgagaacaccgttaaggacttcaagaaggctgccgacgagggacagcagcacggaacccagaacgagaccctccagcgaaggctgcagctccttgaggaggaggccgaggacgccgacaagactcttcgtgaggccaacgagaagcttcgacagaccgatgtcaaggctggacactttgagcgcaaggtgcaagctcttgagagtgagcgtgaccagtgggagtccaagtacgaagagatgtcgcagaagtacaacgctcttcagaaggagttggaggagctccagnccgagattggcaacatctaatcgaactccgacctttatacacttgccccggatgcaggatgtttattagcatgtccctcaccatcantatactcgttcacctgcatnatnctttggttnaagggatctttgantnttggccaaataaccaat

SEQ ID NO: 841 - DNA, 513 bp, Fusarium venenatum
  misc_feature (1)...(513): n = A,T,C or G
gattagacttctttgcgaccagaaacaccacaagtccctctctcagacaccacataaatcccaatccattcgcaatggctcctcaggcaaagaagtcgggcaaggcccagaagcagaccaagaagtacatcattgatgcttctcagcctgccagcgacaagatcttcgatgtcgctgccttcgagaagttcctccaggaccgcatcaaggtcgagggccgcaccaacaaccttggcgacaacgtcgttgtcaagcagcagggtgagggcaagatcgagatcattgcccacaacgagctttctggtcgttacctcaagtacctgaccaagaaagttttttttaagcagcagctccgtgactggcttcgcgttgcttcacttctcgcggggntacgagctcaagtcttnacgttgttaccacgagntgacgagacgacagtaacgaaacaaatggatggntgcacggcnaggatgatngngaatgggaaacggtncaanaaatttaggcttggca

SEQ ID NO: 842 - DNA, 2198 bp, Fusarium venenatum
  misc_feature (1)...(2198): n = A,T,C or G
ntcccctagaanccaaatnacncccccttattatnctncatatcaagacagctcactacaaacaattatgcgatccatactcccagtcccaactccaccacccgaactatgcccttactctcgcgcatcagccagtcaagcatccgccgatgtcatcccactgcttgttgacnatacataccatgtcttccacctcagcacaccaccntccacaaaacaccatcctcaacgactgagaacaacatggtcacgcttgcgatcaacgaaccttctcgaatgggaacgggacccgcaacctgtgatatcccctggagagtcaagtaccgaccctgacgctgatggcgtctggacgggatgcccgtgntgacttggatcagaacatgaatatnttctatacgggatataacntgtttnggaacggccaacaaacaatctttcacaccaaggcttctgaccgtcatggtacaaggttcgactcgacatcaaagccaatcactattctcggcaatgggctggacaagtttgagcgtatcgattttcgcgatccgtttgtctttttcaaccgcgccgaagggagatattggatgcttgtcggcactcgcctcgccaatggcccgtattggagtcgggggtgcatcgccctgttgacttcacccgatcttgaggcttggacagtgtcaccggagcctttgtatgcccccaacgacgtcttctgccccgaatgtccagagttgttcacaatgccaaatgggaagtggtacctggtatattcacgcttccacgcaccaaatgcaggaacagtgtatcgcatggccnacactccatatggtccgtttcgcgtcccacgcnatgggtctcatggacgcttggacggacgccgttggtatgcagccaaatcatgcccaaaggctggagaccctgacaagaggatctgctttggctggattggtgactatgcggacgacnaaaacaaagtggctctggggaggtgatctcggcatcaccaaaatcatgtgggcaaaaaacaacgcctgttttgcgcattgacgcctctcaaaagtttcgaaattatatatggcgaacttctagacctgtgtcgcccggtgatgctgctcccaaattgtatctttgttctctcgggacganagcgacncattnntcccaantnggggctgcggagtggaagananattttcatggccaaggacatttgaaatagaagccatagctcaatcgcccgtcctttagatcataaacatttggncggccnttaacccgtgaaaattcntaataaaaacaaggcattnttcttgtgccatcaacaacaccgcccagaccgagatacaaaaagatggacttcctggccagaatctgcaacacggcactggtgttgggactaatccgaatcagatttcaccttctgcgagcgacgcttgggtttgatatcggagacttctttctaggaagactcttcctcctcctggtcggcgttgtaagcctgcttctcatcctcgtatcgcttcttatcggcggcagccttggcctcataaggagcacgctgcttctcgttgagggccttccatcgctcaccgaggagcttgccgacctgaccgaaagagataccagggttctcctcacggacgttctcacgctgctcgttggcgaagaacatgtaggctgagagaccacgcttgggggcgttggggtccttcttggcacgcttggtggttctggtagcacgctttccggtaggcagcagccttaggcattttgacggtgttctgagggatggttttgagaaatagagattggtggtgttgatgtagtcaaagacttatcgaggcgtgttgagtataggtagagagggacgaatttgggtgnaagaattgtatggnagaaaagagagtgagagggaatgtatggggagggccaaggcagcctttttactatgggggagtgattgtgcgtggggagggaacacggcctgcccagctaccagacttggactgttatgcaatnggctgggctggtaggctggagtgagcttgccccccttcccttttttttctctctctcctccttacccttcccttcctcctctaagaaaattgggtgcgggtgcggtgcgtattgctctgcggtgcgtgtgcttggagctgcacttgcactagtacagtcgcagcagtcttgggtttgag

SEQ ID NO: 843 - DNA, 569 bp, Fusarium venenatum
  misc_feature (1)...(569): n = A,T,C or G
gtggggtacatccttcgatggcagcgaggcgttaatgacctctctgagaaggagatcnaccacatccactacgcagccttgtaccctctggctggttggtttttgcactaccttccttttgttatcatggctcgtgttacttacgtgcaccactactaccctgctctttacttcgccatcctcaactttggtttccttattgattggttcacacgcaaccgcaacaacaccatcaagtccattgtttacggcgtcctgtacactgttatcattggcctctacatctactttatccctatttgctggggtatgactggcccccacaaagagtacaagtacatgaagtggttcgacaactggcgagtcaccgattaagggatgtatcatttctgttgatttgagcaatcgctttttctcgatcgcatattgcatgtgatctagacagatgccttatggaccaccatgcaggcctgtttgtattattcagtttcgggaatgtttgcaaggatatagaattggggggtcatggaaaggatactcgcangggccggtttggcaaagcgaaagca

SEQ ID NO: 844 - DNA, 548 bp, Fusarium venenatum
  misc_feature (1)...(548): n = A,T,C or G
ctgtattcagatggcatacataagtaactacaaactattcacagtctggctaacaataatattcaacgcttcctcacaaactcccgcccaaatgcagatgcaagtttaanaaaagtcgaaacggtcaggaaggacaacaggggccaccagtgtccatatatacatgccgtagcagacccaagcactaacaatcttgacccagcttgctgcgtaagtacccccgacagttgcaaagtcgccgtccttggtggactcatcgaagttcatggtgagcaaggtanctacccaggcagttgctaggaanaagatgatgtggaagacagtataactgtactgggtcctgtttcgctcgtcatctcctgcgggggtatcgccagcttcactctcgtcgtcggacaacaaaacatngggaggcaaactttcctctngacagctcggcgcaaaacctcngttttattttacggggagcactangctgttgagttacaaanaccatgttcgtcgtcctcgggcagctgaatacccgtagagttgccganaacaaaaat

SEQ ID NO: 845 - DNA, 605 bp, Fusarium venenatum
  misc_feature (1)...(605): n = A,T,C or G
cacgacttctcctccgacaatatacaatcaccactctttgtatatctcctccggccacgtccaaaatgtccgccttcatccgtgtcgctcgcggcgtccgcgctgctcccatccgacctgccatgcagccccttgtggcccgctcggccgtcgcccgcttcaccacttcaatgccccgacgaagcgagcatgctgaagagaccttcgaggaattctccgctaggttcgagaaggagttcgacggtgttcaggatgttttcgagcttcagcgcaacctcaacaacgccttcgcttatgatcttgtccctgctccctcggtgattgctgccgccctcaaggccgcccgaagggtcaacgacttcggtactgccgtccgcatcttcgaaggtatcaagaccaaggtcganaacaagggccagtacgagcagtacntcgaggactcaacccctccgagaaaacttggcgtgcctctgaaggaagactttaccctgaagaaaaattaatggtgccatatctccatattttgaccttgtgtttactggatgttngccganacgaaaggaatccgacccaaagttnacccgaattttgattgcggcacccca

SEQ ID NO: 846 - DNA, 831 bp, Fusarium venenatum
  misc_feature (1)...(831): n = A,T,C or G
taaggctcggtctgttcatgtttctttgggttaactcaacctgcacggttgagccctgtcgctcatatccttgccccacgactctaacagacaaaacgctgcatatcagattctcacaggctagaattgaaaggatttccggccattctagggaggtggttggccatccttgtttccaccttatggggacccggatgttacgataaacatgtcatggcctgtcagcagacctgtataaataccctcaaacacctcctgcatcttagctcctccagcctctcagcctcatctagactacaacaccactcttgagccgacaatcctcaaagatcacatcctttcaattaaacactcttcaagatgatgttcaagtccaccaccgcggccatgctcntntttggagctgccactgccactcccatntttggccgtgccgaggccagccagaccaaatcggcctctcaatcttccaagacaggtgagagcagcgcttatgactggtcagagggctggaccaaggactaccccatccaccagtcctgtaacgcgacgctccgtcgcagttgtccaacgctttggatganaccgtccancttgccagcatgccaaggaccacattnttcgacatggacacangtgggagttttttaccaaatactttggcaatgcttctacttctcagcctattggatggtacgaccgtgttggcaacgccgacaagactggcgtactcttccgttgcgatgaccccgacaagaactgtgctacacaagacgcttgggctggacactggcgaggtgacaatgcccctncgaaacagtnatctgccct

SEQ ID NO: 847 - DNA, 620 bp, Fusarium venenatum
  misc_feature (1)...(620): n = A,T,C or G
ctcgtgacttgggcccaacttccatcttccctttatccccaagaactactttgactttactttactttactacgactctcgtctatatcaccgactccggaacgccccaaacattctatcaaaccctctccctcatactttacccgtctactcgtcgaatacgtccatcgcgccagctccgatactttggatacccttcataacccgacatcggaacccagtcccaaccgccatcatgagtagccctcgccgcanaatagagacagatgtcatgaagatgctcatgagcgactacgaagtcacacttgtgaatgacaatatgcaagagttctatgttaggttcaaaggacctgaanaaactccattcgaaggtggaacatggaaggccatgtcgagctgcccgacacgtacccttacaagtctcaagcattggctttgcaatcgcatctttcaccctaacattgatgagtgtctttacttaatcgaccttccagtagttggtctgctcgntaaaaactttaggtctggcttantgtgcttggatgtnattaaccaaacctggtccccatgttcganatgancaacattttganggcttcctccttaactccttngatatn

SEQ ID NO: 848 - DNA, 469 bp, Fusarium venenatum
  misc_feature (1)...(469): n = A,T,C or G
atcgcttcgtttcgtttcgtcacgtctccagtcgcgcacgaatcgcgaaatacacatcacatcatgggcaagcgcaaatcttcaagcaagcctatggggcccaagaagaaagatccccttcccactactttcgcatgcctcttctgtaaccatgaaaactcagtctcggtcaagctcgataagaaagctggtgtcggtcaactagactgccgtgtttgcggtcaaaaattccagtgcgcagtcaactatctatccgctgcagttgatgtttatggtgaatgggttgacgcggccgatgctgtcgccaaggaagacaacgcggagcctgctatggtggcacatctcgaggaggatctggacgangcaacccgaacngcggtcgaagangactacgacgaccaatcngagatgatgattattaaacgtttttttacgcccatgtacaataccaagattgctacgtcctttg

SEQ ID NO: 849 - DNA, 830 bp, Fusarium venenatum
  misc_feature (1)...(830): n = A,T,C or G
attggacgctaagtcagctatttcacaccaacccctccaacgtctttttttacaactctgcctaccttcttcctatcatcactcaacttttcgacatctgcttattgtattgatacattattatcaacaatgtctgctcaagataaggcccaacaataccttggtcagctcgaccgtgagctctccaagtaccccgccctcaacaaccttgagaagcaggctggtgttcccaaggcctacgccgtcattggtgtcggagctctttacttcttcctcatcatcttcaacctcggcggtcagcttctcaccaactttgctggtttcgtcattcccagctactactcgctgggtgctcttttcacccacaacaaggaggatgatactcagtggttgacttattgggtcgttttcgctctctttaccgttattgagagcttcgtccaangtcgtctactggttccccttttacttcgtcttcaagttcatcttcctcctctggctctctctccctgccttccggggtgctgagctcattttccgatctttcctggtccctaccctcggccgatacttccagcaagtccggctctaccgcctnangtctccgtgccaaggctgacggcctcnacaagaccgantaaatggcaccgctgtgtancttggtcgctaatcaaatctcgcgtatactgcgtgacccggaccaagtnctttcggntatacatgaacggaaaantgntgccttttgggaatggagtagctttcaaaataatgctgctcgatttggaggtgaacggatganaaggatcaacatcaggattgggaagtatcca

SEQ ID NO: 850 - DNA, 528 bp, Fusarium venenatum
  misc_feature (1)...(528): n = A,T,C or G
atgtcttcatgccgaaacctttactggtattcgacaagattccggtgatcctgctgagtacaccaagtggatgcgagagttttacgacaagcagggtatcacagacaagaaggtcatcgtcttctctgactctctcaacatcgaaagatgcttggagtacaagaagagtgccgacgaccttggtttccaacccacattcggtgttggaacataccttaccaacgactttacaaacaccaagactggcaagaagtcagtacctttgaacattgntatcaagatcaagctcgggcggcggcccgccactgntaagaatagtgacacgctggaaagaacactggtgataaggagaccgttgagatggtcaagaaagaacttggatatgttgancgtgagtggaaggaggccacnaaacctngcgatggggcaaggcgtaagggaaaacaaatngacccagatccaaggcgtttccgctacactgagtatttcaggatctntcatcgctgaccatagaattaagttaccacg

SEQ ID NO: 851 - DNA, 390 bp, Fusarium venenatum
  misc_feature (1)...(390): n = A,T,C or G
gtcctcagctgggaccttttcgatgagatcaaggcccacaccaaactccccatcatcctaangggtattaccaccaccgaggatgccctccgcgctgttgaggctggagcanatggtatctggctctctaaccatggcggtcgccaagtcgactactccccatctcctcttgagatcgcctacaaaattcgtcgtaatgcccctgaaatcttcaccaagactgaggtcatcgccgacagtggcatccgctatggtagcgatgtcatcaagctgttggctcttggtgtcaaggctgttggtcttggacgtcctttcatgtactccaatgttacggcgttgaaggcccaagaanctcatcagatctcaagagtgaaatccttgccgatgctg

SEQ ID NO: 852 - DNA, 444 bp, Fusarium venenatum
  misc_feature (1)...(444): n = A,T,C or G
cctacatccgccatcaaaaccatacaacgccgaaaacaatctcttgatattgacttatccctcatctcgcgacccatcttccccgacatcgataccaataccgacaccgacaccgactcgactttctccgctccgcttcccccccgctntcttaccgtagttgcgcgcatccgcccgccaatagagcttcgctactctcgaccgcttgcatttcgctttgacagagncaagctcctgcacaggagcctttgagaggaacaatggcggntgtcgctactatcaagtgcgtcgtcgttggtgacggtgctgttggaaanacttgtcttctcatcagctatacaacaaacaaattcccatccgaatatgtcccgactgtcttcgacaattacgctgtcactgttatgatcggngatgagccatacactctcggactattcgataccg

SEQ ID NO: 853 - DNA, 578 bp, Fusarium venenatum
  misc_feature (1)...(578): n = A,T,C or G
ctttcacgattctcactcatctttgtacactgtcctcgacagctccaaccatgctgtcaacctgtttgtcgctaccgatctttccgagggcaaccgtcgtggttcaatcatcaagagcaactccaatggcacaacctatgtcctgagtgcttctaatgtcaacgctgatgaactagggtatgtagactttgagaaggttgctggtcttgagggtgtcactctcatcaacaccgttgcaaaccccgaagacaagaaaggcaagaagacaattcagaccaagatttctcacaacgatggcgctgaatggacctttctggcaccgccacaaaggatgtcgacngaaagtcgtattcantgcagctctctaggtgatggcaaatgtgccttnaacttgnaccattccccgaccgganaacaaggcanaacttttntgnagcaccgttgttggtatganattgcttacggaaacatcggttnagccttggagacattanggtgccgatctttcatntcgcttncggnggtattacctgnaaaaatgtaaaagggctttggaatggcatatgganacagggttt

SEQ ID NO: 854 - DNA, 573 bp, Fusarium venenatum
  misc_feature (1)...(573): n = A,T,C or G
aatcattgtggagggctacaaggagtttgacacaggacgtgaatacatgtgcaggatgggcgactggcgtgaaaacaaggatgttgaacttcagcttgatggtattggcggcgtcaacatcctcgtcaaggcagacgtgcatcgatcaggcatcaacttcccaccctacgctttcgagaaccaggcggagacaganggttttgccaaaatggccaaacgagccggctaccaagtcattggccttcccaactacatcgtttggcactacgatacacaagaaaanggcggtaacctatgaangctgcgggcttaaagcttggtttctganctggcttattacgaaacaacctcagcttgtcctgtctttctgggactacttcaactatatacgcagacccatgacgttacnccngttgatgtttccaacattcntggaagtgctttgatgccagctctcactttgagcactgttcacaacaaagcaacaccatcttccatgctgttatcaanttgcgctcgattccgtcccnatctattacatttctactacaatctgcgttgacctattgggat

SEQ ID NO: 855 - DNA, 521 bp, Fusarium venenatum
  misc_feature (1)...(521): n = A,T,C or G
cagtgtcgcatcgggtgtaggaggtcttgcgcgcaaacctttggaaggcgccgaaacagagggtgctctggggattcttcaagggtgtccggtaagggctttattggactggctaccaagcctgccgtcggagtactaaaaatggccaacaatgtaagtgagggtattccgcaaatacaacaaccgggtttgaccaaaatggattggatcgcacacgatacccacgatacatcccacaagatggcattgtgcgcccgtacaacccccgggaagctctcggccaatattggcttaagcaagtggacaacggaagatactttgacgaacaatacattggacatttggagctaccaaaggaagatatggtcgttatgatcacttatgctcgtatcttgcttatccgatcacnactcttaccagcgaattggacgtgccactgaaggacntccanactattgctaaggaaaagactggctnagtttgtcccttaaaagaagaacaatggacttttatcccgattg

SEQ ID NO: 856 - DNA, 347 bp, Fusarium venenatum
  misc_feature (1)...(347): n = A,T,C or G
ctggaggatctggtcgccggcatgaataagcttgccaaagctcgcaatggccctttactggaatacgacgatgtcaaggaagtcgtcgaagcgagagacagtcaaatggacaacccctacgccaaagacgcccaggccatgctcatccacaacgcgaggacatactggcccgatcgtcgtagccgtgttgcaccgccacatcgccttctggacaaggctcacggaccgttgatagctgtgcanatgaaccttcttacacnaaagacgctcggtggtatcgagacaaacttggatagtaacgttatgagggccgatggnaccccattccctgggctgtatgctgctgg

SEQ ID NO: 857 - DNA, 587 bp, Fusarium venenatum
  misc_feature (1)...(587): n = A,T,C or G
ctctttcagacggagtcgtcgtcggcagccagatcatcactacaattaaaaatgccgagcctggtcaagccctttccgatatcgagaaantactgtgcctacctgtcaggccgtgactctggagattcaaacactagagaanttggccttgttgaggccgttgctggagctagggagcccagtggtgacaatgttactgtcagcgatactattacagatgcagatatcactgccgaggangacagtgctttggtggcccagcttgctgctcttcatggcaagatccctgagcgattcggcgagttcngtggtcaatatgttcccgagagtctgatggactgcttgtcccagcttgaagaagcttcaacgcgatcaaggacnaccctcattctgggaagaataccgatcttactacgaatacatgggacaacgggccatttgcatttggctgancgaccactgaacatgctggaagtgcaacatctggttgaagcccaanattgaaccccctggcgtcncaaaatacatgctctgggacactctcttgccgccgacttggaaganccaatcatgccaanacggtctga

SEQ ID NO: 858 - DNA, 534 bp, Fusarium venenatum
  misc_feature (1)...(534): n = A,T,C or G
agatggagcaaatacctctcaactctgaagcttntgtgggtgatactcacaagcagacaacatcgacactgcccccggatgtcgntcaatgtcttgataatgctcgctttcttcacttggcaacatgcacagataacatgccccatgtttcccttatgaactatacatacctcccatcttcgccttattccaactacccagtcatcatcatgacaacaaacccggnttntaaaaagacatccaacctggtgactaaccccaacgtatcgntgcttgccatgattgggtctcccaccgaccgccgactacggncgccgaccgtnaggcggttttctggcccgancaccgtcgagtcttgcctcactctttaaatatnacctgcancctnttatatcancccacatagaggggccgtcgttggngctagggactgaaagganaatttntgngagcagatttganacacnctttgacaatntacaccgatcnttcacggaaacggcttgtgaagatgaagccgcggttnttctactg

SEQ ID NO: 859 - DNA, 571 bp, Fusarium venenatum
  misc_feature (1)...(571): n = A,T,C or G
gtactttgcggccaaggtacttttcgacattattcctcttcggatcattcccccgatcctcatgggctccatcatatatcccatgacaggactggtagccgactcgacgcatttcttcaacttcatcctcgtgctagtattgttcaatatggctgcagccgctgtgtgcctattcatcggcattgtttgtaaggatggcagcgtggcaaacctgattggcagtctcgttatgctcttcagtcttctttttgccggtttcctgctcaatcacaaggctactccaaagggcgcgctctggctcccagacctatccatattccactacggctttgaaatcacttattgtgaaagaagttcntcatcttactcctgtgtgaaagcaagttacgcctcgaaattactgtccccngcgcaacaatcccttanctccttttggaatcaacaatgacnccatgttggcccgacatttaaaaacctggaaatatcgccgccatattcacctcctgttctttaagcngccaagcacatccgcttgtttgaaaaanaaaaaaaattcaattgaatttgaaca

SEQ ID NO: 860 - DNA, 572 bp, Fusarium venenatum
gtgcctctttctcttgtcgcaaatcttttggacgtatccgacgaacctgcgcattcacgaaaccccgtcaaaatgattattcctatccgttgcttctcctgtggaaaggtcactggagacctttgggagcgctaccttcaactgatcgcagatccccgcaagactgatggcgacgctatggacgagctcggtcttaagcgatactgctgccgccgtatgatcatgacccacgtcgaccttatcgagaagcttctcaagtacactcccgacggacgaaacgagaagaacagcaattgagccagaacgtatagaggaggtcctcgtgaatgagtagcaacgggttagttgtgcatggtttggcgtttgggaaatgttaccgaaatatgtcattttgacggccagggaaagcaatgaattcatcagggtgtcagtatcagagtacaagagtcttcataatcgacagcacctttaaagacctcccgagactttgaagactccaccaatgtttgagcacccttgcttgcattacagcattcaatttgaacggaaaggaaaatctttgggtcaaggat

SEQ ID NO: 861 - DNA, 578 bp, Fusarium venenatum
  misc_feature (1)...(578): n = A,T,C or G
caatgccatcaagcttcgtgctggtcttgcttccgtcatgcatatttccgcccttggtaacaagctcttgcaagacagcaagctgaacaaccagcttcttgccgatgagcctgaccgttgtgccgctgtcatcggtctcggtatcaaccacctgcaacttcttgccagtattgtatacccctacatgccctcgacttccgatgccattcttgagcagattggtagccccggtcttgtttctatccccgaaacatggactggcgatctcatcaagcccggtcaaaagattggcgagcccaagcttctctttacacagattcctgcatccaagcttgacgaatggcgcgaggccttcggtggcgaagagattcgaaagcagaaggccttgagctgaaaaggcgcggccaaaaagctgccaaggataagaagaagaaagaactcctttgcgccaagctgagaagcgggnaacttcaaagacaaagctgctgaaaaaaaaccgtgagctacactgttgactctcctaacatanccctgagnataatatcaaactgggcanatgatcattnatgtaaatggac

SEQ ID NO: 862 - DNA, 494 bp, Fusarium venenatum
  misc_feature (1)...(494): n = A,T,C or G
gctgctcgaactaagcctgatatgattcttncacacttgggcaaactaatgccatatgtgttgcangagtcagtgatcaanaaggaacttgtgagagaagtcatgatgggacctttcaagcataccgttgatgacggccttgaggttcgaaagagcgcatatgagaccttgtntgctctaatggagactgctttcagtcgcattaacaatatcgacttttatgaccgtgttgtggcaggtctcanggacgacaatgatattcgtnagctttgtaacctcatggtgaccaactgattgccatcgacccctacgagaccacacgccgactgaactcgattgcagaggcttatngaactgttctgcagtcaagctgaaggataacgctgtgaacaagacgtaaagaaacangaagaggccaacaagagcatnttgagagtgacactgttatgggcgaaaagatnaaggccccactgggaaccctggtgctgtactaa

SEQ ID NO: 863 - DNA, 319 bp, Fusarium venenatum
  misc_feature (1)...(319): n = A,T,C or G
ctctcgtgaccgcagcaagatccgcactctcaccaccgctttccgtctcaagcatgaggttcttggctgttatctccgagctggcaacgtgaacctgcctcagtggggtttcaagcagatcgaggttacttgcacaaaggagaacaaccctcgcgacacctacacccactggaatgttgaggctcactggaacgacaagctttctcctgccgaggctggtgtttacaagtctcctttcttcacgactttgtccatttgaacgttgctatgatgacttcaaacaacgctctggttcccgatnctgacaagcaagacgatc

SEQ ID NO: 864 - DNA, 600 bp, Fusarium venenatum
  misc_feature (1)...(600): n = A,T,C or G
cgacggatctgtgtaatactttcttctcttttatgccaggttcttccttcttttgaatcgttcttatttgctggattatcctcatctcgagagtccctcacattcattataaacaaccacttgcggcactctcgatatacttgataaatctcttgttcttgtttcaacttgatcttgagactcttcacgtacaacaagaacttccccaaccaacataactaataccgtcgagctacaactcgacacccactctttggaacaccaaaaaggaatcgaacaccacacaccatccttaggccgacagccagtcccagcaaactatacaccaataccaattaataactaaactcaccaccgcagccaactttaaaagaaatggattccacaatgatgccccaggccattggccaaggtcccttctacttctacaacacagagtccaagcatgacgtccgacaacactaccctcaacaacagatgcacatgtatcccatggtccctacgttgccttncactcccgtctactcgcgacccagctctgncagtaactctcagcctccactctgtacagcaatggcctgncgcatgattccactggtt

SEQ ID NO: 865 - DNA, 939 bp, Fusarium venenatum
  misc_feature (1)...(939): n = A,T,C or G
tattgctgtctccggtctcatcttcttcgccgaccatagagtaggtagtggaagaggtaactcggatgcaccaagcagagcagtaagaaatgaagatagcagcaagaccagagtagataatgccgatcatcatgcggttacgggtatcttcagggaagttcttggccaagttggcgctggaccagtcctcagtgacgagcgagcagaagacgaggacgggaatggtgagcaagttgttgtagtacatagtgtcccaatccttgaagttcatcttgtgatatgatgtgacatgtagccaagccagaagcccccttttttgctcattctcccattgcatcgattgccttggcttgcaccgttcagttacagttgcacacccttccttctttttttccaatcttctattttatccctatccactagacttggcatctccacgctggccttctgccaattgancggatcgatttaatttggagaccacatcacaaccnggctctcatttcttgtcgtgtcttgtcctgtcccgtgcatcgcttatcctcttctcttcttgaattcggcacttttcttatcgcgcgttgaatcaaatctgaacgactccntgccgttcggccactcttttacaagaactcaccgtttggcgatcgacgtcttgacacaaccattgggcgaccagaataagaagaacgacgacttcgttggccaagatgcccgaagtcgccaacgagaacaacattgggtgatgggcgagaaggagaacgactctcttgttggtcgtgggcctggcactgacgccctccctgggcagcctgggaaggtttacgggccagaatgggaacagcggccctttctctatccttggctactgtgtttcctctatttccatgaatgttgttaacaagattttttgtttctgggcacttcatggaacctgct

SEQ ID NO: 866 - DNA, 553 bp, Fusarium venenatum
  misc_feature (1)...(553): n = A,T,C or G
tttttttttttttttttaataacaatgttgaatgttaatattgggtatctannaaataacgctgtnaaaactcaaattcatcctccagtctaattaaggggaacacgacggaagcgggnggattcccatccatcaatctcatnaatatgagtctcgcnaacaagcttgtanccaccaatnttgggaaggatgatagcccanacaagccaatagacagcaccagcggcaanaatagntataccgacnacacagtggatgtagtaaggcatgctcttgtactggttctggctagggtcatcgggagcgatgaaaggagcaattacgaggtacatgttgntgaaaaagaaaaaaacggtgacaggcanagtggccttgatgggagccgttccagttgtncttctcgcggnggaggtagaggnggaccaaaccccacccacaaaagtgtttacaatggccaaagggtangaaatgangttaaagatnaaattgtaggcatccccngganggaggagcaaggatgaccatnaccccaatgatnccagtgctngaaaaa

SEQ ID NO: 867 - DNA, 591 bp, Fusarium venenatum
gtcgtgtttcttcaacttcaccatcatccagtcagcaggtctgcacgtgaaacaagcttccttcgaaaccgaacgtcaactctacagcaatgtccaaccgattcaactctggctacggcctcggtggccccgcgccctacggcggatcccaggctgctgatcctcagcagggcgagggctttctcgagcagattcgtccctataccagcaagattgaggatgcgctcgacaccatcagcgagcctgtcaagccctatctccctgccattggccgtttcctgatcgttgtcaccttctttgaggatgctctccgtatcgtcacccaatggtccgaccagctgctttacctgaaagattaccgtcacattccttctggtattacccacctgttcctgcttgtcaacatcatcgccatgttctcttgctccaccctggtcatcatccgaaagcactccgactacccgtcgccggtctcatgggcgttgtcgtcacccaagctcttggttacggtctcatcttcgatcttaacttcttcctccgaaacctctctgtcattggtggcctggtcatggtcctgtccaatcgtgggtg

SEQ ID NO: 868 - DNA, 730 bp, Fusarium venenatum
  misc_feature (1)...(730): n = A,T,C or G
aaatgaaggacttgtctaccagtcgcgagcaactcaaggctgccaagcagtcaacacaaacacgcgtcttgtcgctcaagtcaaacccgacatctgactttgaagcgatcaagaggtcgacactcacagctntaaagaaggagantgaggaactcctcgccacactccgcggcaaatcatcatcacccatgattcctacttctgttcttgcagcaatggagcgcgaaatcacagcagccaaggcggaaacagcatcagccgagaagcgcacccgtcgtctgaaggaagtctggggttccaagtctcaagagtttaaagaagccatnttttccacgctcggttggaccgtgacattatccccaacggcaagatgcgagtcgaaagcacgttctacccatcgcagacggacgagcatgagactcgattgtgtttgatggtgagcgcggcacgatgaaggtcggcggcggtccacgaagtgattcgcgagaaggataagcgatcaaattggaattttgggttanggaaaaggggtgtattcctgggttcctggctgcgttgacgctggagttttacgaggagcatagcaaaaccgnttcaagccaaggccgtngggatgatgacttaatacccttgtacattattggagtggngggttgcgtncatagagncttgttgaaggattccaanatttctgggaatgtaaatacataatggtncctcaaaaaaaaaa

SEQ ID NO: 869 - DNA, 595 bp, Fusarium venenatum
  misc_feature (1)...(595): n = A,T,C or G
aacagtcgaaacctcgctatctcacaacttcgatcccgacccgaagcatagcgaaagcccccccttttcgatacctacggttctttgcgcttattcacatcaaaatgactggtcgcggtggtggcggtggtcgccgtgttctcgttcctcccattaacttcatcttcaagcttctccaatcacacgctacggtcagtgtctggctgtacgagcagctctccattcgtattgaaggcaagatcagaggcttcgatgagttcatgaatctggtcatcgacgatgccgtagaggttaagcagattaccaagaccaacgatnaggagtccaggagacctctcggtcaaatcctgctgaagggagacaatgtgtcgctgatccagagcgccgcaagctgaagagatggtaacgaaaccgatcgcgtggatttgggaaatagacggacaatggagtggagtggaagcatgaagggatacccaaaaccgcccgggccaattnatggcttacgaagcacttccaaggttgtcacggcgctcagtatctctcaggtgcaagaantccgtcncgccgcaaatgggtgtcgaaaagcgtcgaggan

SEQ ID NO: 870 - DNA, 619 bp, Fusarium venenatum
  misc_feature (1)...(619): n = A,T,C or G
gatggctcgtcagtaccgtatcgttcgccctgatgcctctgagcaggagatccaggctgctgttgaggacacaactggtggccaggttttcagccaagccatgatgcagagtgaccgccagggtcgcgctcgtgcggccctgagcgctgtccaagatcgtcaccaggcccttcagaagattgagcagcagatggtcgagctggcacagctgttccaggacatggacactctcgttgttcagcaggaggctgccgtcacacagattgagcagaagggtgaggaggttgtcgagaacctcgacaagggtaacgaggagattggtgtagctgtcaacactgccgcaagacacgcaagaagaagtggatctgcctgggtatctgtgtggctattattatcggtattgcattatcgtcctcatctacatctttggtattaagggacagaacaacaacaacggcggtaacaacaacaagagacgagccatcgaggccgnctctgacgctatcatgcacacagctgtcatgccgctntagctcgtcgcgttgcttggcgggaacgaaggccgcctntcttataacagcgtngcgggaaagaattacatgcccagctcccgacaacn

SEQ ID NO: 871 - DNA, 994 bp, Fusarium venenatum
  misc_feature (1)...(994): n = A,T,C or G
ggccgagcttcaccagatcatgacttgtggtttcgccaccatttctggatctacactcgtcggatacattggtcttggtctcaaccgcgaagctctcgtgtcctcgtgtatcatgtctattcccgcctctctggccatttccaagatgcgataccccgagaccgaagagaccctcacagctggtcgcgttgtcattcccgacgatgacgagcacaaggctgagaacgctcttcacgctttcgccaacggtgcttggttgggtatcaagattgctggtaccatcattacctctctgctctgcatcatcgcctttgtcgctttcatcaacggtatccttacttggatcggcagctacatcaacctccgcggcgaatacgatcttactctgcagttgatcctgggttaccttttgttccctatttcattcctgctcggagtttctcgcaccaacggcgacaactctactggagatattctccccgtcgctcgtctcattgcccaaaagatcatcaccaacgagtacaacgccttcaccgacctcaccaccgacgatcccacctcccaatactacggcctctccccccgctcccaactcatcgccacctacgctctctgcggtttcggcaacatcggttctcttggtatccagatcggtattctcagcaacttgcccccactcgcggtggtgacgttgcgcgtcttgccgtttctgcctggtctctggtgtctggccactctcacctctgcagtgtcgctggtctcgtcgtcaccaaccaagctgtcgactttacacgaacccaatcataaaatgtcatgcgtgtatgttgnaagagaacgaacgaaagaaacaaaaccnccaaaaagaaagaacgaatgaatcgtatataaaacttntnatgtatcaaggaattttatgatatgatatgctatactactatatataccaaatgctatactgganggcacgaaaatggcgatatttccggaaaaaaaa

SEQ ID NO: 872 - DNA, 306 bp, Fusarium venenatum
  misc_feature (1)...(306): n = A,T,C or G
cgataccgatcttcccactgctttcgaggcagtctttctcgattcgattctcggaaaggctttcttctgnactttccagatcttcttttacgctctacgacccatggncgtctaccgcattcccctgactcagatccacgccctnaacatcttcgttcaggnatccttcgatctggntctccttaagtacgggtctgncaactctctcctctactactggtctcttcctttctcgcaggaagnctgnatcccctggncggcactttatngcagagcactacgtttacgagaccgtacaccttcggt

SEQ ID NO: 873 - DNA, 591 bp, Fusarium venenatum
gtctggacacaaacgtcaggatctgggacccgacatctggtgagtgcttggctattcttcaaggtcacacatcccttgttgggcagcttcagatgcgcggggacacattagttacaggtggatctgatggatcagtcagagtctggtcactggagaagatgtgcccgattcaccgtcttgcagcccatgataatagcgtcactagtctgcagtttgatgatactcgagtcgtaagtggtggcagtgatggtcgagttaagatatgggatctcaagactggacatctcgttcgagaactcatcgctcaaggtgaagctgtctggcgggttgcttttgaggatgagaagtgtgttgctctggctttgagacaagggcgtacggtaatggaggtatggtcgttctcaccacccgaagaggtgctttacgaccgcccctctcgcttcaacagcgggtgctggaagatgaccctagtcgcccgttgagtgctatggctatcgactatcgctcatcacaaccaacgttggccggacccagtcgagatgcctcacccaagatgttgatatgcattgacgctggcccatcaacggccct

SEQ ID NO: 874 - DNA, 564 bp, Fusarium venenatum
  misc_feature (1)...(564): n = A,T,C or G
cgagatgcacaaggagaagaagaagatcaagaagaacgttgatggcgaggtccaggaagtcgagaaggagtggtcatactttgagttgagtggctacgaatacctaacttacaagcagtatctcgagcgcgttctacagattgggttccggtctaaggaaagtcggcttgaccagcgaggacaagcttcacgttttcggcactaccagcatcggctggatttccacctctcacgctgctgcctctcaatccatctcgatcgttacggcatatgatacactcggccccagcggcgtcgagcactctcttgtgcanaccaactgcgccgccatgtacgtcgattcgcagcttctcnagancgcttcngaaccatccagaagtctcagtcaagatcgttatcgtcaacgaccaaccatctttccaaggaaagngactcgaaaatcaaggcgatcacctgacctgaaggtctcnccttggaaaacccaaagctggtgaanaaaaccctcancccacccgctagcnnaaaacttacgcgtctgttcntccggtcacgggtnccccaggg

SEQ ID NO: 875 - DNA, 708 bp, Fusarium venenatum
acagcgatcacgcccgcgatccaacgcccaatttcccatccaacttaccatcctacaggtcgcaacaatggacgcctccaagcagcccgtcaagctcgtcaaggtcacccgagtcctcggccgaaccggttcccgtggtggtgtcacccaggtccgcgttgaattcatggacgaccagacccgatccatcatccgaaacgtcaagggcccagtccgtgaggacgacatcctttgcctcctcgagtccgagcgtgaggcccgacgactacgataaatgtgcatctggggagcatggggttcttggaagacggtcaacgacggatggtctatgcatgctgaggcgtgcgcgccttgtattgggacattgacctggagctgcacattacccttttggcactccagtttcatttgttagaggagtcacacggacgggtctgggataacgaaaaattccagaacagttcttcttctgcatgcagcattggaatccgacgaaaagtgaaattcattcttgtttctctcgcgcacggcttcctctttctcctcatcaaacgcacgcctcgcgccctctcgaagctcaaacaaggaaatggattggggggaggatatgcagtcaacacgtgctacgataattcaatgacctcggttttgacattgacctagcaacaggagaattcatgcctcttttaatgacagattgttcttcat

SEQ ID NO: 876 - DNA, 1116 bp, Fusarium venenatum
  misc_feature (1)...(1116): n = A,T,C or G
ctttcagttcattcaatcgtcttaaacgtcttgttcgcgtctttgctctcatctcaaacgcatccatcacttgtctacacacaaaccacataacttccacaaactgtcacaatgcctgccaaagccgccgccgctcccaagaaggcctctggccacgccagctaccaggatatgatcactgatgctattgtcaacctcaaggaccgaaagggctctagccgtcaatctttgaagaaatatgtcaaggccaacaacactctcaatgtcaccgacaacatgttcgactctttgttcaacaaggcactgaaggctggtgttgacaagggtgtctttgagcagcccaagggtccctccggtggtaccaagcttgccaagaagcaagcctgagcctaagaaggccgncgctcccaagaaggttgctgagaagaaggacagtgctgagaagcctgccgctaagaagcccgctgccaagaaggctgctgnttccaagaagcctgcagctgagaagaangccgctgnccccaagaagctgcccgttgagaagaagacaaccgagaagaagtctgccgagaagaccgagaaggctgagaaggttgctcttgctaaggttgcccccaagaagaccgccgctcccaagaagctgctgcccccaagaagactgccgacaaggctgagaagcccgagacaactctcacaaagacaaaggctggccgtgtcgcaaagaccacaaaggctgcccctgccaagaagccgccgcacctaaaaaggcagcgcccaagaagccgctgctaccaaggcgtntctgacgctgagcagtattgaactttaattaatgacnaccaccgcgtttaaagatttgttcacngctanggcacgggaagtacggttactggaatttcnatggtttggtttggagcgggattatttggctgtttatttgcgcacgtacncgaanactcgcgtttgtatgattcaaccctcagccatctcatgttnctggagatggtacactcgaattgcnggtncacttctacacgancatgcctntntgtattatatcccgcatgacatggcaatttttcattaagcgtgtcaggtttgagacaatgcnagcgg

SEQ ID NO: 877 - DNA, 586 bp, Fusarium venenatum
  misc_feature (1)...(586): n = A,T,C or G
ggtgaccctctcgtcaagctgttagcacaccgaggacccgttcgagatctggccgtcgatcgtgaaaggtcgatacatggtctcgacgggccaagatcagaaanatggcagtttgggatctcagaaatgttgcgcgaagtcaacagttacttcacacgccaaccagcttcgtcagtggcaatctccgatacaggcttgacagctattggttggggtactcaaacaaccatctggaagggtctcttcgataagaacgcccctgtccaagaaaaggtcagagcccttacatggcgtggggtggtgagggtaagcgcattgancgcgtacgatggtgtcctttgaaaatgttctcggtatcggtcacgactctggcttctcctccatcattgttcctggtgctggtgaagccaactacaacctctggaagtcaacccattcgagactgccaagcaacgacaagaatccgaantcaagggtctgctcaacaagctgcancccgatntgattgccctcgaccccaactactcggaacctggacttgcgatccgaaaaacacntcgtncccaaaagaacttgacctcctgct

SEQ ID NO: 878 - DNA, 1657 bp, Fusarium venenatum
  misc_feature (1)...(1657): n = A,T,C or G
caaaaactcgaccagctcgtctccattcgccttgcatcatctgaatctttcgcctttcttcttatctcttgttttttactccttcacgacaaacgtccttttcacgatactcaagataccctaaagacttttccttcacaatgtctgacactgtttaccccgaagtcctctgggctcagcgatcttccgagtctgaagcttccaagaacttcatctacctcaccatctccgtccctgatgtgcccaaggacaacatcaacctcgaccttcagcccaccaagctcaacttcactggaacctcatccactctcaagaggaagtaccatgttgagcttgagctctggggcgagatcgaccccgcagagagcaagatcaaccacacttccaagaacgttgaaataaagctacagaagaaggagctcaagaacgagtactggcccagactactcaaggactccaagcgcgtccacttcctcaagacagacttcgacaagtgggttgatgaggatgagcagaacgaggcccctgaggacgacttctctcagttcggtggtatgggtggtggcatgcctgatatgggcngcatgggtggcggcatgggtggtatgggcggttgggcggcatgggtggtgactttggggcattgacttctccaactgggaggcggngctggctttcccggcgctggacggtggtggagctggctacggcggtggtggttacgcgtaaccccagcggccctggcgctcagtcgtcttggtggtaaacacatcacaccgagatattcgcatcgcttgggtgcgacacgatgttagcgaccgcttggcttcgcagcatctcacgtttgctatttttgttttttgttttttttttcttatttgttatctggttgcttgcatttgaacgacacggcggcaccatgacctgcgaagacagacgaatgcctttttgccagcagcaacaggcagtgttcggtcccaaggctttaacgatgcatctgatagatttcgtttctttgatttcggcatactcctcgtttgatacccttagaccgagacgtggggagctggaagacgttggcagcacgctgtgatgcgatggatctagattcggacatgggtcaacagatctcacacagcattacgaagtttatgtttccgccgtctacctggggtttttatcatcccaaggcatttttcacgcattcacgatagagggtcatgttatcgccgttcacatagacaaaagtggatttctcggttctctagtgacgaatcgctcgctggtctctattgggaatagggatcagagggagagcgatgagcgcactttgaagggagcaaaggataatgggtcaacaggacggttacgtctgtttattatcagaancggagagcacgaancgttaccgcgcgacgcccataagttatggcatttggtttgggcggcaccggcatggaaaggatcacaaaagctcttactctttgccatttaggaaggacatggacacgacaaangctttgactcaaggaataatgaatgggtcacgangcttntcatgacggggccatgatgcttcccgtantnnaacagataaccatactggactggactgaggagtcctgaataaaaaaaacgcctttgatttanaaaaaat

SEQ ID NO: 879 - DNA, 586 bp, Fusarium venenatum
  misc_feature (1)...(586): n = A,T,C or G
cattctcatcaaccttcaacttttttggcattgcctcgtttcctttctttttcacctcaatccttcttcgccggtgtattcaacccgttaatcaagatggctatctctcctcaaatcaccaacctggtcatcatcctgggtatgatgcaggtctccaagcgcgttcccttcgatgatccttttgtgctcaacgttgtccgcgccgtctaccttgccagcaacgttatcattgctggtctttacttctacacccagctgaagatcaataagaagaangacctcaccaccctcaagtatgttgagcccgctcccatgggttcctctganganggcaagctcgttaccaccaccatccacgcctacganaacgaacagattcgcaccgctttccgtggccangccatgggtatggctatganggctttcatgcacttgtacatgaatacaccaacctcttctcatccagaacatcatccctctcaagaacgctttcnaaaanacatggtcaaaatcacatctttggcaacctgccgctngtgactcaacgtccctcaacaaccgctgtttcataattccatcagggtgg

SEQ ID NO: 880 - DNA, 636 bp, Fusarium venenatum
  misc_feature (1)...(636): n = A,T,C or G
cggaacccagctcgatcgatattacattctcactcacgcaacaaacaacacttctttctcatactcaatcctttcgacttacaaaccactttcggccacatatctacattttataaacaacaacataaacttcaaaatggatgactgggacaccgcaaccaagatcggcagccgcgctcgtggccccggcaatgctcagcgagagaccgtcgtccgaggaaaggctgctctcaacgctgcccaacgagctggtggtctcagcaccgagaagaagttctcttctgccaacgctggttccgcaccagagggtcagcgtatgaccaaggttgaccgatccgacgacatcatcaagcccaacaccatcggcaagactgttggcgacgtcatcgcaaaggctcgacagcagatcgagcccaagatgacccanaaggatctcgctaccccgttgcaacanccacccaggctttggtcgctgatttcgagcgaggtagcgccgcccccgaccagaaggngctncggcgccatggagcgcgtactcaatgtnaagctgnnaggcaccgacattggtgctncnaagttcctaacangaagaaatgatcaattcatgcctgattanaaggaaatatttgtaacaag

SEQ ID NO: 881 - DNA, 611 bp, Fusarium venenatum
  misc_feature (1)...(611): n = A,T,C or G
gttgccaacaatttttaacaaaaggaaggaattgctcgaaccgtcttccctcctcgccccacttctgcaccgctcgcctttccctccgctatcaatcctctaaatctgccccgcgatctttcatccgcgaaacccttcatctgcacctcgctctcacgagaaacaccagacaccatggctgccgtcgcaacagaagcccccaagatggatgagcaggtcgacctcaccaccatcccccgtcgaccccgctggcaatgaagaatcttccgacgtcaaggacgaaaagcccgtcactgttttccacgaaaaggacaacttcaacgtcaagcaccccctccaaaacaagtggactctctggttcactaagcccccgagcggcaagggcgataactggaacgttctcctcaaggaagttatcacctttgactctgttgaaaaattttggggcgtctattacaacgttgcccccgtctccgaactctctctcaagtccgactaccaccttttcaaggaangtgttcgccccgaatggggaagaccccanaacaagcatggtgggcaagtggtcttaccagtacaaggacaagcgcaacatcnactcaacgtctctg

SEQ ID NO: 882 - DNA, 167 bp, Fusarium venenatum
  misc_feature (1)...(167): n = A,T,C or G
ttcctggttgccaaccgaggcagacacccattcttgaccaacttgcatgcatgcttccaaacagagacccgtgtatacttcgtcatggagtacgttagtggtggtgatctgatgttgcacattcagcgagggcaggtcggtctaancgtgcgcaattctaccccggc

SEQ ID NO: 883 - DNA, 544 bp, Fusarium venenatum
  misc_feature (1)...(544): n = A,T,C or G
cgaggacattgaacaatgntatggccgagagaacatgacccctcgtcatgatggttctccgatccccatcaagatgattacagcagcaccagaacgcggacagatgatgaacctgatcccggagatcacgtcaagagacattatctactccgttggccacaccgaagcaacatatgaagagacatctnaggctgtgggtaagggtgctacaatgattacgcacctcttcaatgccatgcgcccacttcaccacagaaacccaggagtctttggagtcttgggcaaggccgagagcttgccgcgaccgtacttcggcatcatctctgacgggattcacttgcatcctaccaccatcaaaatagcctacagtgctacccagatggattcattctagtcacagatgcgatgcatcttgnaggtcttcccgatggagcttatccttggacgaatggagacacacatccaatattgcaaacggggttttaagctttggtngagaattccgatacaatggcggagctnaattctntacttgngngggcac

SEQ ID NO: 884 - DNA, 617 bp, Fusarium venenatum
  misc_feature (1)...(617): n = A,T,C or G
tgcgaatcgacctctatcaggaactctctgcgcagccgaattgcatcgcgcacaatccttgaagtatcatatatcgactctacaatcgccgacaagatgggaaagaaacggcgcggtcatcccgacatcgaggaggtgttgcaccgtccttggtgctactactgcgaacgtgattttgaagatctgaagcttctcatctctcatcaaaaggctaagcactttaaatgcgaccgctgtggtcgtcgtctcaacactgcaggaggtctctccgtgcacatgaaccaagtccacaaggaaaacctcacgcaggtcgaaaacgcgcttccaacagacaaggtctcgaggtggagatctttggcatggagggtattcccaggacatgctcgaccagcaccgtaaccgtatccttcagaactttcacaagcgcagaaggatagacaaatcgcgacgggaaaccctntttctggacaggggcatcacagaagaagatcaagacggggacccngatgaatttgaacanaggttgnggagtttaaacagaanaagaagggaatgnttgccatggaggcgtggatccactgctgntgtggtggtggtgntggttcttgnggccgtgn

SEQ ID NO: 885 - DNA, 425 bp, Fusarium venenatum
  misc_feature (1)...(425): n = A,T,C or G
ccagcaccaccgacaactttgtgcccacgacanccgacacantggccgccanggataccaagggaaagaaaggaggcaacaaggccgctcaggctgccaaggccgntntcaagggcacaaactcccacaagaaggtcaaggctcgntacagcacctncttccaccgccccaagaccctgatcaccagccgtgctcccaagtacccttgtcgatctgtcccccaccagcctcgtctcgatgagcacaaggttgtcatccaccctctcaacactgagagcgccatgaagaagatggagganaacaacaccctcgttttcatcgtngatatcaaggccaacanggntcaatcaagcttgccctcaanaagctttacgacattgactgcctaanataacaccctgatccncctgacggtaacaagaagg

SEQ ID NO: 886 - DNA, 1066 bp, Fusarium venenatum
  misc_feature (1)...(1066): n = A,T,C or G
ttcaaagctcatctttggatctctttctttctgttcccttattcccttgttccgcctccgtccgccctgaccgtctctccttggcctgaaatcaaccacgaataacctcctgctgcttttcgacctacccaagcgataaaagcacaattcactnttttttctccagcgtcaatcatgtcatcctacctcgaaaagcaggcaaacgccttccgaggcaccctctnctctgccgcaacgaagatctcgaatccctcgaccaacaaagccgcgtccctggctgtaccatcattactagctcctccttcgccttccccttcagctgcttctgatcctaatacccctactaccaagcgaaaacgagatgccgcgcccgaggtcccttactcgcagccacaactcacgggctatggtgctgaggtcaaaacccaaatgacctttgctgncgaatacttgaaaaagaagggcgattcaaagaccattacggaaattatcgatcatttgagtctgagaggctacgacgaagagcacaagcgccagctggcagaaggattgcgaggacatccccgtgtagactggaagcccgatgcgaacttgagcgagcagacctggaagacaggcacttacgctcaccgacccatcatccccggagttaaggacgcaaccacccttctgggtcacctgcaagcaaagacagatgcgtcaggcgtgtcggtcaaagatctcaaggacggctggcccgactgcgaggacacgatatcggcacttgagcgcgagtacaagatccttgtggtccgcacaaagaaggacaacctcccacgatacgtatggcccaacgatgcttctctacaccataaggttcagccagagttccaggccatgtggcagcgcgttcagttaccgcccatcgacgagatgcaccgcaaactcaccagcgtcgggcaaaagcctccgagcgaggacccgcgcaagaccaaggagggacagggcaacaagcccaaggtgcagaaaangcgcagggccacaggatcggaaaggcgaccaatgtccacatggcgcatttatgagg

SEQ ID NO: 887 - DNA, 665 bp, Fusarium venenatum
  misc_feature (1)...(665): n = A,T,C or G
gtggcactttttcaccttttgttttttattacaactctttcttaataccccctttcatcaaatctcaaaatcatggngcaagacccccgagctctcctccaaaaggctcagaagcagctccaaagtgccggtggcggcttcagcttctttgggggacgagaggataagtaccaagaagccgccgatctctttacccaggccgccaatgccttcaagatgcaacaacagaacctcgaggccggaaaggctttcgaacaggccgcgcaagtccagaccgataagctcaaggagcccgatgatgccgccaacaccctcgtcgatgcatttaaggcctaccgcaaagacgatcctcaaggctgccgcgaggtgcttgaacgttgccgtcgatcgatactgcgccaagggtaacttccgtcgcgcagcctctcacaaggagaaccttggtgagctgtatgaggtggatctcggcgatgcgaagagcgcgatcgaatgctacgaactcgctgccacttggtacgagggcgataacgctgctgcccttgcnaacaagctatggctcaaggttgccgatgtggccgccctcnnaaaaagattactacaaggntttcgagaaatacnaaaaggtggctgancagtcaatcaacaacaacctcatgaantacagc

SEQ ID NO: 888 - DNA, 604 bp, Fusarium venenatum
  misc_feature (1)...(604): n = A,T,C or G
cgactctcagaaagctctctctgagcttctcaattctcgcatacgaaaccactttttagctgtttacccctcgtcagccaccgtcaccatgacgctctactacactcttgtctttatgcttctcgtcttcgagatggggctcttcatgctcctggtcttccccatgcccttcaacgtcaagcgaaagatctttaccttcatttcagagaaccccgtcgtagccaagattcagtattggatgaagattaccttcatctttatcctgatcctctttgtggacagcgtgaaccgtgtctaccgtgtccagctcgagctcgccgctgcctccgaacaggccaagcacggtggaggtgccgccgtcatgggtcacgagcgtctcgaagtccaggctcgcaagttctactcgcaacgcaacatgtacctttgcggtttcaccctcttcctatcactcattcttaaccgtacctacgtcatgatcatcgaggtgatgcgtcttgaggacaaggtccgctcttacgagggtaccaaggagaacaccaaggaggccgagaagctcgctgccgccggtaagcccggtgagctcgcccgtcttcgaaangagctt

SEQ ID NO: 889 - DNA, 758 bp, Fusarium venenatum
  misc_feature (1)...(758): n = A,T,C or G
cggacggtgacaggtcgaggctgatattttgacaaaacactcgtcgacacacttcgcacaccacttcgaagctattcaagatgtcgtcgggcaaggttaaggctggagagctctggaacaagtccaaggatgatttgacaaagcagctcggtgagctcaagaccgagctcggtcagctccgcattcagaaggtcgcttcttccggctccaagctgaacagaatccacgatatccgcaagtcgattgctcgtgtcctgaccgtcatcaacgccaagcaaagggctcagctccgtttgttctacaagaacaagaagtacgctcccctcgacctccgtgccaagcagacccgtgccatccgncgccgcctatcacccgatgagaagtcccgcgtgctcgagaagaccaagaagcgcactgtccacttcctcagcgcaagttcgccatcaaggcttaagttaaaaatgctggtagttcttggcgtgtgacggacactgggtagaanggaaacggggtatggagggcgtcgcgtgctttttctttgacaaaacttcgaaatctgcatcgcatggctcagggaatctcggtctgacttgtacttatttcccggtttgggcctcgatctgggacgggatatgtccacaatgggctggccgtaggcagtcttaaaaaacaaaaatgaggtcaaaaaaaaaaaantaaaaaattnttgnggccgttnagcttgcattttanagggnccaattngccntttagggggg

SEQ ID NO: 890 - DNA, 595 bp, Fusarium venenatum
  misc_feature (1)...(595): n = A,T,C or G
gcctcgtcctcgacctctcctccacatcaaatcacatccaccatcactactctctttcacgcagagagaatcccgacacataatttattgataaagaatagactgagcttcaggctcttagttctccaggatgggtcaaggtcaatctggcatgggagaagggggacgtgatgacaaggacaagaagaaggataagcccaagtacgagcctccgcccaggcctacaacacgagttggtcgcaagaagagaaaggccggtggcaccagcgccgcacaaaagcttcccgccgtctaccctactagtcgatgcaagctccgactcttgcgaatgcagcgaatccacgatcatctcttgcttgaggaggaatacgtcgagaaccaggagccgtctgcgaaaggccaaggcagccaaggagggccaaaccgctggcaccgatgccgacgttgaccgtttagcagatgagcgcggtcgtgttgacgatatgcgangaagccccatgggtgtcggaaccctggaaagagctcattgatgatgaccatgccatcgttagtagcacaacccggtcccgagtactacgttagcatcatgagcttc

SEQ ID NO: 891 - DNA, 519 bp, Fusarium venenatum
  misc_feature (1)...(519): n = A,T,C or G
cagcaaacccgatattatccaagtaccagcaacccatccacaaccgccaatatgagtgctcaacaactcaacatcgacaacgccgaccttgagaagctcaacgataaggatcgcaccgagcttcgccagtttctcgccaacgagcagcagcgttctcagatccaagcccaaactcacagcttaacacagatgtgctgggccaagtgcgttcccggaaccatcaagaactccaagctcgacaagcccgaggagacatgtttggccaactgcgtcgagcgatttcttgacgtcaactacctcacgatgaagcacctcaacggcatgcgcaactaagcgaatagtttcgacaagtagttttggggttatcacagatcatgtatgatgaaattggtgtataattagacnggacttgggttggttgggaaatctaaaccatatccaggctggtcacttttgctgggtgcagantttgacgatcgtgatgtgtcaatatgaaagaataagattttcgacccccgt

SEQ ID NO: 892 - DNA, 591 bp, Fusarium venenatum
  misc_feature (1)...(591): n = A,T,C or G
cttccttgggacgttaattgctgttccagctgttacgtgtcttctcatggccttgcaatggggaggcaccaantttggctggggcagctggcanattatcttgcctcttgtcttttgcgcgctgctgtttactgcattcgggtacctacaataccaccaaggtgacaaggccctgctgcccccgagaattctgaagcagaggagtatcatcgcgggcatgtggtttggagcatgttgcgagggggttcttgcggttacagaatactacatgtccatctacttccagggagtgcgaggatatacacctacgaaagctgggttgcttgctcttcctatggtaggcggcttgtctatcgcctttgttatttccggccttggcacgacatggcttggatactattacccattcatgctggccacaatgtcttgaccccatcatatcaagccttctcacaactataactttgaagaacagttaaccaaaccattatccttttgtcctttttaaggctgcatcgtcttngtctcnatatccaataatacacttcaaccattctccccatgaaaantttctcttggtgaacaattttg

SEQ ID NO: 893 - DNA, 465 bp, Fusarium venenatum
aagcattcttcgccaacaagaggaaacgttgatgaccattcttgaggcatttatatacgatccaacgttggacttgcagaaagaaaaacgtacacatcggagaggagatgtaggcgtcaagcttcagcctcagagcgttgtggacagcatcaaacgcaaggttagggggttgctcccaactgaaagcattcctctgggagttgaaggccaagtggaagaactgatcaaacaagcggttgatcccagaaacttagctgcaatgtatataggctggtgtccgttcctgtgagaaaggacaaagctagaaaaaagaatggcgttgggttgaatgcatgcaagcaagaaaagggctgggttactcacaacacattgaatttttaatatgctgattttaattaaacgaacccctctttgaactcgcctcattaatattcattgtgcactaaatcaataaattatgtctct

SEQ ID NO: 894 - DNA, 439 bp, Fusarium venenatum
  misc_feature (1)...(439): n = A,T,C or G
tgnaaatnagggntcccntccataanattaaaatccctttttacacaacccctccgaagatcacccacaacccgtcatgcggtcgtattatagcactatgatgcgagcagcgagatactatggcatagaggacattcgtgtcgagcaagttcctctgccttctgtaaagccaggacaagtcaaggttgctccggcgtttgtcggcatctgcggaacggatttgcacgagtatttaggaggcccaaatttctgccccacgacacctnatcccatcaccaaggaatctattcctgtcacccttggacacgaattctttggcatcatcactgaggncggtcctgacgtcgaaggctttgaagtcggcagccctgtgctattcaccaacgctattctgcggcactgngcagttgccacaaccatgccganaatgtctgcacag

SEQ ID NO: 895 - DNA, 576 bp, Fusarium venenatum
  misc_feature (1)...(576): n = A,T,C or G
gcgctgtggtattcaatatgtcgctcaatatccccaacgcccctaacgcgggtctctttaagcagggttataataagtaagttgtcttttcttggtctggcctttactcccctccttggtgctacttctgcttgttgctgggcagctccccgcctctttatgntgtctctcccgtatccaacttcatgactacagcctttttcaaaaacaccaaactaacaagtctcccttcttctctacagctacgactctgaaagatggtgccgtcctccgcaacatcgacgcctgcagagcaattgcgtccaccgtccagaactctctcgggccctatgggcgcaacaaggtcgttatcaaccatctgcaaaagangantcttacctccgacgctgctaccatcctccgagaactcgaagtcgtacaccccgccgctaagctccttgtcatggncagtcagcaacaggaagccgaaatnggtgatgccaccaactttgtcatcgtccttgctgggcgaactgctccgaaaactgaaganttgctaccatgggtctcaananatcaaaatatcgtcatcnggtt

SEQ ID NO: 896 - DNA, 617 bp, Fusarium venenatum
  misc_feature (1)...(617): n = A,T,C or G
ttcaatcctccaccaaccccgacaacacaccaaactttactatccgatagcgcaatatcgcacagccatgccaccttcgtcatcaaacacagccgctgcgtcgcgaagtgcgagtaagcgactgattaaagagctggagacatggagtagagaacaaaaggaagagaagggcattgagcgcctcgggcctgtcaacgaaggcgatttgatggagtgggaagctgtcatcaatggacggggtataggacaaggttatgatgaaggacgctggcttgtcaacatctccattccatcgacataccctctcgcaccgccaaagatgacctttgttacacctatcgtgcaccccaacattgcgctgcagaacggagaaatctgcctcgatcttctcaaggatgcctggactccagcttatagtgttcttgaatgcgtgcgcgccgtgcgtatgttgctttggatgtcccgagacggacagtcctttgaatgttgacgtcgcagcgctgntgcgctcgggcgatgtgttggggtaccccggaagctagtcgagttctgggtgntcgggaattnttgattcgagatccaaggggccatgatatgtcggttcgactacgtttgan

SEQ ID NO: 897 - DNA, 586 bp, Fusarium venenatum
attacagctcccacctttaacacgctctcaacataaaacttcctttgcgatggacgatcaacaattaccagcggctcctcagcagccgcccaagaaaggttcaccaccctagaacctcacgacccaagcccccaactcccggaaacgaggaagcctctgcgaatctcaatctcggagagttccaggatgttgatactctgacactctccgaagctgctctggttctaaacgctctccacgccaagcgaaagaatgaccgccgaaacgttaacaacaccgagatgttgaactcgactctcacctacctcgataactttgcgcgattcacgcaaaaggagaacgtagaagctgttgagcgtcttctcagcgcacacaagaatcttgccaagtttgagcgcgcacagctgggctccctatgctgtgaaggagccgacgaagcgaagacactgattccttcactggccgacaagatctcggatcaggaccttcaggatttgctcgacgagatttctaagctccagactcgatgaagcgctcactgcatctacataacgagactttgttcaaactcaacaccaaaacgaag

SEQ ID NO: 898 - DNA, 941 bp, Fusarium venenatum
  misc_feature (1)...(941): n = A,T,C or G
tcttttgtaacaaactgatggggcctttctctgcaattaacatgtcgtcatacaaactcactccattaagaagcttcgaaccactaaatattncgtctcattggtcatcccccacattatcgtctggcagggcatgggaatgaattgggaagcttcctttaagggtgggtgaatgcttgcgtttttggtcacctaaaaaactggcgttcgcaatgggcgcccatgatccgttctttccctctcggctctcccactggcgtttcccatcatcccacctcccctccccaaagcttcccctactttaatacgacttgatgcgtccttacctttcctctagaatactccaaagctttcgcacagctcggatacagactcctcttcctctagcaaagtccttttccacatacagagcaatgtcgcaagaatacaagctcaagggtctatcgtccctgtctctttctccaggctctaagcaggaagtcgaagtccaaggtgtcgaagatggcaaggttctcctcgtcaacactggaagcacaacacaggctttaggagccaaatgtactcactacggtgcacctctggcaaagggtgtgttgaccagtgatggtcgtatcacatgtccctggcacggagcctgtttcaatgcaaagaccggcgatatcgaagatgcccccgcccttgacaatctccccgttttcaaggttgccgaacgagacggtgccgtttacatcactggagaagagagcgccatcaagtcttccaagaaacaacccaacgtcaagtgtgccggatccagcagcgcacaagacgaacatgtcgtcgtcgtcggngggggctcaagtacattgggtgttgnccaaantctttcccaanaagggttggaanggaagaatcaccgtcgtgtctaacgaaaggaaactccccaatcgacccgaaacgaa

SEQ ID NO: 899 - DNA, 799 bp, Fusarium venenatum
  misc_feature (1)...(799): n = A,T,C or G
ggccatcggtgctatcctcgctctcatgatctgcgacgccgacaagatcgtccgggaggacaacacaaaggtcatcgtcatgaagaacccctcgtggagcacagagatcaagggcctctgggagactctctacagcgcaccctgggtcgtcctcctcttccccatgttcttctcctccaacatcttttacacttaccagaacgtcaacatgaatctcgcccagttcaacgtccgcacccgcgcgctcaacaacctgctctactggctagcccagatcttcggtgctctcattattggctacgccctcgacatctcgagcgttcgtcgcagcgtccgcgcaaaaatctcccccgccgccctgtttngtcctgaactttggcaatctgggggtgggggctaccctgggcaaaaggataagcgaaccccccaagatcgctatgaaacccccccaatgaaagaatgaacaagatcgaactggggaacgaacggtgccaagcgaattcgtccctccccatgttcctctactttttctacggcttcctttgatgccgcctggcaaacttgcatctactggtacatgggcgctctctccaactctngccgcaagacgccaactttgctggtttctacaagggtatccaatctgcaggcgctgccatcttctggcgtatggatggtctcggcaagccattcgacaccatctttgccgcaacatgggcctgcctcggcgcctcgctcgtcatcgctgcaccagtgattttcatgaanatcaagattccatctccctggaaggaagacc

SEQ ID NO: 900 - DNA, 577 bp, Fusarium venenatum
  misc_feature (1)...(577): n = A,T,C or G
cttgctgtagctgtcgacctcggtcttgggccccgcattggtggtgtcgaaataatcggcaataagaggtgtcatatctgacttctcggaattcgtgtgcgaaaagagcagcttctgcgcagggaccgagccggaggagtagattatgatcttctttccactcttaatggcttcgttnaagaaggtctcgacatccgggaagaggggagcgacgatgttgccagactcgtaaccctgcagccagaggtatccctggagcgacttgaggtacgctatcttgacatcgcgcttcacgagatcgcggacgtgagcttcaaaatcagaaggcgagttgcggtactcctcggggaaagcatcacggtactttgcaaactctggactgtcccactcttgttccaagactttgggaagtgcttcgagtgcatacgggaactgggtacggcgaacagaccttggtcagcaggctgcactgttgttgacgttgggcacactatcgcgaatcggggcaaagtcngtgaangggtcaaagaagctggggttgaatganatctgggttccaaagaaaaaattcagatgc

SEQ ID NO: 901 - DNA, 586 bp, Fusarium venenatum
  misc_feature (1)...(586): n = A,T,C or G
cgacgcccttagccaggcattccctcccaagcctcatttcaccgagtctaacgtacccgatctcacaggaaaggtcagtattgtcactggagcaaacacaggtgttggtcgtgagatcgcacaggtcctctacagcaaaaatgctactgtctgggtagctgctcgcaatgaaaagaagantcgcgatgctatcgagggcatcaagaagcatcaccctgcatccaagggttccatcaagtttctcaagcttgatctcgcagacctgacaactatcggtcaatcggccaaagantttcttgcccaagaaacaagactcgatgtcctgttcaacaatgctggtgtcatgacccaccagaaggctcaaagacggagcaaggatatgaactccaactagantcaattgcttgggccacttcttattcaccaacacctcaccctcttcttcnatcaacatccaatcagcacccaaaacctgtcctgtgatttggtttcaatttcactgcaattttttgccctaagacgtttcaacgtnatatcttgaataccatcaccgcncacctgatgccaattttctacaaccaggggn

SEQ ID NO: 902 - DNA, 604 bp, Fusarium venenatum
  misc_feature (1)...(604): n = A,T,C or G
gcacctctcgataagacctcatcataatccaccgcaatcatgtccgcgacaaaggagttcaccatgcaggatgttgctgagcacaacacctccaaagacatctacatggttgtccacgagaaggtctacgactgcaccaagttcctcgacgagcaccccggtggtgaggaagttatgctcgatgtcgccggtcaagacgccaccgaggctttcgaggatgtcggccacagtgacgaggcccgagaggttctcgatggtctccttgttggtgagctcaagcgtctgctggtgaagagggccccaaacgccatatcgcaactnaaaccaggggaggggncaggatcctaccggctcagcttgacctnttacgcttttgttgcgctgcggnttcgccncctacatgggctacaactncntcaaaagcaaaacgaggcccaaggctccgcataagtgtctnacctcantcttaacgcatgaggacggngantataaaaggggnctttgtgatttgttttgcattcaatgccggttacngatgatgaccnacatttgcttngggagtttttttgcctgaggnaaaagccgtcgaanaaacgtgcttgca

SEQ ID NO: 903 - DNA, 590 bp, Fusarium venenatum
  misc_feature (1)...(590): n = A,T,C or G
agtcaattacctatttaattgtagagtccccctaatgatagtatggaacaaaaacaacaaagcaacaacactacaacacgagtcgatctagaaacaggaaatcacagaaaccaatatctatcaacatgtctcaaaccaacagcagcaccaacggtcatagcaacgggcacaatgcctctactatctccagcgctaccaagcttcgtcagaggctagagtccaacgatatcctggtcgcaccgggtgtttacgaaggtttcagtgcacgtattgcgcttgaggtgggattcgagtgcctctacatgaccggagctggtactgttgcatcgaagcttggccagcccgaccttggcttcgcgtcctcaacgacatgcgcgaacacgccgagatgatcgcaaacctcgacaattctgtacctttgatcgctgacgccgataccggctacggtggccccaatatggtggctcgaancgtcgcgcaatatcaccgctctggtgttgctggncttcacattgaagatcaaatccagaacaagcgatgtggtcacctccgtggcaaggccgtggtcgatatcnaaacttcgaacagcg

SEQ ID NO: 904 - DNA, 449 bp, Fusarium venenatum
  misc_feature (1)...(449): n = A,T,C or G
ntggcaaaaccaacggactgtcntgtgcgccaccaactccagagggagacttttcttacaacactgtttttggccaacgttctcttctntctggngaaaaggtacctcagaaaatagacgacattctatgtcttgcttcggcgtncaaattcccaaccagcattgntgctctacagtgtgttgaagaaggtcttcttnctctnaaagganacttgtcaactgtagccccagagttggccgaaaagaaagttctgacaggatggtctgagaatgatgaaccattgttggaagacncgtcccanaaaatcacacttgaaatgctgcttacgcatagtgctggngcgacgnacgacttttntacatccgtttattgggaaggggngngcccaatntaaaccaangatccagggcaaaaagaatgtcgaaaanacttttatttatnctctttt

SEQ ID NO: 905 - DNA, 510 bp, Fusarium venenatum
  misc_feature (1)...(510): n = A,T,C or G
gcccattcctggtacctaccacgacgagactctggaaatcctcatgaccgatcttgatccggagaatgccaagcagttctatctgtcgcacgcgagtgcggtcgcaagcgacaagatggctgccgaggcaaagaatgctcgcaaggaagccatcaatagtcttggtggacttggcgaggatgttgacgaagtggacgttttcgccaatgacgtcgacagcaacatgcttgactctgtcgaagctctcaccaccgaaggtcacgcattgggaactgtcgtttcggananttgcggcctctccagcgtctaccaacatcccagtatcccgaccccgagtggaccgtacttgttcagcccctgcggctttccgccaacggtgttgttctcctccttcttccgccgaaggaagcaagggtgacactactttaccgtccacgtcctcctganccccntgttcgttgctcttcnanaacaacttcccggtggacgantggacnaaccccctgaatc

SEQ ID NO: 906 - DNA, 609 bp, Fusarium venenatum
  misc_feature (1)...(609): n = A,T,C or G
tttaaacagaagantatcctcacctcacccttctccctctctgttgtcctctgttacacaacatctcacccatcttacatcaaccatgttcgccaaagccatcactgcctttgcccttgtggcacctcttgtctcagcacagactttcacaagctgcaaccctctcacaacttcatgtcctcctgaccctgcttttggcaaggacaccgtccactgtgacttcacaaagggagcttgtccagcttttgaggaagacgccggtacatcaatcagtcacaacgccaacggtgccgtctttacaatttctggacccaaccaagcccctacagttgccacgggcaagtacatcttgtttggccgtgtcgatattgaagtccaagcttcttccggtgttggtattgttaccaacgctgttttgcaatctgactgtcttgatgaaattgattgggaatggctaggaagtgacaatgttcaattcaatccactactcaccaaggtgacgtgagcactacaacgaagacttcaccctgtcgaaaaccccatcgaanatccnctctactccatgatgagnggaccccccagccgttaactggatcatcnacnatgttg

SEQ ID NO: 907 - DNA, 633 bp, Fusarium venenatum
  misc_feature (1)...(633): n = A,T,C or G
accgacaacgcctagaagcaacgggcaacagtgaatgcattatactcttttggacataaaacaaacaccatcgttatcagcataatcaactggaatttaatcaattccctcccaaaatgtctattcctatgcaacgtctgggcggtcgcgcctttgcccatgatgacgataatattgagcaagagtacgaccgattgagagacctggcgcgagccgaggcaaagaagcgtaacgactgctttgctcgctcacgtcaagcctatgaagatggagatggagctggcgcaaaggagctctccaaccagggcaaggcccacgccgcgcgcatggacgactacaaccaacaagcctccgaattcatcttccgggagaacaatgcctctggacgcgtagaggccgactctatcgatctccacggcctctacgtcgaagaagctgagagaatactcgaagagcgcattcgttctgaccaggccaatggccaaacacatctgtacgccatcgtcggcaagggacaccactcttgccggtggtgtccggaagctcaagccccaaggtcgaanaactgtgccaagaactcgggctgcggtnccaaacagacaaggaccaccccnggagggtaatcatcaacct

SEQ ID NO: 908 - DNA, 643 bp, Fusarium venenatum
  misc_feature (1)...(643): n = A,T,C or G
cttgaatgcggcgcaacctcacgacaacccggcacctccgtccaacgttcgatctcgttgccatctcctccacgactacgtctataattgtcgcattcttttgaattgctaggagtttggcttgttccgacctgctccaagctaccccgctgtcatattcgccaacgacaagatggccacaccagctccccccgaggaccaagctcgtctgcttgaagatgccctggttgcagtgcgtcagcagacttcgctcatgcgcaaatgtctcgacacaccgggaaagctaatggatgcgcttaagtgctgctcgacccttgtttctgagctccgtaccagcagccttggtcccaagcaatactacgagctgtacatgtctgttttcgatgccctgcgatacttgtcgtcaccttcgcgaaaaccatcctgtcaatncctaccgactctacgagcttggtcagtatgcangcaacatcgttccgcgaatatatctnatgaataccgngggaacgcttacatnggcattgaggatgcgcccctcaaggngctcatgaaagacatgatggacatgaatcgaggnggttaacatnctatccgggggccttttnttccgtantaacttttccggccaagcgagaganttttn

SEQ ID NO: 909 - DNA, 550 bp, Fusarium venenatum
  misc_feature (1)...(550): n = A,T,C or G
ccctgtttttcccttctcttcttacttgaagtcgattttccctaaagttcttccttttcctttcttcaaactacctgacaacactacgtatccttctgctanctcagaaaggcttgtttctttaccgtctttgttacacaacaccagccgggttactcccagcactgaagacaaccaccacaatgttcacttccagatctcacagcctcctggtggggcttgttatcctcgttgctctggcctcgccggccgttgccttcgganctggtaacattgcctcaatttccaaggtngaaggtcagaactggcgccacggcgatatcactgatgcactcctgatcctgtccaggcccaggctctcaatggcaagaantttaacaaaatcaacgtctctcgtgtctacttcggaaactggcttcgagattatctcaggccatcgatgtctgtaccgtcaantctgtttccgccgaagccattcgcctcttgctctgcgttctcngtttcatgaacttcngttatggttctggcgaatttgaaggtcctgccgaac

SEQ ID NO: 910 - DNA, 683 bp, Fusarium venenatum
  misc_feature (1)...(683): n = A,T,C or G
ccgacctagatctaaacttttgcaacctttcagactcagactcagactcttaacaaactcgctcctacaccctcacacatcatccatcatgtcgtggcaagcatacatcgactcaagcctcgtcggctccggtcacatcgacaagggcgccattatcagcgccgctggcgacagcgtttgggctgcctcttccgacctccagctcaagcctgaanagatgaaggccatctctgccattgttggcggtgacaccaaggccatggacaaggcttttgccgaaggtctctacatcgccggtgagcgatatgttatggcccgagctgagggtcgaagtatctacgctcgatcgggtcgttccggtgtcgctgtcgcaaagaccacccaggccatcgtcgtcggccaccacggcgaggcccaggtcgccggtaacgccacctctaccgtcgagggtctcgccgactacctcatcaagtcgaactactanatattggtttgtgtgcaaggcaaggcgaagaagggtttttgggcggaattatctgtcanaancgtcataaaaaacnctgtatgtccgtaaaccggatagtcaacgcanctgtaacgagcttatgccaagaggagcgagccccctttgtttttaaaaacactgggggttgaaccttnaanctttgagtgtttgggtgtnt

SEQ ID NO: 911 - DNA, 736 bp, Fusarium venenatum
  misc_feature (1)...(736): n = A,T,C or G
cggccgtctcgtcttccanaacctncaaaaggtcatctcctaccttcttcccgccggtagttggtccgagatctggcccgtcattctcaacgtcttcttnggtgttcctctccctctgagcgctttccttatgatcatcatctgtgtctttaccgatcttttcctaagtctctcacttatcatggagaaggaggaattcgatcttctatctcttcctcctcgcaaccacaagcgcgatcatnttatcaacaccaagatctacacccaagcctacctattcactggtttcatggagaccatcactgcgcactccatgttctttctctacatgtggaagtacgccaagatgcccgtgtcggaacttttcttnctttttgaaggttactcagagggttatcacggctacaccaaggatgagctcatcaagttcaacaacactggccagtgtgtttactttgtcacactcgtgttccttcaatggggtaacatcctcgctgtgcgaaaccgcgcttgagtattttccaggctagtcctttgagcaaggctcatcgcaacccttggttgattctcaacatgcttatcaagtttgngcattgccatttttgncaccgaggtcctggaattcaaaaattgtcgatacaaantctgggcccaatgagttttgggtcattcctattcctcttgggatgggtattctggngggggacaaaaataaaaagtntttggganaaantat

SEQ ID NO: 912 - DNA, 361 bp, Fusarium venenatum
  misc_feature (1)...(361): n = A,T,C or G
ntgaactactanttggcattggcaaattggaanttggcttgccacttatgcgtttnggaagttcgatgacttttttnggggngaaactcgaaaaacagttggcgaaaagaccaanaaggctggtcttgaatacgagggtgagtttgacagcagcaaaattactatgaagcgatgggccgagtttgagcgcgacaagcgttcaagaagtggctactggggctcgcgtgaaaacgtgancggggggtggngggacaaacctggaaaagcccgccaggtcaccaatataatgaggagtattattctggatgcttnaattcttggacgccttttggnttacnggatttaagnatttttgaaaacc

SEQ ID NO: 913 - DNA, 592 bp, Fusarium venenatum
  misc_feature (1)...(592): n = A,T,C or G
ccgaccttttttatttccattttcgcaaagaggcatattctacttattcctgattctttaattttttttttcattttcctcgcaaacaacctccacgtacttgaagttacacaacttgcccaaaatgcctcttcgtcttgccatcctcgaagccgacacgcctcagccgcaaactcgcgatcgctacggcggctacacaggcgtctttaccgcactcctcgaagcagcggccaagcctcagaagctcaccgacctcgtcaccatcaagggctacgacgtcgtcaatgagctgcactcgtaccccgcgctcgacgacatcgatgcgatcctcatcactggctcccgacacacggcattcgacaacgacccttggatcttgaagttggtcgagtacacaaaaaaggccattgcttcgaatcgagtgcgcgtcgtaggcgtctgcttcggtcatcaaattgttggtcgggctgaaggcgccaagtgcggaaaaagcaacaacgggtgggaagttgctgtcacagaagttgaactgacagccaagggtaaagaantatttgggtgggaaaagatgcgcatcccccagatgcatcgc

SEQ ID NO: 914 - DNA, 548 bp, Fusarium venenatum
  misc_feature (1)...(548): n = A,T,C or G
aattgagcgtcattcagactctcgacggaccaacgcggcaattgaccaattaccgagtctcgaacccttcgaaataccgacatcatgagcttcgtcacccgccgagcgctctcgacgctcattcctcccaaggtcgcttctcccaaggccattggcgccgcccctgatgctatccgcatgcagcgtgtcgtcagcttctacnanaagcttccccgtggtgccgcccccgaggtcaaggctaagggtctcctcggccgataccaggccaagcacttcggcaagaaccctactgccaagcccatcattcacttgattgtcttccttggcggtattggttacgcccaaaactactactttcatctccgccaccacaagaacaacgctcactaagcgatgactttttgataccttaaacgggtcgttgtgtgaaaaggaacgggggtcgtgtacatataaactncggaaacttcgcgggcgaatacgccgccttaacttccctatgtatctntacaagcaagtgaagggacactactatcacgttttgggtn

SEQ ID NO: 915 - DNA, 632 bp, Fusarium venenatum
  misc_feature (1)...(632): n = A,T,C or G
cgcgacaagactacactaggacttttccacattgagcgcttgcaagagacaacccggaatctagagtagcttcagtagctgcagtatgaaccagcgacagcgacgaagcccaccatgagcaaccttcaaccccccaacgccggcccagcgtccaccccatcacccagcggcaaggacggcctacgataccccagcaatggaaagaccatctaccacagaccattaaacagaaccaaggcggctgagctgagccaggccagttttgcgtatctgtttggcgagatggtgacgtatgcgcagaaacgggtcaagggcatccaggagctggaacaacgtcttaacctacaaggtcattctatcggcctcaaacttctggacctcctcctcttccgcgaaccagcgcgcacgcaaacccgccctctaggcattattcaactgctacactttatcaagcagaacatttggcagcacctctttggtcgacaagcggaccgtctcgagaagtctgccaaccccgaaacgcccgacgaataccacatcatcgataacgagcccctcgtgaaccaatacatcagtgtgcccaaggaaatgagccagttgaactgcgcancgtttgtancgggcgttgtgga

SEQ ID NO: 916 - DNA, 620 bp, Fusarium venenatum
  misc_feature (1)...(620): n = A,T,C or G
ctcacaaaacaacttcaatgctccagtcaaaatgtcctccatcaatttctctccagacaccgacatccccagtctcaatggcaaggttatcctcatcactggaggaaactctggcctgggtctggaaagcacccgacaactcctgaaacacgaccctgccaagattttccttgcatgtcgctccaaagcaaaattcgatcaagccatcgccgagctgcaagagcaaggctcaaatacagatgctgtgtattttctttccctgaatcttgcctcacttgaaagcattaaatctgctgtcaaagaattccagcaacagtccactcgccttgacattctcctcaacaatgccggtattatgatgacacccgaaggcctcactgaggaaggatatgaggttcaaattggtacaaaccatatgggtcacgctttcctcactcatcttttccttcctctgctcgaggagactactaagctcaaccctgatgtgagggttgncttctcgcctcgatgggtgaagccatgtcttctaagaacccttaccaattcgagcagttcaagactaccatgcccaacctatcaagctcatcccgttctctatctcgaagctnggcaacgtccat

SEQ ID NO: 917 - DNA, 1092 bp, Fusarium venenatum
  misc_feature (1)...(1092): n = A,T,C or G
gctaactgcggactcaatgcacaaattctcaaggccacttttcctctgacctttgtagtcaagataccagccatgttgcttgaaatcaggctttttgatacgccagtgttgatcgcctccaattcatcttccgtcaacccctttcgtgcatatcgaaatgtcacgatccccagactcgcggagctgacgatctcccaatcattcagttggcgcaattcttcttctgctctctcagctaggtcaaacccatgatcaatcatctttcctagcttctctacgccaataacccgcagtgtgaaccacagcttcatcgcccgcgacgcaggacgtgtgagctccatactataattccaaaagttgggaatttcctcatcttctatcgcaacgccatcgcgtagataatcgcctcatttgcaaagctccgcaccaggttggccttgtcctttactaacaacaacccacaagctgtaggtttggaaagaagccatttatgcccgtccatgacatactggtcgggcgtactttgagaaccatccacccgctttcgtggacgtgtaagtcgaaaaaagtcgcttgaggcgcccgtatgcaccatctacatggcagccaaagttgctccccgtttgcatatatccgagagctggtccaacgggtcgatggcgccagtatttggtggttccgcaagtggccaaccaccagaaaaggnacaaggccggcttttcgggcctcgggtatcggcatcttcaaaaggctcgggttgaaattgaaggactcgctggcaggcaaaatacgaatctggcctttgtcgaaaccgagtnaacgcanggctttggcgacagaataatgagtctggtcaaaagagataaacaacgcccttgtgcgaatcggcatgtggacaaagcngtcgcgagcgaatacaatggccattaaattcgncattgnaccacccgaaacacaaataccncccgcagntgaanggaattcnactttgggaagccagncactngatcnaaagtttttttaatgaaccctggggccttganggctggaaattttnaacanccaaggnanttgaaangcttgnttccaaat

SEQ ID NO: 918 - DNA, 628 bp, Fusarium venenatum
  misc_feature (1)...(628): n = A,T,C or G
ctcatccaggacccctcctagcctactctacagtcgcacctcacttcactggtgattatcttccaggatggcttctgacgaggagaagaactccgccaagtacgaaaacaatggcagtgccggcgaaaagtaccttgccgacaatggcgacattgccgctggacacacaaccgacaacgccgatggtctgcaccgtctactcaacaacagacagatccagcttgttgccattggtggctccatcggtaccgctctcttcgtgagtatcggtggtggtcttgccaagggtggtcctctcggtctgtttctcgcctacacaatctactctggtatcctcgcttgtgtgaacaatggtatcgccgagatgactacttatatgcctgtttctggtggtttcatccgtctcgctggtcattggtgtgatgatgctcttggttttatggctggttggaacttcttcctttacgaaggtcttctcattccattcgaaatcaccgctatcaaccttgtcctgtcttactggagtcccgagattacacaanccgggncctaccggctggcatctgtantggtgtcattantctataagctctcctcaacatcttggccgtcaaggttacggtgaanc

SEQ ID NO: 919 - DNA, 612 bp, Fusarium venenatum
  misc_feature (1)...(612): n = A,T,C or G
catatttttcctcccctcgcaactccgagtcttttatcaacgatattatattacatcgcgcgcatcgaacgagaccgatagatcgattctgccgacgatacaatggccgacgaacaaccccgtggcatcgaccacactgattccatcgactcaaatgatggcccgaagcagccggacaagaagaagagtcgccgccctgcgaatactgcctttcgacagcaacgtntaaaggcctggcagcctatcctcacaccaaagactgtcctgcctctcttcttcgccattggaattatattcgctcccatcggaggtctgctgttgtacgcgagctctcaggtccaagagattcgactcgactataccaactgcattgncgatgctcccattcgtagtagaggnggaagcaactttacagcaatacctggcagcgcccgtcagcactgcattcaagagttctaacaagttctgtgaatgctcaatgggcgcgcgaggtcaacgcagcccacgcttgacacggggttaaaaactttcaccctcgatgccatcttaagtttaccatccaaaagagatgggtcttcgggttttttntctccccntaccaatttctaccaa

SEQ ID NO: 920 - DNA, 997 bp, Fusarium venenatum
  misc_feature (1)...(997): n = A,T,C or G
ccgtatgtaaataatcgtaacaattcgttaacaggctaaacaaagccacaataatactatctcatnagggctacaaaaaaacatccatcttgattaacctttcctccatttttgatcgtttagtgcttctcgccagactcgggagcgctcacattggggccgttgtccgcagaggcagcaggaactgatgttcccagagcaccgtgaccagcctcaggagcggcagtatcanaagtcttctccttgccaaagaccttctnaagaccagcagccttgtaggcacttccaccgtgctcctccttcttgagatcagcaagacgacgaacctcggcgtggacctcttggacctgtcggctgccctcggtgtaaaaatcggcaatcttcttnccggtgggtgtgttggaggccttctcaaagtaagagctcaagccgagccacaggctgttggcacgttggaagatgccgtagctntcatcggtggccttggcccggtcggtggcgtggtacttctcgtcgagacccttgagggtgganaaaaagcggttggtgacaccgtgagtggcatcgaggtcaagancacgctggatggcggcgtcacctacgacgtagccgtgggcgaggtactcggccaggatacgggcgcggggcttctcctcttgggtgatctcgtcggagtcgcgatcagcattcttggttgtgggaacatcgtcgtcaccatcggcggtggcgctggtgacctcaagatggtttgtgccgagctgggtgttgttgaggaggagagcagtcttcttggcggtctccttctcgaagatgacctctgcggactttgtctcgccgtcctgagtgaccttgagatcttggatcttgccgcagaagctgaaaaagtccttgatctcgctgtcgctggtggcgggggcgatgttcttgacgttgatagtagagttggcagacatggtgaatgtgtgttgtgttgttttgtttagggggtatcaaactt

SEQ ID NO: 921 - DNA, 627 bp, Fusarium venenatum
  misc_feature (1)...(627): n = A,T,C or G
acaaagatacatcgacagtcgaaaacaacaagcctgattcgagatatctgacgcttctctatagacagacttctcctacaatcgttcaatatgcccatcgcagtctcgccaacgttgcccaagaatggcctcaccaaattcaccaactgtcgattgctgaaaggcaacgatctggtctgggatgacctttgggtcagttctgtcaatggcaagatcgtcgacagccaggcctccttctacggtggccgtaacatgcctgataatactatcgatctcggcggtcgcatcattgccccaggttttatcgagtgccagctcaacggtgcctttgggtttaacttctcaactctcctcgatgacatgaccgaatacggcaaaaacatccaaaaggtcaaccgtctactggttaggacaagggtcacatcctacctcccaaccatcacaagtcaacggccggaactataccaaaagacacttccataccttggcccgtccggggaactgcggatcccccaccacggaacccgaatctctcggaactcaatgtgaaggtcctttcttgaaccctaccaagaacggagtccacaatggtgatgtcctnaccgaagctcactctatcgaggacaa

SEQ ID NO: 922 - DNA, 552 bp, Fusarium venenatum
  misc_feature (1)...(552): n = A,T,C or G
ttctggccagaacccgggctacagtcacgatggctacgaggtagcttcgccgctcattccccacggtgtctctgtggccgtctccgctccggctgtctttcggttcaccgccgcttcaaacccagaccgtcatctggcagcggccgaggcctttggtgtagatatcagcaacgtgaagcgagagagcgcaggcgaagttctcgctgaggccatcacaaagtttttggcagagttgggtgaccagcccaagggtctgaaggacctgggctttggcacggaacacattgaggcccttgtggagggtaccattccgcaggcacgtgtgttgatgctggcaccaggattgtctacagagctggaagcggagaaggaccagttacgaagactgtttgagaatgccatgacacattgatgatggtcggtcctgaagataggaggtttgattatcatgcgggtatgcgattgcgcgttgccgatcgatgtgtttgactacaaaagggatgtcgtgccactttatatatttggatgtacaattgatctactgnacaaatn

SEQ ID NO: 923 - DNA, 616 bp, Fusarium venenatum
  misc_feature (1)...(616): n = A,T,C or G
cttacctctactgtgaatcaatnggggcagaatgcaagaacatcaagacaagatcgccacgttggcagacggganaaaagtggcgtatgcaatctacggcacagacaatgacaatgcacctacaaccttctacttccatggtttcccagggtctcatcacgaaggcggctcgacgcacagcgcagctctgaagcacgggctacgcgtcatcgcgctttcacgaccaggatacagcgactcgacattccaagacaacagatcgattctggattatccccaagacatcctcgagatagcagattttctctcgatacaacgctttgccatccttggagtctctggcggnggtccttacgcaattgcttgtctgaaaaaattacctcgggaganactcgtcggcattggcacggnagctggatgcatgcccctgtcattctccacccaaggnatgcttgccataacgcgtatnatgttcaacgttgcgccgtatgctacaacacccctttggatgggtgatagataaattactanggagcacagcccgcnacacggaacattcggnaaaactggaaanacatgatggatnaagatgtaacccgcaaaacnccccccgacg

SEQ ID NO: 924 - DNA, 581 bp, Fusarium venenatum
  misc_feature (1)...(581): n = A,T,C or G
gtcccaccaaacggttattcagccattgaattggctcgactattatctaccaataccttggccaaatgtgcccgagacaagtctagatgagcctggcttggagcgctggccgtgcctggagtcggcaatgcctctcgcaagctagaccatcatggtccgcatgccacaatagaacactgctacgaatcgcaccacgacttgtcccagcctttcgcgcatacgcttcctcgaatacgaaacctaccccagccgaactcgaggctcggattgctgcgattccgattgaaagataccgaaacttttgtattgttgcgcatatcgaccatggaaagagtacactgagcgatcgactgctgggaatacacagggaccatctcggcaagtgatgcgaataaacagatctggataagctcgatgttgancgcgagcgcngcatcactgtcaaggngcagactgttccatgatcccaaattccagggggaanantactgcttcatttantcgatacccctggccatgtcaattccnaacanaaggttcnaaatcttttgctnctgtggtggtgcattgcttcttgtcaa

SEQ ID NO: 925 - DNA, 778 bp, Fusarium venenatum
  misc_feature (1)...(778): n = A,T,C or G
gacttgaaccagttgaatcaaaacagctttggcttggcaactcctcacaacccatatggagttccttctacctaccccgatgtcaatgcgcctgtcgaggctttcccgacccttcagccttcaggcgctgatctgtcgtcaatggctcctcctgccatcaatattgatttcgcgcccactaattccaagcagggtgcttttgatacacccaagtcgcgtatggaccaagactctttgaccccaccagacagaggtcgtcctagatcccgtcctcgtgccgtgaccgacccgttccatcctggcggcggcttgctgggtcgccagggcaatgtcaacatgatgtcgtcttctctaggtgccgacttgtcagcgcgttcagactccagatctttgtcgcctcttgatagacaagcaggcacttcgccttctaggagaagacagtccacatcagcagtgcccaacaacgtcattgctttgagactggcggatcccgagtatcagaacaacccggacaacggcgccactaagcgtgttcagaagcacccagccactttccagtgcacgctgtgccccaaacgattcacacgtgcttataacctgcgctcacacttgagaacccacaccgatgaacgtcctttcgtatgcacaatttgtggaaanggctttgctagacaacacgaccgcaaagcgggacgaaagtctgcactctgggcgaaaaagaaatttgtgtgtaangggcgatttcaaaggccggaggtcaatggggctgccgtaagaa

SEQ ID NO: 926 - DNA, 345 bp, Fusarium venenatum
gagggttacggtaacgccgaggacttcttcatggcttgccttgccattcccgttgtccttgtcttctggctcatcggttacttctggaagcgaccccagtggcttaccattgacaagatcgacctcgacaccggtctccgtgagcacgattgggaggagatcaatgcttaccgtgccaaggttgctacttggcccgcttggcgcagagccctcaacaagtttatgtaagaggagcaaatgcttatcttgcagactttcttgacattataccatcactactatacttgattcctctgatgaggattgctactttataccctgttaatatactggtttatcttctat

SEQ ID NO: 927 - DNA, 628 bp, Fusarium venenatum
  misc_feature (1)...(628): n = A,T,C or G
cgaaatgaagtacgatcctcctgcattagtccaactcacataaccctcagggtatatgcattcttccacctccaggatggtgctaccgacgtcgttgatgttgtggttgttgctcttctcggcgacaaaggatttgagggacacgaccttgcagccagacttgaggtcgaaaaacattcnaaccaggtcatcgttgagctgcgatgtgaaggccttgttgttgacaaggaccacgtccgcacgtttgagtgcctcatggatgggcgcgttcttacggaaatcacctcgttcgaaatgcaccttgcctggtcggactccccacaacatgcaacgcgcatcaaactccttnttntgttcctcggccaggttgcaagcattctccatnatttcacagccccagctttcacaaccaatctcgagggccggttgcaaaaccacgtttcgacacctgacccaaatcgacaaagacctgaccagaggtcattcgagtttgctctaccaggaccttaaaaatgaatgggtgtaaaaagttccccataaacataagtcnggttccgtctcgtactttggagangagttccccttgaaagccactgnncgggcataaatttgatcaagtntgaaanct

SEQ ID NO: 928 - DNA, 819 bp, Fusarium venenatum
  misc_feature (1)...(819): n = A,T,C or G
ttcaattcactctcatctcaaacactcaaccagaccaataaacaatcacttaattactctttcaattcatcaaccaccaaccatcaacatgcagttcaagactctcctcatcgcctctctcagcggtctcgctgtcgctgccccaagcaagaccaccgaggccaagaccgagagctctcccgtccccaagaccttcggcctcatggctctccgctccggcagccccattcacttcgccagcttcagcgctactgagagcggcttcgagctccttctccccaagggcaagcagggcgccaagtgtgctggcggcaagaaggaggatactgctactttccgtctgagcaaggctactgagcttgtcctttacaacactggcaaagaaccagcagattgcctacactgaccgatcaggaatgggccaaggtgttttccagtacactgactctggttcctacggtcgcaactcagagaccaagggctggaaggttgacaagtctggaaacctcgtcttcagcaacaacaacgcttttttcatggcctgccccggccagaaggacagcgacccttggagcgtntgggtctccaccggtacatcgcaccctggttggaatgagaaggagtgccttggttttaacgcccgcgttgttgaaattaagaaagctgtagctgcacttactttnagtncagcaactaaaagaatagagtttgcactggacatatgattggttcagcttagatacgatattcgtgtaaataccatggcaattaattctttcaaaaaaaaaaatanaaaaataaattctgnggcccttgacc

SEQ ID NO: 929 - DNA, 407 bp, Fusarium venenatum
  misc_feature (1)...(407): n = A,T,C or G
aatgtctcgcaatagtggtatcccctggccctcactcctctgtggccaatctctccaagctggctattggtcaggctgggtggttgaccaacattcctgaggatatcttcactgccatcaagaaagattacgataaccttacatggactatcagtgaagatgatgaaaacctgagttggttcttcgagaaggcggatggtacttataaccacaacggtagagttttgttctaccgtggcgttgacggtcccaactctgaagcccttgttcctatcttcaaggaattcatctctcaatgacgtgccgattcagaaagaaaggtaggatagcttgagatagagatatagttggtagatgtacctaatttgaagacgatcttactgggaaaaaaaaacnatnacaagttt

SEQ ID NO: 930 - DNA, 680 bp, Fusarium venenatum
  misc_feature (1)...(680): n = A,T,C or G
cttttctggtaccctgatgcccttccactctccaatcccaactttcaacatccatctgacatcaaacaagcctcttcttatcatcagtctattgcacttgtccgttgatcatcatcagcatcgtggttcaacagcacatcattaaataacaagatattcccgaaggaagaactgcaagcatcatccatcttccgtttgttacttaattctactacaccttcacaatggccaagcgcatcaccaaggaatttgccgaaatttcccaanatccccctgagggcttctcggtggctctgcctcccaacgatactatccacacatggcacgtcaccttaacggcgcccccctcgaccgtctaccacccaggcaaattcggcatcctcctcaaccttcccaccgactaccccttcaagcccccggtcgtcaaatttgtcacccccatctaccaccctaatgtgacaaacgataatctcggcaacatctgcttgggtctccttaaaccagatgcttggaagcccagcaccaagctctatgccgttctggaagcgcttcgcaacctcctggaaaancccanctcgacagccctctcgaanatngcattgcgcagcaataccagaaccggaccggggtgggtttgatcaagcggtgaaacagcatgtcaaaaatacccatggaaccac

SEQ ID NO: 931 - DNA, 591 bp, Fusarium venenatum
  misc_feature (1)...(591): n = A,T,C or G
attccccggagctcaggaggagcagacatccaactcagattcttcgaagaggacagtcgacgagcggtcgtgacagtaaagggccaaccctttgctgctgtcatggtagacttacccacgattactgaggcgatgaagacctgggaccgaaagtcgttcctcaaatctgccgatatttgccaaatgcttctggtctacgccaagatttccagcgaagccgaggctagggaagcgactctgccgagcatgatcgaccagcatttcagatggccacacggcctgacgccacccatgcacgattgtgcaaaccgacgattcgcaaagactatcagtcgtaaggagattgaggacaaggaagcggaagtcgaacgcctgcttgctgaggacgctaaggctggttcgacgcgctgggaatgggtcgacgagaccaaggacgatgacgatgacggcgccgacgaagatgcagacggtgagattgacgacactatggactacttccaganccaggatggattgttcggcggcgaaggtgaaggtgacaacaactaaaanccgacctggaagccgcttttcgctggaaaantcagcgcc

SEQ ID NO: 932 - DNA, 645 bp, Fusarium venenatum
tactcatatacactttcaaaatgaaggacaatagcgttcctctttacacttcgccccaattgggccagacggtgacaaactatgcggaacaacactcaacagcgttgcccaagtatatcaccgattatcatgcagacatctctgctaaccgtgatgactcaaactacatgagctctgtgttccaatctcagtacaatacatttctggtcaagtccactggtgccaagagggtccttgaaattggcgtctatgttgggttctccgcccttgtctgggctgatgctgtcggtcccgatgggcttgttaccgggttggaatttgagcctgagtatgctgaattgtccaagaaagtctttgaggcaaacggcgtcaagaatgcagagatcattatcggttccgcttctgaatctctccccaagctcaacccctctgagccttatgaccttgtctttatagacgcggacaagactggctatcctggatacctgaaacaacttctcgaactatcgaagcccggtagttccagcaggcttcttcgcccaagaacgctcattgtctcggataatgtcctgcgtcgaggcttgggttgccgatgacaaggcactcggtgacgatgagctttccgggagaacaagtgggaaacat

SEQ ID NO: 933 - DNA, 628 bp, Fusarium venenatum
  misc_feature (1)...(628): n = A,T,C or G
ctactactcccacacttcccaagactcatacactaccttcatgcttgaacagaaggaattcgacaacaaggctgcttctcgtgcttctattctcatgaagactggtgcttgcgttggtggtacaatcattggttacttgagtcaattcgttggtcgtcgacgtgctatttgttgctcggccttcatgtctgctcttctcatcccagcctggatcctgcccaccactgaaggtggcctaagtgcgagtggcttcatgattcagttcttcatccaaggcgcgtggggtgtcatccctatccatctcaacgaactgtctccccctgccttcagatcctcattcccaggggtaacttaccaaattggcaatatgatcagcagcccaagtgcacaaattgtcaatgctgtcgcggaaaanacatttgncactctcaanaatggcgacaaggtcgaggcatacggacctgtaatgggcgttgccacaactatcattgctcttggtatcatcttcaccactatgtttggtccggaaaaagcgtggacgtcttttgancatgccggnactggtgtncataacgacgagctttcttaacattaaaaaaaangatttcgagactgcaagtgtgganct

SEQ ID NO: 934 - DNA, 413 bp, Fusarium venenatum
  misc_feature (1)...(413): n = A,T,C or G
gcgnntgatctctggntggaccaanggcagtaatggctactgcaatagcgagctcgaaattgttgctcgcggctgtaaagctctgtgttgtcngaaagcgggtatncaaatccaaggcgtcgggagatgagtagcgtcncaaagaagatgaccacaaagtaaacgattaaaggcgccgcgacacgcacgacggacacgatctggngaaccacttgatggccttgcgaacgaaaaggatgaggatagtgtatagcanaccgataagagaccaanggggaaataatgcatataaagactcgctcataccactcaagtccancagcttgcgcagggagaagcgagtatcattgcggcagcgaagggaatncccagaaanactgctaccttgtnggngacagtcgaatatgacactt

SEQ ID NO: 935 - DNA, 532 bp, Fusarium venenatum
  misc_feature (1)...(532): n = A,T,C or G
cgccgcacccagttcaaggcgaagaacaccttcaagcctgaggaactccgccgccgtcgcgaggagcagcaagtcgagatncgaaaggccaagcgtgaggagaacttggccaagcgacgaggtatcggtaccggtgagaaccgacctggtgcttcccttggcgctgcccctgatagcgacgatgagtccgctcctactgaatctcagttgaacgaggatcttccccagatggtgcaaggcgtcttctcagaccagatcgattcgcagattcaagccactacaaagttccgaaagctcctatccaaggagcgtaacccccgatcgangagtcatcaagaccggtgttgttaaccgctttgtcnattcttgcgattccctcacanccttgtcaanttcanggtgcttgggcctgacaacattgcttccgttctgcaaccaaaccaagtctcatnaggccggggctgtnccaatttctcaacttcttgcaacccnagcccatgttaggaacaaccgtctgggtcctggnaaatcc

SEQ ID NO: 936 - DNA, 582 bp, Fusarium venenatum
  misc_feature (1)...(582): n = A,T,C or G
acaagtttcccaagatcgtgcccgtgcttgtcggaagcaacactggaaaagaggagaagccatagggcgagccctgctgccatatgttagggaccctgagaacgcctttattatcagttccgacttctgccattggggcgataacttcggctacctcccttactctgcaaccaatagtccttctgatttgaagcagctaaagaaggaaagccccaagcccaacggccccccaatccatgaaacgatcaaagccattgatcaagcggccatggatgccgttgagagtggcgatcatgatgcattcactagcactctcaagcagacacggaacacggtgtgtggacgacatcccatcggtgttacaatggcagcactggagttgctccgaaaggaaccgatttcgaaaacaaaggacaattcagtatcatcaagtacgatcggagcaacttgggttgangtatcctgatgacatgagtntngagctacgtgtctgcttatgctgtactttganggatgtttggcaggactgaatattgtaattgctaagctggggaaggcggaaagcttgtcggaattgaacga

SEQ ID NO: 937 - DNA, 600 bp, Fusarium venenatum
  misc_feature (1)...(600): n = A,T,C or G
gatttatatgcagacttgtcgcatgaacaatcttttgacaaaggacctttgagattcataaaaaccaaacatcgatcgctccatcaatacaaggcacaatgcgacctggcgttagaagcacagtagagcgccttgataggcccagcgcctactatcagaaccgcaacaagcgaagacgcgatcgcgatgacgataacaaccaaccacaagagccccaggtcgatcctttggccaatgccacaactctctatgttggcaacctgtctttctacacaaccgaagaacaagtttacgagcttttcgcaaagtgcggngaaatcaagcgcctcgtcatgggcctcgatcgttcaacaaaacgccttgcgggttctgntttgtcgagtatttacacaccangacgctcttgattggttgaagacatcggngggcaaaactngacgaacgcatnattcgacccgattgggacctggntttgaggagggccgccntaccggcgtggnaaatttgggggncaagtncgtgacaagtccncaaggcttttacaagggaaaggaggaattgtaggggatcaagcccaggacanacaatttttttngggaa

SEQ ID NO: 938 - DNA, 506 bp, Fusarium venenatum
  misc_feature (1)...(506): n = A,T,C or G
gcaacttctcgatatctttgctgagcaggacctcgaggactacaacgacttcaacgatgagcaccagggctgggtcgagaaggagagcctggaccacgagaagctccaccgcaagatgcgcctcttgacattctccagcttggccgcctccactcccagccgcgaaattgaatattccaagatcaccaaggctctgcagatccccgaggatgagattgagatgtgggctatcgatgtgattcgcgctggtctcgtcgagggtaaactttcccagcagcgtcaaaagttcctcgttcacaaggtcacataccgtgtgttcggtcaaaagcagtaccaagaattggccaaccgagtcgaccactggaggacaactctgcagaacgtccttggcgtcctgcgccaagaacaggtcaatgccaaggcccagaangancgcgagatccaggaattggagcgaaaggtcccaacgttggtatgggcggtgcccaggaacgacgccgacagaa

SEQ ID NO: 939 - DNA, 440 bp, Fusarium venenatum
  misc_feature (1)...(440): n = A,T,C or G
catccgcgcttacgaagctcggtgttgggcgtttggccaccactgcggttgcctcttctatacaggctcacatcgactccctcatcagcaattccagcttctccagcaaccctaccacccgtcaggctatcttggaagccgcctcgagcattcttagcgataagttttacagcaccagcgaccaagtggaaaactgcatcaaaccctataaattcgagatcgaactcgagaaccaggagtggactaagggacgtgatcacgtgggtgctgtgcttaagaaggagctccaggactgcgagagagccttgaaaaacctcgaggatagtgtcggcggaagacnaaaaatcaaagatgtcatgacctacgtcgataaggcccgtaagggtgaggtcgtggttgagggcgataaccgtagcggcgccggtggcttcaacgctgct

SEQ ID NO: 940 - DNA, 762 bp, Fusarium venenatum
  misc_feature (1)...(762): n = A,T,C or G
ncttgctggtggttactcatggctaccagtttgttcatcctcagtgttgtcaaaattctaccagatccttctgtcgtactcggtcgtgggcggtttagnaggcgccctgctcaattctccctcctatgcatccatcgcccactggttcgacntccgccgtgggtcttgcaacaggctgtgcaatgactgcaggatcaattgggcggtatcatattcccccgtcgttgctgcaaaagctccttcccacaattggctttgcatggacnactcgtatcttgggcttcatcatcttgggtcttaccgtcccggccacactcttcatgcgatcacgtcttccgcgacaaaacaaaagtaacttctgtctggccggaacttgaacatctttaaagacctcaagtttacctttgctgcgtttgggatcttntttatggaatggggtctnttcgtaccattgacgtacatcgtatcttacgctggtagatactctggcgatgccaatagctcttatacgctcatttcgattctcaacgctggttcattgctcggtcgttttctccccggccttntggccgacaagatcggccgcttcaatgtcatgcttcttacccttgggctgngcattctctcggctttcgctctggggctgccagcttggtnatttccaaaccattgatcatcccttcgcggttntatttggctttggctctggctccacctgggttngacacctgtntgngttggtcaactttgngatccgggcga

SEQ ID NO: 941 - DNA, 345 bp, Fusarium venenatum
  misc_feature (1)...(345): n = A,T,C or G
cagtataaactttcgattataagccacacctaatctaagtatatatatccaatcaattgtaccaaaagtagtctggaatcatggttgtcaatcggtgctgtgtatgtgagggtcagagtactcgaaggcagattcaatgacgaaagccgatgggtaaccagccttggaggcagaagcgtggtcggagcaggcatatccacacttggtctcaacccaaggaatatcgcagtactcctcaacaacggtcttgataaaggtggcaagccggagtcaacaaagtcaagtgatgacaccaacactttcgggctggtcggngtcaagagtcttttggattaaccagtnagt

SEQ ID NO: 942 - DNA, 356 bp, Fusarium venenatum
ccgtcgtggacgctgtccagaaggacggcaagattgtcatcatcggtggtggtgacaccgccaccgtcgccaagaagtacggtgttgaggacaagatcagccacgtctctaccggcggtggtgccagcttggagctcctcgagggtaaggagcttcccggcgttactgctctgtccagtaagtaaataatatccaatactgttggagtacgaagtatatgaacctgttgatgacggggaatgaaaatggaaaaaggttgggcaggcaaggctagtctgtagcaaaccagaagaaagtaattgaataccaaataccaatagaggcgtaaaaccgcatcaaataaaaaaaaattttat

SEQ ID NO: 943 - DNA, 629 bp, Fusarium venenatum
  misc_feature (1)...(629): n = A,T,C or G
cagcagtcgagccaacaggctcagtcacaccagcagttgcagcaacaattccaacaacagcaacagcagcatcacctgcaacaacagcagcagttacagcagcagcagcagcagcagcatcagcaacaacttcagcagcaacagcaacaacagcagcagcaacagctgcagcaacaacatcatcagcagcaagttcacccacaacatcagcagcagcaacaggctcaaatacacccccagcagcagcagctccgcaccccccaacaagagcaacaacagctncagcacgcacaacagcatgaacagccaagagctcagtcacatnagcagccagcgcccgtcaacaaaagcagcagaagcagcgtgatcacaaagagagcgcagagagatcaacaagcccagcagcagcagcagcagcagcagcagcaacaacaacaacagnaggaacaacaacaacttcagnagnaacaacaacaacangttnggaccaacacacaacacaacacagcttnnacaggaaaanagaggccagcagcagaacagaggagcccacagagaaaacngccagagggncaagaaagctttttttaagcatcanaacggggngggcgcnaaanaaaacggtgttn

SEQ ID NO: 944 - DNA, 614 bp, Fusarium venenatum
  misc_feature (1)...(614): n = A,T,C or G
agcgcgtcggggcgtaccttgatgtgcagcctacacacattcggttctggacggtacacacctcgacaaataatcctaaggcgcctgtganaagaggtgcgaacccaactctgcgacagatcctcagccccatgggctcaactgctctcaactctactcaaaggagcgacgctttctactttgaggtgcttgagattagtcttacggagctcgacaccaagaagagtattaaagttaccttgttgagtgagggtataacaaaggaggatacgtacgacctgctcgtcccgaagactggaaccatggatgacttggttgaagctttgataaagaaagcacaaatttctagtgaagccgaaagcggaagaattcgcatctatgagacgagctcaaaccgtttntatcgtgaaccttctcgcgatcatcccgttattaacctgaacgagtcncgacagtctacgcanaacgaagttcctcangacgagatcaacgcccgcgacaatcaattcgtccaagtttttcattaccaaaacgacgtcagccgcgtccacggggtgccctttaagttnttggtcattgngggcgaaacttttgcngacncccaagaagagact

SEQ ID NO: 945 - DNA, 652 bp, Fusarium venenatum
  misc_feature (1)...(652): n = A,T,C or G
gcatgttgagcgcgccaggggacttgtcgatacaggcggtgactgggaccgccgcaaccgcctcaaggcctacgagggcctgcacctgctcaccgttcgatcctacaacctcgctgcgccgctgctcctcgactccctttccaccttcaccagttacgaactctgcacttactccaacctcgttgtgtattccgttctcgctggttcagtttccctcaagcgagtcgatttcaagtcaaaggttgttgacgcaccagagatcaaggcaattcttggtgatggtgaagacaagctgctagctcttagcggcgctctcagtgccggcccaggtgctgatgacactaccggcgcgaaggcacctaagacggccaccgctgctgtgaacctgaccacactgggctcaagcgctgatcagcccgaagctgagatggccattgacttcagccccttggccttgctcgtcaagcagcttgtacaaagggcgactacaanggcttcttcacttctctggccaacgttgaggangcgttnctgaaccaagatcgctactttacgagcacaagaactgggtcattcnggagatgcgaaatttgcgcttaccaacagcttctgnaaaagttaccgngttgnccggccttgaaagcatgggcna

SEQ ID NO: 946 - DNA, 613 bp, Fusarium venenatum
  misc_feature (1)...(613): n = A,T,C or G
gtcgctcgcttattaatcagttatctttttttatctactatctttaattcactatgaagttcttcagcactcttagcacccttgcggtggccctcatgatgagtggcgaggctctggctggtacctacaagggtttcagcattggcgccaacagggctgatggtgcctgtaagtgggaggccgactggaagaaggatttccaggccatcaagagctggaacaagggtttcaacgctgttcgtctgtactctgcctctgactgtaacacacttgtcaaggctgtccccgctgccaaggccactggcatgaagatccttgttggcgtctgggccaccgatgatgctcacttcggccgcgacaaggccgccctcctcaaggctatcaagcagcacggcaccggctggatcgccgccatcagtgtcggatccgaggacctctaccgtgaggacatcttcccccagaagctcgcacagcagatctacgacgtccgaggcatggtccaccaatacaacaagaaacctcaaggtccggacataccngacacctggaacgcttgggtcgacggncgcaaacaacgtcgttacccaaggcctgcgatatcgccattacaaac

SEQ ID NO: 947 - DNA, 428 bp, Fusarium venenatum
  misc_feature (1)...(428): n = A,T,C or G
caagcaaatcattcaccatgggtaaagttcacggatctctcgcccgtgccggcaaggtcaagtctcagactcctaaggtcgagaagcaagagaagaccaaggtccccaagggccgtgctctcaagcgcctcaagtacacccgtcgattcgtcaacgttaccctcaccggtggcaagagaaagatgaaccccaaccccggntcttaaacgattggttaaaaacgacaagatttgcggaatcgggattgttggcttgcggaccacaacaatggttgacttcactcagtaatgggatgatggattgggtcggtcgggtcgcatggataggctgagcccccttatgaaataaaaaaggaaatggcaaagaagcgctacgaccctactcggcgtccggtgtcagttgtcacaatgcaacaaacatttgttcgc

SEQ ID NO: 948 - DNA, 365 bp, Fusarium venenatum
  misc_feature (1)...(365): n = A,T,C or G
atcttacactcgtgttgaccgcgcatacctcgaaaatggctcccaagacaatcattgccccctctatcctgtcggctgactttgctcagcttggccatgactgtgcccgcaccatggagcagggcgcggactggctccatgtcgacattatggacggccactttgttcccaacatcactttcggtcctcctatcgttgctgccatcccgaggccacggttggatcaagcccaccgaggcccacgggtcggggcaccttttgattgtcatatgatgatcgnagaagcccaaagaaatggggtcaagggaatttaaagaaaggctgggctgcaaccttttactggctttccattaccgaagggccgg

SEQ ID NO: 949 - DNA, 623 bp, Fusarium venenatum
  misc_feature (1)...(623): n = A,T,C or G
gttggttgccattatccagtttcttcgtcaagcctgcaacgccattcgcaaccaagaggctgcagatggaagcatgctcggatacgccctgttctgttgtgtcggatgtttgttgggtcttttggagtgggctgttgagttcatcaaccgctacgccttctgtcacattgctctctacggaaaggcctactttgcggctgccaaggatacatggaaagatgatcaagggaccgaggaattgacgcttctgatcaatggactgcctttatcggacccggccttttcctttcggcgccctcttaatcgcaaacngcctgcaccctcctcgcctanctctacctttacttcaccgacccngctacaacaagcgacggncaatacaccggtgtcgtnttggccttttccttcctcatcggcttcaagatcgaaaacgttttaaccacacccatctccagcggtgtcgaaaccattttggtcgcttctgggttgggacccccaaggtatgtggcgcgaacaccccgagttgacaacgagatgggcagggtataccccaagggtcaacangtctattcaggaccgcttaaatggggaatgtnttgcatcggaaaaaaactggatttctg

SEQ ID NO: 950 - DNA, 602 bp, Fusarium venenatum
  misc_feature (1)...(602): n = A,T,C or G
cccgacttgttcatttctcaacaccaacttcagcttatcaccattttcaattcccacgtcaaagtcgacgactcgggaattacgagaagcttgttctctgcagcttcttgcctttgacgtttccttctctcgtcctcgtcgacaatctaccgtcctcttctcgactttgggtcaattggctgttcaacaaacgtacatcatgtctcgcatccttcgacccgcagctcgccttgctgcttcgactcgagctatccgtgctcccgttgctccttcggctgcccagtctgccatcacccgcgctgctcttgcgcgacccgttgttttcggttccgcccagacccgatcctacgccgacaacagctccggcgtcaaggagtacaccgtccgagatgcgctcaacgaagctctcgctgaggagctcgagcagaacgagaaggtcttcattctcggagaagaagttgcccaatacaacggtgcctacaaggtgaccaagggtcttctcgaccgcttcggcgacaagcgtttnatcgacaccccatcaccgaatctggtttctgtggtctcgctgtcggtgctgccctcagtggtctccacccgttggt

SEQ ID NO: 951 - DNA, 585 bp, Fusarium venenatum
  misc_feature (1)...(585): n = A,T,C or G
ggtggcgaacgtgaatgggaccgcgaccgagggtcttcccgtcgagatgccaggcgcgacgacgacgaacgaccaagcaggcgagagcgagacccgtacgacgatcgccgccgtggaggaggcagggaccgacgtgaggatagattccccgcgcctcaggaacgtcgaagcgcaagcccgcctccaaagaagcgagaaccaactcccgacctgacaaatatcgtgtctgttctcgagcgcaaccgtcgcctgacacagtgggatatcaagcctccaggctatgacaatgttacggccgaacaggctaagctctcgggcatgtttcctcttcctggtgctcctcgacagcaacctatggaccccagcaagctccaggcttttatgaaccagcctgggggacaggtcacaagtgctggtctcaaggcgagcaactctcgccagtcaaagcgacttttggtttccagaattcctcctggcacaagcgaagatgcgctcatggcattcttcaatctgcaacttaacggactgaacatcatcgacaccacagacccctgtgttttgtgtcaattctccaacnaacggtca

SEQ ID NO: 952 - DNA, 500 bp, Fusarium venenatum
catctccatgcgtgctctcctcaaggataaccttgagaagctcggctccaagcacgactggtctcacattaccagccagatcggcatgtttgcctacactggcctaactgctgaggagatgacccgtctcgccgaagagttctccgtctatgccaccaaggacggccgtatctccgttgctggtatcacctctgagaacgttggccgcctcgctgaggccatctacaaggtcaagggttaagtataagagaatagcagcttaataaaaggaggatgtgtgctaggaaaacggcgtcgcgccaaacgaacgacgccttgaaatcaacatcacgctacgatcagaaggctgtcggtcggggacagatggattgaaaatacccagatcttgatctaggtcaagtgcccgacttggcgaattaatgacgcggtgaagacagcttgaaaatatatgtatgagtaaactgaatataaaacacgaagctaatgtgttgaaaaaaaaa

SEQ ID NO: 953 - DNA, 311 bp, Fusarium venenatum
  misc_feature (1)...(311): n = A,T,C or G
ttccactctatcacctatacccctccatcacataatatagcccatcatgtctggccctgtcgcggatctgggtcttatcggccttgctgtcatgggacagaatctcattctgaacatggctgacaatggcttcaccatctgcgccttcaaccgaaccgtctncaaggncgaccgattcctnganaacgaagccaagggcaaagtccattgttggccccacagcgttgaggagttcgtcaacaaactcaantctcccccgtgnatgccccttggtcaagctggccaagctnttgattactggattgaaaaaa

SEQ ID NO: 954 - DNA, 606 bp, Fusarium venenatum
  misc_feature (1)...(606): n = A,T,C or G
cagagatccacatgaaagattatactgtcnctgcacgggatggatttgctctggaggtacgaacttataaaccacctatagccgacaaggacgcccgtcttccgatctacatccacctccacggtggtggctatgtatttggaaacattccttcagaagacgctatttgtaccgccattgctcttggagccaacgttaccgtcgtgaacctgaactaccgccatgcgccggactttgccttcccaacagcgtgggacgacaccgaagacactttccactgggttcacgacaacattgatgaactcctcggcaacccaagccaagtcttagttggcggcntctccgccggtgcccaactctcagctgccttgacactgcgacaaaatatgtcgtccgatggcctttcacnacctaagcttgccggncaggtgttgatgatccctgcctaattcacccggattcctacgcgcccgttctcgaacagctcaaagaccttcactatcatcatatgtccagaangcggatgctccactcctccaacaaggcggnggtggacaagtttaccagccgntaaaatttcgaatccagnatctcangggatagaca

SEQ ID NO: 955 - DNA, 607 bp, Fusarium venenatum
  misc_feature (1)...(607): n = A,T,C or G
aacctttttcccttcttcttcttattcccagcctttttattctttacagtgtattcacaatccaaataccgcctaatcatgcgtcaaaacctaccgacacaatccgttgccaacggtgatggacaggatttgtaccttcccgacaacatgctcgctcgccaccccagcaagcctcatatcggcagcctggaggagtaccaacagatgcaccagctctccgtgacggaacctgatgctttctggggaaacctcgccgcgaccttctcacgtgggagcgtgattttcacaccgtcaagagcggtctctcatcgagggcaacccttcttggtttctgggcggnaagctgacgctttttnaactgcgtggaccggcatgcgctcaagaacccaacaaggtcgccatcattacgagactgacgacggcaccaatggcaagtccatacctacggagagctcttaagcaggtcaacaaggttcatggctcttaaggatctcggcgtgaaaaaggcgacaccgtgncattacatgccatgattctgagntntggcgcatcttgctgtnccgatngggcttgtaatttgcgtttcgtggatttantggtcctaggg

SEQ ID NO: 956 - DNA, 513 bp, Fusarium venenatum
  misc_feature (1)...(513): n = A,T,C or G
caatcagcagcaatggcgaagtcaaagaacagctcccagcacaaccagtcgcgcaaggcgcaccggaacggaatcaagaagcccaagacttcccgttacccttctcttaagggtaccgaccccaagttccgacgaaaccatcgacatgctcttcacggcaacatgaaggccctgaaggaggctaaggagggcaagcgcgagactgtctaagcactcggcaaaggaatattgaggcgtcaatttggagcattcgcattgctcggttacggcatacacacgatagaacctgcgcaaatgaacgatggaaataccatacgattagcccgaccaaaaaaggtggtggatgtcgatccgtacgtctcggcgaatgatgttgtgacagtcccgagtaaagcatgttgcttggcttttcaggaacatgaggtgantacccgaaactctgcttgaactttnaanaaaaaaaaaaattcntgnggcgttngactttgctttnnaggccaattcgcctatggg

SEQ ID NO: 957 - DNA, 583 bp, Fusarium venenatum
  misc_feature (1)...(583): n = A,T,C or G
atcgattccaaccacgtcgttaccttcctgcagcgacttgccggtaccaatatcgagcatgctgacctactctgccgtttctacaccaaccgcagtcgcttcttcgacgcagccgaggtacaggccgaaacttgctaactccgatttccctatcagcatcaaggatcgaaatcagattgctcagcttggccaaggctaatgccaacgtttctacgactggtattagccgacagcagcaacagatgctaaaccacagcgttactgagttgttggagattgcacacatccaggacgatctgcttgaacgattgagagccgacgaccgtattgatcccgagangtctattgagattgangatgctctcaagggcaagatccagggtctctccgagcttttcaacgactatgccgaccaggctggttactacaacctgtgtttgctcatctaccatgttgccgattaccgtaaccacatgaccatctctggtacatggaagcaacctgatccagcagacacacaatgaaantcttgtctcggctanaaaatgtctgaacctggaatgccctcgccaccactacccta

SEQ ID NO: 958 - DNA, 445 bp, Fusarium venenatum
  misc_feature (1)...(445): n = A,T,C or G
tcaacgccgtcaccatgccgagccacaagtctttccgaaccaagcaaaagcttgccaaggcccagaagcagaaccgccctgtgcctcagtgggttcgcctccgaactggcaacaccatccgctacaacgctaagcgaaggcattggcgcaagaccaagctcggtatctaagctacctcttctcaaccgttgtccgcccccagcacccgactttctctctcttgggcatggtatcacgatgatgttaaaggaaagggtggattgatttgttatggcgtgaactatgggaccgtgtcgttagcgcacgcgcatacacacggtgggggatgggccggatgcctggtttatcgattatcgcggttactgnatgtcacggacngtcatagggaaaaaggaatgcaaaaatctgatgcccaaaaagaaacggcctnaaaantatntatttg

SEQ ID NO: 959 - DNA, 816 bp, Fusarium venenatum
  misc_feature (1)...(816): n = A,T,C or G
cactcatccaaccttaatacgctcaactactccaaccaaacaccaggcaccaccaccaccaaccgccaatatgcagatcaagtctcttctcatcactcctctcgtcgccgctggcgtcgtctctgctgcacccaaggctagcagcacccccaagactgtcaacttccaaggccttgccctccgatctgcttctcccatccacttcaactacctccaggcttccaaggagtctttcgagctgaagctcaagaaccaggacgccagctgctacgacaccaaaaagcacaacgaagccactttccagctctacggcgatgagctctggctctactccaagggcaacccccgccagcaggcatacgttgacttttctggcatgggccagggcaagttcggttacaccactggtgctcagcctatccccaagaacgctcagcgaaagggctggaagatcgacaaggacggtttcctacctgcgacggtgccagcttcgtcgcttgccccaatggcgacaacctcgagaagacttcttggtctgtctgggtctacaacaagcatcaacaaccccggtggcaacaagaactgtttcccttcaccgtcaaggctgccaaggttgaaaacctgtcgcctgcatgtactcttgttatccagcccancgagtaaatttaaggttatgttggaatgtttctagtatatatttttgcaaaaactttacgacgtcgttggatatagagagcgagatgtgtttcaggatattaagcgttttgatttggttccagtacctgaattaatttattttcaattttgaaaaaaaaa

SEQ ID NO: 960 - DNA, 569 bp, Fusarium venenatum
  misc_feature (1)...(569): n = A,T,C or G
gtcactcactccactccttccattcaaacattattgtttctgatttccaaaccaccggtgagatttaatctagtaggtgtctacctattatttatttgggattccctcataacattatgacttcgacaaccaagccaactgtgaactacagtctgtacctggtcacagactcaacaccagaaattcttggtcaccgcaacctcgaacaagttgtcgaggagtctttacgaggcggcgtcacgattctgcaatacagagacaaacacagtgaacgaagcgtcgctgtagatacagccaagaaactacactccatcgctcgccggtcaatgttcctctcctcatcaatgatcgtgttgatgtcgctgttgaaagtaggctgtgagggcgtacacattggacaagatgatatggcatatgaggaagcaagaaagcttctgggcccaagtaaaattattggaggtgaccgcaagcttccaaggaggaagccttcaagnttgtgaagccngtgctactatctcgtatcggactgctattcccccagaccaaaaaagacacaaaatcatcattgg

SEQ ID NO: 961 - DNA, 635 bp, Fusarium venenatum
  misc_feature (1)...(635): n = A,T,C or G
cttgaacgacgtgccatcttctccaagaaatggatcttgcttacccacaagatgcgattcgagcagactggctcttgggttcgctacgctgaagcaggctttgactttttcctcatccgcaatgccgagggcgctatcagaggcttccacaatatttgccgtcaccgagctttccctgttgttgtcaaggataatggccagaacaatgttttgtcttgcaagtaccacggctggtcctatggtatgaatggacagcttgccaaggctcctctttaccaagatcttcctggctttgaccgatccaagaacggcttgtttcctctccacactcatgtcgatgagaagggctttgtctggattaacatggatgccaagactcaacctgagaatgcatggaacgaaagcacccgaacagccgtacagctnttcaanctcgaggactcacattgatcatgtcaagcagggatncagagcttaactggaaaattttgccgacaagtntagtgccacagnacgccgttcgagatnaagaaaagggacttacntgtnatggntttacttcccaacgtttcatgatnttttacttaattcttttctttggnaaggggcctnataacnccaagttaagttcatac

SEQ ID NO: 962 - DNA, 558 bp, Fusarium venenatum
  misc_feature (1)...(558): n = A,T,C or G
ctttgttgcaacaacagtaataacgacctttggtcgtanaaagaaaaatgatatggccgttcacatcgaatgactccaagaaggaaaatgagaggaaactcgaanaagaggcgaagcggcggtccgtctcatggacagatacaatancccgcctcanatcagatcctttcgatgcancacaggcctgggcgcccgtggttntatttccactggcaggcatggcagctcttcagctgtacgcaaactaccttcgtcgcatacctgggtcagcgtatatgcgtcccaacttcttccnaaacagaagtatctatggtcgggttaccagcgttggtgatggggacaacttccatctcttccatactccaggtggtcgttctttgggatggggctggctaanganaattcccgaagtccgcaaggacctaaaagaccggacgatcccgatccgcattgctggcgtcgacgctccngaatgcncccacttngggaagccanccaccttattcagctgaggcactggcatggctaaaaaactttctcctcaaacccaacgttaaa

SEQ ID NO: 963 - DNA, 511 bp, Fusarium venenatum
  misc_feature (1)...(511): n = A,T,C or G
ctttcgtcatccacccaagctcgacttctatcgacaaccacagccaacatgtnttctcaacctgaacacgctactctgctcattcccggacccattgagttcgacgatgatgtcctcaagtctatgggccactacagtgagagccacgtcggccctggcttcgtcaacaccttcggcgagaccctctccatgacccgcaagctcttccaatcgaccgacccctccgcccaaccttatatcatttccggttccggtactctaggatgggatatcgtcgctgccaaccttgttgaggctggtgaggacgcccttgttcttagcactggttactttggcgatggcttcgccgactgcctgcgcgcctacggtgccaacgtcaccaagatcgacggngagggtggtggccnacctcactccccgagatcgaaaaggcctttccgagaanaagtacaagatcttacagttacacacgtngacacataaacaggngtcctgagtgactcaaaaacct

SEQ ID NO: 964 - DNA, 668 bp, Fusarium venenatum
  misc_feature (1)...(668): n = A,T,C or G
aggagagctaccctctggagaactacgtcgatattgagagctatcagttcctcgacattgtcaaggagcgatccaacaacgatgagcaagaaatcgacaaggccttcaacgctctacagcacttggctcgggatcatgcgcgtatccccatttgttggagcgatggaaagcacggaggattctcaaaagcagctgaaaaggctggactacctatcaaagctccttggatgcaagctcaccctctatcccgagaagncaatggcgcgtctcaactagacgatccacaaagtgtcctatctttctggaanaaagccattgccttccgaaaggagtttcccgatcttactgtgtacggagattacaaggtcattcgtcaggatgactctgatatttatgcttttgtgaaggagtctcctgcagatggatccaaggttgctgtcgttcttaactttactaccgaagacaagacctggagtgctccaacttctgaanaagtttgggagttactattggaaaaggatgtaaagcttgttccgatnatgtctctcacactggaaaagaaaaaaacagctgntctgccccnttttganggacaagttttttggtccaatagagaacatacctnnaaaaaggggcccngtccaaaatgttaagattanaagngtctc

SEQ ID NO: 965 - DNA, 649 bp, Fusarium venenatum
  misc_feature (1)...(649): n = A,T,C or G
ctgagtgctacaagtgtggtgagatcggccacattgcccgtaactgccagaagtcctcttacggtaacaactacggtggtggtggtttccagcagggcggtgccggcaagacctgctactcttgcggcggtttcggccacatgtctcgcgagtgtgtcaacggcatgaagtgctacaactgtggcgagtctggccactactcccgtgactgccccaaggagtccgctggtggtgagaagatctgctacaagtgccagcagcccggacacgtccagtctcagtgccccggcaactaaaatggtggctcggtttctcagtataaccactgaggcgagtaggacgtggcgacttgttgatacccacggacgattatttccttattctcttacggcatttttcacaaaagttcatttcctcacacgactttaatgatcatcacggcaagaatggcagctcacaaaaacacaacgtgcgcaatcttcgacaaaagctggcggcgcccagccttgattggaacatatcaccattggatttcgtcaaccgactggaccaacgactacgaccatacatacgactcaactttgaaagaaaatggtgaccagtggagaatgacnaagatcaaaaagggtatcttggtggcttggtaatg

SEQ ID NO: 966 - DNA, 641 bp, Fusarium venenatum
  misc_feature (1)...(641): n = A,T,C or G
ctccatcaccgcaacctcaccacttggccttcccgcaccaatgtcaaaggctctcaacaccaacatcaagcacctcacaacatctctcattcccagtctggagaacatgtttcttgagtctaaagcattcatcgagcagcgcatcgtcagagaaatctttcccgattttgtcaagcaacagttatcgcaatgcaccagtttggctctgtccctcgatgcagaaggcgactctccactgaacccgtaccccggtttgaagggttctttctgcctcagcgatccctcgcgatctggaaacccgattacttttgcctcagatgagtttgaggaattgacaggatattcgcgaaccgaagttctcgcacacaactgtcgatttcttcagggcccccagactgatcgggatcgcatcgccaacatgcgctcagccatctggcgtaacgatgaatgtacagagctgctcttgaactttagaaaagacggnacacctttctggaanctcttaatcctgtgtcctcntctcgacaaaancggnaagacaaagtttttcatggggtgctcaaantgatgtttcatcctcgatacacgacacaagacgaagttctcaaagattctgtcttaanggngctatggagggaana

SEQ ID NO: 967 - DNA, 520 bp, Fusarium venenatum
  misc_feature (1)...(520): n = A,T,C or G
ctggaagaattcgatttggcatcggtcgctttaccactgaggcagagattgattacgtcctcaaggcagtccaagagcgtgttagtttcttgcgcgatctgagtcccctgtgggagctcgtacaggagggtatcgacctcnacactattcagtggagccaacattaggctgtcctgtaatgaatacgacgactatcacacttaccccgacttctctgactagtgtcaggcacgggatgtatatcaaggacgttaatgacaaaatggccggctggagcgaggctcagctgtgcctgtatagcatactgtaatatcagagatacctctttctttaaattctggagatnaaaacagggagtcattggttcaaggagcttgcaattatcggggtatctggccaaaggcnaacaaacaggcgcctntttcaaatgtcccaagagttaggaatantctttcctattggaaacgaatgatcanagcaaatcaaaggtatntgtcccacaaaatgagacaccacaatt

SEQ ID NO: 968 - DNA, 519 bp, Fusarium venenatum
  misc_feature (1)...(519): n = A,T,C or G
attgccaatgccgaggaagtcgcattttatggaggcgccgagactgaaaagacctttttgaaccgcgagttcaagtcgctaaagacttggatggaaggcatctacatgctcaagatccgttacaatattctggaagatttcatcctcaaatacagctggagtgcttacggctacttgctggcatcgctacctgtcttcctaccggcctggggtggtgtcggaggccgggctgaaatgattganaatgctgtacggggaggacgggaacgtaatcgtatgaaggagtttatcacaaacaaaagacttatgctttcactcgcagatgcaggtggtcgcatgatgtactcaatcaaggatttgtcagaactggcaggatataccagccgcgtctacaccctcatctcgacattacaccgggtaaacgccgatgcttaccaggttcganctggacagancgaactatattctctgtccgatgtttcaggaactattcanaagggattcgatggcgttcgattc

SEQ ID NO: 969 - DNA, 745 bp, Fusarium venenatum
  misc_feature (1)...(745): n = A,T,C or G
cctacctggtacctgccctgttggtatataactcgagacacgtttaccaaagcacttcttgtttcctacatctacaaaaccccccttcccctccatgaattttctacgaagattcactccgcttcgatctttctctcgaacatttacaacaacacgcgcaatcatgtctaagctctacgttggaaacctgtcctggaacaccacggacgagactctccgtcaaaccttcagcgagttcggtcaggtcactgactcgatcatcatgaaggaccgtgagactggccgcgcccgtggtttcggtttcgtcaccttctcctcttaggaggangctaccgctgctgtcaacgccatgaacgagcaggagcttgacggtcgtcgcatccgagtcaacgtcgccaacgcccgcccctccggcggtaacggcggtttcggtggtggtcgtggtggtggttacggcggtggccgtggcggttacggcggcggtgaccgcagctacggtggtggtgaccgcagctacggcggtgaccgaggtggttactaagagacttgacttggcttgacttgacttcttgacttggacttccgcatcaccagatgtgggctgacttctatcgtcgcccctaaacgaagaaaataatgaactgatgggtgtggccgctgaaaacacggtccctcgagattgacgatggaaagggactattcaaagataccataggacagtgaaacgctcttctttttttctcan

SEQ ID NO: 970 - DNA, 213 bp, Fusarium venenatum
  misc_feature (1)...(213): n = A,T,C or G
agtcagtgcgagcagcctggtgcgatctttcctcgaagggccggtcttggctattgagacaacagatcaggttatggacctgatgcgcgagacatgtctctcggaacccgatggctggcgacaggttgaacactcagttacnactacggagaagaagtacatacgggagattcatgaccagttggacacctggcgatacangtatgaaaagaa

SEQ ID NO: 971 - DNA, 657 bp, Fusarium venenatum
  misc_feature (1)...(657): n = A,T,C or G
ggtttggcgccatgcaaatcgtatctaacaatgcctccatgactcctgagcaaatcatcgagggcgcgaagccaggccaaacctttgggtggcaactctatgttcagaatcaacgagacaagagtgaggctatgcttaaacgtatcaactccatgcgagactattacaagtttatttgcttgacgctggacgcgcctgttccaggaaagcgtgaattagatgagaagcaaaatttcgactactctgagccaagtcctgccagtggcgagagcaagcccggcgctggaggtgttggtcagcagctattctttggtactgctgctgacttgacgtggaagacgacccttccatggctggcggctcataccgatctgccatcgtactgaagggtcttcaaacccatgaagatgctaacctagcggccaaagtattgctcccaaggtaaaggccatcatcctgtccaaccatggggggcgcgcttgccgacacaagttccttcanccattgcatacattggttcgagaatccgcaaggactggcccgaagtctgagcaagggtcaaatatggatggacggaggcttaaagcgangaacanacgttgtaaaagcgttgtgccttggcncaaccggcgntggtattggacgtctgcgcttttc

SEQ ID NO: 972 - DNA, 619 bp, Fusarium venenatum
  misc_feature (1)...(619): n = A,T,C or G
aggaaagctgcactgggtcgacaaccacaaatatcgcatccacgtctactgccacggcaacaagaccgactcaaagggcaacgagctccctaccgtcttattcgaggccggtgagcgaactgtcgaatacgaattctggaattttgccgacaatgccgttaagaatggatccatctcgcgatactgttttgctgaccgccctggctacggctggtcagacaacgcgccctccccttcatcagcgggcttcgtggtcgatactcttagcgaggctctggctgatgctggggagagtggaccatgggttcttgccagtaccggtattggatcgatctactcgagagtcttttcagcacgacatggagaccatatcaaaggcttactccttatcgaccctctacatgaggatctacttgatgatgtcgcatcaccgggacgtggatttatcctttggctctggggggtattcttcactcggatggaccgaatcctggggcatcttcgcggacaacaagccgcgaccgagttatggacgatcagacancagacggnaaattatctttgccaacttgaggaaaacctgtggtggtctttacttgacngaccgcnacaaccgcaa

SEQ ID NO: 973 - DNA, 569 bp, Fusarium venenatum
  misc_feature (1)...(569): n = A,T,C or G
aaacagaatctaacatccaaacgaaccgccaaaatgtccgacgacgagggtatttcaatctacgatgaggtcgagatcgaggacatgacctttgacgaggccatgggagtttaccagttcccttgcccttgtggcgacaagtttcagatcaccttagaggacttgctagatgagcaggacatcgctgtctgtcccagctgcagtctcatgatccgagttatctttgacctggacgatctaccaaagcctcccacttcaggcgcctcaggcgggcaggtccccattactgcctgagtcaaccgaaaattacgatagaaaaataatacaaattgcagctgccatgtgagaagaaatggtacagcaaacttgtgctgcgccgcgactacgacaatcgtatcagttcctcaagccattcggngaaacctggcacgaagcgacacgacaagaaatatcggactttnattttngtacgccctcnacctgcttgaacaaanaaatttcttnttcatgggacnggaagaacccncanaatgcnttgatcctggcgggatatgntgattantctcggg

SEQ ID NO: 974 - DNA, 799 bp, Fusarium venenatum
  misc_feature (1)...(799): n = A,T,C or G
cctgacagcgatgtggttcagcctctcactcgcaagacctttgagcaacttcctcagacaatgcgcaacatgagtgtctacggaaagactatcttgctcactggtgctgcccgtggtctcggaaactacatggctcgcgcctgtgctgaggctggtgccaagaacatcgtcctctttgacgccaaccaggagctcggtgatcaagctgctgctgagcttcatgacaagacgggcctccctgtctcattcttcaaggtcgacgtccgtgacggtgcttgccatcaacgctgctgtcgatgaggttgttgagcactatggtgctcctgatgttcttgtcaactcagccggtattgccgattcaaacattaaggctgagacatacgaccccgccatgttccgtcgtctcatcgacatcaaccttacgggatctttcctcatgtctcaagctgtcggccgtgccatgatggccgctggaaagcctggcagcatcattttggttgcctctatgtctggctccgtngcaactttcccttcaggagcagagcttgttcaaacgncttcaangcgggtgtcatccaactcggcnaagtcccttcgcttgctgagtggggccaagtacgacattcgaagtcaaactgcatctctcctggatacatgggacactgccctcaaccgagtgccccgctcttgacgcacagaacaaagatctggaagtctctgactccccagaaccgcctcgggtaacgttganaaagcncaacgggtctctgcatcttccttgcctccgactcttccaaat

SEQ ID NO: 975 - DNA, 631 bp, Fusarium venenatum
  misc_feature (1)...(631): n = A,T,C or G
ggaagacaaggtcttaagatcaagcacattcaggacgcttctggagttcgcatggttgctcagaaagagatgctccctcaatctaccgagagaatagtcgaggttcagggtactcctgaaggcatccagcgtgctatctgggagatctgcaaatgcttggtcgacgactggcagcgaggcactggcactgttctctacaacccggttgttcgcactcagccttccaacagtggtaacaccagtggtggagcagggttcaaccagggctctggcaggagcgattatggtggtagccctcgtgtcatgcgaacaggcaacggtgccgacttcagcaacggtagctcaaggccctataaccgccgttccgactctgacgcagctcttcgaggcccacccactcacgacgagaatggcgaggagatccaaactcagaacatcagtattcccccaaacatgggtgggtgcatcatcggacgtgctggnagcaagaatagcgagatncggagaaatnaagcgcacgcatttcattggcaagnaccccacgatgaanatggngagcgttgttcaccattatnggtaccggttangccaccaagtcgnacnttttcttttgtntanaaactaaaaggng

SEQ ID NO: 976 - DNA, 662 bp, Fusarium venenatum
  misc_feature (1)...(662): n = A,T,C or G
catgcagtacttcnagaactccacgttgcgaacctcaaacgccgtcacatcacgtcacctacgctttccacttgtcgcggcgcattaaacttgtataaaaaatgtctgatatcgaaaccgtctcttcctttgtagagggagctcctccaggagagctcgccgacgttatcgcagatatcaaatcgctgacactcgactccaaccccgatatcgtcaataacctcgcgcccgccttcgagaagtacaatgaggagcaatttgttacggtgaagctgcctggtagcagccaaccagttattattagctcttacaactctctcggagacggccgatacttcgatgttgagacctcgtccagcttcgccttcgaccatactacgcagaaagccagtgctgtccagagccacgtattggaaggagctcaagcggaccttgtcaagtccatcctcaagancatcggtccttacgttgaaaagcactttggcaacgctgcgcatggcgtctacccaatcgagtcggactccaagantgccatcgttattgtcggnaacaaatacagcccttacnacttctggaacggacgccggtggatcgctttacatctggccttattngggcctgaggtttttaggttacggctnttcagggccggaatttgntnt

SEQ ID NO: 977 - DNA, 596 bp, Fusarium venenatum
  misc_feature (1)...(596): n = A,T,C or G
aaccaaacaaaggcaaagaacgacaagaaagatagctcgacttcttttttcttccaacaaggacaaggacgaaagacaaaaaaaagaccacttttggtttattaatcgagttacttactgtacacaccgatatatcacataccccgccaatcttttcactatggcagatgtcccgctcgttgtcatttctgaattcgcgcagtcggagcgtcgaatcactccctcgtggtccatctcccagctcaagacaaagcttgagactgtcacgggtgttccaccgggttgtcagcgactttcgctgaagcctacagccggcgcagacgctatcgccattgaggcgcctaacgaggatgacacccacttgtccaactttcccctggcccatatgcagaacttcatgtaattgacacacgggctccggcctccgtatcaacctgaacgataccgcgggcgttgacaaagtatgtcatgcccgaggaggagtcgagaaaaagtccgactcggtacttgcctggnagaagtcgcaaaaactgggccgtttngaccccgatgcccccagccacgagcaaggccaagctcaacgcttntngacaaga

SEQ ID NO: 978 - DNA, 809 bp, Fusarium venenatum
  misc_feature (1)...(809): n = A,T,C or G
tgtctgtctcctcaactcgccacatgtaccacatgaacagacttcgatacggcgaaaacttgttcgaaagttcaatcatatcttgttctgacatgtacttccatttgccgccgcctttggccttgagcttggcaacatcacgcccaacaaatgcagccattcctctctgaacgcccagatcgccgagcgaaaagacgtccatccttttgagggcgaagcaggcaaacatttcaacggaccattttccaagacccctaaccgcgatcagcttttccatgacttcctcgtccgaggcatcatgaagcatctgggcgctcagttctccactgccaaacctctccgcgagccctttgatatactcggctttgcgttgcgatagtcccgctgtccgaagctcctcaatggttttggtagccacttgagatggatgcgggaatcgtgaaccaggttggagctcaaatagcgtgaggaacttccctttattgactttgccgctgccccgatacttgctgnccaataattgaactcgaaagactctcaaatgggtcaatattctctgctagaccctntggcgaaaacgctctacagtggtgattctcaattaggggtttatgcgagcatnaactttgatcagataatcgcatgcctntttcacaaatatcggggtcggtttgattgaggtgcttgcttggcgaaatggttcnagatttgcgaaggggacagtntcgactntttggcnaaggaggccgatttgtaacntggggttgcaagtcggcaacccccgacttacaaggtttttggtcgaactg

SEQ ID NO: 979 - DNA, 622 bp, Fusarium venenatum
  misc_feature (1)...(622): n = A,T,C or G
gctgcttttgtctgtgcggaccgtatccttcgtgatataccctcagccctttgtcacaggtcatcactctttgccttgatagagttgctctctctcatgtggtctagctgtctggaagcagagacagatgtttacgctccccgatcaacatttacatcaaaactcggtggcgtgactgtggagctttcanacgactacgacttccgaagatggacggtagacattctcaaccgcaaggcgagggcatgggtcaatgccgccatcaacatttctcctctcgatgttaaggggattttgcagacttatctctctgaattcagcgacgagggagcctatggtcatgtttctctgggaaggtcgttcgccctcgaactcggatcaactattccttcaacggacaatcgcctgcaatctatggataaaatcggtaactcgggcgtcaacacagcatntggttttgtcgccantatacaactcccaagantatcggtatggngagacactttcagaccgnggcacaaaacttatgagcttcatgaatcacaatcgcgcatgtnatttgcncantcatccggaaaaaaaaggctagggccnctactgctttggctcacattgnggctaa

SEQ ID NO: 980 - DNA, 540 bp, Fusarium venenatum
  misc_feature (1)...(540): n = A,T,C or G
nttttcagccgccgagcagcgcactcttgagcancgcatgcaaaagcgccaggtcaaggagtttatgggtgctttcggcggtcttgtcgagcactgcttcatgtcctgcgtcgatgacttcacctccaaggctatttccaaccgggaaagcggctgcatcaaccgttgcgtccagaagtggatggcctctcagcagcgcatcagcgaccgnttccaggagcacaacgcccagctcacagctcagatgaacaaataagcgcgacaaactcggaatcgcggcgtgtacgaataggaagaagaatataccaacataaaactccgcacgagatctactcttatggtgtcagatgtatactggaaggccgtctcccatgataccgganggggatgaaacgacnacgatgatatcgggcgccgcangttttctgtancgccaaattgtcttctacattataanggggtatanacatgaacnggtgggcttggatctagctnctncatgaaangaaaatatgacccntttnttcttcaaaaaaaaaa

SEQ ID NO: 981 - DNA, 263 bp, Fusarium venenatum
  misc_feature (1)...(263): n = A,T,C or G
caactcatggaccgaatggccatgaccatgggtggtcgtgtgtctgaggagcttcacttccccactgtnacaacaggtgctagcgatgacttcaagaaggttncccatatggcaanaaacatggcgactcaatggggtatgtntganaaggtgggccctgtncactttganaacaaccccaaccgcatgcaaaatccctttgccgagtccacagcccatcanatcgacctgnaggtttctctaattgnggaggaggcctacaa

SEQ ID NO: 982 - DNA, 656 bp, Fusarium venenatum
  misc_feature (1)...(656): n = A,T,C or G
ccaaaccaccgggcctttccaactgacaagaacaaaaaatcactataatccgcctattcgaccagccagagaacacgatataccgctaaaatggccgtcgatccctttgattcagttttcgaccttctgcgccgcctcaatcccaagcagacgaccgaccatcttaacgttatcatctttatcggttctggatctaaccgaagatcttcttttatccgtggaccagccccttaccgtgcgccgttgtaagcagaccggccgagactacctcctttgcgattataaccgcgatggtgacagctaccgctcaccgtggtccaaccagttcgatccacctctggatgaaggccggatctggaggtgtaggtgctggcggcaatgagggtgcgggcgaaggtgcgaattccgagtgagcgtgttcgcaagatggaagtcaaggcgaacgaaggtttttgacgtttatcgcgatttattattacgaaagncggcgtgagcagtgtctaatttctggaatctcgacgatgggtttgcangaagtcgtgcttctcaagaaattttttcccaaggcggcaatttcganggcggttngggacttcattcatgttttcganggccttcgagccgaggacgaaacacttactattagctcacattcn

SEQ ID NO: 983 - DNA, 295 bp, Fusarium venenatum
  misc_feature (1)...(295): n = A,T,C or G
nggctngccncgcattactagacngnaaaactctcactcttaccgaacttggccgtaacctgccaaccaaagcgagaacaaaacatnacatcaaangaatcnaccgattgttangtaatcgcccctncacaaagagctnctcgntgtataccgnaggcatgntactttattngtcnggcaanacaacgcccattgtncntgtggcgggcctgatatttgggagcaaaaacacttatggtttgnnagcttaaacccnctacacggtcntntgttcttcttatnaaaaagcttcccc

SEQ ID NO: 984 - DNA, 531 bp, Fusarium venenatum
  misc_feature (1)...(531): n = A,T,C or G
cagaacggaacgcagcaaggatacgcaagccagcctcgaacttctcagcagccgcagccgcagcctcagcaaggccaggtgcaaaaacctgctgctccgctccatgctcccctcgaagcacggataccacgatactgttttgctgaggacaagtattggttcgtgatcgaagccgtgctcgaagatggtcgacaatgggagctttctcgttactacgaggacttttacgatttccagattgccctactcaccgagttcccggccgaggctggcaatacggggacacagaagcgcactctgncatacatgcctggtccggtcaactatgtgacagatgcgattactgagggacgattgccaactttggacgcctacgtcaaagaacatgctnaaccancccccttacatttnaagatgtactttggtgcgacaattttttgcaccccgcgaaggagactncnagatcgacccaacgttaccgaaattgatatcgctgnttgaagggttccaactntatntttggaatctccg

SEQ ID NO: 985 - DNA, 601 bp, Fusarium venenatum
  misc_feature (1)...(601): n = A,T,C or G
ctgtcttgaatcgcanatttaagcagtcattcatccaagtttcaataactgaacactcgtggcatatccttgatctttagtaagatggccgagaaaaaagattttcgtcctcattacaggatgttcgcctggaggcattggacattctctcgccaaagagtttaaccgccaaggctgtcatgtcattgcgacggtgcgaaacaccgacatgatcaaggatcttgagggccctggcatgagctgcttccctctcgaagtcacagaccccaagagcattgaagcatgcaaagaacaggttgctgaattgaccggaggtcgtcttgatatccttgtcaataatgctggtcgaactcataccatccccgctctggacatggaccttgacgatgttcgcgccacatacnaaatcaatgtcttcggncccatgttcctggtcaaatttttgggcctctgctcatcgaancacgttggtctcatcatccaacantttccagcacatcaaccttggtacctacatctttggggccatctactcctcctccaanggggcccttcaacntntggtctccaaacgcctcnactccaactgaaacctttcaac

SEQ ID NO: 986 - DNA, 571 bp, Fusarium venenatum
  misc_feature (1)...(571): n = A,T,C or G
gaaaactttcaattgagcttctgtgtaacctcaacctactgtttcggatcaatgctttctcacaatgtcctttctgttggcaagctgagccatcgctgtgtctttatcaaaggctatttgacaacacaaatgatggctacaagaaggagtattagcaccgcatctngggactacaatgaagctctcaacctactatctacactctattcgaatcgtcagattaccaatttattcgacaagcccacatcgcaaaatgcctcactcgaacaagccaaagacctgaatgcgctggcgcttcctgagatgcgcgaatggcttcggcgcgctggctatnaaccaaaggatctcgctcgcctgaggcacattcatatagcangcacaaagggcaaaggttctgtgagtgcatttgcaacgggtatgctgcgacaatacnaaactgncggcacatacacgagtccacatnttgtgagtccccgcgagcgtatcnctattcagggcgagcaggtctntcaagcccttttcgnggaggccttntttgaactttgggaacgactgtccaccccgccaaaaa

SEQ ID NO: 987 - DNA, 747 bp, Fusarium venenatum
  misc_feature (1)...(747): n = A,T,C or G
ccctttcttcttcctcttacatcaacatttcgacatctgctttggagcgacaaacccgattcgtttttaatcacggcttgaagatacaaagcatttcaacttttgcatttgctctttgcatttacatcaagcaaacaatcattccgttcatactcgaaccactacacaacaacgcgaccgatacaatggcgactccccagtccatcacctcttacgaggctgccgacagcgacaagaagctcgagcagattactttccgattctgctccgaatgctccaacatgttgtaccccaaggaggatcaggatgctcacaagctccagtttacctgccgaacctgccagtacaccgaggacgccaagtctacctgcgtcttccgcaacaacctcaacacctcggctggtgagaccgccggtgtcacccaggatgttggctccgatccgacgctcccgcgatctacaaactgttctctgccactggttgtggtggacatcgatttagctgtacttcttgcagtctcagcagcgattgcgctgatactggcttgcctctgttgtacaagatctgtctgcgcatcgcggtcatgtgccattttcaccttgccatggggaagaccttttactgcgctaccgaggcaccgacacgtcgctgtgacgaagactgttcgcattatcatttgtatttggcaaggcgtttacaaaanggtatgacaaggtttctgtcatgggcgctgggactttttanaaa

SEQ ID NO: 988 - DNA, 402 bp, Fusarium venenatum
  misc_feature (1)...(402): n = A,T,C or G
tntgtcancaaggaccagacattccccgactnanacaagactgtnctccgtggaacagagtactatgcatgcggtcctagatgtcacgagttcctcaaggaaatcggtaacatccttctggaatacgatgcctttagtgtcggtgagatgccttgtgtgcatgacgagcgggagttgattaaggctgtgcacggtgaccgaggagaactcagcatgatcttccattttgagctgatggatctngatcacggcgtcgaaggcaagttcacgcccagatcctgnaagctctntgagctgaaagctacaaccctttaagtggcagaagttcatgtacgacaacnaccngctggaacgcgctttacctcnagaaccacgancagccgcgggctnncaagccgcttt

SEQ ID NO: 989 - DNA, 647 bp, Fusarium venenatum
  misc_feature (1)...(647): n = A,T,C or G
cagacactcaagattcctttctttctttctttcctcctcacccacacactcactttcgttactactataccttgacttttagtcaatttcattctttaaagtacatcatcaaccactaaactttcgagttaccaataatctaatacccaacccccaaaacccaaccatcaaaatgaagttcgctactgctctcgctttcgctgccggcgttgctgcccacgccaagaacgttacctacaccactgaggtcgttactgcttacaccacctactgccccggtcccactgagatcgtccacggcgacaagacctacaccatcactgaggccaccaccctgaccatcactgactgcccttgcaccgtcaccaagcccgtnatcatgacctccgccgttgtctgccacgactgccccactggtgaagaaaagcctaagcaaggccccagcccagcccgggcacccttgggccacccccggcgcaagggtcacaaacttttaccatgggtcccccggtcntaccccttactgggggaagcccaagcaaacggtggtgacancccgccgggccccggtgctnctcctancgctggtgttcccgaagaagtcccactgcccggtgccggcaangtcgccgctctctccggtgccg

SEQ ID NO: 990 - DNA, 737 bp, Fusarium venenatum
  misc_feature (1)...(737): n = A,T,C or G
cgcaaagagcctcctgtcacttttgcccctaacaaaacctccaatcgatatcctacctcgaaaccaccaaaacacccaatcgacccaaacaaaccgacaagatggatttcggaaacctcggaggaactttcggaaatgttggaaagcagctttccaacttcggagcctctgttaccccctttgcgtcgcgcactttccaatacaccaaggagcagttcggccagactgaggacaagacccagctccctcccgactatatcgacctcgagaagcgtgtcgatgcccttaagcaagcccaccaaaagatgcttgctgtgacctcgcaatactccaacgaggcctacgactacccccctaacatcaaggagacattccaggacctcggccgcaccgtcagcgaaaaagtcagccttctttcttcagccacctctcctgccgaagcccaggctgcccttgttgctcctcccgctgccaagcctcagcccaagactttcaaccatgctgtcgcccgcgccagtctggccagcagccagctcctccaccagcaccacaccggtgccggtgaagaccctcttgcgaaggccctggaaaantatgcccttgccaaccagcgtgttggtgaggcccgacttgcccaagatgcccaaatccaaaaccggtttctngntgggtggaacactactnttaacaccacctgnttttgcacccgtgcccgcaaaaacgttgaaaactcccgt

SEQ ID NO: 991 - DNA, 867 bp, Fusarium venenatum
  misc_feature (1)...(867): n = A,T,C or G
cccatcacaaaacgaggacgtcagagaataggccagcaaacagacgtatctgggaccagaaaaacaatcgccaaaatgtcgaacccccgcgttgaagaacttcccgacgaggagcccaagaagaccaccgtccaggagcacgaggatgactctagcgacgactctgaggttgaggaggttggcgagggccagctccccgctggttctaccgtgatccacaaccgcaacgagaagaaggctcgcaaggccctcgagaagctgcacctcacccgcatccctggcatcacccgtgttactctccgccgccccaagaacatcctnttcgtcatcaacacccccgaggtttacaagtcacccaacagcaacacctacattgtcttcggtgaggccaagattgaggacgttaacgccgctgctcaacaagctgctgctgctcagctcgcctcccaaaacgctgaggaccactctggtcacaaccacggcgagcccagcaaggctgttgaggctgacgagaaaaaggaggacaaggaagatgatgaggaggaggaggatgaggaggaggaggaaggtcgatgcctctggactcgaggataagggcatcgagcttgtcatgacccaaggccaatgtcagccgaaacaaggctgttaaggcattgaaggagaacgacaacgacattgtcaattccatcatggctctaagtatctaggcataagtttttgaccggacgatcttcgacaaaagcatgtgcatgggacgaacactgggctctgtattagttctgggcgaactgtactctgcggaatggagttgatgtcaaacaacggaaaaaaatcaaagggaaagcacccacatccgtcaaaaaaaaa

SEQ ID NO: 992 - DNA, 681 bp, Fusarium venenatum
  misc_feature (1)...(681): n = A,T,C or G
aaacaacttcgtctcttagagattgagcacaaagctcctcttttttcgcatttcctcgagaccatcaacggtctcgccactattcgtgctttcggctggacgcaaccgtacactgacagggtcctaactcgcattgacgatgctcagaagccatcttacttgctcaactgtattcagcgatggcttactctagttctggatatggttgtcgcgtttttgacaattatccttgttatatttgctgtcacgcttcgcgaaaagattaacccttcgnttctaggcattgcactggtcaacatgatgaggcttggtaccaacatgaagggcattgttctaaactggtcaatccttgagacttcgttaggtgctattgcgcgtattcgcatgttttgctcttctgcncccagcgaggagaaaccaggggagagcaacgatccagaatacatttggccgaganaagggagtctggaagtcaagaaccgtagatgtnaatatgaacacacaactgacctgtnctacgcggtctttnattcacctcaagcctggtganaaacttggnatatgtngccaagcngtngtggaaanacctttttgttcaatccttnctcccnatggntgaagccgtcntggcntatanttttgncggagagatatttttgtttnctaaaaattttnttccac

SEQ ID NO: 993 - DNA, 599 bp, Fusarium venenatum
  misc_feature (1)...(599): n = A,T,C or G
gtggacaagtttgccgagggattacaaccacatcagctggcgaagacttcagatgggtcaacggtactcgccaaagccgttgttgagcataaccttcttggtgcatcacgactttacagcaacatcagattcgaagccttggggtcactggttgggactggatgcagataaggcggaggagactacagcacgtatgatcgaacaaggtcgattggtaggtcgaatggaccagctcgacggtattgtgtactttgagggaggcgaggcgtctggaaaaaaaggtagtggaccaacccgaagttcccgttggcaaagaaatgcgaacattgggactccaatgtccaaagtcttggcagaagaagtagaaagcgtcaccaacgcgcctgcaaaaggaatttctgaatttgttgctgcaaaccttgttgtatgaagaaaagatacangcatagaaacttttgcttgtctggcgttttaagggttgggatgaatgaatgctatttatgtctaatgcacaagcacatagctccctttggttttaaactggcatttatgacacaggccaaatcccaaatctaaaatgtttctaccgaaaaaaaaaa

SEQ ID NO: 994 - DNA, 452 bp, Fusarium venenatum
  misc_feature (1)...(452): n = A,T,C or G
gcgcacccgcggctcctagtgcgccctttcccagcgcgcccgccggccctnctnctggtcaacaatattatcccccctatccacaacatgcctggcaaccaccaccttctnctccgcgcagggactggagggattggttcatcatggctacggtagttggaggagtgtnttatggtctctacgagctaggcaagcgttacntataccccaatgtggcacccccgacaccgganaagctggagcaggacaagaaatcgatcgaggatcagttcgaccgancttttacactggttgagcagctcgctaaggatacggagagcttgaanaatgccgagaagganagaaccganaagctagacacggcgatcgcggacctcgagacagttattactgacctcaaggctgccaaccgaagacgcgaggacgatgccaatcgaatcagggacgaagtt

SEQ ID NO: 995 - DNA, 567 bp, Fusarium venenatum
  misc_feature (1)...(567): n = A,T,C or G
gttccatctaccatgaaggccgttcagatcaacaagaacggcggtgttgaggttcttgagcataataatgtccctgttcccaaggctggcgagggtcagattcttgtgcgcaaccaggtcgctggtcttaactacatagatacctacttccgttctggtctttacaangcacctcaattccctcttacgctcggtcgtgaagctgcgggaactatcgttgatgtccactcctctgtcaagggcttcganaacngtactcgggtggtctttatgggcacagtcggtgcctatgctcagtacagcgttgtcaacgcttctgatgccgtcaagatccccgatgatgttcctactgagcaagctgtaccgcttacctgcaaggtctcacacatggacatttatcccaaaagccggacaggtccaggaaagccaatgggttctattcacccgcatctggtggtttngtaccttgttngttcacctctacnaactgtcngtgcccanatcattgtactgctaccncgataaaaactnaactcnccaaaaaaacgtgcngggtgggtttcactc

SEQ ID NO: 996 - DNA, 579 bp, Fusarium venenatum
  misc_feature (1)...(579): n = A,T,C or G
gggacaggcaagatgaatgcgccaaantnttagaacccttgngggctttctcatccaaattttcatggatcgcccgtcaaanacaggcatcactggctaacccaggaaaaccttgtgccaaacaagccagaaccccancaaggacaaacaagagccccggtttcctcgatccatccaggccctggcacctgaaagcctctaaaagcgaagaggccgaaacacggcatcccctcatgcgaccttcagcttcgatccttcagcgttcaacccctcgaattcttctccgattttgctctaanaccgcttactacttgggcctccccgcctacggtcccgtccctctcccacgcatcaccgagcgctggantgtcccacgananaacttcatcttcaagaagtcgcagganaacttcgagcgaaaganactacgtagactcatccagatccgcgatggaaaccccganacagtgcagttgtggctcgcatanctccgcaagcaccaattctacggggtngggaatgaanggcaacatttnggaatttancaactnggcgaaggcacaagatggatgctcttcc

SEQ ID NO: 997 - DNA, 654 bp, Fusarium venenatum
  misc_feature (1)...(654): n = A,T,C or G
atcgtctgaaggcatggtgattgatctgaggaagatgcggaaagtcgaagttgaagaagaagccatgactgtcgagttcggaggtggatgtctctgggaagacgtcgattctgcccttgaacggcatggcttggctactgtgggaggcgtcgtcaatcacacaggggtcggaggactaacactaggaggtggacatggctatctcacagctcgtcatggtttaactatagacaatttgttggaagctgaagtggttctcgccgacggcgcgatagtcgaagcatctgaggacaaagatgcaaatttgttctgggccattcgtggtgcaggagcacaatttggagtcgtcactcgttttctttctcgagcccatcagcaagtcaaagtatggagcggtacgctggtctactcatctgacaagctgccttatctattacgctttgcaaacgagttacataangagacccaacacagaangncattgtcttgctttangaatagcttttgggcccaatggtcaacacccgtcgtattcaactatncctctgtttcatggccanaatnccatgccaaaccgttactttttctaggtcttaattgagttggattcttntggccgataatacttgngatgatgaccacngccgaaaacat

SEQ ID NO: 998 - DNA, 516 bp, Fusarium venenatum
  misc_feature (1)...(516): n = A,T,C or G
tcacactccngtcgacagcaacatcagacaaaatggcccccgccgcaaagaagcagaanaagaagtggtccaagggcaaggtcaaggacaaggtccatcacgccgtcgtcctcgacaagaccaccttcgagaaagctctacaaggatgttcagtcttaccgtctggtcactatcgccaccctcgtcgaccgaatgaagatcaacggttctctggcccgacagtgccttgccgacctcgaggagaagggcatcatcaagcctgtggttacacacagcaagatgaagatctacacccgtgccgttggtggtaccgactaaatgcaattcaacgaaaaatttgagtctcacgattgtgcgtctgggtggcctggacgatagacaggccacatggtcggagggtgttgcaaggcgaaaaagaagcctggtttaggacgctattcatgctcggttaagcattgggacggaatcgctttagcacaaacggcaacggaatgaaaaatcttcgaaacgaccaan

SEQ ID NO: 999 - DNA, 461 bp, Fusarium venenatum
  misc_feature (1)...(461): n = A,T,C or G
cgcaacccttcgagctttcggccttcaacccccccaacaacgacaccatgtctcacgaaagcgtctggaactcccgcccccgaaactacggcaagggctctcgcagctgccgtgtctgcaagcacaaggccggtcttatccgaaagtacgacctcaacctgtgccgtcagtgcttccgtgagaaggccaaggacatcggtttcaacaagtaccgataaacgatccatcatcatgacacccggttttctcgtttaagggatggggggaaatgctggagagcagagtattgagtggaaggggagaactctcagcagaaagtcaaaggcctcgcgttaaaaaagcactcggagggcggcccgttctgnaacaggcagtctagagggcctgcttgggtccctcaagaagatcgtgcgtctgacnaacatcctccgaggatagacgaataccattgtttggcctcg

SEQ ID NO: 1000 - DNA, 560 bp, Fusarium venenatum
  misc_feature (1)...(560): n = A,T,C or G
atttnnggtcgtcaatcatagcaggcgccagcagtacaatagttaccaacccaatatgggttatcaagacacggctcatgtcacagagcaacattcgacacaacacccaggaccaccattccgcatactatccgaaagcgactagcacaccaacaacgcgaccaacactacacgactggcactacaaatccacactagatgcagctcgcaagatgtacacctcggaaggtctcatttctttctattccggactaacgcctgctcttctcgggttgacgcacgttgctgtacaatttccaacatacgagtacctcaaaaccaggttcactggtcaagggatgggcgaatccaacgagggagacaataaatcccatgttttcgggatcctgggggcctcgattctatccaaaatcctcgccagtaccgcgacgtaccctcacgaagttattcgcacccgtttacagacccaacggcgtncgcttgctggcgaggagttcgctcanggtatgggagtgacnggttcaagccccccgagcccctgctgcgaagccaagtaccaa

SEQ ID NO: 1001 - DNA, 689 bp, Fusarium venenatum
  misc_feature (1)...(689): n = A,T,C or G
acgagactgggttcgatctatccttttcccatctcatctcaaatccgcttcattcatcgtttttctaattcagtggaacacccacaccacaccttcgactttctacggcgacgcgactcaaacgtattcgcgtcagactcgtcaacgcaattccgctgcagagaacaactttcgcgatagcttccacatcaacagtctaacagctcgtatatcacaatcaacatgtctcacgaggaagatctcattgactactccgacgaggagatcggtggcaacgagaccgccgcgactgcctccaatggcaagaagggcgagctcgccgccggtaacaatgtcgacaagaagggcagctacgtcggtatccattcgaccggtttccgcgatttcctcctgaaggctgagttgcttcgcgccatcgccgactgcggtttcgagcatccatcggagggtccaacagtcctgatatctctcatgcgctcctcggtggtgatattctcttcttcaagcgttcgtccggtctggcaagtaagaactgctgtccatttgttcttcgctatcgttcatcgtcgtcagacccgtggtcacggaaagtctctgtggttgtcatgtgccacattcgtggctgcctgagccatggtctgacagacagtgggacgtttcagcaatactgcccgactcaaaacngtgtc

SEQ ID NO: 1002 - DNA, 587 bp, Fusarium venenatum
  misc_feature (1)...(587): n = A,T,C or G
cttcgccgccgcttgtgttggatctggagtaccattgcaggcctggatctttggaaagattattgtctcctttaactatatcgcagccgattcggacctttccgaaagcaaattctgggctctgatgttcgttgtcctggcagtaggtataggagtcagttactttgtcgtgatctttgtggcaactcgcatgtcagcgaccatccgggccaagtatcagcaacagtatttcgacgctgtcatgtttcaaaagacatcatttttcgataacgaagatcattctcatggaacaatgacatcgagactaggaacagacccaaaacagttggaagagatgatgggactcaacatggcgagtgtcttcgttgcactcttcaatgtcataggggctgtcactatcgcctttgcacacacctggaaactancagttgtttcgtgttgcgttgtcttgcctgtaatgatcatctcggcttattggcgcttccaatacaaattggcttttgaaaagangaacaacnactctttgcngaaactcaaaatcncgtccgaatcaatggacttttaagactgtcattctctgacctgga

SEQ ID NO: 1003 - DNA, 987 bp, Fusarium venenatum
  misc_feature (1)...(987): n = A,T,C or G
ctcaagtcacttctaaccccatctatatatcacgacagcagacgcttagcttcaagtttcgtggtcgcattaattagctatggatgtcgaagagtcgccctgggccgattcatcacaggcttcgcaacaggcgtcgcagcctgaagcctcggcctccgcttcgcaatcacctaccccagctcccgcttcctcatccgcccctcgtccgtcgagagggccccgtcgcctggtcgctcaacccacacgtctcgaagctgtcgacnatcctcttggtcccctcggtgccgtccccgaagacaatggttccgctcaggatgcccctccggtgcctccgcaaaaggagcagatggtgattcgtaccaccatgcctcaaccgcaacagcagcgacgacctgcggaccctaaccatatcgacgacgaagtaaatgacggtccaaaggctcctcgcgcacctccacccgtcgaagctgcgcagcctagtgctataaggagcagcaaccagcctagtgttagcattgaacaggccgccaagcctactttccagatttacgttggtgatcctcacaaagtcggcgatttgactagttctcatatcgtctactctgtcagaaccaagaccacttctaagggatacaagcaacccgagttcgaagtcaaacgccgataccgtgatttcctgtggctctataatactctccacggtaataaccctggcatcgtcgtcccaccacccccggacaagcaggctgttggtcgctttgacagtaactttgttgaaagccgccgagccgcactcgagaaaatgctcaacaagaccgcgatacaccccacgctacaggacgaccccgatctgaagcttttcttggaaagcgagacctttaatgtggatatcaagcacaagggaaggagagatctattccacccgagagcaaagggcgtctgggttctttgggtattaatggtggangggggacaagtttggggggc

SEQ ID NO: 1004 - DNA, 586 bp, Fusarium venenatum
  misc_feature (1)...(586): n = A,T,C or G
cgcagcagagtgcaatggcgaggccgtcgatctcggccgtagaggtctccgaatcggcgcaattttcatcatcatggcctcctcgctcattgggcgcaatcttgcctattttcctgggcgcgccaaaaagacaatcccccgtacccaaatttaccttcttcatttgcaagttcgtcggtaccggtgttattatagcgacagcttttatgcatcttctggtcccggccgtcaaaaacttgggcgacaaatgtctcgaaggatcgcctgggtggctacaactgggccgaagcaatcgccctcatgaccgtcatggtcatgttcttcgtcaaaatgctcgccgctcgtctcagcaacgccgatatggagcacaaccactctgacgaattcgaccctgccatggaagtcattgccaagaaatcacccagcaccgacatcgaaaccggaaaacgcagggcatccggctaccctcctggaagcgatgaacaccttgcccatggtcgtgagcacaaggaaaggcaagcgcagggtgggacttgctggccaacttctcgccatcttcattctcnaattcggaattgtgttccca

SEQ ID NO: 1005 - DNA, 307 bp, Fusarium venenatum
  misc_feature (1)...(307): n = A,T,C or G
ctttgtcacctctgtcggaaacatcaagctctttggcgacagtgactccatgagcgctgaccctgcattcctcagtctcgctgagagaatcacccgccaagaggtcgacgacaacctncccgtgcgatgtcccgacgacgccgccggccgaccatggaggcgcgcatcgctgagttgcgagacaaccacnacagcactnggcggtaccgtcacttgcgttatccgcaatgcgccctctggctangngagccttgcttcgacaaggttcaggccaccttgcccaagccatgatgtccatccccgccgt

SEQ ID NO: 1006 - DNA, 626 bp, Fusarium venenatum
  misc_feature (1)...(626): n = A,T,C or G
ggcgttgagacacggatcaatcgaattagaaaagacccctctttcgactgtaacatttacatcccatccgtccatccaagctggacaagcgtacttcatccaggcccctcctcctcctcctactctccctcctcttccttctcgtcgctgtaactctggcttcttcaagagctttctcccgtattggctctcttgcgaatcaagtcagattccaagctacacgaacaattctatcaacaagacagctcatgactagcaccatggctcccgacaagtatcgtaaccctccccaggcgccgcctctgttcaccgccacccccgagtcgattgctgccgacaccaagaagctctgcgatgctactaaggatgcgctggactctgttgctgccaatgtcaccgcagataaggcctctttcgccaacgtccttgagcctatcctcatagatgagaatttggctggcactcagcgtcgcatcttgaccttctaccaccatgttttcaccaacaaggagctccgtgatgcttctaccgagtccgagagagtcttcaatgacttcggtatcgagtgtaacatgcgagaaggatatnttcaacggccgnggatgcnggtttcgccaaccgagcat

SEQ ID NO: 1007 - DNA, 422 bp, Fusarium venenatum
  misc_feature (1)...(422): n = A,T,C or G
ggaaaggacaatggcattcctgacttctaccctcaaaactctactcttgcacacgcagctcagcatatcctctatatcggcaacctcattggatatgatcacgtcggtattggcaccgactttgacggcattccgtcagtgcctaagggtcttgaagacgttaccaagtaccccgatttgatcgcanaattgcttcgacagggcgtcagtaatgttgacgcagctaaggttgttgggggtaatctgctgcgagtatggaaagaagtaaacactgttgcaagctcagctacaggccaagggacagctgccgctagaagatgatctgccaagatgaaattcgaggaggcaaaacangcgtctgtggagggtgcgtaaaacttatagtaccgcgattaataacaccgctccggagtttgtttccc

SEQ ID NO: 1008 - DNA, 628 bp, Fusarium venenatum
  misc_feature (1)...(628): n = A,T,C or G
ctccgttcgtccttgaaaggcaacttctcacgagcaaagatggagaagcctcaaaagattgttgttgttggggctggtcctgttggttctctggcagctttatatgctgctcaacgaggacatgaggttgaagtttatgagttgcgacctgacctccgggatcccagcactatcccgctcaacttcaccaaatccatcaacctcgccatttctgagcgcgggatcaatgctatgcgccatgctggccagccaggacttctcgatcatgtcatgtccacaacgattcccatgagaggacgcatgattcatggcaggagtccaaccggagctcattttgaacagtctcaagactacgatgttaagggacgggcaatccatgccattgatcgtgcangcctgaataagcgactgcttgatattctggacaacatgcccaatgtcaagctgttcttcaaccacaagctcacaggcgcaaactatcgcgcttgcaaggcttggtttgaggcactgacngaaaagcgtccaaagagtctcgtttcaangagattgatatatcctttgatctcatgatnggcgctgacngggcccattctggtggtcgctccccttatgaagttacccggatgaa

SEQ ID NO: 1009 - DNA, 588 bp, Fusarium venenatum
  misc_feature (1)...(588): n = A,T,C or G
tatatatcttgcaactaactgctgagaaagcaaaagggaaaatgatggaatacatcgaattgccaaaaattgagctccatgcacacttgactggaagcatctcacgccaggctctccacgaaatatggcttcgcaagaaggagacgggcgatactgatcttgatgatcctctggttgtcatgccagaaggtaagcacgactataacttgcaaaccttcttcccactcttcagcagttatatatacaacctcatcactgacgaggaatctgttcgctatactacgaaatctgttctaactgatttccttaacgatggcgtatgttatctcgagcttcgaacgacaccccgcagcacccctcaactctcagcagagcaatacatcgcaactcttatagacgcaatctcactattcgagtctaaaagtcctcagctacacacccgccttattctatccattgaccggagacatacccttgaacaagcaacttctacactcaagctcgccctgaaataccgcaatcaaggagttgtcggtctcnacctctgtggtgacccaacagcccgacccaacgggcgatataagtgtc

SEQ ID NO: 1010 - DNA, 559 bp, Fusarium venenatum
  misc_feature (1)...(559): n = A,T,C or G
agcagcccagcgcccgaaaagttccccctagcatctcgtcgtgttcaagcctctcctaaatctccaacttctcagcttcgctacatcttcaggcgtcactttgactttgtgtgtgctcgacttgtcctgtgttgcttcgagtccagtccttctttctttcttagaatatcttttgacgttcccaagcttcaactcttatctacctgcttaatttaacaagtgtcgccgaaattactcaagatggccgccgctcctcccaacactatttaccccgagagccatgtcggtttcgacagcatcacttctcagattgagaagaanctcttgaagcgtggcttccagttcaacgttatctgcgttggccaaactggtatgggcaagtcgacgctcatcaacaccatcttcgcttctcacctgatcgactccaagggttgcttccaacccgaagaacccatcccgccagaacaccgaaatcaggcgtttctcacacattgaagaaaacgggttcgacttcaatcacatgtagataccccggtacgtgattctcacaacacgctgt

SEQ ID NO: 1011 - DNA, 630 bp, Fusarium venenatum
  misc_feature (1)...(630): n = A,T,C or G
ttaatactcaattggcaactgagtcatctctcttcaatcatgccgtctccacgacatatcgctgcagctttggttgctactgcgacaactgcatcagctctctatgtcaatggtactgttgttgcaccttgcgattcgccaatttactgccatggagatatccttgagcaggtcgaactcgctcgaccttttagcgactccaagacctttgtcgatatgccagctattcgccctctaagcgacatccaggaagcttttgacaaactcgagaagcctctccgcaacaattctgcccttgctgactttctcgatgaaaactttgaccatgctggcaatgagctggaagaggtatctagagacgatctcgatactgaccctaaattcctcgacaacatcaacgacactgtcatcagagaattcactgaaaagggtattgacatttggcctgatctgcccgtcgatccaccaagacgccaaaaactgtcagattgcccaacagcttnatcccgtcaaccgttttttgcgttgcaggnggncgattccgngaccctactattgggattcttactgggatcattctgggtcttctncgaaccggnggtttttnattggaatcgccaaaaacacaat

SEQ ID NO: 1012 - DNA, 687 bp, Fusarium venenatum
ccaaaaagaggtcccctttaaacttgagctccaaccctcctttctacaacccccgcgactttgactttgactcaattcgacgaattcgtcttctttcctccacgacattgccttctctccttcacgcaacgtacttttaatatctctacccgtttcttccactacccaacatgtccgaccaggttcaagagatcctcgaggttccctccgagttcgtcagagacggtgttcaattcgtgcgacgatgcactaagcccgaccagaaggagttcctgcgactctgccaagccgttggagttggtttcctcatcatgggcgccgtcggctacgttgtcaagctggttcacattcctctcaaccacgccctcgtcggtagcgcataaacactcacgcgatcggtaatgacgagattctggatggtggcgacttgataatccaaaaacccgcaagacgggaacgaggacaatcacacaacctttcttgcttgcgggtatgcttaaaggggcggagttacatgacattatggcgggcacgcgacacacttctacgctgaattcgaccgagcgccataggagatgagaggatgtgttttcacgtccaaggcgctgtttgtatgggttgagaaatacccatgagaaaaacggctacagtgattaattgtacaaatatatccattgttatttctgc

SEQ ID NO: 1013 - DNA, 685 bp, Fusarium venenatum
  misc_feature (1)...(685): n = A,T,C or G
gctgtcatcaccccctacatggttggtgagatcacgaggcaatctcttctctcttcccccctcatcctcctccccctctctcctcacatcaacaacaactatttattacccccttctgcctggccagaactaaaacaaaccagccacacaacaataacaacaacaaaatgggtgttgaagactcacacaccgacgagcgacacggctctgtcgctctccaaactgccgagaatgtcgagcagatcgaggctcccatcacctggaaggcttacctcctgtgcgccttcgcttctttcggtggtatcttcttcggttatgattccggttacatcaacggtgtcaacggctccgactacttcatcagacaggtcgagggtgccaatgctaccaagctctccgagagcaaccagtctctcattgtctctattctctcttgcggtaccttcttcggtgccctgatcgctggtgatcttgccgaccgcatgggtcgcaagtggactgtcattatgggctgtgctatctactctatcggtgtcgctatccaaatgatcactggtcacggtgatcctcttgcctgcatcgttgttggtcgtctcattgctggtctgggtgtcggtttcaattccctatcgcattttctaactgtccgaaattgcccanaatntccttgtgcctcttgccgtta

SEQ ID NO: 1014 - DNA, 445 bp, Fusarium venenatum
  misc_feature (1)...(445): n = A,T,C or G
cctggtgctcagattcggcatccagctctgctcaccatcacactcactcactcaccgagcccgaccttacttaaacgactactttcatacacaaagatggccgacgccggaaaanaacctcatcatgtgtcggagcctctcgaccttgtccgacttcttctcaacgaggttgtctttgtcaagcttcgaggagaccgagaactcaagggaaagctacatgcttacgacagccattgcaacctggtgctaggagaggtcgaggagactatctacactgnggatgaggatgatgacgacgatgagctcaagaccatcagcccggaaatccgagatgctntttgtgagaggngacagtgttgtcttgatctccctggagttccttttaaaacaaataaggaacatgcgcgtcatagggttatatagccattaatacaaaaaaaagatt

SEQ ID NO: 1015 - DNA, 638 bp, Fusarium venenatum
  misc_feature (1)...(638): n = A,T,C or G
ctgggggctaactacgtaatcttattcctgtgcttttccaactccattcgnggccacgcaaacctcacatccatcacaattcgtctgccttgaacgtgatttctttttaaagctgctgcctggctttatctcccttcttctttaaactcgatcgaccacgaatcatcactggcgcaatcctcaggaacaataccctttcatcctaagacacaatgaacatggagccctccgacatctttcgcattgtcaacttggcagtcggtgtcatcgtcatcctcggtggtatcgtgtccatcttctctttcagccttcagcctatcatcctgggtgcttacatgatcgtctttggtcttgttactggccttcttgagttccaaattccccctcaagtttctcgacatgcgtcgttcatgttctccttcatcggccgtggtgtcttctacatcttcctcggctctctgatggtgagcgacagcattctcagcaagatcgctggcagcatcgtcggtatcactggtattgcctacgtcgctctcgagttcgttcccttcatcgagccccctgccaacatgcgcgaggncgaaaacactggctggggtgccgancaggtctaaaaagtcaatagcagtatgtcccac

SEQ ID NO: 1016 - DNA, 621 bp, Fusarium venenatum
  misc_feature (1)...(621): n = A,T,C or G
gctcattttcaacttgaccttatacgttcttttaatttttttattctcgttttagtcaaccatgttgtctcttaaatcgctgtcagcctcgctgataggcgccctgagcctgagcgctggcgcgtctgcagccagtagctcgggtcttgtagcctcgacctatttcgctggcttccatgccaaccgaggcttccctgtctcggctatgccatgggataaatacaccgacgccaagtactcttttgctgagaccactgaagacggtggacttgatctatcccagtctcagcctgaagagcttagctgctttgtcactgccgccaagaagaacggagtcaaggcgcttgtctccatcggcggctggacaggcgccaggtacttctctaccaactttggcaatgagaagaaccgcacagcttttgtcaagacatgtgtagactttgtcaaggagcatgacttggatggtctggattttgattgggagtatcccaacagacagggccttggttgcaacaccatcaacgacaatgacacagccaactttttggagtttttgaangagcttcgtcaggaccctgttggaaagggtctctatctgaccgctgctagctctctggttcn

SEQ ID NO: 1017 - DNA, 622 bp, Fusarium venenatum
  misc_feature (1)...(622): n = A,T,C or G
gcccaatataccctttgaaaggtgacaagctcgacaagaccaaggccatcatcccgggaatccacacaccttatgtatacgaatcagggccttatttcggtgcaagctttcagatacacgctgaggacttcagactcgtctcactaaaccacctgtacaaaggccgaaagatttggattgtggtcccttctacagctgtcgacgttgctgaagaggctcttggtcgaaagggcaaatgttcccagttcatgcgacatcgagctgagttcttctttcctcaaaagcttgaaaagttgggcatacccttccgcatcatcgaccaacgtcctggtgagaccatagtgattctgccggacgcatatcatgaaggattcagcactggatacagcatcgctgaggccaaaaactatgcggataatggttggactaccgaaacataccaggaatgtgaaagtcaaagtgtaagcttgccacaatgattcctgcggatttaatgcggcccttgaaggatgggagaggctcancttggacctttgttcgggtttcgaattacttgncgaaaagaaaacaaccaccgggcaacgccaccaacaacaaccggcatntgggaatatgaaaaaga

SEQ ID NO: 1018 - DNA, 629 bp, Fusarium venenatum
  misc_feature (1)...(629): n = A,T,C or G
cccaaattcgtccctctctacctatactcaacacgcctcgataagtctttgactacatcaacaccaccaatctntatttctcaaaaccatccctcanaacaccgncaaaatgcctaaggctgctgcctaccggaaagcgtgctaccagaaccaccaagcgtgccaagangggtaagtcgaagcatctcccacgctcgtgtttgcaatcacactctntattgtgcctttgcatcgcacacgttgcgatcttctccgacgcaacaaacacaactaacttnaatagaccccaacgcccccaagcgtggtctctcagcctacatgttcttcgccaacgagcagcgtgagaacgtccgtgagganaaccctggtatntntttcggcaggtcggcaagctcctcggtgagcgatggaaggcctcaacgagaagcagcgtgctcttatgaggccaangntgccgccgataaaaacgatacgangatgaaaagcaggcttacaacgcccaccaagangangaagagtctttctaaaaaaaagtnttcgattttaaacccaagcgtnnctcgcaaaaggggaaatntgattcggatancccaaccccngggccgggttggaaattntggccaagaaat

SEQ ID NO: 1019 - DNA, 587 bp, Fusarium venenatum
  misc_feature (1)...(587): n = A,T,C or G
caatacacaccaaatcaaantggcatcccgtcgcaccttcatatcctcagctttgcgcgcctcagttgccgtccgacccgcgcggcctatcttcaccatcgcagcccgcacagcanggccatctctggcatcacgagcatttgcnccctttgctaagtcgttgcgaagctatagcgtcaaggaagaaccaacaaaagactttaagaaatgggaattcgaggaattgaaaaaacttgtggaagatggcactcatgaagatataatcattgttgatgtccgagaaccgtacgagctcttcgagacaggcaaaattcccggcgcgatcaatatccccatcacaacagcagtgcagagtttccatatcccggaggaggactttgaggagatgtacggcttcgagagaccttcaaaggacaaagagctattgttttactgcaaagctggcgttcgcgcaaagtcggccgcgcatttggctgancatgctggctggaaaaaagtgagcgattatcccgggagctggttaanattggggcggcncaaaacnggcctgttgaaaagtgtcaagccggtcttanggatcaaattgc

SEQ ID NO: 1020 - DNA, 581 bp, Fusarium venenatum
  misc_feature (1)...(581): n = A,T,C or G
gtcgagtttatcggagcgtcgcgatgaaagctgtgacagaaatcgacatcatggctggccaaggttcatccgtatttcaagaaacccttcgcatgttttagtgtttaaactggattgcttattgctcgtgtgggcatttatagccggtctcttcaaggacatggaccagtctgccacgacagccgcatttgtctccggaatgaaggaagatctgaatctctacggcaatgaacttgtngagtttacgacatatttctccattggctatgcgatctttatcgttccatcgcaactcatccaaactcgagtccgaccatctatcttcctaccagtttgtgaaattatatggggtctttttacactcttcacctacaaagccccaaatgccaaaatcatctatgcgctgagattcttctgggcgtattgantctacatcgtggcctggtattgttaacccgatctttaattggtatcgtcccgaaaaactggaaagcggtggccatttccgtgtcacggggttacaggaaaattttctcggctcccccactgcctctcaggaacccaacgaatcccggtcttct

SEQ ID NO: 1021 - DNA, 570 bp, Fusarium venenatum
  misc_feature (1)...(570): n = A,T,C or G
caccanacntgccctcctttttttcctcgttaagggatttaaattgtactcattccaattacaagacccaaaagagccctgtatcagtatttattgtcactacctccccgtgtcgggattgggtaatttgcgcgcctgctgccttccttggatgtagtagccgtttctcaggctccttctccggggtcgagccctaaccctccgttacccgttgcaaccatgtttggccaatacccaaacatcgaaagttgatagggaagaaatttgaatgaaccatcgccggcacaaggccatgcgattcgaggagttatcatgaatcaccagtgagccccgaagggcattggtttttaatctaataaatacatcccttccgaagtcgggatttttagcatgtattagctctagaattaccacggttatccaagtagtaaggtactatcaaataaacgataacttatataatgagccattcgcagtttcgctgtataattgcttatacttagacatgcatggcttaatctttgagacaagcatatgactactggcagatatgcaaccaggtaactttcg

SEQ ID NO: 1022 - DNA, 597 bp, Fusarium venenatum
  misc_feature (1)...(597): n = A,T,C or G
cagatgttcaatataacacaaagcatcctgtatatccggtccttcaacgaattggcaaagaaattacacatcaagtcaaaccaaaagccgtggttgtcttctcggcacattggatgggagaagaggacaccatccatgtcaacaatgcagttgatactgacctaatctatgatttctatggcttccctgatcatttttacaaagctcagtatccaaacaaaggaagccccgagcttgcgagtaagatcatggtgatgctttcagaggccggaattcagtcctatggaatgaaacgtggcctagatcatggcgtgttctctggcttccacgttgcttttaaccctgaagcgaatcctctaaactcccgctggttcaggtctctttatttaagagtgaaacctcatgctcattatgcccttggccgcgctgtgtctgccttaggaacaaggaacgtcataatcgtgctggaattcgtaccaacttgcaaactcacacatgttaangtaccagaacctccatacntgtgattcacaccctaaanagtgcgagcgaccgattcgcagaaaaagcgcgttcanaagaacaaaaaccccttct

SEQ ID NO: 1023 - DNA, 602 bp, Fusarium venenatum
  misc_feature (1)...(602): n = A,T,C or G
gatgaagttcgcctcggcatcttttctcctattttaatgtcaattgcgctgtcgcttcagtctctcacttgatctgcaacataattctttcgaataatatacacatacacatacacaatggctgctgaacgtattggctntattatcaagcacctggcccctgggtcagcgcttaacagcatccagtccaagaaccccgacgatattgttatcaccctcgccgtgcgaacaccactcacaaaggccaagaagggtggcttcaaggacacatcgcttgaatatatgctctatgctatcctgaaggaagtccgagaacgatcaaaccttgaccctgcccttgttgaggatatttgccttggaaacgtctntgatgccaaggctgcctacaaggttcgcgcctctgctctcgccgntggtttcccaacaccggcgggccttctcatnaaccgattntgctcctccggtcttaangccccgccgattcccccttcatctcaatggcttcatcnaaacggtttggcatgggcgccaanaaaaaaacattgnggggacccnctcanaagccttttaagaaggcgttcattaaaaanccaagagntntt

SEQ ID NO: 1024 - DNA, 663 bp, Fusarium venenatum
  misc_feature (1)...(663): n = A,T,C or G
atttcgacgacgacaacctcaagcttcattctccccggtcaattttcacgccaaatcctcaatcacaatgtctaccgcccaggagctctccaacatttcccaggacctgatctgggagatcgtccgtgacaacaactgcttctccgccaagagcaagaagaacggtggtgttcagttctcccgagaccccctcaacctgaccaacaagagctcccgaaagcacgccggcttcgtcaacgacaaggccgtcggtatctctgctggtgagaagggtgccgttgttgtcaccaccaagaaggctcagcccaacaagcccgccgagaacctcaccaagacttcttacagcggctccaagagcaaccgcaagacctaccaggccgttgccaaccaggtcgccaagaactcttaccgcgctgacctccgctccgctgctgttgagcgtgcttctgccatnaagaagtccaacaagcccgtcaagcccgagcctgagcagaanctncgtggcaacaaggccaanaangccgttgccgccgncgctctgaggagaactaagctttacgatgcaaacatagaaatgggggttgtgaataaggctataggatgaactagggaggtaagctgcatagcttacacctgatgagaaaagggatcatcagaatgggc

SEQ ID NO: 1025 - DNA, 600 bp, Fusarium venenatum
  misc_feature (1)...(600): n = A,T,C or G
ggcaccgccttgagtggcgacggtattgatctctcagcctttgcgccaaaggttggaactgagaatggtgaactatcgacatttcgagctttccagtcacggggggcaaccttactacgganaattagacgcttttccaaggaaggctacttccttgatgtgactgtgttggaggagtgtgtgaaanccaacgtcggcgatctcacattcgaggaagcctataatcgaagcaagagggtgttaaacattacggttgcaacagagggtcaaggaggtgtgccgacnctactcaactatctcaccgcacctaatgtgttgatttggacagctgctgtggcgtnnaatgcctcatcgccttcnctctatggccaccggaaaacaaccatgctctgcaaagacgctcatggtaacatcgtaccttgggcccggccaatactatcnactttcgacactggacncacacattatactcggatcgagactcacctntaanggcgtatcgntgaacttttcaacggcaaccacttttnttgtcaggcaagcccggncattccttatcccctttatccantcccattttgcatggcccgccctggtaga

SEQ ID NO: 1026 - DNA, 812 bp, Fusarium venenatum
  misc_feature (1)...(812): n = A,T,C or G
gtgcatttctttcttgctctttataaccaccaaccggagtcagattattgatcgattggcctgttcgaatagaccgagtaggtctgggaaaggaagaaaggtccggacatatcgacgagtttgcgcggcactttcggctcggacaattgaaagccgcattttccccttaggcctttctttgttatcttgagcatcaactcaaacgtcgacatcgtcatcgttttcgtccgcagcgaccacccgtgggcgcaacgcaacaaacttgaagaaaaaaaaacccgaaatctccgttccctcatagccccgtagccgactcgacacctgtcacgaatcgatcgccgtcgactttacaacccaatcaccccgatatccctccagttcgccaatctngggggcctcgaaancaacccttcgggggaacatcggaagctgttggcccgcatggcccaccaatttgcagacccttcgaggaatacaactttgattctttgccgcccaacttctcattgttgcaaaatntggccgcaggcgcctttgctggtntagcaaaacacactgccatgtttcccatcgatgcgatcaagacnagaatgcagattctgaaccccagcaccacacccgcctactcgggagtcattcgcaacactgttcaaatcgcccanaccganggtttcttcagcttatggcgcggaatgtctantgtcatcgttggcgcaggaactgcacatgccgtttactttgcgacttacgaagcagttaagcatgccatgggtggtaaccaaactggtgttcaccancctctcgctgctgct

SEQ ID NO: 1027 - DNA, 612 bp, Fusarium venenatum
  misc_feature (1)...(612): n = A,T,C or G
atcctcaaaaatgtctgccctcttcactctccctatcgcgcagtgtggcgctcaccctggcggtaccctcacttgtactgagccctcaccaagagtctacctgctcaccctcgtatcgccccccgacaaccgtctcacaacgcctgtcctcaatgcctttctcaacgcgctagacataatcgagtttggataccctcacggtgttgtggcaacaacatcaggaattcaaaagttctacagcaatgggcttgatcttgaacatgctgttgctactgaaggtttctggcatttgctgtataatgtttggaaccgcttcttgacataccccatgcctacagtggctcttatgaacggtcacgcctttgcaggtggtctcatgctcgccacatctcaagactaccgtttggctccctctccacgcggcttcctttgtctcaacgaacttgtcttcggtgctcctctcaagcccgccatgtcagctctgttccgcgtcaagtactcccacgcaacgtatcgcagccttgttcttgaagccaaacgcttctcaggcgaagatgctgtggcaagccggtattgccgacaatattgcgccccaaggtgtggaagaccttn

SEQ ID NO: 1028 - DNA, 597 bp, Fusarium venenatum
  misc_feature (1)...(597): n = A,T,C or G
ganttttttttttttttttttttngatcatatcaaatgtatnggggaatatacaaaaagatacccaaactccggtatatgcttttccttctcttaacgggtttaanggaactgnccctcggtattaccctcgcccatactcttgctgntcgaacttccactctggatagcacccaggatgccatcaatataactngcgccgctccacttntgangcgtnaaaacatcacacttnaagtccttctcgcgacgctgaacaatatnaacatacgccttnataccgtnctttttgaactccgcnacaggcaattgtgatggttgcgttggagtgcaaacccnctacnaaatgagctgcacacnaaacccttttttgcaatggccaaangaatgacttgnggggttcatcccggaaaccgggggccntccanttgaatgnggggagaggtgtcccnaaaccttggcgggaaaacctgnggacggggcggcctaanttggatcttctggaaatnggggcccctgttcaccaaaggaatcccctttggaccnatgcaaaaccccttggtacccntttnttccggccggannggaaaaccttcng

SEQ ID NO: 1029 - DNA, 502 bp, Fusarium venenatum
  misc_feature (1)...(502): n = A,T,C or G
nagaagggttttggagcgctcatgtcttcttcggctgaggatatngctgagcagatgcccaagctggctgagcaagcagagaaggagggtgctgatttcgctggtggnggngttgctgctacttntggcgagaagctcgctgagctcgtcaagcgaacatatggcgagtttggtgacgatattggntgctttgtgctcttcttcctnaactttgtaacacttgacccggcgaggncttgttcctggcgccgacgacatcacgcctacattttcggngacatcatggagtggcatggntgcatcngacaatggtgtcccgcccgnttnacacccaaagtcaangacgngtctactcttgnngacatgctaacctacaactttgntccatcgagggacaaaaaganganacccaaagaattacccttacgcaanaattaaccggacaaagntacaattccggttaaaaagttgtttanacnacccccgaccgaggaattaacgt

SEQ ID NO: 1030 - DNA, 705 bp, Fusarium venenatum
  misc_feature (1)...(705): n = A,T,C or G
ggtatctttccactcaactatgtcgagaagcttaccgatcctactgcggatgagctgcagcgcgaggctcagatggaggccgaggtgtttgctgagatcaagaacgttgagaaacttctcacattgctcagcacctccaacactgcgcccagagaagaggataatgaggagatttccaagctgtatcaccagacacttgctattcgaccaaaactcatcaagttgatcgaaaagtattctcagaagaaagacgacttcacacaattgaatgaaaagttcatcaaagctcgacgagactacgaagctttgttggagtcttccatggcccatcctcctcagcacaactaccaacagtatgccatgcgcccagctcctggacaangttatcctcaggctggcggatatcctccccaaggagcaccgcctcaggatccatcacggtactacacacctggccctggangagcagcctccataccaggcctcatcccctcccctaacttccagaaccaaccccaaggtcnaccagctcctttttacgtancaggactgaantgccgctggctccaacctatcccctagaaatgaatctccttccacggcnaacagccgccctatcaacacatcgacactggccgaactcaaccttacatcatctcagacacaccntntggtcaacnctatnggaggtgactgnaacncttt

SEQ ID NO: 1031 - DNA, 597 bp, Fusarium venenatum
  misc_feature (1)...(597): n = A,T,C or G
agtaatcatctccacggccgtcgtggccgtcctcacaggctacgctttcggtatctataccatccgtggctatctcatttcgccttccctagtcnaagagcgtcggcgcgccctgcacgatcctgtcgagagcgacgaaagcgatgttgacgaagacnatactgtgctcgaccatgcacccaactgggccaacggccccgacgccgatcgcaagcagggcttgaaggctgccgatgaggagaagaaggagcctgttgttaaggataacggcgaggagtgcaagcttgttcttgtcgtgcgaacagatctcggcatgacaaagggcaaaatcgctgctcaatgctcccatgctaccctcgcatgctacaagtctctcgtccgcgctcccgccaactctccccaagcccagatcctcaagcgatgggagcgtctcggccaggccaagatcgctgtgcaagtcaaganccaggacaaaatcctcgagctccgacgcaaggcacgatctctgggtctcactgctgaagtgatccaggacctggccgaacacagatcgaagcnggtagcatgacggtctgggcgttggactgctcccncacc

SEQ ID NO: 1032 - DNA, 589 bp, Fusarium venenatum
cgtcaagtcgacaaacctgtctctacaagatccacgagcaccaggattgggataccgactcttgcaactggaccagaacacgccgcaagccgaccttgaaaagaccaccgaggaagcttacacaatacgacgctatcttagtggcattcccgaaggacaagatgagatctcgaaagagcatgctcttccacaggaaacaaatatggatatcatgcacggtattgacttccacaagggttgttatgtcggccaggaactcacaattcgcacaagacaccgcggtgtagttcgcaagcgaattctgccatgtgtagtctacgagaaggaacatgcacccccaacaacactgcaataccacgccgacggcgcagcctcatctctcgaaagcgtgaccgcggacatgataccgcggggacacaagcattggacggttcgagaagcgaagacgcagcgctggcaagtggctcaagggcgtgggcaacattggacttgggttgtgtcgtctggagaacatgactgacgttacctgccgggcgatgcggcatcaggggcattcaaccccgaagacaattcctgctggaattggggg

SEQ ID NO: 1033 - DNA, 647 bp, Fusarium venenatum
  misc_feature (1)...(647): n = A,T,C or G
gtcgcatttaaaacctcggttgcttctccccaggttttcttaaccttttcattatcgtatactcttaatttgattttacacattaatctcaactcgtatcagcagccatgcctctcaagaacgacaagttccccgcctcggccgccttcgacgccattcaagaggctatcaacgccagcgatgccgatcgcaaggacgccatcaagcagggtaacggtgtctacgcctttaccctcaagaacgcgagcggcgacgaggccagctggcatattgacctcaaggagaccggaaaggttgcgactggcaccggcgaaaagcccgacgtcaccctcatcctctccgaagagaactttggcaagctcgtcgctggcaaggccaatgcccagcgtctctttatgggcggcaagctcaagatcaagggcaacgtcatgaaggcgaccaagcttgaccctgtgctgaagaaggcccagaccaaggccaagctgtagttgaagcgtgtttttatatagcattgtgcattattttgntgtttctttctgtacgatatccacttgctggttgtcaatcactccatgcttcctggatgcgaatacatataggagtatacgcgtcaatatcaattttgatacctttttaaaaaaaaaaaa

SEQ ID NO: 1034 - DNA, 513 bp, Fusarium venenatum
  misc_feature (1)...(513): n = A,T,C or G
ccgaacgaataacacaacgctacagaacgcaaagatgttggacattgaggatttcattgaggagcgcggcgggaaaccccgagaagattcgggatagtcagcgtcgccgacatgctcctgtagagctcgttgacgaagttattgccctttggcaagatgcgcgaaagaccagtacggcgtcactcagatcggtacacaaataaatggagtccaaaaggagattggactcnagaagaaggctaaggaggatgcgaccgacctgctccagcagaaggaggaattgacagagaagaaaaaagtccaggaaganctcgctgcggccaagaagctgagctcaaggtcnaggccaagctcgtcngaaactacgtccacgactccgtnccgtcagcgagaacgaagacacnaccccntcgagagaacctgggcgccgagactttgacaagaacaagcaagccgctctctcccaccacaatnnctcctgcgacttggaagatacaacccgtccgaagtgtc

SEQ ID NO: 1035 - DNA, 579 bp, Fusarium venenatum
  misc_feature (1)...(579): n = A,T,C or G
ctctattctctttctttcttctcccctgcgatctaganggcgacggtttcaataaagaaaaagaaaggaaaangacaactccacagtattagaaaatggaacgctctgaattgggaattctcccaagcaaaacccctggcgcttccngaacagcaaaaggaacctttcctctgggaacagttgggaaggaaatcgcacanggtcttgaattggccaacctttttgacattgtcaaggtccgactccaaacatcaaaccaatactcctccgctatcaatgctgccacaaccatctacaanaacaaaggcgctctagccttctacaagggaacactcacgcctctcatcngtatcggcgcttgcgtttccgtccattcggtgccttcaacgctgcgaancgctggttccaggaacgcaacaatggggctgaactttcttatcccaatacggtgccgcaggtgccttcnctggtatctccaactcattctctctggacccatcaacacatcgtatccgtctcanantcaactcacgggccggtccttgttcnacggactggcgantgctccccaacttgacc

SEQ ID NO: 1036 - DNA, 991 bp, Fusarium venenatum
  misc_feature (1)...(991): n = A,T,C or G
ctcgtctttcttatcaatacctgnaaaagcccggtctacaatcttgactttgttctctctacccatttaatatcctgcttgtcctttanaacatcaacaaaaattctctattaatagtatcggcgcgttcaattaacgcggcgaagagtacacaatgaccgttattgaaggaaacgttaggccaacgctgctgcgaccgccagagcatgacgaagataagtctttgattganaacgtcttggacgttaccgagctcaaggttctaggaacagatatcttcacaaacacacatcctcaatggcgtccccctggagcccgtggtatttatggcggcgccgtcatcgcccaatgccttgccgctgcgcaaaagacagttccagagacattcttggngcactccctccactgttattttctccttgntggctcgtccgagaccccaatcctctaccacgttgagcgggtacgcgatggccgctcatatgcgacacgcacggtccaggcacgacagaagggcgcatgcatctttaccaccactatcagctttgttgcgccaggttagtccagacaagaancagcgggaggtgaagccatgcggcgacccttccaganaacgtaactgcncccgcggatgattggggacggcgagccagagtgggcaagggaccggaccctttcagagtcacagaattgaagtgctgggttccaatgaccctgaanttaagccacagggaccgcaagaacagacagtgggtgcgatcgcgacaaaagatctcnnctgcaggcgggcaccaagcacatctaaatgctttagcctacatgtcggatanctactttatcggcaccgtctcccgcctccatggcctatggcgcttcccattctcccctgaagaagtccctccctngatganaaaaccccggaaaangtccagganatttcnaatttnaaagcatgggttcccnccttgaagactggaanaaaaaaaatcnc

SEQ ID NO: 1037 - DNA, 581 bp, Fusarium venenatum
  misc_feature (1)...(581): n = A,T,C or G
ctcacttaacccaccgaacccccggctccgatccacggcttccagctccggaccctctcccgatcagcgccttgactttttccgggtgttctgataaagcagtccaacaattcaaagatcatggcaacgcaactcattgctctgccggccgtaaaacgtctcagtcctacttgcatacgcatactgggcggcaatccaggaaaattcactcttcaaggtacaaacacttaccttcttggcacaggccgaagtcgactcctcattgacacgggtgaggggcgcaaggcttggatcacttcggttcgcgagatactgcagcaggaaaatgcaaccatcgccactgccttaatcacgcattggcatcatgaccataccggcggtattaaagaactcctgagtacctctcctcaggcgagaatctacaagcacactcccgacgacggacagctcgacataaagcacggtcagcgctttgaaatcgaaggcgcgaacttgacagctgtntatacgccagganacaccagcgatcatgtcgtgttcgtgtttaangaagaaaanacaatgtttactgctgacaatgt

SEQ ID NO: 1038 - DNA, 564 bp, Fusarium venenatum
  misc_feature (1)...(564): n = A,T,C or G
atcccatcatcttcaccttctgaatcgaaacagatcaacctcctgtttctctacctttttttatctcccaagtacaatcactcaaccaagtcatcatgttcaactgggctaagcaacaactggccaatgtcgccggcactcaggagcccatttacggtccctctgccatcaagtctgttgccatcgaggccgaaaagactccctacaccgagctcactcgagatggcttgaagtggaaggccatggactcnacctctgttgagacagagagtttctacatctgtgccgacaacggttacattgctcttgcccaggtcatctatagcaacgttgccggcattcgaacaacctgccagttcaacgcaaaggtctttgacaaggacccttcaaagccccacctttgggcctcaacacctntcaacaaccaagactttaacgaggacaagacgagtttctaccccgacgactgcccgtcgagctatccgaggatggccttactacactatcaagagcatgaacagccaggaagccatcgtnacctgaanacacccgctctacccctgg

SEQ ID NO: 1039 - DNA, 524 bp, Fusarium venenatum
  misc_feature (1)...(524): n = A,T,C or G
ttagatntataactnccaagaagtataaaaagaatgttacgcataaacgaaacatcgacttgactatcgtgatggggtagatcgagtcaatcaacctccaccactcaaacaatttgttgttgaaagatcttgcggtccataacagagaaccatacctattctntttaactaaacatccatgccatcgcggatgcgcaaaaagttggcatatcgctccaaagtccagcgacgggacgccttaccccagaccgccatgggaagagaagtnatgatgataacaaagctcanaacaccaagttcaatgaagcagttctgcagacctgttcaatccaataactacacacaaatgtgaagatggtagccatgctgttttgatacagcnccctaccatccctaangaccatgtccgggtaactgtcaccgaggtntgtgatgctaaaatcaccagcgcanccgtcccaaagccgatgaaccaanaccacgtccggatggccanccaatctgactgaccatgccaatacccn

SEQ ID NO: 1040 - DNA, 567 bp, Fusarium venenatum
  misc_feature (1)...(567): n = A,T,C or G
acacattcaatcttgtactcgactctttcgtatcgggtccnactgccagcaacagctttgctttgattcgattgtgctccgcttgccccactcataaatatttgatctgtgcagcaaaccaaacttgacctcccccgccatcaatcaatcagtccatcaccagaatcctcccctccaaacaacataacaaaccttacagctagcaaacatggcgggataagaccaagaccctcacacgacacctgtcggcccttcttaccgtactcaacaacagaagcccagtgctaccgtctctgtcgatgtcaacctagacaatgtccatgttctgccccagacccctcagctcattgccctactgtcgatgatccgtngcaaagagacggagcgagcagactttatcttctactccaaccgaattattcgtctgcttgtcgangaaggtcttaaccatctgccccgtcattgagcatactgtcactacgcctattggtcgtacctacaatggtctcatgttccagggcaagattgcggtgtgtctatcatganaactggtgaagctatggacan

SEQ ID NO: 1041 - DNA, 493 bp, Fusarium venenatum
  misc_feature (1)...(493): n = A,T,C or G
cagactatcaacaatgtctgatcgtactgttcttgttacaggtgccactggactcttgggtcgagaggtatctgcggcttttggtatcaaaaattgngaggtcaaaggaacaggcttttnccgtgcagatggaatcagcactctcaaagtcgacttgggcaatgagaatgaagtagcnaattttctagatgataccaagcccaatgtnatantccactgcgctgcgcagngattcccagacaaggtcgacaaagaccccngagggagccagancactcaatgtccctgctagcaaggcacttgccaaactggccgntgaaagaagattttntggcatttacattttactgactatgtgttccctggcgtacncggagatgctccataccnanctgaccttaacccgnacttaccaaccttantggcagactaacttgatgnggacntgctgttttagaaccttttaaggancttgtaaggaagcttgggtgtg

SEQ ID NO: 1042 - DNA, 959 bp, Fusarium venenatum
  misc_feature (1)...(959): n = A,T,C or G
gcctaaactaagatacaacccacttctcactctctcctactcttgagcgcccatttccaaacgactttgtcctttcgcatcgtgagactgtttattccttttcccatccacactctaccttcgtccgaccacccctcatcctaaacatcccgtctcctgacgtagaccgcaatcatgtctcaatccggagccaccgtttctcaggaatgcattactgctttcaacgacttgaagcttaacaagaagtacaagttcatcgtctacaagctctctgacgactacaaggagattgttgtcgagaaggcctccgagagccgcgactgggaggacttccgtgagacgctcgtcaacgctaccgccaagagccgaactggtgccgttggcaagggtccccgttacgccgtttacgacttcgagtacaacctggcctctggcgatggtatccgaaacaagatcaccttcattgcctggtcccctgatgatgctggcatccagcccaagatgatctacgcttcctccaaggaggcccttaagcgatcgctcaccggcattgccaccgagttgcaggccaatgacactgatgacatcgaatacgacttcatcctcaagaccgtcagcaagggtttgttgcttaagcgcgttgtcacgaaaccgccaatcgccgcccgcgcttccttatagaaaccgggtggtgatgggatttgacatacctaggcgtttcaagagttgagacgccaaaataagcaagcaatttaatgagttggaatgtttagtgagtggatggaaacgggcgcgaggataccatgggtttttcgtttcttttggggacgtaaacnacnaatttgcttcaggaagcgaaacgtaaattcgcataattgccagccctggccatgtttcgtncgtaccccgggaaaataaaacgcatgctggtatatggcaatcattggcattttattatc

SEQ ID NO: 1043 - DNA, 487 bp, Fusarium venenatum
  misc_feature (1)...(487): n = A,T,C or G
cgacgatcccttctacgaaataccgaaaatgtcatcatccaattatgtcacaacgggccaggcgcnaaacctacgcgcatgcatgatctgctcgatcgtcatgacctcccagcgcttncaaaacgaaggttgccccaactgcgaggagttcctacacctccagcattccccggaccanatcgagagctgtacatcccaagtttttgngggtgttatcactgctcgcaaacccgaccaagtngtggatcgcaaagtccagcgcctcnatagctacgtgcctggcatgtatgccatcaaagtctcaggacaactacctgatgatgttcgatcgacgttggaggacgaatataaggatacantncattccacgtgcggcacagaggcgganaacgatncttaaaatacntacttttgccgtgcccacaatnaatttcnctntttttggaaaaccgntgtggggggantaaattgntgtgtttttggaaaa

SEQ ID NO: 1044 - DNA, 544 bp, Fusarium venenatum
  misc_feature (1)...(544): n = A,T,C or G
ctggaaatgacaganccaatctcaatcagccgtcagtgggaagaccaattacattatgacattgtcatctcgggcaagagtttccccattggtagcaagattcccatcgccttnaagcttacaccactggccaaggttcaggtgcacaagctcaaggtttatgtaacagaatccatcgagtactggacaaacgataagcgtgtgacccgcaaggatccgggccgcaaaatcttgctgctnnaaaagtctgntggcaagccccttgattcttcctactctttatccgatatccgaacactccgcggnggagagctcgaccctgaacagcgacaacaggcccgtgaggcagntgccagaanacggacacaggaagctgcagacgacaaactaccgttgagccactgccnaaccatctgcaacctttttggtgacctggacttggggcttganaccatntggggctcaacggaaattgaagccaatgtgcanatcccgacctgcgagatgatggccaanaacaangagctgcgactcaccccgactg

SEQ ID NO: 1045 - DNA, 585 bp, Fusarium venenatum
  misc_feature (1)...(585): n = A,T,C or G
gtagtgcaatatggaggcgttgacgccggcaccagcaatgattggatatgcctgagtgtgagcaccaatgttatgccagtgacattactcgcactcttcctgttaacggctttttctcaaagcaagcttctgcaatttactctattgtgcaacgcatgcaggaagaatgcataacacgtgtccggcccggcactgtttactatgagctccagcttcacgctagcgacgtggctcttcaangcttgcgcaagctgggtctcttgaaaagtagctttgacgaaatccaaaaagcgggtactgttgcagctttctttccccacggcctgggccaccatcttggtcttgaagttcacgatatcactggtgatgagcgcctcctcatgcgagacaactttcacgttgaaggtggaaaacgtgagatggtgactgccgcccccctggtagctatgcaccgcatggcttcaacaccaggccctaccaggcccagacagaccttcagcctaacatgatagttacaatcganccaggaatctacttctgccgtcctttcattgaagggtacttcctgaacaactcgacacatgc

SEQ ID NO: 1046 - DNA, 588 bp, Fusarium venenatum
  misc_feature (1)...(588): n = A,T,C or G
attaactgttgcaaggggcgctggatatttccagcgtttgtgggactgctttgctgtgccacgaattagacgcgccaactatggtgcttcgactgtcatgattgcgcagcagatgtgcggtatcaatattatttccttctacagttctaccattttcgtcaatgctggctacaccgaagtccaagccctgtatgcttcactaggatacggtgctattcaagtcattgcaacaatcccgacgttgtttctcatcgacaccaagggacgcagaacgctatgtctcatcaccttcccgttcatgtgtgtcttcttgctcgctgctggtctgtctctcctcaatcatagtggcagccgaagtgcgcagattggacccgttgttctgttcgtctacctcttcacaatcgcctactccctgggtgaaagtcctgtcgcctttcaatactctgccgaagtattccctactatccagcgtgagcagggtatggcctgggctgtctgcatcaacaacacctttgctggtattctcggtctcaccttccctcgaatgantgctgccatgacaccactggaaccttcggcttctacgca

SEQ ID NO: 1047 - DNA, 588 bp, Fusarium venenatum
  misc_feature (1)...(588): n = A,T,C or G
gtggtagtgttaataccacatgcttctttcaaggctctcaagagtacttcatcttcgactactctggaaatgaaaaactgagagcaatatggagaaaacttctattcagattacaggcaattgtctttgtcatcgatagcacagatagagcgaacatggaggagactagggaggcgttgtggcaagtactacgagaggaaatgcttgatcctcagcctgttctaattcttgcaaataagcaagacaatcctaaagctatgagtgtgcttgaactcattgagtgcctccgaaataanaaagatcttgagaaaactagaaaatgccgcattatcgccacgatttccattaccggtgaaagtttagtccaaagacntgagtttgatgccaacaattgtgcgtttcnaatccctcccnctgagaaaaatgacntngaagaaaattccntccacattcccttatttctcccttgcaattctcattgtttccgggaaaaggaaaaaccaaccttanaaacaaatngtggttccgttttatactgccccaatttaacttttacnccgttttttcnttccccganttttaaaggcn

SEQ ID NO: 1048 - DNA, 487 bp, Fusarium venenatum
  misc_feature (1)...(487): n = A,T,C or G
cggccgcagggaattttttttttttttttttttttttttaaaaaaaaatagtagttttgtatatgcttcgtcaaatagtacaaattctgtacatgatactagaatacacacgccagctgcgtccaataggccaccaagccggccaatacaagttccccaaatgccatttctctatttgatcttcttttgcttcagcttgatcgtttggtcgttgatgaacacgccctttcccttgtaaggctccggaggacgccacatgcgaactcgcccagcgaaggacatgataacctcacggtcaactncctnaatcaggatacgtgtaggcgcaggagtcgtaacggtgacaccgcgggggataccctnctngacgggatgcgtgaaacccagcttgaggcacaggaaacgctggccaggaaattctntttnagccttcccgagggtgccttntacatggttggngacttcgccttcgcaaggccaagggtga

SEQ ID NO: 1049 - DNA, 503 bp, Fusarium venenatum
  misc_feature (1)...(503): n = A,T,C or G
ccggcttagatctgtctcgataacaagcactaaggctcacttttggataactaagtccaagtaccctgacgacattcatacttcagccaacaaagatctcacaattcatcatgtcaaagcttttcatcggtggcctagcatggcacacagaggagaccactcttcgccagaagtttgaggagtttggtcctgtcgaagaagctgtggtggtcaaggaccgtgatactggtcgcagccgcggcttcggatttgtgcgatacacccaggagggcgacgctcagaacgccatcgcagccatgaacaatgtcgagtttgacgggcgaactatccgagttgacaaggcatccgacaacggccctcgaggtggtttcggtagaggaggaggtggtggcggcggctatggacgaaactttggtggccaatgccatacggaatggccctcctggacctgctaccaaatgcctgnccctaacatgtacgcgcccatgccttatggtcgcgga

SEQ ID NO: 1050 - DNA, 566 bp, Fusarium venenatum
  misc_feature (1)...(566): n = A,T,C or G
cgacgacacttcaacccccggacgtcaattgcttctcctcgattcaaaatgaagtactcgctcgcccccttnatcctccgccggccgtggctcgcccgntttttcaagcccgccgctacctggtacgtnaacactgccgggtaccgccagatgggcctcaaatacgacgatctcctcgaggaggagaacgagactgcccaggctgccctcaagcgtttttctaaccgngagtnctacgagcgcatntaccgtatccgacgtgctgnccagtgcagttaccaacacaagctccttcccaanggccagnggactacctncgcnttgganaagccctacntttnagncttttatngaaaaggcccccccgagaaggcccaaaanaacaagctcaattcctttgttggcggccgaaacactaaaattttttggccctccggttgggaggacagtangaatgaaggtttggaaacnctcccnggtggnggtgaaagggaattcctcctctaaaaaaagggggtcncctcacggtaaanaattcccgntttttttgagacgttggcttgctc

SEQ ID NO: 1051 - DNA, 633 bp, Fusarium venenatum
  misc_feature (1)...(633): n = A,T,C or G
ccgggcgagaaaagccaactgtcaacgatccttgtgcctcgacatcgactcgactcgactagacattctccaggcgcatttcgccaaaacattgtctcaacttgaatagttgctttcagcgtattggaattctctatagatagttgacttcgtgcgcttcgtcgctgttgtgcgctctattagacatcatgattgaagacaagtatattggtctggctctcgccatgacatcggccctcgccatcggaacaagttttgttatcacaaaaaagggattgatccaagcagaagagcgacatggctttgaaggcgacgggtttgtgtatctcaagaatcccttgnggngggccggtatcgcaactcttgctctcgganaaatttgcaactttgccgcatacgctttccccctgctatccttggtactccccttggagctctcagtgngctcattggngccgtcttggctcttatttcctnaaaaaaaacttggtaccctgggcaaactgggcagtgctatttcctgattggcgccgntatnattgngctcccccccctccaaatgaagagattganaccgccaagaaaatttcatttggccattcanccaggttttcttctatcgctttcgccggn

SEQ ID NO: 1052 - DNA, 594 bp, Fusarium venenatum
  misc_feature (1)...(594): n = A,T,C or G
cttgtttagttcgagaaaaacaagatcaagatggcttccctcaggactcttaccatctctaaccgctctccgaagcaacccatcaagaaccttccagagtcgatcgaggtccaacccgacaccaccgtggaggacctcaagattttgatcgcaaaggagaccaagctnggtgaccacaaccgtattggtgtntatgatcccactaccaagaagaccctcaagaaccgcanggctcgcctcgtcgatgagcccgccgtagttgcagctggcgaggtcctcattaaggatatgggttaccaaattccttggagaaccgtcttcgtcgncaaatacctgggtcccctnattttccatgcccttttcgtcgcagcccgcccctttttgtaccgcaatggagacggcgacatgtcccaaactcaatggatcactttcgccatgatcatgctgcacttcgcaagcgcgagtacgaaactnttttttgtacacaagtttttccgcaacacaatgccctgggaaaaacatntttaanaacaagtttttttntactgggcccgtcttttggngctggctgngccttactcatttaacaacccc

SEQ ID NO: 1053 - DNA, 574 bp, Fusarium venenatum
  misc_feature (1)...(574): n = A,T,C or G
ctcgtttcgacaacccaccccataagaagatatactataaacaacacatagagccaagttaaagagccattgacgctctagtctttgtaaaatggcctctcaagaatctcaaatgccatttattcgcaacctcgcttcaagcgatcgcaaactccgaacagcttctctagagacccttacaacattcctcgcctcccgcccatccctttccgacctcgacgcccagaagctctggaaaggtctcttctacgccctctggatgaccgaccgtcccctcccccagcagcgtctcgcaaccgacctcgccaacctcctcttcactctgaagcccgtctgcgccatcccctggttacgcggattctggactgtcgtcgggaattcagtggaccgacatcgacgtcctccgccttgaaaagtttcttcttctcgtccgtcgcgttttcgcctcgcacgtgcgattcctgagggagcgcgactggaaggacggtgacgttgaaggcattgtngggagtctggccgaatttcctttcgataaggaaggcgattgcgaaagaacctgtgggcttanantgca

SEQ ID NO: 1054 - DNA, 579 bp, Fusarium venenatum
  misc_feature (1)...(579): n = A,T,C or G
ctgagctcgttactggatccaagacagcggaccccggcgtcaagaccgctatgctcaaggcgctatacgaggttatcagcaaagctggcgctaacatgggagaggcctctcgagcttctgtcttgtcacttatcgacatggatacagacgagagagatgagaccatgaccatcactaatgccaagctactgggcgcgctcatcaagaacgttcctgaagatgccgctctgggtttgttgaagaaccgcgtggccaccccacattttacccattcttctgttcttgctctgaactccgtcctggccgagtccccagatgttctgcttcaaagctccttagtcgacgacttgcccgacctcttgttccaaggtgtcactaacaagaacgtctttgtcgcggacaactgtattcctgctaccggaaagtatctgctctcggattctgcaaagaccttgagacaacaaagggatcntcnaggcctggcttctgttaccaacctggaatgcgaccgattccgtcacttgctcnatcctcgtcgtaccgtcagccgcaaagaatgnnatggtcggnccangttgc

SEQ ID NO: 1055 - DNA, 560 bp, Fusarium venenatum
  misc_feature (1)...(560): n = A,T,C or G
cacagaggcgactacagagactacagagactacacagactgcagaggccacagtgacagagacagaggcacccaaagagcccgtcacagagaccgcagagacggccgaacccgtcaaagagcccacagacaccgagtcaccccaaacttccggcgaaaaagtcgacgagtccatcgaagccgtcgaagaagcctctgaagacgaagcctccgacgacgaaggtggctggatcacaccctccaacctcaagaaacaccaagcagcatccgccggcgcagctctcccttcaactcctgtccaaaaaacctccaagccgccgttctcacctctgattncgccatgcaaaacgtcgctctacgaatgaacctcaacctcgtcgcacctccctcgcacgaatcacacatctcaagaactgggttctacgctgccacggntgcttccagatcnccaaagaaatggacaagcngttctgtcctacctgtggacaaccacactcatgcgcncaagttgctccnccgacgaacacggaaacttccagggtcatctccagaaaaaatttc

SEQ ID NO: 1056 - DNA, 291 bp, Fusarium venenatum
  misc_feature (1)...(291): n = A,T,C or G
actgtccatgccagcctaagcagagatcttcgattccatcacaagtgcactccttgtccattggtggtgcctgtcgagaactctttgacagcaacattgccagcggtgtcagagtncgtcaagaagcacaaagcattctccaganacgtggtttcaatcgattctttcctcnaccanattttggtgctgagttcattggccaaaccaaganaantcacagcgcgtggttgtgatggaaaaaatacatgcttctcntcnaaccccaagacgaatttcgaacggaccagcgcc

SEQ ID NO: 1057 - DNA, 814 bp, Fusarium venenatum
  misc_feature (1)...(814): n = A,T,C or G
atttgaacagttaatccatttcttagtccaggtcgttgcgtgaatcctttggttcaatctgctagatttccgcagttttcgaaagacactgtcacttgcatccaattctttactaaaccaactcatcatccactactacaactcgcttggttcagccaacttcttaccgctctctcgcctctcaccgtcatctcatatttttaccgttccctgcgaacatataaacccttgggtttccatcaattcttactactttttttttttttttttttaccacaaacaaccgacatcatgcctcctaagcgaatccgttgcaccgccgctacttgccgcgagcctgcccagcgcatcgtcggcgactgtaccttttgccaaggtcacttctgtggcaagcaccgtctactagaagaccacaagtgtactggtcttgaggattgtaaaaagcagtcctacgagcgtaacgctgtacaactcgagtcggagcgaacccaggttatccggggcgtgtaaaccgaccaaagagatcacacatactctcataacagatgtgtcacggactggagactggcgtcactcctcacgtacacgatgcgcgactntgacggccacgacgtaacgatgggattgggtttcgacacagtatttgcatgaaaaganatgcagggcgttattcgccattgtatatttctatttcaacagttgaggatgcgacggcgtactggatatgttttgagggggcataattccccattctagcggggtctgcattaaatcaattcatcacaaatcaattacttactattccaaaaaaaaa

SEQ ID NO: 1058 - DNA, 277 bp, Fusarium venenatum
cgcatggctcctaacgagattgagcgcaagattgacgccattactgagaaggacattatggacttcgccaaccgaaaactctgggatcgtgatattgctgtcagtgctgtgggaaccattgaggttctctttgactaccagagacttcgcaacaccatgaagcccaagttttaagttatagagggctagtggagttgtgaaaatcgaaaccagggtatagagtgtatgagataccgtttacaggcctagtgtccataagaattcctctggtcatact

SEQ ID NO: 1059 - DNA, 624 bp, Fusarium venenatum
  misc_feature (1)...(624): n = A,T,C or G
tcaaagtccattaacatttctcgtacacaaaatctttcacaatggtcgaccgtcctaacaagccttcggcacttgcctcaacccccgcagctcctccccaagctgttgccgacattacccacgacaactcccgtgtcaaggccgttcttccctcgggcgagagtgtcgaggtcctcctccatggtgccaccgtaatcagctggaaggacgcttcaggagccgagaagctctgggttagcgagactgctgctcttgatggcagtgcccccgttcgaggaggcattcctatcgtcttccctgtctttggtaccgccctgaccatgaacccgtagccaaactttcccaacacggatttgctcgcaactcacgaagggagttccttggcaagtccaccagcgagggctcaactctagcgtaagctcgactttgcctgtcctctgagagcattagcgacgacttcaaggggttntggcctacaagttggtcttattacagggtttttttgacagcagagttttggaccacaattgttgtaccaacaacgggacacccgtttgattcaaantttttttanacttcttnaaataangttttgcttccanagttatggtttgaggattnttn

SEQ ID NO: 1060 - DNA, 584 bp, Fusarium venenatum
  misc_feature (1)...(584): n = A,T,C or G
acggatagcaaatagctactgtgcctatttactccgctgagatggcacctgctcgaatccgaggtgcccttgttatgttctggcaactttgggttgttattggcatcttccttggattctgtgccaatgttattgtcaaagatatcggtgatattgcttggcgactggagcttggctcagccttcattcctgccttccttcttatgatcggcatttacttttgccccgagtcaccccgttggcttatgaagcatggccgaatttctgagggattcgtctccatgtccaagcttcgtgcccaccccatcatcggtgcccgcgattactactactcgtatgttatctatcacgaagaactccgcgagaacgcaggtgctggctactttcaacgtctctgggattgtttcgccgtccctangatccgaanaaccaactatggtgccagcactgtcatgttggcccagcaaatgtgcggtatcaatatcatctctttctacagttccncatctttcgagaagccgacttcaccacaaacaancttgtancctctctgggctatggactatcaggtctctcctatccac

SEQ ID NO: 1061 - DNA, 541 bp, Fusarium venenatum
  misc_feature (1)...(541): n = A,T,C or G
gtataanaacatctaagatgtctctccangaaaaagtctacgcgataaccggtggtgcaagtggtattggcttcgcaactgccaaagtccttgcacagngnggggcaatcgtgagcattgccgacgttgacatcgctgccatgtcaagcgctacggcatactttaaanaacaaggcgttgtcgcaatggtttctcgagtcgatgtctcccagaggtccgaagtanaaagctggctggatgacacagttgcaaaatatgggaaactcgatggcgcaccaacgtggctggtataattggcaagcatcatggtcttcgggctgtancacacctggaagatgaggagtggcacaagatcattgctgttaacttgacaggaacaatgtnctgcctaagaacgcancttaacagagtagtcgntgggggatctatcgtcaacgtggcatccattcatggtatcaagggattcgctaaacacggtgcttatgacnccagcaaacatggtntttttggctttgacaaangctgcnggaaaanaaaaccg

SEQ ID NO: 1062 - DNA, 438 bp, Fusarium venenatum
cagtggccgatcaggctgttcaggaaattgttgcgctttatgaacactctggaagtgtaaaggaacgggcaaaggtaacagcaacggcgcgtggcgaggctgctgagtgggtggccagtgttaaggtcgtggctacggatacgggtctacgcgtaacatcggggatcttcgagcttacagggtccaagtctacccaaagtaagattgggcttgaccgtttttggcgagacgtccgaactcattctctccatgaccccgttgcctacaaaaatagggaacttggtcgctatcaactccttggagaaattccggagcctacgtggtacacatgagagtaagttctttggtcccattgacaaccgagggttgtcgggaaaactccccagaacaatactatcgtttgtaattctctttcaattaaatatatatttaaacaca

SEQ ID NO: 1063 - DNA, 568 bp, Fusarium venenatum
  misc_feature (1)...(568): n = A,T,C or G
acaaggacaacgtcaagcagatgtggcccaaggctggcaacagccccatgtctggctgcgagtctttcccttgcgacaacgcctactggctccctgacgacgtccagaccaaggtcactgaggaggttgacctcatcaccaccctcggtgatggtgccagtccttacagtgcttaggtgcccctactgncattgcccaagcggccctttttcttcacttcttccctccccctttccaccttttcatgccgcggcgttgaacaccgcattgacgatgtcatgaacccctttctacactacacgagtttcgttttacataccctgaaagatacccctcgtgtgttgcaataccgaggcctttcgntatagacctttgggctggagcaagtggcgcttatgatgatggatacccatanagacaaggacaaacaggattgagttcatacttggaatttcaactatgaaagcgggcattttttcggcttntgcccatacggcttgangttttggataacaaaaggtgaggtggccttgtttaataccaatttacctnttggactaacatttaa

SEQ ID NO: 1064 - DNA, 437 bp, Fusarium venenatum
  misc_feature (1)...(437): n = A,T,C or G
cttgcaacaatggctggaaagtttgagcccaagaccgccgtcactctcgaccctccaaaggacgacatcatctccaaggaggagctcgccaaggccaacggcgctactgaagggggcaagtgctacgtggctatcaagggcaaggtttatgatgtgactggcaacaaggcttacctccctggagcttcctacaatgtctttgccggcaaggacgcctcaagagccctagccaagtcctcgacaaaacaggaagatgcgcttccagagtggcaagacttggatgataaggaaaaaagcgttcttaacgactggatcaccttcttctccaagaggtacaacatcgttggtgttgtggagggtgccacaaacacagagtgactagccgcgttgcctccaagtactcacgtcaagttatgaattcacccgttnnaaaaaaa

SEQ ID NO: 1065 - DNA, 548 bp, Fusarium venenatum
  misc_feature (1)...(548): n = A,T,C or G
cttctttcttcttacgttctaatctttacggccagacgacnattaccttgccatgcctctgttggcttcaacctcaatcgccgccgcggcgcatgcgttaccagtcacattagctctgtcgggtatctttggcagcatcagtttaacttcttggatatgccttctgctaccccaattgttcgccaactacaaggccaagagtgctgatggcctcagcatggccttcctcatcgtctggcttctgggcgacgtcacaaatctcatcggagccttgttcacccgcctagcccccaccgccgttgccctggcaggctacttttgtattgccgacattgtcctcatcggccaagctgtttactacaacgccatcaatgcccgccgaagcgagttcgccctgaggaacgagaccaattgaccttcggaaggaatcgcctctcatcaaccgatcgcgccgacgaaatctctcttttggcctcccggggtctcagtcgacgccatgcgacacataccgagtcctcaatgganccattgaagaanatcgtgaccgg

SEQ ID NO: 1066 - DNA, 356 bp, Fusarium venenatum
  misc_feature (1)...(356): n = A,T,C or G
naattttggacgatgacttttgaactctcgttcccgataactccaccttttcttcacctcctgccaaacgagccaagaccgccgccacaatggaagctccccctgccctccaaatcaagaagctctctgagaagggccgtcttcctactcgtggcagcgagttcgctgctggatacaatatctactctgcccacgacacaactatcccancccgtggaaaggctctggttgataccnatattaacatggctgggcccgctggaacttatggccgtatcgctccccgaaaaaggcctngcttccaagcactttattgacacangcgctggggtatngatgcccataccggggccagg

SEQ ID NO: 1067 - DNA, 584 bp, Fusarium venenatum
  misc_feature (1)...(584): n = A,T,C or G
ctggatgaccgactaccaacaactcagtcaagactcattcttaccactctttcgaacaagcaactcccaaactcgtcggattcgcccatctccgaatatctttccacaagcgatgatgaatttctttccttgcgactcgcggtgcccctatgcggtggcaaaggtggttttggatcacagctgagagccgcaggtggtcgcatgtcctcacgcaagaagaagagccaagaggatcatggatctagtcgaaatttggatgggcgacgcttgcgcacagtgaacgaagccaangctctggcagaatacttggctatcaagcctgaaatggagaagaaggagaaaganaaacgccgtgagcgttgggagcagatcgtccaagcctccgaacaaaangaggccgagatcaagtcnggtagtaaaaccggctggatggccantgggttgatgataaggaagaaantatgaaagganccaaagcantttggcggcatgaaggccgcactataaaanaactgctcggcctctatgctccatctaccaccnggcacaacatctnttctacannaaaagaacctctctgagaa

SEQ ID NO: 1068 - DNA, 536 bp, Fusarium venenatum
  misc_feature (1)...(536): n = A,T,C or G
gctgcggcgactgccagagcgcccgttgctttcttctacaatgttgccaacggctttcacaacgcaccatcaaacgtctttgatgttgatgttcgccgccgagacnaaataacagggctggggagcggcgtcaaaaccgcagggaaggaattctgttatgggatctgggatgcctttagtggcatagtcgtcaaaccatatgaagacacaaagaatatgggcgccaagggtcttggaanaagcctgttganaagcgccttggtataatangcaatttgggctctgcatgtttcgggctcccangatataccttgaaagggctaganaaagaattgatgaaacgttatatgacaagcctaaagcaganatattattaatccnacttccgccaggtntanaagaatggaagaaagctgccgaaantnaaaaggaagaaatatccggaagtggaaaatattaatattataataagtcttataagtntaatttanctagtgctttctatcttaaaaatttatataatttagattatagtn

SEQ ID NO: 1069 - DNA, 573 bp, Fusarium venenatum
  misc_feature (1)...(573): n = A,T,C or G
cgcattgatacaaactcaacgttgcccctcattgcagaacaaagaaaaatggcagctcccggcaagacttttattgtcgagcatctcgaccctgaactaggcccttggtcagagcttgagtatctcgccattgctcgtgagactcaggataccaacggctcttttatcctttccagtttgcctcctactttcaaggttccagcagacctcgccagcaaccctgccttcactgccgagcagcgtggcgttgaggagctttatgctgccaacaagtccaaggtttgcctgcttgatccatctgccgctaaggacctttctcctgaagatggtgacacctttgatgcctttttgtttggtggaatcctcggcgatgatcccccacgagaccgtacttcagagctccnaaagaagggctttgagggtcgcagactttggccccaagcaaatgacgacagatctgctgttcgagttaccccgtatcggtgttcaaagacaaaggtgcctgttgaccaggtcccttactggactttncccgagctcaaagttnaatggagcccganagcacccgagatg

SEQ ID NO: 1070 - DNA, 547 bp, Fusarium venenatum
  misc_feature (1)...(547): n = A,T,C or G
ctcttctctcttctacgacatgagaacaagaagactgctgtcaactacctgttcaaccttagctctgactttaccaagtccatcaaggccaaggaggagctcatcgtccagtgtggacctcgccgcatggtgatcaagcccctatactctcagcctggacagacaccaaacgatgtccacaagtactgccgattcatccaccctggacaatcagccattgcgactttcatgggtcctctaacatggggtgccgtgcctgtgctnttcttcaagcgaaccaccgccgaggatgtcnagaggaacgaggaggaagatggcctcacattggcatgtctctcatnggacaggaaccgncatccaccctcaacatcttgcgtcatcncaaagcgcatnattcttaccggcacccctacatntaacaagagaattgcnccntccgatacntgttttcacaaaaaaaactcgagtggttcaaggccttgcccctgggaccagcgagacncatnggttattaagagcctttggtccaatggttctnaaggttctt

SEQ ID NO: 1071 - DNA, 441 bp, Fusarium venenatum
  misc_feature (1)...(441): n = A,T,C or G
cggtgtcactcccaaggatcagcttcagcctctgattgatgatgctcttgatgagattgagttcattcgaggtcctgtcacttctaagtggggtaagaagcgtgctgagcttggccaccccaagcccttcaagctttcctacgtcgagattggaaacgaggactggcttgctggttacccaaccggctggaacagctacaaggagtaccgattccccatgttcctcgaggctatcaataaggctcaccccgacctgactgtgatctcctctggtgcctctatcgaccctgttggtaacaagaacgctgggtttgacatccncgnacccggaatcggtgactaccacccttaccgtgagcctgatgctctcgtngaggagtttgatctctttgacaccaccaagtccgncacattatcgtgaagttgnttttnttaccccac

SEQ ID NO: 1072 - DNA, 552 bp, Fusarium venenatum
  misc_feature (1)...(552): n = A,T,C or G
caagaaccacgacctggtccgtctccgccacgttggtactgacaagatcctgctctctcacgatgttgcctctccttactaccccaccaaccaggaattcacagctgtcacacccgaagaagctctcggcaagcgcgagaaggaaactctgtttgaggtcgctcgagcacggnaagaagaaccaaaacttcaagtcgggtggcngncactttaagcttatcacaaccaagcaaggncggtnttgnggactacaccaagcctttgcttgagtggggttacaagcagcaggagataacggtacaagcanatgngcccagttccacgggggggttcgttgnggnattggtttgtttctggcgataaccttntcgccaaagccgacccaaggnnaagttttttcctttttcaaaanggtnaggttaagggcttttttttaccaanaagaggttaacaggngccccctttgccagctttttaaangggcttttttgtccggggnnaagttttggantaaaaggaaaccnccaaaaattttttttggaaccntttggg

SEQ ID NO: 1073 - DNA, 578 bp, Fusarium venenatum
  misc_feature (1)...(578): n = A,T,C or G
gatcttgtcatcatcgccaacgacattttcgatttttccaaatattgcgcttttgaggccaataccttttctctcttggactctctatcaaacgatataacaatacttcataactattaacaatgggttggttttgggcagacnaagctcccgctgttgcggttcctgctggtcatccagcgactaccaacaaggctcctccacccggttgtcctatgcaccaaaagtcggccgacgctttgaatcctactgccaaacccaagcctgcccagatcccgtctacttcaagatgccctgtccctcacagtgcccgaaacgaagagcagcccaagtctctgatctcccanctcaaccctctcaactacatgttccccgatctctcccanaacctgcgcctaaccaagaattcgctttgccgactagccgaaatgaatcaaccattcccaagggctctggtgatngcaactgggaataccttcacctcaccaatgtcaatgccccctgcncaaggttacctgataccnatattatgccntccaaggcatggttcgggccaacttcctgaatgaaggccctgg

SEQ ID NO: 1074 - DNA, 603 bp, Fusarium venenatum
  misc_feature (1)...(603): n = A,T,C or G
aaaccattaatttagaccccatctcttctggatctttggtttccatcaacgtttactatctattccttcctttcttgtctccatttcgcgctctctaagaatcctgctgtgattctcttgtcaaatctccttcctcgggtttaattcttcaacaatgtcttctcctcgtccttcctcccccgtcaacggcggcgctgctgccagcggtgccaacatcggccgaccctcatctcctgctatccctggtggtccccgtactgccatccgacgacgcgctgccgccgaccagaaggagaagattgccaatgctcgaccaagcagcactcgcgccgctggcgccggtggttccagcagcaccatgctgcgactttacaccgatgagtcgcccggtcttaaggtcgaccccgtcgttgtccttgttctgtctcttgtctttatcttcagcgttgttgctcttcacattatcgccaagattacccgaaantctccagctaaanggctgcgaaaactcatcaaatttcacgacaaactcgaagaaaaagggagatgatgatatcttggggacctgctatttcttgttataaccatgaatgatgggtaggc

SEQ ID NO: 1075 - DNA, 570 bp, Fusarium venenatum
  misc_feature (1)...(570): n = A,T,C or G
gcgccgacttggtcgcctgcatgaggcctcagcctcctatcatcagtgctgtccgcccagacactttggccaaggcatactcggagaccaactacacattcctgttcgcccctgtgttccacaccggcatgcgctacgttgcacctatccgtaagcagctcccttggaggacagtcttcaacaacctgggccccttggccaaccctgtcgangacttctcgaagctcgtgtcattggtgtcggcagacganatctcggccctgcttttgctgaagcgctatgcatggccggtttcaagaaagctctcatcatttgtggtgaagaagatctcgacgaagtcagctgtgctggaaacacctgtgctggaangtcaatgagacaattctggaaactcgaggttgaacattcaccgtgcacccancacttggtctgacactcatcccctcaaccanctcctctggcaaggancttctgaaacgcanaaatctgtccngatcctccacaaccccgataatgatccatctcnatttgtcttctcacatgccgtctcctgtccatctgtttctcaag

SEQ ID NO: 1076 - DNA, 630 bp, Fusarium venenatum
  misc_feature (1)...(630): n = A,T,C or G
tcgaatcccggaacgatcaagccgctgtgcttagatctaaatgatctcgagagcgtcacgaacgctgccgaaacgtttgctcagcaggaaagtcaacttgatgtgctctggaacaatgcaggtactggaggtaccgcagtcgagattggggcgaaaacgaaacaaggtctcgagccaatggtgggcatgcattgcgtcgcagccttgctcttcactcaactgctcatccctcatttacgcgctgctgctgcgtcttcggtaagaaagtcgtctcgggtcgtttggacgtctggctttcttgcggaagcagtgacaccaacaaatggcatcgacttcgattttctcaaggaaggtagttctgaccgagtgcagaactacggtgtttcaaaaatggggaactggatgctgagtcgcgaaatgacaaaccgctatgctgaagatggtatcattagcatcactcagaatccaggaaatctcaanggcggggcatacgctggtacaccagctgttgccatgttcttgatgaaagctttcctccatgatccgaagtttggagcttacactgagctgtactctggnctatcaaccgatatcaccancgagaataatgggtgttacgtcattccttng

SEQ ID NO: 1077 - DNA, 573 bp, Fusarium venenatum
gctcagaacaatttctgcaagcattgttctgatcttgacacaagatcgtcgggctcgattcttcatgcgctgaatcgcctgcagcctctattcggctattgcttctctatcgtaccgtcgattaacagttcctgttcaagcttcgaatcgaaacgagttgtagcgagacgtggtcgggctatttgttcaaaatgacgtcatctgcttctacagctactcctctcagacctcaacacgactttgaacttcgtgttgaagaggtcaaggcccccaaaagtgatatcaatgcattgattctggactatctcaccatggagggatatccaaacgccgcagccaatttttccaaagaggccaatctgatccctcaccaggagactccctccatcattgccaggcaggaaatacaaaattgtatccatagcggcaacattcaaacagctattgaaacattaaatgatttcgatccagagattttagatgaagacaaggcactgcatttttctctgctacgacttcaacttgtcgaactcattcgtacctggtaacacacctgggaggcgatattaggcc

SEQ ID NO: 1078 - DNA, 823 bp, Fusarium venenatum
  misc_feature (1)...(823): n = A,T,C or G
agtgttcatgccgnggcgccaacgctgatcccagcgactggagtgacgaatacaaaaagttcctcaagatgtttgccgaggcgcagatgcacagtttcgagaagggctggggatggtggtactggacatggaagacggaggacaaccaccagtggagttacgaatctggtctcaagtctggtgttttgcctgagaagccttgggatcgngattttaactgcgataaagatgttcncgactttgaaaagatgggattgcccgagtatctctgaaaatacagaagggtttgtgctgcatatattataggttctgggtatgaaaggtttgtttnggcgtttngggtatgcatgggattggtatatagagcaagtatgtttgggccantatgtcnaggctttggagagacgacccggttgaatgtncttataatcaaangtncagtacattgctacatgttagatagatagttaataagaacananagaaatagttgcccaagaagaaggcggccaagaaggagggtgacgaagagtaaggtatacgacattaaaatatgtgttgaagaggtgcggaaagaccaaggatccgaggactggtgaaaccagaaacgcgagtcaaggagaatgcatatcggcagtttgggccaacgactttaccaccattggatgggccatatacatgaaggaaaatatcttcataggaaaactgttggaaggctgaaagggacgactggaatcgccaaacccgacatcggccgttttgatcaggtgatgtagagagaccagaaagatatatataaatctcacacagcctgatactgatc

SEQ ID NO: 1079 - DNA, 467 bp, Fusarium venenatum
  misc_feature (1)...(467): n = A,T,C or G
ngggcanttgttgatgacacatccaagttttcctccaaggacgccagtgctagccccaagacattgatgcgaaagtcaaacatgaatcttcgaacagtggctatccttcctgtcacggctggcgtacctgttgttgagtttggaaatcgtctcatgaacgcactcgctcaagttggcccagcaaatggtgccacttccctcaaccaggctgttattctcaaccatcttggcaagcatgccttcaacaagatgggaaagctcaggctctctcaatatcttgctgacttggaagaaaaataccgcctggtgtttatgttgcanatccaatgtcaactcccatggacgcaacttgtntcacgcaagcagatagcattctnttggnggcctcgcanaangatcccgcaatggngagtccagcgcttatgcttggatgaatctcggntaaaaggtctggttttgttctgcct

SEQ ID NO: 1080 - DNA, 496 bp, Fusarium venenatum
  misc_feature (1)...(496): n = A,T,C or G
caaaacacagccatctcaacaagcaaagccttgcttgtcccatacgaggctcaccatgtgcggcaataccacgcatggatgcaagatccagacatccaagatgctaccgcttccgaaccgatgactttggaggaggagtatganaaccagcagtcatggcgcacatnatccgacaagctcacgtttatcgttngcgggcccgtcacacaanacacatcactcgngaagtccancacagntgatgctgacgctctcatgcgtggagacatcaacttcttcctctacccgtttgaaagcgatgatgaggatgatctacagatactcaaggctgggtcactggcgaagtcncgtcatgatcgcttcaccctccatcgcgggcaaggttttggacaagcggagtgtgcccctttttgttttnttccaaaacatatcgatgggatccttgcaantatgaggcnaaagactcagggtttgtggnaaancaaagagggaaaaa

SEQ ID NO: 1081 - DNA, 649 bp, Fusarium venenatum
  misc_feature (1)...(649): n = A,T,C or G
cgcgagcattatcgtctggttctttccttcaaatcccaagttatgaagcactttcnacaagatccccggggctggctccgacaggaacggcgctacctccaagaggaccaagccgctcgcaatgctcatggtaaacgtttcccaaagatcatgcctgccaaaacctnaaagtcacctcgacaacgcggcgatcgggtccagaagccccaatccaccccgcggccgatccgtacccaccctcccgccggccccagccctggcgccggcatcgtgcgaccagctcgtcgtgttagtgccactcctgagccgtctcgtcgtgtcgttcctcccaaccgtgaggataaggactttgcctcgctgganaattactgcccgcctcttgattcattgccaaacaaacccaacagtctcanggtggagtggaagggtcagccactcgatctcagcaacgatccaaacaagatacaccttcatcccgatgaagtgtccctancaagcancctgcgcctggatgctgccacctacttgactagcaagagacgtntntttatgtcacgacgtgactgctaccgtcgnaagaaaaatttncgcaagacggatgcttaacagggttgcaaaattgacgngaacaaagccttaaaactggggg

SEQ ID NO: 1082 - DNA, 615 bp, Fusarium venenatum
  misc_feature (1)...(615): n = A,T,C or G
cagatccgtgataaggaagcgggtgctgttaagaggtttggcattgagaagttccccgctctcgttctgatccctggtgaaggcaaggaccctattgtctatgacggtgagatggccaagaagggcatggtcaagttcctcactcaagctggacagcctaaccctattcacgctactggcaacaccaagagcaccaagagcaccaaggccaaaaaggacgacaccaagagcgctaagaaggacaagtccactgaagcggccaaggaacctaccgccgaatcaaaggagcctactgccgagcctgtcccttccattgttcctatcgctactatcaagagcttagagaagctcaccgaggagtgcctcgccccgaagtctcacacctgtgtcctcctcttcactcctggcgaagctggcgagaaggctgttgagtcgctcttccacctnaacaccaagtacgttcacggaggccgnaacacttttcccttcatcggcatcccagcgacagcgacgccggtttcactnttcccaangctcttggactcaacgacaaggtcaacctggattgntatcaacanccgncgtaacttggtggggncagtacgaaaggggact

SEQ ID NO: 1083 - DNA, 580 bp, Fusarium venenatum
  misc_feature (1)...(580): n = A,T,C or G
ctcggcaatggtgctctcctgacacccgtccttcgctcccctcctacagcctacatctacaaccccaaggagcagaacaagaccatcgaaactgatgagctctttgctgctggccgacaactcaacctcgtcactgtcttccaggctcgcaactctgcgcgtgttactgtcattggcgccgctgagatgctccaggataaggcttttgacacaaaggttgctcgaaagggtggcaagcctcagttccctgctaaccgtgagtttgtcaccaacttgggtgcttggactttccaggagcttggtgttttgcgagtgaactcgattgagcaccgcctcgacggcagcaacgagaccaaccctgagatgtaccgcgttaagaacgatgtttcttacaacatctccatgtccgagtacgcctggaacaactggcaaccctatcacgcccccgaangcgacgttgtccagctggaattctccatgctgtctcccttctaccgcctctcattgaagcccattcacgtcaacgaacatganaacatctactctaccaacttcaccctgcctgatcagcacnggcatc

SEQ ID NO: 1084 - DNA, 623 bp, Fusarium venenatum
  misc_feature (1)...(623): n = A,T,C or G
ngattggtcatgttggtcttcgcatggaagaattcaaggttatctacactgccattcgcaaacaaaattggcatatccctatcgccatctttggtggccatgcgcatgttcgcgacactgtccagtatgactcaaatgctttggctatagccagtggtcgctatttcgagactatcgggtggatgtcaatcgatggtattcagaaagacattcanaaaagcagcgccaaagaagtcgaggcggctgcttctgctacctttactcgccggtacatcgacaacaacctctacggcctgcactatcacactggtctcaacgaaacgacattccccactgagcatggaaagagagtcagcaagatgatcactcgcgcccgcaaggccctccaacttgactacaagtttggctgtgctccgaanacgttgtggatgcatcgagccaagcacactgacgangacagtatttaccattggatctcgaatcacgtcttgcccgatgtcatcccccgaaaagaccgcaaagacaagtcgaggntggctntcttcaacactggnggnattccgatttgacatttttcaangggnggttttacaccaaaacagcacttatgctgggtgcccttt

SEQ ID NO: 1085 - DNA, 1005 bp, Fusarium venenatum
  misc_feature (1)...(1005): n = A,T,C or G
ctcttgcgagagcccaagaaatcgaggccagagtcaaggatgacaagggtgatgcggaggatgccagaagggcaaggtggttccaagaaattcgaaaagatgcctcacacaacacatggcaggatctccggattttcgacgtcgaagggcctttgcaccagagtctcgtcgacgtgctgagtgcttatgccatgtacaggagtgatattggttatgttcggggttgcaatacaattgctgccctgctgctcctcaacctacccgatgtcccgtccgcattcgtcgcactcgccaatgtgcttaaccgcccattacctctgtctttttatactggcgacccaggcgcacaagcttccgctttcaaccttgtcatgcagacgctgtctctcaagtcggcgcctctgcacgcgcaccttaccaaaaagatcccaactgccgaacttgagcaatccttgtcgggaatcctgacagccatattcacacagcatctggccattgacgaaacaacccggctatggggacgtgtacgtctttgaaggcgatgctctcttgattcgagctaccgtagcgcttctnctcagccgagagatgacgctactnggcgccaaaacggctgatagaagtcaagacaatccttaacgaaagaaatgccaaggtctctgccgccagagttgctggcgaagtgggtgccgaggacaaatttatgatgtcagtccgtgaggcaggaaaagcttagcgcgattagcaacgggctaccattttggaaaggctcttggtcttggggcttgcttggatctaaagccgtaaatatggtattagatggggaacatattggctccattttcatggcgtttattacacggacttcggatcttggataagatgcggagggaatgtttatgaagtatttggagaggntatagagccggtgtttttatcttcgtaattgcagttgaccataatttggacaacgagattttgaatcaatatattttgatgatcccc

SEQ ID NO: 1086 - DNA, 414 bp, Fusarium venenatum
  misc_feature (1)...(414): n = A,T,C or G
atttaaggttttttttttgagttcatttcatttaactctcagggagcccgacttttttattgaatctgtagccacctaagaaaatccatagccgcgttcccagacccgatgaacgcaaaatgcaattctgaaataagccggaacacgccaaagccaaccnttccagacgtgatacacctttgcaccttttatcggttgctcttggccacacgctccaactcatccttcttcttgatagcgtaagagttgctagaacccttagcagngttgataagctcctcacaaggnactcagcaatggacttgacattgcggaaagaggcctcgcgggnaccagtggtgaggagagagcccgttacntacgatgttagccgacagctgaaggccatngacgctttcgaggctgaagccggaa

SEQ ID NO: 1087 - DNA, 655 bp, Fusarium venenatum
  misc_feature (1)...(655): n = A,T,C or G
gcggaggatattcctgctcagccaaagcccaagaagagcaagaagagaaaggcgggtgcaccagatgacgaattactcgatactgagcttggtctcaacacgctcttcaccaagatggacaaccaactcttggctgatcatctggttcaaaagttgacccgtttcggaggcgatttgagtgctgtcgaaatttcagacatgactgtctcagccaacgccattcaggacacgaccacatggcaagaaccaagaaccttggacaaattccctaatttcctggagagcgtcacagagaaccctgaactcttgtacaagtcagccaagaagaagggttcgcctcatactctcattgttgcgggagcgggattgagagctgcggatatcgttagatccatgcgcaaattccagaacaaggacaacgcaatcgcgaaactgttcgccaagcacatgaaggttgaagagcaagttcaattcctcgaaaaagcacaagacangtattttgtgtcggccacctgcccgttaatggatcttatggataacggngcgctcttcctcgatnggctgaaacgcctggtccgtggacgctttccacattgancaaaaanaagcgtggcgttttgggcatgaagggcactnttgatgnccnttggctcgt

SEQ ID NO: 1088 - DNA, 814 bp, Fusarium venenatum
  misc_feature (1)...(814): n = A,T,C or G
cgtgcctcttgtgaccaaggcacctccagcacgcagaagcacacccaacgttcagcctatcacttctcctttccctggccagccaggcacaagtgctcccccaccccctagcggttctccttacgggcaacgaactggagcgactccgccccctcctcctcccaagggatccgcgccccctcgagttcaatctcccctggcagctcctccccagaacttccaggctcctccaccagctgccagtggccacaacccttacgcaccccctcctcccgctgctggcgcaatcccttcgccaatgccaaacgctctcccacggactgcgtcgccgtacaatgctcctcctgccacggcacctccctccaaccgatatgctcccactcctgcagcccagccacagcaacagtatagccaacccccaggatccatgccacctcctggagccgccagccgtcctcccccagctggttcgttcaagcgccccgcctcaagcagttcaactcccnggcaagtatgctagctcgccatacggtggctcctcctaaccagacatccgcaccaccaactggggccacctcctatgaatcggcctgggcctcctggaggacctgctggtactgnttctnccaggccaactcctctnctncccagtcctcagcgccttccaaggccaggcatnctgccggtgaccgatcacatatccccccaacgctcaacgcttggtagacatctgaacaagatatgcagcgngttgntttcaaagcttctgcgacatttgcgcctcaggttaaagatacacaagaagcgantttgg

SEQ ID NO: 1089 - DNA, 619 bp, Fusarium venenatum
  misc_feature (1)...(619): n = A,T,C or G
gctcaatccccacttnccattccagccgtaaaacccactggctctcagttacctgacctattccattccattctgattctgtgcgactgacctactcgagctttcatccacattgccccggcatttgtagttcttcactttttaacccaaccaagtcaaaccgaaaaattgccaccatgtcgtcggagaacaaggaagtcgattacactctggncaaccnagataccctnaccaagtacaagaccgncgctcagatctctganaaggtccttgntgaggtttccaagctcgtcgttcctgggctaagattgtcgatatctgccagcagggagacaagctcctcgaggaagagatctccaaggtctaccgaggaaagaagatcaataagggttttttccaccccaccaccgnctcccttcgttctacgtaccccctacacttccctcacttcgacgaggntgaggggcagcaccgaaatcaaaagatggggaggntatcaagatccagcttggtgcacaaatcgacgggttcgggttcattgttggggacaccgtcatcgttcccccgaagacaagggcggngagaagatactgggccgnactggcgatttggtccttgc

SEQ ID NO: 1090 - DNA, 638 bp, Fusarium venenatum
  misc_feature (1)...(638): n = A,T,C or G
cttaaacacaactcgcatcttattacgcaatactcgtttctgaatgacttgacattataatgagcgaaaacaacgctctcatagtaggcatctcaggatgttcttcaagcgggaaaaccactcttgcgagactactgngggacattttccccaacacttttatcctgcatgaagatgacttttatanacccgagaatgaattgcctacaaagaatggtcttttagactgggattgtgccgagtctctcgatatccctgccatggctgaatccctcgcttatatccgccaacacgctgcctttcctcctagtcttgattctaaggaggataanaactctgtgggaaagtgtcctgtcccagatgctataattgaagcccagcgcgccaaagtagacgctgntntaggaccanaccacccgctccgnaataaccttcgtntgtgtctcctggacggatttnttnttttttcaccctncatggccgntgnaaagcctaatttaaacatcaaactntttttgagaacgacgtntgcaaaagcccaaagcganaaaaaaggctagaaatggatatgtccctcttggaaggattttgggcnggatcctccgggntacgtggaanaaancggtttggncccattn

SEQ ID NO: 1091 - DNA, 600 bp, Fusarium venenatum
  misc_feature (1)...(600): n = A,T,C or G
gcgaactcaaccttcacttattagcctctcccaacatcactacgccagtcatgaaggttattctcgcaatcaacgccggctccagttcggncaanatatcggtatatactgcagataagaatgcagagcctcaccaaatcgccgaagcatcagttggcggtctaactgcaccgccagcaactcttgcgtattcccgtggcaatgaaaaagtgctcaaggcgaaggaggtttctgaaagcgtcaanacccagggtgacgcttttgacctcattctaaagaccttcatcgatgatagtgagttgaaagagatctcttcaaagggagacatcgccatcgctagtcatcgtatcgttcatggcggcgactacgaccgatctcaagtcatcactcaagatacttatcatcatcttgaanaactcagtgatttggcaccgctccacaatggcgttgccttgagtatcgncgatacttgcatcagcgctctgcccagcacggtcaacgtcgcctgcttcgactcacaattccaccaaactctacctccacatatttatacatatcctattgacccccaaattgcaaaagancaccgctgcgaaagtt

SEQ ID NO: 1092 - DNA, 585 bp, Fusarium venenatum
  misc_feature (1)...(585): n = A,T,C or G
gtggatatcgccaattaaatcacaatgagacggcagatcatcgcatcggcttctctcgcagcgctagtcagtggtgctgatgtcgacaactcgaagcttgacccgctacagttcaagaaagatggtacctttcagattgccatcttttctgacatgcatttcggacaatatgaatcttcgacaggccctgaacaggaccgcaattcaatcgaggtgctcaacaaagtgcttgactacgacacgccagatctggtagtcctcaatggcgatctcatcaacggtgactcaacatggaaacacaacagcacacactatatcgacatgattgttgagcctatgatcaaccgcagtctcacttgggcgtctacttatggtaaccatgaccataactacaacatcaatggtgatgatattcttgtacgcgagcaaatgtggccaggggcacgcactcagaaaatggtcaacgagacaaatcaggcaccaccaattattaccttccagtctatccctctgactgctccgatacatccgaatgtancctcagcttatactgtggttcttcgatagccgtggcggaaactatta

SEQ ID NO: 1093 - DNA, 586 bp, Fusarium venenatum
  misc_feature (1)...(586): n = A,T,C or G
cacgcgtgtcgacagcagccaagagatcaagaagctcgtccccaaattcacaggtcctctcacgggcttcaaaggctatcacaacaagcttgccggttatggccactctgctaatgctttgagagctgtttatgagcagtgtgttaagcttggtgtcaagttccatctgggcaagaatgacggtgaagttgactctttgttgtatgcgtcaagtcgcgagggtacaaagtgtatcggcgctcggactcgtggangaagcattcacactgctgatacgactatcgtcgctctgggtgctgatgctgccaacctccttcctcgagtcgggaagcaaatgacaggtcnggcctgggggtgtcgcacacatccaacttacagacgaagaagcagctcacctcaagggaatccccgtcacaaacgtgcgagatttggcatttttctttgagcctgatctggaagaccaagaaactcaagttctgccatatgggaagtgctttttacaaactactctttcaccaaaagatggctctcacttcccttccccnaaattgtctgattcncaattcatgcccctcgaanacaaaaa

SEQ ID NO: 1094 - DNA, 618 bp, Fusarium venenatum
  misc_feature (1)...(618): n = A,T,C or G
atccgatactttctcgaaatggtagatcagaaacaccgctatggaagcaatctatgcagatatcatgaagtctggaagcaaacagataccaacgagaattacttttactggctcgactacggcgaaggtcgcaatattgagattgacggctgtccgagagacagactcgaaagagagcaagttcgatatctttctcgtgaggagcgccaatactacttagtcgaagtcgacaatgaaggaagactatgctgggcaaagaacggccagcgcattgatactacagagcagttcaaggatagtatgcaaggcgtggtacctttggatgatcccacaccagccttcaatgctgctgctcggtcaacagattcgaattcccacgattatgctagtagctcaagttcggaatcttcactcgagtctgaacgagaagcagaccgggcggctaagtatgcaactcctggttacgacaacaagcagggtatgcacaaggtatcacagatttcagcatccacgatattcaacaaaatgatgcgcaagtccgttagaaaaaacacttggatattggcgccgatacaaactttcggatgnatggtgggtatcaaaggactcgggcgcatt

SEQ ID NO: 1095 - DNA, 566 bp, Fusarium venenatum
  misc_feature (1)...(566): n = A,T,C or G
tttttttttttgatcaatcaagctctgtttcatttcattgacccagtcgcaaagcccagcatacgcatcctatatacataacctcccctctacttttacaattgcctcattcgtcagctgctttgtttaggttcggtcaaagtaagtccactggccagggacaggcttctcatcgaggtcctcccagaccttggacttttccattgtctcaaccagcttgagctcgccctcggcaacctggataacctcctcgataagaccagctccgatcttctgctcgagctcatggacttggtcaagcggtcatctgaggctcatcctcccactcgaccttctcatggtcctcaagaagcttgcgctccgccaggtagctgatcatcgctcgtgccaagcaactgggagtcaaggcaccaaccccaangncaaaggtaccacccgaggtttaaaangaaatggatcngttttttgggctgctttacnggtatgcatcggaagggggattgcgttacttgcggtctggccataaatcatgcatgctagagaataaaaaacgcnccgtgaacgac

SEQ ID NO: 1096 - DNA, 1773 bp, Fusarium venenatum
  misc_feature (1)...(1773): n = A,T,C or G
ctttccgtccatctatctctctttttttttttgggtagacttttttccattatttcctcgtcactctcttttgcctcaacggcttttatatccaaacttaactcacactccttttttgaatagactttataacagtctaacgtggtgtgaccgtgctcaacgttgtaccgaataaaaagtatcaccacaaatcgatcgataatcaactcaatcagtcaacatgaaggtttcatccgctgccgttgctgctggtgccctcgccatgggcgttgaggccaagaactaccttggtttcaactctggtgctactctcgccaaccgagaggctaagttcaaggccgacttccaggccgagttcgagactgcccagaacctcaagacctcccccggtgacttcaacgccgtccgtctctacaccaacatccaggcctactccgaggatgaccctatcgaggctttcgaggctgccatcgacaccaagactcagatcctcctcggtgtctggacctctggtactgactctatcgacaaggagatcagcgccctcaagaaggctgtcgctaagtacggntctgacctgaccgacctcatcattggtgtttccgtcggtagcgaggatctttaccgtaactctgttaccggtgtcaagaacaagggtggtgtcggtgtccagcccgatgctctcgttgacttcatcgacgacttccgctctgcctttaagggtactcccatcgccaaggttcccctcggccacgtcgacacctgggatgtctggggtaacgccaccaacaagcccgtcctcgatgccattgacttcattggagtcgatgagtacccctactacgagaacgacaagggcaacagcatcgacaatgctgctaagctcttcaacaaggctttcgatgccaccgtcgccgcttctgccggtaagcccgtctgggtcaccgagaccggatggccctacaagggtcctgactgggatgaggctgttcctagcgtgaagaacgctcagaagtactggcaggacgttggctgcaagancctcttcaacaaggtccccaccttctggtacaacctccgtgactccaaccccgacaacaagatgaagttcgccattaccgagaacctctccaccacccccctcttcgacctctcttgcgacaagattgacgatgaggagacctccagctccgccgagtccaagaccaagacctccactggtgcttccaaggctaccggcgatgctcactctaccggtaccttcgtcactgctactgcttccgccaccggtaccggctctgacagcgaaggactccactgctaccggtactggctctcagtctaagcccacctctggctctggctccggttccagctctggtgacnatgactntgaatttggcttcttccgggtntggattttttggctntttccagttttggttcttccggttntggatctttttggctccggttccgccaccgagtntgggttcttntgggttctggatctggcaccgaggctggctccagctntnaaactgacgctgctgccgagacccccagcactgtcaacggtgctgctggtttgaccatctctgctgccgctattgccttctttgccatgcttgctctgtaaatgtcctaaatggatctgggttgaatgacgcccattagccgtgtnttttttacttatttctcgcacccgagatctgtttcttgtaatattttatggatagattacggatagacaaatgttggctattttttaca

SEQ ID NO: 1097 - DNA, 537 bp, Fusarium venenatum
  misc_feature (1)...(537): n = A,T,C or G
ctcgtccctttttctcttcacgccactcgtttcctgtcaggcttcattgtgaacttttcgtccatacgccagaactttttacacctaattccaggaaatatcaatctatactattccctgttgcatatctccatcgttcgccgagaaaaccatcaantttttttttcttaaacaaacaccatccacaaaatcaatcacaggatcctttccaattacaaactaggtcataatgcattccgttaaggttctttccgccattgcngcactcggtgtctctgcggtctccgccgctacctgcaccagcgacgtcaaggttaccgagcccaccccacaatcgactgcacagttgtcaagggaganatcatcatcgacatcatctctatctccagtacttctattgaatctatcgatggcaacttccagcttganaaactcgaagntctcagcaacctcgattctccaccctcnagaaccttacggctcagcttcatcaacttctcgtctcggaaaactgaattcgttacgaaggtttcctaa

SEQ ID NO: 1098 - DNA, 621 bp, Fusarium venenatum
  misc_feature (1)...(621): n = A,T,C or G
cgaaaaagggtggacgtgcttctcaaccaacgacgatgagtattggcctgtgcatcgaatcatcaacaaagacgtcgtttggtgaattgcactgcactgcgcaaacagcaccagctttggcttcgatttccttccctttctccatcagccttccctctnggatcctttnctttctcccaaaagtctagtccccgtacaaaacgaaggcctgcgtaccttactacttacttacttgaacttgntnggcttancaacctttcgtcgctgtcataatattcgctgcgcctcagctcttcgacttcgtgcagccctcgatcctcaaaccttgacaatttcgngcccatagtcacgaccacaacccccatcttatcgcagccaggatcttcacaggaagaaatcatggcgctgtgtcaaaacagattgcaagaggaaaggaagcagtggcgacaaaaccatcctttnggtttntatgccangcctcacgcaccaaaaaangtnttctcnatgtcaaaaactgggaatgcggaatcctggaaaggacaaaaccaattggnctgggggcttttcaacngaccatgggtttttctgaagaatatcccacaaagnccnccaaatgcaaat

SEQ ID NO: 1099 - DNA, 551 bp, Fusarium venenatum
  misc_feature (1)...(551): n = A,T,C or G
acggaaatcagccatctacacaagcttcgtatcgtccatcgtgaatcttaanccgcaaaacttccttntcaccaanggcanggatggtaanccaaaatngntggtttctaatttnggactgtttaaaaaactgaagggnggacaatcatcctttggtgcaactacgggtcntgcancaggaacttctggttggcttgctccggaacttctgctcgatgacaacccacaanagggtgctatgatggaactaacaccnaagcggctccngatctgttttggcanacaacaatgccatgccccgacntgctacccgagccatcgacattttctcgcttggtctggttttcttctatgttttgaccaatggttccatccttttgactgcggggatcgctacatganaaaaatcacattcgaaanggccagtataattggatcttctccactctcttggtgatttttcccatgaagcctcggaactcatcgcatccatgcttgaaacngacctaaatgtcnccaacagctnaagaattcttggccccccttcttct

SEQ ID NO: 1100 - DNA, 656 bp, Fusarium venenatum
  misc_feature (1)...(656): n = A,T,C or G
tcgaaaataccccgcctcgaaaccgttagagcttcctcctttaacatggtcgccgaaaactacgatgccgtcctcaagggcaaatacccaggcaaagcccatgcgaagcgcgtcgtcgacctcattcgcaaagacgtccccgatgccaacggtattatttacctcgagagtcagttgactcgcatgatggaagatagcgacgagcccgaacccttccgtcaacgacgatacttttactacctcaccggctgtaacctccccgatagccactttatctacgacatccaatcctccaaatcgacccttttcattcctcccatcaaccctgacgacgttatctggtccggtctcccccttagcatcgacgaagccctctcgcagtacgatgtcgacgaggtcaagctgaccaccgaactcaacgctaccctcnccacctngggccgnaaacccaaaggccttcgcttttgctatcgcgaagcaagtctctgacatgtgtcctttatcgaggttgggcaacaagaacttggacgtcctcaagaacgccatcgaggngtcgcgcgtggcaaaggacgaatacganggcgctatgctgggnaanggccaactatatntttggnattgggacaaccgagctggctttggcnaaggnaaaaggt

SEQ ID NO: 1101 - DNA, 564 bp, Fusarium venenatum
  misc_feature (1)...(564): n = A,T,C or G
ctcgagaacgtaacagttcttggtgacgatgtcactgtcggagacgagatctacgtcaacggcggcagcgttcttcctcataagtctatcaaggctaacgtcgacattcccgccatcatcatgtaaggaacgtttctcttcacgattttacgttctactacaactctgttggaggacacaccagcacattttctatctacattataatctcacgcacgacatggatgaggaaaaaggaaatcgaacaaaattcaccactctcggaaggtatactggccaccttttttatactaaggcggcctggcgggaaagaaattaaagagcctgcccggctatctatcttaatacttttgtgcagttgtctcatgcccctattatgcgtgtttatcaggcgtcaaggtcgatatttacaggaggcaggtaggcgaataagccattgaaggacaagacaagaacatgcagttaagcaggcagggtttatggtagcgtctgaggaagccgtgtgcaatgaatgcttttgataccagttattgaattaaagaangtggtgcaataccatttgat

SEQ ID NO: 1102 - DNA, 638 bp, Fusarium venenatum
  misc_feature (1)...(638): n = A,T,C or G
gggggacagctaccgttgactacacatatacgactttgtttttatacaacgacaaaggtttctcctcttcgaaaataagccgaatcgtccaattgcgccaatttggtttgcgcaaaaacaatcgccatcatgaaattcctccttcccgttctatcgttcagcgctgctgtcaatgcgctgcacttcttcattgacggcacaactcccaagtgtttctacgaggagcttcccaaggatacgcttgttgtcggacactacactgccgaggagtgggacgaacgagtatcagcctgggtcaagcacgacggaatcagcatctacatcaacgtcgacgaaatcttcgacaatgaccaccgtgttgtctctcagcgcggtctatcctccggccgtttcaccttctccgctgccgatgctggcgaccacaagatctgcttcaacccatcatctaactccggccgtactcatggctctctgccaagaacccaatggcggatcaagctcanactcganctcgtgattggngagaccaaccagattgagancaacgacaagggcaagatcaggatantacttcccgtgttaangncctcaaacgcccgcctggctgatatccgaanaaaacaaggtttccaacgtga

SEQ ID NO: 1103 - DNA, 624 bp, Fusarium venenatum
  misc_feature (1)...(624): n = A,T,C or G
canacatnttatatgatcaggtcgaggagctgctgcgcaaggctgancancgcctgaaagatggctctgnttctgntatcacagcaaccaccacctatnctgctgtantcccagcctcatgctggcgacgctgtgacatatgtcacgcaanaaaagtcttccaacagctgcancaataaagatggtctgactgttcagancacctccccaaccgctatcgggactcaaagtcacggaaaagtctactgcaggctccgactggttcgatcttcccaagacgaacatgaccccctgaattcaagcgagagtggcaagtcctccgaatgcgaggcatcctggatcctaaacaccagtaagaaggcccttcgcgccgagcgctcctgaatacttccaagttggccaagaatcattcgggggacctaaccgagttctttagcgcaagggttgaccgcgcaaggagaggaagcaaaacatccttgacgaggtcactaggggtattgatactcacaagttcaccgacaagtacgctggcatccaaaagcaaaagtcaagcggaaagaaggcgttttacaagaacgtagtagcgacacgtcgcaagcgtaattaataataattttatgcctt

SEQ ID NO: 1104 - DNA, 527 bp, Fusarium venenatum
  misc_feature (1)...(527): n = A,T,C or G
aggccgaccgcctcaagaagcgagaagctcgcgaggccgccgaagccgaggacaaggcccanaanaagcagctggagaatgtcatggccaacattggtgaggatcaggctgaccatctggaccactttgacatgaacgagattgtccgagcanaaaaggctcaacgcaagaagggcaaggcaaanaagaaggctttggaaaagganacccgtggcggtcttcaggaagacttcaagatggataccggtgatgaccgtttcaaggctgtgtttgagagtcacgagtatgccattgatccttcgaatcccaagttcaaggctacaaagggcatgacgaanctgctcgaggagggcagaaagaagagaaganntgtggaagaggaagatgatgcncctaaagttaagaaggccaagaagggacgaaggtgagttgagttgatgtaatgtaaaatttttgttgaaaatcgtcttggagttaggtgattaaaagttggtntttgatancccatttatnaagcattagttccc

SEQ ID NO: 1105 - DNA, 511 bp, Fusarium venenatum
  misc_feature (1)...(511): n = A,T,C or G
gaccaagtgaaacaacaagaacgctgtgtnacacgaactcagttcgttggaaactttggcgaaccagtgaaacaccccgcatcgaacaacctatccagcagctcatgtttagaagcctcngtaccgaaactcgtctctgaataaaaacaatctgaaacgaactccattttctattccggatcttttcnggtaaganaacagccgtaaaacgcacgggtgtgtctgtcaaaaaagtccatcaattggttgatcacaccacaggccggtttccacagaaaccaaaatccatcccncccngaaacaancatggggtngtacaggtcaaagtctacnaacttggtggaaanaaactcngtatatcaaatataccccgcgtcttaccaagactccaccggttctggggttngtgatctcaaaggtatcatctctcgagttgactaccttaaagacttgggaattgatatcatatgggtttcacccntcttcaaaacccnccggtcnatntggggtt

SEQ ID NO: 1106 - DNA, 630 bp, Fusarium venenatum
  misc_feature (1)...(630): n = A,T,C or G
cactgaaccccgattaccctagagacacgcaaccaacacgacacttataacaacatttcccaacctaagcccgtnattatggcggccaacgatcagcaatccgacatgctggaagcgctgcaagagattcagcgcactcaagccctactcgtgaatgctgtcgagtcactctctggtagatcgatcgacgaagctactggagatcatgccaaggacaacgttctcgatattggttctagngaggatgccaatgagggcgaaacaccttcagtagagcttcctattgtctccggagacaaattgaaagctcccgaggcccctaccgccgtccagcgccagcaaggtttcacttcgcgcatcatcttaacgacttacccaaagcagattggaattaaccctttgcctatggactggggtaactcacaccctgttaagcgtggccaatcgtagtttcaagggctgctactactattcgacgtcgtaatgctgttggagcccatgggggttcttactcgatctactatgcacttgcagtcgccagcaaggagttggacagggatcaccgccccgntttaccaacaccgagccnggcggcaanattggnccctttctnaatggggaaaccaaaat

SEQ ID NO: 1107 - DNA, 585 bp, Fusarium venenatum
  misc_feature (1)...(585): n = A,T,C or G
gaaattctcggccgcaggaaatttnttttttttttttttttttttttttttttttttttngttngaaattgttgaattcncnctcttagccnccgcccactctataggccaggccgtanccttattgccncggacccaaattgtataattacatttgtcgatctgggttcccttcctgtaaccactcgctctaagccatcgtactattgtttaaaaaaagcgtgtttccagcttccaggggttgttcaattcgaaccctaagggtgcctctggcttgtctgtttgtcctcgtananttcctgtaanacaacggtcacgttccatcatttgtctatcccgccgtcnaactgattgtcagcattgttgctctccagcgaaacaaaattgaacttgtccaggcctcgatgcttggcagtatcctttctaaccttcttcttgtcatgggaatgtgtttcttgtttgggcggcctcattcaccgaggctcgtctggcaacggaaccaaacaggttttctcctcagctactgccananaacctgctctcttatnacctgttcttcggcctccttgtcattccaactgcttt

SEQ ID NO: 1108 - DNA, 635 bp, Fusarium venenatum
  misc_feature (1)...(635): n = A,T,C or G
caagcttcgagatgcaactctacttacaataactctcgttggaaacttcttgccgaagctttctccttattctgagcttgagtgtcggcaagccaggtccttaacattacccctcccggctcttacgccgacctaccttgacagatacattatacagtactcgtacacatcaacctattcaccatgaacgtacgaccacccatcgatgtttcaggctccgaggctgtcttgtccgtttctttcaacaatgatgcgagttgtttctctgtcggccttgattccggtatttgtgtctttcataccaaatcctgccttctcaaagcctcaagagatttcaatgccggcatcggcctcgttcaaatgatgggcacgactaattacctggctctagtcggcggtggcaggtcccccaagtttgcaatgaacaaagctataatatgggacgatatgaaaggcaagggtgctctaaaaatcacgactctcacagcagtacgcggtgttcaactgggtagggaacgtatcgccgttgtcttgcaaaaacaagcgtccgggtctactcttcactaaacatccagatctactttatatataccaaactgnaaaacaaccttgcanggcctgtgctntntgtcgaa

SEQ ID NO: 1109 - DNA, 390 bp, Fusarium venenatum
  misc_feature (1)...(390): n = A,T,C or G
acgnngatccactactctgccagatactcagacagtgaatatgagtaccgtcacgttcagctcccaaagccatgctcaaggccattcccaaagattaccacgactctttaaagggaactcttaagcttcttggggggaggaggaaanggcgagctttttggcattacttnaaagtctaggatggggacactaccgaagttcaacgagcnagaaccaccattttttttttaagcgcccgttcaacttccaacccctnagnaatcgatagatcccccacgactnanattcccccttaaaggaccatacatatttatngcccggacccaccttaatgggggttacactnaacgctaaccaagttcgttatcgttcgngatttttaccccgtgg

SEQ ID NO: 1110 - DNA, 578 bp, Fusarium venenatum
  misc_feature (1)...(578): n = A,T,C or G
caattccaaatctataaactcgccccgagccaatgcttcaacccttaacgcctatgatatgcttccatgatcgtacagattaaccttagcagtattaaacaattgaagttccaatcagtgtccccacaagccagccgctaaccgtcctccctatcgctattcccgtttggcatactccgtgagttttcatgtccatcatgctgcatcacatgcatgagctaccatagccctgccagatggcatatgcttaccacgatcctacggcccgactgcagtagcaacatcctgctgtgtacccatccgcaaagcgtggcatggtttcacaccacggccttatgatgaaaactgtatttccagtccaagcgtccggaaaggcttgtcaagcttcctcaggtcgatgctactacccaagctgaacaggaatgatttggcccgcccttcccacagcacccctattcgcatgttttggtccatccgggttttgagcactccagcatatctctcctctccnggcttttctggttcggtctcttctttcgggggcgggantaggaagcaacaatggctttacagcaact

SEQ ID NO: 1111 - DNA, 611 bp, Fusarium venenatum
  misc_feature (1)...(611): n = A,T,C or G
ttgcaacatttttttgatacttattgcgaaacctgctataactactcatacttttttttttgtgactgagctccattgtatcatatccaagcagcatattacaagacacttatcttnattatgcgcggcatccaaatcaccgaatatctcaagggccctgatcagcttcaggtcactgacctacccgatcctaagccctcggaggatcaatatctcatccaagtacacgccgcagcagccaactttttcgacattttacagatccaaggaaaataccagaaccagcccccatttncttgggttgccggcgccgaattcgcaggcacaagttatcgctacgcctgtcgatggctccaagcccaagttccctgttggatcgcgtgtctttggcgcgtctcagggtgcgtttgcgaccaaaatctgtgctattgaggacactctgctgccagttcctganggctggtcctttaangaagctgctggtctgtttgcaccgcccccacaagttacggcncactggttgtganggcagggatcaaaaaagggcgactattttctggtccatgctgcccgcggggggtgttggtcttgcggttgttaaagggncaang

SEQ ID NO: 1112 - DNA, 340 bp, Fusarium venenatum
  misc_feature (1)...(340): n = A,T,C or G
ttctgcacagctgaagtcattgagccgaactggaacaagttcatgtctcgtttaaagacaaaggatgagaatgcggattcaatctcgggaacttcgacacggaccgtagatgagcttatgcaggaccatgtcgacttcttggatacgtgtctcaaggaatgcatgcttaccaatagtaaactactaaggattcactccaaactcatgcagacgtgcacgatcttcgccgctacacnaatnggctcacacgtgagctcnaaaagncanaccaanacnttttaggccccaaaaaaccctaacnatgaagagggatnaggggagccttncnaaagaaaaaagg

SEQ ID NO: 1113 - DNA, 706 bp, Fusarium venenatum
  misc_feature (1)...(706): n = A,T,C or G
tttgatcggtattagtctcctcaagtcccgacttncaccagccaaggacgcaacggcacaccccaactttatgatcttcaagagcctgcctttcctgttcactaccatcggcgtcttcctgctcgaattctcactcttcatccctctcggatacatctcaacgtatgcgctgcacaagggcttcggaaaagatttttcatataacctcatccctattctcaacgctggttcaagtcatcggtcggcttcttccgggttattatgccgatgtgatcggtcctttcaacgtcagcatcctcgccgtcatccttgcatcgtggcatgtttctgcgtatggcttctctcggtggaacgacagctggcgttatcatcttcgccggctcttcggtttctcctctggtacttctatcgcatcgcacctgtttgcattgggcggctgtgcaagacccaggagtacggacgatactatgcgacggcgtacacgaatgngtcttttgctggctgattggtattccatcggtggcagtattgtccaagccaatggtggcgaagtactggggactcattatcttaactggcgncanttatganggtctatganctcgctggtcttgggcaaggtacccttnttgggctgnacaantggaaaggccgccttttgactactcaaaagccgacgcatatttacaacgggccccttccaaaa

SEQ ID NO: 1114 - DNA, 556 bp, Fusarium venenatum
  misc_feature (1)...(556): n = A,T,C or G
aatgctttccagggcttgaggttatgtacctcttcgcctttgagacaacttcgtgcgcccctccaacaaacgtccaagacgctggatgcgacccgacgactccaaaatgtccgagccttttcgacnacctcaccgatgctgggcagctggttggaaccgaatctgaaccgaaagaagaanatggccaagggtcgaccgcgtgtcgcaacgggtggttctaccaagggtacaacggtgctgtttggcgaatggggtctccgaatgacggatcaccaccgaagaatcagcgcaaagcatctaaagatgccgangacaccattaaagtgcgacttcgaggacaaaaataccggctatataagcgaaagaactgtaacgttggtgtttacntcagcggtaatgatatgcntatgggtnaaggtaagggtcttttgaccattgggccaccgaatttctgttaccaaattttgttcgaaatccgaagaaaacttcacaaacaggtttnaaggatccttccgcctngctggaaacaaactgcctggccagtgggaatttttaa

SEQ ID NO: 1115 - DNA, 815 bp, Fusarium venenatum
  misc_feature (1)...(815): n = A,T,C or G
caggataatactcctcgggatctcccgcagaaacgtcagcgttggatcacaattcgacaggacactcactcgcagtcccaacttagtatctatacgcgctgaatcggtattattcacaagcgcaaagagacacgaccgagggacctagaaataaaaagcaaaagcaaaaagcaaaacaaaggaatatcgataggtactcttatctgcaaaattacgtctctacacgtcctcgtcacatatatcgtcatcgctcggacagctactgcagctgccaactcaaaaaagagacttccaatccaacaacctcagcttaggtgttacaatctcctccctccgacctgtcacttctaccggccccacgctgctaccccggagctgttcggcatcgtctctcttcgtaaaacttcggtaccttcgtcacgagatcatagacatatattatagcagaaatgtcgccagctgaggacaagagcgagactgccggcgaggtcgactttggcgataacatcgacatgctcactttcagccaaatcctggagatggacganccggatgattctgaattcagtcaatccattgtgttcgggtttttcgaacaggcagangagacctttgaacanaattaaggaagcactggaagaagaggatctcgagaaactatcttctcttggcacttctcaagggttcatcggcgacactaggactcgtcaagatcagggatggatgcgaagcgatccagcgataccgcaagaatgaaaacttggacggntcttcgcaattggacaacgagaaatgtgtgaaagctcatggcgaat

SEQ ID NO: 1116 - DNA, 587 bp, Fusarium venenatum
  misc_feature (1)...(587): n = A,T,C or G
aagaccaccaggtcgtgctcgaagctctcggggaatccaaattcaattaccttggtctttcttacggtacccttctcgggtatacgtatgcatccctgtttcccaagtctgtcggccgaatggctctcgatgctatcgtggaccactcgcaatccgagatcggagctctcctcgcagagtctacaggctacgaatctactcttaacgagttcttcgattggtgtgacagaaactctacctgtgctcttcacggcaagaactcaagtaatgtatgggaccaggtgctctcgcgcgcagactcaaagcccataccagcaccaggctgcaacggcacatgtcgctccaatgtgaacggcgaagagatccgttacaacgcacaaagcttcctgacattccaatatctcactttcggcctaactggctcgatcttgcaacctctcctccagctagcagagcaaccaacagctctatccacaccaccctaattccggatgtcganaccnacggtcgccgtacaatatctcccatggagtcanacggctccatctaaaatcgtgattancngaactctcaccttgacttgccac

SEQ ID NO: 1117 - DNA, 447 bp, Fusarium venenatum
  misc_feature (1)...(447): n = A,T,C or G
gacattggtagcgaggacttcactcttatctgcgactgtagtttgaatgctatgtttggtttcagctctcagcttcgtgccgctacccagggcaagggcgagttcagcatggaattcagccactacgctcccgccccccctcatctccagaaagagttggtcgccaagcaccaggctgagattgaggctaagcgaaccaaataaacaagtcgcaggacttggaagagaattgctagacacatcagagatgtgatggccgaggcgcaatccatattgcgccaatgtacaatacaaatgaacgggtctatgatcttgtaatataatgtcacaacgactccttacnaggggtttagaggtccacgacagatagatgagtagtagaatctggatgagggtgccattgtnatacaaggcgttggaaaagtggacaaatataggtttcantnt

SEQ ID NO: 1118 - DNA, 672 bp, Fusarium venenatum
  misc_feature (1)...(672): n = A,T,C or G
tctgaatcacagcactcatcgtccttgtcaactgctgcccatttgatgtttgaagaaatcaaagttgaaaggcttcttatactcaaccgaggtttttagtggtttcagagagaaaatatcgaattcaagctatatattcattgttttgttgcatcttcctaaactcccctcccccggctcaaccctatgttgcgccgtgtcgtttccatcatgacatcgtcatccccgaaacgtttcataccgttaaagaagagaaaccataatcttccagccagcacttccagccttcgaggtgtggtctttgatatggatggcacactctgtgagcctcaaacttacatgttcaaggaaatgagagacatattggggatcaacaaaacaacggacattttggaacacatcgaaacactcccaacatcggagcagtcagaagccctggaatctatccgcaacattgaacgaaaagccatgaagactcaaactcctcagcaggcctcatgacccttatggcgtatntggcaccaacgccatccccaaagcaatctgnactcgcaactttgacgntcctgtncaaaattgatggacaagttcttgagggctctcgnttnatcaattgtcacacgagaatttcgncacccaaaccgatcctggcggnattttgatattggccag

SEQ ID NO: 1119 - DNA, 592 bp, Fusarium venenatum
  misc_feature (1)...(592): n = A,T,C or G
ggactcttatgccaccaaggcatcgaatctcaagaaaacagccattctggcatcgaaagaggccaagcgatggcaactgcgaacaaacaaaggcaccaaggatcttcaagctcgcgcgaaacgtgtcatgcgtgatatgatgggctttgggaagcccaacaagcaaaaggagcaaaacttgcccaaagctgccaaaaagcaggaaantcaaaaacgctcgcaaaaaaaaagccgaccgtgaaagccgctcgtcaaaagaaaaaagcttaatttccttatctctcagaccgagctatactcccacttttatcggcaagaaagatcaagaccgacgaaggtggaacgaaagtncagacaaccccgacgtcgccaaggatgcccatcatgcccaaccagaaagatgcttgacattgacgancctactggccctgttatcggcaaggtcactaactttgaaaaacctcgatttcgaaaaaagtagtgatgaagctctccgtgctgctgccatggccaacgctcagaacgccattgcagaaggccagaanaaaggtcgcgacttcacaaccaaggnttggacatggatgatgaaggc

SEQ ID NO: 1120 - DNA, 806 bp, Fusarium venenatum
  misc_feature (1)...(806): n = A,T,C or G
tggcaatagaaacaaaaatctgcaacatattttattgactttatgtgaattgtttttgcttctaaaccatcatgattcttatcagcggcgtttgtctccgaaagaccgtcactagtagcgggttacacaccgagcaaagaaggcgacggcatcgcctcgctaggagagtaaactctccattaaccaaatcaagtaatgaaactacgagtttcaattgatcaaattcaaataatcaagcgtcaacaatattaaattcttgaagaactgaactcatttgactctcaccctacacttgactaccttatatatcacgagcgaattacccgagctttctgcgacaccatcgaccaaaacgatctcactcttacacttgaagacatcgtgaattcgatgcgtcatgtctcttggagaacttgcaggcagcccttcagctttttagtagtccaaagagcatcgttatccaccatggcttcgtccnggcgttgctataatgacgcaattgatgcgctcaattccttcaaactccttttgatattattgaagctcgcaggaaagctggtataaaagcccaatgctgtatcaatccaagagatgaagacatatcttcatcgnatcngatatactncatctgatttgacaaactcaacatcgtcatgtggcaggaccaaaggcaanggagtccttgccattggcgactccatcttttttaatatnagcacgcaagaggccaccttacaaaacaggcttnttatatncccttacctaanactgncccggagcgcatcgtataanttgaaccctatnta

SEQ ID NO: 1121 - DNA, 535 bp, Fusarium venenatum
  misc_feature (1)...(535): n = A,T,C or G
ctctaagtcatgactcccctgtacaaaaagacccttgtgctcggtgcctcatcaggcattggggaggcccttgccgccaagctcatcgccacaggcaccaaagtcattgtcgttggcagacgacgtgagaatttggaatcttttggtagcaagcatggtcacaaaaatgccaaggcagttgtctttgacgtcaccaatttgtctgctatcaaagacttcgccgagtccatcatcaaatctgacccagatcttgattcggtcgttctaaattcgggcatacaacgaggctttgacttttgcaaccctgaatctatggatctgagtgttcttggcgacgaacttaccaccaattatacatctgccgtttacttaactgcagcgtttattcctcatctaaaaaaacaggccaggggtcatctnatctacgcagcgctactcttggnctgattccttccatggggcgcacgcccaactataatgcctccaagnccgcacttnatacctttatnctcaatgcgcgtaacaacttgtcgat

SEQ ID NO: 1122 - DNA, 628 bp, Fusarium venenatum
  misc_feature (1)...(628): n = A,T,C or G
gtgataacgctcgagcacgtgaggctctacgccagtgtctacccgaaccacttcgcgatgccaccttttcctctgttctccgcgacgatgcagcaaccaagagatgccttgcccagctactcatcaacctatcggataatgtcgtacaccccaatggtgtcggcggttccagcatgtaaaaaaggcgacgctaatatctgggagactcagttctccttgttgtgacaatacccttgtgcattgatacggcgattgatgaaggacggttgaattttatttatgatattctgggaaaagcgaagggatcaaaagcatgttgcatcgtttgatacccgcaacccttccggcttaatgcgcagagagaagaccgacattccagcagagcgactggctgncttntcttccaacgtcnccgctgatggttatggggcttgcattctgtttcacatatctcgaaactggatcaaaaggcttatatcggtttgccatggaacaacactgccaacaaaagggcctctgctactcttgtttccgccttggatctcggccgntggacccaaaccataanggaccttnattttgngaatgggctccgcgtgaatatactcaaggaanatctangggngga

SEQ ID NO: 1123 - DNA, 612 bp, Fusarium venenatum
  misc_feature (1)...(612): n = A,T,C or G
ataggacgttttttttttgtttttttaacatctctcgaaccttactgaaatctctggtcttatagtaacgatattatccattcctttgaacctcactctcctcaatccttccatcatggcatcctccagaaccatgtcacggacattggccgctctcactcggcctgtcacggaaacatcatcccgagcagttccacgatggactcgttcaatggtcactaatcgatctcggattccttccatatcttctggattgcgaccacttgcgcaacgacagcgcatcgtcaagacagcaacgccaagcctcgctggcatcggtagcggcgtccgaaccatcttcatccagacggagaataccccgaacccagatgccctcaagtttctaccaaaccatcgagttgttcccgaagaattctctacgcccttcatcgaatacctcaaccctcgagcaacgatctctcccccgcatccctctcctctagccgctaagctcatgaatatcgacggagtcacttcggtcttttatggtgccgacttcataaccgtcacaaaagctgccgacgccaactgggcacatattcgccccgagatanttgcactcattacagaaac

SEQ ID NO: 1124 - DNA, 631 bp, Fusarium venenatum
  misc_feature (1)...(631): n = A,T,C or G
gtgctgttgatatggatgaaaagaaatcgtcgctcccgtttgtcgggattccgatgcgcctngactgcccgcgtaaccgctactntatngttatccttcctcgcattttcaccatcttccgcatccagcgatttcagtgaccggctccacgataacattatattacctcctggtccagnccttccatcancccccgaaattcctgaacctgcggagcacacgttcagtctccgtcacatataccatcatggtacccatctccatcctanccttcatnggaagcgggatgtcatccatgaccagacaagggtttacctggctgcagaagacnattttgacgaatatgatattcttcgattgaaagccaagagtcnccccgagacaatccaacntttatctgatcgaaggccgtcagttgtcnaccccatggtggctgagtcgcgacagcgaggatacncagctgttcttgatgcatcagcggggaccatggatcaagtttcatctcctgatatcaangataaaggacactggtctcaccctatctnttatgactgccaacgcatacgtcnancatgatactgatgcctattgggangatgttggaaaaccnatggaaccccagcgcccnttt

SEQ ID NO: 1125 - DNA, 689 bp, Fusarium venenatum
cccaaagcctaacaaagttcctaaacaactttccaactactaccaaatcacacattttcgagtaattcctcgtcttcacaaccgacaacatgcctttcaccgctagcgacatctgcaagatcatccttgccatcatccttcctcccgttggtgtcttcctcgagcgcggttgtggtgccgacttcttcatcaacatcctcctcaccattctgggttacattcccggtattatccacgctctatacatcatcctgaagtactaagccttaccgcacttgacttctcagggctacagcgcatcccaaatggcttaatgagtaccccgcttcccaacaaccgacaacaactggtcagccatcggttgtcctggaccaagcgacattctgtctgacagccaagacaccaatgactgccgtgtcaaccgggtacgcgcattcgcccggaagttttgtgtttctgtttgcgcaaccttggcttcgctttgataccttacgccggtgatccgcgcttacgagtttggacgccgattttatgacaggcatggacgcgatgcgataccagttccttattttctttggtttatttgcggatggaggcgcatgctggattggctcttaaggcataatgcattgggctttttaagtaattaattcgatacccgtcaatccaacgtttccttgacatcttaa

SEQ ID NO: 1126 - DNA, 474 bp, Fusarium venenatum
  misc_feature (1)...(474): n = A,T,C or G
cacgaaacccgtcgctgcgattgagtccctcatcgccctcctaaacgcccaaccttcaaccaccgtcttcgagatcctcgacacagtcaaagtccactccgatcgcctcaaggcctccgtctcgaaccccgtgcctctatccgccggaacagatctcttcctccagtacctcgtttcttctctccgacaacaagatggtagcttcgacgccgtgaggcagcatctcctccgcaacggacgcctttttgccagcgtgctaatgccgcgcgagagggtatcgcggatgcaggatggaggctgattctcgagggccagtgcattcttacacacggtgcttcgcggccgttgttggtatcctggatcgcgctgctaaaaccttggtgctggcaagttcaaggtttctacgtgcgcgangaacccgtgtcgaggagagcgatcgcgtatccgtgagcttccttaaagggaattcccgtc

SEQ ID NO: 1127 - DNA, 454 bp, Fusarium venenatum
  misc_feature (1)...(454): n = A,T,C or G
catcatgggctgtaacaatttgttgaagggacgatgggtgtgtcacgaaggagggaagtggtatttgtaggtaccttgaacnacacaaatatgaggtanatattgtatcaggcgctnttctgcggtcactgtgcagcttgccacaaccatgccganaatgtctgccacagnggtggcttcataggcttgagcggaagcggtggaggtttaagcnaagctgtttgcgtcaatgctacacatgtccatcctcttcctnnagatctgcctctggagattggagcccttgttgagcctctctcggtttcttggcatgcgatggccgcggcgccaganatcaatcccagttccaaggttgtgattctcggagggggcccattgctggccatgattttttgtnttaaaacaaanggcgtcagagaaatattntttagagntgctcatacnacanactttg

SEQ ID NO: 1128 - DNA, 441 bp, Fusarium venenatum
  misc_feature (1)...(441): n = A,T,C or G
nctttcaacgacctgttacatacgcagcctgcttatttattaattaattaacgtcatcttcccatcatgtcgactctcgaggagctcgatgatctcgaccgccgagacanggaggacaagaagagagaaggcgacgacaagaaccagaagaagcatactgntggcgacgccgacatgaaagatgctgaagaagaggatgatgatntccttgatgaagagatcctngggcttagcacacaagacattcanactcgcaagcgtctgcttgagaacgactcccgaatcatgaagagcgagctctctcggttatcgcatganaaggctgctatgggcgaaaagataaaggaaaatctggacaagatcgccaataacagacaactcccatccttggtggtaacgttggtgagttgctcgatctcgaccaactggcgaatcatcaga

SEQ ID NO: 1129 - DNA, 501 bp, Fusarium venenatum
  misc_feature (1)...(501): n = A,T,C or G
cgccagagtagccaagaaggttgatgtgcgaagactcaaggangaattgtggaagggtatggataatgacattctcgggaaacaacccgaaccttcagcatcacctgacggcgatttcaaacaggaacagccactcaagtttacagaagtcatgaataacctgcaaactgtataccccaaaccggttatggatgacatctctacatcgtactgtttcatctgtctcctacatctagccaacgagaagggtttgatgattgagaatacgcctggtctgtcggagctggagattcgcagggattggtcggcggagattgttgatggcgaatagtaagancaattttagactgcttggttgtgtctatgtttttgggggatggtttacttgacnagtcatganacacctgcagacttcattcgaaaaacatctagggaangcatggaanataacctgatgatatcctggccnttngggaanaaatccaaaataggccacattta

SEQ ID NO: 1130 - DNA, 625 bp, Fusarium venenatum
  misc_feature (1)...(625): n = A,T,C or G
atcaaccttcacgtatcactttcaccgatcaccgcgacgacttccaaacgacatcacgacaaactgaactgaacttcgatatttagngaggctcttttaggagagaccagccctggttcagcaagatatactctacgaaccgaangggcaggcaagctagctagctgtgcacgtcacccatattccccgattctaccgacaccacatacacaacagccaacatgagtaacgacgctattgccgactttctctccgagcagagagatgaagctcctgaagagttgcagcctctcattctcgacttngagaacttntgggaacgaaagctctggcaccaacttactgatgccctcgtcgatttcttcagccatcccgagagcgccccccanaggctacaattctacagagtctttattctcaagtncgccgataaaatcaatcaagttgaagcttgnggacctacattgaaggcggcaacagagtgcgatgaggacgaagagcccctttcttctacaatcggtcgccnaaaanggtgacaacganaaattttaaaacccttccttttttntttaantggcggggcccaaccaaaagnttaanttggaggaaataanacgggncgcng

SEQ ID NO: 1131 - DNA, 537 bp, Fusarium venenatum
  misc_feature (1)...(537): n = A,T,C or G
catcactcaagcgtctatctaaaccttcactaccggcttcttctttattgctctactcaaattcggcacctcataatcctcaccccgcaaaatacaaccccagtttcaacattcgagcttattccaagttcagtatgggtagcactcaggacatgaccccgggaaagccggtcctattcttcgatattgacaactgcctctacccgagaagctccaaggtccatgacctgatggctgatctcattgacgagtacttctcaaaacatctggagcttcttgggacgaagcggtcaaactacacaaggagtattataccagctatggcctggccatagaaggactcgtgcgacaccatcagattgcccgctcgactatacgcgaaagtggatgacgctctgccctcgaangcatcatcaagcccaatcctgactgcgtgagctccttaggacatcgacaagtccaggtattcggtgnttttacaaacgctttgtaaccatggaagcngggnccgctttggcttcaggnattttacggcta

SEQ ID NO: 1132 - DNA, 383 bp, Fusarium venenatum
  misc_feature (1)...(383): n = A,T,C or G
tttggcaanacaaagctcatggccaaggcccttggtcanactcccgaggaggctatcgctcctggaattgaggacctcaacaaatacttgaccggcaccgtcggcctgatcttgaccaaccgccccgccnaanaaatcctctcttactttgagaacctcgctcctgtcnactttgcccgcgccggcgccgtcgccacccgagacttcttcattcccactggngtcgctacgctactgntggngaggttcccgccgancacnatgtttctttggcgcacaccatcgaacccgagctggnacgttttgggtgtncctaccccgtatgaacaanggccgantttttnttggtnaccaaggttggtganggtgaagantacactttt

SEQ ID NO: 1133 - DNA, 448 bp, Fusarium venenatum
  misc_feature (1)...(448): n = A,T,C or G
atttcaagctccatctttcttttacattctcctcccgcctgcgtccccgtcttgtttgttttcttctttcatcccatcttcattagttcatctcaccacaagaatacgtagaatgtctgacgaaaacttcctcgccgcttcggccaagcaccctatcgtgcctaaccatgtctacaactatggcactgcggggttccgcatgaaagccgaccttctcgatggcgtctcgttccgtgtcggtctcctgtccggtctgcgaaatcgtaagctcaatggccaggccattggtgtcntgatcactgccagccacaacccggctatcgacaatggtgtcaagattgttgaacccannggtgagatgcttgancangaattggaggctatnccncaagcttgtcaactctccttctgatcaggactctcgacaactacaaggnnctgggtacca

SEQ ID NO: 1134 - DNA, 639 bp, Fusarium venenatum
  misc_feature (1)...(639): n = A,T,C or G
ggtgaaccaagatcgatctgtcttgttgagaatcgtgngaagagcanagagtcacgaatttgggtatctcgccaaggtggctgggtgaactcatgaaagagggcattgttccgcagaaggaagccgatctgagcagtctgacggctgttttgagcacggggatggtattgaaggaacaggtctttgaatggttttacgatggggcttttcctaaccacatcaaactcgccaacttttcaggcggtacagatatcgccgcctgcttcgtcatggagaatcctctatgtcctatctacgctggcggctgtcctggaagagtcattggcactcctatggccatatacccatcctcggctgatctaacaaaaccaatctccccagtcccagacggtgaaccanggagatttangtaggaacagcggctttcccaaacgtacctctctatctgtggnacgacacgagtcccgctccaggcaaaaagtacacttcagcctactttgaccgattccctggtgtgtggtcacaanggcgattttgcangccgtccatccanagactgggcatatccatatccctcggtccgctctgatggtgttttgaatccnnagcggtattcgcnttgggaagtgcngatatctn

SEQ ID NO: 1135 - DNA, 454 bp, Fusarium venenatum
  misc_feature (1)...(454): n = A,T,C or G
agttacctgttcaaaccatcccaccttgaactaccgccaagatgcctcaagaggtcgctgntnttaagaagttcatcgagatctgccgtcggaaggacgcttcctccgcccggatcaagaagaacaagcagaccaacaacatcaagttcanggtccgctgccanaanaacctctacaccctggttctcaaggacaacgacaaggccgagaagctcaagcagagcctcccccccaacctgcagctcaccgacgtctctagcaagaagaagtctgcttaaatgaaggtggtttgaaaaacgggtaactcttggtagcgggaggattcacatgcacgaatgggcgtcttgggataccttgcatttcatcatgtgctctggaaggaggatactcggatgagtccaaaaaaataaaaagaaccgattcgagtcacgaaaaaaaaaganaantgataatg

SEQ ID NO: 1136 - DNA, 620 bp, Fusarium venenatum
  misc_feature (1)...(620): n = A,T,C or G
ctttcatacagcatcaccacataacctgagccttttgagcacgcgaacaggccgaattaagttaaaacgcgagcaacaacatatttgagacagtataccctcgcatgcgcctgtgacgacatgccatccatcgccctgcgacagagcagacgatgtagattgatagatacgcgtgcttacttgacgaatactccccgatcttcgtatacgaacatacagtttcgcgctgcgacaaacgcatcatggcgtccggtttctattcttgacgactgggtcgcaaaagaagctcgccctatcagccttcgccaactcatggtctttggccgatctctcacagaatcgcgcctgatcagctctgccaattatgttcgcaccgaattacctacgcgtattgcgcatcgcattcgagacatgcagcgtctaccatacgtcgtcaccacgaacaaacatataaaagaggtctatgatttatattatcatgcctttgatacatttcgcaaagtgaaggaagtcaagacgctggaggaaaacgacaagctgtgtgaactcatcagncataaccttaaaaggcacctgatgnaataccacagcttgggatgggaatcctggantgcggnggt

SEQ ID NO: 1137 - DNA, 534 bp, Fusarium venenatum
  misc_feature (1)...(534): n = A,T,C or G
gtcactataagaatactcgtccttcccatccattagtcaattcaataccaactcacactctcagcttcacatcattcaaacacctcttcgactaaagaccaatcatccactacttaaatcaatccaaaatgtcaaagattcttacagttttcggcgccactggcaaccagggcggttcagtcgtccgcgccatcctcaacgaccccgctctctccaaagagttcaagattcgtggcatcacccgtgatgtctccaagccagctgccaaagagctcgccgcaaagggtgttgaagtcgtttctgccgacatgaacacagccgaacaagtcgctcccgccgtcaaggacgctcacactgtcttctggtcacaaactactgggaaactaacagcggaaatggcgagattgcccaaggaaaggctgtcgctgatgcttgcaaaactggaggtgtgaacaacttattttctcatctnttctcganccaacaaaaataacaacngggcgtnttanccacattaaancattttgaggggca

SEQ ID NO: 1138 - DNA, 576 bp, Fusarium venenatum
  misc_feature (1)...(576): n = A,T,C or G
gccatcactcatgcaatacttcaatgacactggcctggatatcgttgatggtgttctgaaccttattgctaccaagctcaacgttgatctcattgccagatcganaattggtgtttccatgctcacgctcatccttagtcgtgccgtgctcctcaagcagacgggagccggcacccctgagcaatgggacaactgggaccgaacatttgaaatcctgtttaccaggctcgagccttcgcttccttacatcttcccaggtagtgttaacaccggagaggatgtgtatgtatggcagcttcttgcagccatgggcgttagcgctacccatgatcaacaaactcgtttggtccttgctgtcaaagatcgtgtgcttgatactgtcactgtctcaaagactctgcctcctgttatgggagctgancgcttgaacagtgtcnacctattcatgcgatctatcggtttggatgtcnaacttctccagtaaacacatgttacatatgcaaacatctcttgtcggttatcttgggattttttctggctggcatataggaatgaacntccaaaaaacnggaagca

SEQ ID NO: 1139 - DNA, 666 bp, Fusarium venenatum
  misc_feature (1)...(666): n = A,T,C or G
gatcgtactgcaggcccttctcagcagcaatcggaaactcgccaacgatgtgaacgtgctgggcactaggaaggacaccccgcgcctgcgggagcgagttcacaatagcatggataaaacgagggatatgtgtagagagattggcgatggtgtcaagcggcttcaaacatgggaggatttgactaaacaacaaaagtacgagcaaacaaaggtttcgagcgatttccaagctgctctgcaggaattccagagccttcagcgacgagccctcgaaaaagaacgcgcatcggttaccgccgcccgtgcggcacaggaaggcgagggcggcgagggcgctccttccgagacacaactagagcaactgcagcaacaggagcagcgcatcgtactcgcacctcaagatgaggtcgattttcaggaagctcttattattgagcgtgaggaagagattcgcaacatcgagcagggtgtcggcgacctaaacgtcctcttccgacaagtagcgcaaatcgtgaacgagcaanggggagcagctgggctcgatcgctgacagagtgggaagatgtccgagaagatacgcgccaaggctgacgtttagaaaccgacaggccgccgcggtaccaaaaggcagctcgcaacaaganctgctgcctatttggtttttgg

SEQ ID NO: 1140 - DNA, 900 bp, Fusarium venenatum
  misc_feature (1)...(900): n = A,T,C or G
ggaagaattcgcggcctcaggaatttttttttttttttttttttactttaacatatctttcattaaaaaccctaaccgcataaaacctctgcgttgatcgtgcctgcaaacgaagaccattggtaggggggtataggccaacagccagantgtcngaaaaccgtcaacgccgtcctggtgggttctctcgaaagcgccaacgccgttgctgtgagcaagcgaangttcgcaacaagaccagccaccttaatgtccccaaacttttgaatctcccttcctgagaagaaatancaaccaagtctatctgtaaaataatgcgctccctaaaatgggtaacacaaagttcgtaaaagcatgtttcgttgcttgattgttccgtaaattgccttgtaaaggcgtcgtcatcccagttgaaggggttgcccagtcagataacccataatagaaaaaagnaaatgatagtcgagtcggagtaggttaanctttggtctcctcctcctttnttgccctcaccactctcggggccttgagccttgacgtacttcgtcgtagacangcaagggcctcgtcgaccttggccttgagagcggagtcgtcctcaataaggttgacaagctcggtgttgtccatctccagaagcataccggtgatcttgccggcaaggtcggagttgatggcctggatcttggggaagatcagttcacccagaatctgcttctgttggggaggaggggcggcagcaagctgttgctggaggacggaggctccggcaggttcggcaccacggccgccttgaggcccgttgccgttgcggccaggaccacctcggccaccctggcggttgttgttaggggggaagccgggcatgttaccagccatgggaggcatgccaggcatacc

SEQ ID NO: 1141 - DNA, 577 bp, Fusarium venenatum
  misc_feature (1)...(577): n = A,T,C or G
cgaggtcaagaccaacatgtggagccctaccatcaagtcttacctccgcctttacaccaccatggacctcaacaagcttgctggtttcctcgaggtgaagcccgaggagcttcgatcatggctcctggttactaagcagcgaactaagcaattgcgctggcaggaccagggtctgcttgacggcgagcttgtcaatgttagcgaccttgactatgctctccaaggcgaccttattcatatctcggaggccaaggtgggacgaaagcttgtggactggtatctccgaaacctgtcccgcacctataactgaggngntttagagagaactggctagtcactttttctcaaaaaatcgtggggtcttcgaaccgagcctcaacagcgcataaagcgctgaggctgagtactccacaacggcccagggccaggagaatcattacctgggggtatgcaggccaacttgattggatgtataagcatggcaaangcgtctcggagttggtgatgctcgtgcaagaatctgagaatttctcaggtttggctgnatgtgcnggaaganatatgggactttcttcta

SEQ ID NO: 1142 - DNA, 631 bp, Fusarium venenatum
  misc_feature (1)...(631): n = A,T,C or G
gctacttcacggcaagtccgaaagtcacgacgttgagaagcaaatcatctctcgaatgaagcaggagcttggacagcagttcaccagcaaattcgaaggcatgttcagagatctggtcacgtctacggagctcaccaccggctaccgtgaccacattcgcaatgttggagacggtagtaagactatcgacctcaacatcaacgttcttaccacaaactactggccacctgaggtcatggggcgtaccgcacagattggcgagggttctcgtgttacttgcacgtacccacctgatttgcagcgactacaggcaagctttgagcagttctatctgaatgatcgtaatggacncaagcttacctggattggcacnatggcanttntgatatnaaatgtattttcccggccatcgntgggaagtttggccctntntaaaaagagcgggnatttgaaataacgngcccacatttgnttttgggnggcaagcttttnttaaaagacctggaanaaaacaaccctttgaatttggnggaaaaacaggccaaaaaaaanantttgggcccggantttattggggccnttaacgggcattggggggagnccccaantnttgttttcnncttaagggant

SEQ ID NO: 1143 - DNA, 588 bp, Fusarium venenatum
  misc_feature (1)...(588): n = A,T,C or G
cagaaaatgatgagcctggaaagacagactctccagctgggccctttggcgagcacacctgcgattctcccgtctctctggaacataacttgtaccaggcaataaaggagatcgtcccagacccgcttttactatcttcaccggtgactcgttgatcattcgatctggaacactacatggggattacaatgagcaccagattattgaatcatatgagaacatggacaagcatctcggtatagtttacggcacagcaggaaaccacgagtctcatcctacaaacgcctatcaacctagctctatcggcgaccatcgtcttggatctacnaacttctcgccngaacatggtctcctggattggaccgaaccgcctccaganttacgcaaatgggtgcctactcccccaaatatccccatggaaactccgtgtctttctctcacacaaacctattctaccgangcaacttttggttatttccganaaagatgatncgcgaccctagttaacagctcgattggcttatcgaanaactccncgttgccganaaaactggagancgcgtttatttcntcngacatttgcccctt

SEQ ID NO: 1144 - DNA, 507 bp, Fusarium venenatum
  misc_feature (1)...(507): n = A,T,C or G
cagatacgcaggttgtttcttctatagtatagactcgttatccgttttctatctctagaactttacaatgaacgccttccgctgcttgagacctgtcgccgctcgagtgccttttcaaaggtcaactcttcctcgagttgccagagcttacagctccaagacctacgaatatatccaggtttcacagcccaagcctggtgtcggtcaggtgacactggaccgcccaaggctctcaatgctctttgcacacctcttatcaaggagctcaaccaggctcttcttgaattcaatgcagccgatgacacttcagtcattatcttgaccggatctcaaaaggcttttgccgctggcgccgatatcaaggagatggccctctcagtttcgctgaacttacaccaacttcttcatagagcttggtccgactaccactcaaattaagaagccatcatcgctgtgctcagncacgctctagcggagntgtagctggtttgatggcgactattactg

SEQ ID NO: 1145 - DNA, 445 bp, Fusarium venenatum
  misc_feature (1)...(445): n = A,T,C or G
ctcacctcacgaagctcaattgaatcagcaaccatggcttccgacgcaatcaccgagccgcggcaagcgacccgcgaggagatgcgcgagtcgccaaactccctctggcctaccgagacagctgcgcccaccttctgattcctctcaacaagtgccgtcgggataccgtggtatgccccttggaagtgctccgatgagcgacacagctacgagaagtgccaatacgtcgagttcaagaagcgagtcgccaagatggacgagttgagggagtcgaagggtggtgcaccgaagcacctagagagaaagacaaagagaccgaattcaaatcccgggtacgaacaaacagggccgggccggaattgtacatttacaaacaagccaatgtgtttgacggaatagaaagaggcattccacacaaatgaaacngattcaagacgaatatttt

SEQ ID NO: 1146 - DNA, 736 bp, Fusarium venenatum
  misc_feature (1)...(736): n = A,T,C or G
agaaatcaataatttcaaaacctctcttcttcttttaactaaaccttcctcactttgacatctgtctgccccgctaccccgccaaaacccctccataactctatcaatcttatcataacgaccaaggcatagacctttggtcactacagtcgtcaagacgttttccaatctccttaactcgacgcatcacccgtttgcaggagcccgctgctcagccgattccggaggctcagcggactcgacctttgaacagtaaaggtctactcacagaaagaaacccgtccaatctccataaaccgtaaacttccacgtcaaagccaattcaagcaccatggctcctcacgcggaagtcggcacgggctcctcaaacgggtcggtatacaacggccaaggctcctccgctacccaggatctcttcaccgtcaactcacccaacgtcacctacacggatgcggaaatccgttctcgatacacctaccgcaccacgaaggttgaagttgatgccagccggcaaatatgttgctactcctaacgagactctctacgacttcaaggtcgaccgcaagattcccaaggtcggtatgatgctggtcggtctaggaagcaacaacggcaccaccgttaccgctggcatcctcgccaacgccgtcagctcncctgggganaccaaaaaangtctcgcgagtccaactactacggntccgtttgtcttgggctcaaccctcaanctcgggca

SEQ ID NO: 1147 - DNA, 717 bp, Fusarium venenatum
  misc_feature (1)...(717): n = A,T,C or G
cctcttgtgacaaagctgtcagccgaaaaagtcatcatactttggaagccaaaaccatcaagtttcttcaactcaagcttcaccctcacgcccttttaaacaccatccatagcgctcaatatgtcggaccgtgttagtcaactcgcaggccatctgaactaccccaagggtctactttcaggacaattagcgattatcactggttctggtcagggaattggcgcaaaagcagcaaagttgttcgctaaagagggcgcaaaggttattgttgcggatattgacgcaaaaaaatgcagtgctgtcgctgaaagtatcaacaaggacggcggtcaagccaaggccgtgcctggtgatattcttaaagcagactatatcgaaactctgataaagagcgctgctgactttggcgatggcaagatcaacattattgcaacaacgctggctacacttgggatggagttattcataaaatgacagacaagcagggggacactattctggctcttcattgcactgctccatttactcttgtccgggctgcagcgccgtactttcgccttacgcgaaggggctcctcggtgcattggtaacatctcatctacatntggcgngccccgaaaccgcagggcacttaattatgccttggctaaangcgggtgttctggcttcccaaacattgnaaaggagngggccctcttttggttaaggccaacacnn

SEQ ID NO: 1148 - DNA, 575 bp, Fusarium venenatum
  misc_feature (1)...(575): n = A,T,C or G
agttctcctgtcctccagcaccgcctctatcctctatctccatcacatcgcgcccgccgctcatcctacacctaaccctcagttgacctctgtgcaagtcaagcaagtcgacgttcgacgagctgaattcttatatccccacggcgacaagatattctttgctggacgacgaaagtacttccaccactgggaccttaagtcaggaattgtacagaagacgacgcaaatccaaggacatcgacttgagcataagtcaatggagcgtttcaagctcagcccgtgcggtcgctacatggcgattgtggcatctaccaagaagggaggcggtatcatcaacgttttgaacacgacgtctatgcaatggattgctgctgctagactagcgagtcgcaacggcattgctgactttgcttggtggagcactggaaatggaatgaccatccttggaaaggacggccaggtcggcgagtacagcatggagagccgctctttcttgggtgtatggcacnatgaaggctgtgtcggtggtattgtcctggccgttggtggccaccaagggccngctgttctaggcg

SEQ ID NO: 1149 - DNA, 584 bp, Fusarium venenatum
  misc_feature (1)...(584): n = A,T,C or G
catgacaatgcaggtttcttcataaatgcgacaatgtccccaacaacttgaacaatcatcccatcttgctgtgtctcatacctctaatcatggcagaccagaagacagacgaccacatggccacggccaaaacaagcgtcgagtcgcaagcccgcggcgcgacagcccaagccctcgcaatggaccctcagcatcgcgctgccgtcgaaaagagcatgaagcgcaagctcgacacccgttgcgccctcttcgtcctcatctacatcatgaactacctcgatcgcaataacatggctgccgcccgtctcaagggtctccaagaagacttgaacctgagctacaaccaatatgccacctgcttgagtattctgtacgtcgggtacattctcatgcaggttccctccaacatgttcatcaaccgcatacagcgtccttcgctgtacattgctgcggccatgttgctctggggtctgatctctacactcagtggtagcgtgcacaactttgctggaatggtctgcattcgattcttccttggtttcgtcgaaggggntttcctgcctggtgcactgctcattctgtcc

SEQ ID NO: 1150 - DNA, 1006 bp, Fusarium venenatum
  misc_feature (1)...(1006): n = A,T,C or G
ctcttttcacggcttccagcctaccacactctttttattatactcataataatttaggtcgctttacagcttcttatcaacaatcctcttttcctaccttaccaattactatataccgtaattcttaaatccaaccttcaagatgcagttcaccatctccgccgctgccctcatggccctcgccacccaggctcttgcccaggtcgctgacttcgaccccgtcctcacccccagcaactgggagcaggtcaagaccggtgagaccctcgagatcacctggcaggccaagcccaagtactccggcgagaagatctccatctctttgatcggnggtgctacccagaacacccaggtccccatcaagaccattgctaccggtgttgacaacgacgctgcctntttctnttgggccatcgactcttncggcggcaccaacaacgtctacggtctcgtcctcaagctcgagagcaaccccgaggttttncagtactctttccccttcaagantgagggtggcaaggccgagganaagccctncgagaccgagganaancctgccgagaccaagaaggacgactacgagctccccactgaggctcccaagcccaccaaggaggcttaccccgttcctcacaccaccgtcgtcgctgtncacgaaaccgtcactgtcccttgcaacaccaccactgttggnggntctcccaccacctttgtccctgttgtcaagantcactaccctatccctcctcctgnccaccaggctcctcccgccaacaacaacggaactgctcctcaccctcccgtttacactgcccctgcccagcctaacgtccctgttgttcctactcancccgctggtcngccccctgtttacggaaaggccancctactcccgtcccgtctccggtggctgccgtttccggggctcccgttggccgttattgctggtctcgtcatgggcgcttttnnctttgtttncggganttccccccccctttgatctttt

SEQ ID NO: 1151 - DNA, 641 bp, Fusarium venenatum
  misc_feature (1)...(641): n = A,T,C or G
tgcgccaaccatgttcacttcaagatcggtagcaagactcgtcctacgacgagcatgctctcctctgacctcctctcctntgaggcaattctccacatcgagacctctcgccgttagctaccactcctatactcttcccgcccacacctctacgcctcccanaaacgacgacgttcccgaaacatcaataacacaacctgatcctctccccaaagtccacgagactcgtcctcccccacaacagcctcagcaccctcagcccccgaagcaacaagaagctgcgacgacaacaacgacgacgcagaatgacgttcccgccacctcggcatcagcgccgaagctaaacgagaaggaagcccagaagccgaaggccgccgaccacgatccaagctacgcccacgcaaggccgctatgaaattgacgccctctgcggnggagcaattaagagagctgctcgatcagcccgagccgaagctcatcaaggtcggcgtaaggaaccgaggatgcagtggtttagcgtatacctcgaatacgtcgacaagcctggcgctttcgacaaaacggttgacaaagatggcgtcaanggtcttgattgataacaaggcttttttcagcatttnttgggaagcgaaatggactnt

SEQ ID NO: 1152 - DNA, 589 bp, Fusarium venenatum
  misc_feature (1)...(589): n = A,T,C or G
cttcaatgccgtcatgaaccgttcggactcccatttgccgtcggcaaacatattcgcccacgctgtcttgaggtctgtcagattccccgacttgtgcgctgcatcgagagcctcatttcggcccgacacttgcatgtaaacgcgagtcgtttcctccttatcctttcttgtcccgaggtagcgccctcccgggagatggcaaaaggtgaaacactttgagtcatgtggttgtgggagtgtgctgaagaagccgatgtaccctccaaggaaatggcgaggatcgggggcatcagggccgagcatgagccgtcgtgttcttgatccggtcccatctgctgcgacgacaagatcaaagtcatcttttcgaccgtcgtcaaaacccacatgaacctttcccttgggatcgctctcgtcatcttgagtcagactggtgacggttgtaccgaacgatgcttcacgttcttgctcttctcagtaagacccatcaagatactcgcaagatcaccacgcatgatttcgtattctgtggtgaaggccttnttcataccggccgtgttncgncactggaaataatacttttggctggcct

SEQ ID NO: 1153 - DNA, 768 bp, Fusarium venenatum
  misc_feature (1)...(768): n = A,T,C or G
ttatcaattgacctttaaagagtaccgcaataccgtcaagatgttcgcccgatctgcattccgcgctgctcagcctttgaggtctgttcgtcgatatgccactgaggctggaggcgctggcggttccaatgccctcctctatgctactggagctgctgtccttggtggtgctggttactggtactttggtaagagcggagctcccgtttctgccgctgcccaggatgtgaagcaggctgttggtgccgagcccaagaaggccttcactggtggtgatcagggctgggtctcactcaagctatctgatgtcgagattgtcaaccacaacactaagcgcctgcgtttcgagctccctgaagctgaccaggtctctggtctgcacattgccagtgctcttctacaaagtacaagggccccaatgatgagaaggctactctccgaccttacacccccatcagcgatgagaacgacaagggcttnctcgacttgcttatcaaagaagtaccccaacggtcccatgagcacacacttgcacgacatggcttcctggccagcgccttgacctcaaaggccttttcccaaagtacgcctggggaggagaacaaggcacgaaccacatcgcccttaattggtggggggacttggtataaccccaatgtaccaagttggccggcgccatttttaaaaaccccaagggnaaanaccanggccactttggtttttgggaaatggcaaganaaaangaanttccttttnaaaaagggtttt

SEQ ID NO: 1154 - DNA, 530 bp, Fusarium venenatum
  misc_feature (1)...(530): n = A,T,C or G
cgagctcgaggcacatatgcgaattgaactccttgaccccagttggaaggagcaaaaggccaaggcagactcgcgctatgcctcaaccaacatttcccatgttgacgttgcaaacaatctgaagcgtcttgctagccaacgcagcgacgtcttcgacccgtgaccggacaggcaattttccgagggccaactggcgcgtagaaagaaggctgntattcacagctatgatggtgccatggacgctaagagccaagcacagttggccatatgcaaaacgttaacgtcgaggagcagatccgcgccattcatcaaaagttcgccgacaaaaagtgaagtatttggtagttggggcaaattgccgatccggaatatgaagaaaaacaccggtaacccgaagccgagtgtactggggtacgtcggcttgtcatgggccatgttaaaatgtttgtcnganaggcttttaggttaaggttaaggngggcccattggggctngngtttganatttccggcttaattgttgttaacttn

SEQ ID NO: 1155 - DNA, 322 bp, Fusarium venenatum
  misc_feature (1)...(322): n = A,T,C or G
ctcaagtgggagaagtgggatttccgggtgggtttcaactaccgagaagggtcttaccttgcacgatattcgatatgatggccgcagtctcttttaccgcctctctcttgctgagaatnttngtcccttatggcaacccgcgtgctccctaccctcgcaaggctgcctttgaatctgggaaaatgaatggtgccggtatcaacgccaaacaatctccacttgggaatgtaattgtctanggtactatcaagtacttcagtngcctatcacaacacaccatctggganaanctatgganctaccaaatgtcgtctgttgtccc

SEQ ID NO: 1156 - DNA, 679 bp, Fusarium venenatum
  misc_feature (1)...(679): n = A,T,C or G
natgacaaangagagccagatgacacatgctatggngttaacagcagttnacctnaatgaggagacaggcgaacctgtccgctggagggnncaaaacantnggggtactgctgctggtgacaagggctggtttgttatgagcgatncctggcttgatnagtttgtttatcaggcagntgcganccccngttctgcagtaaaaagtnanggatgtcctcaaaaaggaggccattgtccttcctcccntgggaccccatgggggcgctggcttnaaancacgcgttccgtgtgcacccgggaagnttgtgtcacattgttttcgcgtattccacctatggaatcgatatttattatgaggatatgtccgacaagccatantgagagctattaccacatacacaaagttttgccatccaacaatgttgtttnttcagtcacgtgcgcgttgtccttgtaggacatgacatgacgatggatcgaagttngaggcaacacgatgcagtcactatatgtnttgacataaggattacaagaatatcattagacgtatgcgcacctcggcncaatgaagcttcnccgctgtatgttatggggtncaaattacaataatcaacagatgtgtatttgatcctggaaaaaaaaaaaaaaaaaaaattcctccggccgcgaattcttccag

SEQ ID NO: 1157 - DNA, 231 bp, Fusarium venenatum
  misc_feature (1)...(231): n = A,T,C or G
ncatccttgacaaatgactggaccaacaccgagacccgcnantaggctggcgttctccctgatnaaccagtcngagaatgacccctacaggggtnagagcacncgaaaggtacctggcctcgtcaatcatctgtgncgtggacaggtctgatatnaaatnccttgcgtctgcttgacaagggggctgacctcgacgtttttcntggcggnggccgactttggctgggtgcg

SEQ ID NO: 1158 - DNA, 759 bp, Fusarium venenatum
  misc_feature (1)...(759): n = A,T,C or G
ggaactgcgatacggcggtgataaagtaacatcaggtgtttcatcggatcttgagagggccactgacctgggcttcatgatggttacccttttcggcatgtccagcgtactaggacccgttgaatacggtcgaagatacgagaatctcagctctgaaacaaaggcagcaatcgaaggcgaagtccggaaaacgataggaaagtcgtacgaggatgtgcgaaaactgttgaccgaaaagcgaagcgagttggacttgttagccaaggctcttgtacagtatgagaccttggacaagtttgaggtagaaaaggtaattcgaggcgagagtcttcccggacgtatcactgcacctaaagggccaatgagactgcctattcctcaacaagctccaacaccaccaggtctcgggggtgttcatcagcctcaacccccggagacacctgcgccgcagcagcagcancagcagacacatctagaactgatggttgaggttgaaggcttaaaaggccagtatcacgccatggtggagcaaagatgaggtaaaaaggaagcccggcataattcacgccacgcacgacgtatgtggtgttggaaaacagggtgaggatccatatcgaacacatatttctacagcgagcattgtgtggaattggatgaantaccttttnccagtcncgaaaaaaaacggggtttnaacgangacnactggccttgtgtntaggcttaacgatttatgtccatatggactttattttgttc

SEQ ID NO: 1159 - DNA, 745 bp, Fusarium venenatum
  misc_feature (1)...(745): n = A,T,C or G
ccgacctggtgtcattgttcgtgagctcaacctggaccagcccatctacctccagactgccaagaacggtcacttcggtaccaaccagagcttcagctgggagaagcccaaggctcttaacttctaagctgtcttgtgacatggtatcaaaccacaaaaagagtattcaacagctctatgcatacatctcaacagatgtgtaatcagtacatttgatttagcaactataggcggcgtacggttctcaacgaaacctatgtatctcccaccggaagggaggacggtcggtttccggcttttgttttattcatgatttctatccaaaaaccattttggttccacgggtgtggagatttctttcgcgatataccaggcacggagtgggcgtctttcaacaaagacattttagggcaaacctgcatttgtgaggcgaatcaaaagaagagtcaaaaagacttgcattataacgataccacgataagggaaatgacaaaaagacgacgcatccaatgtgaaaagcggcgttttgacgaggaaacaaaagaacttcaacatctttttcttttcaggatttctagccgagctgatgcagtaggcgggcgaagaccagccaggacgtggtggaggttggattgatngctaattagaagtcgatctttgatgatagaaggattctaatggctggtnagtgcccagttgtgnnatgcaaccgnactagactagaaagaaacagntattccggaat

SEQ ID NO: 1160 - DNA, 300 bp, Fusarium venenatum
  misc_feature (1)...(300): n = A,T,C or G
cttctggccgaggcgaacaaattggatgtggatgttctgtgctggggtggtactcaccgctttgacgcctttgagtatatggacaagttcttcgtaaaccctggcagtgcgaccggcgctttnatggagggtttcagncaagaggcccgaanagcctcnccgagcttttgtntnatggatgttcaaggcatctcgctcaccctatacgtctaccaattacgaanagactacaagggcaactanaacgtggnanttgagaaggngacatacacaaaaccngnatagcctttangaggacat

SEQ ID NO: 1161 - DNA, 499 bp, Fusarium venenatum
  misc_feature (1)...(499): n = A,T,C or G
acagatcacccataatgtgntgacgagaacgcgaacggtacccccggcgagcaggctgctcccaactnggaacacctcaacatcaaggtgacggacaacaacaacgaggtcttntttaagatcaagcgcaccaccaagctcgagaagctgatgaccgccttttgcgaacgccagggcaagaccacaagctctgtccgattcctctttgacgggacgcgagttcagcctacggacacaccggatgcggntcgtttacctttgtccaccacacgcctatttctgnatacatatggcgcaggtcatttggaaggtcctgagcgcgcttgacatgttactatttntagctcgagatgcaagacggngatacacttgaggtacaccangaacaggnnggaggattttacttttaagcggaaaaggaagcgggcgagggatgtacanaagcggngtttttaaangggtgaattagccaaactgctggnttgaanttggattccat

SEQ ID NO: 1162 - DNA, 402 bp, Fusarium venenatum
  misc_feature (1)...(402): n = A,T,C or G
tggccgtttactgccaggacaagcttggtctcacatcagaaaagatgaacccccgtggaggagctattgccctgngtcaccccctangtgctactgntgccagacagattgtgacaggtctgtctgagtgcangcggcagaagaagaagatgcttctgacaagcatgtgtatcggcacaggccagggcatggctggcctgttcgtaaacgagcaggtctagaacggtcaatgcatgataggcgctgggttattaattatgtaacaacaacagatctcgatgcgatctaccagttggttggagatatgatttcctgatgagcgagaatactgaatttgaaagcataaaantttgttccttttttagcaatactgagactactgaaaatcatatcggtgaaacc

SEQ ID NO: 1163 - DNA, 630 bp, Fusarium venenatum
  misc_feature (1)...(630): n = A,T,C or G
cttagatatacaggatctctcccccctccccctatcttttacatcttttgcactttgttttttacacaaagacaatcatcacaatgccttttgcgactgaactgacaaaacgactgggcatcagagtgcccgtcgtgcaaggcggcatgatgcacgttggcaccgccgatctcgcctcagccgtttccaacgctggcggcctgggcctcatcaccgccctcatctacccgacccctgaggaacttcgcaaagagatccagcgctgtcgcaccctcaccaagaaccccttcggtgtcaacatcaccctccttccttccatggtccctcccaactacgccgctttcgcccagaccatcattgacgagggtatcaaagtcgtcgagacagccggtaactcgcccgggcctgtcattacgcagctcaagaaggccggaatcatcgttcttcacaagtgtaccaccattcgtcacgcgcagaagcgccgttaagctgggcgtcgatttcctcagcattatacggtttcgagtgcgctggccacgttgggagagagcgacattaccaactttatccttcttagcaaaacgcgtcaaacctgggtgtgcccttcatcncnagcggtggcttcgcaaa

SEQ ID NO: 1164 - DNA, 579 bp, Fusarium venenatum
  misc_feature (1)...(579): n = A,T,C or G
caccgcctttcaacatcaccgccatcactaaaaacctgcatccttaactcctattgacgcgtcatggctggtgactgaccgaattactcgctgctttaacatcacgcgcgcatctcctttctatatcataccctattcccaacaacgccgacatggatccatctttgacgcgcgatctgccgaattcggctcctaattctaccaagataccatctccctctacggcttctaaacagtcaccgcgaccaggaatcggacgcattctatcattacctccacaatggctctccatgtatgatgagttcataaccaagaacgctggtcaagtctcgcagatcgagagcgctctacgggagtttgacatatataattccaggccgattccgcgatgccgaaatcgcattccgagtcgattcattcgggtgttcaactcctatcactataccatgactctctactttaaaaggctatcgcacgtctgccaatggccagcatgccatcagcgcatgctcgatacacacgatactggacccaaaggagtggcgcatatcgaagaatanccatgtttttgcagatgat

SEQ ID NO: 1165 - DNA, 590 bp, Fusarium venenatum
  misc_feature (1)...(590): n = A,T,C or G
ccctgatattgagcacatgcctcttttcgccgtttcccaccgtctgcttggcagcctgagatcgacatactacgaaacgaantaatgtactacgatgctgtggctaaggttctcctaagaaattcaggcctggacctactaccccctgctttctcttgcccgtttcaacctctaccgactatcttggggactttcttctcatgggtcgaagtcccaagaagggtcctgcgctggctatttggtggcttgagatcaccggacaggtcttcttttggacatggttcggttatggcctcgtctacaacatgcttccagacaactggactcggttctactttgtcatgataagcaacattactgcgtcacccctgcatgttcagattgtgctgtctcatttcgcgatgaacactgttgaatttgggcctcaggaatcttccctcanaaacagcttcgaaagacatggacatcnaatgcccgantgcttgattcttccatggcnggctgcagtccaagtnatcatcatctctttcccgcgtgcccgtcataacctgcgtnctacacanaaaccnttcaggattctgttacaaatc

SEQ ID NO: 1166 - DNA, 628 bp, Fusarium venenatum
  misc_feature (1)...(628): n = A,T,C or G
agcacatcacaacgcagttatcagaacatcatatacaccaagcacaatgtctgcatcttcgggatctggaagctggactagtctcatgcaacaagctcgaaatctanaaaaacagacggagaacttgttccatacgtattcgcggttcgcagcagctcctaatatcccacccaaacccacagaaaaagaacgcgagacagagacgaagttggaggagttattaaaaaagcgtgaggatgtcattagcaaactcgtccgactgctcgattctgaagccgcctcacctnctccgncataaaacagaagaatctcaacnctttccagaggaagctcgntgatcacaagaaaaatctaatccacctacgctcaaatctacaagaggctcgtnatcgcgcgaaccttntgntaacgtccagtnggatatcgaccaataccggcagaacaaccccgaagctgccgaggccgattacatgttgcaggagcggaatcgcatcgacaatagtaacaacatggncgataacgtgcttanccaggcgttttgctgttaatgacagctttaatctgcagcgcgaaacattgggcagcatcaacnnggaggattaccncnccccagcaagccaaggngccg

SEQ ID NO: 1167 - DNA, 213 bp, Fusarium venenatum
  misc_feature (1)...(213): n = A,T,C or G
ccaacatcttgcgggtatgaangacagcaaggtcattgccgccattaacaaggatgccgatgcccccatcttccaaattgccgatgtcggtctggttggtgatttgtttgaaaaggtgccanagctcactgagaaggtcaagaactcatagatgtctataatgtacatagtatgaagtacaaaatgatgtnatatacaaacagttaaatgttt

SEQ ID NO: 1168 - DNA, 813 bp, Fusarium venenatum
  misc_feature (1)...(813): n = A,T,C or G
taatggaagactcgtctcaatgagcatggcgtgaagattgttctgagtcattcgccacagagccaaagacggtctccgaactgtcttanaaccatctacgcgtcgtacttcatatccaacgtacttttttacttacattaacaggcgagacatcatgacgagaggcaaagacacacaagacgctcacatccaagaaaacgtcgctgatgaagaaacaaacgacggaaatgatgtcccaagctcaccaccccagccagctacctttaaagggcgtcttcaaatgagtgacttcatgttcaagtcaactgagtctacaggcaagggagaaccccctattcgaagatcaccacgattcaatccatcaacgtcttctgccatagcggcgcctacaccagtaactacagtaaagaggacgaaaaagagggaagcggaagagaaggagaatgacaagccaaagaagaaacgagcacgccccagttctggatacgcgccaccctcaacgtacgcccatctccctggtctgccagatgccattgccgacaaccttctcgttctgtttatcggtctaaacccgggaatacaaacggcaagaactggggcatgcctatgcttatccattaaatttattttggaaacttctcttctcaagtggtcttactccacgtctctgcagcccgacagaagatcgtcagctccccgagatgtactcaatgggatttaccaacattgttgcccgaccaagccgcaacgggtctgagcttagcaagcagganatggacgaaggtgttgagattctccacnaaaatgtcgcaa

SEQ ID NO: 1169 - DNA, 622 bp, Fusarium venenatum
  misc_feature (1)...(622): n = A,T,C or G
gctaagcattttctctactttgacgaagacagctatcgaaccgaaccgatatcgatactataccgactcccattatgtccgaccctgtcgctgaggtcaccgagggcactgtcaagctcgtgcttgacgaggtgacgggcgagcaggtcacgcgcaatgagctgaaaaagcgaacccagaagcgagccaagaaggctgctgcccaggcctcgcgtgaagagaaggcaaagaaccaggaggcgaaccccaaacctgctgcgcccaagcccaaggctcaggagcctacccagcttgaccctgatgccatgttcaagcagggcttccttgccgatgtttacaaggagagacctgtgaagcccgttgtcacccgattccctcccgagccaaacggataccttcacttgggccacgccaaggctattgctattgactttggatttgctcgctccacggtggcaagacgatccttcgattcgatgacacgaaccccgacgaagaggaggagattacttcgaatggatcctgaagatcataagtggcttggatttgagcccagngccatacacattcagcgacaacttcaaaacttttngatctngcaaggacttgtcaagaaggaaag

SEQ ID NO: 1170 - DNA, 579 bp, Fusarium venenatum
  misc_feature (1)...(579): n = A,T,C or G
ntttngtttcnttccggcntcntgtacataatccatacnccaacatnataaccccggcncccgatttcataatttatcgagtccgacattactccttttgaccctananaccagatcgngcggagaaggcaactatcagtagagcctcatccaaaattgcnaaatctgcatccatcgttgagccggcncctctgccgggtttggngcgctctcgacntcccttgaaaatccacgggaanaaataattctcacgccaggtcgtactcataaccgcagcaggtctccaaggtgaacagcctctggttgatanaacaatgtaaataagggaagtcggcaaaatagatccgtaacttcgggataaggattggctctaagggttgggtgcgttgggccttgggcggaccccctgggagcaggcccccactagtcgggcaaccgaccggaggcagccagcatccgggtgctgatcccttggcangcttcgccgcccgcgcncgtttaacaaccaacttaaaactggtccgacaaggggaatctgactgttaaataaaacatancattgngatggncaaaaggggn

SEQ ID NO: 1171 - DNA, 734 bp, Fusarium venenatum
  misc_feature (1)...(734): n = A,T,C or G
caggtaaaggcggagaatcccacgttggctctagaagtgccttggggaaagagcggcatagttcagacacggacgactacctggaaacgagaagctgctaccaacccaatattctatatatttccatgaactctgttgactccatctctcttctcgcatcctaatacacatcaaaccttggccctttcatcatcacaaaagaaacccaacaccaaaaccacaaccctcaccaacacattcaaaatgtctgaactcaaggtcggcgccaacttccccgaangtgtcttcttcagctacatcaagcccactcctgagatcgctgaattctctacctgcggcgctcccaccaactacaacgccagtcatganttcaaggataanaaggttgtcgttgtctccgtcccngtgcttcactcctacttgcagtggatctcacgttccttcctacgtcaaaaacatttgacaaaatcaanggccaagggcgttgacaagtatcgtcattgctgtcaacaacccatttgttcatgcattggttnggccaaggccaatggaattacaaataacaaaattctcttatgtccaccacaatgccaagttttcaccacattcggtggaactgggcaaaaaactgccgttccccngattgtgacatggaggatctttcccctcaagatnacccgcacatcaaaatcgggccctggngccttgctattggaaccatttctcccaaaatt

SEQ ID NO: 1172 - DNA, 533 bp, Fusarium venenatum
  misc_feature (1)...(533): n = A,T,C or G
ctcacttgtcctgcctgttctttatcagttatcctacttcttctctagtaggcgtgactaaaggacgagggttgttcacatagttcttttccgtacaatccaaacttactttaccttctacaacttttcgcaagcttgctcactcaaccccgcaccctttaagcaacacaagatacgagcccgttctacggcaaagcttatttatttccgttcattatagaatcgggaaactaccgcaaaactcgaaccaaagttattcatatcgagaccgtcatgaatttcctctactcaacagtcaacaccctccgggatcgctatacacccgtatcccataagtcaaccttccgccagactggtcaaatcacacccgaagatttgttgctgctggtgactatctcgtctacaanttcccgacctggtcctggggcganccgantctcccgaacgccgantcanccatctgcctcccggcnagcagtttctcgtcacacgcaagttncctgccacgtcgttaaacaatanttgcttgggaa

SEQ ID NO: 1173 - DNA, 629 bp, Fusarium venenatum
  misc_feature (1)...(629): n = A,T,C or G
gagtcgaagggcaagacaattgttattaccggaggcgccaatggactgggatctttcatggttcgtgagtgggcttcccacggcgcaaatatcatcattggcgatgttgccgatgcagctggcgaggagctcgtagcttcactcacagctcaatatccggactcggcctttgcctttcaacactgcgatgtcactgattgggagtcccaggtcagtntatttgagacggccgttcatgtcacccctcatggnggaatcgacattgttgttcccaacgcgggcattattctccccgacgtttntattcagttcgaggagcctgttctaaanaatggccgtttgcccaagcccgacangaaacagttngatgtnaatatcacnggngctacctacaccantcacctcgccctttactgggtgcctnanaatggatcttnccctcgggancgatgccttnttttggggggntccttgtttcctttggcccttccccacccanaccatgtacacgangagcaagcctgccatccttggcctttttcccnacttttccgngcnaaaatttttccggaacggngtccggngggaacatgancaccccctttacttcttttaaaaggnccaacatg

SEQ ID NO: 1174 - DNA, 623 bp, Fusarium venenatum
  misc_feature (1)...(623): n = A,T,C or G
tggatctaccgagggtaggctatttctttgggagacatgcaccggacgacaagtatccacgccgccttgtcacgttcaggccgtctcatgcttggccgtaacgccatatcacattctttccgggtccgatgactccaacatcaacgtctggtcgttatcccgtcttctagagctcgacgcaaaggctgaacaggagcccgatctgacactctccaatcaccgaggtgccatcacaagtctaactgtcagtcctggtaccaattcggaaactggcatatgtgtgtctgccagtaaagacaagacatgcatcgtctggaactatcagacaggccagctcctccgtacggtactgttccctgcaactcccctctgcgctcgtcttgatcccagtgccagggcactctttgtgtcatccgaagctggtgctgtctaccttgntgaactattcggtggagacaagccgttgcttggttcccgcagcactgagcaaccttcattgtcgtgcagatcaacaccccgcttgctgtctcggatccggaacttggacaaccatcgtgtattgctctgacaaacgacggacttcaatattgnctggacacaccaanggcaagatcatgcgatgg

SEQ ID NO: 1175 - DNA, 621 bp, Fusarium venenatum
  misc_feature (1)...(621): n = A,T,C or G
gagtggtcangcanggtgccattccagatctgcgaggagattgctaagcataccttgaagcgtcacctcaaggttgatagcggagacattactgcatttggcgcaggtttctccaacatagtcaccttctcgcatatggataangaggcttttgacnctgcccgacgagctttccaaactctcgaatacgatattcgaaacctcgaagatttaccattgcagatccgacaactttcagcagtatcaccagctgccagatatgcttccgttgatgctcccacacctggcttccatacaggaaccatcgagcctatagatgtcaacatttactttgaggcatcangccggtggccggagaattcggtagctattcaagagaccaagattgagtttttactcgatttcgataggcgtctgacatcaaccanagagaatatcaaaacttaccttggtcgagacaacaagganattgggatcgagaacttggcctatctcgatatcgtctatgatactggagcagcattccggttgaggattcatgccgatttggaagacatcctgcttgagcgacagatcangaacaagacacttgaccctcgtatccnttgagggagtcacaag

SEQ ID NO: 1176 - DNA, 301 bp, Fusarium venenatum
  misc_feature (1)...(301): n = A,T,C or G
ngtcgaggntgacggcaagcacattgttgntggtntaaagaangaatacgtncatgctcngaacgctccactctgngctattgagcgaacactctgctncttcttgagaactaccanacngaggacggtctcattgttcccgangtgctgcgaaagtacatgcnggntgagcccgagttccttcctttcgtcaaangaagccttcnaggaggccnagaangtctganaagaanganaagaccctncctgtgcgagagaaggcataaacgaaatcacttgntaaatgatatgcgatgatata

SEQ ID NO: 1177 - DNA, 384 bp, Fusarium venenatum
  misc_feature (1)...(384): n = A,T,C or G
naaacaaaatncattccncaacccaagggntcnactcttcccantacaaagtcntntccatcatcttctccagctttcaaaanattctattccttgatgccgatgcctttcctcttanaaaccccgatcatctctttgacgtggaaccgtacaagggtagcggactggtaacatggccagacttctggctgcccaccatatctcctctgttctacaagatcgctggggtcaagatgccaaacgtgacaatcgactctcgaagctccgaatcaggggtcatgctttacaacaaancaaganacgccgacagtctcttgctggctgcttactacaacttttacgggccaagattttattaaccagcttcactcccaaggcgcttgg

SEQ ID NO: 1178 - DNA, 302 bp, Fusarium venenatum
  misc_feature (1)...(302): n = A,T,C or G
ncccttgccaaagcctgcgaaaatcatgccaacagtgccgaactgggaagctctggtcaacatcacccaacccgagagctggtcgaccaacgcctgctatcaaatgacaagnaatcttcattttaagcaagcctcaagtgggnccagcgattaatggagatggtcattttcgaccgtgtccgtnaggaaatctacgaaccaagaagctcaacgttcacttgttcaactcggtcaagaaagctcttttcaaacnttgctggtttctttaagggnttccttttccttttcgttggcaacgggac

SEQ ID NO: 1179 - DNA, 495 bp, Fusarium venenatum
  misc_feature (1)...(495): n = A,T,C or G
cccagtccaagacaagcactgtcctctttactcaactcgcggagtacaagaaccgaggcgagtttgcgcagcctcacaccaccattacacaccacctggatctcgccgatgaccgaggtcttgttctcatgcagggcaatgtcctgcctgacaggggtgttacaccagagaacgccaagtggcttcttatgtctcttcagcgattctatggcggatgggaaagcgagagcgctgagttgagcggcgagcgcaaggaaagggctgaggagagaaagaactgctgggctggttcgcagctggtgatgggagattcagcgttgacaggcttctggaagagctgancgcatgggttgatcagaagacatgaatactgtgaccatgaattttgacctcatggtagagtgaagggacgatgtttaagancgaaacaacagtcgtgcccatcaattttgttaaataaatagataccgtacgataattcatctacttgacctn

SEQ ID NO: 1180 - DNA, 308 bp, Fusarium venenatum
  misc_feature (1)...(308): n = A,T,C or G
ntcctaaacatncntcctgtcgttcntatnaacgttggccagcacggcccctccacagccgataagctnaagatgggtgccatgatgggtggaaccggnggtgtcatcatgggctttgtctttggaaccgcaacattttccgatacngngctggtcctaacggcatnatganaacccttggcaatacatggntggttccggggcgacctttggcttcttcatgtccattggcagggcattcgatctgatgctgaccccaaactgcacganatgtatatgcnaaccccaccccnnctataatgctgatg

SEQ ID NO: 1181 - DNA, 533 bp, Fusarium venenatum
  misc_feature (1)...(533): n = A,T,C or G
cttcttcttcttctagtcattccttgtcactctttacttgagttgccttcacgtgtcctcccaccgtcgtcgcgtcttggagaanaaagccacgtcgaatacgtaacccgttctacctcttcaacctaataaagggtctcgtggtctcaaattgtgtcgctcccaacgatcaattaactcgcccatcatgtctgcgactcccgctaccttttacgagcaagctgccgctgcctaccatcgaccgtccctttggtattcacctgtggcccatcttcgacaaggctttcactgctgttgtcggctactccgccaatgacttcaagtttgtgcctttcgagactcccatgtccaccctcaagtcgacatcgatcttcattgncatctactactgcatcatcttcggggggtcgcgagtggatgcccaacccgngagccttttaagctcanggggtctttttttgatccacaacctttacctgactntgaacagnggggctctcctggctctctttattngaccantttctncccca

SEQ ID NO: 1182 - DNA, 510 bp, Fusarium venenatum
tttttttttggaaagtttcatttaattcatcccgacgaccctctatagtgtcttctagaatctaccaataaacccatgctttggatatccatccaccttaaatccaatactcactcacaaacacaaacactttcaaacaacccaaccccaaacaaccaaccactatcacaatggagtccctcaagcaagctggcaactacgtcgctgagaccgttcagcaggctacctctggtgcttccaaggaggccaacaaggaggttgccaaggatagcaacgtcgccgccggtacccgtgtcaccgctgccaaggatgccctgtccgacaagttcgaggagaagtcccacgagggcaaggccgaggttcacaaggaggctgctaagcagtaaatcgaataacgacatgacacggaaatcactttctgaagaaatggatcgcaacggcgttgaaagggaatagcgttgggactacataggctgtatacacttacacctaatacaaacagtcaaatcc

SEQ ID NO: 1183 - DNA, 1052 bp, Fusarium venenatum
  misc_feature (1)...(1052): n = A,T,C or G
ggagtcgtcttcgtatgcgagtgttcgggtgtaaaacccctacgcgtaatgaaagtgaacgcaggtgagagcttcggcgcatcatcgaccgatcctgatgttctcggatggatttgagtaagagcatacggggccggacccgaaagaaggtgaactatgcctgtgtagggtgaagccagaggaaactctggtggaggctcgcagcggttctgacgtgcaaatcgatcgtcaaacatgggcatgggggcgaaagacttatcgaaccttctagtagctggtttccgccgaaagtttccctcaggaatagcangtgttgaactcagttttatgaggtaaagcgaatgattagggactcgggggcgctatattgccttcatccattctcaacctttaaatatgtaagaagctcttgttgctttatttgaacgtgagcattcgaatgtatcaaccactnaggtggccattttttggtaagcagaactgggcgatgcgggatgaacccgaaccgcgaggttaaggtgccagagtagacgctcatcagacaccacaaaaggtgttagtacatcttgacagcaggacggtggccatggaagtcggaatccgctaaggactgtgtaacaactcacctgccgaatgtactagccctgaaaatggatggcgctcaagcgtctcacccatacctcgccctcagggtagaaacgatgccctgaggagtaggcggacgtggaggtcagtgacgaagcctagggcgtgagcccgggttgaacggcctctagtgcagatcttggtggtagtagcaaatacttcaatgagaacttgaaggaccgaagtggggaaaggttccatgtgaacagcggttggacatgggttagtcgatcctaagccatagggaagttccgtttcaaaggtgcactttgcaccgtctggcgaaaggggagccggtcaatattccggcacctggatgtgggttttgcgcggcaacgcaactgaacgtggagacgacggcgggggccccaagcagagttctnttttnttcttaaaccaagggcntt

SEQ ID NO: 1184 - DNA, 640 bp, Fusarium venenatum
  misc_feature (1)...(640): n = A,T,C or G
gttggatgccctgcggcctaatctgaaagaagcaatggagttagatgaccactacaactacttaggctctgcgcccagcctgaacttgaaggatttgcaaaagacatttttcaagacgggtgttttacagatcgtgtcagctcgatctcggccagatgctttcatgacagaacaaacagcaagcaatcctgctgaagcacaccccggaattgtcgacataaaggtcacaaaggtgggcttgctttggcggaaggatgcaaagaaacgcaaggcacggtctccttggcaggaatggggagcaattctcaccggggcacaactctatttctttcgaaacacaggctgggttaagtcacttatgcaccagtcgataccatatcaaagcagggcatgatggcataccggtgatcttnaacccacactttaagagttcaaaccagatgggcctatgtctacntatgccgaagttgcttttatgatgccggttataagaacataaaatgcttttgtatacgtcnacaaggtggnctggaaaaaggcttttggnnacaatgaggngagatgaatgactgggttcgccaacntaaatatgcagccgcnttccggaccacaagggttaaaaaccccgnntcctgggccg

SEQ ID NO: 1185 - DNA, 637 bp, Fusarium venenatum
  misc_feature (1)...(637): n = A,T,C or G
gtgagagccttgctcanaacgttgttgctgcagccaacaacccctttgccaggacaacgattctttatctcttcgaggggcttgccaagtctctattcccccccagccagtcattcgaggttgagattctcaaagaggttcacgagatccgtcagacaacgagtaagaaggatgaggacattcgccgcaatgaactcgtcactgctatttcgcctcagctcatctctgtcattggtgaggttccttccnaacttactgccaccgcttttggctgccaatttgtcacagatgtcctcctctcgggagttggtgacaagcagcaggctcttgaggccatcgcccagtcagccagtggcaaccccagcgaggaaccagcanatgatgatcttcagccccaggtacacatctcaaggactccccacggtggccgcatgctgaagtcgctgatccaaggcggcaaatacgacaaggctgccggcaagaatatccccgttgaccctctttcgagttcttcaacgtnctctaccagtntnaaggacacattattggactgggccccggacccanctattcgttgttcttggcttttgaggccgcgaantttggaaanaaccgatgcnctcaaaanacncttaaa

SEQ ID NO: 1186 - DNA, 637 bp, Fusarium venenatum
  misc_feature (1)...(637): n = A,T,C or G
tgatgctgacaaccaggatgaatctgagctcantcttgtcctgcgagacctcgagctggacatcctcccaggacaaaaggtcgcaatctgtggtcgtacaggaagtggaaagtctactctgatactacttctcctacgactcctggaccctctctcctnttgttctgctaatatcaagatcgacaatgttgacttgcatgggattgaccgcgccactctgcgcaaacaaatcatatgcatccctcaagacgcagtctttccaccggatggaagctccatcaaagccaatctanaccctcacaatttagttacagacgcagagtgcttcagcgttcttaacacagtccgtctaaccaantttgttcacgacaagggcancctcaacgcaggcatgagcgccgaaaatctcagtgctggcaaaaacagnttttcagtctcgggcgacaattctacgtcgtcgagctcganataggggcnaaaaanaancaagggggcttgcttctgctggatgaggggagccacagcggnggacagaattacagaccgggcgatgccaagaanatcatnaaaanatgagtttgagagttnttctnttatcattggnttcccatcgggtngganatggttgggaaantct

SEQ ID NO: 1187 - DNA, 702 bp, Fusarium venenatum
  misc_feature (1)...(702): n = A,T,C or G
cttgtctattttcctagtgcttctccaaatataccagtcgcttactgataagctggactattaaaaagttgcctttccctccttcttcaacatcagcttccgaaacttgagcgtggtctgttcaaccccaccttcataggctatattcatacagtcttgggctgctttgcgagacttaaaaaagcttcttcttcatttccctagccagattccagagatcattcaatccttctcactgagcattaaaccatgtcaaccccccgtgttttcctcattcgccacggtgagacagagtggtcgcttgatggtcgtcatactggcctgactgacatccctcttactgccaatggtgagaagcgcgtgaaggcaacgggaaaggctcttgtcggcccggaccgtctnattgctcccaagaagatcgctcatatttatgtatcaccccgaaagcgtgctcagcgtacatttgaactgctcaatctgggacttagccgtcctctacctggacaccacacggcgacaccctgatgggactggcctgcagtgtgaggccgaagtcaaatgacaaaatatatcccagagtgggactatngtgactaccaaagaatcacatcttctgaaattcgcaagancaaaacccnaaaaggggatcaaggggtcctgggatatattngaaaggatggtgtccncgtgganaaanccccn

SEQ ID NO: 1188 - DNA, 671 bp, Fusarium venenatum
  misc_feature (1)...(671): n = A,T,C or G
antaaattcatctctctcaacacacaacaacacaacttcttctccttaacaaccacaaaaaccatccaaaatgtctctgcactaccttcctcccgtcaagccctccgccatcgctctgggcactgctttcaaccacggtgttgagctcgccgtcctcgcccccatcttcggccagacctaccagcgcgccaagtcctcaaacaccaaggaggagttcatccgctccaaggaggcttctggtgctgccctcgcctggggttcttccctgactggctctgcccttcaggcctacggtgtcggtgctctcatcaacgccactggcactctcacctacaagggcgctgcttacctcggcgctctcatcttcttcgccacctctgcttccggctacgtctctcagatcttcgtcgagaagcgacctctcgacaccgtcggcgtcagcctgctaccaagctcgttgagaccntcggtctctccgtcttcctcacttggtggggaacccgaaccaaccctttggagtaagggactctctatgacgaatgtttttaatctnccatgtcnggatgggttttcatgaaattngtatancgaggcctcggcccgggtgagaagtaataaggacnggaatgacntataaaaagcaataaggcaatattccaacaaatgaccnt

SEQ ID NO: 1189 - DNA, 851 bp, Fusarium venenatum
  misc_feature (1)...(851): n = A,T,C or G
tacccgtaccgctttgcacagcactgcaccatatcgacaaaagagagaagcacggcatttccttgtccttcaactacaacgtcagcgttccagtataaaatcaccttcgccatgaaccctcaccagaagaacaaggtcgacgtcaagtcactcactcccgaggaacagcgtctcttccgtctctacggcaagctgccctcccgatccgaccacttcgccaagcatctcaaggaccgcaagtatttcgactcgggtgactatgccatgtccaaggctggcaagggcgacggcgttgatgctggtgccgtcggctctcagcaccccgtcccggagaacattccccacctctcctccccagngaacggctccggaaccaacgcccccaagcaccacggctccgtccccggcattcaggcaggcagccctatcaaagagagcagcttcctcaagagtgagaccagcgtcgatgagtctcagggagacgacgtcgacaaacccnagggtacagacactgctgctgcacctgagcccgttgccgccgggggcgaaggcattcccatccgaagatagaagaacaagtcgtaataacatgggggaaaaacacaaggcgggttgcaataggaacaaccncatganctttttttatcattgggttttttattatggccnaacacgaantggnggtttgtcgaantttngtgccgtgggcttanaagggaatggcananttgttttgacgacttacnaggatcccacaatttgcntttgggaaangggaaaaaaatttggtttggnccccaaaagggggaanntttttatttgnaaccctgaaatanggtagggtggtttaa

SEQ ID NO: 1190 - DNA, 537 bp, Fusarium venenatum
  misc_feature (1)...(537): n = A,T,C or G
atcaaccgtcgagcgaacaacaacgtccacgatgtccgccgtccgattcacccgcgctgccacgcgcgctaccgcccagcttcgcgctcccgcccagcgccgatttgccagcacacagaacgagttcatcaaggagcgtcagcaccatcaaggagcacgctgctggtaccactgaactctggaagaagatctctctctacggtgtcgccccctgcnttattgccgccggtgccaacgcctactggctctggaacgagcactgggagcactggtctcacatgcctcctctggaggagcgcaccgagtacccctaccagaacatccgttccaagaactaccagtggggtaacggagacaagactctcttctggaacgacgaggttaactaccacaacaaggacaaggtcgcctaagtatgatctgttgatagctcatacgttggacaattgctggatcgctnctttaaggactactccctctggagatgcttcgtacatgttccctagactcgaattggactgatngttgaanaaaata

SEQ ID NO: 1191 - DNA, 603 bp, Fusarium venenatum
  misc_feature (1)...(603): n = A,T,C or G
aattggacaacgcccgggccatgcaacccgcccaggagtcgcgccttctctgtcctcttaccattcccgaacaacccgtaatgagtcacccgctgttggtatgtccatgaacatcccaactctgacgcccaaggcgcagccacagcgtcccgccggaacactaagcaaactgagtggctactggaaaggcagccagctgtctggcaccttctcaactcttcgtggccggggccccagtgcacagaacgttcatatctatgaggccagtgaggcacacgacagtgctgaggatgtgagggagattatcgagcggcaggatagggatgctgaccgtctcaaaaatgtccgagcatgctgcgatggcaagcatgatgttggaaccctccaccttacctctaagcgaggccgtcctggaaacaaccacgcgcactctacgcactctcagcctggacttacacactctcatactaccatgtcttctgtacgctctcgagtttaagcagacgcatacatatcacaactattccgtccctgtaaatacctttgttgaccatttcactggttgtcaaactcacctgttacgatcgacatncttacggactt

SEQ ID NO: 1192 - DNA, 594 bp, Fusarium venenatum
  misc_feature (1)...(594): n = A,T,C or G
ttggactataccttatgtcgttggtgatatacccgttcctttgagggccatgacgtgtactgctgtaggcaagaactcatcgtgtttggcggaggtgacggtccggagtactacaacgatgtttatgttttggatacaacaaactttcggtggacaaagccgaagattataggagacaagatgccctcaaagcgaagagcgcacactgcttgtctttataagaacggtctttacgtttttggtggcggtgatggtgtccgggccttgaacgatatatggcggttagatgttgccgatgtcaacaaaatgtcatggcgactggtttcaagttccgataaggcgagtcctggggaccaaagactaccgtcccaaagcaagaggttatcacacggccaatatggtgggcagcaaacttatcatttttggtggttctgatggcggtgaatgttttgacnacgtatggggtatacgatgttgacgcgcaagtgtggaaagcagtggccatacctgttgctttccgtcgcctgtcacatacggncacaatagttggctcatatctcttcgttatcggtggacacaatgggagcgagtatc

SEQ ID NO: 1193 - DNA, 1020 bp, Fusarium venenatum
  misc_feature (1)...(1020): n = A,T,C or G
gtttgttacatagtggaatagcgatggagttctctttactgtgtttgttgtgtgtattgacgccagtaatggcctcgttccctggaggctttgagcttccgtcttagctcaaattctctcctcctctcgcgcgcagataaccccgttagcaaagacggcaactgtggctctaattccgatttcaatgcaacatgcctcacatccacttttggtaactgctgttctgaaaaagggttctgcggcaagactgtggcatactgcgccgaaggctgccaaagtgtgtttggtacctgtggaacaggtagtgggcagcttgttagtacctcaggatcttgcggtgcgacatcctctagcaacattacatgtcaaggaagcgagtttggaaactgctgctctganaagggctactgtggcaagacttcgacgtattgtggtgctgggtgccaaagcgggttcggtacttgtgaatccgatgatgagtcctcttcggttactacagccactacagcaactcgtgagacttcaacctcgatagcagcatcagaaacgagccttggtgctatctctgttgatggtaactgcggatccaattcaaacatcagcgccatctgcgaangcagcgagtttggtgattgctgttcggaaaagggatactgtggcggaagctcgaactattgcggagcgggctgccaatctgaattcggttcctgcgattcgacaagctcatcagcaagtccatcatctagctcagacccgacaagctcaccactaagctcagactcgacaagctcgtcnacaggttcccttagcaccggtgccaccggttgggatcgcgatcgggtctgttattggtggcctcggattgataagccttctancctggtttttgatacngaagaanaaacgaaagccgatatcccagtgatggaanttngtgaagaaaaaacccacaatgccccnaagtntgaactgaaangggaaaatcatctgaattaaatggaagaaggaccccgctgaatt

SEQ ID NO: 1194 - DNA, 360 bp, Fusarium venenatum
  misc_feature (1)...(360): n = A,T,C or G
gtgccgnttgtcgagcattggtgcgccaggtccagagcctgatcaaggagcgcagccaagaggacgaccaggtagactacaccaagcttggcgcgcacgagttcaaggtgcgggaaatggaacagcaagtcgagatcctccaattggagaacgccttggcatcggctcgtcatcgtttgggcgagatgcggaagatctcttaccaggaagagtaagggtgtgaatatgggcttgntgacaggtattcgnggtattccggggccaaagagtgttncggctggccttatcatcttgaggtagatgttcaaattaagacatttaatcgcagggattctttgcataanaaaaaanatggtttaa

SEQ ID NO: 1195 - DNA, 1424 bp, Fusarium venenatum
  misc_feature (1)...(1424): n = A,T,C or G
ctcaattgtgactattacattcattttcggctttgccattacgatcattccagctctacagcaacttgcgttttctcgcgtttcaacttgaatactttctttagtgaagcaaaactgtgtcttgcttgctacctgaactgtggaatcgatttctacagccattacatcgtatctacgttgtcatagacaaaactgaagctaccgcaaaaaacctacatacccaaccttcaaaatgaagtccgtcgtcgctagcatcggcatgatcgccgccgtggccaacgcctaccagttcccccagcacgcccactaccgccgagactacaacggaaccgactctcagaccactctgaccgtcaagaccaccgtcgtcgagaccatcactagctgcgcccccaccgtcaccaactgccccagccgtgaccagactgccattgctcagctccctgagtccgacaagaacaccctcactgcgacccacaccgtcatcctcactgaagttgtctgtcccgtctctgaagccagctccatctacacctccgtccttcacgatgccgaaaatggtggtgttactggcaagaccatcactgctgagggtcccatgaacactggcggtgcttacccccctcccaccgagaagactattgtctccgactacaccactgatcagggtgttactcttacccagggtgaggagactatcaccaccaccatccacaagaacatccagaagactctgaccgtccctgctggccctganggtcaccaacgacggctccaagggcaacggtacccctgaggatgacaccaccaccaccaccaccaagaccactactggcaccatcaccaagaccatccagcgtgttgatgagaccggccccgctaccggtggtgacaacggctacagcactggtaagggtgagggtgaggacgatggctccaagggtaccggcaacggtaacggtaacagctccaacaacggtggctccggctccggctccaacaatggtggtaacggcaacggtgagtgtgtccctgagactgtcaccgtcaccgctcctgcctccactgtctatgttactgttgtccctgaggctgccaagaccaacggtgctgatgaccctactgtcactggcaaggctgttgagggtgatgactcttaaggatgatnatnaaggacgactccgccgaggataagatcttgcgacaccaccaccaccctcgacgctaccggtcactgtcgtccctttacccccgttaacggcactgctaccggtggctacgccaagcccactggcttctntcgccgtcttcggtaaatgtncacggacaacttccatgtatatgaagtcttgtcagtacattaatcaccactttgggtactttnttgggtaggcatctantgaaagaaaggcttcctttggata

SEQ ID NO: 1196 - DNA, 588 bp, Fusarium venenatum
  misc_feature (1)...(588): n = A,T,C or G
aagttccgactaccctcaaggacatctcctctgtccctgacggtactgccggggctcaagccggactcgacnataaacttgccgggctttcgctgtcttctcgcgcagttcatgccgataatggtatccagtcacacagggcagttgcaccggntatgcatgtcagcacnactttcaggtacagcgaccaccctgatgcgctgaggtcctgggataacactgatcctnaaaaccctctcgactctnatgtctactccagagcaactggtccaaacactacccgctnnaagctgtcttgacatccatcattggtgctccaaccgtaacttactcgtgtggtctatccgctttcacgccatgctggttcacttgaaccccaggcgcattgccatcggagatggctaccacggttgccacggcgtcatcagcatnatgtttngtttaaaaaggcctcaangnctcccccttgactgtgccgtcgangactcgagcctggcgacatnngccacgtnganaacccnttaaccaacaggngaggcccgcgatttgnttgttnttcaaaaaaaggnaaaaaaaggtggggcttac

SEQ ID NO: 1197 - DNA, 511 bp, Fusarium venenatum
  misc_feature (1)...(511): n = A,T,C or G
tgcaattgtgcccagctgcgacgtttggcttgataacaccaagacaatgagctacgcgggtggcaatgcagatgcagaagatcaggacatcaaagatactgatgtcaaggctgacaaananaaagagggttggctcantttcaanaacnaaatcattcgcatcgcccacaccttgaggctcaagggatggaggcgtattcccctgggnggtggtgacatcatttctgttgtgaggttgagcggtgccctgaccaatgctgtatacgtcgtcacgcctcccaaggaaatcgatgaggccgacggcaggcnaaagccctccaaagtcctcctacgtatctacggacctcaggtcgagcacctnattgatcganacaatgaactctcagttttgcaaaggctggcacgcaagaaaatcggacctagattgctcggcactttccanaatggccgcttcgagcagtacttcgaatccatcacactcccccgagggatcttcgagaccctgacacgt

SEQ ID NO: 1198 - DNA, 244 bp, Fusarium venenatum
  misc_feature (1)...(244): n = A,T,C or G
gcgttcagaacggggcggntacgtgggagagtgaccccaaccggaaatataccgttccttcgacttgcggngtgaaaagtgctgtgcagagntatgtttggcggtgatcatcatgtcccgatgaanaggaggaattggtacgtggtattgganangtggcgctgtcatattcagtntatatgtgngattctgtgaaatcncaacgcatagagaccaaaaaaggcccacctattcgtgtgnaata

SEQ ID NO: 1199 - DNA, 589 bp, Fusarium venenatum
  misc_feature (1)...(589): n = A,T,C or G
caacttgatacccccaattgaccttgtatagcatcactgtctcatctcatcttgcatcaaaagctcgctcatcatggccttcactacaaatgccaccatcaacagcttcggtggacgcttcctcaagctgtctcacaagtccgccgtcactggaactcccatgaacgcaaccctttacctncccggctccgcctcatcttccaagcccgcgcctctcctcgtctatctctccggcctcacatgcactcccgacaacgtcacagagaagggcttcttcacgcccacgcctncaagcttggtctcgctcttctctacccagacacttctcctcgcgagaccgacctgccggtgagcacgactcttacgactttcgnagcgtgctggttctacatcgatgccaagaaggaccctacaggcagnactncaggatggngacatncattaccaaagagtgctgacctcatnttcaggaggtcaaggaggtggctaatgggccgttcattttggacattaatggnggccccgggctttgncttgtctaanaccctgcaggcaaaaattcnaggttgggttcttttcaaccttttaa

SEQ ID NO: 1200 - DNA, 693 bp, Fusarium venenatum
  misc_feature (1)...(693): n = A,T,C or G
cgctcccaagggagatgctatcactcgccgatctgctgtccagaagaagaaccctctcaagaacaagcaggtcatgcttcgcctgaacccctacgccactgtcttcgctcaggaggctcagaagaagcagaactaaaaggattcccgacttgctgggtgtgcagcgggtttttacggaactgaatgacgggtctagcatggtttgatatcgaggcntaatggcttctttgaaggttgagctttcttaaaaatgaatcagagatttgatatgaattacaccaaaatnaaagtgggccccatcctcgacctcctccctcttggttactccaaggtcctcggaaagggccgtctccctgagatccctctggtcgtccgcgcccgctgggtcagccgcttgctgaggagaagatcaagcaggccggtggtgtcgttgagctcgtcgcttaagcgaagcatcgcaactgttctgtaaatgcttgaggagtcggttgggcttgtatgggaaattctacaaacggaaaacaaaacctctccaaccccggtgaaaaacaaagcctgcgggcactggagaagaaaaggtctccctgcgctcgggaaagatgggccagggacctaggtcggtcggcttcgggcattgcatcagggactcttgcacggagttaacgaaataaaaatcgattttcgcccatgatt

SEQ ID NO: 1201 - DNA, 363 bp, Fusarium venenatum
  misc_feature (1)...(363): n = A,T,C or G
cccgagcgtccgtctctccacgctattgtccaggacacgttcgatcccaacgcccaggtcataccgccactatcactaccactaccactaccactctcggtagacactctccatatctctccatctcgaaatcacatcccagtctgtcaacatggcctcccgacaacctcccgctggcgcccgcggcaccaacacccgtttcgcgcagttcaagctggttcttctaggcgagtctgctgtcggaaagagttcaatagttttgcgatttgtcaaggaccaattcgattcctatcgcgagtccactatcggtgctgctttcctgactcaaaccatctccctcaanaaaaaaccccggtcaatttc

SEQ ID NO: 1202 - DNA, 501 bp, Fusarium venenatum
  misc_feature (1)...(501): n = A,T,C or G
gggaccaggaaacaacatcggtctcctggcagcaaagacatgtgccactggagtgcgaggccgatattacggcatcgctgccgcagttggtaaaattggcgcttttgttggaacatacgtgtttccgtacatccaggctgccggaggaaacaaaacacaaagcgcacagtatcccttctgggtgtcatccagtctttgcattctttccgcactgattgtctttttctgcatcccgcatatcggccaagatacaatcaccgttgaaagaccaaaatttcgccgaaatatttacaaaacagggctgggacacggctccaaatgggcctccaatacactgatatccaaagcaggttacccagtgactcccagaactgaagaaaattaaattgactttatataaatcccgatttgcnctgcatattcccattacnaagggagcatttganccttttcatcggttnttgcacatccaatttttntccttttaacccccggaatacc

SEQ ID NO: 1203 - DNA, 623 bp, Fusarium venenatum
  misc_feature (1)...(623): n = A,T,C or G
ttttttttttgttcgttgaagactttgngatctattttcccttttcagacccgtctcccatgatcagatccctaaccgtaatgtcgatgcaagcaatccgaatagactccacgtgtcgaaatatgactttgtttccatccacgcgctcttcgcttaagaacggggcttctccttcttctccttccacagagcaaggagaccgacaccagagaccttgacgaccttgaatcgcacaccgggaatatcacccttggccttgcccttgcgcaacacacttttacaacctttcgaagtctttcttcaccaataccttcaacatgtctccctgctcttgctgtaaccacgccgacgcttcttgcaccagcgcttgctnttgctgcagcactaaattccttcttattattaatgcctgacaacacttggcttacaaccacngtcgcgacaatgtcttctttgacacattgaggaacattcaggaacaaagcctttgctaagcaagtcggacagatatgagaatggaaacaatgaatagaaatggnacaaaacatgcgaaaagtagctgtgacggccaattttcgatggtagcgcagnggtagatacaaaatggaacttgcattgccttg

SEQ ID NO: 1204 - DNA, 626 bp, Fusarium venenatum
  misc_feature (1)...(626): n = A,T,C or G
ctattccaaagctcttcgaagcagccaccaattgagtgccgcgacaacaccacaagaattctcaaaagacttcaaaatggcctcaattgcgcgttcctctctgcttaggcagaccgctatggcttctcgattggccactgctgctgtccccgcgacccgaagcgctttcatgcctagcatccgaactcagcttaagagcgttgctgctttccacaacaccacccgacgatctgctattctccctcccggacctcagcgcattgagggtggagtcaacgatcctgctcccgttcccgagcccagctccactcacggttcctaccactggactttcgagcgtctcctcgccgccggcctcgtccccttaaccgtcgctcccttcgctgctggctccctcaaccctaccctcgacgccatcctctgcagtgtcctccttcttcactcccatatgggtttccagcaggtcgtcatcgactatattccctcaaggaacctaccctggtctccgcaagaacttcaactggcttctcaatattgctacggttcttgtcggcgtgggactgtacnanttcganaacaacgactttggtatcaccgaagctgttcgacaagtttggaaggcgtta

SEQ ID NO: 1205 - DNA, 720 bp, Fusarium venenatum
  misc_feature (1)...(720): n = A,T,C or G
cggagatctaaaggaatcgacatatcaccttcgttatgcagctcgtttgaatgacccaaccgccatgcttctctacgccctggcttgccggcatggatggggcatgcgcgcaaaccagaaagagggtgtggaatggctacgaaaagctgccgaatacgctagcgtcgagatcgcagatgatgagagccatgtaaaggaaggcaagcatgtcgatgtgatagaacgaagaacccgaaaagcccaatttgcgttgagtatttatgagttgggcgtgagccatatgaatggctggggaatcgagcaggacaagtctctggctctgcggtgcttcgagatcgccggtaactggggcgatgtcgatgcgctagctgaagctggtttctgttatgctcaaggtgttggctgcaagaagaatcttaaaaagagtgccaagttttatcgcatggcttgaagccaanggtatgagcatggttgggaacagttggatccacaaggcttaatacgacgacgacgacaacgaagtctactacgttcaagaaggacaaaaagaangccaggaacaagtccccaccanaactatgtttggacggaantaaccgaaggcncacttcagtgaccncttactacnataatgatactctccactaccnnttatccgantttgactggtttccctgatcnggggttcatggggtctaggaagaaanatctttnctcctc

SEQ ID NO: 1206 - DNA, 596 bp, Fusarium venenatum
  misc_feature (1)...(596): n = A,T,C or G
aaggacggttctcgcaagtatcaccttgatatcaagctagatactcttgtgtccaagattcgcttcgacaagagtggttccaagcctcgtgccgttggcgtcgactatcttgaaggctccagtttatacaacgccgatcctcgctctacgtccacaaagcccagtgactccggtagtgttaacgccaaacgcgaagtaattatctctgctggtagctttaacacgcctcaactgctcaagcttagtggtatcggacctaagaaggagctcgagtctttcgatattcctgttttagttgaccttccgggtgtcggaaccaatctccaagatcgctatgaagcaacagtgattggcaagacggcaaaggattttgtcatcacatccaagtgtactttcatggagacggatcctgatccttgtctggaagattggaagaaaggtctaggacctattgacaaaggtgtatacgccaccaacggaattgcactgggcagctgttatcaagtcctcagttgctgagaatgaaccagatcttctggtttctggcgcgcctgctaagttcaaagggtacttccccgggtacgctcntgactcac

SEQ ID NO: 1207 - DNA, 599 bp, Fusarium venenatum
  misc_feature (1)...(599): n = A,T,C or G
caggccccagggcatgacacctatcaatccgccaaagaagaccaagccagtgcggtggcaatttggcattcgatcacgtaactctccctgggaagccctcctctgtattcacaaggcgttgtacaaattaggggccacatatattcccgacgaanattatgagtcgaggacagcagaagagcgagctgaagcttccggcgatagcagtttcgtggactcccatgatggttaccgtggttccacttcaagtattgatcctaagaagcgttacaatcttcctgccgacccttggcacatcaacgtgcgctgggatacttctgctattaaaaagaagctggaaacacgcccagtacacccagtactcccagttcgcccagtacaccagatggtcattattctaaggaccatttgttgcgctgcactggacatacagatctacnaaatggancatgggtntacctcctcaattcaaatgctcaggatacaaaacnctcacnggcantacttgaaganaaaganttaccagcccttccctttctanacttgntgccaanttgaatatgcacttgcaaaggcgaataaaanaaatttgctggttg

SEQ ID NO: 1208 - DNA, 581 bp, Fusarium venenatum
  misc_feature (1)...(581): n = A,T,C or G
cttgactctgtacaacaagctggtcctcggaatgttccacttcccgtggctccttactttcctccacgcttctttcgccagtactggcacatatctcatgatgcagatgggttacttcaagctctctcgactgggacgccgtgagaacctcgctctcgtcgctttcagcgctctctttactgccaacatcgctgtctccaacctgtctctagccatggtttccgttcccttctaccagaccatgcgcatgctgtgcccgatcttcaccattctcatctaccgtgtctactacggccgtacctacagctacatgacctacctttctctccttccccttattatcggtgctgccatgaccactctcggtgagatgagcttcactgatgctggtttccttctcaccattctcgganttgttctcgccgctctcaagactgttgtcaccaaccgattcatgactggctctcttgctcttcccccaattgagtcctcctccgcatgtctcctctcgccgctctacaggctctggcctgcccactgccaccggtgaagtcagcgcttccacaaagctcatcacctcc

SEQ ID NO: 1209 - DNA, 633 bp, Fusarium venenatum
  misc_feature (1)...(633): n = A,T,C or G
tttcaaagtccgatcagtagcttgggaataccactgatcaaaatgacacaaacacaatcaaccgacaacccggagacccttcatctcccccgcattctttgtctacacggcggcggcgtaaatgcagaagtctttgaactacaatgccgagttctcatcaagcatctgagatcttctctgcgttttgtatttatgcaagccccatttatctcggctcctcatccagacattgtcagcgtttacggtgaatacgaaccctttcggcgttggctccgatggcaacccgaccatgaggagattgagcccgaggccgccgccgagttgatccgggaccagacccgccgagccatggatacagatcccgggaccggagagtggatcggcattctgggtttctctcagggcgcaaagattgctgcgagtttattgtggacgcagcaaaagatcacggagcaattcggaccagatgaaagccttgactcaattcaaggttgggtggtctcatggctggaagaagcacctntcattacactgggaccaccgactggaacaatccaccaccaattggtgacgccggccatgctgagctcaaaagttcaaggactggggctgagtcgaacaaagggggaacat

SEQ ID NO: 1210 - DNA, 1027 bp, Fusarium venenatum
  misc_feature (1)...(1027): n = A,T,C or G
aaatacttggccaatnggcctcttccttttcctcttttcctcatctccgaattgttcttctaaccgccatgcgtttcttccattcgcttctctcctttgccttgcttgcnacaggcgttgtggctgcaaaaaantcctccgccgagcgattcaacgaattccncgccaaacagatctcgacgcctctcaagctcaaggattccacctacaagtccttgacatccacacctcgagactacagtgttgccgtactccttaccgctgccgatgcgcgattctcttgtcagttatgccgagaatttcaccctgaatgggaactgctaggcaagagttggaacaaaggcgacaaggcagccgaatcgcgactggtttttggcacactanatttcgttgacggtagagataccttcatgtcgcttggtctctcaactgctcctgtattgcttctattccatcctacggtcggtccccatgcatcagctaagaaggaacccgatcgctatgacttcaacactggacctgcatccgccgaacgagttcagtcatggctcgctcgttctcttcctgaccgacctcaccctagcgttaagcggcctatcaactacgcaggttgggtagtctccatcactgctgtaattggagtcctcactgcggtcatgggtgcttggccctacctcgctccaattttcaaaagcccgtaaatctcttgggctgctatctcccttatggttatcctggtggtcatcaagtgggcatattgttcaaccacaattcgcaagggtcctttatgttactggtgatgggcgccggtgggatcaactacattgtcccaagttttcaagcagcaacttgggcttaaagacccaaattggggggccggcactttaatggngntctgtcattctgcggcatactcttgccattaaaggtccgncgaatcgctgatgccaagactaacaagtcgccgcaatcgggtttnggggggcttcttctttcttcgggtacaagcttnttggttgagcgnggt

SEQ ID NO: 1211 - DNA, 654 bp, Fusarium venenatum
  misc_feature (1)...(654): n = A,T,C or G
gacataacctgaacaagagggaattccctcagtactcgttatgtgaagctatgagaatcctccgcgccgttgaggtcggcgaaccccccgcttcgatcaagtacgagctacacatcaacctcaaaaccgcccgtaacggccctgtcatcaagaacagcgtccgtctacctcaccctgtccaaagcgattggcaaatcgccgttgtttgccccgaaggcagcgagatcgctcgtgaagccaccgccgcaggtgctgtggccgttggtcaagagaccctcttcgaagccatccgacaagaaaagatcaactttgaccgacttatttgccacgaagccagcgaggctgcctcaacaagggcggtctgggaaagatcctcggtcctaaangnctaatgcccagcaagcgtatgcgaaccattggtnccgatgtcgncaagnctatgcgagactntggcggngctggcgaatatcgngagaganaaggnggtattcgtctgggtattggacaattgggatactngnccgacaggttaaagaacaacattaaggngtgnttgggcaanatnaaggagaagggacccggaatttaaaaggaggggcttaaggaagtccatgaggtttttttnanacaacaaatggaccaggtnttaacttn

SEQ ID NO: 1212 - DNA, 640 bp, Fusarium venenatum
  misc_feature (1)...(640): n = A,T,C or G
cctacatcaacaaaaccgaacctcacaaccatcctcacaatgcctcgtcaacgatccgtcggtcgcgctccttcgcgccctaccgccgctgcttctgctcctaagccccagcagactcgacctgccgccacccacgctgctcccgccggttctcaccctcctgcccaggctatgcctcctcaggctgccggttctcagggtcctggacttttcggtcaaatggccagcactgctgccggtgtcgctatcggttcctcagtaggccatgccatcggtggtctgttcggtggctcctccgagcccgccgctcccgtccaggctcaagctgctcctcaagagcagtcctggaaccagaacaactgcgccggtattgccagaactttacaaagtgcatggacgacaacaacggaaacatgcaaatttgcaactggtatcttgaacaagctcaaggnttggcaggctgcttctagccagtaagcgttgacttggagattatacgaataaaaagacttggtatcattatnggaaaaggaaacaacatcnggggataaatccctgacaagcggtgtgctaatagaaanctggtaggaatactatgntacatntcgaccaanccaattggttaatacaaaacaagaan

SEQ ID NO: 1213 - DNA, 598 bp, Fusarium venenatum
  misc_feature (1)...(598): n = A,T,C or G
caacacaattcaacatgacgacaaaagtttggagccgaaacacacaagccggtgctgctctggagaaagtccaagaagccattcnaaaccctacagcagcgttaattccaaagccgccttctgaccttgatgagatcaaggctgatagcgattcattcactttggcttcattcaccacggaggatgctttcgagcttggcaatcttntatacgcccgcctctaccctttcgctcttgagggcaagccaacagtgatttcaattgctctcgcaaacacttctcaggttgtctttcagactgtgactggacctggtacagcgcctgacaacgagcaatgggtccgccgcaaganaaacacagtcctcagattcggttgcagcacctggtttatgcacaacaaactcaaaggcgatgaggctgcctttgctgcaaagtatgctatcgccgactccaacaagggcgactacgctatccacgggggagctattcctattcgtgttcgnggcgttgaggnaattgtagctgntgcgttgngagtggactgaancaggatgaggatcatggagtttttggaaacgtcatcaaaaatactggaact

SEQ ID NO: 1214 - DNA, 589 bp, Fusarium venenatum
  misc_feature (1)...(589): n = A,T,C or G
tcttcgacgggttcaatgagtacaatttcaacatcgatgtcatggcagcggcatacgactctatgaagcaaggtcttacacttgtcgaacaagagatgcctgcatctatttcattccacgtgcccgatcagtatcacaagcgcatcatcggtattggtggccagcacattcaacgcatcatgaagaagcactcagtcttcgtcaaattttccaacgctatggatcgaggaggcatgggtcgggaagatgatgacatcaaggtcgacaacgttatctgccgcacacctgcgcgcaatgcgcagaacctggacgctgtcaaaaacgaaattctggagatggttgaccgcgctgattctgagtacacctctcagattgtcagcgttgacgtctctaccatcgccagctcattgccagactccccgatatcgatggtttggacagaagtacactgcaagatcaacttccctagtactgancaggccagtgatgaagtgactgtcacggtcctcagtggcaggtcctcattgtgtcaagaatcctgggtntggtcctgataagcacaacttgtcctgctagaacccngaattga

SEQ ID NO: 1215 - DNA, 644 bp, Fusarium venenatum
  misc_feature (1)...(644): n = A,T,C or G
aaacgaagaccgcancctgcgcgttgacggtcagcgatggctcacttttatgaacaaggacatgaactggggctacaagacgacgcctcaggaattcgctgatagccgagagctggattactctcgcggaaaaggtcttggtggttccagcgctatcaactttggtgtttacagcgttggtgctcgtgacgattacgaagagtgggcgcgtatcgtcggtgatgattcatactcttgggagaagatccaaaagagatataagagtcttgagaactttcacggtgctctacctgagggtattgacaagaagtatgctgctcccaagagtgaggatcatggaagtgagggaaaacttcatgttgggtatgcgagtgaagtgggagaaggatcttcctnccgttcttgacctctttgaggatgcaggctttcactgaaccctgatcacaactctggcaaccctcttggaatgtctggtctgatcaactcgagtcacaagggacgaaggnctacagctaatgactgtttggaacctaacctgagaacttgactgtattgacagattcttntgggcagcgagtaattcttnagggnaacaaggctntggagttgaagtcaatggaaagaagtctttgntttnaaaggaa

SEQ ID NO: 1216 - DNA, 595 bp, Fusarium venenatum
gatttcgatacatcttcgtcgctgagggaccttatgggacagcgaacattacagcatcagtcggatggttaccctgatggcgttgatctcagcagtggtgacgaagaaggtgacgaacccgatgactcgcctaatcagaacatctatgcgaccagccgagatccaaaggcgctgccaaaccgtcctcgacaagctgcccgccgtaccagtagtgctgctgcggctgccggcactgctcggggtgcaagcaagagtcacagtggaaatccggcgttatcccgtgatgatagttccgtcgctactgcgggcgcggcggagagtggttacagcagcagtaacgagagtccctgattctacgttgatccaatatgtttgtaacatattattattctgcatttcacgatttttacttggggtttaggtttaatatagaatgaaaaaaaccgggtttcttcacatatttctatacggtcagggaacaaatttgaatctctgttttcaagggaaggttgcataagtcgcatttagcttggcctttagagaagaaaggtcatgattccccggggtactctttttatgagatcaaaggttgcca

SEQ ID NO: 1217 - DNA, 224 bp, Fusarium venenatum
  misc_feature (1)...(224): n = A,T,C or G
nancgccaactatgctntcagcgagactcgcaaccctgtgcgaactctcaagatcgntgctcctaccgccatcatctctgtgtccatcatttacatnctngtcaacatcgcctacttcgctgctgttcccaangncgagatcattgcctccgagcgtcttgccntgcttnatctcttccgcaacgttatgggtcctgctgccgagcgcgccatgtctggctttg

SEQ ID NO: 1218 - DNA, 776 bp, Fusarium venenatum
  misc_feature (1)...(776): n = A,T,C or G
aattntttttgtttttttttttttttttttttttcattcataaggtctaccattatatattttaatccctgggatgacaggcgatattgtttattgtcaaggactttatctccataattattcagcacatctgcaaccctgaacgnggatccaaacctaacccagctattatgcanacgtagggtaggnttagnggcaactntaatgaaccaatatntcattcctccttaagctcaggagtaacggcccagcgccttccataaaanacagngcccaaaagctganagccaacgatgtntccaaggtaggntccaacaacaatngtaacgggccanttttgccactcacgatcccagtcganagggataggaacggttccaagccacgctccaaccactgttccgagaaagccgccaaatgtctgatcgaaaggagcanacacgccaacaacagcctgtaggggaacgggatcggatccgcgaacgtanaanactgggtatatcgcgaggacggcaatgtgagcgcancacaanaatgtgtggggagcgtgagtaaggaacggcncgccaaaaaggacgagtaaantatggagggcgggcgtcaggatgagtgccaaaaacaaanaaataacagnggtagggaaagacttgcttccttcccgtcagactttttttttaccgggacccgggttnttanatgaaaatgaaaaccccgtggaggaanactcacattaagtaaactgctgaacaagancactncggaaaaccaatttttaa

SEQ ID NO: 1219 - DNA, 452 bp, Fusarium venenatum
  misc_feature (1)...(452): n = A,T,C or G
gaaaaactttgagaaaggaagccgagcccatcgaaaattgaaagcctccttgacgcactcgattcttatcagtcgttgtaacaacaccactatcattgtcaggggcaaggccaaccaantcacggttganaactcactcgactctcctgatcgttgacacccttgtttcaaccgtcnacgttgtcaaggctcaaaattcgctcttcaggttatgggtaccatccctaccgttatgcttgaccagatcgacagcgcacaaatctacttcngcaaggaaagcataggaaccaaggtctcacaagcaaatcggcgggcntcaaccttaacgttntctctggcgaggacaaaaatacagggangtgcctctgccccncaaatctctcttctncaacaattccaagggananttggtcnccaaatttntggtccccccggctaatacaaaaggcctt

SEQ ID NO: 1220 - DNA, 366 bp, Fusarium venenatum
  misc_feature (1)...(366): n = A,T,C or G
cggaaaaagccagcagtcttgccatcttggtcgaccctgttattgcaactggtggaacctgcgctgctgccatccaaacgcttcgtgaatggggcgcagaacgaattcttgttctctctgtcattggagctaatgagggtgttcagcgagttgctgccgagtggccggagggatgtgaagtctggatcgcggcggtggacaacgagctgaccagtgatggtatgttgaagcccggnctgggagatgttggtgacaggctattcttgaccattggtaaataagaagcgtcaacgaattctgtttagatgttgattccaattgcataaacataaaggctaggtagaatacatttgntatatacccatt

SEQ ID NO: 1221 - DNA, 202 bp, Fusarium venenatum
  misc_feature (1)...(202): n = A,T,C or G
ngggcnaatactgctcgtatgctcnctnactcgttgggtgttgctggtgttaaacacatcatcactgtcgaccttcatgcatctcaaatgcttggntttttcaaatgtccttgtcgacnatctacatgcaaagnccatcctccaaaatggatccgtcacaacgtgtntaactggcgcgaagnggttgtggcttcaagaatgc

SEQ ID NO: 1222 - DNA, 609 bp, Fusarium venenatum
  misc_feature (1)...(609): n = A,T,C or G
caccaattttcgaactcatatactggggttaaccatccaattggatattgcgctcagctcanggctgggaccaagctgtcaatatgtcgctctttctaaacatgatccgtgacagattcatcacgataccagcacaggaagaagactgcacaggcaaaacattcgttgtgacaggagcaaacagcggtattggccttgaaacagtccgtcatcttacagaacttaaagccgccaaggtgatcttgacatgtcgaagtattgaaaagggcgagcaagccaagaaggacattgaagaatcgactgggaagcaaaatattgttcaagtttggcatctagatctcgcttcgtatgacagcgttcgggaattcncttctcgcgtcaacaaattggagcgtgtcgatgccttcatcaacaacgctggccttctcgatttcaatcgtgagatgattgaaggccatgaatcaatgttggctgcaacgtaatatctacgactctgctttcctccttgtcttgcctgccctaagctaacagcgatgagggtcaatatcgctcctcaccttgtcattgtatcttccgacncacttttgattgccgcctcctttangngac

SEQ ID NO: 1223 - DNA, 587 bp, Fusarium venenatum
aaaacggccgatccatgtgaagcccaaatcgcgacatcgccatatttaatacaatacaatacctaaaaataaaccgatcttcaatatggcagcttccactcgaagcctccccagagcatcagtcctacgcgcctcaaggttgacacagggtctgacctctcgccgacccttccactcatacgatcatccaccaccaccaggaccatttggcgatgcagaaaattccatccttgccgccgcctacaagcacgtacccgaactcggattctctcagaaagctctcggtcgtggagcaagagatgccggttatctcgacatcagtgcaagcgttatccccgatggcgcctttggcctgatccgataccatctaactatccagcgagaagctttggcagctcgcagcagggaaatctttcctgatacagatcatccaagtgttgcggcaagagtagaagctctgacatgggagcggcttatgggcaacaaggagattctgggccgttggcaagaagcattggccgttatggcacaacccagctacgttcccgagtcctaaaaagacttgccaaactctcagacaaaatttg

SEQ ID NO: 1224 - DNA, 312 bp, Fusarium venenatum
  misc_feature (1)...(312): n = A,T,C or G
ccgactccctcaacaccgatactatcaacaattacatatcttgagggaagcagaacgcgaataaagccaccatgtctgacggagttttgaagcccgagaaggacttctcgaaggaggttgatcagcagctccctgaagctgagaagctggctgcgtcaaacaacctccaaggcgccattgagaancttgctgctctcgaaaagcaaacccgacaagcctccgatcttgcgtcaacatcacgagtactgatcgcaattgttacctatgttaaaatgcangcgactgggantcttttgaacgacagaccttggt

SEQ ID NO: 1225 - DNA, 254 bp, Fusarium venenatum
cgaagctctcccacaatggctcgctgctcagcggccaaggccactggtgatgccaggacaaactttatggcccctggtatggaggaggataagcctatgggtcaggtcgagtatggcgtataacgtggtggttgtaaaagaatagaaagatctgctttgttttattgcgtctgggaagttcgtagtatgtacatattggacgtctgacagagggctaaaggtagataagttgaatacctaattccttcgctacg

SEQ ID NO: 1226 - DNA, 680 bp, Fusarium venenatum
  misc_feature (1)...(680): n = A,T,C or G
gacgaatcgacgaacgacacctcaatcgaaaccaccactcgtcattgtgaattatttcgcctgtcacaatgggtatctgggacgctttcaccgatattgtcgaggctgtgaccccatggagcgttgttgaggccaaggctcctgctgaggagccccaggaggagaacgagtccaagaccgaggagtccaaggacgagcctgaggaggaggaggaggatgaggaagaggaggaagaggaggaagaggacgaggaggatgaggaggaacctgtngaccccaaggagaccctcgaggaagagtgcaagaacgctccccaatgtgcccccgccaagcaccacttcnacgagtgcgttgagcgtgttcagcagcaggagagcgagggtggcgccaagnaggactgtgtcgaagagttcttccacctcgcccactgtgcgaccgcttgcgccgctcccaagctctgggntcagctcaagtaaattaacatcacggggttatcggttcctacgacgatggaatggctacatacacgtcgaaaagatacctgagccggaacgaggcaggacttttcnctacggaaagctgcttccttgtacgaatgctcatctgttgggtgtcaagtcgtccagaggtttntntgatgtcggctctctctgtaccatacgctcttacgcctgaataga

SEQ ID NO: 1227 - DNA, 565 bp, Fusarium venenatum
ggcaacggtacctacaacccccccaagcctcagccccccaaggagacataccctgtccccgttcccgttcccagcaagcctgtcaagcctgagcaccccgaacagcctcagcctcctaagcctgagcaccctgagcagcctcctcagcccgagcagcctcaacctcccaaggagaccaagcctgttgctcagcctcctgccgagactcaccctacctaccccgttcctcctcagcccgagcaacccgagaagcccgagcagcctgagaagcctgagcagccccagcctcctaaggagactcagcccgttgcccagcctcctgctcctcccgctccttccaagcctgtcgagagcgctcctgttgttcctccttctcccagcaagcctgttgagacttaccagtccctcctgcttccactcccactgagcccgctgaagttgtcaactctgctggacgtttccgtggtagcatccaggctgctctcttcgctgccggtatcgtcgctttcttcctgttaacaaacaatatttgttattccttctaagctcatgaaggagcatgatt

SEQ ID NO: 1228 - DNA, 504 bp, Fusarium venenatum
  misc_feature (1)...(504): n = A,T,C or G
ccggtcacttctaaaactactcaagatcgttgtgccaggatggcgcagtaaagagtcaaggctgttgatgagccacagtttcttcttggttctcaggacgctcattagtgtgcgcgtagctgagatggatggtgctatatttaaagctctggtgaagggtaacggggaaaggaaattttgaaacgtatagtatggtggatgctgattgggggtcccgcaaccttcaccaactccatgctatcatatcaccaaccgagttatctctgaagtacgatcacggctcaccaacatatcccgacaaatatctatccaacctgaccttctatgggcattcggctctggatgatcgaataaanaacccgatcngttgaatgcggttgangtttcaaaattctctaatancctgcngagctatacacaatttanccaaccncgtnagatataatatatatactggtcttttccaaaaactcngtggtgaangtgtctctcctgtcccttggt

SEQ ID NO: 1229 - DNA, 640 bp, Fusarium venenatum
  misc_feature (1)...(640): n = A,T,C or G
cgctaacgtcatgggcggttcagtcgttctcaatcctctatcatctcattacaagactctcaactctctatttcgggagtctcaccataacgagcttttcatcgcagacgcacaagtgctcctttccaactcgagcgattttcttgagcgaacgaggattctcaatcgaaatgctctcgctatggcaaactttcttgacaaggccatatcctctcccaactctcctgtcatcaacgtgcaatatccgagccttctagataacaaggcaaactacgatgccatcttacgggaagggacaccggatcttccagagccagggtatggatgtcttctgactgtagaattctctactgttgaagcagctacatccttctataatagggctggattttacccaagtcctcacctcggaggccatgtcacgaatatgttgccatataatatgatgggtttcagcaaagaacctgaagagaaggcatatatggatggggttgggcgtcagaanaaccagcgtaccgtatttcacccggctggagagtgaagaggactgattgatccttaccagatgcgctgagggcggnacagacctcganggttgattaccaaaagaatactaaggatcttaaggatacttanggct

SEQ ID NO: 1230 - DNA, 593 bp, Fusarium venenatum
  misc_feature (1)...(593): n = A,T,C or G
ctcctcaccgagtaacctcccttgtctcctctcattgggtactttgtctgttgggtttgtatttcgaacctctctcttctttcctccccatcctctccacagcctgttctacaggtcttcttcattcgccatggcctctactcatagttccaagcagcgccttgcgctcgctatctgcgatttcctttctgcctcaacaaacgatggtacccttaccgccgacgacaaggactccatcgatgttgccatcaactgtatcgccgagtctttcaaggtcgacctaccgatactctgccgtctcagcagcatcggatcgcagaaactccttcaaatttactccgtcttcgagaaggccgcgctgataagccgccgccgctcctactccgcaccgtcgtgctcaccgangaacagaagaangaagccgaagctctgaagtcaaagggtaacgctgccatggnccagaaggantacagtgctgccatcaacttctacactcaggctttgggcatcaacgccagcaacgctgtctacctttccaaccgtgctgccgcccactccgccaacaagaacacgcttccgctcgctctgatgct

SEQ ID NO: 1231 - DNA, 609 bp, Fusarium venenatum
  misc_feature (1)...(609): n = A,T,C or G
tagcaaataaccaccgaggttcttaagcgacgaggttacaagcaaaccattctgangggtctttctctctactctcttggcgccatcctgttctggcccgttgccaagtcggccgactccaatgccaacggacgcgcagtattcggcggcttctgcgcgtgtacactcgtgattgcttgcggcctggccactctcgagacttctgccaactcttatgcagtcgtcatcggtgacccagcaagtgccaacgctcgcctccagttctgccagtcttggaacggtgttgcctcgttcattggtcccttgatcgcctccaagttcttcttcactggtgagaaccagaacagccttaccaatgtccagtttgtctacctcgctgtcgcctgtgctggtgccgctgttgctgttcttttcttctttgcaagcttctgagatctccgaggctgttatcgaggatgangcttggacacagcaacgagggctccattttggaaacaatacaacatgtgggtcgccttnggngctaaattctgctacgttggggcccagntaccatcgccaccttttttatnaactacnctaaaaaaaacnggggggtctntactgcct

SEQ ID NO: 1232 - DNA, 574 bp, Fusarium venenatum
  misc_feature (1)...(574): n = A,T,C or G
gcttaaacttccacttctactatgctcaacaatcgcaaacaagcgcatgacacagattcacctgcgagatccattacccgctaccttttcatttttgcccttccgttactagttctcttcatttggaataaggtattcagtagcaccaaaacggagaccacaaaagcaaacatgtcttcaggaagaatcgccccgctcgtttttcctgcggcatcccagcacacagctacagtcatctttgttcacggtctcggtgacactggccatggttgggcgagcgctgttganaactgggcgccggcgacagaagctggatgaagtcaagttcatcctgcctcatgcacacaaatccccatcagcgtgaacatggggaatgaaaatgcctggatggtttgatatcaaacaacttgggtgggaaangtttactctctcgttcntaacgaaaattnnaaggctccaggctcanccaaaatncttcccnaatctcttcaaanaaaaaatgggntccgggaaatttcccctnaacngcatngttctcggnggnttcctcangggtgggtgccatnttctccnt

SEQ ID NO: 1233 - DNA, 486 bp, Fusarium venenatum
  misc_feature (1)...(486): n = A,T,C or G
cgtcaatatgaagaaccgaactcagaatgctccgaaagccgggcgctgccgaaccctaaagaaacgggaacactaacatttgggtaaactggggggccacttccgggtgggttgaagaaagcaagcgaagggtatcatcancctaacgggtctgttccgccaacccgaacaagaaacccttggggccgggcgcctccccacgatgccatcttcaacactttccgcccgcaccaagtcccaagatcttcttctggctccctcccatggttgccggttactggatgatgaactgggccatcgagcgaagcgagtaccttaactccaaggctggtcgtgccgagttcggtgacgaagaagantaaatttgttatattctggcagcaaaaccatggcggatgttttggggtaggtcctctggactcattgttcatcatcaatacctagatcaggaagtgcaatagacatttgtccaatatttcttttttt

SEQ ID NO: 1234 - DNA, 505 bp, Fusarium venenatum
  misc_feature (1)...(505): n = A,T,C or G
cacgaagccggtcattctcaaggacctgcaccattgactgtcaactcctccaacttctccttgagctcgttagttgatttgagagtgccatttgtttcagcctctccgttcgtaagctcggcaggcgtctctccgttcgtcaatccctttctgatggcgaggacactgtcaacaatgacagcatcgatgccctgcttgacctgacgctgcaccaaatgtcagcgaattcacgttgtttctatcatgtttagtaaggcttacctgaaccatgataggatcgttgtttagcacgccatagctgaagcatacaataccgttttcctttacaatcttgatcaaacgggggctgttgatgaaaggctccgcagcggcaacgatacctaaaaggtccagcgactcgcgaaacgaatagcttcctgaagcgacaaacccgaatgtccatacatcacaacagcctgcgtctgtnaaggaanaaaataggaatagaaaggcgcttgttacctca

SEQ ID NO: 1235 - DNA, 419 bp, Fusarium venenatum
  misc_feature (1)...(419): n = A,T,C or G
ctcctctcccaccacaatctcctccatcacagcctttacaatgtttgcgcgaacagtagcctcgtccctccgacaagccgcccggcccatggccgtccgctnaacagcctctgncttccgcacccccatcgctcccctaacacccttncaaacccgtnttctntccgaccaaacccgatccgcatcgacaaagccgtatnatccgcccccgtcgtgctcttnatgaagggaacacccgaaaccccccagtgcggtttttcgcgcgccgcatccaaattctcggtcttnagggngcaaccccgacaagttcgctgctttaacgtctcgaggatctgactgcgcgagggtattaangagtactccgactgggctacgattcccaagntttacgttgaaaaagattcatcggggggacggat

SEQ ID NO: 1236 - DNA, 962 bp, Fusarium venenatum
  misc_feature (1)...(962): n = A,T,C or G
ttcatctttgtttctctatcttgtaatctttgttccaacctatcgactgcgtcttttatctattataaactccttctccccgtcataaaaaaaccaccacctgcataatcattctggtctctccgatctcgcctttttgtggcccaacaactccccgcgccagcgccgaactatcgtaccattgacctcaacaagaaacgttaaatcgtgcagcgacattttttggatacatcaccgctcaaacgcaactgtactcattgcgcatcaatcccctcaaagtatagcttctacgacaagctagcttctcaattgccttttactcgcgacggcctcatcgttacaggtcgcctanaatgaacctgaacaaggccgctcgagtcatcctctttggtgcccctggtgttggcaaaggaacacagaagcgagcgcttgctctcgcgcttccctcaactcaatcaaatcagtaccggagatcttcttcgtcgaaatgtcaaggatagaaacaccactcggcatcaaggtcgagaacaccatgaagctggtggccttgtggctgacnatttaatcctacgacttatttccaacgaattttatactcgcggctggcttgccaagaatggctctaatgttatgacctttcatccgaagccacagcactcgaacattctttcaacaacaacgctggtgtcgaatctttcatcaacgctgcgcctttcctcgacgggcatagacatctgctgcctcaacnaccctcagcttcgtttatccttgacggttccctcgaacagcatcccaggccgtcccttgacaaacttatcccatcaactggtctctcactcaaaanaccgttttcgtttcctgaacccttctcgaacttnggtcatnaaccttccggccgttntacacacanttcaaccccccaaggtcccggaaagangaatccccgggaaccctgatcaacc

SEQ ID NO: 1237 - DNA, 269 bp, Fusarium venenatum
  misc_feature (1)...(269): n = A,T,C or G
cgatcgagctcaagttgtttatcatgagatgccggggtggaatacaccgaccacgaacgtgaagaccttnagtgatcttcccaagcaggcgcangactatgtngagttcatcgaaaacttnattggagtcaaggtaaaatggattggcactggccctgaccgaacgagtatgatcaagaaataagtccggcggtggacgccataccagcgacgagttgtgtgtcgctatgatggttagaacaccaattttaaagaccaattgtcncacn

SEQ ID NO: 1238 - DNA, 643 bp, Fusarium venenatum
  misc_feature (1)...(643): n = A,T,C or G
ncaccgnatggggggcgncgtggacgtgaccagcttctggcagaggaagcttcgaacctggtatacgcgtaaaagccctgttgaactatggctggacctattgaggacagcagaggtctttgaagactgggaagaagccgcgctgcatcttgatnacctcctcggncttgacttatggaggaataacccagcttctaaatattatgactggagactcattggcgaacgtctggactcncttgcgacagctcgagaagatgccaactttcagcagctcgtcaatctattaagatctggtctggtccggaacctagggaacatcacctcacccaaactttacgaccgatcctttgttggcgccaagtatcttatagaagagtacattacccagattgctgaagcagtggaagatattcgtgcccttcctacgacgccatccgctgtccatgaccatgggccatctctgacgacacagataaagctagattgtatacatgatacgagacaggctttcgggagaagcaccctcgttcttcaaggcggtgccatatttggcatgtgtcatttgggcgttgtgaangctctcttcttacgcgggttacttcctcgcatcatcaccggtcagccacggcgccttgatagn

SEQ ID NO: 1239 - DNA, 470 bp, Fusarium venenatum
  misc_feature (1)...(470): n = A,T,C or G
ggtcgactcacagacttggagtttcttgctcgacgccttcgtaccggccagtctcccaagcaggctatggaggagattgtatccgagacagccaccgacatcgtgcgaatctaccttcttggcaagccgtccgatattgagggcaagaagttctctcctcaacaggcctggcatcttgttaaatctcttgcgaaaaacccgaagctgcgttacaacgaagtcgtactctccgcgccattctcctctgccgctcctgctggctctaatgccgatgctgctatcgataacctcgtcagtgccgaacttattgcagtcaaaacgtaccaaggccgccaatgactatcacaagccggcaagccgctgcaccaagccgcgttctctggtcttctccatgaacgcgtgcttcgcgcgaagatggattatgataccctgnacgactcatccaaagcggaggctcgttcgattgagaa

SEQ ID NO: 1240 - DNA, 472 bp, Fusarium venenatum
  misc_feature (1)...(472): n = A,T,C or G
gagaacgagatcaagaaggcntaccgcaagatggctgtcaagcttcaccccgacaagaaccctggcgactcccaggctgaggagaagttcaaggacttgcaggaggcttacgagaccttgagtgaccctcanaagcgtgctgcctacgataacggtgatgaccttatggaccctaacgacatgttcggtggcggcggcatgggtggaggtatgggaggcattgaccctgagatccttttcagcatgatgggccagcagggnttcggcggtggaggcggcggcttccgatctgcttggaggcttcctggtggtggccggnggggcccactttnacttttggnggtgatcccanacaacagcgtggaggataccctggtggtttcnacttnttatgaccatatggcgctgatgatgacgatgaccacnttgatagttaaagtgaggaccaangctcnttttctttgacgagggg

SEQ ID NO: 1241 - DNA, 578 bp, Fusarium venenatum
  misc_feature (1)...(578): n = A,T,C or G
atcaccctccactctgactctgaggttagttacgacatcgcaacttttcctctttcctgactactaccaaacaaaaaacaccagtttcatttccccccaccactcgcatcacccacattccggagcttttcgcaatggctggcaacaagaagagcgacaacagcaagaagctcagggcaacgctcgcaaggcagantccgccgcccagaagcaggccgccgaagacgcccgtcaagaagccaatgaagccgataagtggaacaagggagccaagagcaacgccnagaaagaagctgctgctgcaaangctgctgaagctgagaagaanaagctgagaagctgctctcgaagccgangaagatgccaacaatccctcaaagggccccaagaagtcaaaagctcctgtcnagaaagcgcgtgggcttgaactttcccaactcgacgacganaagccttcagccatcaacgcctctggtatcgataacgccctcgatgccctgtccctgacaggcaacaaggacgatggcaaggtcgaacgacaccccgaacgaagataccccgccgcatacgcccagttc

SEQ ID NO: 1242 - DNA, 595 bp, Fusarium venenatum
  misc_feature (1)...(595): n = A,T,C or G
caggcgcacgcatctccattgccaaggcaccccacgatgagactggtgagcgtatgttcaccatcatgggtaccgctaaggccaacgagtcggcacttttcctcttgtatgagaacctagaggcggagaagatgcgccgaagccaacttcaagaggccgaatagccgactttcagaagaaatctcgttgatttttgcttttctcgtgctccatgcgacttgctaaaataagtttttggcaggatgggctggggcatttcagatctgacttgccgcgaggcttgtgttttcagttaggacgataccanatggcagcattacgagcgactgaatccatttgtccgacccattcccccttatcaaccccgaaaaccctccatcataaaactcgtntcttttcctgattcttacccttctcaatatctttgctacatcaattagggtttgactagtgtcgattccgactcgagccttactgtcacatcttcgccttttaaaccgaaccagcttcttttttttgggcgagcagatcgctnccaaacactgcagcttgccgtctatatcagcttcgcccacctggagtttttggcaatggc

SEQ ID NO: 1243 - DNA, 336 bp, Fusarium venenatum
  misc_feature (1)...(336): n = A,T,C or G
gcacccgtcgccatgttttcaaccacctcaatggtcttccgggccggcgctcgtcgcgtcgttcgacgatccatccccgtcctccctgccatgggccccagccctacccgatacctcgccggtcgaaacaacttcgtcattgctagtgtgagccagcaacttcagcgacgtggttatgttgccganacaaaccccaaccctccttttggaaagaanaatgcttcaaacgatggtcctactcgaattggtctaataggcgcccgaggatacactggttcagctttggttgagcttcttaacgagcaccccaacatggagcttacccccaatttgggn

SEQ ID NO: 1244 - DNA, 414 bp, Fusarium venenatum
  misc_feature (1)...(414): n = A,T,C or G
aatctcgtacgcgtcggccgtgggcaacaagctgatgctcaccaagacgggcacgggcggtctctcagagctggtgggcgagcttgacgatggtcaggtccagtacggttacgtgcgcgtcgagtacgccaacgacaaggagagcactcgtgttaagtttgcgctggtggtctggattggagaaaacacaaaggtcatgcgcaaggctcgtgttagcattgagagcggtgatgtcaagaggcagctttcgcatcatagcattgcggtcacgacgggggataagtccgagttggatgagagggatattgtggttcggttgaggaaggctggtggtgctgattacaatggaggacggggttaatcgactactactacacatacatacatgcacatacggagtacacatgccnaata

SEQ ID NO: 1245 - DNA, 586 bp, Fusarium venenatum
  misc_feature (1)...(586): n = A,T,C or G
tgcaggtacaggcgcttctctccggccacgctgaacaagatccccgagcctggcgcggctggcttcgctgatgctttggtgaagcttgtcgatggcgagtctgagtgggatgttgaggttctcaaggacgctgtcaccatgcccaagggtgtcgttctgcgtatgtgcgatgttgactgcggaagcaaaaccgtcggtatggtcaanaaggtcctcgcgtggaaggcctcaaacgccgacgaatccaagaccctttgggatgaactgcagaaacgtaacgagcaattgattgccactcttaacgccggcgatgttgcacagctgcccganaagatcaccgctgtgcgagagaagattagagagatgggcagcgcgagcgaagttcccatcgagcccgagagccagacagagctcctcgacgctctcagcaccgtcnaaagggtctatggtggtgttgtccctggtgcaggtggttacnatgcactggctctcctactgaaggacgatgaggagacaaancnaccaataaaagtgtttttgganaagtgggcagaanaaaatggtacaaaggtcaaactgctccgcg

SEQ ID NO: 1246 - DNA, 629 bp, Fusarium venenatum
  misc_feature (1)...(629): n = A,T,C or G
ctgtgcccttccagctttccttgttcctgcaagccctcctacgccagttggccctgcttctgagaccccaaagctcagtctccgggagtccatcagcgttctgagcagttctttggaaatttggttgattctcattccattcggcgtctatgtcggcttcttcaactcaatctcttctctcctcaatcaaatgctcacaccttatggcattagtgatgacnaagctggtatcggnggtgcagttttgattgtcgttggtcttgttgcatccgcgatatcttctccgatcattgatcgcacaaagagttttcttctgacactcaagatcctcgtccctctcgttggtatcagctacttggtctttatttggatgccggaaaccagggatgtagccggcccttacgtggtcctcgctatcttggggcctcctcgttttcactggccctgtcgcactcgaattccttatcgaattgagccatccactcagccccgaggtcacttcaaccgnggcatgggctatgggcaactctttggcgctatattcatcattggtaagagatgcgcttgcagcggcaaagatgccaatccttcaaanaacatgaaaaacccattggtctttcaagcngtct

SEQ ID NO: 1247 - DNA, 827 bp, Fusarium venenatum
  misc_feature (1)...(827): n = A,T,C or G
taaaccataatatccacttaaactttagatccaaactcgcattgtttttctttctacttccaaaactaacccctccatcaaaatatttatataaatcaattcccctctactcccccaccaaaaccctcaaacttccatcaccaccaaaacaccaacctaaacctcacacaacctcatccgaaatggccgccccttctgactctgtcgtcgtggagatcacctccaaggctcaattcgacgagcttgtcaagaagaccccctacgtcgccctccaggcctccgcctcgtggtgtggtccctgcaaggccatctcccccatcttcaagaagcaggccgccgagcacacctcggaaaagttcgctttcgccaaattcgacaccgacgatgtccccgacctcgcctttgagatgggcatccgatccatccccgccttcttcttcttcgagaacggcgacaaggacagcgacctgatgggtgccgtccctcccaagctgactgccgctatcggtggctacgccaagaaggccaagggtggtgatgaggaaaagcctgctgaggacaacaccctcaagaccgatgagaacttctaaacgagaacttttcttaaagaacaaaaaacattacaaagcaaccggcttttagaagcgcaggtttcgcaagggatacccctagaaaacgaggcgcaccaagacaggcagcantatattacccacaatttccacaagattcaccattgagctaggaatacgactttagccatgcgaaaagcatagttttaagtaggatggcccgcgccggttagctaagaatagatcacattttacttc

SEQ ID NO: 1248 - DNA, 578 bp, Fusarium venenatum
  misc_feature (1)...(578): n = A,T,C or G
ccaggctctagacgctgggtctatcaacggtgtcatatgggctgttccccagaaaccgcgtaccaactttgacatttccaagacttatcctctagctgatggttcaatcatcagcgtcgaaggtcttctcaatgatacccacccacacttccgccttccggtgttcgcaccccaaagagccgtcttggcacatcccaacactgtattatttctcacccacgggggtggttcaagtgccaacgagactctcttccacggtacaccagtccttgcagggggctacttcttagatcagctctgtaacagcgctcgtctcgcagcatcgggcgtcggaacgtctcttgacaaatcttatctaacaccgtcctctatcgcatcggccatcaaaaacatcacntctgacaaggatggatcgttcaccactaacgcccgccgcatgcaacgcatacaatcctcaattccaagcggaaacacctcgcagctgaactcattgaagaagtcatggtagatcanaaatccggttcgcnacggcgttgactgcgcctatgcatctgcaganagcgnatatgccctgccga

SEQ ID NO: 1249 - DNA, 594 bp, Fusarium venenatum
  misc_feature (1)...(594): n = A,T,C or G
ccgccttcagctgctgcgccagcaatccctggacgaggacctccagtaccgcctccaggaaggagcagcaggcttgaggaagacaacgccgatgggatccaagcctccacctcctcctatagggaagaaaccgcctccgctgccgacatcgcggaaaccctcgtctatgtcgctgccacctctgcatcctcaccaaacttggtaccttcagctccccctcctccaccgccttcgagtcacgcaccagctgctcctcctccacctcctccatctgcggcacctccgccccctagtcaatccccaggatcttggtcctcggtaccacctccgccgcctcctcctccgcctggagcaaaccatgcaacatcatcccttgctgcgcaggctaccattcgtgctgctggtcaagcatcaccaaacgccgcacctcctccccctccaagcgagtgcgccttcacctccggccaccaacaacacgttctcgangctcctcttctccgccactccatgtttggatccaagtatgtttactttgaccgcaaacggaagaaaagtcaccaagttcctacgcattcgccttcgcaaccacctagt

SEQ ID NO: 1250 - DNA, 644 bp, Fusarium venenatum
  misc_feature (1)...(644): n = A,T,C or G
caaacccaacttcaaacaacttcacttcatatttataaaatgtgacaggcgatatttcgggataataagatcaatttttctatatgcccgactttaacaatgcgggactctcgcccgcgaccattgagtctatcgctggtctcagtgctggaactgtctcaactttgacggtgcatcctcttgatgtagtcaagactcgaatgcagatctatcgcagcacagctcctggtgcggtccgtccaacgacggtgtctatccttcgcgcactgacatctacacctcacccgatcgcctctctctaccgcggtctaacgccaaaccttgttggaaacgcctctagtngggcttctttcttcttttttaagtcgcgctttgaaaacgctgtcgcttcttggcaaagccgcccggatggacgcccaacaccgggtgactacttcgtcgcgagcgctctggcaggcgcttngacgacgacgctgaccaatcctatctgggttcttaaagccgtatggtatcttctgatcgcggctctcaagggcttacccttntatgctcgccggngctcgctntattnttcaaaccgaaggcatcggggcttttatcgcgggttggggaatctntttgggngggcgtatctcacggcgctn

SEQ ID NO: 1251 - DNA, 981 bp, Fusarium venenatum
  misc_feature (1)...(981): n = A,T,C or G
ggctctggtgctgagggctctcgtcgccgagcttctggacgtgcccgcgaacgtgaacgtgcccgtgagaccgcactgcccgcactggtcgtgtnagtcatacntgagtgtcatgatttctgaaacgcttactgacaatgctacagnagggtgccgagaagaaggagggcgaaactactgaggctgttgctgccactgatgatgctgctaccgcagccgctgcacctgccaccactgaggttcaacctttgtccgatatcacaaacaagatcaacactgacgcaaacgcaaagacctctaagacccaacctcgccctcagcgtgagcgccgtgagcgcggccctcctgctgacggaattccttccaagaccaaggtcatggttgccaacctgccttacgattctgaccgaggacaagctcattgagcttttcaaggcttatgagccctcttctgccaagattgctctccgacctattccccgattcatgatcaagaagcttcaggctcgtggtgaggcccgcaagggtcgtggcttcggtttcgtcactctggcttctgaggagcttcagcagaaggctgttactganatgaacggaaaggagattgagggccgtgagatcgccgttaaggttgctattgacagccctgataagaccgacgaggaacaccacgagggtgatgctaccaacggtcaaaaaganaacatccccgccactgaggctgcccctgcggctgctcctgctaccggcgccgtggctgctgcccctgccactactgctgcggctcccgctgcggctcccgctgccaccaaggctgntgaggccacccctgcctctaccactcccgccactactactgcctaagttaaggcacggcgcgagtttcacggacatgaacctcgtattatgtcatgatgattactctaacgattggggcatgcgatttcaacgatttctnttacgggagattctcctacaacn

SEQ ID NO: 1252 - DNA, 654 bp, Fusarium venenatum
  misc_feature (1)...(654): n = A,T,C or G
caagatctctgatcgagcttgttccgcccacgccagactcgcccgcaacgaaacaatgactgaccgcgacgttctccccgacaatgtcaagcccaagcactaccagctgtccttaagggaccttgagttcaccaactggacttacaagggaaccgtcaccatcgactcggaaatcaccaagcctaccaaagaaatcatcgtaaacactctcgaactcaagctctctcgcgccaaggtcttcgtcgactccaagtctgcggaatcgacaaagtttgactatgacgccaaggcccaacgttctaccatcacctttgacgaggagctccccgtcgcttccaaggctgtcatcaccattgagttcgagggtatcatcaacaatgaaatggctggtttctaccgcagcaagtacaagcctaccgagactccttccgcttctgtccccaacgatggcgaatggcactacatgttcagcactcagttcgaggcttgcgatgctcgccgagctttccctgcttcgacgaacccaacctcaagggcacctttgacttttgatattgagancccttctgaccagggttgnttttgagcaacatgcctggtcaaggagactcgtccnttccaaggatgggtgggaacaatgnggtaatttgagan

SEQ ID NO: 1253 - DNA, 505 bp, Fusarium venenatum
  misc_feature (1)...(505): n = A,T,C or G
gcgaggcattcttgttgggtgctatgtctaaagcacttgcgactatcgccactcaacctttgattgtggccaaggttggcctccaatcaaagccacccccggctcgcaatggcaaaccctttaccagtttcgttgaggttatgaagttcatcatanaacatgaaggcatgctgggtttgttcaaaggcattgggccacagattctcaagggccttctcgtccagggtattttgatgacagcaaaggagagggttgagttgatgttcatccttctgattcgatatatcaagtccattcacctccgcaaaatcagccgtaccgctgagaaactgcagcagcagcagcagctcacagcgtgcggcgaaaccggtgacaagtacttagattagggcnacagctggtgaggacaatcacaacaacgggtcatttngagaagaaggtttttgcaaaantggataaaacgatagtagttnttngttgctattctccataatacgtgaatctt

SEQ ID NO: 1254 - DNA, 871 bp, Fusarium venenatum
  misc_feature (1)...(871): n = A,T,C or G
cctctagtcaatcgctacctcgttgtgcctcttacctaccttaattaatactcagtcattctttcaatcacaaacaaccttccaaccttcaaaatgaagtacactatcgctaccgtcgctgccttcgccaccatggccctggcccagcccgctttcaccaacaccaagttcgacctcactgagggcaagccttacaccatcaccttcaccggttgtgattctggctgcactatcattctccagaacggagagtccaccgacctcaaggactacaagaccttgaccagctccgctgagggtgactctttcacctttactccttctcagctcccctcggacacctacaacttcaagatcaccgactctgctggtgaggccaactacagcgagcagttctcctacgagggttcttacgacgctccctccgtcacctctgctactaagaccgctgcggagaccaccgccgctgctgagaccaccgagaaggctaccactctcgtcaccaagcctgtcgatgagaccaccactgctaagcccatcattcccactcacgtcccgttccccccaagaacgccaccactcccattgctacccccaccaagaccggcggtgctggtgagactggtgttcctgaggttcccgtcagcggtgctacccgcatgacctcttcctggctctcattgctggtgccgccatggccatggtttacctcaactaagttatggacatgatttttctgcacgaatacccgggatgaaaagagcggtttgatgagaatcaagttttcggtgtataattctactttaatgatggctttgtttattcgtttccgggtaccccacgaaggcgtcaccggccgggttgtntcttn

SEQ ID NO: 1255 - DNA, 876 bp, Fusarium venenatum
  misc_feature (1)...(876): n = A,T,C or G
ctcggtgccgctactctttccactgcggccgaatcgcgaaacataatctactatgaccaatggcataccaaggatcttccctccaaggacatcaccagcagcgttacccacgtcatgatgtccttcgccaactcatctctcttcaccacccagcctggtggaaagtacgagcccttccagcccctcgagacggtgcgtggcctcttcgaccatgagattaaagtgtgccttgctattggtggctggggcgacaacgccgggtttgacgagagtgccaagaccgatcgcagtcgcgagaggttcgccaggaatgtcgcttctactcttgaccgactttggctttgactgtgttgatatcgactgggagtaccctggtggtaacggacagggactacaagcaagtccccaactccaagaagacctacgagatcaaggctttccccaagcttctgaaggagatcaagaagttcattggagagaaggagctttccattgctgttccagctcttgatcgtgatatgatcgcttacattccttctgagactcctctcatcaacaaatacgtcgactttgttaacgttatgacatatgatctcttgaaccgtcgtgaccattacactacccaccacgtcttcatccaaggggctgcccgtgccattgacaagtacatttctcttggcttcctccctccaagcttgtctcggaatccttttacgccaaatactcaccaccaanaaggtaccctgcactgagctatcgttgcctacgagctctgagacccgagacgaacgaacggaaatcggttctgatttgaggtgcaactcctgcgcccaanactgatactctacgagcanngtgtgtgtactctcaatccga

SEQ ID NO: 1256 - DNA, 1120 bp, Fusarium venenatum
  misc_feature (1)...(1120): n = A,T,C or G
tttgcgacacctactgttctgcatctactcccttattatcgactgacctctaaccatcgccataagagatccgcctgaccttgcgcaagtttgagctcatttctacactcgaccgactttatataccggccgacgtcttttctacattctataacctcaaccctcgacatcaattactagcatattcacgatggatcactcacacatggatcacagcggtatggaccatggagatatggatcatggccatggaggaggcatgaaggacatgtgtngtatgaacatgctcttcacttgggataccaacaacctctgcattgtcttccgtcaatggcacgtccgttcaacaacgtcactcctcttctctcttatcgccgtcatcctcctcgccattggctacgaagccctccgatctgtctcccgtcgttacaaacaagctctcgataaccgcgtccgctccgcccccagtaagctttctatctccttctcccgtctctgcacgggcattgcacatatttcctatccaggaaaccccaaggacaaaagaaaacagaatgctacgctgtatcctcttgccctatctgtctaaagtctttggggaaaatataaaatcgcacccttgctaagtcttaccgtgaggtctgtctgatgctcctgttactgaatcgactcccatcctgtcaggacaatcccatggacaagccgaccagcgcgcccacctcatcaaggccgtcttgtacgctctgcagaacttttacgcctttatgctcatgcttgttttcatgacatacaatggttgggtcatgatttctgtttctcttggcgcatttctcggatatttgttctttggacaaagaacttcggccacaaaggaaaacgcatgccactaaagacgaattttgtaagaaaaacgattgtggtangggccatgcgttatgcggcgttaccgttggaacagctattagtttgattgaagtaggtaatcacgtacctgcgggcccgggcgaaatcccattcaagacagcacagtaactttggggggaacccctcggttaagctatgctcagaatacacttangataaacaaatgagtaaagaacaagccaaattatttccgtat

SEQ ID NO: 1257 - DNA, 588 bp, Fusarium venenatum
  misc_feature (1)...(588): n = A,T,C or G
ctaaccgtcacggtcaaggacggagatagctcacgcgaaatcagtgctcgcatttcagccttgccagcacagcacagctctgctcgaggtttatttgaccgcgatactaccctctggtgttcctggggtgtcaagtctggtggaaagtcggtttggtttggcggcgacacaggctaccgaactgtcccaagtcttccacccggaactgatgattacagcgccgagtacgaccaccttccgaggtgtcctcaattcaaacaaattggtgaactccgtggacctttcgacctgggtctgataccgatcggcgcataccacccccgagcagccttctcgtctgttcatgccgacccaaatgatgccgttgaaatctttcgcgacacgaaatgccagcgagcgatgggtatacattggggcacctgggcgctcacaatggaagaagtcttggatccccccaaggtactgaaagaagcattacgcaagaaaagcattccggaaatcggggtgtttgatgtgtgtgatattggtgaagctagaaagtttagctgaacctgaagaagacntgcaggaattataaaacnacatgtt

SEQ ID NO: 1258 - DNA, 614 bp, Fusarium venenatum
  misc_feature (1)...(614): n = A,T,C or G
ctatcactgcggactacggtatcatcagcgggccggcccgttctggtggtgtcaagattgctcttgatggtaccagcaaggagatcaacttctttgtcgctcacttgggttacactccttatggaccttacgacacatgctttgaccactaccccgtcgacaagatcattgagcgtgaggctcagtctggtcgcactcctcagatgaaggccactcttgctggtatgaagagtcagcttgacaatgccgacgacactcccgttttccttgttggcgacttcaacgccccctctcacctcgactacaccgacggtcttaaggacaagaactgcggttactctggcatcaagtggcccacctctgttctccctgaggaagccggctcattgattctttccgcgtcgccaccccgatcccgtcaaggagcanggtatcacttggtcttccatttacatctggaacggnggccgncgtcgacctgnacctntttgaccgtattgactttgttctacacaanggcaagggtcttgaaggtgaccgacttccaaactgtgggtggtggtgaanccnaaccttancccaancacaaggagaatgagtnggttntttgacct

SEQ ID NO: 1259 - DNA, 636 bp, Fusarium venenatum
  misc_feature (1)...(636): n = A,T,C or G
gcatagcaagacaacagttaagctactctgtcacttatttcttctatctcagaccctctcaaccagcacaattatatatttcctctcggcatagccgtcaaaccgccaccatgtttaagaaagaaatccagccttcgcccaagcagaaagctcaaatcttccgtccagcgaaaccctccgcaaggatctactcgacacataccctctcctcaacacctatatcgacnagatcatgcccaagaaaggccaccctttcgagtatgaagcttaccgaccgcaacaccctctacgttctcgactcgacacccatcttcttccagcaggacctgacaggaatccttattccccacctccgacttgtccatcgcttccctcaagccttccctagcatcgcataaacgtggtgctatccgcttcgtcctctctggcgcccctcatgntcctggacttactccgctggtggcagantgccgccnacggtcgcccgaaggtgtgccgaggacaaaatgaccnaaaaggacaaaattccnatggattnaaattggtcagggtgagccgtgtntctaccaaggcaagaaaagctntgtgtggaaactccncngaacaaggagtaagcaggnaggggcgnatnagaac

SEQ ID NO: 1260 - DNA, 576 bp, Fusarium venenatum
  misc_feature (1)...(576): n = A,T,C or G
ccctaattctctgaacaacactccttctatcgctggagcccaagttcacgatgatgtttttggtgatatcacagatgaaggtcccaactaccgagctgtcggatggattggtaccgncncccttatgatgaagacccaaatcggtcttggtgttctgtccatcccagctgtctttgacgtcctcggaatcgctccaggtatcatctgcctcatcgttatcgccgccatcacaacatggtccgactacatggncggcgtcttcaagcgcaaccatccccaagtatacggtatcgacgacgcgggttacctcatntttggtcgcattggacgtgagatctttggcgttgccttctgcctctactggatctttgtcgcaggttctggtatgctcggtctttctatcggtctcaacgcggtctntctcacggtacctgcacagcttgttttcgtcgctgaacaaacatttgnggcttntgcctcgcagggtcccgacccttggccaaataacatgctcgctttgggtcggtntnggcttgnatnaatgacccgttttnttcaccgtcaccaatcgaagtt

SEQ ID NO: 1261 - DNA, 604 bp, Fusarium venenatum
  misc_feature (1)...(604): n = A,T,C or G
ccgaactcttcaagccttgcgcaaaattctttcgacatatgccgccgaacccgacggatcagcgcccttgacatttgtgctgatgggtaactttactcagcatgctgtgctcgcacgcggaggcagtggtggaagtatcgaatacaaggaatactttgattccctggcttcggctctcagcgacttcccaacactacttcattcgtctacgtttgtttttgtccctggagacaacgatggctgggtctcttcctttacagcgggtgcttccgtaccattgccccgaaagcaagtaccagacatgtttacatctagaattcgtcgtgcttttgcgacagctaatgccgaagctggaggaaagacagatggtacggcagtttggacctcgaatccaagcccgaataaagtcttttcgggcctaaccacgagcttggtcttttcanagatgatgtgtctgctcgtctgcgccgagcctcggtccgtctnaagcctnaagccaacgatctagtacagatgagacacaaaagttcggatnctnatcttcccgacgacgttcaagccatggatatttgagctgntcatcatgaagnaccgactgntactg

SEQ ID NO: 1262 - DNA, 649 bp, Fusarium venenatum
  misc_feature (1)...(649): n = A,T,C or G
aaaattgataaatacttattttataacagagacgaggaaaaatggttaacgaaaagctcatttgcgtcattggcgcgactgggtaaccaaggcggttcagttgcccgtcgattcctccgcgcaggttttaaagtccgtggtttgaccccgaaacccatcctccgattcggccaaaaatttgaacgcggctggtgctgaagttgtttcagtcgatttggatgacatagagacacttaaagaagcattcaagggcgccaacatcatcttcagtgtgacgaactactgggagcccttctttagacccgattgccgactgcaggctgccaaggaaggcatctcgtgtcgcaaatttgcctacaatgtcgaaattcagcaaggaaagaatatcgtcgatgccgctgcaactgtggctgaaggtcttgacaagaacggcttcttagtctcaacgctgagtcaagctgaaaaatgcagtgaggggaaatccanggatttgtatcactttgatgcaaaggctgatgtgtttcccccatatgtcganggaaaaatatcccaacttgctgccaagatgtcatgcattcacacaggctacttcttcaccagctttaacattcttcccgacctctatttgacaagtgctgntggctttgag

SEQ ID NO: 1263 - DNA, 628 bp, Fusarium venenatum
  misc_feature (1)...(628): n = A,T,C or G
cagaacgactcggtatttattttcctgaaaccagtatcgtttaagtttatattagggatacggaaataaagttttcgaatcctataccgcctcttgagttcaagatgcctcacgttccttcatcaactgaagctganaatcaaggcgatgcgcctgaactcgtctttccccctgtcaccaaagaccatattcaaaactgctcctacgactcttggtttcccaagtataggagctcttgtctcaagtctcgtataattcctctacccccagctttcattgaataccttcatgaagatggtattgtctaaggcggacgacgatgagcatcaagacgaaccagaggaagagtggcatgcatcatccaacacatctgcgacaccacaagcccaagnatccagaatcatcagacgacgaaaatgatgagcccgagagattgccaccaaaccaaagattcccagagacacataatctcgtcaaggagacgattgctgaattgggtggctcaagtggcaccaaaagttaaactggtcatcaccaaaggatgcgaagtggatttcacctcaccagaatacactcaaatgcacgacacccaatggatttctatnctgcttctcagtcgtctttcttt

SEQ ID NO: 1264 - DNA, 355 bp, Fusarium venenatum
  misc_feature (1)...(355): n = A,T,C or G
gaaataattctttcagaggttgctacatcacgacagaactttgcaagagagcttggtgctacacgtgtcgtgaacccgatagtcgagaacatcaacgaggtcgtactcggtttgactgatggcaagggtgccgatgttgtgtttgactgcgccggtgtaccgatgagtatcaaaagtgcatgcgaagttgtcaggcctaaaggcactgtcgtcaatctcgctatctgggagaaggagattnctttcaacccaaactggatcacgatgaaggagagctcgtacaaatctgttctcggatatgctcgngaagactttcaggctgtcatcgcaaatnttgcttaggtgctattaagcc

SEQ ID NO: 1265 - DNA, 647 bp, Fusarium venenatum
  misc_feature (1)...(647): n = A,T,C or G
cggtatccgaggtgagcgccctgagcgcattggtgacaagtgctggttgtacttccccgaggacaactgccccttctaccgtgccaccatcttctccaactactctccctacaaccagcctcagaaggatgccaagctccctactctctaccttgccaacggtgagaaggctgcttcttccgaggccaaggagggtccttactggtccatcatgcttgaggtttctcagtccaccatgaagcctgtcgatgttganaacctcctcaaggacagcatccagggtcttattaacactgagatgatcaagcctgaggacgagatcgtctccacctaccaccgtgctttcgaccacggttaccccacccccactctcgagcgtgagggtgtcctcaagcaggtcctccccaagctcgagtccatggacatcctctcccgtggccgcttcggcagctggcgatacaaggtcggtaaccaagaacactccttcatgctcggtgttgaagctgtcaatgccatccacagcggggctgtcgaactgaccctcaactaccccgactttgtcaactcccgccaaaacacttgagcgttgtctcacccaaaacttttttttcacacttcccaaaacaacggaatcccaaccacttcaa

SEQ ID NO: 1266 - DNA, 672 bp, Fusarium venenatum
  misc_feature (1)...(672): n = A,T,C or G
gcatcattagcaaacatggcgcgtggatggtttgtcaattgcgctgcctttctcttggctttgaccgccggagggaacgcgtaccgtcttcccgccctctccgctcgcgccagagacagtggtcccaaagccgtcaacatcagtgttcctgtcgatcatttccacaatgacaccatctatgagcctcactctgacaagaagttccctttgagatattggtttgacgcccagtactaccgcaagggcggtcccgtcatcattctcgcgtcaggcgaaacttcaggcgaggacagaattccctacctcgagcatggtattctccagatgctagccaacgccacgggcggtatcggcgtcatcctcgagcatcgttattatggaacgagtttccctgtgccagacttgaagcctgagaatatgcgcttcttgtcgactgagcaagcccttgccgacacagcctactttgcgcagcatgtcgagtttcccgggatggaggacacaatttgactgcttccaccancccttacatcatctacggtggctcctacgccggtgctttcgctgctttcgcgcgcaagatntacccgaactcttctggggcgggatntcttcaactcggtgttaccgcaancaatgtggaattactggaagtactttganggcccacgtctc

SEQ ID NO: 1267 - DNA, 460 bp, Fusarium venenatum
aacttgcgccggcaggcggacgatatgggaagggaactcgaagagcaacgtgaaatgcttgatcaaatagacactgatgctgatcgtatcggtggacgattggcgacgggcatgcagaagttgcagcatgtggtacggcagaatgaagatcgctatagcagctgctgtatagcggtcctcatatttgtccttatactgctgctaatcatccttcttatcatataatgtctgccatagacttcaagagtcagatgtttagctcctttacagcgtttacgatataaccacatgtgggattggagtttgggatggggaattgcttttcacgaattatcgtactctttgaccaagaaattttcttatctcacttaaacgtgtactagaactatatatagagtagcagcggcgggtttattttccaaagttgttgtgttatctaaaggtttatcaaacaattgcc

SEQ ID NO: 1268 - DNA, 547 bp, Fusarium venenatum
  misc_feature (1)...(547): n = A,T,C or G
ttgacgcacgacttctgttctggtacattcgttttactttatttctctggactagtttcatttcattatgctgggtaagttcctagttgccgctctggcggttgttgctggagtcaaccctgccgaggctcaacagcaaaacatcttcattactggtgttccagtcactggtggaagtgccgttcctgctcgccgcaacatcaatgaccttatcaactntggtggtcccactctggacctttacatgcgagccgtccgctccatgtacgatgccaaggagaccgattggaagtnttatttccaggttgctggtattcacggcaagccattcatccagtggaacggcggtggtggccgaaacggcaacggctgcctggatactgcctcacggagagagcattttctgacctggcaccgaccttacgtctggtttacgaacaaattctcgtcgagcacgccnagcgactcgccaacctttattctttcnaagtaccgggcccantaccgttgatgcaccaanaaactgggagcttcctactgggattgg

SEQ ID NO: 1269 - DNA, 591 bp, Fusarium venenatum
  misc_feature (1)...(591): n = A,T,C or G
attgacacagccgacacctttacacccaaaatgcccagctcatgtaaagaactgcgcgaggcactcgcgcagtgtctccaagaaatccgagtgtgtcatggttcagcgcaatagcgccggcgactgcctccgcgaacccctcgtcgacactctccccctaaagtgccgccagctgaagaagggcttcggcgaatgcaagcgtggcatggtcgatatgcgcaagcgattccgcggcaatatgcccgtggcttaccgtacgatggagcaggctgaggagggccatggataccagctctacgctgggcggccggcctttgcaggcggtgtcnagaagacggacggaaacgagcccattccccaagattggagagaatcgagaatgagaagtggaaggccgagcaggcagcaatggcacagcagaagaaatgagagaacggaattctgatctcaaaccaggcggttcgcttccgtcgaatcactacagcaatcaacgatttacgaanacatgtcggaattaagatctaatatgaagacaacaaatcggaaaaaacttgctcactgttttgatcagtcatctctgggacgtgcata

SEQ ID NO: 1270 - DNA, 678 bp, Fusarium venenatum
  misc_feature (1)...(678): n = A,T,C or G
gcaccgactgcccagccagtcaacacccaagcaacaatcgcaagcaacagcaacatcagggaaggggccgcgtcccaatccaatcaagtctcctggcgcaaaaccaaacaaaacgggcaaggtgcccccgacgggccaagcaacaagcaagcaagcaaagaccacgattatgggatacaatcaaagctccataaagccccgaagttacggggacgaattccatgaagctcacacgatnatcaaaaccttccaagcatcaataaccttatcaaccaagccccaagcaagcaaaatgttcanggtaattcctataacaacgggcaagaccaatccgcaatttttagccgctacgatagataatcaccgaccacaaaccgtcagtcctggaactgatcccgcaatcctccagcagcaacagcagcaggctatgccacagcctccacagcaacaacaaccttctgacaaccagcaatctcaacaacagtaccaacaacaagcaagcaaccgcaggcgcaagcagcaacctcaacaagcagtcccaagcagtttcaacaacaagcaacaccaaggaacaagaaccaagaacgaggtacaacaagcaagccacaacaacaagccccgtcaagcctggtcaccagtatactaaattccgtcatgcgcgtcacgaaaggnaagtac

SEQ ID NO: 1271 - DNA, 247 bp, Fusarium venenatum
  misc_feature (1)...(247): n = A,T,C or G
agagtgtgctacagcgtggagagaagatcgacgatctagtggccaagagtgacggcctaagcgcccaaagcaagatgttttaccagcaagccaagaagcagaactcttgctgtattttgatgtaatggaccatttcatttttcctggcgttggacctggcttnttttcagcacataagggatgtcggcattgagattggttattcgtgtggcgcagatacttccaatcgtttatttaacccaccaaa

SEQ ID NO: 1272 - DNA, 594 bp, Fusarium venenatum
  misc_feature (1)...(594): n = A,T,C or G
ggaacggtagcgggccgcccggttgctcgtcgtatggagttcggtcctctatcgcggccttcaagatcgcaagcgcgacataatcgcaaactacacctaccagttcgtcctgtcatttatgaaccagaaggcatgaaggaaatggccgccgagcgacactttgaaatcagtgccaagtcatgtttccacgttttgtttggtgataagagtttcgtgttcccgaagctgtactttgagcgacgagcccaacagatcgcccaaggaccgtgggtgctggtagatcagggcaggatgaggcgtgacttccagttcaaggttgactataaggatgttctgggtcggtcaaagacggcggacgtcaacgactatcagattatcgatgttttcagtgaccatgttacgtacgtggtgacacncgtcaagacgcctggcatctacctcactcaagctggttcaaggttgtgacaaaaattgtcatcacccatgtggctaaaatccaagtgcaagctggcttatctacatcaaaacagattggtngaaagaaccagctctatccaagaacctgattgaccgtcaggcaatccacgacccngc

SEQ ID NO: 1273 - DNA, 502 bp, Fusarium venenatum
  misc_feature (1)...(502): n = A,T,C or G
gcttttccagaagctcaccgtgtccaaggagtcctctgacatcaaggagtcttccaacgagttggcttctttcatcaacggtcgcatcggtgaccaggtcgtccccgagaatgttatcgagggcttgaagaagcagctcgccaacaagaaggacgccgccgcccgtgagaaggcttgcgttgccatcgaggctatcgcttctcacgccgaggtctccgctgccgtcgagccttacctcgttgtcctnctncccgctgtccttgcgccgttggcgacaagatcaccgctgtcaagaatgccgccagggtgctgtctcgncattgctggcggcatcaacgccaacgctgcaaggntgccttcttacgtcatggagtccatccgaagtgccagaatggcccgaaaagatggccgtcttgacttcgtcgagtactcgtaagaactccctgntaagttggctaccgggttcctgactatcctggatttcgagtcattngggaaccaa

SEQ ID NO: 1274 - DNA, 523 bp, Fusarium venenatum
  misc_feature (1)...(523): n = A,T,C or G
ccactactgatatctgataccacattagcgaagccctgccacttaccctttactgttcatcgtgacctatctcagcctcgcgtatagactaaaaataaaaagtcttgtctcacacctacgatgcaagaactcgcctgttgncccccggcctttgtcgagaggaaaaaaaagattcttgaccaactcgcaattcctgatactgagtacacggatgcttcaccaaaaggctctgtanacgagggaatccgggatctnattaatgaaatcaatcaacagtcaggattcgtcactaccagcagctgtgcagggcgtgttantgtattccttgagggacgaaggattgctgacaccgaaggcgaggatgagcgaatancangtgttggtggaaagggtgctggaagaacctggttgttttgtttctcacgatcctatacccgataaaggtgatggggccacggactggagtagtcagttttggacttgaanattctacagctgcttaaaacgcatctccaacggtcaa

SEQ ID NO: 1275 - DNA, 600 bp, Fusarium venenatum
  misc_feature (1)...(600): n = A,T,C or G
ggacaatccatttcaaagcaccgcatatctcacgttctttgcacttaagcgcttctctctcactcctttgggatcgctttttctcaagacagtgctgcggttgcttctccgaaatctagcggcctgtcgtcggcataataaggggaatttcgcgtattcgactcttcagtggttcatctgcgcgccaaactgaacgcctcttttcatttaacgtttcctcccaacctcgacacaaccataagacgtcgcctgacatggccgaacacgaacctgtgaacccgatggcatcgccttcgcctcaacctgacatgacgagaaaccgactgcctacgctctttgaggtcttgagtcgtcgcactctgcctcctgttgacctcttctcattctatatttacatgcgcgatcaacagcgatctgttgattaccttgatttttggctcgatgtcgcccagcacatgtcactggtgccgacattatgttcgtgaacttcgacgatccgtgcttattnggccctcctgaaggcgcaagtccaagcgatcttcagcttattctagaaaatattggggaattggaacccaaaactgccggccngtccatgtt

SEQ ID NO: 1276 - DNA, 521 bp, Fusarium venenatum
  misc_feature (1)...(521): n = A,T,C or G
taaacaaaancgggacggggcaaagaaacgccgactaaggactctacatgggctgagaatttccggttcactattgatcctttagaggattacgtctattatagtcaactgttgcaagctgaggctttggcctcggcttacaggctctggaagcgacagtggcagggcccgaagaaggagtattgcagtggtgctttagtatggcagaccaacgactgttggcccgtcacctcttgggctatttgtgactattacctccgtccaaagcacgcatactataccatcaaacgagagatggcccccgtcactatcggaatgacgcgccgagtacataagcaccccaaggacaagtacaccagagttaacgtcgaaatcaagacccaagttgagatctggggcagtaacctcaacttgaaagacgcgactgtagattgcgtattgaangcttgggacattgagacaggaaaagaaactaccncaaacagtgtcttcggactcgttctcanacaaccgtcacaaag

SEQ ID NO: 1277 - DNA, 619 bp, Fusarium venenatum
  misc_feature (1)...(619): n = A,T,C or G
ncttaccatcgagcacccttcaggcgcaccccctcctcctgtgcctgtcaaccccaagcgcactgccaatgtgaccaagctgcgcgattctggtaacaacgaatatcgcaagggcaagttccctgaggccgttaagttctacacgctgggtgtgcagatggccatgcagcgccctatgtgggagcctgctgcgctcgtgcgggaggagatcaagcggactgcttgccaaccgggcgcaggcgcacatggcgatgcaaaactgggctgagggtgccgtggatgcgcatgcgagcgtcgaggcgcgctgggtcagaaacccaaaggcttggtggaaaaaaagaagatgtcttggccgagatgggcaaatttgaaagaggctagggactggatcaaggaggggattggaggtttgagggtgaaaaaggaaaactggtgcactttttgaaggagatcgaaaagaggatttgagaagcaancaggcttaaattaaccaaanaatggttgagtgtggntagaatcaaggcttgctgaaagnttgaaacaaaatgggaggattcacccnagacatgatanttnggtgtnagctttaaagggcaacgattagnagttnttaaggttt

SEQ ID NO: 1278 - DNA, 570 bp, Fusarium venenatum
  misc_feature (1)...(570): n = A,T,C or G
gtctcttgaaaactacgccaaggcaactagctgctaccgaaccgccggcgctacatgttggcaggagtgtctctacactgcggcccagcagcaacctcccatgtcttctgagtctatggctgatctcgccagcaaccttgcggatgccctctgggaagccaaggattactcgtctgcggctaccatccacctcgagtaccttgactcaatcgacatggctgtcagttgcctctgcaagggctatcacttcgctgatgccatccgtcttgtcgtccaacgcaaacgtcccgatntcctcaacaacagcgttgacaccggtcttgctgacgcactgggcactacaactgagttcctcgcagactgcaangctcaactcaanggccaaatcctcgcgtcgctgaacttcggcgcaaggtatcgaggacctcctgcatctacgaagganaccgcnctggtggatggacatcccgacnattctcngttgctgatctcnctttcacacaatgatcatcttanacataacaggaaggcggaatttggaaactgganaggtattcacaaaacaaaact

SEQ ID NO: 1279 - DNA, 565 bp, Fusarium venenatum
  misc_feature (1)...(565): n = A,T,C or G
attccccatctctcccatcttctgtcttttgttagcttctanacaaacactcgtctacaagcttcgatcgctctcaccgcaaccccccaaaaaaccacttatacatcacatcacaatggaggccatcaagcaagcgcttcaccttggcaagggctctgacgcccctgctgagcctactcccgaggctctcaacgagctcaaggagaagtacacaaaggccggccaggagcaagtcttcaccttctacgactctctgtcctccgccgagcgaggaactctgtaccagcagctttctggcttcgacccttcccacatcaacgacatcacacaccgcgcattgaaccctcccaagaccagcgatgagcccgaccgcctcgagcctnttcccgaatctgccaccgccagtatcctcgattccagtgccgatgatattgccaagtggtacgattccggtcttgacctcatttntaanggtcaaggtcgcgntgcctcatggntgggggccagggtactcgtctgggtagctctgccccaagggctggtacnanatttggccttccttcca

SEQ ID NO: 1280 - DNA, 638 bp, Fusarium venenatum
  misc_feature (1)...(638): n = A,T,C or G
gctttcatcatcaaccacatcaaagatacaagccatccatcaacgtcgcccgtatttccaccccgaaatcgacgggtgaaataaatacatagaactttattctagcgaacgtccatttcctctaaaacaaaccgcctcccaacgcaaatcaacagttcacatccgccaacatgttctcaagcaatggcgcatcgtccctgggcaaactcccaacgttcagtcatacactcacatctctcacacatcttccgcaccctccgccccaggcatccacgatactctccgcccacggtgtcggcgcatcccccttcgactccaagtccacacccgcctctgcccaccctctcgaggcccgactgaagaactgggaggccactcaggagtctctcaagatggaaactcttcgacaaactatggcatggccgaacccatccgccgtggcatggagctcaagattgtccanaacggcgaatggcgggccatggcccttggcgggggtctgcccagcgttcatgaagatattcttagaagccgcgaaactaccattacttgggaagattctttaagggcgatganacaagggccgtggctggattccaccacaagatggagaagaacttaagattcagtaaacgtgc

SEQ ID NO: 1281 - DNA, 554 bp, Fusarium venenatum
  misc_feature (1)...(554): n = A,T,C or G
cgaacctcaaaccagcaattgccgacttgtacacactcaacccatacaatccacctcaataatcgcctcaattcgcctctagccatgtctttccgagctcccctccgtcgattcgccttcgccaggccctcttcctctatctccgtcgctgcccgtggcttccactcgacccctcgtgcctccgtccgggtcggccaagagatcccgaacaccgacgtcctcctcgaggattcgcccggaaacaaagttaaccttgctgaagagttcaagacatccaacggatacatcattggtgtccccgccgccttttctggcacatgctccagcaagcatgtcccctcatacatcaaccaccccaagctcaaacaggctgggcaggtttttgttgtctccgtcaacgacccctttgtcatgaagggctggagcgaccaagcttgaccccgcaaaacagaccggaatccgattcctcggtgaccccactggtgagttcaccaanggcttggacctcggtttcgaagcataccctgtcttccggtggcatgcgaagcaagcga

SEQ ID NO: 1282 - DNA, 361 bp, Fusarium venenatum
  misc_feature (1)...(361): n = A,T,C or G
ctttcagcatggtgtgaagacggatcttgccctactgccacccaagtggtatgagaaggcactgggccttaaggaatcaagtgcctcggtggcagcacccatgccctgtaagatcctgaanaatgaagttgaagagggccaaacagtacaaangggtgcccctcttgtagtgatcgaatcaatgaagatggagactattatccgatcgccgcaagacggtgtgatcaagaagctggcacacaaggaagganatntttgcaaagcaggcacagtgcttgtgatgtttgaagaaccccgaaggaaaggatggagatgcatgattgatttggatataatgatataataaattctggcgttaaat

SEQ ID NO: 1283 - DNA, 930 bp, Fusarium venenatum
  misc_feature (1)...(930): n = A,T,C or G
gtcccatctccaatctttcatcatgcccggaggcgtgtgtgccgncctcnactatgaggtcgacatgatgtccgagtacgttgccganatggccacccgtgtcgtcacacccgaggctgntgngacttcgccattccgcaagttcgtgtctcaaatcctcacctngacacgattgcccagcaccactatcctccttggaatgaactatctcgccaagaggatcaacaccttgaagggacagggtccctataaagcttntgagggacaggtctggcgttacctgaccgtttntttgcttntgggaagtaaagttcctcgatgacaacaccttccagaaccgctcttggtccgaggtgagtggcatcgcccgtctctgagctgaactcacttgagtttgagtgggtcgagtccatgggctggcgcctctatgtcaatcttgacatgagcaaggattaccaggcttggctcgagaactggcgtgactggcagagcatgaagaagcgacaggtcgcccaggccagccgcgagagggtcgcatttgttgttcccgccatcgataccgacatcgccaggtattttggtcacccgccagtcttctcaatcgcgttacctccaggaacaggttggcgaatacgagcgctaccaggctatgaagtcccagcaacagagctaccgccacgcgagtctggctggggtcacacttcttggggagctcctntaattccccgatctggctatggcactcagactacgctatgctgntacgtngagcaacgacggtcaacgatgggttttnaagccgccgacaatacgcaatcgatatcctaactctgntatagacttttacccaattgggcctaantctaaagggcactnccttttacnaaaatntggacttggctgttaangantcctggtggtganccanaa

SEQ ID NO: 1284 - DNA, 578 bp, Fusarium venenatum
  misc_feature (1)...(578): n = A,T,C or G
gccaccaaaagcaaaacgccctgtcgatccattaccgctccactttgggggaacagttctaggaccaaaaaaagaaatatcaacttgatcgcccgcgaatttcgagtttcactcaattcgcttttataaaaccgggacgactttgcgcatatcgctctttgtcgactttttctaaagattctcacaagtcgacaattgtgcgttgcaacttttgtcgcagaaacgcactctttttctttcagaaccgcccgacctcatgtttcgacgatacgcgctcggcttctcgagcgtcggacgacagctctcaaccatgagctcttctagcactcccgttgaggatatgattcgcgcaaagatcactgctgctttcaacccgcagactctagagatttacaatgactctcaccttcactctcaccacaangccatggaacacactacttccagcgagacacactttcgcgtggtcatcacctcagacgcattcaactccaagatgcagcctgctcgtcaccgcatggtctacgcccttctccgtgacgagatgggccaggaaaacggnatccacgctctccagc

SEQ ID NO: 1285 - DNA, 573 bp, Fusarium venenatum
  misc_feature (1)...(573): n = A,T,C or G
cgacaagagaacgccggcctacctcactttcaacgacgttcagcctttgattggatcagaaccctttgcgcaaaccgaggacgaagccatccaaaacttcgactcaaccaagacgacccccctcatcgtcttcctcggcatgctagaggatggaaacgagaacgaccacatttcttctaccgatcacggagatattcaaggccatccctatttcgctgtcgatatcacccccaagggcaaccatgtcgaaaaagccgcgagcttcttggcggaacaggagaagaaagaactctccttagatacgaacgctcgtgccatgaaccaatctcctgaagcagccgccttgtacgctcaagctagatccatgattgattggaactcacgaagccctttctgcgctggctgcggacagcccaacctttctgtccacgcgggctacaagcgtgtctgccctcctgccgacaaaaagggtggcgagaacggcgagactcgaggagattgtgctactcgacatggcgtgtcgaacatttgcttccctngaacggacccactatgattgccggccgttgtttc

SEQ ID NO: 1286 - DNA, 623 bp, Fusarium venenatum
  misc_feature (1)...(623): n = A,T,C or G
gtccggcatcggtcagagtcggtattatcttatctgatctttcaagtacctacatcggaactcagctgggctggtaaccccacttaactgcacgcagtgccgcttcatgcagtgggctaaattttccccaaggtaactccaacgactcatcatcgtagaggcatccttttgctcatcgtcatacacgtcgacctcactcaattggatcatagcaatgctctccaccactgccgccctcagggccggtgcccgccgagctgtctctcgattgcccggcgccgcgcccaagatcacggcggccagccggagtcacgacctcgcccccgcccgcgcgtttagcctgtcctccaaggtcctctccaagcaaccagatcgaacccgcgagattattgccaaaccatcaacagcattggtagtccgcgcgaaggccaacaatacctcaagctattctcgtccgtttcctcacaaaaatttgctgtcgtcaaggngggaggcgcaatgctctaaaantaactcgatgagatctgcaaagttttgctccccgttcgagactcggccataccatggattggtcaaggggaaggaccccacttaacaagtggtttaaacccgggtttacaaat

SEQ ID NO: 1287 - DNA, 513 bp, Fusarium venenatum
  misc_feature (1)...(513): n = A,T,C or G
ctccattcttctgtcaactactaccggccttggcttctttattaccccagaagtattaaaagccccattcgctgttgaatctaccggagcggccccactcttccgtcctccggttgccggacaccggcttcttcttctctcatctttcgatctctctcacgtttcataactcttctatttgtcttctcccatacaaccggtcaactcattaggtcaagaatcacttcatcatgctgccttctattccggttctagccgagtacggcatctctcctacccatggtttccttccggatactctaccattgactcgtctaccggatccatactacaacaaatgggaggccatcgcagccaacctacaagcccttattcttagtcgtaggctgcgtggtgcattgatagactggcagtctctctactatcgggcttgaacatgacgctnaatggcgcctgctattcaatattgggcttnatgggccatggatatatctgggggaggngatcaccatt

SEQ ID NO: 1288 - DNA, 563 bp, Fusarium venenatum
  misc_feature (1)...(563): n = A,T,C or G
cctcacgcacgactccatgagcgtgcgcaaggctcataacagcggccgaaaccatctacgaaatgtagtcgattactacgaacaaattggccacgagaaggcccagtctgtcattgactcaatcacatcttcttatgctgccgagggccaagcccacgcgaaccctatgcttcctcagaatcagcctggccacggctttcccccgcctcccttcggcttcccaggtggtattcctcctccattccccggaatgcccggcgcacctcctggacaatttcctccacctcctggcggcggtcgaggtatgcctcctatgcctccattcccaggggccaatggcatgggcattcctcctaacggttttcctttccctcctcctggtggcttcccattccctcctccaggagctcctggcgctcccggtgccgcgttccccggtatgcccggtatgcctccgcctggtcagggtttcctcccggtggtattccaccacctggatttgcccctcctggcgcangacccccttctggacacgaaaaagcgataaagcttctactgagtgg

SEQ ID NO: 1289 - DNA, 635 bp, Fusarium venenatum
  misc_feature (1)...(635): n = A,T,C or G
gggcagagcagaaacaggaggtatcaaagggacacggaaatatattggcacaccagaggcgcaggctgtattcctcaacctaaagataccttgctcagttcaagcattcaaggatccagaacgcggcaagtccaagcagtacctctttgaggctattgagcgatactttcaaggaggcatcaccagcgtagaggaccgcattcattgcaccaacctgccaccgatctatcttcagcatccaggacattctttgaccattgtcgggtttgagaagcagatggatggccacacaaacctcttggtattcgaccccagctttcacgattctactaagatcagaaacctcgtcgggaagacagttcgactgaaatcctcttccatcgacggacttgtgaagccatatcgtcgcggttcgcactacttccgtaaatacaatgaatacgaagtgctctatctcacaaaatatgcttctgtggcatagttcaatgtaagatnngcttactgctggtcccttgaaccaagcctgaagccttgggcaacgcgcgaactcgatganaaattctggtcctctcaaccctttccaattcggcaaatcctataaaggncaacggagaacaatataatttgctgcgttc

SEQ ID NO: 1290 - DNA, 573 bp, Fusarium venenatum
  misc_feature (1)...(573): n = A,T,C or G
ctatgattgactcagtgtaagcaatttaagcgatagtgaccattttctttcgtgaacaatgtatcttcgcattccaaaattagacccgacttcggtattgcggagatctggactcctcaccattgcatgagcagacctcaaccgtaccaacagacagttcaaacgcgatcatcccctgataaaaaatgccattcatcattcaaggctcagtcattctggttacagcaggcacgtctgggcttggtctcagtgtagccaccaaactcgtcgaactcggtgcaaatgtcgtgataaactacgcctccaacaaagaccgtgctgacagtgcgctttctcaactccaagaattgtcaaggaaacaagatccctttcccaagtccatcgcaattcaagccgacgtcactaaganatccgaaattcancgcttggtagccgaaaccgttgctgctatgggcaagcttgacggtgtggtgtcnaacgccggctgggacccaattcgcgaacttttctgatcttgacaataatgtcnatgaaaaagttggggataaatgttatgcgggcaacgtcaantca

SEQ ID NO: 1291 - DNA, 589 bp, Fusarium venenatum
  misc_feature (1)...(589): n = A,T,C or G
gcgacaacgttgctcagcagcttgctaaaaatggaacattggctatcattcaaaacgccactcgcgccggccggcctaagattcatgagatggcccctggtagccaggttagtcattttctctacaaatcccgggccaacgtgcagttctgtatggcatcattggagccacatttcactggccttgttgcccgcaggagattaatgacaacttaccatgagctacatgcatcaattcacgccaaacactcgcaccttaaagtgttgcatgcagttggggatgatgcaacttccctggcatggactacgcctgtttccaagttttactgtgtaccagggcctaacgtgtcaaaaacaaccataacacagggagcaaacaaaatcattcaatgggcaaagaagggaagaaaaacgcctttttattattggaagcggtgtgttctgaagatatacctcctatcgaagtctggtttcctcntccatcctaaaaataaaaccgcctggccttgccatcgatcatgtnatggggccaaacagaaaaaaatncctcccaacgcccacattattcgtttctaacggaatcccccttc

SEQ ID NO: 1292 - DNA, 539 bp, Fusarium venenatum
  misc_feature (1)...(539): n = A,T,C or G
aaggaacatcccaccgcttattactctgatttgaacattgtcaaccatcatcatgtcgaccactccaggagtaactttccgaaaggacggaacgaaaacattcatcccgctcgagaacaacccagaagtgttcaccaagctcattcataacctaggcatctccaagaagctcggtttctacgatgtctacagcgttgacgagcctgagttgctggccatgattcctcaccccgtccacgccctnatttttatcactcctgcgcctatgtgggctcgcgttcgggaaagtgatcctggttcaaaagagttaacatacgatggctntggccanatgaacccgtcatgtggtatanacagactatnggacacccctgngggctnattgttttctacacagtgaaacaacggtccggccaagattttttaacccanactgctctaacnaatcatnaggagacacaggaccttaancccttgacggccgatttctttaaattccgtgactggaaaggccatttggtgcactttacagggatttt

SEQ ID NO: 1293 - DNA, 599 bp, Fusarium venenatum
caatctcaacctcaaccatggaatccctctcagacaccctgtgggatgtagtgatcagcggcactgggctacaacagtccctcctagccctctaagctttggattccatcgtcgagatgtgccccggtcggactgacccagccttctttgttgaagagctctgtcgcgttcaggcaaaaacatacttcacgtcgatcccaacccattctacgggggtagcgaagccgctttcagcctccaagaggcagacgagtgggctgagaagaaccgatccgcccacacttcccggttattttctgctgcggaagcaaagcgtgatgacaccttgagttcagcacgtgcctacagtttggctctcgcgccccacttgatacattcacggtcgaagcttgtcactcagctcgttgattcgaaagcatttcgccagatcaagttcctcgctgtcggctctttctacatctaccaagcccccttcggattcttcgtcgctacattccctcagccggataccgtcgactcgcgaagattcttttccaacaagtccataccggctcggtccaagcggtccttgatgaagttcctcaagtttgtgcttgatt

SEQ ID NO: 1294 - DNA, 400 bp, Fusarium venenatum
  misc_feature (1)...(400): n = A,T,C or G
gcggtactatgagcctggcgcgaaaatctatgtctttggcttcagccgaggtgctttcactgccaagttcctcgcccgaatgctcaacaaggtcggtcttctctgcaagggcaacgaagagatggttccttttgcataccgtctctatcaacgtcatctgcaaggcgagatcaaagacagtgaggtagcccagtgctcccatggccatgagcacgatggagatgaatctcactcccacgctggtgaaatccggctaccgggccaggatcccactgatgtcagtgacgagaccagagaggcttcgaatgagattgaggccttcagccagacgttttgtcgcaaagagacgaactcttgatggcgaanaggagaatttcaaggnattctttcttnggcatct

SEQ ID NO: 1295 - DNA, 565 bp, Fusarium venenatum
  misc_feature (1)...(565): n = A,T,C or G
agctgatcttccaccaaattgctgggagacggtttcctttcttttactggcgaactttgatacccctcatcacctaatcttgaaacctgttgcaaccattggcgaacagcgaacagggaactgcacgggtatatacaaatccacaaccattcactgccaacttgtaccagccgaaatagaatcttacttaccccgtttccctcgaagtgattgaactcccaccgctcaataatctaaccacaaattcgtcatcatcatggcgtccgtatcgtcacttgataaagacttgcgcaaaatgcgcttggagaaatacacgcctgctgcagcgaacgaagcgcgctcatggattgaagacatgctaggggagaatcttccttcgtcagatctgctagaaggcctcaaaaatggaatcctttgtgcaagctcgccaatcgcgccctaccgcccccaggaatccgattccagaaatccgccatgccgtttgtgcaaatggaaaacatctcgctcttcctacgcgcatgccagtctncgccgttgaaacttcnacaacacaanacattcccga

SEQ ID NO: 1296 - DNA, 422 bp, Fusarium venenatum
  misc_feature (1)...(422): n = A,T,C or G
cctgaagctgactcccgtccaaaccgaaaagctcaagaagctcgccggctctcgctacaatcccgagacagagatcatcaagatgagcagcgacagctttgagcaccaagcgcagaacaagagatacctctccaacctaattgacgacctcatcactgcggcaaggaccccaaggatacttttgaggatattcccctcgacactcggcatcatgttgttaagcccaagccgcaattccccaaggagtggcgcatgaccnctgagcgtcgacagcagcttgatgagcaccggtcacgtttggncattgaagatgtgaagatggctganagcggtcagttgatcgaccgngttcaagccattgaccaacacttggtganaacccaccgaggacanaagaaggccaagnttgnggacntgttctt

SEQ ID NO: 1297 - DNA, 628 bp, Fusarium venenatum
  misc_feature (1)...(628): n = A,T,C or G
caacatcatgctgcgcaaactcctcgtcgaggaccgtgtcattggcgatatatcaagtgtagttcacactgaacctgtaggctactggcacttctctcattcatacgttagaggaaactggcgtaatgagaacaccactgccccgtcgctgctgacaaagagttgtcatgacatcgacttgttgctctggctgctctgctctccagaaaaggcgggacagggagagcctcatattcctgcgacggtgtcttcatcaggcggccttcatctgttcaagaagagtagaaaacccaaggcagcagggtccgcaacaaactgcacaaagtgcccccttggagacgaaggctgcaagttctcggcaaagaacatttaccttggcccaaagctcaaggggctgcagtccggcaacactcgatggccgtcagtatcgttgtccatgatatcgaggactacccgatcccaagaacaaagagaggagctcctcatgaagacccttgaggaagactatngcgagtcgacgcccaagtccgaaatccaatcccggnactgggtcggccgttgcgtctttgaacagatacaatggttgngacgaccaatttgcacaatacctggnccgaatctacttaag

SEQ ID NO: 1298 - DNA, 742 bp, Fusarium venenatum
  misc_feature (1)...(742): n = A,T,C or G
tttttataccccagatttctcttttcaagcgcctgtttctcgttcttcatcaatcaacactgcttccatctctacgcgcagtcagctccattctgtcgcgacacgatagcttcatacaaacgtacaaataaacagacagacaccatggcctcaccacagaagctccgaactcccatcaccgatcttttcaagatcaagcaccccgtcctcctcgcaggcatgaacgtcgctgctggtcccaagcttgccgccgccgtctccaacgctggtggtctcggtgtcattggtggtgtcggctatacccctgacatgttgcgcgagcaaatcgccgagctcaagagcttcctcgacgacaagaacgctccctttggtgtcgacctgcttcttccccaggttggcggtagcgctcgcaagactaactacgactacaccaagggtaagctcaacgagctagtcgatatcatcatcgaggagggcgcaaagctctttgtctctgctgtcggtgtacctcccaaggctgttgtcgataagcttcacnccaatggtatcgtctacatgaacatgatcggcacgtcaagcacgtncanaagtgccttgacctcggtgtcgatatcatctgcccccanggtggtgagggtggtggccacacccggtgatatccccacgactgtcctcatccccgtggtgnggacatctgcaagaacacaagtnccctntcactggcggtctgtncaaggttatg

SEQ ID NO: 1299 - DNA, 579 bp, Fusarium venenatum
  misc_feature (1)...(579): n = A,T,C or G
gcattggcaacccgacaacctcgaaccctttcgcctccagcctccttcacatgttcgaaacccctcgaatacgaanccgggntctgaacttttcanctcttacgaaacccaaatacaaactcntccnaagccgaattgaaacaagaaactcnaacaaatccctgaactagctggggagcccnaaagggggccatcagccaaaccgaacgggnacttganganctcgattaacaactcagcgcaatgcgcctggagaagcagaanatcccaaccagctctcgcaccaaggtcnaccagcgcttccgaaactacgaatcagacacagacgccgctcgtcgcaagttgaacactctttcctccgaacgttcagcgcttttcggatngcgctacacagaaaaaccgctggntcatcagatatcaacatggagcagcgacaacagttgctttccggcacgggaacgccttgatcnaaacacacagcgattgaaaaacagtcnagcccttgccancgaaaacgaaggcattggggccgatacatgggcaatcttggttgacancgaaaagttgtcgaacgttccc

SEQ ID NO: 1300 - DNA, 596 bp, Fusarium venenatum
  misc_feature (1)...(596): n = A,T,C or G
tttgattcgctttttgtcttattttctactctaatccaacaatgccttcttaactacctcaacctcctctgaagttccacacaccagaccagccctgtcatcacaacccttcagagtgatatcgaatattcttgatccagtcgcagggtcgatagcttgacctccagcacactcaataacgagcgccacaggtaacaactcgtagtacttccgcagcttggccttgctcacggacgtcacgggtgagacgtacacgccgtgacctttgacaagggcgtggtagacgtcaaggtataagaccaccagagtatcgtaagtgtatacttggcgttgatgaactttggtgaccaagctcatgtacttggtcgttcttttggnggganattngcaaaatgggcgggggcnaaagtaaccgngntttttaaaanggagggttcnggaaaaagcgaaagcnttaaggacngggnccacngggggaaactttatgggggantttgttttgangggtttgaantttcnaaaagccaacacaangggtttttggattccaaggggacttttntaaangggggancaaaatngcccaagggggtttc

SEQ ID NO: 1301 - DNA, 663 bp, Fusarium venenatum
  misc_feature (1)...(663): n = A,T,C or G
ccttcctctcttagtggttgtctttccctttccatcgcgcttcactatcacattaacaactcaaccgcaatcatgtcaaagacctttaccacaagcgacgttgcgtcgcataacaagcctggagacttgtacatcattgtcgacggcgatgtctacgacctgacaaagtttcaggacgatcaccctggcggcaaaaagatcctccagcgcgttgctggtaaggacgcctccaagcagttctggaagtaccataacgagggaatcctgaagaaatacaagaaccagctcctggtcggctcccttgactccaagcccaaggctcccgaacccaaacctacggccaacgcgacacctgtgcctgcggctcctacgcccaaggccgtcaagactgccganaaagaagttgccgccaaagaagaagaanccgaggctctggagccctttggtgaccanattccctttgctgaccctgcttggtaccaaagttaccactcaccttacttcaatgaatctcatgctgctctgcgtgccgagatccgtgnaatggataganaacnacatcnancctcatgtcctgactgggacaaggccaagaggtccccaaaaaatttacaaggagatgggccgcggggntacttgcnggcttntggggnaaaaaccaat

SEQ ID NO: 1302 - DNA, 601 bp, Fusarium venenatum
  misc_feature (1)...(601): n = A,T,C or G
gtggnttcacantctgaccctcaanccancaaccccactgggaagacgacaatacaggngtctcaatncctagtccctgtttgcgactggnctgaaaangctgaaacaagactgagaagaangaattgatttcacagtcttaccgattctcatgctcggtctctttgccttacagcttgatagacgaaatgtgggctatgccatgactacaaccttcaccgaaagatctcngtataactaatgatatcgtcaactatggcaaccagctcatgctagccgccgttgtcatcttcgagattcccttcaacatggatttgtccaagatcggacctgcactttggcttatcatacangtatttgcatggggaacaatcgcaacagctcatgcagntatacacancaagtcaagattttacgtcacacccttctgcaagaatgtgggagctggatacntggctgcgcgctgacgatnatccctcattttatacncggaagaatggacgcgaactagctggtttnnttggaatacgccactggctnagttggctcttccgcttattcaaaaccnggnacatggttgaaaaatggatggnttccccac

SEQ ID NO: 1303 - DNA, 617 bp, Fusarium venenatum
  misc_feature (1)...(617): n = A,T,C or G
tcctgaccctcatttgtccaaaagagactcaactgttgaataattggttttcttattttgcttgctatttacagttgtgcggcttgcgctcaacttccaactcattcgctccttgtccaattcgactacttctaaatttatactcgcgacgcatcaaaagtatagcacatactctaatattcaacccgtcatgggcaacgacagctccatcctcgccgacggttccgcaatgattgcgcccggcacatctttcaaccacacgctcttcgacacagctttaccgccgctgcctgtcttcagcctcgaggtccagcctgacctcttgtcctgggtctccgacttttggctcaatctgctgctccctgtcgtcgtctactgggccttgtctctcaccttccacgccatcgacgtactcgacttgttccctcaataccgacttcacacgcccgaagaaatcacaaagcgcaatcacgtttcccgttatcaagtcgctcgcgatgttatcctgcaagcaagatnatccaagtcgtcaacggcgcactccttgccttgtcngnaacccccganatggtaagcaaagggcgaatatgacgttgcnattgggctaaccgcantcg

SEQ ID NO: 1304 - DNA, 621 bp, Fusarium venenatum
  misc_feature (1)...(621): n = A,T,C or G
ctcccgccatggcaacggcaacgctcatcgctccgtcagcccattatccagctcaaccgcctttcccaagctattctcaatcgaactngggtgccgccagcatatccaacatgatttcttccgttgaacctcgaaaacaagcagacgatcaagagccgccaaaccgtcaatcgcttccgtctatctnggaagtcattcagggcaccaagcctggaccatatcctgtcgcacacgcacctggtctccagtctaccccgactctgcatcgccctttgccccggctcctcgatctttccccgaaactganaaacgttcctntcctcagcctnttcacccgacctcagnttttcctcgacaagatggcctgcctgcgttctcggactcaccccgccacacttcagcagncgccatacttcctccgtctntgatcgcgncaganccctccgatcaagcctgatctgcctcccagcatcaccacctngagcaaaagcattcggaacctnatcaccctntgaatggngtttattcgcatctcgcgcaccgcttctcggccctgtngatacaacctggtnaattgctcctggggaaaagcctctcctgngtatctatttcccaaaaacn

SEQ ID NO: 1305 - DNA, 670 bp, Fusarium venenatum
  misc_feature (1)...(670): n = A,T,C or G
gctagtacctacccctacttacgactctcgacaacttgtctttatcaactttccttcctcttctaattattccatcaactcaactgctctccagatccaaacttgccacgggcaggtcaacaatcatacgaattccttctatagctcacacttgagcaacccgccctgacaatgggcgcgtggaacctcttccgtgttctgggcgacttgtcccacgccctctcgaaatgcatcctcatcttcgccatccaccgcaaccgcagcgcagaaggtgtctccctcatcacgcaggtcctctacgctctagtcttctgcacccgctatctcgacttgtttagagagagtgtgccgtggaacattgtgttcaagatcttctacatcctctcgtcgatttatattctgggctattatgcaatggatttaccctcgttctcgcgaacgtgaagtctcttggaagattggcgctgtcattcttggcggctccttcgtcctgtcgccaatcgtcatgctcatctttgaacgaagtgaacaccgaagttccaaacctggatgtgggtgtttcccaaattctcgaatccgtctgggcctcctcaactcctcctctgananaaacaaccgccccaccgttatcgacttcttntacctggcgccttggnttctaccgngcgct

SEQ ID NO: 1306 - DNA, 549 bp, Fusarium venenatum
  misc_feature (1)...(549): n = A,T,C or G
cgtctcgtatgagaccgccgctctgcttgaaccattgtctgtggctattcatgcagtgaaccgtgcaagaccagagcctggctctactgctcttgttatcggagccggcaccgttggattgctgactgccgcaatggctcgccaatcaggctgtacctcagtgactatcaccgatattgacgctggtcgtgtcaactacgccgtcagccaaggattcgcgacgcacgggttcgtgactcccatctcacgtttgaattcgnccaactattnttngggaatatctacacctgccactggtaccttgacacctgccagcacgttctcgacggnaagccgnttcgacggagcaaaatctntggctacggacatacttgcctnttngaactcccctggctnattcatccttgaagaggatgaggacggcgtcgatgtcacatttgaatgcactggaaaagaggtttgtatgcccacaagcttgnacccaaccaaagctggngggaaaagtcatcatggnaggcatgggaactctatncaaactnttcctttgng

SEQ ID NO: 1307 - DNA, 686 bp, Fusarium venenatum
  misc_feature (1)...(686): n = A,T,C or G
gggaagggtggcaccttggggcaacgactttgttaagaacaagggtgagggtaggatctttctccttcacggtgccccaggcgttggaaagacatgcactgctgagtgcatcgccgagctgaccaaccgacctctcatttccctcacgagcggtgatttaagtgtcgattcttaccacattgagaacaacctcagctatttcctcgagctgggccaacgctatggcgctcttgttctgctcgatgaagccgatatctatcttgagcgtcgccgctccagtgacatcaagaggaacggtttagtatctgtgtttctccgggctctcgaatactaccgaggagttctcttccttactacaaaccgggttcaatcattcgacagtgctttcctgagtcgaattcatgttgccttgcactacaagaatcttggtcacgaggaccgggagcgcatctggagtcataacttcgaccgtttgagccgagactccaatggctttggtgcatgtttccaacgcagttcgcganttttgcttggatagttgangatgtccgtagcctcaagtggaatggccgagagatctgcaatggtatncaaactgnacttggcttggctgagaacgatcanaggaagaaagacccnagaatttnatcnttggtngaagcacntttggnttgtggntaaaatga

SEQ ID NO: 1308 - DNA, 639 bp, Fusarium venenatum
  misc_feature (1)...(639): n = A,T,C or G
ctcggaaagtctggtcaatctgagaagctctttgccacttgtatcctcggtgtggttaagctcagttccgcttacctttgtgctttcttcttggtcgacttcatcgggcgacgacgctccttgtatggtggtatcaccattcagatgttttctattctttacatcgccatcttccttagcattgtcggcacagaagctctcgagaacggaaccttgaccccatctcagaagcatgccggtgtgggtgctgtcgtgatgctctacctctctggcgtaggatggacaatgggttggaactcgtttcaataccttgttaacgccgagatttggcctcttcgtctacgagccttgggaaagctccatgacgatgtgtctacacttcgccaatcaatacnggnacacaaangctggtccgttatgctcctttccatgacaagcgcttgcttcttcttcttctggcagtggtggctacttggcttattgggtttggcattggtcctgaatggctggccgatcgtcagacctgacnagtggtctcctaccttgnccaanatggncgcatggaataggnttgccctgcaatgaancctattgcaaggataaaggttagtaaggcaaatgttaataanttggcccaaa

SEQ ID NO: 1309 - DNA, 623 bp, Fusarium venenatum
  misc_feature (1)...(623): n = A,T,C or G
ctccaagctgcactctacaggaacctcgacggagtctcgggtcatgctggttggcaatggctgttcatcattagcggtataatgacgatattctggggtttcattggtctacttgtcattcctgactcacccgccattacaagagctctctggctcactgacgccgaaaaagagcttgctcgtcttcgcatgaacgactgtggtgcaaaacgtctggcatcatccctcttaaaactctcgttcacaaactcaaacttctcgtcatgagtccattgcgtatttggttctcgcggcatatcttcaatttgcatggagtcagcgcgcgaactcttacttcttgctcttcctcaaaggactaaacaatgcggatggaacaccacgttattcaagtatacaccgtaacctgatccactcggcggatatgctatcaagtatagtctgcaatattggcctcaacgccctcancgattggaaagcgtggcgttggcaggtaagtgcggcncgcccaattcaacttatcgcaacattggtctttcagntggnctgattatggaggaaatcatgggctttacttcctactttgntactgganttgggganatgcatacttgntgggggggcna

SEQ ID NO: 1310 - DNA, 512 bp, Fusarium venenatum
  misc_feature (1)...(512): n = A,T,C or G
ctacaactccagcaccgttaatgacgtgcaaaatgtaatcacacaatgggctganactctgccggtgataaatgacgangaagcggcgccctatgcctatgcatacttggctgagctgattgaaaagcaacacccagctgttgttaaccaggctggcaaggttttcgttttcattgcccaagcccttgaggcggagacacttgtaggccagactgccaaccgcgtagtccaagttaccaaaggactcctgcagtcgacttcagttgatccttcgccgctgctacaacagttctctccccaggcgcaacaaacaatcatgggattcttcaactagacgtggacctcatcagtgttggttatcgcgaantgccgcgtggctgggattcaatgaacgtcnatggtagttattcccataaagtcncgaagcatgaatctaaaaaattangtcngattgataagctncnaattttacgaaggaaanatgaatttgttccngatgataccaaatgatc

SEQ ID NO: 1311 - DNA, 625 bp, Fusarium venenatum
cttttcttcaatcaacctacacttcatcgacatactcaggttcttaaccttaacgcatattctacgactcaatacatacattcagcaacatggctcctccgccaaaccccaatcttcctctccaggaagagacttatggctcttgcccaaacccttcagttcggttggtttgtcggacacctcaccctcatcctcgcaacgattcgatatggcttttcctggttgagaatgaactactatacccgcatggcccagttctcttaccgaacagcctttgtcgccgccgccgtcacctatggcatcgtcgtctacaagacaatgcgcgctcgtgctaagagcggccagcgtgctgctcccactcccttggctatgcttgccgatgagaacattcaatacctcgccatgtctcttgtttggctcttctgcccccaatatcctctcgccttgatcccttataccatttactcggtcttccacgttgccacctacactcgcgccaacttgatccccgctgttctagcccccaagcctgctcccgaagctggagggtgctactcccagcccgtcgaaacaagcgtcgaacaccctcttgctaaccaaaatgggcgcttttgttaaaggagta

SEQ ID NO: 1312 - DNA, 165 bp, Fusarium venenatum
  misc_feature (1)...(165): n = A,T,C or G
nggtatcccgctccggaagctggacctngacgtcgaaagacttgcatncncatcaactttcgagatcgacgagcttgccnagcnaagcnagaagttggagcancgtgtttccgtccttaacgagagttaccnagactttgaagaagcncgagggcgacctgaccg

SEQ ID NO: 1313 - DNA, 503 bp, Fusarium venenatum
  misc_feature (1)...(503): n = A,T,C or G
ctccgatgcctccgtcttcgcggagtacaccgnccccaagatgtacctgaagctgcagtactgtgtctcttgcgccattcacggnaagattgtccggtatgttgtcctcctatccaggagtgtgacgactgcnccatggttgcgtatgtgcttttanatgaaccttggtggtaccatgtnaaacatattccagcctgccccagcgcagttgcatactcctggtacgtatttaacgatttatgacaactgacatgaatataatagtgtccgatccgttgtcggccgacncaaccgtgcccctcctcctcgcgtccgttacaacaaggacggnaagaagatcgttcccactacccctaaggtttagatgggttgatacttgggatggagtccggttatgatagcagcattcaaaaaatggntgggatgaatacctnngggattatgaaactaanaaattccaaaaatcaactggacgacgtttgatgtctacncgtntttgacaa

SEQ ID NO: 1314 - DNA, 644 bp, Fusarium venenatum
  misc_feature (1)...(644): n = A,T,C or G
tgacaatctcagtaacagactgagctcactcactctcgttcctcccaaccttcccttctccgatcctgtcagccgttttgagtcgnacaaatggctcctcgtctanaattcagtatcgagcaaattcgaaataaggctcgcanggacctgctgtatttgcttgaaggtgttcgcggaaanaanaatgttatcctcgatcagagtcttgtcggtccaatcgggactatagtcaaggttgcaactcttcaggaatatggagtggataagttcttnnttttggagaatgacaacgcagatacaagccagcgcaatgtcgtcttcatctctnggggagagtgcggtcgccatgccgaaactatagcagcccagatcaaacgcatccagcgcgaaagccaaacagggcacgactttcacatnttttgggtcccacgccgaaccctcgtatccgataagctgctngaanatgccggcgtattgggcgacgtcaatatttccgaactcccacttttcttnttttctttaaaaaaagatgtactnttccttggagctcgacggctngtttcgcgacctatcctttcgaaggacgttacaccaaacttcttatgggngaaagccctnttggaagtacaacaaaaaccccngtt

SEQ ID NO: 1315 - DNA, 856 bp, Fusarium venenatum
  misc_feature (1)...(856): n = A,T,C or G
cccagccccaggtccagaatggagttaagcctgaaggcagttatgtcaagactgagtctcccgtacccatcaagcaagagcctggtttacagggtaacccgatggcgtatcaacagtacgccaaccccaacataaacatgaacgacaagaacaacgtggctgccgcccgcgctgcccaacaattgcaggctcaatatggccagcgtgctgcaggctcgatcaacgctttgcatcagcaacaacaaccacacccccaacagggccagcagcagcagcagcagcagcaacaacagacacatcatcaacagcaacagcctggccaacagtcgaacctgacccagcaacaacaacatcaacagcagatgtatcgtcagcagatggcctctgcaactgcccaccaacaacaacagcacccctccaatggtcaaccccacatccagaatggccagaccgacggtgctggcgacgtggacgactacgagggtgtgctgatgcagcgggctgcttctggtgattttcgcgaacttggacgggttgagatcgaccgcatgctgcacgaacagatccttggccaaggctaanagtttggagggtggcgggctgatggtccccctgaaggaagccacccgacactcgtcagcttcaacatcacgcaaggccaagggaaagcaacccgccgcgtttgacggaggtgatgacgatgaagaagacgatgacgacgcttttaactcggaccttgatgatcccgaggatgaccgcgaatgatgatgatgtngacgacgaaggactgggcacatcntgctgtgcatgtatgacaaggtncaaccngtcaagaaacaantggaagtgcccactt

SEQ ID NO: 1316 - DNA, 1669 bp, Fusarium venenatum
  misc_feature (1)...(1669): n = A,T,C or G
acttctccctctcgttccaggtcaatatcagtcaagattcttcattccaacacctcacacatcctctccccagaaactctaggccagtctcacttcgtctcactctcacacgagatcgatcgccttcgttgtcacatattactactccgatccaatcaatcaaaatcgtcaagatgaagtcttctctcctcaccgttttcggcctggttgctgccgccgctgcccagagctccggcgacctccctcagtgtggtcaaacttgtgccagcaacatgatcagcgctgccaagtcccaggagcttggatgtgatgctggtgacgttagctgcctttgcaccaaccaggacttcatctacggtctccgtgactgctccgctgctatctgcaacgacgagcaggccgctgctgttatcgcctacggtcttgccctctgccgccaagctggtgtccagattactactggtagtgctggctccgtttcggcctctgctactggcaccggtgccgttcgaactgtcctcagcaccctcgttgagagtgacacaaccatcacttccgccgtctccaccatcagcggtactgccactggcggcaacgaagacgacctctccgtcagcacctacactagtgttttcaccaactctgcgggtgatgaggttaccagcaccatcaaggagatcctcggtggtgttgccctgactacctacacctctggtggatccaccatcatcgagcctgtcgagactgcctctgcctctgactctgcctctgcctctgcctctgcctctgacgggactgagtccgctgaggtcactaccttcaccaccgacggcaccgaggtcgtccgaactctcgtcaccgagactgcttctactgactctgccgactctgctgaggtcaccactttcaccaccgatggcaccgaggtcgtccgaactctcactaccgttaccaccggtactgagtccgagtccgagtccggatccgtgtcggagactgttactgacgcctccaccgtcaccgagggctctgacactgctaccggcactgatgccgcggccagcgccacctctactgaagctgacaacgctgccgtcgctcagatgaccggtgcccctattggcgtcatcgcagctgctggtatcgctatgctcctcctttaaatgaaggatggaccggattttgatgtttaatgcttttacgttgcacatgtttgttacataattcacgcctgtacctcgatcttttgggaccttagcatatttcctcggtgcaaggagtcggtttgcggaagaatcttcacattatggagaaatggaaacgaagtgaatggacatgacaggtcaggttttttcgaggctttaatgacggatacggcttatctctcctttaatggacacgacaagaaatgttagagaacggatgggatctttgatgttgtttgtgaggcgaggcggtggtatgacatgggagacaacgacgggagacggcatgctcgtgctgctgtcacacaaggcctgtgtcgtctttgatggttacatgggttctgggatggtggtgatacccggcctacggcctgacttcgggggtggactttacttctcacattcattgagaattagtaatagataatcttcttcacacaaaaaaaaaanaaaaaaanaaaaaa

SEQ ID NO: 1317 - DNA, 584 bp, Fusarium venenatum
  misc_feature (1)...(584): n = A,T,C or G
cagcataacacagcacagcacagtagatacaaacagatacgtacctatataaaactggctacatctcagatcacacctcgattctgtcttttgagttacctgttcattctcatcatcattggctctgttcaacaaccaactgtctatataaaccactcaataacccactccactcccattcagatctatattctcaacttgacccagaaaagtgacaacgatcatcatggctgactcttcaatcactttcctgcccctcggcgccattattcaatctcttgtcgtcaacggcgtcaacatcgttcaaggcttccccgcccaagaagactatgagaagcataactctccctactttggcgtgaccgttggccgcgttgccaaccgtatcaaggacgctcgaattgacagcctcaatggcaaggaagtcattcttgccgccnacgatggaaagaaccatctccacggcggcagaattggctggagcactcgcgtctggganggcccaagcccgttggcacccgtgaagtcctggtgttgaaggtctggaaggcggaaaaancgttgcttttaccttactagcgagg

SEQ ID NO: 1318 - DNA, 551 bp, Fusarium venenatum
  misc_feature (1)...(551): n = A,T,C or G
agccattgagactctcctcaccaagactgaatggtcgcccaagcgcactttgatcctcgcatttggtttcgacgaanagtgctcttggtcctcgtggcgctgccaagaatngaagagttntgacggagcgatattggcnataatggaattcccttcatttttgatgagggcggttcgggagttcatntcntcgacgacacgctctacgttctttcttagtgcaggagaaaggcgcgattgacatttgggctgaactccgtgtcaagggcggtcacaggntntatttctnacccacacaccgggcattggnatnatttccgagattgtcaagtgccctcgaagcaaaacccctactngcctggtttttgtcaaggacagtncccgtgtacnancacctttgtgtgtttgnacgttaattaccanatgcccaccccaagttnagngaactcttaaanaaggacgaccttgaaaaaggtgactttttgncttnaattcgtttttgacccaagcgcaaaggttaccattttaaaaaaccgcaagccgtggaaata

SEQ ID NO: 1319 - DNA, 342 bp, Fusarium venenatum
  misc_feature (1)...(342): n = A,T,C or G
cgagcttggtactcctcttggcatcaccatcgatttccagacagtccaagacggctcggtcaccctgcgagaccgtgacagcaccaaccaggtccgagctgagcaggggaagatcatcgacgctatcaagtcacttgtggatggtagcaagacctgggcccagattgagagcgagctccccaagtttgagggtcaggaggtcnaggttgttgcacgataaagcangaaaagggataaaactagcatatacgaaaggaaaatgtaatttattagatgtcatcttggcatggtcatgtgtcaaaacaatgaacgtntaggcaggagttaggatttgtcctgatc

SEQ ID NO: 1320 - DNA, 579 bp, Fusarium venenatum
  misc_feature (1)...(579): n = A,T,C or G
agaatgattcgaactacgaagactggcgatattgtagctggttacactccttcaggtcttggccgtcccgtcacctatggaacacatcaaacccatatcatttgtccggaagacatgttgtttagggtgcctgacaaccttcccttgcccgacgcagcgagtttaacgaccgtagctatgaccgcagctgacgctgtttacaaccgtctcgggtttccgttgccctcgcgaaagggtcactttgaacccaacaagccatttctgctatggggagcaacgagttcggttggatactgcgcacttcaactttccatcgcaagtggtgtgtctcctattttcgtcacggcaaagcccgaacatttcgaacatcttcgatctcttggtatagcccatttattcgactacagggatccagatgttcacaaatccatcgccaaagctttgcaagacctagggcttgagagattcgaatatgcattcgatgcagcgggggctcctgattccgggggtcnggtactccganctgtctcagacgttacacggattgtttctactgtattgcgtgacaanaaaaccctc

SEQ ID NO: 1321 - DNA, 366 bp, Fusarium venenatum
  misc_feature (1)...(366): n = A,T,C or G
gctcaagttcgaggtcgcgtncccgaagatcttggggagcaacagcaacggcgaagagaacttttggcggtgtatcgatggacaaaggacgggactggcttggcactatgagcagggctctatagtcatggctaggaaatgaatggaaacgtaaaaaggaaaggagaaaagggacaacatncttggggcgtcttgggagggacattcnctttttttggacggaataacggccttaatggactcgagattganctcgagtatgggagcgacaagggtgcttttagataccatgaagcgaacagcgatgtcanttatcgaaaagccaagtcttttggcgtatgaaaatttcaactctatttaatcttt

SEQ ID NO: 1322 - DNA, 466 bp, Fusarium venenatum
  misc_feature (1)...(466): n = A,T,C or G
tacaacacctattatcactacttatcattcccgtcatatctataacttttgtaactcttctatacgtatagaagttatngctttttacaatctgccanataaatatgaaagctttccgattcgccaatgccgncgangggctcaaactatgcgacttgccagtacctgagcccagtgaagggttcgcgcttatccaaaccaaagcagctggtctctgtcattcagacacacatgtcttacacggcggcggaaaagcttggatgtgcaacctgcccatcactttggggcatgaaatgtcaggggttattgccaagttgggtnataaatcctccccttttcaaatcaatgatcntgtggcaatggcctgtgtcgggcaccccattgaagaacgaaacttctcggaatgccttggtgttggagtccacggaagatatgccgantacccgttgcgccgttcaaatacctg

SEQ ID NO: 1323 - DNA, 654 bp, Fusarium venenatum
  misc_feature (1)...(654): n = A,T,C or G
agcttattgcagcctcagacaaatctgatgccgacaaagatttcattggtcgcgcccttgaaagatcaagagagcagtctctatctcgctacgaacagcccggctacgacgaggagaccggtgaaggttctcgcggttggtactcatacgttttcaagaactctcatatggccttcgatagcgagcaattctctgtcttcagagccttgtggaaatggagagataacacagccaggaaggaggacgagagcaccaacttcgttctcagtaccagggacattgcggaaatttctcgcatcaacccaccggacgcaaaagccctccacagcttgctgcctcttaatgcatcgctagccaggccgcgcttcaacgagatctgggggtacatcaaggagtccaaggccaaggggggccgaagtttgcttcacttttttacttcgatggcccagacagtcttatgangaatggcgtcctattgggggcaggaagacaacaaaagntaccagaccttgatggagangncacaagcagtaggnttgactcgatcgcagttatttttggagatatgnccgattaagtacctcaagngggatgttttgaccccgacgttccnaaacttgaggagggacttatttccgttnccctggnaanaag

SEQ ID NO: 1324 - DNA, 488 bp, Fusarium venenatum
  misc_feature (1)...(488): n = A,T,C or G
tagcaagccacgtttctttacaaaactcgcgtaatagctaccgtaggctcaagatgcctatctgcatcgaatgcaggcaccccgtgaagacgctatggacagcatattctggcgcaggggacaaagcaagtggacataatattcgacttactgtctgtcgcaactgtggctgcttctgcgacaagtatgtcgagcatgactttgtcgttttattcatcgacctggttcttataaagcctcaggtgtatcgacatttactatataacacgctcatgcgcgacgatgatcgactagatcattctatcatccgtctangtatcctgctacttctctttgatgtgtacttaacatgggcacggctgganaaacagacagtgcctgacgctcttccaggaacgancaatctaggcaaattggcacaacaaccaattgtccttcaatatctttctcctaatattttgcgccctctcaaccgcancattccatgt

SEQ ID NO: 1325 - DNA, 455 bp, Fusarium venenatum
  misc_feature (1)...(455): n = A,T,C or G
cccttcagtagagatactcgagatgatgacattatcgagccgatttctcgtacctattccaactccatcanaacacttcgccgtcgacgcagtgccggtcttaacctgtcccaagttcgttcggnanaacgtgtcgctaccgttgcttcctcgctgtttgttatcggcaatactgctcaaggccctaaggagcgtccgttggcgagagctccgacacttgctgtaggggatttcccgaacttgtcgcgtgaggtgacaattgggcgcaattccatattccacaacttgtcatcggaggaccgagatgagcttggcggtattgagtacaaaagtttaaagttactcctcaagatcatcggcggatactatgctttcctccaattcctgggtgctgtctgcctgataggatgggtcaaccacnctcccagcaagtatgttgactacatcgctgaatg

SEQ ID NO: 1326 - DNA, 578 bp, Fusarium venenatum
  misc_feature (1)...(578): n = A,T,C or G
cgcctcttcaaaccgctcacaactcactcaactaaacgactcttcagtacatctcggttcacaatgggagataatatcaagcgcaatcctcacccggatttcaagggcgtcgaggcttctcgccccgagtttgacaacacctctgagtttcactacaccaagactgttgatgcgttctgggctttcggtgcgggtgcgaacaagcttggaaaggatgatgccgataagaagcacgtcactataaatcctcatgaggagggtcgtcctgcgggcttcaactacaaattcctcatctccgccatagttccccgtcctatcgcctttgtgagcagtcaagcacccgacggcactcacaagaacttggcgccctttagctacttcaacatgatgaaccacgatcctcccatgtttgtcgttggcttctcatccagtctcgctgctgccaangactctctacgcaacgtcgctgattcgggcgantgtgtcatcaacatcatctccgagcactttatcgaagccgcaaactcatgcagtgtgaatgcccctacggcgtctccgaatggganatttcaggcctc

SEQ ID NO: 1327 - DNA, 590 bp, Fusarium venenatum
  misc_feature (1)...(590): n = A,T,C or G
ccagcccatactcaactgaagtatcgtcaggctggtcaaggtggtgatgccgacgaacatcctactcgcgacctcgctgccgagcttctcgccgctgaaagccgcccatttcaccaagaaagaacggcgcccctgctatgatcgacgatgccgacgaggacgacgangccagcgtttctggtggtnccaaacgagcgcttccaaccacagatggagaaggagaagacctagaagcgaaaagacgacggatnttagcagagacaagagatattgatgccgatgacgacagtgaagaggacgaggaggacagcgacgacgacgacgatagcgatgatgattctgatgcggagctacagagagaacttgatcgcgtgcgaaaagagcgagaggagagaaagaagaaagangaagccgagcgtctcccngaagaacaagatgctcgagaacgaaacnttgccctcggaaatcctctcctnaaccagccagatttccacctgaagcgccgttgggacgacnatttgtcttccagaancaagctcgtggcnccgaagaaaagggccngaagaaggattcgttaacgatctcctccg

SEQ ID NO: 1328 - DNA, 465 bp, Fusarium venenatum
  misc_feature (1)...(465): n = A,T,C or G
tgttgaggctgaagaccctgcccttcagcccgacgacaactttttggttcactacgccgtctatcaccacttcagatcgcttggttgggttcctcgtggcggtatnaagtttggtgttgactggatgttgtacactcgaggacctgtttttgatcatgccgagtttggattgattgtcattccgcctactctgatgccctttggaaggaaagcggaaagcagaagccgnaaaagacctggcaatggcttnatgggactgtgcgcgtcctttcacacgtcaccaaaagtcttgtgctngtttatngtggatgtgccacctncatccaaatcgaacaggcttttgagcaaggtgtnggncgaggccctgagctatncaaaggnaaagaaatgatggtcaancatggcaagcaatcncacagagatgatgagnttacgcttatganaaacnttgaatggatngaaatt

SEQ ID NO: 1329 - DNA, 573 bp, Fusarium venenatum
  misc_feature (1)...(573): n = A,T,C or G
gatctactgtataaacaggcattgcgactcatactaatcgccggccttctcatcacagtcaaagatgcatatcctcgttaccaatgatgatggtccgccatcaccacattcgtctccatacgttcactgtctcattcagcagctacaacaggccggccacactgtttctgtatgtcttcctcacacgcagaagtcatggattggaaaggcacacatgattggtcaaaccctcaagcctgtgtactaccgcccttcatccgtcgtccatggtgatgattctcaaggtaccactcaccatcgaccatctcctgaaggagatgttgaagaatggatcttggttgacgggacaccgcctcttgcgttcagattggtcttcaccacttcttccaagatcgaagaactattgatcttgtcgttagtggtcccactatggcagaaacaccactgctgtctttgctcttattcangaactctaagtgccnctctggaagcgctgtttgtcaaanaaattcaattgccttgaactttggcttttcttcnccaggnaaacacaaacccggtcatcattcaaag

SEQ ID NO: 1330 - DNA, 328 bp, Fusarium venenatum
  misc_feature (1)...(328): n = A,T,C or G
nggggttngggggtttnccaatccattgaggntggaagcctgggatccaancttgttggtnttgttaccaaccgaaaccttaanttcgagggaggaccttgaccagcccgtctntaatgtcatggttaaggaccttgtcactgntcctgagaccgtcactntcttgaagccaacaagatcttttcaagtccaaaaagggcaagctccctatcgtcgacaaggactccaaactcgtcttctatgatctcttcgtttccgacttggaccaagaaccancattttccctaatngctttccaagctttccgacagnaaagcaagntcctctg

SEQ ID NO: 1331 - DNA, 586 bp, Fusarium venenatum
  misc_feature (1)...(586): n = A,T,C or G
gctcaattgaacgctgcccaattcgcccaacatgttcgtcgcacgacaaagggcagccttcgtggctcgacagctgcagcgaacagcacgaacctacgcctccgacgcccacgctcaccacaaggccgccgaagttaacgagtcgttcagcaccggatctctcctcgctgtcagcggtttcttcggctccgttctcatttaccagtttgttcccgccgngggcgagcaatcttcaatcctcaacttcatcaacaagtacacttcgcgcagcaaggactgggaggaaatcaacgctcttcacaccaaggccatggagcaggctggatacnaccgaaaccttttcgagaacggnggcaacaagcaccgattcgtcgatgttgcataccccgaggcaatctcttcgtatgctaaccgaaaccacattgntggtcatcttgccaacatggactacgttgntgagcactaccgacaacagcacctnaaggaggaggagcgaaaagcggccaagttggcacaaaagcaggaataagggatgtncactagacgtgaattgatacttgaattcatttttcattgggcccaaaaa

SEQ ID NO: 1332 - DNA, 736 bp, Fusarium venenatum
  misc_feature (1)...(736): n = A,T,C or G
naggaggngatggaatnctgacatggatcatgagctntgcntcctnaaccngtgatctnaactaccnaatcnatacnatgtgtctgtgatactgtcgtngcaacatgnaagcataacaatttgggcaaacttcttgatcgagancaacttntaggagganngtcaacacanccnagactncaagctttgagcttggacgagatgcccatctcatatcgccccaacatacaagtacgatgtggggactggtcattatgacaccacgtgataagagacgaagccaccgcttggtgtgatcgactgcttcacagaggtcgcggtcgaatataacagtttgactacagacgtcacgaggttcgaagtgaagcgaccaccgacctgtgacaggaacctttaatctttgggtcaataaggtcaaccccaggggtagagcaacggcntggatggaaagtcagcaaagctttgaggatatgcgtgacaaggaaacctctgaggataagctctgcttcctgagagatatttgcggatttgacgaagcaacgagcaaaaggctcatnaaagaaagatctgnanggcgtgaaaaccgcaccccgtgcgcacttgaagtgactgccatatcataccatatcatatannagacggcttggnttaatcgtcaaaacgaggaacatganagccctnatngattggataangttaatcggantttnaagggattggggccgtttgaagatac

SEQ ID NO: 1333 - DNA, 589 bp, Fusarium venenatum
  misc_feature (1)...(589): n = A,T,C or G
gcactgaacttcgantcttgattttcctanctcttcctgatctttattgaaccattcaagccctcagcgctgcctagcccctgatattgactgtctctggctattgacctgcataattcaaacaagactcatatccaacacacccaataatctttttttcatgtcagcaatcatgccttacaataccacagctattccccctcgtaaggagcctacaggacaaaaccaacttccgctctcaagagtcaagaagattatcgcacaagatcccgagatcagcctctgctccaacaatgcagctttcgtgatcacactcgctgctgagatgtttgtccagcatctagcagaggaatcacacacccaagccaagctagaccgcaagccccgtcgaaacatccaatacaaggatgtcgcctccgccgtcgcacatcacgacaacctcgagtttctcgaagacgttgtgccaaagacggtgccctacaagcatatcaaagccgctgccaaggcaacacaagcacgtcttcaaggggagaatggtagcaaccagaccatcaactttcccgtgggcgaaangcaccnagaagctcac

SEQ ID NO: 1334 - DNA, 952 bp, Fusarium venenatum
  misc_feature (1)...(952): n = A,T,C or G
gtgatagtgctgcctgggttctgacctcatataacgcttcgctcataatccaacctgtctcagtgaatacaatggcagatctcggtcttcctttccactccatctccgggcttcccaacttccgggacctcgcaggccgcccacttcctattaagtcacgccccgaccacacgatcaagtctggtctcgtcttccgctcagcagagccgtctcgtctcaccgaagacggaatcgcagcgctgcagaatctgaacatctctcacgtttacgatctgcgctcccgtactgagattgagcgctacgccacgggaactcgtgagtggccaggcgcgaaacgtgtttttgttcccgtcttcctggatgaagactatggcccagaggctattgctgtacggttcaagaactacacggctgagggaagcgaaggctttgtggaggcttatcgaggaatctgggaaacgggaacgaaacctatcagaactatcatctcacacctggccaggccagacccttcacctttactcatccactgcacggcaggcaaggacagaactggagtcatttgtgcatttatcctgtcaatctgtggcgtagatgatcagaccatcgcccgcgagtacgccctcacagaggtgggacttggtgatttcggagacgagctttcaaagcagtgatgaagatccctgaactccaagagaaccccgaaggtgccaaacgaatgcttggagctaagcctggaaacatgctggcagccctgagaacattaaaaaaacagcntggctctgtgagcaataccttgtcaaagtactgnggctgtcaaaaaacnatctcgaccaggttcggaaaactttgntcgtccccatagcaaccaatagcctcagccnttaagtntncccatggatgcaaaagatcaancgtccataatcaatntcaagatcncnttttaaccant

SEQ ID NO: 1335 - DNA, 427 bp, Fusarium venenatum
  misc_feature (1)...(427): n = A,T,C or G
atgaaacatgcgatccgactacacaactccggtcttctcacacctagcgatcccagcagtgctgagatactgcaaaagtttgaacacaaatcaggactggaaaacatcgcanaaaccctcaagattaagcgtgtcggtaatgcgcatcaagcaggatctgactcattacttactgggaaggtctttttctctatgcgcgacaagatctttgccggtgacatccctgatgagcacgttggtaaagtttggggtctcggattccccgactcgacctctaacattatgtcgatgacgaaccagcaaagcaacaatgacggcagacaaatggcaacgcacccagcacacccaacactacgagtgtcgggctggtactacccctggacctcanggcacaatggcatcctcaacacangactatgaccctgga

SEQ ID NO: 1336 - DNA, 573 bp, Fusarium venenatum
  misc_feature (1)...(573): n = A,T,C or G
nttctcatctaaatnagtcaacatgaagctgtccgctgtcacccttctcactcttgccaccggcatcattgccgctcctgtcgctgaggccagcaaggaggtccgttcttacggcagctacgagccccccaagtccacttacgagcagcccaagactcccaaggaggacaagcccaagaagcctgagtacaaccagcccaaggctcccaagcctcaccacgagaagcccaagaagcctcaccacgacaagcctaagcactacgctcctcctcaccacgagaagcccaaggttcctaagcctcaccacgagaagcctaagaagcctgcttatgagcagcccaaggcccccaagcctcaccatgagaagcccaagaagcctgagactcccaagaagcccgagtacaaccagcccaaggctccttaagccccaccacgagaagcctaagaaggccggaaacttccaaaaagcccgagactcctaagaagcctttnttacgagaagcctaangnttccaaagccttnatcatgagnaagcccaagaagcctgagaccccaagaagcctttcttacga

SEQ ID NO: 1337 - DNA, 574 bp, Fusarium venenatum
  misc_feature (1)...(574): n = A,T,C or G
atcattcccggctacgataacggcaaacattcagaaggggacgaggtttacttaaatctctccatctgcaccctccctaagtcattctctctcttctttattcaccaaccctaaaagataccccagattccaacgtctactacccctcactcaaaatgtccaacggtacaaacggcaccaacggcgcctcgccgcaatcaaagttcgaccccaactttacagaccatgtcattggccttatgagccccgagaccgagcctagacagcgcgagatcctcacttccctcatccgtcacatgcacgacttctgcagagaagttgagctcaagcaagacgagtggatcattggtgtcaactacatcaactctcttggtcaggcctacaagaagaaccgcaacgagacatggcgtgtctgcgacattctcggtattgaatcgcttgtcgatgagatcaaccacaaggtcgtcaccgacggtgggaaaggtcccacatcctccagcatcctcggtcccttctggtctcccgagaccccttccgcgaactcngtggcagtgttgttcaggacatgcccaag

SEQ ID NO: 1338 - DNA, 625 bp, Fusarium venenatum
  misc_feature (1)...(625): n = A,T,C or G
tcttcgcaagtttccgcgcggtgaaagatgtccagaatgtggtgctaggcgatggtatttggaaaatggtctgcgtttctgctccaacggacatcaagtcgagggatttgttcaattcgatataggtgacgaggtagatgctggaaatctcggaagagtagccagaaaggaaaaggaagtcaaagaaaaagaacttcgacatctcattggccaagcaggaaggaatctctttctcgaatgcctgcagctggttttgagaaaccaacttttatggctcataacaagcaaaggtcatcgggaagaacttgagactgtggtccgcgacctttgggatcttcgcacccgcggcggtggtgcgcttcccgtgggagaagagacgcaagaagcagaacaggatgaaggtctcgcattgttcagctctcagcctacagctgatgcgaagatcaaaggcaacgcgcccaagaaacaacacacaagagcccagagctggaatccagaggagaatcccgactggccaatgcctaggatgattgacacactggctttgtgctaccttgggtgcttgctgctcagaatacctacagncatcggtgaactgngtctttgggccaatgctggacgaatc

SEQ ID NO: 1339 - DNA, 883 bp, Fusarium venenatum
  misc_feature (1)...(883): n = A,T,C or G
caagctctttgttttgttttgttttgtaatacaatcaaatacaaatttcctatacatgcagacttgattcttctccctggcactcggtacttgaacatgcaacgtttcggtgtcgtcggccaatgccgattcgctgcacgtcggttgacgctgcctcggtatgtcgcgccggtaacagcgacggccctgagggcttcatgtctgtcgcaaaggacatttcatacctctcgtaccgctctatcgaaacctaagggatcattgggcgtcaacccgaacaacttcgaagagcccaccgatctggcacgcaagatattctccgaattcgcttttgcatttgagtacgtcaatggaccttcatatatagttccttcaccaatattgatggcgtcttgtatcagggccgtaacagggtggacggagctgataaggttatcaaaatgctcagaagcaatggtattagatatgtattcttaacaaacggtggctgcgttcccgagagcaagaaagaagaaagtttgcaggagcgacttcagattcctaagcatgaagacgccataaagggaagaatgattctttcgcacacgccaatgaatggttggagtgaggatataaagaaagatggcacgattctgatcacaggttctcatcctganaaagcccggcagattgctcttgattatggctttaagcgcgtcgtcccccancaaanattnttgctgagtgnggngatgtgttcccctttgagcgcatcgagggngaaaaaaatggcaaacctgtgccttttctgatggcaaagcgaatcctttgcttaaaagatcctattncacgaacatncccgcaaatgccctaaaaatgaccatntttttatctggaaccacccaaa

SEQ ID NO: 1340 - DNA, 578 bp, Fusarium venenatum
  misc_feature (1)...(578): n = A,T,C or G
cctcgaccaagtccgtctcgtctgcgagctcgttggcaccccaacagacgataattggcctggtgtcactaagctttctggttatgctgtccccggccaacaccctgtgcgtggtaaggactggtacgagatgcgcttcggcacggtcggctctgacggtgtggacttgctcatgaagacactcatccttgaccccaagaagcgtatcaccgcccgcggtatgctcgagcacccctggtggcactccgagccaaagcccacgcgcaagcaagaccttnctcgaaagggcgggacaggagctgatgacaagatgggtgctgatctcaagcgacgtccaggccgtgattgatgatgatagagggtccaaggttgctcgcaagcttgactttggcggtatgaactagatacaggtagatttgacatggatataatgggcgcaagancatatggcatgaacttttgggggattcttttggcgtttgggtttgccaagtagatggagagcaatatgtcacatctagtnaaacaagtcaggtaccatgatgcaaaatgagaaatttattagacacttcaaaaaa

SEQ ID NO: 1341 - DNA, 591 bp, Fusarium venenatum
  misc_feature (1)...(591): n = A,T,C or G
attggtcagacccatctattaatcgtttccttacaggctcattcttttctcgtcaaactctcccctcacatcctatccaccatgcgtcctttcgccctctcgacagccgtctttgtgaccgggaccgtcgctcagaatgcctggaaaacttgctacgatggactgttcatgatcgctgcacgaggcacgaacgaggataaaggatctggtagaattggagacattgccgaagctgtcgccaagcgtatcaatggttctcacgtctacggactcgactatcccgcgacatttcaagaaccggactacgaggaatccgaggctgatggcgtaaagaagctgaaggacattctcggcagctatttctaccaatgtccaaacaacaaggtcgctgtctttggctactcccagggcggccaagttgccagtgatgtcttctgcggcggaagtggtggggatttcccaaccaacgaacccgttacagttaaagatgtcgaaaagaacgtcattgctgtcatcacatttggtgacccaagccacgtggcaaacgtctcgtacgacntaggaagcacattaacgacggtgttttccagc

SEQ ID NO: 1342 - DNA, 629 bp, Fusarium venenatum
  misc_feature (1)...(629): n = A,T,C or G
gcaaggaccaaagccgngctccttctacttataatgatcgnggcaacaacaacatgggcggcaactttggtggttctggaggcggctttcgaggaggtaggggcggttacaaccgnggtggcatgaaccagggtggctacaaccgtaacttcaacaacaacatgggtggattcaacaacaacatgggaggcggatacaacggatctatgggaggtggtggtaactttggcttcaacaaccgcggcggaatgatggggggtggcatgcgagggggtcctggtggtatgcgaggtggtcgaggaggcggcatgatnaacatgaacccgatgggtgggatgcctatgggtatgcccggcaacatgggtatggcatgatggctcccaatggtatgcccggntttcaaggtatcctcacagcttcaacccgggctttggnttcaaccaaaaccagggtggcggtggcnattgggggaacccccatggagccaaaanacctaggggtgaatacccactntttgacantgnctataaaccccaatcggtgggaatnanatgctgccaaccacaacttgaaaattttctgcaacaaaaaacttgcgngggaaacttttnttttccccganggttggg

SEQ ID NO: 1343 - DNA, 616 bp, Fusarium venenatum
  misc_feature (1)...(616): n = A,T,C or G
cgtcaacgaggccctcctgcgattgatgatcccccctggtctcctgacccaaggctccgatgagganaaggccaaggctgctgcccaaaaagcccctacacaggccaagatcaccagcctcctggagaagattgccaaggcctacgatgttaacattgtcgagagcaccacctngtggctcttcgatcacaatgagatcgaaggcagcaagaagatcgtnctttccccttcagagggctccaagggtgagggtgttccccaaattggtgaggtttggggtgttgaggtcggtgtcaatctgggctccggcaaggtcaagtccattgaccagcgtgccacccttnaccgncgcaccaaccaaacttatggtctgaagcgacctacttcgcgcaagatctnaacgaggnccaaaanaagttcggtccttccccttcacttgccacaactggaggatgaaccgtnatgcccaatctggtgttgtccagtgtgtcccaagaaatgttttccccaatacnaacttgtttggcgaaaaangacaactttttttgtggcccgatcctttacaacntttgttttaccaaaaacggtttaccaagctnggggggcccncccctct

SEQ ID NO: 1344 - DNA, 419 bp, Fusarium venenatum
ccacactattatccctctacacctcacttaacacaatgtcaatcccaaacgaagctcttcaaaagttggtgcgggagatcgaaagccaggccttggtggcccagcagcagattggcctcgcccgtacacaaatgacttcaaagcagcgcgaacagcgccttgtgaagctgactatgaatgagatggctactcttccttctgacgcggtggtgtatgaaggtgttggaaagatgttcgtctcactgcctgtagactctcttcgacagaagctcgagggccagacgcaaactttggagggagaggtggacaagctcagtcagaggttgctgtacctggaaactacacacaagaatagccgcgagcatattgagcagatgcttcgcgccaaataaagctagcaataaaaagcttgcaacatg

SEQ ID NO: 1345 - DNA, 588 bp, Fusarium venenatum
atcaccgacttccatccgtccaaaccctatcgcccatcctcaacctttccccttcatcatcagattccaagacctatcgcgaccaactccaatacatccctaccgtttggacgcctaactactcgactgtcgcgtcgcattgctctccttgtcgcgacgactatcaccttccgactgcggcccaccaaaactccacgctgacgcaatctgttcccttgacttcaagcataagagacgaaattaggcgatcagcttatgttctttaaaccagactccttaggctatttatttttataccctaagagacctgttcctttttcggcctcaatatgaagtatttaccagtacaagacttcgaagcggtgacaagcacgctcaacttcaacactcccgactgcaacgttacgggcgggtgcgatctttacacaacgaaagcatcaggcaccgataagaaactgtacaaaaacatcgacaatgacctaaattcgcaacacgaagctctcctgaagcttggcgctagcctctcaccacctgaacgcgctcacatgctagccacatcaccaagcatgcaaatgttctcgcattcaa

SEQ ID NO: 1346 - DNA, 805 bp, Fusarium venenatum
  misc_feature (1)...(805): n = A,T,C or G
cacaaataacactttattgatcgcatatccaccacgacaactctctagccaccccccactgctcactcatactttcgatactttgggctacacacttacaacccgtcgcccaccatggctgagcgcaacctctcccagatcatttctcagctcaagcattccccctccatgagctatactgatgccaacgccctcctctcaaaggncaagctcgctcttctcaagctcaacgccctgacgccctctccttcgactcccacgcaactgctgcctctcgcccgtgagacctacgancagggcgccttatttgccatccgcgctcgcaatcccgaagccttcacccgttacgttcagcaactccagcctttctacgaactgcccgcctccgttctcccacccaaccttctcgagcgttacaaggttactggtctgagcttggcttcttctcttgacacagggtcgaatatgccgagtttcaccctgagcttgaaaacttggagaacgtgagggaagtggcggtgacttcaaaacgatcgatacctgggctatcctatccgtttggagagatggttgatggaaggatcctaccaacgggtntggaanggcatgaanacaccaagtgcttgcgacgaatacagcgtatttctganatcttaanaacaaatccgttctgaaatgcttccacaggaacgcgcgtntcccacttactattactctacaaatcctcctctcctggatccaaagnaagttnttcctttgcccccncctggtggatgttcgcaangcactctattcccaagccctn

SEQ ID NO: 1347 - DNA, 288 bp, Fusarium venenatum
  misc_feature (1)...(288): n = A,T,C or G
ctttggcgatgttgatgcgcctccggttcctgtgacctaccctattcccactggtcccaggaaacagctcaccggctacgacgattaagatctcgaattaaagacaaacaaggaagattcacggctcggtatgacagaaaagaggaagcgagcacacantnttgtacaaaccacggcgtcacaagagcagcactacagngggggnggaggaatatnatagatgaattcnngggacaaagagtcgacgtccaagatctatcagcaattgacgctccaattcggttttct

SEQ ID NO: 1348 - DNA, 548 bp, Fusarium venenatum
  misc_feature (1)...(548): n = A,T,C or G
gacgcatagcatatcacgcgatgtttatgtcatgagccataccacacaacactccatggatcaatagacttcactttaatcacagactgcacgaccttccacaaaacatcctcctccaaacgatataatggagaacctatccatcaacgatgcccctccacagggccgtggtgcgccgcaaccgctacctcagctgccgccgcaaatgttcacgactgccgcgcagctcctggacctcacagacaagaagctcatggtcgctttgcgcgatggaagaaaacttatcggagtactgagaagctgggatcaattcgcaaatcttgttctccaatccacgatcgaacgtatctttgcgccctctcccgactcagcaggtagcgaccggccaactggtctctacgcagacataaaccacggcacattcctcgtccgaggcgagaacgtactactccttggtgaaatcgacctcgacagagacgacgatcccccgcctggtttcgagttggccgacttgnaagtcgtcaaaggagatcgcagaggagaagaaa

SEQ ID NO: 1349 - DNA, 667 bp, Fusarium venenatum
  misc_feature (1)...(667): n = A,T,C or G
ggtcatgccaatggctgtgtnaatggagacnccaacaagtcccgtcaagaacaaattgatagtactgcnccgggcaagcctccncctaacntgtggaacaaccntgcaaaaatggntctttgctttgccaactgatncggatgctcagcgagaaaaggcaagcccttctacaagctgaagttgaaaggagatggtacagaagttgagtcaacggcctggccttggcaagaaacgggcttgtatttgcacnttgcgatctgctatgtgccaacgttatcatccacgaagatgacnatgcagcacctacagtcgacttcatcgactacnantatgctactccttcacctgccgcgtttgatgtggcgaaccattttgcagaagtgggcgggatacgactgcgattactcagccgtccctagacaggaccagcggcttgctttcgtgacagagtacatcaagtcctactttgcgttaacaggcgagagtgtcaacgaggaagaagaagtgcgcaaacttatgattgaagtcgatgcctaccgaggagtgccaggcttctactgnggtatcttggtcacaaatccangccgtcatctnaaagattgacttnactatgctcantntgctgaactgcgtntgaccngagtctggnnatacaaggctnaggagg

SEQ ID NO: 1350 - DNA, 622 bp, Fusarium venenatum
  misc_feature (1)...(622): n = A,T,C or G
gttgagcttgagtttgacaagtcctacgacattccagggactgagggtgcaactgtcaccatgataccagccaaccactgcccgggaagctctctntttctcttcgagaagacaacaaatcagggggccaatagtcgtgttcagcgtatattacattgtggagattttcgagcttgtcctgcgcatgtcaaaaatcctcttctcaaaccaaacatcatcgactccatttctgggaaggtcaaacaacaaaagattgatatctgctatttggatacgacgtacctcaatccgaagtactcctttccacctcagaacgatgtcatcaaagcttgtgctgacctttgtggatcaatgtctcctgatcccaactgtaaagacgatatttgggaaaaggccagtgggcagggcactccagcagttagcaagttcttcccgaacgcaaagtctgatganaaagacaaggtccacaccaanaaaaagcatcctcaacggttacttgtaatttgcggcncctactcaattggtaaagagcgcatttgcatcttcatcgccaaagccctcaaatctaaaatttccaacacctggcaagaacaaaatntgaaacaacttggcgacccaaaat

SEQ ID NO: 1351 - DNA, 620 bp, Fusarium venenatum
  misc_feature (1)...(620): n = A,T,C or G
caaaacccgctccttgttggtttaaagtagtatttattggtgtccgtccttccccatggctgcatcttcgaccaccatgcctcgaatgcaatcttcgctgccattctttgcaaagctactccttttcgcttgcctcatcgcatcgaccgttgccgagtccatgacgctttccgacgatgtcctacggaatattccttcgccaggcgacgactttgatatcaagaatggcaagctgctcgctcctattttgatcccacgtgtccccggcactgagggacaagtgcgcacccagaaacactttgtcgactttttcaaggagaacctccctgaatggaccctcgagtggcagaattccacttcaaagactcctgtccatggaaacaaacaggtccccttctccaacctngtttttcgaaaagatcccccatgggcgcaaaatggggatgtcagccgactcacgctggttgcacactacgacagcaagtatgaaccaaaaggcttnattggcgcaatcgatagcgctgcaccatgtgccatgttgatgcatgttgcgaaggagtgtcnaaaattccctcaanggcgaagtggaacaaagatgcaaaaaggacggggccatggat

SEQ ID NO: 1352 - DNA, 1500 bp, Fusarium venenatum
  misc_feature (1)...(1500): n = A,T,C or G
gggcgtgtttgacgtaagctgcatataatgatgcatgatgagcccgaaatcaaacaaactattcttgtctttcccatctctacctttcctacatgtatagacattgtgtcacactgtttacagtgtgacagacaacccttacataacactcggttcacacattccactcctatatccattcctctctcaagatacatcacttgcaatcatgcacgtgacagccacaaagcaggacaagactacggtcgtactaccagacctgttcaagggctttgttgttcaaacaccccgtatcaacaaaggctatgaggcagtcaagccagtctctgaacaatggctttcagaaaaatgccagttctcttctcggatgaaagaaaagagtcgagttctgcgactttgctcttttcatctctattgcagcttctgatgcccctggtgatagactcaagactatgtgcgactggggtaactgggtatttccttttggatgatttgtttgatgaagggtcattggaagaatgctcaaanagcaggctcaattcgttatcgacagtctcatggcagatatgcttggtaaaacatttaccaacaagaagaattcgtgttgngcaagcncatgatgatatntttcgaagagtttccgagggctcaacaagttggcgctcggacgagatttgctctcgcaatgagagactatacagatggagttattcatcatgtgaagcatttctcttccaacagtattccaagtatcgaagatatgcttcataccaggagactatcatctggcgttacgcctttatatcaccttgttgaatatgctcatggtattcaattacctgatgaggtgtttgagaaccctgtcattcaaacgttagaacgtcttggtgtggactttgtcttattggcaaacgacgtcttgtcttactgaaaagaagagaatgacgattctcccttcagcatggttgcctcttgcagaaatggctggccaatctgcccaggaagcctttgacacccgtggggcgcacttctcgaaagagcgacaccaagaaatgggcagacagtcctagcggaactaccaagctggggaccagaaattgacgctcaggtgacacgatatgtcgaaggcatccgaaacntgtccaagctaatgtcacatggagcttccaatcggggaagtactttgggaaacaagcccaaagaaatttgacaaacntcggttgggttgacgtgatgatcaaccccccgtatctgcatcagcngggagcaacagcagcgacgtcatgcagccaacaattcatttgggtcactggccaaagagtctttcttcattggttcagcatgtatcctggtcgtttnttttgagccttgtgatcatctgttactttgccgtgattattcggcattgagtgtatgtagatagagtcgatcgacacggggatctgattgtgatctgattgttgattcagatagtgagacaatataagcaattgctttcat

SEQ ID NO: 1353 - DNA, 977 bp, Fusarium venenatum
  misc_feature (1)...(977): n = A,T,C or G
caccctcgttgtcatatcaaatctgtcactcgttagaccagactaccattcccactttcgcttttaaactactttactcaactaattctaataccaactccaaaaaccatcaacatgcgtttcacatcaatcctcgctgccggcgctttcgccaccatggccgctgcccagagcaagaccgtctccctcgaccctgctcagcagtctcaggccgactgcctctccgactgtgagcctggcgatgtcaagtgccagtcttactgcatcactgttccctctcctgacgagaagaacatcgaggaaaccaccaagtgtgttgccgcctgccccaagggcaagggctccgaggccgacactgagaagtacaccgtttgcatgaacgagtgtatcgccgacaactactggaagtccgttgatggtaccccccgtggcaccgacgtccccgatgtcaagagcaaggcctccgaggctgcctcctccgctgctganaaggccaccgccaccggtactgctgctgagtctgatgctaccgccactggtgcctccgctactgagtccgagtccggctccgactccagctccgaagagaccggctctgcctctggcactgccactggtaccgctgctgaggtctccgagactggtaacgccgcctcttccctcgttggtggtgtctccttcctcggtctcgttgccgctatcttcgctctgtaaattgggtttcctgctttaggataatctgatttggcatgacggagaaggatttaatgggttttattacagcggtaatgattggagtttggatttcaagatgtgacacgttggacagcatgataaggcctacgggtctgatcaatttcatggacaaattttgtttttttgggtaatcatttcgcgttcacatatggctcggcatatgagcatgaatacaatacctcttttttgcgcctccaaaaaaaaataaatatnattnaaaa

SEQ ID NO: 1354 - DNA, 399 bp, Fusarium venenatum
  misc_feature (1)...(399): n = A,T,C or G
tgaccttgcaaacaagtggaaggatgctaaatttgagcccagcgctaaggaccttgagaactttactgcaaaccagaagcttgtcttcctggctgaagtacaacagtccggtgatctaactgcagaccgagctcagctcatgggcaagacgtacgatttcctgtcatcgcagaacgtggaaatcctctcggcgtactacctgattgctctacaggcaaaggattctgccatttaccaagatgccgccactttctcggaggggttggtcgtatgaagtttgtgcgacctntgtccgnccttaacaaagggaccgacagttgcctggaccctttganaaaacaaggnttttttatccatttccaggntttgtaaaaaaggatttaggtttaaagttggggc

SEQ ID NO: 1355 - DNA, 638 bp, Fusarium venenatum
  misc_feature (1)...(638): n = A,T,C or G
gtttcgcgttatggatggcggaaagaagcttgtcaaagttcctaatgctctcaactcgtcctctcgaacccccaagactgctatcattgctggggtcaagttttaccgaacaaagacaggcaaccttgtggcgaatcgcattgttaacgaccagcggcgatcgggcgcggtcaagaagattgatcaactttgtaaaatcttctcaacgactggtatttcctctttctatgactggagtggtccacgcctccatcatccgaaccggcctagtggccatgggacaaaactaacatataatttctgccaggttcatgcactaaaggccctcagtgccgctatattcacgatcccaacaaggttgctctctgtnaaaacatcctgaaagacggacaatgtgtnaacggcgagttctgtgatctttcccatgacatgacttccgagcgcacacccaactgcttgcacttngccaaaagccattgcgccaaggatgaatgnccttatctcacttcagancgtccctgntggtntagtgtgccgaactttggcttnaatggctactgnganaaaggggcangttntactgaacgtaccgtttttgagtgtcctgctttancaatcccggccgatgtaagancaag

SEQ ID NO: 1356 - DNA, 563 bp, Fusarium venenatum
  misc_feature (1)...(563): n = A,T,C or G
ccaaaagtcgagagcgtcattgtccagatctacgcccctgagttgtcagagatatactcatatttggatatctggtcatcgatccgaaaacttacccatccaatttctcgcccccgatccgcgattaatanaccccccactccccatcgaaatcccaggtctaagttccaagacaagacaagtccagtctcaactaccgcgactcgaccttgcttntttttcctcctgtcttgncaacaacagtcaagctacccgagcctatactttcaacantggcttcaacactcacaacaaccgaggcgcaatgtcgccgccgnnaacaataccatgaagccgatgtcgtcgttgtaggagccggtgtattcggttgcactatggctttcgctctcgccaaccaaggccgatccgtncttntctcgagcgatggctcaaggagcccgatcgcattgncgganaacttctccagcccgggggggcacctccttnaaaagcttcggccttggacactgngtngagggcatcgacgcaaaagccttgntacggatcnccattttctaccatgg

SEQ ID NO: 1357 - DNA, 418 bp, Fusarium venenatum
  misc_feature (1)...(418): n = A,T,C or G
caccaagacttgcctntgtggtacaaagacctcaagaagtaccatcttgctcatcactttctcgattacgagcttggtttcggagtcaccagtagattctgggacaccattttcggcactgagcttatttacnacaccaagaagacaaaataagctcactataatgcgcgcaatttctgcctggcgtgtatcttataaattcaagctggcacactgtatatatgtcttgctatcaagtgcttggcgcacactgggttgtacggagcagtcatgattaatggatggtaatgaacatggngggccctggcattaatggatcgaacagcataaatagttttaatggntgggactggtacgcccgacattnttntttggacagagtcactttttaataatatacctcgtntnaaaaaaaaaa

SEQ ID NO: 1358 - DNA, 675 bp, Fusarium venenatum
  misc_feature (1)...(675): n = A,T,C or G
caacaatctagctccttggctaccaactctattacaacttagtagagctcaacgacactcaacctcttcgccacatcctttactttgctagggacggctcccttgccacgatatcacaaaccacaaactcacaaacactttgtcaacattgtgtgcaaggatgcaattctcaacaaccaacgcaccccattgtctggtgcaagatagtttcgacgacataaaccccaaggacttcctcagacaagaattcaagtctaagcgaccacgaactgccgatatccttctcgaggagctaccacagggtcttgttcaggatgctgaagcaacagatgtcacaggagatttcttctcagccaagtctgagttagagtcagaccacgaggaacaactccccgacggaatcgaagagaccgaggaagagagacagaagcactggttcgtcggtagcatcgaccaaggcacaacatcaacccgattcctnatcttcaacggacatggtgaacctgtcgccagtcatcagatggaattcgagaacctttaccccagctntggatggcatgagcatgaccctatgaccttnttgaatctgccgagatttgcatcgagaaggcactgaaaaattctgcgccaaggacacagtgtcgaagaaattcctntnttggtatcacaaatcaa

SEQ ID NO: 1359 - DNA, 989 bp, Fusarium venenatum
  misc_feature (1)...(989): n = A,T,C or G
tcagaattcagcagctttacaactcatttaattaatacaaacaacacaaaaacctcctctactcaaccaatcattatccctgctacctttttaccacttaaacaaaaacacatcaacaaaatggccttcttccttccccgtactgtctaccatacccaggctcccctgaacccactctactatcttctcaaggaacttgaccagtctgtttcacagccccagcagcctcagcagcctcagcaaagaagccgatgccagtctcaacagaagagccaggctcaggctgaatgccccgcctatcgggtgacaacccgaccatgggagccccgctttgaggctcatgagacggaggactcctttgttctctacggcgagcttcctggtctgaacaaggaaaacgtcactgtcgaattccccgaacctcgcaagcttgtcgttagtggcaaggtcgagcgtttcacagaagcctccaaggcagctgaaacagtcactgagcagaccgctcccgctnccgtcattgagtcagacaacgaagacacccagagcagaagttcataccaagctactgtcgaggacgatgttgatgatgaagtttgaggtcttgagccacacatcacaaaaagtcagagaccgttagtcaaccacagtctgagactttnagcgagaaggncaaagacaagcagcctgagcaanccaagcagctgagcaacccaagcagnctggaanagccaanacgttntggttacaccaaggagttttnacnctacttactttccccacctacgtnaaccacgaggnagtaaccggccaacctttaaggatgggctcctggactggcattggtcccaaggctactcccaagtctcgcgcatcctcattaactagaggatcggatattggtttccacattgaatgngatattctttggattanatatgtttangagttcttaagctggtttcttaantaaangggtttntaaaaaaaaa

SEQ ID NO: 1360 - DNA, 586 bp, Fusarium venenatum
  misc_feature (1)...(586): n = A,T,C or G
aagttagaatagggtctttcaatatcttgatcgtcgacatgtcgtctggaaatgacatgaattgggatcgtatcttttaccagcctgaggttgaagcgacagttgatctattcgatgtatggaacccagtcaatgacaccgtcgatcctcagcaattaaacacaaccctgactctggttgagaaccatgccagtaatcccactcaggcttccgagtcaatcaatagtatccctaccgccgaccaaaagcccgctacacccattgctcaaagaccagggaaacgcctttctctagcttccgtccgtgtcctcaataaatggctcacaaatcatacgcatcatccctaccccactgtcgcagaagtcgaatctatcatcaggcaaacaggcctaagcaaacaacaagtcctgaattggtttgccaacgcccgccgganaaagaagtttgcgtctactgtagcgccgttgacccgaagttactcattttgagaccataatcatgaactttgcaacaagaaggaaagaaatgagcgaancttttacagaaaagaacatctgagacagcatctccgattggtacacngatc

SEQ ID NO: 1361 - DNA, 616 bp, Fusarium venenatum
  misc_feature (1)...(616): n = A,T,C or G
cttgttcagatgaaattcccattattttaccaacaagtaatacattcatctcattgacaatgcctcgcataaaagccccttcaaaccttcctgaactcgtcaagactacttttacaaaggccagatcagagggagatttgcactacttccccacccaagttgccgttctcaatgtcgactctatcccatttcaactacgcttctccccatccctggccaacaaacccaagcctccgccgaaagacatctncaagcctcaaaagccatttgatcctttcgagagccccctacctgccctcaaagtctcagatcttggcccctctcactactgtgtcttgaacaagttcgctattgtacccgagcacttnatncttgccaccaaagacttcaagccccagactcacgttcttgaagagtctgatctagaagctacactggcttgcatcgaggnatacgaaagctgntagaagaactgaagccgagcaagggcaccgggacngagcattgggcggnggagatggctttacgcattcttnaactgnggnggatcactntgggggcaggcnacctnattgacacattcagntacttcccaattggaagggtgaaaggatgg

SEQ ID NO: 1362 - DNA, 287 bp, Fusarium venenatum
  misc_feature (1)...(287): n = A,T,C or G
gtaacaccggcgatctcgtctgcaccggcactctcatcgttgctggacctcacttgctctaccagactgatgcttccggccctgctcctcgcttcctcgttgagaaggctgactctcttggtgccggaagtgcctaanaaaatgggaaattttgtcttgatgtaaatgactgattgggaacaaaaagcaataggccggcctattcttggagacttttacgaggtatacgtatgttaagtttttattatttggtagatacattttgcaattctactggttgatagacc

SEQ ID NO: 1363 - DNA, 357 bp, Fusarium venenatum
  misc_feature (1)...(357): n = A,T,C or G
ggaagatgtaaagtcgttacagaaattacatcagcgaaggagctgaatgtacgagatcttgtgctttctagcgacgaaatccaagtacaacgtgcagtacagtgtcaccgccagaactggcctgtgcttggaaaagaaagctcaagaaaggacatggcccgtgtcnagaaaagggcttgcctcttcttaccagtgatcaggtcaaggggatatctccaggacaaagcacatcgatgttgacggcattcgtctggaaaaaggtgacctcnttgtgcgccgangcgtctaggaagacgaatcctcnaagaacttcgagactaacacngatagtgaggtgctcactatccttgatacaga

SEQ ID NO: 1364 - DNA, 578 bp, Fusarium venenatum
  misc_feature (1)...(578): n = A,T,C or G
attcgtgcctgtacactcgtccttctcctgcgcgtttctttttgagcctcattatcgatcgataaagggcaacgacataccgaatctcaaggctcaggaacgaaatatattctttatcaacagaacaccgccatgtctcggcttactcgatccctccggctaccccggcccaagagcctctttggtatcaccagtctccagaccggcacagagcttatttcactggctctcgttttcaacaagattaccggtgtttacggactcctcgccatccttactggatatcagctatctctcctccaactctcgacatacgtttactccatcgcggtcctggtaggacttgccatccttactcctcatgttcgacgacaaagcccctttgaatgcctggccctcgcatggctttacatcatcgataccgttatcaatgcagcatacaccgcagctttcggcctagactgggtacttctctactcagcttaacgagacaatcgaattcaagaananagatctgccaaattttgtggctgaaggtatgcaanggctgcgaaaagaagntgccatgcatggaaagg

SEQ ID NO: 1365 - DNA, 334 bp, Fusarium venenatum
  misc_feature (1)...(334): n = A,T,C or G
nacccgacttgngtggagcccccattcgancgatacnctcatcagtgctagttacgatatgacggtgcgtttgtggaatgacgggtcgatgcaacancaacaactaccacagggtccantgatggcaccatcaataggtactcaggtgggcggtgatgaaccgacataccgagtttgttacgggagtcgattggcgtctctttgncatgggtggatggntggctactgttggctggggatgaanagagngttattgtgggatgccnacatgctaatgggccagngaatacnataacatcaanattcnccttgttanattgncgttactnggagt

SEQ ID NO: 1366 - DNA, 628 bp, Fusarium venenatum
  misc_feature (1)...(628): n = A,T,C or G
gctcaaccggacagtgacaatagcaatggccgcgtcgtcggcgacctggcctgtcaatcggactcgtacctccaaactctcgagacaaaagtaatttcttgcgaaaaggctcctaagcgtgcgcaaaagtcaaaaaagcacgatgcacgccacgaggaggctgagtggttaattgagtgttctgactcggtacttttccctgaaggcggcggtcagccctgtgaccacggaacaatcactttgctctcgggcgacgaccaagaccccattcccatcaaaaatgttcaacgagagggtctccggtgtgtcatccactcaccaaagcctatttctcctggtgtggaggtccgccaacaaattgcttggaccgtcgatgggatcacatgcagcagcatactgccagcacctttgnctgcctaatgatgaagaatcacgagctcaagacgctggttggggaatggtactgacggaggcttaactatgttgacttnaaaggaagccgcagatgangagatgcaggtatncagatagctgtgcggaaaagatcagagactgtaatcaggtgagacgcagatacncaacatgcaantcctgggctntacaancttacgngtttgaggtatcatnt

SEQ ID NO: 1367 - DNA, 615 bp, Fusarium venenatum
  misc_feature (1)...(615): n = A,T,C or G
ggaaagatggacgaggcagatcggaatccgaacttcgagttcttaggcggcaacggnggaggttttccctcgcccatatgcggagacttggattttcccgttccattaacagtattgttcatatacttctgtcnaatgaatcgttccatcgcggaatcggcttcgtcaacgtcaacgggcacaggcggcttgccatgttcagggttgtataagttgttcgatgtaatatttccaaccttcctcatgttctgttggttgtgtaagctgagagatactcacgtncgcaaatctggtattattctcgttactcacatcgacttgctcgttggtccagctgtccatactcaaggacttgactttggaaatgtgcgtaccaagctttcggnggattgcagcacatctcatacataanaaaacgccgagctaataacgaagttagtcagaagtcgatttccggnacgccatanaaatgcttacactccatgatgcccatgctaaaagatgacagttcacgttancaaattccgaacgttctacaggcggccccatgangaacttcattgnatgtctggggggacctggattacncccatgacagtctgccacatattattn

SEQ ID NO: 1368 - DNA, 549 bp, Fusarium venenatum
  misc_feature (1)...(549): n = A,T,C or G
gggaactcaagaactcagcacaagtctgctccatgtcattcaagagggtgccgtcttccctgcagcaatcattacgattgctgctataaatgacgctgatcattatctgatattcatttcgtagcctaagtctccattggcatgccgtctgggtatcgccctccggatacctcaaactcatctgctatcttttccaaggtcttcatctcgtcttccgaaagctggcagcgttgagcattttcctctactctggccgccgtggttgctcctggtgctgggattatagtaggcaatccgtcgtggccattcagacctctcacccagttaattgcgagttgnctggggtaatatccttcttttcagccacagccttgacctgctcaacgagcttgaggttgtgctggaacccttcgggttggaaacgaagaaacttgctggcaattccttgaccctggaactcanagctgttattaaagcggccagnaaaaatctgtttggtcgntagttgcgtaaattttcagatgaagtntatagatntncttacccccc

SEQ ID NO: 1369 - DNA, 618 bp, Fusarium venenatum
  misc_feature (1)...(618): n = A,T,C or G
tgcatctgttagatctgactttggcatcgcttttctcgcatatactatacttttgactcagagtcttttctcttcattcctctcttcaattgnccccttttacgctactcgctganacaaagcctctcctgtgccgtctctaggtccggtcacgaccccgccaaaaactcctatccccaccaaactcgacaccgccatggctnaagaaggcatcttcagtgccaacctcctctcttctgaggtcaaggccgctcttcctgagggttacactctacgcgctttgcgcaagtccgacttcaacaagcggtttcctcgactgcttacgcgtcttgaccacggtcggtgatattaccgaggccgacttcgttaaacagtacnatgacatggctgttgctggcagctactacattattatcattgaggacacctcgcgcaaaganaatcctgtcgcagaactggtgctttgatcactgagcgcaagttcatccacttntnttggcgccgcngccacatngaggatatcnctgcccaaaangaccaacagggcnaanaagctcggtcttncaaatattcaaaccgctcgancacattgccnaacanggtcggntgctanaaaat

SEQ ID NO: 1370 - DNA, 501 bp, Fusarium venenatum
  misc_feature (1)...(501): n = A,T,C or G
gacaaagtggtttacatgaaaagcttattaattgctccccaaatcccgtggcttcttttagacttcttccctcccaaactcttagtggttgtgcaccctgttatgtccctttagtaaatctccttcattgactattcacccgcttactcgcccttgagcttgtnctgcttaacagtgaaagccatcttgaggaagtccttctactncttggtgtggacgttcttnanaccggtggcaacagaggcactggggtttcggccagcgtacatgacgtgcttgcggntgtggtgctcantgttgttgagcaaagtctcgatacggggctgagtgaagcttcaagcacggcgtgaaaggttcctctngnaccagaccatggcttgncgttggggtaaatgtcgaggttctcctngagttgtgccaagggaaggggttccatcgacgnngccgtaacgtctgccacggttncgactccgtcngaacgcncataagagattgcctatg

SEQ ID NO: 1371 - DNA, 531 bp, Fusarium venenatum
  misc_feature (1)...(531): n = A,T,C or G
caaaaaatcaaccacattcttcgccattgttatctctgccagaatgcggtcacttttgagccttgtgctctttctcttcgccgcgctggtttcggccgtgagcacagctggtaaccgtatgctggttgtgctggacagcccaaaagacaaggagcctacacaacctttttccgcgacttgtctgagcgaggatacgagatcacgtatgaatcaccaaagaccgaaagcctagctttgttccttcacggagagaggacttatgatcatctcgtcttcctccccaccaagattaanggtcttggacccaatctgactcccagctcattgtcgaattcatcaatgccggcggtnacatctcgttaccatgttctccaccacgtcgtgcctccactatcgatgccgtcctcatgganctcgacattatctccccnaggaacncaccggcaagtgtnacacttccttcaanacattcnccgccaagaaangaaatctcttnncaagccccncaccccnccccgcgaaaagaaactt

SEQ ID NO: 1372 - DNA, 995 bp, Fusarium venenatum
  misc_feature (1)...(995): n = A,T,C or G
acgtaccaaccacttacgtccggccactctttttattcttgctccccccacgacgtcacaccccacatcacacctccattacctaaccaaccttcctcatcttgacaatattcacaacctcacatctctttgggataaaaggttattgtcacttctctttgtctccacgtcacgatcttgctctactgcaaacgtgatcccactctctagcacagcaagaaaagaacttggtgcagacaccctaatcaaccaggtcacaagaaagaactgaaacacgttcctttccctcttcgctcctcgcgcgcaatcgatatcaacgacgaccggaacgaagcgatccccgccgacagccgtcatcgtcacatcagattcgttgcgctgttgtagacaacaataaaagaaaagaaagaaagaaaaaaaaacacgctgctggggaagtgaaagaagctcgtggccttccaatacctaattctttggccgatatcttggagtatcgcctaccaaaaaaaaaatcgaccgcctttatttcggttttataccggtctgcatcgaatctattcattcgacgctttnccggancaatctattcaatggntgggtcangtttctttgtnnggggacacattcncttgntttnctctcccctattgatctgttcagcgattgttcataaccgttgacacttctcgataccgactccaatcatggaaggcatccagactcacccgtccaacgcggcgcaagccaaggcctttactgcgcctggatcgctgtcgttccccggagccacgaacgagctcacaccgccgcctgtcggcaacagcgatgctcaacaacctgctcctaatgggtcagcaggcgggcaaatggcaacggggtggcacccgcaacgcctgtcgcgacgcctgctgttcttaaggaccccagtggaatcactcccactctacaaaacatcgnggctacagagaaccttgactgccggttggacctnaaaa

SEQ ID NO: 1373 - DNA, 528 bp, Fusarium venenatum
  misc_feature (1)...(528): n = A,T,C or G
ccacaactttccaactatttcgctgcctgaacccaacagtcattgcgacacttgaattccaccactcttgacagcacacttaccgcctccacaacaaccatcaccgtcaacatgcgcagcaaattcaaggacgagcaccctttcgagaagcgcaaggctgaggccgagcgcatccgacagaaatacgctgaccgtattccggtatgtaacttttaaaaataacatcttctctgctttttgggcggaacagccgctttcactcgacaacgacaacgacaacgacagactggggggttccgccagttaccgaccgcctcctctnttcatntttccgcaccctacaatccgttacattttacgaataggttatctgcgagaagtcgaaaaaagcgatatcgcgaccatcgacaagaanaagtcctggttctgccgatctgaccgtgggcagttcgtntcgtnattcgaagcgaatnaagctntccccgagaaggtttnttatttttgtcgagangttnttccccacagtgn

SEQ ID NO: 1374 - DNA, 597 bp, Fusarium venenatum
  misc_feature (1)...(597): n = A,T,C or G
cttccatggttgataaacacggtgcatcacaagatactatggaaaaaatttcaaagttcaccacttttgtttcttggaatctgcgttggcaggttttcatgcatgccgactctcatccacccgcgaagctttgggtcatacagacattattaattctcgaggtgtatgagaagatgaacgcaagccgggttcttcacgagtgtgctcatatctacttccctacaacactgtctctcatgcgcagaggaagtgccctgacagggaagcagtcctcgtatgtgtccagagttccaacccctctgggtagccccaaaatgggatcatccagaatgtttcctggatcgaatcggccgggctttaactcgtcccctganaaatggtgggaccactgggttgcgcaggaagctctcgacgaagctgctttagctgcatttatcatcgacgctacgcatgcgggtttatttggacatcccccacacttgtgattcacgaaatcaaactgccacttcttgggacaacactctgnggcctctgattcccatcaaaaattgggtgtgtcgagtcaagttttatgccaacggngtcacnccaataatt

SEQ ID NO: 1375 - DNA, 606 bp, Fusarium venenatum
  misc_feature (1)...(606): n = A,T,C or G
attgactacattcccatcttcaagtctttcccatccttcattgtttcctcacaacaatttcgcaatggcttcttcanaactcgctcaacttattccacccgactcatgggattcgcatatgcatattgttgatgttganaactacgctctcgacccctcagcaacataccgcccaacctcgcactntcttgagcaggcccttgactttgaaactagcgngggtctccnaaacatcgttcttgttcagccatctatttatggcttgaataattcgtgtttgcttgatggtctgcggactcttggttctgagcgtggaaggggagtcgttgcaatcgaccctaaagcctttgatgccgatgagctccgcaggtggcatgagttgggcgtgcgtggtgtganactcaacctgcagtcagttggggcanaaatggatgccgacnaattaaagcagcagttgacattgtatgccgatgctgtaanaccattgggttgggtcgccaagtttacgttcccatgaaaatgatcgaaatcctcgagtntatcatnccaaaactcaacatcaagttctggatcnaccattgggacagccccctgaaaaacaacagg

SEQ ID NO: 1376 - DNA, 527 bp, Fusarium venenatum
  misc_feature (1)...(527): n = A,T,C or G
cgagattgagtcatgccctccaaactactgacctttctgtaaccggaattactattacctctattctcctccaatacacaacattcttcgcctttggcggctcaaacgccattagctctgtcgacctttcaagcgcatacaacggcatcagtggtttcaacttctttgctgttgggtttctcaccctcgtcagcaactgggccgggcccatcttttggacttctgctgccaatctcctgctactccgcaagtatcatgaagggtcagcgcaatgcattttgggcaatatattaccttgcanacctatcgtctctgcggctgttgcgttggtcatggcagcttgcattcgtnnaaaagcactttcattggacgtctctcacccaatatcttacggttggccggaaccttaggtcacactgctgatcaatacggntcgggggtctctttttggtggatccccactanntaaataaacacaaagaaaggtactccngtttaatntttaaaaaaaacaaacaaaacctaac

SEQ ID NO: 1377 - DNA, 574 bp, Fusarium venenatum
  misc_feature (1)...(574): n = A,T,C or G
cagcgagcgcgtaccggtgcgcacacacaagatgacagacttgagaggtatcaccattaccactggtatactgccaagctctgtcaaggataatctgacaaaggcggtcgagcgcattggagccaagcttgtggatggagtccgcattgatacgacgcatttcgtcacaactgagggtcgtggacagcaatgggagaagctgtcgagagtaacattcctgttgtacgtcccgaatgggtagaggcttgtgaaaagggcggccgtattctgggcgtcacaaagttctaccttgatgcaatgaaacctggtcccccagcagaggagtctacaccaccaccaccaccacccgagaaggaggagaagacttacccgtgccgcccagtcagaacggtgaatcggcttcgagatcagaggagaagctggacgataagataccgggagaaggaagagaatgaaaagaaggaaatagaagaacccngggagaacggcgagaagaagaactcaagcgacagcagcagtgaagacgangacnatgtggaagtcgaacagaaggccatgaaatcnccgcaagaag

SEQ ID NO: 1378 - DNA, 1053 bp, Fusarium venenatum
  misc_feature (1)...(1053): n = A,T,C or G
ggttaccacgttgcccacaaccccagcgtcacctcaactgttgagcccaccaccggccgtgagctgaacattctcgacgttcccaccgactctcacaagtcttcatctcgctcatcctcttccaagtcttcctccaagtcttcttcttcctcctcaaagtcctcgtccaagtcttcttcctcgcacaagtcatcctcatccaagtcttcttccagcagcaagagctcttctcactcctccaaggacaaggagtctcgatcctcgcgatcctcgcgccacagctccaagctctccgtagacatccccaagggccgcccctgtcaatctcccagatccaggcccccaagcccatgtcttcccacgcgaccaagcacattttggatgcttcctactacgacaatggcgaacttgacgagcttgccgatcgtctcggcagcgccaacattgaggacgagttcatcaccgacttcagcacctcaccagtctcctccagcggttcttccctgtcctaccgctccgacagctcttctcccaactcgtccctctctggctacagcacacccggatccgacgtcagctcttgcacttgcgagcgctacggtatcactcgcaagggcgaccgtgtcaagctcgactgcggcggatctcgatgtggctttgatgacagcgactcctgctccagcgacagcgaggacgaggatgagtacgagcctgtctctcccgccagctcccgccgccacggcgtcgttgcataaatgcattggtgtaatgcgaagactttggcaagaagttgagagaacccttagccgttcactccttgtatcgggcatcctatggcagcacaccagcgctgggatgactcgacttatgttgttgtggtaatatcagcaatcatttttcgttccgacctgcgtcacgtatttctgacncggatggcaccccagctggtctcggaatgtttcaaccgcccggtacnttgatctcantaggtcangctgcgaccgttganccatccacaatggttctatctggctgcgcaacgttattctctcc

SEQ ID NO: 1379 - DNA, 358 bp, Fusarium venenatum
  misc_feature (1)...(358): n = A,T,C or G
ngcccnttgttggngggnctttttgctngccggngggngcttntgttttttgtcgaactcntttttcaacgtcgatggtggccaacgagccatcaagtnccaganattgactggtgtcagcaagganatctatacgaaggaacacacatnaacatttcttgggtttgagactcctattgggtacgatgtcccaaccaaaacccacgcaaccgttgcgtncttgaccgggacccaaggactttgcagatgggcaatattacctggcgngngcttttaacgttcccaaatngatgctttgcccagatctaccgaacacttngnaaccganctncgatgagcgnntgctggcctttatttg

SEQ ID NO: 1380 - DNA, 644 bp, Fusarium venenatum
  misc_feature (1)...(644): n = A,T,C or G
aaagcaatgcttgggtggttccgtcctttggctggcacccctggttctcacatcttctttatgatgactcggccgacgtcccgacatataggcccacctccggctccgacgccgacaccgacaatgccgcaaagcaggcccactacaacgccgttctgcagccggaaccttcattggactttgtcgcctccctaccaaccccaatcgctgtaagcacatttctcaaggaaactgaatcccgactatctgccaaccctcatgctctggtcggtgagattggcgttgacaaggcctttcgtcttcctgagccatggaacccatctgagcaagctgaacgagattcaactctcactcccggaggtcgcgaaggtcggtatctcagtcctcacagagtaaggatagagcaccagcgtgctattctttgctgcacaactccgtcttgnttgccaagactcgccgagctgtcagcgtcacngcgtgcaagctcatggagtgcttnatgacactctttgccgacacatggnaaggncattgagcgtgaaagtgataacacgccgaaaacggggtttggtcgctaanggtgcttgaggactttttcggatgaagaaaacgaanaaaaatngcgaggaagccttntcttcacg

SEQ ID NO: 1381 - DNA, 590 bp, Fusarium venenatum
  misc_feature (1)...(590): n = A,T,C or G
gaggagacggactggatgccaaacctgccgaaaaaggaggatcaaatgcgatgagacgcgaccagcttgcacaaaatgcgttcagtccggatggaaatgtgatggctacccaataaacgtagtttcgacaatcactccgcacaaagagagacttccaaggctgccgcctcccattcccctgttatccatcaccagctactcgatccccttcaaagtccctgggagccaaagagaccgtcaactgctccactacttttgtgttcaaggagcgtcggagatttcggggtttctcacctccgacttctggtccgagattgttcttcgagagagtcatcaagactcagcattacgacaagcacttgttgccatgagttcactgcatttagattacatcactttagattcagtgaacagccaagctgcaagtgttgagacattggataattatggcaaagccattcgtacaataaggaaganacttgcccagccatcgcctgatacaaccaaagttgcactcatttgctgcatcatattttattgctgcganagtactctangaaatccnggttcagctcaacagcatctaaaca

SEQ ID NO: 1382 - DNA, 472 bp, Fusarium venenatum
  misc_feature (1)...(472): n = A,T,C or G
tcgtggtagatacgggcacccgntgactnggcagntgagaagatgtcttgccacagcnagtatgatccagagaagccttcttgntgggtgnaacaatgcnnatgcctcgnttcagagcaagggggtacagttcagcgacatcttnagagctggtnttgtcgacaagaacgtcttggcgggggctttggaaaggnactngatgacctgatcgagagcgagcggggccttggtacgaggaactgagagtgtcaacgacgttctcgaggttaatgggagagtagtcgtcgttgtagatggccttgcggctcgtggcaatgtaggcaaggttcagtttcggggatggctttcgaagcagcaagggactggagctggtcgataaaggccttgccaacacctccggcgcctgttgttgggacattagtttataaagttgtgtatttataagtttcgaatgtttcanttnataaaaaaa

SEQ ID NO: 1383 - DNA, 634 bp, Fusarium venenatum
  misc_feature (1)...(634): n = A,T,C or G
gcccgatactgacttcgtacctcactctgtagctgagagtcatagtacgataaagctcacgtcgcaacctcatttattctcacaaatataaaagcgatacctcagcagctagctacaacttntttttccttcaanacaaatctttnttttacgcatatacaggaattgacaagacgaaatcatccactcacttcaacaacacgatatagagcgcatactggctcgccgtcaacatgtccgggcgacgcgacttnctcaaccaggcagcgcccganaactacgtcgctggtctcggtcgtggcgcgacaggtttcacnacaagatccgatcttggtcccgctagagatggacccagngaggatcagatcaaggaggcgctcgcgaaacgagctgctcagcttggtctcgcgccaaacaagaagggcaaggaaaaggaggaggaggaanaaaaagatgaagagcgatcccaagatcccgataacgaagtcngactttttgccggnggtgtctaccacaanggacgaatgangaancccacaagatttgggaatgggtggatgaaaaaaatggncccaaaaaaaaagccgccgagaagcccnaaaaccngcccggganggacaatnccgaaccgaac

SEQ ID NO: 1384 - DNA, 677 bp, Fusarium venenatum
  misc_feature (1)...(677): n = A,T,C or G
caagttacagctctctgcatctctaattgttttataggtacactggatgctctgtagatcagctctacacccataatgtccgaatcaaactctcttctggccttcttcagccagcaaagcaacacgggcggcatcattgtcaaagagcaacccaaactcgacctcgacctctacatctcgaactacaccggtcgaacgagaatcgatcgtctcatacaaatcggaaagtcatcagtgccgctatgcatcgatgcgctcaagctcgccatagccgaagcaaagaaaggctcggatgtatcgcaatacggcgaagcttggaattgtctccgtactgcggcacctcaagagccagaagctcaactcgaaacagaatgggtcgatcgaattgaacgtgagaacaaaagccgagaacgcacgtctcgaatctcaacttaagcagtaccgccccaacttngaccaaagaaagcattcgaatgggcaacgaaaacttggggcagcattttgagaaaaacagggnaatctggaagcggcagccgaagcgtacaatcgcatgcgacagggactcacaaccaccaagcatattatcgatgnggatacacttgtcatgttacatcgccggcntgatggncatggactaaaaacctgggaganatcgggttanacggctaaaggaccaa

SEQ ID NO: 1385 - DNA, 673 bp, Fusarium venenatum
  misc_feature (1)...(673): n = A,T,C or G
cgaagccctcgagcagtggcgccgcgacggaacaggtccctggacaaagtttgcctgtgagttgggtattggctggttcaagcttgacaagcttgtccagtcggaagagttcaaggcgcttcctgctcaggaacagacctatctcatgaaaggaaactgtgcctcattatgagattctgacacactttcctattcattggtttattcctcagttcccggatgataacctcaactactcttgcattctcgtgttttactataacgcgcagagtcaaggtgaagtaacactccagtcatccgatcccaacgtccctctcaagttcgaccccaagttcttatcttcacctttcgatcgtcgcgtagccattgagtctctccgcgatgcattccgtctcgtcaagcatgagaactacgtcaagaacaacgtcgacaccatggtcggtccccagggtgattcagacgaagagcttcttgcgcattggagagcgaacatctcttctagctggcacatgtgcgggacgaccaagatgggaaagaaggatgaccctgaggctgtgggttgataagtgactccaagggtatcggtttcgaaggaattgcgtgttggcggatatgggtgttgtgcctggtttnggctaattggcatattcaagctggtgcttatgtgacaggg

SEQ ID NO: 1386 - DNA, 519 bp, Fusarium venenatum
  misc_feature (1)...(519): n = A,T,C or G
ctcattggcgcattcatcgttgaccccctcaatcattacttcggtcgtcgaggtgaaaatcttcattaccgcatgctgtcttactgccacgcctatcgcctccggcttcaccactcatggcaaacacttttcgccgtgcgcttcgtcatggggaattggtattggtgccaaaaacgctaccgtccctatctactcagctgagatgctcccgcacgcattcgtggtgccctcgtcatgttctggcagctgtgggtcgtcgtcggaatcttcctcggcttctgtgccaatgtcatcgtcaaggaactggccgaatcgcgtggcgtctgcagctcggctctgcctttatcccctccttccttctcggtcttggtatctggttctgtccaaaatccctcnttggntcatgaacacngcaagcatgccaagggtttccgatcatncaaaaactgcaacgcccnanattatcgcccgaaggantttactattctgggttnctacaagaagaataatgtncaaggg

SEQ ID NO: 1387 - DNA, 581 bp, Fusarium venenatum
cgcaagtacaagcagagccgcgatatcggcgtttcccttgagctacttacgggtgccgcagctggtgggccttgctggtgttatcacctgtcctctcgaacgttgtcaagacacggcttcagacacagatcagcgcacccgcagaaacccgggcgaacaaggaccacatgccacatcacaaatccggcatatctctacctcatctcccagcacgcaccggccacgaccggcgctattgctctcgacacttcttccgtctttaccggcttgcgcatgatttaccgtacagaaggcattgcaggatggttccgcggcgtcggtcctcgcggtgtatggacctttatccagagcggctgcatgctgttcctgtaccaacgacttctccggcagctcgaagttttcattcccagcgagctcaaggaaatgtagaaatctccacacatacttcacatacactttttttctcgcccttgtcactacttgatgattttgaaccctccttttttatgcgccgtttctgccaccacccatccctgtataacgtattagagaatcggacctatgatatgaatagcaatggc

SEQ ID NO: 1388 - DNA, 587 bp, Fusarium venenatum
  misc_feature (1)...(587): n = A,T,C or G
gcaccatccacaataccgactcgactcaactcaactcggttagatacgctcagagaagcatttagtttcttttgcgagtctgttttcgtgttttcggcctgttagcatactaccgaggttaccttgttcactcacctctacttttacgtgacgcttcactaacagcgtctcctctcccatcaactttgttgttctgcaaaacaccgtcactcgggctttctcactcatttgancgctgcaaacgtctcgaaccctctttgccaccgttcattatggcttcccacgctagcgctccgcagattacggtcctgggttctctcaatatggatctcgtctcctatgtcccacaccatcccctacccggtgaaaactcacttcatcccatttcaacacttcgcccggcggnaaaagngccaaccaagctgtagcatgcggcaagctgtccgggattctgaactgaacagcccttcagccaacgtctccatggtgggngccgttggtgctgatcctacggaactctcctccttganagtcttcgctcttttggggtttctgttgannccgttagtgctcgtcaggacagaaat

SEQ ID NO: 1389 - DNA, 936 bp, Fusarium venenatum
  misc_feature (1)...(936): n = A,T,C or G
cttgtggctacggccaacgaccagattgcatctatcgacgacaacgaagacgagggtcgcctggcttatctctccagtttccgtcgtctggttgagcagcatgtctcgcctgcatacctcgaacgtatcgattctgaggtcaatatgttgcgtgacggctacgtcgacttcagtacgtggtgtatcacccgcttcgcacagctcgtcttcactgtcgacttcggcacagtcatgcctgacttcttcacaccccgctggtacacaagtaatgctatgaaacagatggtggtgacatttgaagagtacgtcaacgactatcgccaggtactgcaccactcccttgtggacatctttattgagatctttgctgaggagctgcttgttcggtacttatccgccgtgcgaaacaagggtgcaaagttccgtcgcaccgacccctttcaggacaaagctgttcaacgacatctctactgcatttgagtgctttagcactctggcatcaccccgatgtcggtgcattcatcaaggaaacctggcgtgtcacagagcacttttctgcgcctactattcggcagaaccgtgatgccatcgnttgacgctttacgtaaccttcaagacggcttactgggatctgagcgttcaatgggtcgaggttgtattaaggtcgagagatgatttcgagangtccatgatagcaagcggtcaagaaggaggctgccaatatcgatatcgaacgtggacccggagaccatcatgagtagaagtcaagtacaaattggacgagtcatgaattanggttgcacaaaaaaagaggaagggcattgcnggnaaattgnatganaggcattatttatgctccttaacgacaatgatattnaacttggtatttagcctactggtggcantcgttgggcttactttggctgagcataaaac

SEQ ID NO: 1390 - DNA, 567 bp, Fusarium venenatum
  misc_feature (1)...(567): n = A,T,C or G
gcgatcattgctaacaagtgctaggtttaccaaaaggttcttcttgtttatgggacaattggaaaccccgccgaacatgttctcgacggaactctcaacgtttgtcggctcgacnataactttcccgcgatcagctggcccgtctgcaactctcacttnaaggcattggtttacttgcaaccaggaccaaacaagttgcgcttcgagttttcgagtcccaaactacccaatagtaacagctcgaacccgattcacgcctcctaccttaccgttcatatgctcccagtcaacaattctccgccgctgcagcttgctatactagttgccaaggattcgccagagacattcgatgcgtcncccgccgggccnaaaaggagggcaatggactggagactgccgtgaanaanttcaggatggcggcgtacctgtggcaaagcattcacctcggaacagatgtggcggaacaaacttggacngcgcgcattcngttttgatnaaaaatggacaacangtccgccaactntngtgaccgananaatggcncntgcgttccnaanccagggttat

SEQ ID NO: 1391 - DNA, 542 bp, Fusarium venenatum
  misc_feature (1)...(542): n = A,T,C or G
ccntctcaagcccacaaagcctatcatccccgtccctcctcctgtctacacaactgaggttctcactgccatcaccacctactgccctgagcctaccactcttactcacggcaacaagacctacaccgttactgagcccaccaccctcaccatcaccgactgcccttgcacagtcaccaagcctnagactgagcactaccctcagcccacccctggcaagcccggacaccccggcaagcctgaggttcccgctcctcaccccactgctcccgctcccggaaagcctgagtacccccagcccggccacccngaggctcctaanaccaccggccccgtccccgtccccgtnaaccntaccgggnactactnttcttctgagggtaccagccctgccgtcgtcactggtgctgccggccgnatcgcccctgntggtctcctggcctttattggcgccattggtttnttntaagctattctaccacatgcttggcacggatatttattttnggatggganataaggngacanaaaaggggggggan

SEQ ID NO: 1392 - DNA, 609 bp, Fusarium venenatum
agccattcgaggtagcaaagaccttgttgcaagtccggaatcaggatgaaaatgctatatttggacttcccgcagagccagagacccctaagaagccggtcactccacctagaagctctatgtatgattttagagactcggactctgagggcgaagagcctaattacttctcatcaaacatcccctcaactcctcacgaatctccatggggttcaagctctcaacgagatccatcgcctgtgaagaaaccagctatcccagaacactttcttcaactccgacgcccagattcgattctcgaggtgatcggtcagctatggtcgaaagagggtgcctggggagtgtggaagggttcaaatgccacattcctgtacacagtgttgcagtcgttgctggaaaactggggtcgaagcttcctcagtgcaatttttaatgtcccagacatgggtgttagagaagacattgatcgcatgatcgacattgcttcgccttacccttgggcatctctttttggtgctgctgctgcagctgtggccacaggacttgcctgtcgcattggacttggtccgaactagacttattgtcaccccgagctcaaacgggcagcgc

SEQ ID NO: 1393 - DNA, 611 bp, Fusarium venenatum
  misc_feature (1)...(611): n = A,T,C or G
gaaatttagtgatagtataagatcaatcgtgtcctgcgactctntttgggaactttgntgttcatataagtatattcttctctcangggtatcttaagaccgtctctatacaatcacatctaatatagatatacaatggcgacaattcgacatgcccgccgggaggacgctcccataatccttcagctcatccaggagcttgccgattacgagaaggagccagatgccaacaaggccaccattgagaccctacaggccacaattgccttcgcgccatccgactcccccgacgccgacgcctttgtngtccccaccaccgaacccatctcgccaacaaagcccgcagatgccttttcttatttcccccgaaggtgaagccgcggtatggcactgtncttttacaactacagcacatggngctcgcgcgcaggcatttatntngaggacctgtacgtccgggaatnaaagcgcggnaagggataccgcaagaaattgttgancacattggccaaacaggtcattgccatggatggagttcngctcgactgggtagtcctcaagggggnacgaacctacatcaagttntntgaaaacatcggggcctacctatn

SEQ ID NO: 1394 - DNA, 431 bp, Fusarium venenatum
  misc_feature (1)...(431): n = A,T,C or G
ctttcatctcctttcccttccgacatcatctcaacccttgggcgcgcactccttttccatcaaaaagaagccaatctcgtaactacgagatattctattgcgtttcccaccactctatcctttctaataatcccttttcccccttcccagacggttccattccattcggctccgtcttcatcctcttctctacaataatgtctggctacgacggcggatacagcggcggtggtggccgcggaagtggcggcggctacagtggtggtggttacggccgtgatcgcggtggtgatcgtggtggtgaccgcaacggtggtttcggangccgaagcaacggaaatggctacggaagaagaagtggtggttatggcggtggcggctacngcggcggtggtggtggttacngaagtggttttggaagtggtgctggc

SEQ ID NO: 1395 - DNA, 504 bp, Fusarium venenatum
  misc_feature (1)...(504): n = A,T,C or G
ctggacaccagcacgacctccacctgcgggactggtcaactccaatatggtcgtcgcattgcacttccacggtggaggctacgttatcgggaatggtcgtgacnaagatactggattcctggcgaaaactcttgtgagatatatgggctgttctcatgtttgtacaccacaataccgcctctcgagtagcaacaacggacagtttccagcccctcttcaggatgccctcacggcttatcttgatctgatcaagancaaaggcattcctgccagtcaaatcattctctcaggcgattcggctggggccaacctggcactggcattggtacgatacattcacgaacacggacaagttgacgacatcccactccccaaaagcnatggctctttgggtcaccttgggtanacntcgcanctgctttggaacaggacttcaagcagtcacccaactacnaaacnaatatctgaacatntctttgccgcnctggggtgcaactaccgtcc

SEQ ID NO: 1396 - DNA, 564 bp, Fusarium venenatum
tgcttgcgttccgtatcgccgcacttgtcccggcctaacccagactcaacagcctctggccctcgtccaaatcccatctccacgacatactatactttctttatcgaccatttcgagcacccgggtcttgttccggcagatgcggacccacgactgtgaaagcccgctgagcattcttatccccaccgtcttatcaactgcctatctcgcgacaccactcctccaaactcgacatcaataccaacaacgtcgtatcggccattcataattattcatgtcgaattcaccagaaaacggacctgccaccagcggtcataaacgtcctcgaagcgatgatgccgatggagacgacgccgtacctcaacaggacattcccgacaatgccagcgttcccaagccaaagcgactggcctgtatgatatgtcggaaacgcaagctcaagtgtgatggtgtgcgacccagttgtagtacctgttcacgtctcggtcatacttgcgcctacgatgaacagcggagaaaagagcggccttaagcgtggctacgtgaaggccttcgaggagcggg

SEQ ID NO: 1397 - DNA, 498 bp, Fusarium venenatum
  misc_feature (1)...(498): n = A,T,C or G
gaaaaaggctcgttctgtagcaatctcaatctnaaagcacccgttgccgacgtccagtccatcaaaccgaacctacctcccgcgatacccacgaaatccgtcatcatgtcttggctcggtgttcaacccctcaagaagttcaacgctcctttcttgaagccttactggcctttcttcgctgccggtgttgtcattgcctacggtgtcaactccgcccagaacgccatgatgaactccgccgagttcaagaacgacccccgcaaccctaacgccaaaactggtggccactaagatgttgggaataggaaaagggatttcgtccaagccggcaagcataattgatccgctcgaacgcgagggtagggcccatgagatggaattgtatcatagaatcgcaaaaggggcttaattgacctacacaacgatctgtacgacttgcccacgggtgcagttggcagcaacgaatacgctcaaaagtccggatgttcgaatgctgag

SEQ ID NO: 1398 - DNA, 405 bp, Fusarium venenatum
  misc_feature (1)...(405): n = A,T,C or G
caggattgcggcatcaaagtgtcgccagaagaagaaggaatgggtcngcaacctcgaagacactcgatacggcttggagcatgagaacaacattctgcacaagcagtacaatggtcttgtggacgaactgagcaccgtcnagaatcaactgatgatgcacgcttcctgcaatgacgccaacatcaaccagtggctggacaatgaggcgaagaatttgtccagcgtatcgcctcncnaaacaaggctcagactccaccgcataagaacactggtgattgctgcgataaacatcgtcgtanctcaagtgttgcacttccntccctcgatcgatagaatccgagatcaacttcgaccacatgccggatagtatgatctattcnagaccttagaatgaaagatggtggc

SEQ ID NO: 1399 - DNA, 650 bp, Fusarium venenatum
  misc_feature (1)...(650): n = A,T,C or G
cgagtccagccccgaatacacttattatcgggtcaaggagccgttaattgctttcatcgacgctctatccgatttcactcctcaattcctcccacccaatgagacccagcctaccaagtctctcgaattcttgaacgaggctaccgattttatccataggctgcctaactgggaacctcaagcatatcgacatcacaaggagaccgcatatgaagagatatccaaggcctgggcgctcgttatcaacgaggcaggcaagaaagctgggggcctcaacctgcactctggaggatgggaccagattctgtctcgacacaatgaacaatctggcggccgtctctccactgctatccacgccatgtccatgagtgttggatggatgggttctaacgcaaatactgggtctggcagtgcctcagactccatattaaaccaattgatgtcagggtcatatggagctccagttagagttggaccctggtaaggcacgggctggtcactgaagccttttcgagantatgantgcatactgnggggcaccggacgagtcaacttcgcacatataacgaccggattcatcatggacgacttttcatttggtagcataagtggnatagacttgaggcgccttttttttcttcttgggnggn

SEQ ID NO: 1400 - DNA, 392 bp, Fusarium venenatum
  misc_feature (1)...(392): n = A,T,C or G
tgcctacaaataaaatcatatacaatggacgctgctcaaacaacaatctcctcgcctgtgagcgctgccgcaaacgttgcgtccacttccaccacagccaccaacaagcccaagccctgctgtgtgtgcaaggacnaaaaggccaagcgcgatgagtgcatgctcttctccaacgcaaaagaccctgccgccgactgcaagtctatgatcgaccagtaccgatcctgcatgtcgggctttggattccaggtttaaacaaggcaaaaaaggcgacgactgtcgatgacnaaatgattcctttggtcacaattacggaccgtgtacaacattagacggtataatgtanaataacgggcaatccatgcattttcctctccccaaaaaaaaaaaan

SEQ ID NO: 1401 - DNA, 605 bp, Fusarium venenatum
  misc_feature (1)...(605): n = A,T,C or G
cgccactggagatcttgctttaatcctcattttctgcgagtgatataaacaaggaggaaaccctcattcattttttccaacaattttgcattcaccaacttaaccttcattttttcccatcaaaggaatatcagcctcttttccaacaccaaagaaaaaaaaagtttcttactccaccaccacacgcgagcgacttctatctctcacgcgaccgtcacaatgaaggtcttcagcaacagcgttacctacaactactcctgggacgaggtgtccacagccaactggacaaagtacggcccctggaacaacaagtctgagcatgttatcgncgtcgacacactcttccgcgaagtcgaccccgcgacaggtatcttccgaccgagcgtctgatcacatgcagcaaaccgtcccgatggatcaagattttatcggcggaccgganatgagagctcatgtncgaagccagtacctngacctgtaacaagaccntacctggtnagcagacttggctgggcaacctgtaacgtcaanggaagtgctttaagctttgggacttaaaccagtantccaaagccaaattattgtttgcggggtgnaacaattaa

SEQ ID NO: 1402 - DNA, 515 bp, Fusarium venenatum
  misc_feature (1)...(515): n = A,T,C or G
ggtatggatatcaccttgccggtgagggcggtggtatcaaagtgactcaattgcaagtcggtgctcaaatcaaccccaacccctttgtcgagacgaccctcagctatgcgctcacctacatcgatcgctttgctgggcatcgtcccaatcacagcttggcatctgcccgtctcatcatccttgcagataatgactattactctcactcggaatccgacacgactcgttcaagtcgtttcgctaagttccccgtgactctgggcaatgccaacaagactgggtcttggctcttccgctgctcttgtcacctcactaaccgcctcgctcccttgttcaatatctaaccganggtctccttaacaatgatccgacaaagggaaagagaacactgcataacttaactcaanggctgccactgcgctggccaaggtaaaggttggtcaaggttttgatggttgcaacggtgtctaagggtnnttcaagtaaaaggggctntctccnggcaagctgnacaa

SEQ ID NO: 1403 - DNA, 1161 bp, Fusarium venenatum
  misc_feature (1)...(1161): n = A,T,C or G
agcgacccccctccaaaaaccacaagaagagatcaaagccggccgatctaccaacaaatggccaccttagcccccaagagaatgggaaacataaccatcccgccgaccaacatcctccgcctaaaagggcgaaacaccgttcttcacaatccgtcagctcccaagcccccaaacggagcccttcttacggaagtggccgaccaaatactgtccatcctccaagccctgctaccaccccaccagacctccccgaagattttcaaattcaccagtactcccaagggttttacaacttgtacaatgcaaganatgtccccgactcgcacaacaatgccttcgctagcctcgctattccacagggttatctcgctggcttcgcgaccccaatacgatgaggagtgaagttggcagacgccattcggatgtttttcaaaaatcatccaccaatctggaagctaataaacccaaccttgaagtcggtgataccacgagaacactggatgacggcgaggctctcagatggaggtttctgaaatccagcacaccaattgaaaaggacgtgcctctagtggaactgaatggtgcaatcggtttccaaaaagactattgcgctgacccagcaaatctctgggctgacctctcttctcctctcccttttgttttctttcaccctgtccttccgttgtatatcgacacacgacaagaangttctttagctcgttacgtacgcaggagttgcaaacccaatgcccaactagacacatatctttccgacgagagcgaatacacttctggatcgtcagtgatangcacatatccgccaacgancaaattacctaccctgggactttcgcttaganaaaaatgtggatgctcgctggcttcatcttcttggtttgagcgacgacgattcctctagccacacagaaatgcccgtggatgacacagagtatatggcgatatcgaattggatgagccggatcctctcaaaatatgggggntgtgcgtgcgacctggataacaactgtgcgttcgcacgctttcatcgccagtatntttatttgaaacaacaagtgcgtggccccgccaaaaaaaaacaaagaaagtnccaaacacangctnttttccccaccaattccagganaaaactgttcttaccca

SEQ ID NO: 1404 - DNA, 771 bp, Fusarium venenatum
  misc_feature (1)...(771): n = A,T,C or G
aatcaagtccaaacttanaaacagaccnctaagccnttttctntcctntaatcgccggtaacagcctccagaatttccataacctcctccgtcttcgtgatcttataagcattggtcttgatccagatgtcgttcaagctattcgcagcaagaccggggagatgatcagacgttattccgacatccttcaacgacctcggcatgcccaactccctaatgatcaagccgagaatgtcggccaaatcatattctttatctaccattttcagtccattcatgagtgactttacgggttcctgcttcaaaaggatatccagcgtacgcttctgctggtctttgttgactcccttgtcggcgttgaaattgcacactgctggaagcatgatgcaactcgtctcgccatgcccgacacctaaaggaccaagctgatgaccgatagcatggctcgcacccaggggtacgccagtggatactgcgtgcatggcttctacaacacctgtctgacaaagatggcgagcatccagatcctgcgggtcatgtttgcatcgcagcagcccgggtatcaactgttccagcccatgtgccgctgcttcgtcaccatctttggtgctttgcaatgaacacaaaagtctcaacacaatggtccacaagctctaatgccagtactgagccagatcttctgtgggggtgtagtagttaattggggatcctgaatgacaaagtccgggtcgactttgggctcgaacgtgaacttggncttgttttcttgtc

SEQ ID NO: 1405 - DNA, 365 bp, Fusarium venenatum
  misc_feature (1)...(365): n = A,T,C or G
nctgacatcgacgtaatcgtggnatgtgatnatctccttctcantatcgatctgagcgttgatctggggaaccntctgggcagccntggtggtggccttggtgaaagcacccatgtaacccatacgcacnccntgctcctcggcgacttcctccttgtacttggctctccaggcgatcaggttggtcatgtcgacttcttggatngtggtganggaggccagtgttctgggatgcttgagcggcggcaatggttcgtccatncggacatgtctcctgccanaccggtcagtcntgcatacaantactgncatgaatattacantcgctccctcggttgggcacttncctggcggacagaggcttg

SEQ ID NO: 1406 - DNA, 433 bp, Fusarium venenatum
  misc_feature (1)...(433): n = A,T,C or G
cgatctggtagcttcgtcatagggttacgcacccctgtggattgttggcttggaaagcacagacaccgaggaaccgtaacagcagttacaatgtcaggtaactggagatacaaagaatacgactgggtagcaggacccggtgactatgtcgtcgagaaccccggcacgatccatacactgtttatgggagctgggtctgaggtgattttcaccatcacgggcagtcttgaattcttcaacgatgatgatagtttgaaggagacaatggatattttcagtttcgcgcagttgtattacgatcactgcgaggaaaagggtgttgaacccaacaagggtctgtggtattagangatcaagatcagcgcgttcattcaattttatcactttcgctcgataattttctatagctgaaatgcgtcgtatttaactgctc

SEQ ID NO: 1407 - DNA, 376 bp, Fusarium venenatum
  misc_feature (1)...(376): n = A,T,C or G
nccccngcccatttgtatnaaacttcacctcgcttgtactgaaatggcacgaactcaacgccaaccgtaccgtgtatattcatgagcttcacaagagatacggcccagtggtccgtgttgcgcctaacgaagtctnttttaccgtcaatcgctgcatcaaaganatttatggctccggtggcagtggatatgacaagacggaattctacaatctctttcaggtctatggcaagcggtaggaatgctattacatgttgatacactagttatgctgactctggataacatanaaccatgttctcaccttggttaaaggcgaccacncaaagcgacggaaaatgattggcgatcggtatgccaacagtaacgtgatgaa

SEQ ID NO: 1408 - DNA, 588 bp, Fusarium venenatum
  misc_feature (1)...(588): n = A,T,C or G
ccgcaggaatttttttttttttttttttttttttttgaagaaaacaccatacattacgccatgacacaataaatatcctacaactttgtcacagtctcgtcggcaccagcttctttagccaatgcccaggcaaactcagccaaagatcccctcgtctcagcatgctgtctcgctttttcactgctcgcttgtctaagcgcataacgcgctgcaatgccctgacacacacccgccagcttccagatgctaaacgacatgccccacggcacctccggccgagcgtcgtagccactttcctctgcgtnccactccagaatcttctccggctgtggaagaacatcagttttgccggggangaatcctgatgcatcgtatggagttgcaccaaggggatttggccgaataaaattggtgaagaaattgcagatatcngaaaagggatggccgatggtagacattcccaatccaatatccaatcactctangctccgtcttgtgaaacaccaagttatcaatcttgttatcacctgganaaccttgcccggtcctgggntgcatcgccatcttaaaaaacgaaatccctccaaa

SEQ ID NO: 1409 - DNA, 762 bp, Fusarium venenatum
  misc_feature (1)...(762): n = A,T,C or G
ggagatcgttggcgagcgtgagaaccaggtcactgaggttgtggatgttcctattgagaaccatcgctccctcattggtcgcggtggcgacactaagcgtcagcttgaggccaagttcaccgtctccatcgatgtccctcgacagggtgatggcaagaccggtgtcaagctgactggccgacccgagaacgtggcgaaggccaaggagcacatccaggggcttgttcagcagcaacagggcgagaccatcaggttctcgcaacctccaccactccatcttcaacggtggncaagttctttcgtcagcttcgaaacaactactctgttnctgttgaccacgcttgntcaaacttttccgccaagcctgactttntactcgttncaacgtcggagctctgcctctgatcactgacgatgacgatgccagctctgaggctcactcgtggaaggttgttcanattgatgctggcgatgatggtgatttcccctgggttcttcgcggttcatccgagaatttcgagaaggccaaggatgctattgccaaggcccttgagcaggcgaaaaagagcgacgcttccggttattttgtcctccccgacccttgcacttaccgacatgtcattggccccaacggcttcaaggtcaacgcttttcgcaaggagagcgactgacaagatccaggtccctcgcgaccaggccaaggatgaagccattgagatcgttggaactaaggaaggagttgagcgggcccaaaaggggggn

SEQ ID NO: 1410 - DNA, 630 bp, Fusarium venenatum
  misc_feature (1)...(630): n = A,T,C or G
aacttcatcatgccgtggaaagaccatctcaagcgcctcaagaatgaattcgaaaatctagtcggtgagccacaagctcaaaaccagagtcagaatcagcaacattaccccccaccgcctcctcctccccaaggccaacagcccatgggccagaaccagcagcaaggacacgtctactggcagccccaattccgccccgacgcacccgtttcctctgagtgggacgcaaagatcggtaacggcccgcatggctggggtaatcaggagctacagtactacaccgccgatcaacaaaacgccttccatactccagatggaaagcttgttttacgtgccattgcaaacaatgcagagtctgatcatgagaagcggtatacctctgctcgactcgtgagtcgcagacgctctctcgcgatcaaggcgtcctcaccgcctgctacttcgccatgcgcgacaggtatctggcctgcattctggcttcttncgnaggagcccttttctggccactgatggagaagtcgacatagcggagacgtggaacggcgatatggagaacactcgtgttttcactggggacaccatcatgaagccngacaagcatngcgtcttggcacccaanattccgacatg

SEQ ID NO: 1411 - DNA, 657 bp, Fusarium venenatum
  misc_feature (1)...(657): n = A,T,C or G
gattttatgacccgccgcgaattgaggggccgatttacgcttcagaaagtgggctgaaggaagctatctctatcttgactgttaccgtacgtcaattcttgagcctcatttaaccaacaccaatttaccaccaccaccaatttacacccattcactaccgcagacatggatatcagactcctcacaaacgcagacttgcccctcatccagcacgcaaacctcgagaaccttcccgagaactacttcctcaagtactacctctaccatgccctctcatggccccagctgagctacgtcgccgtcgatgtctcaaggcccaagaaggacccttacgagtaccccaagattgtcggatatgtccttgccaagatggaggaggagccttcagacggtatccctcacggncacatcaccagtctgagtgttatgcgcacacaccgaaagactcggtattgccgagaaagctgatgcgccagagtcaactcgccattggtcgagacattccaagccaagtaccgtcttcctgcacgttcgtgtcttcaacgccgcagccgttatntttacgagaacacactgggtttnaccaacgagaagaaccgggtccaaatactatgccacgggaaaatnctttgatgcgttanactnggggntaanaaa

SEQ ID NO: 1412 - DNA, 595 bp, Fusarium venenatum
  misc_feature (1)...(595): n = A,T,C or G
ggaaagtacgagggtcgagctcccgctttgcttgataacttggtccaggctatcttcctagctcccatgtttgtgtggcttgaaatcctcttcaagtttggataccgacctgagctccgagcccgtgtcagcaagaaagtccagattgaggtcgagaagttcagggctaagaacggcaaggctcaataaagcagatttatagccaatttgaccatcgagacaaatcacgttctgatgtgtaggaatacaccttagacaccgtcgatcgatgatcagcgcaggatactcgaatcaaagtggtcgtggagtcaatggatgtaatgaaggaattatagactacaccaccaaagagaagtggtatttgtgatctcattccctggcttcgctcacgtacttggggttcccaagagcagtatcgattgcttatacggccgccacgtttgttgccctgangttcacgtcaaaaccaatatgcatatttaggatgaaaggaaggtctgaatagggtcaggccatattggccggctcaacattgcacaagtgtcaggattgtgttatttgcaatttaaattagcaattatcatcgagcatttac

SEQ ID NO: 1413 - DNA, 752 bp, Fusarium venenatum
  misc_feature (1)...(752): n = A,T,C or G
gcaaaaaggtcacctcaagggcgacgatcgtaagaaggaccgtatgtgccttttcaagcaattgattcaaggcgtgtactatcttcatgtcaacggtattgcccaccgtgacatcaaacttgagaatcttctcattaccaaggatagcaagctcaagatcactgatttcggtgtgtcagaagttttctgtggtacccacccgggtcttcgtgaagctggcggacaatgcggccgtaatatgggtggcgaaacccgcctgtgctcacctggtatctgtggcagtgaaccttacattcgctcccgaagtcctcgctaagaaggaatcttacgacccccgagcccttgatgtggtggaagctctggcgattggcatgatttaccttacctttggaggcgctatttgggtcccaagcagagcctgggggagcttcatttaccgacaagctttgtcaacgggttggaaataaaatggtatgcgaagcattcagagagcgacgccttcatcagcgatagtgattaccctaaatgttacccctcgacgttggcatgagcccgctgctttgcgccgcttgtcctacagatgctgaacccagacccgagcaaacgtatcggaatcgacgaagtcatnaacaaccgctggctgaaaaacgttgagtgctgccactcgaatcctatgacacccggtttactnatcgatgccccaaaaaagacaactcataatggcaacaagaaaacttntgtataaccacttg

SEQ ID NO: 1414 - DNA, 507 bp, Fusarium venenatum
cgctcttattcagcttgaagaccaggttacatagataaatacctgagagtacaaggccaggttgcttcttattgaagcctcgttttcttgtttcctctcgtgtcattgtctccactatctgatcattttcgcccaaattaaaatgtcctattccgtcaaggatcgttttgcagttgttaccggtggtggttccggtatcggccacgcacttgttcgactgcttctcaacgcaggatgctccgtcgccattgctgatctcaagcttcgccctgaagcccaagctactgtcgacgaattctcccaatcctccgacggcaagggctcggttttcttccaccaaaccgacgtctccgactgggcccaaatctcagccctatggaatgctaccctcgaaaagtacggtcgaatcgatatactggttaattgcgctgggagtttatgaagcaccgggactctccttctggaacccccccgtatctcgcccctggctgaagacccgaagatgcc

SEQ ID NO: 1415 - DNA, 970 bp, Fusarium venenatum
  misc_feature (1)...(970): n = A,T,C or G
caaatcgcaagaggctccgtgtcgacaaagatggtggcttccaagatgacactccgatcacttcagagtgttgagcttgaagagttgccggaagcagacagaagttgcgttatctgctacaatgaatattgtgtagagactcctgagggtgttaaagaagcccctcttcgcttgcccaaatgcggacacatttttggtgaccactgcatcaagaaatggttcgaagactcggatagttgtccctactgtcgagacaagcttcatgcggaaccaaagacacaaggcggcagttctgctagggcattcatgaatctcatgagatctagaggcatcaatcccggactggcagctcaacaattgccggatgaggtgctggcccatctcagagctcaccctacaggtgcggaccgacgaaatggctctccgcctcacgctgtaacagcagcaagaagatcgccaccaagagaaggcgttgaacaccagcaccgccgaactagagcacgtcatgacaattcaaacacacacaatgctctatcgattcccgaatcccgcaacccgagcagtttccatggagacaccccgacagcccactgtgcctgctgntgaactacccttcattcggccgcaacctgaacaattgccaatggaaagacaaccccaggaatggggacgaggtcacgctcaggatgccgaatgtagtgtcgacgtcagcccaagatcgcaagcgcaganattcaattgcctccgcggttttgccagagctatcttcatatnctttacaagatgcgcaggaccaacgcccgagagctaggactcttcgaaaccctttgcaagtgcagactggttcgccttaccaaaggtctgggaaacaacgaaaccgcaccagatatgccataccactcaaaataaaaggnggtagcttgtcccagggngcattcgatgggaataggatgaataacgcaggagttgt

SEQ ID NO: 1416 - DNA, 551 bp, Fusarium venenatum
  misc_feature (1)...(551): n = A,T,C or G
tatcggcggnggtggctgtaaccatggcacatttggtgacatggccaatgcaggacatggcaaggtcgcaggttccttgtggtcgcaagtcaagactcgcgaccttgactntatggagggtaaagatggaaacccagcaacaggatacatgtccaactcgcctgccccgcctagccagacctngttcgaatatggacagaaccctaactatgcaggatcaaactctggatactcccagcanggcagntacaacgctcccccgccgnaacaatnatacggnggtggntatggcggacctcctcagcctcagtacggagctcctcccccagnacattatggcggccccaatatggagggcctcctcctcaanaatatggaggnccggggtatggaacaccccctcctnantatcctccatacggccagccaggctatggnggaccttcttctggcaaccaaccttctctgggtggggacaatatcccggntacaccacggatactaaaggaaacatgatggnaaataggagcgtgctnttatatatgaaaccn

SEQ ID NO: 1417 - DNA, 810 bp, Fusarium venenatum
  misc_feature (1)...(810): n = A,T,C or G
tatggcctgattgtnatctgaaagtncgtccctgttccttgtctatctaactaagcattgacttgtcttatcttcctcttcactcatccaaagatacccccctagcacctgatttcgcttttgatcttctcttccttcatctcttcgattaacaaacaacacatcaggcaatctggacgacatcatcacaatggctgctaccaccgagcacagcgagcaattgagcgagaagcacgatggtctcaacggaaactttgaccctgaggctcagcgtctcgaggcattgagccagttccgaacagcacagagtgttcagatgagccctgagttgtttgagaagctgtacctttcgccaatgaacaaggtcaagggtgatcttcgacagacgtttgcaaacccaacaccaattgctcttgttggcttcttgcttgcctttacgcccctgtcctgtgatctcatgggctggcgaagtgccggtggcagtggtgctgcttcaaacgccgtgtacatgtttatgggcgggcttctcatgattatcggtggtgttctcgaatgggttctcggcaacagtttcccancttgtgtctttgctctttcggtggtttctggttctcttatggtggcactctcatcccggcctttgctacatacgcctcttatgctcctgccgatgctcaatcctcgncnaagcctgctacacaaggttcaatgctagtctnggatcnggcccncttatgggctcttgtctatcatcttcttgctggcgccctcngaacaaacgntgtcttggcaagacttttncactttgac

SEQ ID NO: 1418 - DNA, 524 bp, Fusarium venenatum
  misc_feature (1)...(524): n = A,T,C or G
gcgagagggttaccgaggcttatacaagggtctgacacctaacctcctcaaggtcgcacccgccttgagtatcacatgggtggtgtatgagaactccaagagaatccttggattgaactagtcgtcccagctagcgatcagacgaaagaaagggacaaaagacatgagactgaggaacccttcccagttctcacaaacaacatttactacttactatacatacacacgcaaatttcacatcaacattcaggaaagcgggggtcttagcgattggatggcattgcgttacgacggaggggaatcttatggcgttgaaaggattgatatatcagatgaaagcggttgacagccattgccaatgaacagagtggtgtttcgaatagcaccacgctgtattaaactacatgtttctcatttttcaaggtggaagancgatggctagaatttggttgaacatgtatttgttcaaagacgagatagaagagacgaagtggtctcatgaagaataaatcaagtttcttttn

SEQ ID NO: 1419 - DNA, 326 bp, Fusarium venenatum
  misc_feature (1)...(326): n = A,T,C or G
tccaccgcaacgctctcgagccccctctgtacccctcgatcgacaacctcgaccttgcgatcgaccccttcctcgagaagacctgcgatctcctcctcgagagcattgagtcgcactacaccgacctcaacaacttccaatactaccagcgacaactcggtcgtgagcagaccaagatcacacaatggcaggccaaagcgcaagaacgaagaacgcccagcgtgctgntgccaagcaggagcctnttcccgaggatgagtggnaacgacttgttaaactttcttnaggagcttacccgactggagggtnttgttgaatgccaaaca

SEQ ID NO: 1420 - DNA, 616 bp, Fusarium venenatum
  misc_feature (1)...(616): n = A,T,C or G
ctactatatacatatacatgccctcttccactccatccattccaccctcctcttactatcttacctactccaatatttattaatccttcacttggatcgtggatcacccacattgcttggcatataataaatactatagcttctatttctacgctacaatgggatcaggtagcttgccctctcctccagctgaggatcaaaaatcgaccctctctcgaaaaagtacatcttcaagtaccaaatcggtcaagcctgtgcaccgcacctccaagcgagccagctcaagtgctgctacaattcaccaccacgatcatgtcacacatacaactggcatggacggtcgacacaagcgtgtgtggaaagcttgtgagcgatgtcgcatgaaaaaaacaagtgtgacggtgaattcccctgcaagcgatgcaaggatgatggtctagtttgtactgctggtgtncgaaagaaaaaggaatacaagcagttgcctcgaagttacccgaaattctcgaaaacactcaattcgctttaattgctaccggtcacaagctttactcaatggttcgaaacaaccaatcctgggaccttggcgancccgaattaaacaatgcggcaaccc

SEQ ID NO: 1421 - DNA, 467 bp, Fusarium venenatum
  misc_feature (1)...(467): n = A,T,C or G
cttcnacatcnccaagattcccgtggttacccgggagcaggctgatgccgaggatcgatctaagaagctgattgccactactnctaccctnaaggcccccaaggttggccctaccaaggccacaggtgccgaggccgttgcgactgcctctgctcaggctcaaaagtacgctcaggagcttatggagattcccgagatgcacgagtttggcagtgtgctcaagtcttcggctnttatcgagcttaccgaggccgagaccgagtacgttgntnctctggcaagcatatcttcaaggagcatgttgttctccaatcgaggtcaagaacaccttgcccgataccgtgctcgagaccgtttaatcgtcgtcacncctgctgatgacnaggactcgatgagncttcatcatccaagctgngaagtntcaacttgtgagcctggcaaggcttcgnggcctttanaaanatggc

SEQ ID NO: 1422 - DNA, 614 bp, Fusarium venenatum
  misc_feature (1)...(614): n = A,T,C or G
ctcttttgtttaattcagcggatttgtctgtctttgtttccgacatctatactttcaatccatcgcctcagagttgtggcctacgtttccttctcagcctctataccagagtagccctgggctctctttgaaccgtcaagatgagttcagactactcttacgacgagcagggccaattctttcccttctttatcctcacacttaccgggatcgtcactcttccccttacctacacactccttcgtccgagtcgcagcgatgatgcgctagcgccgcgaatcaagaccgactacaagccagagcatgcggccacagtcgactccctcaagacagcgcggaagcgcagccagtggagggtcaagcgggccatctttgtggtgttcggctgggccctcatggctggcatggcctacctcatcgtagttacgcagcgaactgtccccaagctttacaacccttacgacatcctcggcatctcaaagtccctcaatgagaagcaaatcaagtcgcactacaagcgactttccctcaagttccaacccgacaanggtcgccctgacgccgccaaagaatgaaaccgtggaatctctcaacaactactacgtcgaactcac

SEQ ID NO: 1423 - DNA, 379 bp, Fusarium venenatum
  misc_feature (1)...(379): n = A,T,C or G
agcttgtccgacttcccaggcgtaacattcgatgttattctcgattttgttggtgcacagaagacggtcgaaacggcagtatcaatcgtcagggatggtggcactatagttctggttgggttggcttcgtcgcgtattcaactaccaactgcggatatagttaccagaaatctctcactaaaagggtcaaccagcgcaagcattgatgaattcgttgaggttttggaactgctaagttctaaagccttgacgccacagattcgagagattccctttgaggaagttcccagtgcccttgagtcactgagtcacggcgaagtcactggtcgnctttatactagaccttgagatatattataaatacacttatcnggttaac

SEQ ID NO: 1424 - DNA, 500 bp, Fusarium venenatum
  misc_feature (1)...(500): n = A,T,C or G
ccaccttgctctcagtcttagtcaacaaatgaatacccgncggctcttcactactgcattcaagaccctcaacgtctntcttacaaaatcacattcactccttccaatcttccgtcccctcctcacacatcgcacaatggcttcagctgctgctaaacgtctcaccggcaagactatccttgtcaccggtgcctcctccggcatcggccgttccactgctctcgagtttgccaggaccgcacccaagaatgacctacgtctcgttcttactgcgcgccgtgttgactctctcaaagagctagccgagcaaatcaaaaagcgaggtcggggaatggcgttcaaggttcttcccttcaaagctggatgtcaacaactctgccgaagtgaaanagcattggaaaaaacttggccgaagaggngggangaacattggatgttctttttaacaatgcaggccttgtcaagggcgtggcttcggctccaaaaattgntgnggaggt

SEQ ID NO: 1425 - DNA, 262 bp, Fusarium venenatum
  misc_feature (1)...(262): n = A,T,C or G
cctccgcgtgcggttacacantcaagatgattcaattaaagacaatgcttaactgcatcgacaactngggcgctgcccttgttgaatgcgtcttggtcgttggccaaaagcgacatgcccgaatcggtgaccgtntcgttgtcgncgtncaggacagcgtggtagctccttccggnggtatggctggtnttttctgnccncaacaagtcaancgaggtgacatttttcaccccgtcntngtccgaaccctgatnccntacaa

SEQ ID NO: 1426 - DNA, 632 bp, Fusarium venenatum
  misc_feature (1)...(632): n = A,T,C or G
ctccgcacgttccctagcgatcttctccgcggttttagacagaataccgcgcgtcttccagaggtcatatctcctgagcgcataaaggcctttttcgcagaccttgtgctcggtagccgaaccctttaaaaccctcgaaaaaaaaaaacatccagattcgagagcggggcattttttcttgcacccctccaacaaccacatatcgcccatcatggcaccctctttcgaccaccttcgcgaggccgaccttgacgatgacgagttcaacgatgatgatattgatatctccgacctgcgagagagattcgaggtttccctagaccaaggctatgacaactttgtcgtcatcgacggccttccccaggtcactgaggaccaagaagcctaagctggtcaagttcttgttgaagaagctcaacacagtcggcaagacacgcgaggactccgtacacatgcccatgggcgacgatggaaagtctcttcgattcgcctttgtcgagtactcctcaaccgccgaggctgccgccgctactcgccagctcgacctcactcctctcgacaagaagcacactctccgcgtcaacaaagttcancgatatcgaacgctacggacgagaaggnccgcattgacg

SEQ ID NO: 1427 - DNA, 554 bp, Fusarium venenatum
  misc_feature (1)...(554): n = A,T,C or G
cccgagttcaccatgtgcgagttctacagcgcatataccaacttggaagacctgatcaaggagactgaggagattttgtgcggccttgctcagcactctcaagatcttatctccactgagctgacagcccttcctcccattgacatgtctcgctttgtccgccccttcaaacgagttgagtttgttccggcactccaggaagctcttgggactgcgtctgcctaagctctcatcaccacatgctttaccagaagtgctcgccatcttgaagctcgctaacatccangtccctggtgaagtgcctacatcattggccaagctgcttgatcgtttggctgccatctattggaaccatgttcttcacggagccgtcttattatgaaccacctgcttgcatgtnacactggcaaaaactcctatgccccgaganttccactctctctgtcancaaactttctcggtggtgcaatttggcactntttaaaaagaaanaaccaaacccnagggcattgttgaaatcaaatcnctcacaggagaagcgcttgtttgactcc

SEQ ID NO: 1428 - DNA, 587 bp, Fusarium venenatum
  misc_feature (1)...(587): n = A,T,C or G
ccagggtattgtagggggcanaatccaagattcgcgaacccctcgatcatttttaacacttcatcccctaaactcacaaaccgcttcttggcttttccatactagctgngggtttcgactaaatagccatggcgcaacgattcggcgcttcgtcgcttcatcagcgtgactcgcgtagcgctctcttcgagggatacaatggcgacgcagcctcgcgacgacctgtcagcgcaagccccaaccgaggatatggctacggcggatacggcgccccttctccctctcctntaggacagggtggtttcnacagttcacggcccgcttnatttcnctctgcgacaccgaacaagaggggccaatatagcgatgcagttctcaacgagcttgagagtcanaacgatgcgcaggtggagggtattctgggcaaggtcaaggttctcaaggatatgactgtcgccatcggagacgagattcgcgagtcctcagcgttggcgganaanatgaacgatactttcgactcgactcgcttgcgtctcaggggcactatgaaccgcatgcttgtcatggctcaacccactggtgnggga

SEQ ID NO: 1429 - DNA, 586 bp, Fusarium venenatum
  misc_feature (1)...(586): n = A,T,C or G
cacccccaactcactgagagatgttgacgaggggtttgatgactcttttgggtgcagatgggtatggactttccactcttccctagcagcaatggtatgggtcaaagaccaatgactatcagccgctatttggcgagattcccagtgccaatatgggcttctcccaaaactctcaggacctttccaaatggactggtctaccgtttgatttctcgcaaaactttgactaggaagtcgatggtttgccgagatattacaataacgagtaaagggggacttactcaaattgtataatgtcccctaaaaattgccaaacaaattttggtttgatgagatatgaagcttttatttataggccacccagtgcggggataaggtctttttnatggtattgcagacgtttgcttgctcattgggagatcgctttctccttgagaatcacgaagaagattaggccttttaaggctgttgttttgttttatcttccacgtggaaaggaggaatnatngccctcgaattgggtatctgggaagcgccacattgtcatnattcattntcccaccacaacttcagaaccgcaagttcg

SEQ ID NO: 1430 - DNA, 389 bp, Fusarium venenatum
  misc_feature (1)...(389): n = A,T,C or G
ngcctagaacnaantcccttgaagagcttgctaatcccgtagggatactaaaatatgnttntttttnactatncgccccctgctactcncacgcngactaggtaaagctcataattatatgtggggcggctgctttatantaagctagcccgagcccctccggggctacaccnaacaattagtaattttagataaaatatgaatttaactttagggctttttttaanaggaatcttagggtttgtttttaatngaaaaaatataatattaaggcttatttttattgaaanaatgctttttatctattacattcttaatatttgggaangtcttggccaaantccatgaaattaatagggcaaacgggtggncatttacattaattggtg

SEQ ID NO: 1431 - DNA, 586 bp, Fusarium venenatum
  misc_feature (1)...(586): n = A,T,C or G
ctccagccgctcaacagtgactttttctgagctccatccagccaagtcgcagttatcaactcgacaacgtcctgatccctcaattgatccagcggcaattccataaccacgatgttgtctcgagctctccgactccccagggctgtgcctatgcgcaccaagctcgccgctcccgcttataccgctgttcgctccgtcaccaccgacgctgcctctgcgtccctgagccactcagtccccaagtccgatgacgagcctttctccgtcaacctcagcgatgagagcttcgagacttacgagctggacccccctncttacaccctggaggtgaccaagaaggagttgaaggatatgtaccgcgagatggttgtcacccgtcagatggagatggcggncgatcgtctgtncaaggagaagaagatcgtggttctggcatctgtctaccgacaggaggctgttgccgtggtattgagcatgccatactaagaggacacatattccgctacgtgcacggtacctttttcgngngcttgtccaacatatgggaactgtngccactanggttttatcgnaggnggtcatgcca

SEQ ID NO: 1432 - DNA, 308 bp, Fusarium venenatum
  misc_feature (1)...(308): n = A,T,C or G
aacaactacctacccaaccaccaaacaatcttcacaatggctggcgactgtggctgctctggtgcctcttcttgcaactgcggctctagctgctcttgctctggctgcggcaaataaacaacttggtcctttgatcaatcgaataccacatctattccaggcccagactgggggtcaagatacatntttntgacgacaaatcancggacggagtnatgaanggcggagttganatcatgatgtgattgggatatgcggttggatagctacaatttaagctcaaatactatccttgttgtactgttgag

SEQ ID NO: 1433 - DNA, 499 bp, Fusarium venenatum
  misc_feature (1)...(499): n = A,T,C or G
nccaggcagcggcagctgctgctgctcaaaacggaggtcccgacccccagggacctgatggcactcctacctcatcctaccccggctcacggcctgttcagctgcctcccatcggctaccagcctgctcagtacccgcctccaccatcggcggttcctcaacagccacttcccgattacaacaacagccatatgtactccaattaccagcctcactcgccctatgcgcaacctaccagggcatttcttaccaatcaaacgcgcaacccccaagccactaagtgggggatggtcaaccaaggatcaagttctagaagaagaaantcattaaaatcaggatggaaaaagaatacccgctgttctatattggaactgccgtggtgtctttgatcttttgcatcnatgcanacttgaccctgtcttngacaacccgtngatttnggatnatggaactcccatgcgaatccttgattcggtnattactctctatttcaaaatgg

SEQ ID NO: 1434 - DNA, 609 bp, Fusarium venenatum
  misc_feature (1)...(609): n = A,T,C or G
gccgccaagcaacaccaaaccgtgtcacaactgccgtcgccgacgcctgcgctgcgaccgntcatggccgacatgccacaaatgtgcggtctcggggcaggaatgcctcgggtatggcaaggttttcgtctggacgcaaggtattgactctcacggcaatgtcaatccgcctccgggccggaggctacccgacgacactgattcttccgcctctgcctcgcccccgggacattatcatcaactgggtcaaggtcaacatcacgatcgcccgagaccccagcctcaacctgactatagcgaccagcacccactggcgcgcttggtccaacaagcacaacaggctgcccaagaggcagaggagttgaagcgacatcagcaacagccgaccccacgcaatgacgaatctgcatcctcgagcgatggcaatatgccttggccttctccggctgacttacagatccgttgttccaggatcttgaccgcacatngggattctacctagcgcatttctccgaaagcgtttgnaangatctcgtggtcccaaaaacacctgaaagtaatncattccgggagctgatccccttgacacggaacnccccgttttttttt

SEQ ID NO: 1435 - DNA, 972 bp, Fusarium venenatum
  misc_feature (1)...(972): n = A,T,C or G
gaataccggcgctgccgagcctaggctcattgaacctctgcctccgacccgcatcgaagtccgtaactcccaacttcctacccatcgtccagacggccaacctttcccagcgcgagaagaagcgcaaggcaaagcaagacccatatcgatgggctcaagcacagcaacgaaaggccgccaatgtgcaacgacgtgaagagctatctcgtgaganagacgagtcctggggtgatgctgtcctaggaaagaagaccccgttcatcgaatctnttgcgacagctggcgtgcganatactgagggccagtctgtgacagataatggaatccgcaactattttctttcggataccgaggtcgaggcagccaccaagcatgcctaccaactaccgagcccatgattgggctgtgagtccanatagacctgaaccangaggatgcgatgaagcggcacattgagaaccacgagaaggttatcgaagctttaagccgaattacgtcgcttgagaacgggagcttaaaggaccgcttccacgccaacgtgcagcgcatcattaacgagtttggtcgtcaccgcaccgactccatctttatgcccaacaagccccccaaaactatgctcggggaggaaatgcctggacgacttggtcctgatactggcagctctgaggtccagattgccatcttgacagccaaaatccataacctctcaaatgccctacaaatcaaccgaggttataaggacaaacacaacaagcgtaacctaagattactgttgcatcgccgacagaagctcatgaaatacatggatcgtaaggagagaggaagtcagcgatgggctcacatggttgagacgctaggccttacacctgcaacctggaaggatcagatctcgttgtaagaagangcgggagctgttgttgtagaataacttggttctntttatgtacaatacaagccacctggaaggatgag

SEQ ID NO: 1436 - DNA, 328 bp, Fusarium venenatum
  misc_feature (1)...(328): n = A,T,C or G
nacaaccattaacncatcancaacaactntctagatgatatcnatcataaanaatggctcgcactnaacaaaccgaccggaagtcactggtggtaaggcccctangcangcagatcgcttntaagggtgaccatangtcccgcccnttttcttgggggagtgaagaacntcaagcgatncaatccgncccggtactatcagtnagattcnaagaatacnagaaatccacttgagcntcttattccaaagctacccttnnaatgttcagtacgtnagaatgccaagaacttaaanttngatttccnattcaggctntgcnatgagggat

SEQ ID NO: 1437 - DNA, 588 bp, Fusarium venenatum
  misc_feature (1)...(588): n = A,T,C or G
attaaagccaacccgttccctcaaagtttcgatttttcaaaccctacatcttcaattcgcctgttgtcctcttctcctttgacttctcgtttatcttttctcgccttcacttcacttcacttcaacacttcacttcaacacttcacaccatattcaacatggttgcctcatcgaacaccggcctcgancgcgangatcaccagcgcgatgccgacttcaacagggccatgcacggcacctcancccaagcccgaagtggtgtcgctgccatgttccgcaagggcggtgctgctaacaagctgctgttgatgaatacttcaagcattgggacaacaagcccgcagaaaacgaaactcctgaanaacgaactgcccgtcaagctgaatncgctactctgaccgacactactacaancttgctaccgatctctacaaatacgatngggccatcctccacttctgcgatctccccangngaaccctttaccaagccattgcccgccatgacactaccttgccacccaaatggtntccaagaangcataagttcctgannttggttgcggttggtgggtccccccntaaattc

SEQ ID NO: 1438 - DNA, 473 bp, Fusarium venenatum
gcgacaacaggcagcagcagcagcagcagcagcaacgcgcatatcgcctgccacccaccaatacgcccgcattttctattcttctgagctgctttcccaaccataactctctttcgatcatgagatagctagcacctttgcattctgactgactactccccccgtcgcccaagatgtcagtcaatccagcgccgtcgctgcagcttgcagagtacctcgagaagctgcccggcacaacctttagaaagctctatcagcagccctctactgcctttgctatcttccgtcgcatgctgccacaccttgcaaagacctttgtaatgcgaatcctctactccccgaaaccaattctcctcagcgacctcgatgactgggtaaaaccagtgccaaacgccaaaaagatcaagctctctccatcctgcgcgttctacacatcgtacaaatctcgacaccctccaaggaacgacccagga

SEQ ID NO: 1439 - DNA, 634 bp, Fusarium venenatum
aaaatggaattcctggaaaagaatcaggcatggaaagagcctgattttgatactgtattgcaatatttgcgaacagttttgttgagacatggcgcttctctcatctatacctcacaaaatgcgccctctcagctaccgtctcttattcattccactcttggaatcacatctctcctgaagcgtcacccactaaagcataacgttatcgaccgcgacaagattgtggttcccaccaactgggactcatggggcaagattcgtgttcttggcggaacatttgacgccgagcaggtctctaattcatggtccgaagatatcagcactccccgcgagtctatgcgcttcaatgatgatgaccaaggtgaggtggatgaagcagagttggaggagcggcaacagaaaagtgcgatcgcgcgttacgaaggatggtgccgtgaccctaacagcggcggcttggcggttgtcgaaaatgccatgcatggcgagaagtggatcgccgtggagagtgacgatactcaagacttctcgagaagcagctcaagatcctcgaagcattcaaagccaagcagccagagaagggttccgataacgccatcgcccgcagcacgcgtcatattgattatagcaatgacaa

SEQ ID NO: 1440 - DNA, 582 bp, Fusarium venenatum
  misc_feature (1)...(582): n = A,T,C or G
cttcaatcaattaatccacatcccactcatcttagacccagtcacagcgacgacccgcccgacgacccgaaagagaccaaccatacagcaattgcgccatcccacgttacctactactatcctactactgcatatagtacccagtggtaccttgctctctaccttgaatgtcaatattctttagatccctccttttctttctactcactatcaccctggctatctttctgtcgccctcattcatcccccgtctccgccaaatatcttcccatcttctcatcctcaatcgaccgctcgcaactatggccgccccgtcttacgcctcagagctcaagatcgctgagctcgccgttcagcgcgccaccatcctcaccaagcgtgtcttccacgagaaggccaagggcaccgttgacaagaacgacaagaccctgtcactattggtgactttggcgcccaggctctcattattgctgccctccgtcacaacttccccgaagacgctatcgtcgctgaagaagaagctgctcactcaaggaggatgcgaacctcaaacagactatctnggactcgtcagctctacca

SEQ ID NO: 1441 - DNA, 332 bp, Fusarium venenatum
  misc_feature (1)...(332): n = A,T,C or G
tcaacacaaacaaaaccaacctttaacaaccactaccctttccaaaaacaaccatcatcatgtctggctgtggatgcgcttcttctggctcttgcggctgcggctctggctgcacctgtgacggctgccctcacaaataagctatttcttcaacgactttgacgggaaccctgatggatgaaatganacatggggaagctggatgtctttcagggtctgacgattcggggaagattgatcagcaatggatccactcgttacttcttggccgtatctttatttgagtatagtcagaattaaatgaagacacaaattgcagtctctanataaaa

SEQ ID NO: 1442 - DNA, 531 bp, Fusarium venenatum
  misc_feature (1)...(531): n = A,T,C or G
ctcgagccactccgactgggtccattgacaagccattgtcgacccccgactatcgtcaataccgatcctttcgcttttcgtcccgtccgccctttttttgcgactctattcccaatggcttcgaccggagtgaacgttctgcggtggtccgccctcggcctgggtatcttttacggcttcacccaccagcgagcgattactgcttctcaaagggctgagcacgcgcagcacgagtacgagaagaaggagaagcttatccagcaggccaaggccgagttcgccaagaagaagagccttcaactggtgatgatgttattaccgatccttcagaccccaagttcgatcttgagaagctgctgtngaaggtccanaaggagagcccttagatatgtaataatggcgcggggcaacacnantatgacnagggagagaattgaacgataggaggttttggcgaaaaggtnaccgctagggaaacaggtcntgctggggcaataatccgaacctcgaaccagaccgatttntgattga

SEQ ID NO: 1443 - DNA, 645 bp, Fusarium venenatum
  misc_feature (1)...(645): n = A,T,C or G
ctgcaggatcgggttggttgctacctaggcattctcggcaaggacacagtcgatcttacagatgtgcatgctatcatgcttttggaggaggaagatgtcaagctgcttggcaaggtccaggaggtcttgtcctctgcagagatcaagatgaacatgctgagtggacaggaagccaatatggacatggatggttacagtggctatgctgcgaagttacttcgaatcactgccatgatgctggacaaggcagcggtctggccagtgacacgtctcaaggctcgatgcctggaggcacacgcaaacttcatgcgaactcgtgctgagagatcgattattcctcagcatgactcacgactgtaatcatcgatacgtttggggtgataatcttacgacacttctggcttcatgtcccgagaagtatttacgaagagcaagcgttatgcccgagatacatacagggttcgaggatgttctttctttcgcgtcacataacggcactggcttgacgcaccatgggaattcttatgaacgtcttacacaaaagtcgacccttttttgcgaaatactgggtttttcttntttggggcatgaatacagtaaccccgatgtgtgtatgtttaacgtcngggccgttaaccggtgntt

SEQ ID NO: 1444 - DNA, 567 bp, Fusarium venenatum
  misc_feature (1)...(567): n = A,T,C or G
gccgcaggaattttttttttttttttttgatgcatcaaagtcccaaaggacatgtttatatcgtctcacgtagacgtaaacagacgagaggccaagtagacaaagtaccaatgatctaacgattgatggcagatgtcacattcagagtgagtgaatatcggaaagccggcagagtgccggtcggtctctcaggccgtggctcgactaaaagagtcgagctgatgcagcaatggcaacagaaaatacaagccccatgtgagatcgctgagggttccgagaagcttgcttccgttccttctggtggtgccggtgctgccgctggtggtgccgccgccgctggtggtgccgccgaggaggccaaggaggaggagaaggaagaggagaaggaggagtcccgaccgaggatatgggcttcggtctcttcgactaagcgatctctacccagagatttgcaaagtaacgatacctcacgaatttcgaagatgccacgcacgggttgttcaccagttcttacatgtcttttgcgtggatggattggcccgctcatggctggattgggtctctntt

SEQ ID NO: 1445 - DNA, 406 bp, Fusarium venenatum
  misc_feature (1)...(406): n = A,T,C or G
cccacaatcatcatacctgagcttgctgagctgggtgtctacgcccaatccgtcaaaccagtcgacaactcatggtacgaggagggcactctctccaatgggcctcaccaccacctcatcaacgtctccgagtcaggcctcgcgaagcatctccccgagcatacatcagccgtctccagacataatgcccagcatctcatgcgtgtcttccccaaaggtctcgtatttnatccaccaatctgaagcccgttctttattggggaatcggcgctcanatntgtgctttnaacttgcagaaatttnggagctagcaaccaatttaacgaggttttttttagggnacggatggttacnttttaangcccgtttttttcgngccggggaaacggaaagttgancacaggcc

SEQ ID NO: 1446 - DNA, 630 bp, Fusarium venenatum
  misc_feature (1)...(630): n = A,T,C or G
ngggnggatacccaattggtttggtttcctcctcgggtcaagtacgcttatagacctgatggcctgaacaagagggccagactacgcgtcaagaagaacagtaccaccgtcccggtgtccaaaagatacgcaacacgaagtactatagactatccatcaagactaacccagacaaatctagacctcaacctccctctaaataccaaccttcccagtaccaccaaccttcccactaccaaccacctcccaaattccaaacttctcacactcacgtagagatcgacacccaacgtcatccctactactccacccccattgatctcgctgaacgtgaataccgccagcgttaccgccctgcccaagctttttccacaagaagacccttcttcccactctcatcctcactaccaacctcaagacaacttcaaagccaacaactacaccgttgaaggncgacccgctcccaatttcaatcctctgagaagactgaaatcaacaagtttactgntgacgaacactnctctcgcctcaagtacaaccacaccgggaagaccgaattcnacaactacactggtgaaagccgattttccgtnctcaatacaacacctgtgagaagactgggatcaacat

SEQ ID NO: 1447 - DNA, 337 bp, Fusarium venenatum
  misc_feature (1)...(337): n = A,T,C or G
tacaatggacgctgctcaaacaacaatctcctcgcctgtgagcgctgccgcaaacgttgcgtccacttccaccacagccaccaacaagcccaaggtgagcctcacccgtcgaccacaattgttctcaattgccatattaacacttcctctcaaaagccctgctgtgtgtgcaaggacnaaaaggccaagcgcgatgagtgcatgctcttctccaacgcaaaagaccctgccgccgactgcaagtctatgatcgaccagtaccgatcctgcatgtcgggctttggattccaggtttaaacaaggcaaaaaaggcgacgactgtcggattggaaaaccc

SEQ ID NO: 1448 - DNA, 896 bp, Fusarium venenatum
  misc_feature (1)...(896): n = A,T,C or G
catccattcgctcttacactgcctcttacactcgttgtatctcgcctttttaaacaaaaaacataaacaacacattcaaaatgaagtactccgtcgctttcgttgctctcgccgctgttgccgctcaggctcagtctcttgccgacgttcccaagtgcgccattccttgcctcgacaaggctatcgccagcgagaccgactgtgacaagaccgacctcgcctgtgtctgcaaggacttcagcgctgtccgatctgtcgctacctcttgtgtcattgacgagtgtggtaccgacgttgccatcaacgaggttctccccgctaccgagggtctctgcaagaaccctcccaaggagtctgaggacaagtccaccgctgccgaggagaagcctaccactgctgaggagaagcctaccaccaccatggtcgttgtcagcaccagcgttgaggtcgttgagactaccaccgccgccgccgaggagaacccaccaccactgtcgctcctattgttcctaccaccgctgctgaggancccgttgccagcactcccgctgctgccacccctaccaagggccctgagcaggccaacggcgctgctggcctcactggtctcggtgccatcgccatggctgctttcgctgcccttgctctgtaaaggagtttaggaaccagcttgtcagttatgaaaacctgattcctcaagtagtcaaactggacagtcaatgtacatctggtgagacgaacggggtaagaggcattgtttttttttttaaattgaaaggacgatattgattatgtgtatgagaattggaaacgctatcaggattcgattcacnggttaataagtaatggncttcgaccacaatgaatataagcgaatataccagtgangccttttt

SEQ ID NO: 1449 - DNA, 591 bp, Fusarium venenatum
  misc_feature (1)...(591): n = A,T,C or G
cgactcggacgcctatcaaacaaacctgtggattggcccgagatcaatgcggctngggggcatgctttgctattactggtaacggtcgcggacaagttggcatacaggtttgatggctatgacccacagcccatgggcagcacgtccaggattgttcgatatgaagttccgagcccttcatcgancagacttggcagtcgtactgctagtatacctcctaaaacgcatatccttgagttgtacagctccggggacatgccccttgggcttacttttatgcatcgacgttttgacaatgccatggtgggcttcctggagcttgtgcgacagctgggtgcgtttgtgcataggcaaactgacgctactggcacgccgnttagtttgccatacaagatcgatggtgacaaaataggggacgtgagcatcaaactcggcatcnctcaagatgatggttggactaaggcgtgcaagctgacgttgacatgctgtaaagtttctgcttgctcacnccagtaatgtgacgtccaacgcacgaaatgggggcagtcaatacaggggatagaanganaaaaanaaaaggtttcctccctg

SEQ ID NO: 1450 - DNA, 432 bp, Fusarium venenatum
  misc_feature (1)...(432): n = A,T,C or G
ntttgntgtgtnggngctggttacgtcgggggccctactgttgttgncgttgttttccaaaaccctnaaatccaggttactgtcgttgaccganacgtcacccgtatccgacgctggaactcccgtcaccctcctatctacgagcctggtctgcatgatatcgtccgaatcgcccgtgatggnggccgacctggcaagatcttcggcgagcctaccaccgacagcgagggctccttcgctgaggagggcgagatcaccatcaatgagcgcaagcccaacctattcttctctaccgatgttgccaagcacatcagcgaggccgatgtcgtccttgttgccgtcaacacacccaccaagtaccgtggtgttggtgccggtagtgccactgacatgaccgctttcgaaggccgcactggtgtcgntgctcaatac

SEQ ID NO: 1451 - DNA, 656 bp, Fusarium venenatum
  misc_feature (1)...(656): n = A,T,C or G
ctcatttcttcttttcatgtcttcttttattttcatcaacacgctcgcgcatcttaatacaaaccctcttttcgtacaatcttgggtcgcgctcatctgattcatttttcgagaatttttcctgtcattgtttctcattcaattcctctttatttctccagtcttttgcatcatggcgcgcacaaaggaagatgtcgcgtccaaaggcgactcatcgccaaagattcccaaatcctcagctggtgtgaccaagaacaccgctgaaactcctgtcaagcgcggccgtggaagaccaccaaagggcgctgcgcccatgcctaagaaggtttacgtccctactggtcgtcctcgcggacgtcctccaagtggtggcaaagaagaaagctgcccaacacctaagaaagtcgcggccgtaaacgatgatggtactcccaagagaggacgcggacgacctcgccgggctgccgctgctgaagatgaagaatccgctgcacaatgcccaaggaaaccaagaagcgcggaagaaagcccaagaatgctaacccaactgatgcttcggccgacaggataaggacnatnatgctgccnacaacctagngcaanaggttcctccccatcnccgaaaggcaggcaatggaaagggtncanacaaggna

SEQ ID NO: 1452 - DNA, 586 bp, Fusarium venenatum
  misc_feature (1)...(586): n = A,T,C or G
tgagttaccaaagccaacatgggggagcccaaatgccccgccaatcgttggagccgtgcatcgacgtccaagggaaatcaatgaatctcctcctccagaacccacacctccgccgcaggctatgacagctgtcccgctatccgacgctggcactgatgctggtaggcgcgcgtccatgctgtcagtcccaggtgctatgcccggagaccactctgctcgacatccttcgatgccctatcctgggggcccatcgccttcgcctattccatacaacgctcatatgacgcctcattttcagccagttacgccaggaacccagcctccacaggttcatcagactccagttccaattccacatccacctcaccttggtcctcagccccaagtgtctgtacgtcctgtgcaataccagcaccagcctcaacatcaacagananggtatgcacaaagcttcgctcctaattatgggcagccagtgcctcccatgcaccaacaaaccccgatnggaaaacacattacccaacttacaancaancgcctgctcctcctgttgtgcgttaccctatggctccacgccccggatgcc

SEQ ID NO: 1453 - DNA, 618 bp, Fusarium venenatum
  misc_feature (1)...(618): n = A,T,C or G
aagttggattaatacactcgctactttaatacttccaccaaaaaacaacaaccgtcacaatgggtttcgtcaagactgccgctttcgctaccgcccttctcggcgctgccaacgcttctcctcactatgctcctccttccaacgagaccatccactacaccaccgaggtcgtcactcacctgaccacctactgccctgctgccaccaccctcacctacggcgacaagacctacactgtcaccaaggccaccaccctcaccattgaggactgctcttgcaccatcaccaagcccgttgctaccgctactggctatgctccccccaagcccactcacgccaaggactgcgctgagatgtgctccgacaagttcgatgagtgccgcgttgctcccggtgctaacatggctcaatgcgctgctgagtacgctgcttgcctcggctacaacccttgggagagcggcaagttcgtcgagcccactgcttgccacganggtgtcaagcctactgggcctgctacaccaaccgagggtgtcaccaagctgaccacctactgcccgagaagacactcttaactacgggaacagaacattcccgttaccaagccgggaccgncactgt

SEQ ID NO: 1454 - DNA, 484 bp, Fusarium venenatum
  misc_feature (1)...(484): n = A,T,C or G
ctgggaaatcaaaaacgtcgcgagaagaaataaccgcattttttggaatcattttttacaggcgtacaacatgggtcaccataaccttcgttttgatgacgaccctcattcgctgagtggcgcttggagtcccccaacaagcagagccaatttttgcgaagaagactatgctatcacattctatcttgcggaatttatcaatgcgttgacaaacgttacctacgtatacttggccctgcgatccatgtatggctcgcgcaccgtggactgtttgctcaaactgggactttatgtcttttccctatggtctcggcatcgggtctttttttttncacgccacacttcccaaacgctcgagttggtganganctgccatgatgctgtgtctggccatgcttcgagctnttttattttgngacagcncccaaaacgtcgttcatntaatatttgggggggtcttcatctcgtctaagattcacgcatg

SEQ ID NO: 1455 - DNA, 409 bp, Fusarium venenatum
  misc_feature (1)...(409): n = A,T,C or G
ctcccacaatcaccgcctcctccatatgcgcctcaagacacgggccctggagttggagcaaaccacccagcatcaagcaatcatatgatgtaccagccatctcctattggcgcttaccctcctcaaccccaatatcctacacagccatcctacgctccggcagcaagtcctcctctacagggtctccagcctccagcacttcctccacnaccttcgtcttcgcaaggattcgcaccatcatctggattcggttctggcccaactggctacaatccatccaactatccactaccacctcagacttatttctctcctcctcctccagctttgccagcacgtcctggtcttggaaagttggctggcggaagaagaaaaanatttggcagcagctccgcggataagtggctga

SEQ ID NO: 1456 - DNA, 716 bp, Fusarium venenatum
  misc_feature (1)...(716): n = A,T,C or G
caccacccctgctctgctgaccttcctcgagggcttcggtaagganacccacactctattctggcgccaggtccttgactccattggtggcgtcaagtccgtctttggcgaggacnaatccatcaagaaggcccttgacaacttcaccctgaagctcattgatgaaaaggtcaaggaggttggatgggagttccccgagggtgaggactacctcactggcatcctccgaaaggagattatcggcgttgctgttgccagcggccaccctgctgttactgaggaggccctgaagcgtttcaatgcctgggttgaggaccctgaggctaaccccattcccgctcctctccgtgttgctgtctggcgcgctgccattatcaaggagcctacccgcactgttgaaatcctcaagaaggaatggctcaacaccaagtctatcgatggaaagcttctctccctcagttttctcggcacggtccaggataccgaaatcctccagaaggatgtcattcccttcaacttcaaccagtctcctccgtccaacgctgtccctgctggaaaacatgcacgttctgggtggctntattgccaacaacgtcgttggcccgcccgttcaagtggcaattcatgaangacaactgggatgctgntattaccaactcggcaancctgtngttgtcgaccgatacataaaccttagtttgaaccgttttacggat

SEQ ID NO: 1457 - DNA, 470 bp, Fusarium venenatum
ctcctcgcccgacccgcgcaaagccccgacacatacccaattggctcaagatggcgtcgggatatggaatgaacggcggcgtcggccgctgctttcccttctggcaggaggttatgggatgctatgttgtcaacacctctgccgctgacgactccggcaagaagaagtgcggtctcgttctcgaggattactacgagtgccttcaccacaagaaggagcacgctcgagctcttgctatgcaagccgcctacgctcgctccgagtccgctacagcacgcgacgatgcgcccagtgtgaagcaaataaggagtttgggacttatcgacaaggaggaagacacaaagaaggtcctgggacgaagctagatggtggaatgcacgatgaatgttattcgagcgaccttatatgctcgccggcttctttgtatcgatcgactgtatacaaaggaacggaattgatttgctcaactg

SEQ ID NO: 1458 - DNA, 526 bp, Fusarium venenatum
  misc_feature (1)...(526): n = A,T,C or G
taagaagcgaggtggaactgctgctggagtgcctcggcccttgggagaatccccttccatcaacggtgtagccaaggaacaggtatcggataatgatgaagattgctctgcatgcggtgctgccggagatgtcgtttgctgcgatggatgcccgcggtcattccactttgaatgcgtggggaatgataccctcggaccatcttcctgacgaatggttttgcaacgagtgcttgtncaagcgatacccctcgcgcatgcccgccttcaagggtgtttttgctactgctcttaccaacctggagaanacatcctcgcgccttcagcctccccaagaaattacagacccgctttgaaggcgtcnaancagccgccgacngtgattacnaagaagtcattacttcccagacggccagaaaaanaatggttntgaagaattgccgacttttcaancacggatgaaggcngcagtactctccncggtgtcaaaanctgccccaattncccctatatccgtcatgtcgccctc

SEQ ID NO: 1459 - DNA, 773 bp, Fusarium venenatum
  misc_feature (1)...(773): n = A,T,C or G
gcaggacgtctttgttaacagacgtttctatagatgacgaggagagcgacgacagctcctcctcctccgcccctgctgttggtgccgctnccnttgctgctcnccnccagttcgacgatgaagaagacgatggagatgtcctagattcttgggatgccgatgactccgaggccgagcgtgagaaggagctcaaggccaccgaggccaagcagaaggctgctgctgctgccgctgctgctaagaagcccaagggtcagcgaattgccgaacaccaagctgagcgtgctcagcagaaggctgaagctgaggaatctgatggatacgaagagaccgagagcgagaaacgtgagcgacttcgacgtaccgaacaggaggccgacctcgcacacgctgccgacatgtttggagatattggaattagtgctggccgcgccaaggctcgtcccgctaccgtcgtcaccgaccccaacgatcctaccaagaacggtgacatctccaagatgcctctcttccagccaaagaacaaggtccagttcgagaccctccgtacgaacattgccctctcatcgtggccaacgcaaagagcgcccactactnctgtttctncaagacttaccaangcccttgccaaggagatgaacagcgagcagatcaagaaacttgccagtagcatgactgccctgggtaatgagaagatgagggangagaagnttgttgcaaggcggcagaagtaaagntgcaagacaagacttcctngtaaccggcgngctact

SEQ ID NO: 1460 - DNA, 580 bp, Fusarium venenatum
  misc_feature (1)...(580): n = A,T,C or G
ggtcaatggggctgcggtaggaggtttgctcgagccgatgccctgggccgtcacttcagatcggaagcgggccgtatctgcatcaagcctttgttggacgaagagatgatggagcgacaacggctctggcaagaacaaagaatgcaacacaacatggcacaaagtatggcggctgcgtctagtatgcccatggatggtcctgtctatcccatggacccatcgggttaacccccatgctcccagcagctcttccttgcacagtaccctgcgctggctccagtttgaattggtccaccccctgatgtttaattccccgcatngaanaataaattccnttgccgttcctccntttgatccngtgactacaacaaaaacacaacgcgatactttnnttgcccctgaacagaatttgcaaaggcgcatggtttcaggcttccgcaaaaaganatcccattaattcngtgccggttattcggcncccccctaaaaaanaaattccctaccaatnaantttttcctgcccacttctaaacttttttaaaccnttcccccacacccgctttcnttcttcttcctnttc

SEQ ID NO: 1461 - DNA, 632 bp, Fusarium venenatum
  misc_feature (1)...(632): n = A,T,C or G
gaatccattcgctcgtatttattctctttctctttcttcttcttttcatcatgactagtttcatctcatcttatctacctttcanaaaatccgaaaatacagcgaatatggcgactcctgagaccaacaagcagtggaccaccggccaggatggactcgataaactccagtttgganaaggaaaggtcccgcagcccaaggatggagaggtccttgtcaagatccatgccgttggcttgaattatcgtgataccgaagtcatcaatggcgattacaaccaccacgcctctgtccaagacactgaggctctagtaccctgttccgacatgtgcggtactgtcattcagagctcctctcccaagctcaagacgggcactcgtgtcatgtccatcttcaaccagacccatctcaccggccaagttgtcgaagccgacatggcctccggtctcggcttgcctctctccggtgttctgacagagtaccgctgcttcttcgccgacagcctcgtcaccgtnccggattacctttctgaccaggaggcttgttggttgcccatcgcaagccgnaccggctggatgtgtatcaacngnatgcgaacattgggtcaaccccgccgacggcaacaagaagaa

SEQ ID NO: 1462 - DNA, 416 bp, Fusarium venenatum
  misc_feature (1)...(416): n = A,T,C or G
ttcgcccgaacatctttgcacaaataaatcagtcataatggccgtccgacccatcaccggtatgctccgacgaaacctcgtcctggatctcagcatcgctctcggctccggcttcgtcatggccaacttcttctggtacggcttccacatgccccgaaccaacgcccgcgacaactactacatcaagctcgaggaggagcgagctgctcagaagaacgagtaaagcaaagatatgccgagtcgaagtcggatggcataagcaagggcataggggaagttgggaagtacacatagaggccactagccaatgtttcgtttgtcgtgtagctgggtaaaaagcaaaataccaccacggcttcaaccacatcgatcgctggcaatctgtactgtangcaagggcaaccgaatcgtatgtg

SEQ ID NO: 1463 - DNA, 617 bp, Fusarium venenatum
  misc_feature (1)...(617): n = A,T,C or G
atctggtcgaagtaccgacgcgctttggggcaggatacctgcggaagctctttcattactccgaggaatgatgagcattgacgcttcaaaacgattcaacttcacccaagtacgccaacatccctggtatacgagacacaacgctctccttagtgcggatggtcgagttacagatcccatcaacttggcgacgcagatgttggagaacctccgcatcgactttactcatcagccaacatcgcagccttcttccagcgacaatatggacctcgacactggcctgaatgctggaaagttctcctccactcaacctgagacgcccatcgccgacaaggaatgggattgggaacgcacaccactgaagtccgtggcttcaccagcatcctcattaccgcattctcgtcgagccatgattgatatccttgctgatgagccttcaatgtcgcaattctcgcaaactcccggtcccttcatgactcttacgcaacaagcccgtcgatttcgtgatatctggcccccagaatctntcacccggtcttctctgctgtcccaccagctnatatcggccaaatgctcagtgatgctctcatnancttaacatttcaagaggccctgtt

SEQ ID NO: 1464 - DNA, 623 bp, Fusarium venenatum
  misc_feature (1)...(623): n = A,T,C or G
gcgataggtgccgctctgcgagaccaacctaatgtcacaattatgaccggcgaggctgtcaacgatatccagtatgatgaggccaagaaacaagtccagatcaacagtttcaacacccagaacgaggagaaaagtaattcacaggcatatgacaagatcgtttcaacgctatccgcccagcatatcgcccgactcgcaggcgataaagtgcaatcgctctccgccgcacactntgtttctgtcatgacggncaacatctggttccctcaggaaaacctgaagcctcctggtttngggtacctcatcccagactccgttgaaccagagctcaatccanaacatgctctnggtgtcttctttgactcanacgttggaactcggtccaaggacaaacctgctggcaccaagctcttcgtgctgatgggcggccactactacgaccgtctggcgttactccccccactgaggatgaaaccttgttcaagctcgaaacctacttgagcgtcatnttggtatcctcgcgatcccccgctatgccacaaaaaaactttgnaaangaatgtntcctcaacanaatgtgggccaccaagaccttttgngcaacgccaccttgagcttaaant

SEQ ID NO: 1465 - DNA, 589 bp, Fusarium venenatum
  misc_feature (1)...(589): n = A,T,C or G
tcgacctcggaatagactcattgtccatatctactctgggatacgaccacgaacgctcgaattttctaccgaatacgcggctatcgacctgtgactgattgttagtattgagtcatcttcagccgttggcaaatttgtctacacagaccccgcccatagctgagccgtttccggactcgacgttgaaacatcaaccgaccatcgattgactaaagacacggaaaaggagcagttactgctttggaaatcaattgaaggaggagtcatttgtttcgttttaatacgtcaaaatgtcaaacttcaacggccgccgcggccccaacgtgtcgcagtatctccgtgacctcaacgccgtcaaccgtcaggagaatgctcacgatgagcctttccatatggaggaagaactcgccctctttaccaacactcaattctttgattttgagactggtcagaacaccgactaccaggcccatcctgtcaaggtcgacatggaggcttcccaaagcacttctccttcngatggaatgacccngctcctctgtcgtgggtgatatcgctactggcactttgatttcttgcagggggantt

SEQ ID NO: 1466 - DNA, 333 bp, Fusarium venenatum
  misc_feature (1)...(333): n = A,T,C or G
nttctcgggggtgccgctggtggcccttggcangtcaaggtcggcacngaggtcntcntctacgctgtcctcnatnttcttaccaaggctgtcctcggcctctggatcatcacagctactcgccgaaaccgcnacatcacccctgaaattggtggctactgggcccacggtgctggtgctganggtaccatccgtgttggcnacaacaaaaaggtgcttaaacccatcgttaaaaatctcgatcgcnaccgtggggcttatccgcattcgtcactatatccaaatatttcanctccaccttgaatggtggttgcttcacaaaaccaaccaacc

SEQ ID NO: 1467 - DNA, 325 bp, Fusarium venenatum
  misc_feature (1)...(325): n = A,T,C or G
ctctgcaacggcagcatcaaggctgtcaactggaagcgagttttcctcctcgtcttctcttggatcatgaccatccctatcgccggtcttatcgggggatgtctcatggctcttgctctcaacgcccctcacttctaaaagcatcgcaaacttatgatacctatggggggatttganaccaaatcgctcattttattgattggaattttcaacgcaaatgggatgaaaagaatagaggagtggatttgattgcatanaatatcgtgttggaatcttttttatagnncccttgtcttacnacttaattgataaaagatnccctttt

SEQ ID NO: 1468 - DNA, 344 bp, Fusarium venenatum
cacgagcagttcggtatcaacccgattcggtgcttctggtgcctacaaggacgtctacaagaagttcgagttcacccccgagggtatcgccaagcgtgcggttgccaccgtcgatttctggaaggatgttcccaacatccgatctcccatcaaccgcgccttccagcagatcatctagatctaaaataataacgagtaaaaagaaacgaaggaaaatagtaaaaataccggtacaaaatgaaaccggccagaatgattatgatgatggactttggagcaaggttttgtggatttcgagcaacttagacgtactacgagatgaaattaaatcttttagaacaaag

SEQ ID NO: 1469 - DNA, 589 bp, Fusarium venenatum
  misc_feature (1)...(589): n = A,T,C or G
gctgtctgtgtcatggttgacgtccttggtaattttgaggtttggcgacgcagcagtatccggcacccctttggtctcgagagagccgaggtccttgctggattcgccatgtctgttttccttctctttggagggtttgacttggtgtcacacacacttaagcatttcctcgagtctcttggcaaccatgaggctcatcatgaacacggtcatgacagtccagatggttctattgaccttgtgtctgctgctgctatggtgagcaccctagtctcggcatacggtctccgaaaccatgctcgtattgccaaacttctgcgtgtctcgtaccttgctgctttgccaaagtgtactgtcaaaccccttccacttcctcacgctctcattctccgctggtattgctcttcttccactcctctctatctcaatctacacgtggctcgaccgtcttaattgtgctggtatcgccttggccatggttgccttggtatgcgntagccgtcgcacaagggccttatgctactcaggtctatgggggcagtgatggcaacaacgcggtcagtgccgtcctcnaaaaantaaaatnaac

SEQ ID NO: 1470 - DNA, 459 bp, Fusarium venenatum
  misc_feature (1)...(459): n = A,T,C or G
gcgttctgcatgatatggaaggtgctatgaagatgttcgattccgttgtcaaggagtctctcgtccccatcagcgccagcttgtaccaagcactcttcgaggccatggttgctaaccatcaggttgctacttccgagcctgtcctcgcgcacatgcgaagcaaaggtgtggagctgactccttacatcgccaacactttaattcacggctgggccgctgagaagaagatcgaaaagcccagggcatatacgatgctgttggtcgggagaancgtgagcctagcacatacgaagctatgactcgtgcgttcctagccgtggancaacgcnaacaggccaagggtgttgtcngtganatctcacccgcngctacccatgctgttgtcacaaggttcttgaacccctggaagaagtcaccagaaattgctgaattaggcaccnattgaaattgaatgttgaa

SEQ ID NO: 1471 - DNA, 430 bp, Fusarium venenatum
  misc_feature (1)...(430): n = A,T,C or G
caaccatcaccagtcacacgacacattcttctctanaaatctttcaaaatggngcgcataaaagagagatatcttcttgtcaacatcgtttatccgcccnaccctgcaaaggctgtanaatcaaatttgccagtctcggttcttcatcaccagccaaccatcgaaaagctgactcctggcgcactaatcaagggtatcagagctgaagtcgcgtnattatacggtgactatggatctggagcattgataacctgctctgngaaatacctttcgttggcaacctcaacttttattctcaaatgttcaagagctcactatcaactgctnttggccacattgcctttatggatcatgttcctgagaaaacggaaatcgtcatnttttgtgttgngcgcntaggggaacaatcccaagctgaagaggagctttc

SEQ ID NO: 1472 - DNA, 256 bp, Fusarium venenatum
  misc_feature (1)...(256): n = A,T,C or G
naagcgcgagcgcgctgctaaggacaagaacactgccaagtcccagctcanggtgaacgaaaaggcttgcgacattcagtgccagatctgcaaatctacctttctcaagactacaaaggcccctgctctgaaagagcacgccgagaacaagcacggcnaggccatcgccgactgcttccctaccttccaagagtaaaccgantntgctggagagccgcctggacttgagacaacgataacgatattccgggtttna

SEQ ID NO: 1473 - DNA, 606 bp, Fusarium venenatum
  misc_feature (1)...(606): n = A,T,C or G
tgacgctacaccggcagaaataaaaaagtccttntattcgctttccaagacacaccatcccgacgccaatcgttcagatccaaacgcatcatctacgttctccctaatctccgagtcatacactgtcttgtctgataagtctcgccgctcagcctacgatcgagatgtcctacgtctgcaccatcatccaccgcaaacagccgctcaacgtggttcttaccattcccaccaggctggnggacgcgcaccttcaggcttaagtcgcaggagaggtacctttcgcggcccgccgcctagtttctaccggagtggaggctggggagaccaggcggacaagcgtcgcaaggcgcatgaanaaagtactggtggtggcggcgcatcgtcgcaagaacaaggaacatcacacagtcgtcatcagagcccctggggtgacccttttaaaccccacgagacctnttnttatggaggcatgggaccaggcgacnatcttttgggcccaaaacaatgtccccnctttgacaaaaaaggtataccccaacacatngacgagangacgacgacntaaaaaaacgatggcaaaagcgggccatgggtgacaacaatttt

SEQ ID NO: 1474 - DNA, 632 bp, Fusarium venenatum
  misc_feature (1)...(632): n = A,T,C or G
ggcgggtatctcaccttcctccctatataacaattggccgcaacattcagcacatcccaatcgcatcgacaacagctccatcttttgataatcatgtctgctcaagattactacggcggcggcggcggcggctacccccagcaaccccaaccttcctacggccctccccaaggccaatacggtcctcctcaaggccagtatgggcctcctcagggacaatacggtcctccacaaggacaatactatggcccaccgcaaggccaagctcctatgcaatatcaacaagcaccccctcagcaaagtggtggaaagggaggcggcggcggttgtctagcaagttgtctggcagctctgtgctgctgctgtgttgctgaagaangatgtgaatgctgcatggaatgttgcgaatgtctctgctgagtgtncaacaccgatcaccatggataccaattttacgataccgttgataggnnctactcttaaagagnttagacccagaaagaaccaaaccaacgactcttattattgnatttgnaatacccgcatgaaaccctgncntttggatcttggaaatgcttcgatatgaaaatgggntggagttganaagcccattggttgtgacggcccaatgg

SEQ ID NO: 1475 - DNA, 610 bp, Fusarium venenatum
  misc_feature (1)...(610): n = A,T,C or G
attgcaatctccatttccgcagcgcaccgttttattttcttcccaacaacttggtgaaacaacaaataagactgcgactagtaaaagccggccacaccatgtcgcaacgacagcaacaaagcgcaccagcgccctcacaaacacaaaccgaaactccgacacaaacaccagagacaagcgaacaggctcctcaaattctgcgacttnggggtgcacatgcttccaacggacgatccgtccagngggcggaggatgtaatagacaacgaaggtcttggacgcaagagttcaaaagtgtgctgtatttatcacaaacctaaagctgtcgatgagtccagcgatgaatcctcctcagattctgattccgactcggaatctgatcgtgacggcgcacaaccagcaagtggtaaacgtcangcctgtggtcatggacatgggcacaaccacggacgaggccgaanaagcggaaaangcaaaaacaagaaagcgccaagtncaaatgcatacaaaaaaagtgccccagccgaaatncaaagatnggtcatnaaaagcccagtntttaaattaangggggcgacgatcttcaattngaagggttaagaaagatggcc

SEQ ID NO: 1476 - DNA, 633 bp, Fusarium venenatum
  misc_feature (1)...(633): n = A,T,C or G
cgaattcagatcggactatcaaatccccatcaacactcttttcgctaccaaacaaccagctatcaacatcaaccaccaccaccgacatcatgaagtactccgctgtcgctctcctcgccgccctcactgcctacgctcaggcccagtccatcgatattcctggcgttgacgaggcctcttccatcattggcgacatctcttcccgagttgagggtgcttcctccatcatcggtgatgcctcgtctatcattgaggatgtctccacccgagttgaagacgaggtctcttctcgcctcagcgatgcctccactgctgtcgccggtgctaccactactctgaccgacgcctctaccgtcaccgagtctgctgagaccgagagcgagactggatctgacaccgagactggatcccagaccgtcgacaccagcgctcttgccagcgttacctcagcccttgccgangcctccgagtctgttcaggacaagctcgactctctcagctctgctgccgagactgccaccggcgctgctagctcctctatcgccgatgagatcgctggccttacctcccaagctggtgccatcgccaagcagcgctgccggtgctgctaacaattgctactgatgacaacgc

SEQ ID NO: 1477 - DNA, 591 bp, Fusarium venenatum
  misc_feature (1)...(591): n = A,T,C or G
ccagaaacaaaagatcctgcctaatacaattacctacgcaaccttgcgcactttgcagctcctagattcactatcacttctcacaatcttaaagcactggagccaggatctagattcattgtctctgtacctgttagcacaccatcatcacttgtttcacgctgatcgatccgataaacttcacgcctctgcctaagccaagacttgaggcatttcacattcgaacaaaatatcgtcaatcgagaacgcctaaaacagacaacgtatttacggaatgagcagcaagacttcgccagcggagctcaagacccgcaaaagacacgactatcgtttcttccttgagtatcgcacgcgttggaacgataatgacatgtntgaccacatgaacaattcagtctataactttttattcgactccatcatcaacgcatacctcatagacaattggggtctccatcctccaacngcatcacagtttggcatgtgtgttnncacccacaccgacttcttctcatcaattgcatacctgccgttgctganctgcattgcgtgtgaacaacttggtcgnccagcgtccgttcaaaaagcctc

SEQ ID NO: 1478 - DNA, 691 bp, Fusarium venenatum
  misc_feature (1)...(691): n = A,T,C or G
tccgacaccactacagcctcgaggattgaagagcttcgtgatctaacctccagtttacggggtgctcgaattgacaggctttcaccacagcgaaaccccatcatggcctcagcaccgcaattgatcggcctcgccaagtcgctgcctgctcctctgcagcgcttcttcgcccgataccctcccgccgccatcctccccgaaaacgcccccaagactcggtaccaggaggagagaccgaaccctttccgnttctacaagcaccccgtgacaggaaaatggcaggaccctgtgtactcgcatcgtcgccaggccgagctggtcaaaatggggccccccacagcggtgtcgaggatctgctgcccgacacacgcaaggccaccgagtacaagttggctcatcgggttgagcatggtctgagagtcaagggtactggtgtgggacanaaggtcaagggtcatattcacgaacgacacatgattgcaaagatggagacaaggagaaaggcaatgttggatatgcccagtctnatcaagcgctggaagagggtgggcaaatacngatggaccaagttccccaaataaacaagacttcngatggaatgactgntttcgtgcnccctgtacatttacctatgtntttttatgtaccaaaaatttntaccacgatnttggcaaacactttgttcccanta

SEQ ID NO: 1479 - DNA, 620 bp, Fusarium venenatum
  misc_feature (1)...(620): n = A,T,C or G
tcgctatccaaatgtacgaacaggcggtatcatgcgacgggaccttcgacattgccctgactaacctcgccaacgctgtaaaggacaggggacgcattaacgatgcaatctcgtattataaacgggcagtcaactcaaatcccgacttcgccgaggctgtttgcggtctctctaccgctctcaattcggtttgtgactggagaggccgaggtggggtcatactcaaaactgggagatacgatcgatggcatgttgatggcgatggtcagcttatcgatgctcgagctactgggcatgaggatggcctcgtaagccgtgttgtccgcaccatcaatcgtcagttgagcgaggcatcacattgggggcgtggtatcctcgacgataaccgtatcgctactttggcgcaacagatccaagatcttggcctgggcgaaccacacgaggttcagcaaggtctgagaaattggaggaacaagcgatgggagggtgcacgcgtcgttcgcttggtagagcgcgcgactcgtgcaactcaatggaagtggtatcgagatcgntacatatcggctaaccaagcacccgntcggtacactcgcatncgtttgcccaacggncttgcagta

SEQ ID NO: 1480 - DNA, 620 bp, Fusarium venenatum
  misc_feature (1)...(620): n = A,T,C or G
ccatcaccgcacactttcttatccacaacactcataatgcctggaattcctctgcacgcccttgacaacttcaaggccaagctcaaggccgccttcaagaagaaggacaacaaggaagaagccaaacccgccgagcagaagcctaccgagaccaagcccgccgaaaccacacctaccaccaccgagcctaccaagaccgaggccgctcctcccgcgccagctactgagcctgctcctgcggccgagcctgcaaaggagaccaagcccgagacagaggtcaagcctgaagctcctgcggctactaccgagcctgcaaagacagaggaggctgctcctgctcctcctactgaacccgcaagcccgaggccgctccggcaccgaacttccgctcccgtccctgagcctgcaagacngaacccgctccggctgntgagctacctgctgctccgccgtcccgactgcccagctgctgaactgctgctgttccactgttctgccgcgactacttgttgcccagttccgcacccggtggagccctacagagctcctgttgaggttctaaggaaaaganaagaagatcccctgttctccgttctgccccgnggctttgttaacaaang

SEQ ID NO: 1481 - DNA, 615 bp, Fusarium venenatum
  misc_feature (1)...(615): n = A,T,C or G
gtaggaaagcattggtgagaatgggcgccgtggaacggttgtaacctttggaagtattggctcttggagtggtggcgcgacatactctgtctactccatggccaaagcctgcgtatcctctctcgcagagtctcttcgngaggaactagagcctttcaacatcctcgcttcagtcgttgaaccaggatacttccgcaccagcttcctcaaccctggtgtcaaggtagncaccaagaaccgcatggatgtttacaacgatgagaacacatccactggcaagacacgcaaggntttggagaagacggataacaaccagcctggcgatgtcaagaagggaacaaaaatcattgtggatattttgacggngacaggtgttggaaagggaaaaaaagtgcctgtgcaaatcattctgggcagtgatgcggatgtgtttattcganggaaaattggcgaggcgctgaaaattttggatgactggaanagtgtgactgtgaaccccgatatcacaaaatgagggactgtaataanttntgtcttacaatcgngagtgccgactggngtcaaattganaatancccatgcctccccaaaataggnttttntgggcgattttcn

SEQ ID NO: 1482 - DNA, 574 bp, Fusarium venenatum
  misc_feature (1)...(574): n = A,T,C or G
ccacacttacggatggttcagcaggtgaaggacgaagacnaatccagcatcgacatgaatattgaggatggattatcatgcgattcacggttatgatagagcaagctttgacacaccaagcacacaccgactaccgacagtatcagcttcacaggcccttgacgacattggatgtgacgcgtcaactcacataccaactggtctcgaaagcctggatcgttcactcctaggtcctgtagctttcgactcgcaagatgcagcggtaaaaggtggtgttcaacgaggccaagtgacagagatttggggacctccgggttccggcaagacagcattgggcctacagcttacagcgaatgcgctatgcaatggtgatgcagtagtctggatagattgctttcaggctctgcagcgagacaggctgaggacggtaacaaaagctgcccaagctcgtcgaaatggtccatcatccacagaagttgaggcaataccagctcggggaagttgatgcttctcaattctaccagtactcctgttttacacttcctcatttgatttctctcgtgtcgagacctac

SEQ ID NO: 1483 - DNA, 256 bp, Fusarium venenatum
aagatgctcgtcgagtcatccgatgagcctgctcaattgcgaaagaacgttactagccctaacggcactacccatgctgcacttgtcagctttgagaactcgggattgaaggagattgtcaacaaggctgttaaggctgctgctgaccgtgcccaagagcttggaaagaactaagttatgacatagatacgtcgcaacgacatgacaaaataaaaaaaaaagcaatctagtttaatacatcctacatgggaatgtg

SEQ ID NO: 1484 - DNA, 634 bp, Fusarium venenatum
  misc_feature (1)...(634): n = A,T,C or G
gcgttccatgttacatgtgctcggagatcccggctgtttcttaaaatgaagacgagtcagggtgccctcgccgtattggacggcggcatggttcttaaggcgttctgcgacaagcattgtccgcccgactatgcacaggagcataacattcaccaggccacaaaagccgccaagaagttctacaagagaaccatgagaaatcgcatctgggccgacaacaccgtcactgcaaacaacattgccgcgcggcaccgcgatgcgctcgctgaacaaccatcagacgaatcgcagctcacaggaaacaagaattctgcttctggtgacaagaagaaagggcagcccccaaagaacttgtggaagatgccttcaggtgcgcccgttataccccaggtagtattcgagatcgtggaggcttcaatccaaagatttcctttccgtaagcgtaaggatttcttgagtgaggcatgtcgctactggaccctcaaaaggcagaagcgccgtggcgctgcactcctaaagcgtctgcagctccagatggaatcgttttcctcaatggagttaacacgacgagacttcgcggcaatgggccaagcngnaaggcgagattgactcgacgtatcgaattcgccgaaga

SEQ ID NO: 1485 - DNA, 532 bp, Fusarium venenatum
  misc_feature (1)...(532): n = A,T,C or G
cttgtccaaggagccgccctttcatccgtcagtgcacatgcggagcctctcgtatcacgactcggtatcgtttctagcaaaccgatcatgttgccgagaatcanacaattcgacttcactcttgccgtggctgtcaagaccgnttgggccatagtgctganccaccacgtcacaagcaatgatgttgtcttcgcagatatcctgacagggcgaactatcgtgcacccctcagtcncagatgttgtcgcatgttgcgcaagagcagtaccatgccgggttacttacgaaccggagtggaccgcgaagagactgcttgaacaaatcaaacagcagcaagtcaacagcatggcacatgaaggtctcgagctccagcagattgctcaacgattcatgggctggtcggaagaagtcgaatcanatgcaccagacatgcgagtcagcatggtgaatcacacaaaggcgcaaaaacaaaatatgtcacttggctctacaatttacnaacgaagtggntgngggcctgaacaagtnttac

SEQ ID NO: 1486 - DNA, 666 bp, Fusarium venenatum
  misc_feature (1)...(666): n = A,T,C or G
cagtgacctgtgacaagtagctgcaactttaccctcccttgtaatagcgctgttcgtttttaaccacgtacacatcaccaactacgaacgagtcgctcgctatatcagttcaaaacaatccaacgatcgattactagtttccacaatgtctggctcaggatacgacgccgtcgtcgacgttgacgatgagggtgacctcggccacaccgacctccaagaagatctcgaattccacacgtccaacttcaacgacacaaatcccaacacccgcaagcctccctctggcggcagcagtcttcctgcgccggtcacagcttcgagcggctcaggttcatccaagcgcttcctctggagcatgaacttttatgcgcagttcttcgatgtcgatacttccgctgtcctgtcccgttgctgggccgctctctttccccgagcaaacttctcgatgttctcgagggcaaccctgatttatacggaccgttctggatcgccacaacagttgtcctgattctcttncttggaggnacaatcagccagtatatgtctgatacnggcaagggaccattcctntacgatttcaaagctgntgagcggcgccgttgggcttaatntacnggtacacccttttnatncctatggntctgggtncttggncctcaaatactt

SEQ ID NO: 1487 - DNA, 576 bp, Fusarium venenatum
  misc_feature (1)...(576): n = A,T,C or G
ccagtaccgaataccgagtcatattggatcagatggcgattttattgtgtcgtatgatctataattgagccactacttctcgatcattacgactcaattgttgtcctctgttcacctttagaacattggcttctatcatggcgtcctccttcgcccctgggttccggaggttactcttccaggcctcgattacagcatcggggccttcaaagttcttcgtatgcaaccaatatcttcgaactgctccccggagcatgccctctcgagttcttaacgccgtccgatcacgatcctacgccgatgctgccgtgagcaagtcaattggatccattgccgagcaggcttctgttcacgcatccccctctgtttctcaagctgccaagaangcatggcctgaatcgaaccccaagggtgtcggcctctggcttattgggcagtgctgttagtgtttttggtatcgtcgtttttggtggtctgacacggttgaacgaatctggcctgaantatcactgaatgganacctgttaccggttcgcttcccccatgtctaaggaggatgggaatccaaatcgaaac

SEQ ID NO: 1488 - DNA, 798 bp, Fusarium venenatum
  misc_feature (1)...(798): n = A,T,C or G
acactcgttaacaatctcgcccaagtcactcacttgaccacactcgctcactccagcaaaactcgcattcgctctccaaaactcactcactctttgaagtatccccaaaacaaaatcaacctttcaagatgtacgccttcaacgccgcggctcttctcgcccttattggtgccgctgctgctaagcccaccgcgtctcctgctcccatgcccactggaagcaagaacggcacagtcactgtcaccagcgtcgtcgatgtctacaccacctactgccctggacctaccagcttcacatgggcggcaaggactatgttgtcaccaagcccaccactctgatcatcactgactgccttgcaccgtcactgagactcaccccgctggtcctacttggattcccgggcaccctggctacaagcccgggcaccccgtcaagcctgagcaccctgagaacgagaagcctggcaagcctgagcaccccgtcaagcctgagcaccctgagaacganaagcctggcaagcctgacaccccgtcaagcctgagcaccctgangttgagaagcctacaagcccgagcaccccgacgtcgaaaagctgagtaccccgncaagccttgacacccccganggtganaaagcctgccangctgagcaccccaccaaccccanaagcccgaaggngaaaagctggcaaggncaagangtccccgaggagcccgttggtanntggccggggccgggggcattccaanttnggaatcggccttgtaaccttctttgggcttatngggtttggaanct

SEQ ID NO: 1489 - DNA, 926 bp, Fusarium venenatum
  misc_feature (1)...(926): n = A,T,C or G
cgccaccatccaaataaaactatgtccaacaaagactccgtcgtatatnattacctcgccatcggcaagcttggtcggggngaacccatnaaactgnttttggaggatgcaggtattgagtatgaggagcgtcgntacgcaagagacgatacttggcccgaaaccaaggcgaagttgatcaagcaaggtctgactaggaatgggcaagttcctgctnttgagtacaaaggccatgctataactggccatgtcccgattctgcgctacctgtctcgtgatcttggtcgatatgatggtcagagcaatgaggacaagtntttgacggacttggtatcanacatntatgttgattggagggctcaatgggtgagaaacctcaaggagggcccccgagaagagtacaaggagactgctgcccctcantactacgatctcatcggacagtattacgccgatcacgagggaccttatcttctgggtaatgagattactacaccgactttctcgtctatgtctctattgataacgatgctcgaacaaagacactccctgagagcttgccagaatctcttgtcaaattcaaaggctgctttcgaggctcgacccaagcttgttgaatacatcaagcagggataagctcttcacgtataagattaatanacccaaatagattctgtgtggccatcgctcaccgagccctcttgatttcctggcctttgatgcacaaaccacaactcgattanaaagtctcggatctgactcatgttgactgtgngggctcgccaccgttgagcttaagcatcaatgtacttaatatgtgactttttctatgccacaaacgaatcacgggtacacatagaggngacgtgttcacacaagatggatatggaagcatagttcagtcaattcaaaagtagtcncccgan

SEQ ID NO: 1490 - DNA, 913 bp, Fusarium venenatum
  misc_feature (1)...(913): n = A,T,C or G
gcgaagagcaagccctagtcaaaagcctgaggacgctctagcaagtgccaccataccaatcgatgtgccctcgatttctcaagcagaaccagatacagctgctcctactgacgcagtagactccaagtctgatgaacctgccgataccgcctccgacgaacctacccaggctaccgacgaaccttnaaaggcatctgctactgatgctgagcctactgccgatgaatccgnanagaccactgccgcggatccttctcccaccgaggccagccctactaccaaagctgccgagaagtctaccgctgntgatagcaagcccgccgagacttctgctccatcacccaccgaggctaccaacgacgccgagtctactgccgctgcttctgccactgatgagaataccgctgccgagtcgacaaaggcagttgcttcgcctaccaccactggcgccaacaacagcgaggaccaaaacgacgacnctagcagcactgccgccggtagcgatgaggaggccagcagcactgccggttagaaggatacccaaacaaccggtaagccaagtcaccttttacacacatttgttgtagttacgaaggaccaacgacaatggtgatcttgagaccatgacctctacgagtgtttctacctcaacacctggacttagcgatggcgatgatgacggcagctcctctggcatgtcgaccaagaccgcaatactgtcatcggcgttgttgtcggtattggtggtgccattgtcgtcggtgctcttggtctcgtanctgganaatctggggaccaagaagcacacgaaagaaccgacggactcatggattttgacgaatccaacaagccgcccnaacagcaacggtccttaccacagtgttgaaaaanacgaagtacacagtgttggtan

SEQ ID NO: 1491 - DNA, 657 bp, Fusarium venenatum
  misc_feature (1)...(657): n = A,T,C or G
gccggcggaaccaaggggtgatcggatcggcggaaatgaaggcctgcggcagagtgcgggccttctgttttgaggattataatcagagtatattgaaagtttcgcgatcttttcgtataattgttttaggcatagtgcaatcgataagcttggctgcaggtcgacggatcggcatcatagccccaggtggtgaaatcgggggcagcggcgaggcccaccagcgcgcgcgccttggtgcccagcgcctgcgccaccagcagcatgagccagccgcccatgctcgacccgatcagcaccactgcgtcgagatcatgcgccgcgaccagcgccacgacctcgtcccgccagcgcgacagcgtgccttgggcaaattcgccttccgacaggccgcagccggaataatcgagcaacaggcaggcacgcccctgtgccaccgcccaatccatcaccgcctgggnctttccccccgccatgtctgacatgtagccgggcangaacaccaacgccgggccaantgccgggcacaaagcgggtggcaaggcgcaaggccgtgcgggccgggggatgaagccaagggggcancggtgtggtcatggcgctcgtgctancgatagcgggcggnatatgtccacaggcacttgagcaacctgcctgcgn

SEQ ID NO: 1492 - DNA, 470 bp, Fusarium venenatum
  misc_feature (1)...(470): n = A,T,C or G
gttttcgtcaggattggcaaagaactcgattcttgtttcctatctgcgtatngcccctgctcactcatggcttcggcgtttgacctatgtctcaattgttattgncaccacacttatctttgcctttctgatcgtactatggacgcaatgcacacctacctctgcctactgggccttgacaggaggtgacagttgccatccggaaggtcccggtgtactgagtcaancaatcacaacagttctgaccgatcttctcgtctgcgctctgcccttgcagacactatttcaactnaaactccctctgtcacaacgcatcgccctcatcgcgtcttctcgctaggtctggttgttgtntttgcggcctccatgcncgcatattacactcattgggtcaccgacaaaacgtacgatgttacctgggaggggttncacctttggatctggaccgctgangaaactaatctgggagt

SEQ ID NO: 1493 - DNA, 671 bp, Fusarium venenatum
  misc_feature (1)...(671): n = A,T,C or G
agctggggtacctgagggttattgccaaggtcgatagccaaggtcgtccacgttgggcccttgctatcacatgcggagtaggcgtcatactcacatacatcaacttggcggctggcggacgtacagccttcacttggcttatctccattacaagtgcctcgttcttttgtatgtggatcatcatcgcgttcacatccttccgattccatcgtgcgctcaagctacagaacgaccctctttttagagagccatacgcttggaagtctgttggctggcccgctggctcctacctggctccttcgccatttgggggttacttactgttagttgctttgccatcggaaatcaagcctctgggcggnggaggctttactcccaacaacttcttccagtacatcatccggcattcttatcatcgtgggtttacagtcgggtataananaaatcatgcgcacgccgtggcggtgaacttgctactgccgatttggaggacagggaagacccatcttancgttgaaganaacaatcaagctggacgcttactactcgatgtccaagtggaggggctttgggaacctacctccagctttggtgagaaatgcccaactttgcatnggatgacttcnaacttggnataanattggagggtatgtattttcttggcactttgg

SEQ ID NO: 1494 - DNA, 567 bp, Fusarium venenatum
  misc_feature (1)...(567): n = A,T,C or G
caattcttgagtgcaggctccaacgatttcaaggcacgtagtgtcggcaccacggcatggattgcaagccctgctgagaccgtcgaactccttgacgagctagctgatatgatgcaaaagaagttgtcttgattgaatgcttgatctgactagcggccaaaggttaagcttttggcatacgactatgctcgatactgtcaagatangcagattgccggtttatttcangagaggtctttcagccgcaatccgacgctcacctaagatggatgagtatgcggcgccacgaaaagcgcaaatngacacngacaaggagggtgaatccgaaatagcgtaatagtttgcaaatgttgacccacgcttggnaatgactttgccctnttcataaaaagaaggcttggtttggcgcttaanttttcccaacactggttggcttgcttctatancttggataagaatattatnggccgacatgggnggtccttttttgcttaaatatgaccccccaatgggcttttttgaancgtcgattntctaccggaatntttaaaagaaaatctttctaaa

SEQ ID NO: 1495 - DNA, 282 bp, Fusarium venenatum
  misc_feature (1)...(282): n = A,T,C or G
gaagaattctcggccgcaggaattcctttttttttttttttttttttttttttttttttttttttttttttttttttttttttttttttttttttttttttttnnnaanaaacttggttctttttttactcaaaatataccaatactactttntgccatcacnctgagtccttntgggncgctnttttgctatgctgnagccctacccctaaccctgcgcattgnatttgcagtaatcaaagttgttaaccctgttccccgcccattntgggaatgcaaccg

SEQ ID NO: 1496 - DNA, 583 bp, Fusarium venenatum
  misc_feature (1)...(583): n = A,T,C or G
ctcgaaccgaatcgacctgcgacaacgtcgatatcatgcgcttctcaatcgcatcgtcacttcttttcctggtgagtgcagctagcgctgcctcgtcttggagcttcaaagatggctccgttaccgtcgcctccaagcaaggacacggcgctactgccaaattcaaaaaccaggagccagccaaggatgctcttattctaggaaaggcagataccatcaaagtctcattgactacgaccgaagacagtgaagcgaagcgacctcaccaggccttcatcgtcattacagagtcgactggcatcgaagtcgccctccctctggacatcaagtcctctggaaaggccgtggcctctttctcgcacaangacctccctgtcccgttgctcctctccgacgaactcctcaaggtcaacctcgtgttgggctccttcggctcatccaacccctcatctctcccgttttcaacattcagatctatcatgtgcccaacactccccttcccacatttgaacctcccctgcgttacnaanctcganacganatccaccacatcttccagggtnggganaagaanccncctatg

SEQ ID NO: 1497 - DNA, 440 bp, Fusarium venenatum
  misc_feature (1)...(440): n = A,T,C or G
aagcccaagaccagccacaccacaaacaaggngccccttctcatggccaactaccccgagggttggagcctcaagaagaccaccgagggtgtccttggcgacgttgcccctaccgtcctcgccgccatgggcctgcctcagcctgaggagatgaccggaaagtcccttctcgagaaggcttaattaagatgatgatgatgatgagcaaacataccttaaaaataaaatgatcccaagggatgatgtagtagtattagcgacttgttgatggctgggcgatgggcgtgggtgtgggctgttagttcttgatacgtgctagtcgactgcatggctttggagttgatgagggttggaagctaccctcggctgaatagacctagagtcgagagtttttaaaggagtaaaattactaagaatagagaattatacattatttctca

SEQ ID NO: 1498 - DNA, 435 bp, Fusarium venenatum
  misc_feature (1)...(435): n = A,T,C or G
ncctgatgttcccatcattcccttccctcaaaatgccaggacaccaccgggcttttttaccactgattaggaccgngaccacatttaagcagcgatggngacctcaacctcnacaccggccttgatgttgacnatgacggacttgacaacctcggggggggcgtggaggtcnatgaggcgcttgnggacncgganctcgtaanantcccaagtnttggaacccgccgctactccttagggcatttgtttctaccntganggcgaagtatgggtgaaacncttgancccatccatttttagggctagacattcggnaggggagttggtacacaagtncttaagggattnccactttcatggncccgncctgggtggaaaaangactaacccttttggggggggtgaagaagcggttactttggccccttaacctcg

SEQ ID NO: 1499 - DNA, 610 bp, Fusarium venenatum
  misc_feature (1)...(610): n = A,T,C or G
cacaaagagtaggagggggtgctataactgcaagagaagacgtatcaagtgtcaagagactcatcctgcatgcggtcattgtacaaagactggactcaaatgcgagtatccgtctacgccacagatcattcatcagccacatcaacagattccattgttcagtctccaggatatgcgcttcttccagcactttctaacacaatgctatcctcatcatcctctaaaacaagaggacatctggacacacgaaataccttgtattgcccacaacaatgaatacctcatgcatgccattctcggcttctccgcatccgaactcatgagaaacgaccctagcatcttaccatcagccatgaaccatcgcatcaaagccataagagccatcaagaaacgccttgcagaaactaccaaatcttcaatgaactatgaagaagcaaatgccatggtagctacctgttttgccctgacatttcaatctgncancctcgangacggactggccgaatatntaacttttatncggggaatcatgattgnangaatgcaaatgatgtttcggggtatnaacctatntttganaatatgcttgacaggacaggattactggttn

SEQ ID NO: 1500 - DNA, 619 bp, Fusarium venenatum
  misc_feature (1)...(619): n = A,T,C or G
ccaaccgcgaagtgctcatctttggtgacgtcgaaccagacagcatatcacttagtccgaggaacctgcaaatctggcaagaagcagcaccaaagatcgcttcgggaaatctcaaggctattttcatcgaatgcagttatgacgactcgcagagcaacgaccgcctattcggccatctgaagcccgtatttgtcatggaagagctgcgtgcgctggctaccgaggtgaataccgttcgcagcatgcgtaacgctgattccaagaagcgcaagcgcatgagtagtacggctgacgaaggtcctcgacggaatccctcgcttgccaacttcacatcggaagacccagtgtctcccaagacgctcaaggcatcaacgccagacttcgtgtacacaggtcccgaaacaccttcgacaccgnaccttgctacaccaacagcagagttgacactcaacccgtctgattcgatcacatnnggacctgcgaatangagggctctngganggctttaaaatcggcatcattcattgtcaanggcccgctagacnaatggtcccnacgtcggagatatnatacttggngccaattggacaatcacgagaggcgaggngcaatttnggtn

SEQ ID NO: 1501 - DNA, 619 bp, Fusarium venenatum
  misc_feature (1)...(619): n = A,T,C or G
caagaatctctctcatactgctaaatataaacagcacatctacgctctcacactatgtcagtaaccagccttcaatacgattctgaattcgctgaggcattggccctcatnaaatccggccgcccctcgatccctcccgagacagctctcgacattcgtcgtaataatcacgccttatttgccaaagtattccctaaaccaccaccttcagataccatcaagcagacggactgcagcgttaaaagctacgatggngcgcanatccttttgcgtcgttatgtcaaatcagatatcctcaacgccaaagtacctcaacccgcaatcctagcaatccacggaggtggctttgtatcangcgctgtggagatctgtggtggactcaacgcaaaaatggccttnaaacaancaggccggtgtttgctgttgactatcgtcttgccccgaacattcgtttcccgcaggggnggangacagcttcgcagcggtaaagtttttttaaagcacgcagcaaaactnaacatttatcctaagcgcatttgtgtacanggaaaaaagtgcaggcnggggaataaccgngggaactgtgctnatgggcanaaaacananagctcaattctct

SEQ ID NO: 1502 - DNA, 432 bp, Fusarium venenatum
  misc_feature (1)...(432): n = A,T,C or G
gattcttgctctagtctctaataacgacagccaacatgaagtttagacttggtaacccggccgntatggccgaaacacctagcgaggtgcttaactggcgtctgtactggancacctttgtctttggtatcctcggtgctagccgtggactaaatgaaggtctggtcggtggtatggtgtctctcaaaagcttcaaggaggaattcaatctcgacgctggttctgaacatcaccaancccaagtggagtccaatattaccagcatggnccaaatcggttccatcgccggttcgctactagcatttttcatctgcgacaagatcggccgtgtacaatcactccaagtcctttgcctgctgnggctggtcggattcatcatcgtccgagacgagtcatggaagcgttggtcannttttagttgccnctttattg

SEQ ID NO: 1503 - DNA, 508 bp, Fusarium venenatum
  misc_feature (1)...(508): n = A,T,C or G
gagaattgaagaagctttgcaaggcagtaccgactactacctttcgaggagtgcagagtcgttcaggattgcggctcagatctaccttcgttttgtttgttacgacacctccattacgcatccatcaattctcgagctccacgaacaactcctcttgtgtctttctgacatcattgtcaaaggacaaaagagacgatcgttcccaatgtggcctctctttttggctggttgcgcatgttcttctgaccaacaacgcaaggttgtgttggaccattttactctgttggatagtaaatggcctgtgagcaacatttcagcagtttggaatgctcttaaacttatatggcacacccgcgacttacaatntaccagccaggattggagagaggtgattaaaaaatttggatggaagntgtctctgtcataaatggttagctatagaatggttcgcttgtgtgtaagatctttccagtcaagtatcaaacnggagactgcgctttcaacgctt

SEQ ID NO: 1504 - DNA, 584 bp, Fusarium venenatum
  misc_feature (1)...(584): n = A,T,C or G
gtcgctcgagaggagaggttccatcattgaccttctcgtcatcgagatccccccgaatggccttacgccgcgaaatgccgacctcatggctcttttgctgacttcgcgatctattcatgctgcgacgctcaatacactctatcgtcacattacgattcctcactcacgaatcttccgaaagtttcttgcgaccatcactgagtaccctgctctcgcctcgatcgtgcggcggctggactttagccacttcaacccctccaccattttctcgactgcgagcgagcgagctcagactcgaaacttgacctccgagacccttcataaatgtctcgagctaaccccatacctacaggagttcttggcccaggagtacatcgatgaggatcttggacctgaagtagtcaaaaagctctttttcgatatgccccggctccaagccgttgatttcgccggctgctcctcacctttcttcaagaactctttcaacagcctcctccaggaacagtggnccgactctctgacacttactcgcgtttcgtttcacaagtgttctgaacctgccaggatctgtttttgaagntatc

SEQ ID NO: 1505 - DNA, 487 bp, Fusarium venenatum
  misc_feature (1)...(487): n = A,T,C or G
ccgccgtctcggccaacgtcaacttcatggccaaccccatcatgaagcgtggtgctctcgaggctcgccagaccggcctcccttccctcggtgacatcagcgaggagtgccagtctgccgttatcgacatcgcccagggcgtccctactcctgcccctgagatcgtctctgatctcctcgagaacccccagaccgacccctgcagcttcagcacccccgcctctttttcagcgagtacggngctacagctcctccatcattgcctggnacgccaagaaccaaggacgacattatgtccgntgtcaaggagtgccccgagcttggtgagctcgccagcttgtcccggtttgngaggcctttggtactgccggccccttcttcccttaatggctttgccacaacggttgtngtnctccgggggtttttttggcggaaaaanattgccaaaacccccgggggttttttccaactttgggggngttacccc

SEQ ID NO: 1506 - DNA, 513 bp, Fusarium venenatum
  misc_feature (1)...(513): n = A,T,C or G
gccagacgtgacaaagtcaaaaaatggcccaaaacgggctcgcctaccggcatcagacaagaggtaccctcggaaaagaagtttaacggcatgtcntgtatgccgcgccaggaagacaaagtgcgacaacgtgcagcctacatgtgggttttgtgcatcattgaatattccttgttcttacgataacgctgagaggaatctttcgcaatttgatccagctagtttggaaatccttcgccaattggggcagatcatcagtacccaaaatgaacttacacacacagttcggtctatcgccgcatcccaatctcatgtagcattggggccaggtgcatctcaagatcaactacgcttccacggtagtctaagcacagatgaaacagtacaaccgcagcatgagcttcacctgacagactggtttgcaggacagtcagattcagcttcaacaacgccatcctcatccgcaagtgcagctgcagttcaatggttcggaattctagcttatgacgcccc

SEQ ID NO: 1507 - DNA, 431 bp, Fusarium venenatum
  misc_feature (1)...(431): n = A,T,C or G
gcgttggtcagcattggccaaaacaatgtcatcgctctccttcaagtcatatgcacaggctagctcactcctgccccagctatcgggctactcagatacgccccagcactggcagccaaaagaatcgttcgattacagtttcatccaaatcgaggctgatgatgaaccgcatgtcatcgagactgacgttgtcattgtcggctctggttgcggtgcaggcgtgtctgccaaaaacctagcagaggctggtcacaaagtccttgttgtagacaaagcctatcactaccctgccaaacacctcccatgtcacaggaagcagcctgtgctcatttgtatgataagtgggggcttcttcacgacagaagactttggagcgaccggtgactgctggcacacttggggtggangangcacggncaactggattgttt

SEQ ID NO: 1508 - DNA, 876 bp, Fusarium venenatum
  misc_feature (1)...(876): n = A,T,C or G
cttcgctgctccttcagtcgccgcttggcaagctgttgccaccgctgtcaccatgcccagcatccccctctcaccgcttctgccaaggcttctcaacttgtctacggtggtatcaccaanggcaactttgccatcaaggatgctcagcgaatcaaccttatcgctggtaacatcgcctccggtactgctgatgtcgccaactcccttgtcagcgacttccgagttggtttcctcctcaagantcctcccaagctgcagttctacgcccangccatgggaactgtcgtctctgtcttcctggctcccggtatctttgttctcttcatgtccgcctacccttgtgtctacaagcccagcgacgaccccgctgatatctgccccttcgctgctccttcagtcgccgcttggcaagctgttgccaccgctgtcaccatgcccagcatccccatccccaagtcctctgcttacttctccattgccatgggtatcctctgcgctgtccaggctattgttaagcacttctggctcgttggctctcgcgagaagtaccgagactggctccccaactggatgtccgtcggtgttgcctgggttctcggccctgactctggctacgccaacgctatcctcttcggttctattactgcatggtggtggcgcaagtacttcaacaaccactttgagatgtacgcgttcgcaatcgctgcaggattgatcgctggagaaggtttcggtggtgtcatcaacgctgctctcgaacttggaaaggtttccggttccttcaagggaactgaaattgccctgcccggtgctgagtggtagatacaatagataactgttagttaatgttgttatgancgttttgaaaggcngtgg

SEQ ID NO: 1509 - DNA, 767 bp, Fusarium venenatum
  misc_feature (1)...(767): n = A,T,C or G
cacaaactcacacatcaaactctaacctaaccgaaaatgggtgtcggtcgctttttctgtgtgctattgccgttcgcacttacaatcggctccatcatcttcctcctcgtcggtgccctcgccggtgtcgccgacaagtctctctacatcttccgagtcgatgttgaggacctcagcatcagccccgccgatgtcgacaacatcatcgacaatctcgacctaaaggacctcaagctcagcactcgcgatgtgccccaactcatgatccgtgccgaggatggtgctcccatcaaggataacatcaccgccaagatgctcggtctcgacaagtactacgacatcaacctctggggtttctgcaagatcgacgccgatggcaagcgcaagtgtgagaagcctcaatttgactgggccagcaagtctctgaacacatctactctcgttggtaccaacaaaaacattgctattgagctccccgatgagatccagagtgccctcaaggctttcaagaccgctaccaagtggacacaggttggttacattgctgcctttaatgctctcgctgctgaaatcgtccctggaatcctctccaactgctctcgtaatggctcctgcttgactggattggcgctggtattgcacctacctcgtaatggtccgttgtccacaagngtcaaactggtacgtctcgggctgttaggctcgcaantttangggtcaaggccatcaaggcgttttgccgngcncacccgngcttgccctggggg

SEQ ID NO: 1510 - DNA, 525 bp, Fusarium venenatum
  misc_feature (1)...(525): n = A,T,C or G
catatatccatcttgaagatatcccaccatgcgtagccaaatcctcgcctccgccctcatctcgggggccatggctgctcgtcctttcctcgagcagcccgacactggtctcgagatggtccttggagatctccccaagggcgaactccctaagctcgaccagatgatcggcctccccgacttcgagtgggctgcccagaactacctncctatcgagaactacacctactaccgcaacggtgccgctggcgagtggtcctaccgcaacaacctcgaggtcttccagcgctaccgnttcaagccccgtactatggntgatatcacaaacattgagagcactctgnctaccaccatcctaggccacaacttctctggtccttcttnatcacccctgcgccagggctggcaatgctaccctgacgctgagaagaactttgtcaanggtgctggcganggtgacattctttacatggccgntctntatggctntttttcattgangagaatggcaaaggccaagggtga

SEQ ID NO: 1511 - DNA, 360 bp, Fusarium venenatum
  misc_feature (1)...(360): n = A,T,C or G
ggcggagctggaggtgcaggcggtggcaacgatgaattcgagttcggtttcgatcctgcgatggagcccgagcttgctcttgccctacgcatgagtatggaggagganaaggcccggcagganaaggccgctcgcnaanaggaggaggctgccaanaaggcctntntaggtgatgtcaaggaggaanatgagggtcagggatcaagcagcaaggaccaanataaggacaagangggtgatgganacaagatggacacctcataatanattatggttccgctttgcaacattgcagaaactgtacaatanacacagacagggggtttttagatgacaagaagattaangcccttncgatac

SEQ ID NO: 1512 - DNA, 936 bp, Fusarium venenatum
  misc_feature (1)...(936): n = A,T,C or G
gaagaattcccggccgcagcaattttttttttttttttttcttacagtggttgttttgtctaatatacagatgctatccaaaatctgagatgggtaaagtcaccaagaccgaccctgatagcttacatggaatactgtacatgtcgcaagagaaagaagggtatacaccatcaagaatcactttcttcttccttctgttgtctcttttctctcaaactgaggctggcaatacaccaacaacctcttcgcatctgccacacagcgcgtcttccgcaggcgccacatatcgccagcatcgaaaaacacttctcctgctttggtggaagcacgtgcaccttaaccttaagcatcttggatctcgaactccttcttggtaggcccattcaggctggtcaggaatgggctggttcagttgtactgaaaacaccacaaanatgtcctgcagttctttccacgtagcgtccaagaacagctgccgctttgccatcctcgatttcaaggatgaacgaactctggagaaaactgccaagcaccttggctgtccgtgcctcctctaacgtggccttgacagcactgtggatttcggtgaagatagcctggtccttacgtaccacatcttgaggaagcgtcnagcgtagagggtcaataagaggcgtatcatatagctgacgagctggattctccaaggatgaatcttcggccatccatgttggtngatgcgaccatgcctcttcnacaagcataggagtgatcggcgccnacatgcgaaggaaaccgatgaaaatgggntcaataataccacctccatcaccgcagtacagtcggtctttcagaccctccaagtagaatgccgacaggtcggctgcgacccagcggttaatcatactaactgctctataaaactcaaagtcgttgtacgatcccattacctgttcg

SEQ ID NO: 1513 - DNA, 551 bp, Fusarium venenatum
  misc_feature (1)...(551): n = A,T,C or G
ccagcaacaagctgctcgtcctgaacagcttcttcaggatctcgttggccagcgccagcatgcccccagccaaggctctggccgtcccgatactgctcgtaacaacagcaacactgagttcttgatgaacctgatgagagcacctcaggagggccaacgaaacgacttgttgatgcgcatggttccgcagcaccaaaagccaggacaaatgcctcaggagcctgatttccctagggacgaccgtggcccccaacgtcaaatgagacccaaccaccacctggctttccgatggaggatcgattccacaacccttctgacgttgatgcacgaccgaatcagcctacgcaaattttgcagcgtccaccaccccgtcctggcctggaacaccagatgccacccagctggatgcctggtggncagatgcctccccctcagcaacnaaganttatgatccctcctccagganttcctggcngtcctgttaggcctgtcggtcctggaacaaaccgtaacatgccatgcctcacatgttccctcccaacttcccaccc

SEQ ID NO: 1514 - DNA, 665 bp, Fusarium venenatum
  misc_feature (1)...(665): n = A,T,C or G
ccgcactctcacctctactcatgtctacactgttactagctgtgctgcttctgtcatcaactgccctgctcgctacacccagaaggttgttacatctaccatcatcgagagcacctatgtctgccctgccactgagactggtgctgtccctgccatgaccacctctactcacgctgttcctgtgcctgtcaccaccattaccgacactctcaccactgtcgtcccctgcaagactcgcactaccaagaccttccagcctcccactacacctccccctgctcccaccgtcaccatcgtcgagagcaccacctactgccccgagactggcaagtccaccaagactggcagctctgaggttcctgtcgttaccactggtgttcccagctctgaagttcctaacccccctgctcccaccactgaggtccacgagaagcccacacactcgggtcctactcctgagaagcccactggcgacaagcctgttctcctcccgtcgccactgtcccttaccctcctcacggtaacggaactgnttctacccctgttcctgttgtcccactcctatgtcctcctgttgtcagcaaccctggtgntnaaacccctnacttnggtggttcttcaggttaaccttcttcagtgnnggtttccctactggttntacccca

SEQ ID NO: 1515 - DNA, 368 bp, Fusarium venenatum
  misc_feature (1)...(368): n = A,T,C or G
tgtttntagaggatgctgtgaagcaggcggcgcgcntcatctacnttgcgcagaaggacaacaaggacaaggactttgagctcgagatgacctggatcagcggacctgatggtcctaccaagggacggcntgtcgaggtgccaaaggagctgcgggaagaggctgagcgattagcaaaggccgaggatgaggatgacgacnacgacgatgacgatgatgatgaggacgctaaggacgacnacaagatggaggattagagagcgattgtgtcaagaacaaaaattaaggcacttgtactatcatgatgacgaattcatagaatttaatggttcatctgcaggcttccgaactacttgcgggatgcctgg

SEQ ID NO: 1516 - DNA, 120 bp, Fusarium venenatum
  misc_feature (1)...(120): n = A,T,C or G
naanccttcacaanntcgctgtcnctgtttaccaccaatgcggaggttccaantctgcttaccccggccnctntctccgctgcncttgtggaagcangtgtgnaaagatgaactattatt

SEQ ID NO: 1517 - DNA, 667 bp, Fusarium venenatum
  misc_feature (1)...(667): n = A,T,C or G
ggngggtgttgcacctnataaataagacaaaaaggccagagaancacctgcaggtgcaaaatggactaanatcagccgcnaggttgagaaccccgaggctntgactattgggaaggagagattcgaggtcananacgacttcgttattgtgcttcgggtacttagcanggaagaanttnaagcgtatgcctnagcaacaccaggttctncgggagagacgacgccgcgacgaagatggtggtgaaacggatcgggatcgtgatagagacgatgatgagagaaaaaggcatcatcgccatcgtcgccatcgtgaagacgactcgtcggattatgaagacaaggatcgtgaaaggcgcaggcgtcaccgagatgaggaagagtacgacactaaggcaagagattctgaccatcatcaccaccaccgcagccaccgggaccgcgagcctgttctggaagcttaatccaacaagcaagcacataaagatattaccaccaccccaatgactgcttttttagattatggagcgttatattgaatgtattcaatgaaaggatttcccatcggatttgnatcgaatttaacatatatcatcagcatgaactggccggttagcgaggcattcaggatacgtaaaataaacaaaatacatttcggctcaaaaaaaat

SEQ ID NO: 1518 - DNA, 336 bp, Fusarium venenatum
tgtcgaatgggtgaacaagaagtcaaagggagagtttgacattctgttgcagcctggcgagaacactttcaggagtcttagatgggatttgaacgacatggatcctcaggacgtcagttgtggcaactggggtgtgtgggcgttccgtggaaagaggtaccgagacagccaccagggatgcttaaaaaagggtaggacgaggatgaacaaaccacgaattctcttgtaccatattgtacagattctgtagcatagctgtgtatatggatagatcattactgaaagcgtcacgccattctctacactttaagaggaggcatgcaggtatggtagcag

SEQ ID NO: 1519 - DNA, 545 bp, Fusarium venenatum
  misc_feature (1)...(545): n = A,T,C or G
cacgtttcaaactgactgtcgtcgtccggtcttccaaatgccgtctttaggatgtggaacgtgtcgagctcgtaaagttcgctgcgatcaaaccgtcccaaaatgcaatcgatgcataaaagcgggtcgagattgtgaaggctatggtttgcgtctgtcttggccccgtcacaatgacaagcgacgtgctatcgtcggaccacattctagacaatcccgattcaaaggaatatccgngaactatcggctgctgaatacttcttcgagggatatcaagctacatgatatgatcttaacgtcagctcaaatacatagcgtggccgttgaagcagtagccgatacaccattcaagcctgccgaggacacagtctttgcgagacaggcaaaacctttccttntattaaactcccctgcaacaggggttcttgcaaaagttgagtccggccaacaagcccttgtttcaatattttgtagaaagggcctcgtattctataanccctttgggaaaaatgcccacagagtccccggaattctgattcgcatgg

SEQ ID NO: 1520 - DNA, 532 bp, Fusarium venenatum
  misc_feature (1)...(532): n = A,T,C or G
gctaaaagaagatccagaatctcgacttgttctgtactttcatggtaacgccggccatgtcgcacaagctatcagacctctcagctaccactcgttaaccgacacctcatcataccatgttgtcgctattgactacagaggattcggccactcgacaggctcgcctactgaaactggagtaattcaagatgctgccacacttgtggagtgggctaccaaggttgcaggtgtcccagccagccgcattgtctccttggacaaagtctangcacaagccgtggtcaagtgcaagtcgccgaaaagtacgctttacagggtgttgagtttgccgnatnaccattgtcgcaggttcaagcgacttgggcaaatcttttggtggggctattggtattggaggngttgtccctgtccttgcacccttccgagngggggcctacgcttaataccgtttnatccatcgatttcgtnggcgaanaaagngggatttaaaatnaccgtttggnttaatgttgngggggaananaaaaaaaaa

SEQ ID NO: 1521 - DNA, 640 bp, Fusarium venenatum
  misc_feature (1)...(640): n = A,T,C or G
tgcgaaagcaatcaagcttagtgaggaagaagaggaacgaaggcgcaaggagctagagaacagtaatgctgcttccctcttcgacgatgatcccacgccttcgcagcagaccagtcagccacagtacactggtttcaatcagggttaccagcaaggcaaccccgttgacttctttgccaaccctattgaacagaaccagcctcagcctactggctatatgaacaacgcctacactggtttccagcagcctcagcctactggtttccagccaaactacaacccaggctttgggggccaacagactggcatgggtttcgacccatttggccagcagcagcagcagcctcaacaacagcaaagcttcagcctcaaccaactggttacaacccatacctgcaacaacagcagcagcagcagcagcagcctnaacagcaatccttntctnccagcgtttccgagcctactnttcagctggtagcaataacccttgggcaaccagcaacaggcagcagcaatnggatgcaacnaaccctactgggttcaacaacccctttggccagnttgggcggncccaatccggttgaacnaaacccatggtattcnttggggcgcttcccgaacaggaanangctttaatttn

SEQ ID NO: 1522 - DNA, 586 bp, Fusarium venenatum
  misc_feature (1)...(586): n = A,T,C or G
caaacacgttgacaagctacgaagtgacatacaaaatgaaagataacgttcagtttgtctatcagcggtcgtactatataaaggtcaagtccggcttaacctcaatctctgttatatacaaatctcctaacatccacttcgtacatcaactacataatttactgaaccttactctcaaccttcttgcccttggtgttcattccattaggcgtcttcaatccaccaaacaccgctgcagcgacaactgcaataccagtggcacccatagtatatgcgacctctcggccagcccaccagtatacacttgtgaacaagatgggacccaggcctcggccaagctgaccccagcttcgtaacataccgagcttgttaccgcgctcgtcctcgtgagcctcgaagctgctcagancgttcaagccagtgacgaacgtggcggatgtgactgccaaacatgtcgcagctaggtacaaaccaccaatggtgttgacccgtcccaaganaacgaaggaccaaggcacgcaagtnttccgatacggacggacatcaggggtgggagactcgtgtaacaccgccctgaagganggat

SEQ ID NO: 1523 - DNA, 837 bp, Fusarium venenatum
  misc_feature (1)...(837): n = A,T,C or G
cttcccaaacaaagtcgcccttacctgcactcgcaacgcttcatgctcctctacctaccattagcaatggcaactctggaacaccagttatgaagcccgcctcagtgccctcgaggcctgctggagagggtctcaagtatgcctctgcagctgcggctgcagctgcaagtgacaagaacaatgtgggtatttccccattacctccaccacctggcgccgcatcttcaagtatatctccattgccacaatctcgaagcagtgctaccaactcccctgctacatcctctgcccagcccgcttctcaacaaccagagtccaagcagcccacaccggcgccagcacctgctgaacccgagcctgtgcctacgccagcacccgtgcccgcacctacaaaaccgtccaagcgatcaaaggctgctggaaagcaggttctggtgcccganactccagcgccgtcaaagcccgcaaggacaaatggcacatccaatggtgtcaagtctaccgaggaagaggaagagtccatctaccacctgcctgcatcgttgcaagatctggttgatacctatgagacttcaagaaagcggccataccctccctccgcaccatcagcattacgcatgatgactgccagccaggccagctgccccgatgttgtggatgccgatgtgccacnaacataccgacccgaagtgccggtacccccaacaggatccaacttcccccgngagccgtcccccttttcgacgacccgcgggtgtactcacgcatcgatcccgacactntgttctacgtgttctactataacaagggatccgctcaacagtacatggctgccaa

SEQ ID NO: 1524 - DNA, 471 bp, Fusarium venenatum
  misc_feature (1)...(471): n = A,T,C or G
naaatttntnccattcttccacgaaagacaccgtcgatcaagatgagagccaaatggagaaagaagcgggttcgccgcctcaagcgcaagagaagaaagatgagagctagatccaaataaacgcatcgcaactcaacctgacttgacacatctctcatgatgttacgacctcgcacgcctcaacgataccttggccgaagcagggcacctgccattctggcgcctctgggatttcccacaacgcaatgagttgggatttgactttgggaactacgtcagggtgattgaaccccgcacttgagcggctgttgtggcacacaatgaacattatggtggatggaattatgacaatcgaatggttaggcaaaaggcggtgttggatcgactactatcaaatgctcaccaacacgaagcatcagaacaagattctaagacaaagaaatacagggatttcctgacaaanaaaaaaaa

SEQ ID NO: 1525 - DNA, 559 bp, Fusarium venenatum
  misc_feature (1)...(559): n = A,T,C or G
aggaagaggagctttgatgttcaacagcatttttttgatttctgattagattagtcacattataagagtaacggctggaaaactgtatcgttcacaattaccgattacttatttaaagggcgacaaagtttctatctatctatctcgttctggttggcacaaaagacgttttctccccatatccatatttagaacttttttttttacttgggccatttttacattcctaccttgaaccccaccatcgtcacctaccctaccgttacttgcccaaatcactgtcgtcataatgcctgttgtcaccccggacaagctggcaagtctgcnaagacaatccagtgatattcgaaatatttgcatctttggcccacgttgccatggcaaaactttcacttactgatgctctgntcggcacaaatggcattatctnaccaaagctggcggggaaagatcnatncttgactcaggcctgtgaagcngactcgaggatcacaatngaatcgtccgcatttacttactttgccttcnttggaaanagccccgacctnanccgaggtaa

SEQ ID NO: 1526 - DNA, 583 bp, Fusarium venenatum
  misc_feature (1)...(583): n = A,T,C or G
cttgacttccaaggcgcagcaaatctacttccctgtggacgagaacacaaccgtcgttgatacagaggacgctcccaagggacagcaggtcttcttcagccctacccagctctaccccttctggcttggtgccgctcctgactacctcaagaacaacccttatgccgtttacaatgcctacaagcgtgttgaatactaccttgacaaccgtgagggtggtatccctgcgagcaacgtcgagactggtcaacaatgggatcagcctaatgtctggcctcctctgatgcacatcctcatggctggacttgagagagttcctccaacatttggcatcctggacccttccttcatcgaagtccgcagactggctcttcgccttggacagcgatacctcgactcgactttctgcacctggtacgcaactggtggttcaacttcggaaacccccaaactccaaagcacatccgacgaanaagaaggcatcatgtttgagaagtacgccgacaacgctaccaacgttgctggaagtggtggcgaatacaaagtcgtcnaaggctttggctggacaaacggtgtcttgatc

SEQ ID NO: 1527 - DNA, 519 bp, Fusarium venenatum
  misc_feature (1)...(519): n = A,T,C or G
cttgctgatgaaaaaatgaaagaaattattggagataaagaaaggcttacntaanggaacacggtnctgatgaaggccaaggaaggactcggaataanttgaaacgcgtgggaattgggcnttctntgcccgtntnctcaaaaaggaaaaaatnctctgttgattcacttcttatatcggagtattttgaanttaatcacagtcttgaaggcttgcttcgcatatttgaaggagattttcggcatggtcttcgttcctaccgatgccccggtttggcagaaaggatgtcccgtttacaaacctggaactcggaaggatcaaggtggtgggttcctcggatacctctaccttgactgtatgcgcganaaggtaaatatcnggcgcacacagctctctcntccaaccngggcttcnttacttcagacaacaacgncattatccttctcatctctataactccctccttcatacccgcgggcgtccactctcttctacctccgaagctccaaacaatgtttc

SEQ ID NO: 1528 - DNA, 618 bp, Fusarium venenatum
  misc_feature (1)...(618): n = A,T,C or G
ctaagctgtaatacactcttttcattgattagatatcaactacggggcctagacatcacaaccggttcatatcgccatggctcctacattattatggattggtctcgggaacatggggaggggcatgagcaagaacattgttgagaagggcaacctagacggacctctgctcctgtacaaccgctctaccaagaggacagctgactttagtgctacactccccgacggcaaaactgaagttatcgagtcccttgccgatggtgtcgcaagagcagatgttatcttctcctgtattgccaatgatgaggctgtccaggagacttataaaacaatgcttgagagcgatgtcaaaggcaagctcttcatcgagagttcaactatccacccagagacaaccgaagccatcgccaaagatgtcatcgccaagggcgcccgagtttgttggccgcacctgtgtttggtgcccctgagatgggccgaaactggtcagcttgncnggggtgcttgcttgganctgctgncagtggtcacaaaaagccaaagcgtggttccagggcgtcaccttccaaggccgatattganctttccgaacaagccgtacaggcaaggnttttgact

SEQ ID NO: 1529 - DNA, 634 bp, Fusarium venenatum
  misc_feature (1)...(634): n = A,T,C or G
agctaatcaaccccagactctcaatcaagacccaaatccttgtccccagattccattttcgtctactgacatttctatctcgtatatccgtatttccccgcaattcagtctccgatgccttctccaatggataccgaggatagtcccgattcccggcccaaggaatccagcaagcgtcgccgtctcaatttcgcctgcaattactgccggaatcggaagacccggtgcgatgagcagcaaccttctgccaagcatgcatttcagcgggaatcccttgcgttaccgaanacagacgtaggccgggcaagttgatcaagcgacgcgaggcaggtaaatccattgatggatcgtctgttgggtctggaagtccatcggagtacggaatacattcagtcaccgagaatgtctcaacagaaggccctnaatcgcaaaagacaactgacgacgcgtccatntttgnggcgactggccgatacgtgcaaaatcgcaaaagtccganacagtcgcttaacaaaaggtcttnccatacngatactatcagtaattcnctggcgatcttaaacaaaatcgggtaccacgttttttcangttttgatgagnggntggatctttcggctttcggttaatggtccct

SEQ ID NO: 1530 - DNA, 295 bp, Fusarium venenatum
  misc_feature (1)...(295): n = A,T,C or G
cgctgagattacagtgccccttagcgagctaatcctcgacttcaccgacatcacaggtcgccagatgtcatttaccaacggtcaagcagcatgctcttttggaatcgcaccctcgaccccacaggtttccattctgggtgacacattcttaaggagtgcttacgttgtgtttgacctggaaaataacgagatctcgctggcacagagcaactttgacgcccaggctctcacattctcgagattgcacaggaaaaaatgctgtccgttgcaattggtgcangaggaccacantttt

SEQ ID NO: 1531 - DNA, 544 bp, Fusarium venenatum
  misc_feature (1)...(544): n = A,T,C or G
cgtcgacgccgtcttgcgaaggcatgcgatcattgtcgcaagggtaaaattcggtgcgatggatctcgaccagtctgtggacgttgtcggggtggtggaagtgagtgtcactatacagatgttcacaagcccgatccacgtcgacgtcgcgtcgcgtctcaaaactccgctagtcctaggcctaggcgggagacaacgaattctgttcaacccctgcaatcagactccattgctgtgcagggaggtacagagcctcagcctgttggtgaagaaacctttcatgagccaggtggattgaacagaacagctcgaccccccaggatgcgatatatggagagcgcgaagacatgcgatactttggtccggcttcgggcatactctttgcttaactgcacccanaaagacggaccggcagaaccggnntatggctnatggaccacaattttngaccatattcgaagggaataatgaaacttaccatccngaccngggattttaatggaangaatcttaattncgacataagctttggtggtnaatctcg

SEQ ID NO: 1532 - DNA, 496 bp, Fusarium venenatum
  misc_feature (1)...(496): n = A,T,C or G
gaatatgtcaactctctatccttctttcctccatcaaacgagcaccctgatggctatgttgtctctggcggaaaagataccatcatcgaagtcaagtcccccaacgcaaccagcaccgataatgccgagcgccttctgatcggtcactcaaacaatgtctgcactattgatgctgcccccagtggcaagtatctagtgtccggcggctgggacggtcaagcccgtgtttggagcccccagaagtgggaaacaaagctattactaagtggccacnaaggcatgtcggtctgggagcgttgttgctttcaacgaccatacagtagtnactggttgcgccgacaaaaacatccgcatttttgactttggggnagctcctntggagatgtagccccaaattcactntttatacccccgacgttgtccgcncctttgccgggttcttaaaatcacccgngcggggccatttttgcgagcgcnacaacgnangcctatccgt

SEQ ID NO: 1533 - DNA, 627 bp, Fusarium venenatum
  misc_feature (1)...(627): n = A,T,C or G
cggtcaaattatgccctgggactacgatcttgacgttcaaatctcaaacggcaccatgcagtggattggcgataacctcaaccgtactgaacacagntggaactataccgattctgcttnaggggagttcatatccaanaaatacctactggacgtcaacccccaccacgtcgacatcgatcgttctgatggacnaaacatcatcgatgctcgttggattgacatgcanaacggcatgtacgttgatattaccggtctgcgcgagcgcgaggtggatcggccagntatctggagctgcaagaacaagcatcgatacagaagccaggatctatggcctatgcgcatcaccgagtttgaaggtgttaaagcccgtgtgcccttcaacttcaataagattttggttgatgaatatgataccaagagtttggtcaccgagagttgggcangccccgatgggatcacgataacaagatttggatcaaggagaatgaagaggaacaaaacagcgcaagctcgggccgtcgatcgtcacctggccgaggntgttgcttacccaaaacccaaagaggagacagntgggccatcagctcttaagggtcctttttcnaataattctctcacaattct

SEQ ID NO: 1534 - DNA, 614 bp, Fusarium venenatum
  misc_feature (1)...(614): n = A,T,C or G
ttttctttctttcttccttcctggtgacactcattgccaagatttgctggtttaatacgtgcgagccacggtttgcatcaaagttgatcctgcttacgaacccaacaagatactttgctattgacacctgattcaaaacccagctgcccacacatttcaagatcacccatccccatcaagtttgcgacaaaccctccgacaaccgttctcgctttatcgaaatgcccgaattcgtcagcacacctctctacggcggtgcaatcacttgcgatctgcccgctaagttcgccgatgtcagcaagttgcgacaagtgcctgataaccaggaagtttggatcgaccaagatggtttcaccagcatcatatttgatattaccgagcgtgtcggaggctctggctcaagccccgaggttgacggccgtgctatgacgacccatctcgaagatatggttggatcagacattgataccgtcaagatctggaacactggccgagaccgagtttaccagattaaatggnacacccggctacacgctnantttcacacagacccctcacgttagcaagtnccggggaacaaccttttgngcccgactttactggtatnatcttng

SEQ ID NO: 1535 - DNA, 614 bp, Fusarium venenatum
  misc_feature (1)...(614): n = A,T,C or G
cctcttcattctcatcctcacctttcaaagtaacatcacttcgatacccaaatctaacgactctttcacgtcgatcacaacaccaccaacacaactcccttccacacaatcattcacaatggctcgcggcggagactcagcagaccaaggtccacttcaagggcagtgatgactttgtcatcttcattgacgatatcgagacctaccagaagtggaagaccgacaagagcatccctctggctcacttcatctcctctttcaagatcttctgcacacacgggacaaggagtccaggggaacactcgacgcagcttccaaggccgctcttgagaacgagtttggtacctctgtcgatgacgatgtcattaagcagatcctcgagaagggcgatactcagaccactgagttccccgagcgtcaaggcaacaagaacgacaacaagggtcctctcatctcccactagaagttagcagggtgccagacgatgttccatgcagcgggcgtttgggtttttctcaggtttagcgcgaantcaattacgacaaactggggcgttgttttgaacaacaacgtttgtctcgtccgaaatggttgggcaattgttgttgggcagg

SEQ ID NO: 1536 - DNA, 282 bp, Fusarium venenatum
atacggattaacacgtttcgaacctgctttgaaacatatggtggaccatctggcaaggggcatcctcgagcaaactcacttcccctatgtaaagccaccgctggaccccaatgaggaacttcatctagcacagagcgcctctcttcgtgccggccgaccgaactgggcatcgctggtcgccgtcctcagagaaccgacagcgattgattgttttcatgggtggaggcctacatacaagcgaaagtcgggcgtgttacaaagttggggaggcccgaacccaaa

SEQ ID NO: 1537 - DNA, 1085 bp, Fusarium venenatum
  misc_feature (1)...(1085): n = A,T,C or G
tgtacctacacttaaatagcccgaccattcttaaaagagacctgcttagtagcctttattccaaccttattaactcttgactctgaatcgcatttcccctctttactttactttagtaccttagtatacttacttatacccacctactacatcattaactgccaactcttgatatttctcaacctaccaacaaacaccttgcacaatcctatcgtcgcactctagaaacaacttctctcctcgtcgcatacactttcaaatcctacttccatggccgatttcgctcctccagctggcccgcctcctcccaaggcccccgaggtccctgccggatgggccgtgcgatggaacgaccagtacaaggaatggttctacgtcaacgtatacacgaaacagtcccaatgggagaaacctactgcccccgtcttccctaatgatgacggtgcgcccgccggtcctcctcccggatacgagccaggcaacacgcctgtagttacagacaccaagaagaacccctatgaagatgtcacagccagcgccggtggttcatctcaagacgaanacgccaagttagccgctcggctccaagccgaanaagatgcgcgtgcgctcagtggccctggcggcccagatgttcctgcaggatatggcggctcgaatagnccgttcccccagagcaacagcccttatcctcaacaacaaagcggcagcagttaccccgcagaactacccccgagggaccggggtgcttaagagtggcggcttcctaggaaagttgctcggtaagggcaagcagatgggtgacaagcatcaacaacaaggtgcttatnggtgggtatgggggggcttacggtagcatgggtggtggttaccctcancagcagtactatcctcagcaacctcagggtggctacccaggacatggccctcctatgggctatggcgctcaccccnttatggtggtggttacngcgcaccanntggctatggtggatatngaagcggcccggctaccgccaacatggcggcggtttccgcngtggtggtatgggaagtggtcccaacccggaagttggggtttgggc

SEQ ID NO: 1538 - DNA, 395 bp, Fusarium venenatum
  misc_feature (1)...(395): n = A,T,C or G
gagaagctcacacaacaattggacgagaagtcgcgcgatctatctaagatggtcaaggagattaacgacatctctggtacattaaacaagggtgctaaacccgaggaccctctgagccaaattgtccgtgttctcaacggccaccttacacagctgcaatggatcgatgctaatgcctcatcgttgcaagccaaggtggcagctgctcagaaatcaagcagcaacctaggaagtcactatgctggttcggataacgatgcggnggagagcttctatcgctcatacatgggacgacnatgaagggaaggattgtaattggtgggattggagttttanggcanggaatccaggtatttnttttcgaagatgaatnttaaacagagcatgcgtaaccc

SEQ ID NO: 1539 - DNA, 713 bp, Fusarium venenatum
  misc_feature (1)...(713): n = A,T,C or G
cgaacgtttgacggtccaaccattctatccacttcttgattgtataagttctgtatcgcatctttcgcttcaaaccgacatcatggctcgcggtaaccaacgtgatcaggatcgtataaaggcccanaaaaaagcaggaggagagaagaagaagaataaccagaccggtacccaaatgcaacaatccaaggagtccagcgccgaaatcatgcgacaaaaacaggctgctgctgaggctcgcaaggccgccgaggccgccaanaaataaaagctgcgatttgctgtacgaacactatccacttccactcaaaaaattaccatcgattgtctgtccggaataccacaactgaaaaagatggaataaggactacagagagggagcggaancnttcgaaaccagacntttttttcagcgatgcaacgaaacgatttttgggcagcacaggcgaagcggtgcaataatacgggttgtctttcanaaactataactatagcctcgcaatacatctttgggatgatgtttgctcgngatggctaaacaagcagctntaggggccctnccgtctttcgtcnttcctactctttgnctctncttggaagaaatggttnccggacanatgattgattgnttngcgtgatccananattaaccnctccaagggaccagtcaatccctttggggaggngaccactctcnaatgttttaaggcngg

SEQ ID NO: 1540 - DNA, 589 bp, Fusarium venenatum
ctacacaccactcgacagcttgacgacgtaagagcttctgcagccttgtcaaccaaagttgccttttaacacctttacagtcaccttcaacattactgaccacaattctttctacccttggcaatcagtaaatactcaatatgccaatctcaccaatcatcacatttaaggccggccaatgcgaggttgatgcctcctccaagccctacaaggtgaagccgcaatctgagcctggctacatctacctatactccgaagatgatcttgtgcatttctgctggcgcaagcgcagcgagccactcgacaaccccgagctggacctgatcatggttcccaccgatggcagttttactccctacgaatccacgacatcttctgaacccacctccaagactgatggccgcatttttgttctcaagttctcgtcgtcctcccaacgatacatcttctggctacagtcaaagccccagagcgagaacgggagaccagcctactacagtcctcgtgatcgtaagatcggcgaaatcgtccatcgattgctacagggcgatgaaattgaaggtgggccgaagaaatgggtaatgtccgc

SEQ ID NO: 1541 - DNA, 590 bp, Fusarium venenatum
  misc_feature (1)...(590): n = A,T,C or G
tttttttatgaacttgttgcctggagccattttttttcctttgttcaattacaacaactggatcacgcaagggcgcagaaattaattagctactggataatgcagtctttttcaattccttgaaacctcccgaagacacacacaacccatcatggccgacgattctacccccctcgcttctctctcggttacccatgtctactatgaccccgaaagatcacctctcgctcgtatgcgcctacctcgctctcctcccccaagccctctgcgtcgtctatgctacactcgtgctctttactcgcgaagtcgaagtcgcccttatgttcctgggtcaactcgcctgcgaagtcctcaactttgctctaaaacgtctcatcaaggaagaacgaacgcgtcgtatacatggtaaaagctatggcatgcccagctcccacgcccagtttgttgctttctggancgtctcccttgcgctgtttctgctcgtccgtcacaagccccctcctgtgctaaangggcggggcagaaagcngtgtgcaccgaacatggaatgttgtcaaaagggtccaatgaatgtggctngcatggcgatg

SEQ ID NO: 1542 - DNA, 645 bp, Fusarium venenatum
  misc_feature (1)...(645): n = A,T,C or G
ttcatttcaccgcagcagagctgcttttcattcattcaaacgttncgggttattgtctgctacagaattacgcaggccatgcactttgttaaaccgttctaaaagtttcaatttctaattgcagatatgtctcacgagatggccaatgagaagggcgaagcanagaattctactctattgacacctgaggctatcaatggagctgtttcgcctagtccaagtgcaagctcttttacttcttctattgaaacaagcgattcggagttcacttcatcgtgggcaaagttgcaagatgtttattctcggaacatcggactcttttatgttctgctggcacagctgttcgcttccattatgtccatgacaacaaggctcttgtcaactggatttgagacaaaatttcatgctcttcanataatcttcgtccgaatgcttgccactgcactgattgggtctttctacatgnggcgagaaaaagccccgattttccttttgggcccgcgcgaanttaaaagattgttggtgctgaaaggcatggcccggatccggngggctcttnggtctttaatattctctttcatacctcgacgttcccacgcgacgggcatnacttttctggncccgacttntgacagattnattgnc

SEQ ID NO: 1543 - DNA, 512 bp, Fusarium venenatum
  misc_feature (1)...(512): n = A,T,C or G
gctactcttacttaccttgctgttacttcactacacccaaatctcgtatgtcgcgttgaagacgtttccctctctctttcgtctcttcaacctgcctctcttcaactacggtcgtcgccctccgtccgttcttgaattgatagtatagccactaaattcgatttgtcgccaatcattttctaattaaccaaagtctcagtctcatattgaggacctcacttaacttcacttctcaaccgttctttacaccggcgtgctctcacgcgcctcattaatattcaagatggcgactccttccgtaattcccacagattccaaacgcgacaccaccggtcagtttcacagaatcacaagaggaaaccgcagcctntggtaccaagctgactgtctgcaataaccaaagcgagcccgancatgcggttccggtatgaaagccaacaagcgatcgccgacccgttgatcctccgccgtgncgagctccgaattgttgaangcccctctctngaagaggg

SEQ ID NO: 1544 - DNA, 626 bp, Fusarium venenatum
  misc_feature (1)...(626): n = A,T,C or G
aaactttatcgatactttccagtgcttaaccaacccatgctccaatacgactcatctacaccttaaacccgacctccanaaccaggcgacgacggtcgatgccttgagagtacagcgctttgcgacaccaatcgactcctgatactgcgaccgtcccgactatcaacgttccttccaccgaggtctaaaagacaaaatggccatgcaatcttcactggaggtgctgaagaacacgcttgaggagattgtcaagaacccgcaataccatgatctattatcgctagtcaagacggcgcgcaatggtatnatttacggaaccaaggngcgggttctcatgcgctggngatggctttntttccgctccggaacattncgagaaaaggncaaattagtccttngagcgacgaaacaccatgcgaacaacttggcgcgcttcgtaccattataagctgccatgttggcctcaaatctttggcgcaaacctggaaggagggacatacacttttttgaggcggtcttggngnggtttttttntttgnggcgatcaancnccaggaaaaatttttttcaaccaaantcgntttcgttttggcgtgtatctcccctcccncatgtttaaactgggn

SEQ ID NO: 1545 - DNA, 881 bp, Fusarium venenatum
  misc_feature (1)...(881): n = A,T,C or G
cttgcactccattgaacccaatgatctgagttttctgtttctttactttgtctcttcttaagtctttgatagctcccactgtgacagggtcgcaatggaggatgagcgaggaactcgcttgcttgcgtccatttggacgttggcgcttctaagtcttatcctattgtttctgcgtgtctactgcaagcgatggcgaggcaaaggattgtggtacgatgactggttcctcatcgcggctcaggttagttggagctctacctacttaatcaacaacatcgaagctgttggtgctgaccagtggatctgtcccgccttctaggtaacactaatgatctctgtcgccatcaacacgtatttggtctctctggggttcggccggcacaaggcaaccatcagcgacgaaaacttgaaaacgatcaacctcaacactatcgtcggagctgctttcggcatcatcgcaacgacgactagcaaaacgtccttcgctatcaccttgtaccgaatcgccaccaacgtatggatgaaatacttcctaatcttcgtcatcataaccatcaatgtcttcatgaacttggtctggatctttggtcttgccaaatgttcttctcttgcccgagtcttcgataaatcggtacccggtacttgctgggacccaaaggcgctacttcagttccaattatttgctgcctactattcggccgttctcgactttgtcttggcactcctcccctgggccatcttgatgcgaatgactatgcgacgacaagagcgacttggaantagctgttgcaatgaatttgggtgctattgctggtatcaccggtatcgtcaantctgtcttgtggtcagcatgaaaaatgacaatttcccctacaacgcgt

SEQ ID NO: 1546 - DNA, 299 bp, Fusarium venenatum
  misc_feature (1)...(299): n = A,T,C or G
ntgaagccaacatattctacccttttcgtntccttactttcattcacagacnctatatctctgcataaacgggaacatgaccttgaaccaagagttataagtgctnntattcagcgtcgccatgtanatgatccctttgcccatgancgacaacgtntaancaaaagagatggcacggtcaatgttggaatcgacaatgagcaatccctatacttcctcaacgcaagcntaggaactccaccacaaaacttgcgccttnatntcaatactggaagnaatgatctttgggtgaatgcatg

SEQ ID NO: 1547 - DNA, 250 bp, Fusarium venenatum
  misc_feature (1)...(250): n = A,T,C or G
cggcttgggagctgagcggttcctggcgtggcttctcaagctctggacagtccgagaggcttgcttgtatcctcggtacatgggtagatgcacccngtaaacgaactgttgatgagatgtatgaaaatggagtataggtttatgatacagtgaaacagatttctagtacaatctanggataaaaagcgatactgctttactgatgcaaaanaaaaagnanaaggtatgcaacagatngngattatataaa

SEQ ID NO: 1548 - DNA, 554 bp, Fusarium venenatum
  misc_feature (1)...(554): n = A,T,C or G
cgcgtntgttctgtcggtaaacgaaactgcccgatggcataaatccacaagcagtatgaccacctactgcttttgtctttatcctctncaaaccctattgttatgccccctcagcgtcnatcatgggtcggatgtacaaggtgcaagagcttcaaaaagaagtgcagcgaggagagacccncttgtcggcgatgcaccctgnctaacgcaaagtgtgaatacnccgtcaagttgcgctggggagggcgacccttcaatcgttcaccgttnggggagtgtttgacccaaaatgaaggaaaagttgaaagattanatttaaacaataaaaactttatttacgtntctccttntactctaaaccaaatcaccaaaggctgngtcaccccggtacaagaggtcgatagaacgcaatggatatcaacttcgccatcagcaattccaaaaacatccgagtnttcnaggtgggttttttntccgaananccactattcctnttcactcctntgaaaagttttcggtattttgctcctttnacanataaggattttattttc

SEQ ID NO: 1549 - DNA, 600 bp, Fusarium venenatum
  misc_feature (1)...(600): n = A,T,C or G
gccaaacattcgagttgataattagcccaagaggagaagcatcggcatcatgtcttcaccagtcgccaaggccgctcgccgcgtcacgaccgagcttcgaggcgttgtcgtctctgctggccttatggaaaagactgtcaaggttcgagtaggcggccagaagtggaataagaccgtcaataagtggttcgccgaccctaaacactatctagtccacgatccgaactcgtccctacgaacaggcgatgtcgtttctatcgcccctggatggccaacttnccagcacaagcgccacgttatcaaagacattattgcaccttacggtgttcctaccagcgagcgttcgctgtacccacactggaggaaaggatagcggattatgaggccaagaaggctgctaaggatgagccggaggcagccagacgacaagaagaggagaacaaaagacgaggaagaaaagcgattggnaactgaaaagaaggaggccaagcgtanggcttggaangaggcnaacaaaaacacaaaccggacaccttacgaacgatnntggcttgaatcacctaaatnttncatcacacacatgacccanactatnttttt

SEQ ID NO: 1550 - DNA, 717 bp, Fusarium venenatum
  misc_feature (1)...(717): n = A,T,C or G
ggccattgggatttattgacgggcaaattagctgccaaggtggctgttccttggggaccgcagggctttgaacttaanaanaaagctgttggtcgcgacggaaaanaaaagacaaggagtaacgtcgtcagctgcatggcatggagagaggatggttggggagatcagttctgcgtgggtgggacatcaggcgtggtgacggtttacggagcgttgtaaatatcagttataccactcgagtctgccaaacggcgaagcaggcttctgccaggactctaatggtgaacccatcactctgaacaacgttatctttttttgcatatagcttgatttattattgaaatgaaagctacattatcttcaagggcattttcagattcgtacatagacaagatgttgtccatcatgagactccgtatagattgcttgaacattaatcgcttcccaccagcgccgaaaccgtgacccaaactgccatgattcaaaatgtngtacccctttttatgcatcaaatgctggttttcgtacactatcatgtgtttgttcttcaacccataccgacatacttgaaccagttgggccgacaatcttccgatgtaaccaggcttcgccatctgtaagacgaccagtgacgcagcccttacactttggagagttgggacagttgaagaagggaatatgttgatattcaatatcacggaaccagtgaatttgctt

SEQ ID NO: 1551 - DNA, 506 bp, Fusarium venenatum
  misc_feature (1)...(506): n = A,T,C or G
gctacatccacaagtaacatcgttgtggccgagcatatcttttacacagcaagaggatcttgtctgctaccacacnacaacggcgctgttgcggttatcgatggcgagacggtcaagttgactccattcaggacagtcaacgngccacctcctatgtcaatgtttgacatcacagcttctgctgctattgccgacgttgcctttggtcgcnacaatacctcttttgctatcctccaccgaaagggtatcgaaatctatacctggcctgnnaagaatggcaggtctatcaagccacaagtgtcaaagaaaatcacctttgacgagatggccancccaggttacaacgttcttttgaggatcgccgctgttgctgacgctttccactacttcggtttngaggaaaaaaatgggttcgtccaacgatctgtacaggctccggggngggcgatcgtctgttgctgatgtcaactctcgaaagatcttgnttgctacaccagttaccaaaa

SEQ ID NO: 1552 - DNA, 641 bp, Fusarium venenatum
  misc_feature (1)...(641): n = A,T,C or G
atcttatacctgatacgaagctaccccgccatcgacttacctgtttacgactttcaccttacaactacaacaacaattactacatatcttancctcgatgtctaatcctganaaagctcctatgtattccgntggtgaccagcacggaggcggtttattgcctaccgcccagccaggtcaggagaatccccctcacgataattccgcccctcctgtgtacgagcaaggaacagccgagctccccagcgatgagaagcaacagcagcctcctnaatatgcccctccccctggaggcgaaccatcacagtctgccgcggatgagaagcaaaggttgggacagcagtacttcccacctcctcctcctggtcctcctcctgcgcaggaccaacatcagcaatctgcccctcacccaaacccgctccagggtaacccagtaattgcacctcaacagcaacnggcgactcaacaacccatcgatgcccagaaggaacagcagagctacgccatcccacaatacgatcctgctcatcctactttcgcgcctcctnctacaaaccctacaaaccttacaaacgagtccagccagccaccaccacagnttctgttcaaagagaacccctcggncacggnaatgatcaaac

SEQ ID NO: 1553 - DNA, 205 bp, Fusarium venenatum
  misc_feature (1)...(205): n = A,T,C or G
ctgggctctcggaaacgagatgtggggagcatggcaagttggccagatgacaaaggaagactncgcaaagaaggcctaccaatgggccaaggccatcaagcttctagaccccagcgtnaccctcattctttgnggngagacaaggacacagcacctgggactnatacgttatnaaggntggcttnaagtttgnttacaccggttt

SEQ ID NO: 1554 - DNA, 426 bp, Fusarium venenatum
  misc_feature (1)...(426): n = A,T,C or G
agactttaccaaaaacattacctctacacaatcaaaatgggcagacttaacaacggcgactggctcctcgttggaaacagcatntggagcgatgacggcgagacagagttccgcatgcaagacgatggcaaggtcgctgtctaccatggcgaagaatgcgcctggcagaacacccccgaacagaactggcaagttcacggaatcaagatgcaagaagatggcaacctagtcatttacgacaactctggtctggacatgccatctggcacacagacactgctgncggcaagggcaacaagtctacaactcttgtggtgcaggatgacggtaacgttgtgttgtacaatgagggtggtgattctntctggnacactgttgcaacaagtagaattatcnttaaggaaatgaagagggtctntnaacttc

SEQ ID NO: 1555 - DNA, 578 bp, Fusarium venenatum
  misc_feature (1)...(578): n = A,T,C or G
catcattatcaacatccacaacaacaacagttggccccacaggctcaacagcagacccaggcagcatcagtatcagcaagtccaacacccacagcagcaacaacaacagcaacagggtcggccaggaagtaatggttctcttggacgactggaagccttggttgccgttgcaacaagcgaagggtcaaccgccaaagcgtactgagatgccacgccactcttcctnggttgcactataactccttatggagcactcatcgcctccgaacatctgtcgcctcaattgtacgtggctgctttgagacgatnatgactttaacgattttacgacacatttccttgaaacctggttcggcttgatttttacccggaagcccnaacgaancacnttacgggcatngctttgtcacatgatacacgaancatgatctctttngtcttgtctacatcacgaactccctactcngggaatcnaccttttcctttttggcacaaacgatagcattcgacgatattccancttgatangtccttccgaaaanacattcacntcancatatctnttttatctaacccgt

SEQ ID NO: 1556 - DNA, 393 bp, Fusarium venenatum
ggaacttcattgttgtcatggtcactcccgtcgctctcaacaccatcggctggcagtactacatcgtgtacgctgtcatcgccgcttgtgttcccatctcggtgtacctcttcttccccgagaccatgggtcgtagccttgaggagattgagctcgtcttcaaggagtcgccttcagttttctcgactgtcaagttcgccaagaaccgacctcgcgaaactccccagcaattcctcgctagcaaggagaaggccgaccacttggaacagggcgatgaataaatgggcaattggattttagattgggaagcgaaagaaagcgtttgcgtttatgtttgacgacatttttgatagacaactagatcaatagaatactagtatgattacgacatcc

SEQ ID NO: 1557 - DNA, 531 bp, Fusarium venenatum
  misc_feature (1)...(531): n = A,T,C or G
gaagctttcgcttgttttctttttcttcattgngagaaganaaaactgttcttgactcagttgttttatttatttcttgctaccactaactctacatcacctaattgagcaaagttgcccaaaatggctgaaaatgtgatggccgcctactgggatctcccagctgtctcccgaaacctagttactgctctagtgatgacatccgtcacttgcaagcttaaccttgtgtcggtctactcggtgctttatcatccgacatatttgtggatgttccctccacagatttggcgcctcgnaacatccttcttcgtcgagctgaaccccatcaatttgctcttgaattgcgcnctttntgtttcnctacggcaatcntctgganatgggaaacgctcntttntcgcgcaagggcgatcttgtcttttcattctctttatctgnncaagaattctggtaagcctttgtctacacacccgngcctttgcatcattcctacgngtcccctttcaaaaccccccttattntatnttgccc

SEQ ID NO: 1558 - DNA, 538 bp, Fusarium venenatum
  misc_feature (1)...(538): n = A,T,C or G
ctggcttcaacttctctaataataatacccagaaacgccatggcatctccttcgcttccagaaagttacacctctcttgatcttccaactctccaactcttccatcatcctccctcatcaaaagangtcacacccatcatagtcatcaaacttcaccgtcccgaagctcgtaatgcattcaccgacactatggctgcgtctctatcccacgcgctaaacaccctctcgggtgatcctcgcgttcgtgctatagtcctcacttcatcagatccaaagaacgcatgtactgcgcgggcatggacttcaacgaagaacatgcacttggtaaagangctgctgaacatcgcgantcaagaagcatcgttactctgccaatgtnncgctgcaacnagcctgtcatccttgncataaacgntccgctgtcgggttggcatnaccatgantcttgggcgccnatatccgcgttgtgaccgcgangccaaaatggattgtnttcggtcccgtggttcacatggaagngttncacaactcttctccc

SEQ ID NO: 1559 - DNA, 639 bp, Fusarium venenatum
  misc_feature (1)...(639): n = A,T,C or G
ntgatgccattcagacacaacgttgatccccttcaactngctaaacgataatatctttgcgcaataacgccaggtctncaaaatgccacccgctctgagtgacgatgaaaactccgaccttgaggagntnactacacccccacgcgctgctcgcaagaagtnaacatcagccgttgtgcctgacaagnttgaggacaccaaagacgggtcagaggaagagttggacgaggacgaattcgttgtcgaggcgatcaaaaagcatctcattgacgaggatggcactctgaagtttcaagtcaagtgggaaggatacgaagccaaaaaggatctgacttgggaaccggaggagaancttcgtgaatctgctcaagaaatcctagacaaatatttcgacaagctcggaggtcgagagaagctattcgaggagacagaaaccgcatccaaaacgaagaagcggggccgagctcgaacggcggggctcctagcaccancggctcaacaacaaaacgatctcgacaaggngataccgcacctggcaacactacancttgcgcacatncaagccatggggtnncgcccgcgggctcatgggaaggatgagaancgaatcaatngagcntcgaggaggacgaaaacatc

SEQ ID NO: 1560 - DNA, 742 bp, Fusarium venenatum
  misc_feature (1)...(742): n = A,T,C or G
gcgcgntccttcttccccagctttttccctgaacctaacctatcgcttttccatctccatctcatctttaatcgccttttctatcatcaagtaattgctgggttttttactggtgaaattgtaattacgagcctacctactgtcgcatagctctacacaacctcgacttcgaatcgttaccatcgccatcatggtcgccgacgcagttatctaccatcccacggtagcgcactacctgcgctacatggccactaccctcggtcgcgacaagctcatgcgagtcttccagtactttgcccgtttctacgcctggtacctcctccgcgcaaacgcaacagcagacaaggtcgctccttggaacgccctcaagaagcagttcggcctgttccgaaaggtattccgagccggaaagttcgtcgagcacctcaaggctgctgccaccgcttcgactcaaagtccatggaccccgtctcaagtacacccaggtcggtcgccagcttggttacgccggttatctcgctgcgattctctcaccattcctcacgccggcggtatcaagaactggaaagcacgctacgcgcatgcagcaagaaggctaccgatctgggctggtggtaatcgnctttaacatcttcggctagtgtccctctcttgncagttgagtgcacgagcatcaaaggttgatttgaaggaaggagaaggtgtcnttgaaaagcaanacatttntattgagcgcgctgnc

SEQ ID NO: 1561 - DNA, 763 bp, Fusarium venenatum
  misc_feature (1)...(763): n = A,T,C or G
gcgctgccgcatcaacggcccatttcatagacctgaccttagctccgtttaagttgttagtcgatagatataaacctaaacatcgccgcattcgttctgagatcccttcctttcttcaccttcttcctccataacctcagaccttgtcacaacaaaacacttgcgttaaatcaatcagttcgcatttgcgctttacacctggactcttactaaaccgttgtacacataaacctctcaaacgtcacaatggccgacacaaccgagcagcagcaacccaagctcgttgacgactctcccatctcccctgtcgaacgacgaaactcgttggaggctcatctcaagcaccgccccgagcgctccgagcttgtcgagaagaacatccttccagcctctaccgcagcgccaggcctcctagcacaccagaaggagctcgagaaacacatgctcgaggacaagctcaacgacaagatctcgcaccgcccagaccccgagtctctcatcaaggagggtgttctccacgacgacccccgcgccgtgactcaggacgaggctgcgaagaagtacgacgaggccatcgaagacgagtatgccaagcgtgagggtggcgcctgatcatgatgtcatgcgacagggcagggtacttacctggnccagggtcatgagagcctcggtacagaaactgtactcatgatgctnaatgtggagttttcttttttggaatgtgtgaaatgaattgactgttgatggctttggttagaagtac

SEQ ID NO: 1562 - DNA, 121 bp, Fusarium venenatum
  misc_feature (1)...(121): n = A,T,C or G
ngcgccgancnctacaacgnccaancctactatactggatacgccctcttctggctnggnatcactgnccgcatgtgcaacctcatctncgggngtagcccgtnggtgtcaacagaagtgg

SEQ ID NO: 1563 - DNA, 608 bp, Fusarium venenatum
  misc_feature (1)...(608): n = A,T,C or G
tcganacagattgcgangggggtcaacatgtccacattgcaacgcgcgaaatccatccggaaacctgcccctttctnttccaccactgcaaagacaacaagaaccaccgntgctgctacaaattccccagatgcagatcacacaccgagtcgtctccccatcaagcctttgaccagaagcgcaacgacttcaagcactacaacaaggtcattgaggaatggtgcatctggtctttcaagggcaacttctgtcaaacagcctactaaaccagcaacatcggaacctgcgaagagagaaactaggtatcctccttcaacgacaactacaagaactcgaccagcggtgaggccgacctcggcagatggaccaactcaagctaccaggaaagctccagccccttcacacacgcgtgctaagagcaccgcgaccggattgaanaatgccctgcattaagaccggcttnatcgacctcgtcggntagtagtaccacaactacgagcactactaccaccactgttctaagtcgactcgcaccctacgctntttgacaacgcccaaggnaaaaaagtncttgggcgctgngcctcgctttgaacaagcctttttga

SEQ ID NO: 1564 - DNA, 640 bp, Fusarium venenatum
  misc_feature (1)...(640): n = A,T,C or G
tgacgattatcatttcgaaaaagagcacttttacttcggctactatcatccggctcctcccacaaagcggcgcatactctggtttgaacgattgatacttaattttctacacattcaagatggccgaccgattcccttcgcttgaggacttcgattccggggcgcaaaccgacatcaaggatccgaccgctgagccatcgactgacgattttctcgctcgtgaaaaggctctccttggagacgacgccgaacagttcacaaccaacaatgacgccgctgctttcgctgatgccgatgatgaccttcttggtggcgccggcggaaacgagcaatctactttcgagtctcaatttcctgacctgacccaacctgaagctggcactggagtttctgctggaactgccattaccggaggaccttccgtaagctacaactcaggataccaggcctctttgagaaggagcaggaacccgaggttatcaaggagtggngtgaaaagcgagacaaccanattgccancgcgccgancaattcgctgccacgcgaagaacaattagggggtcancgacatcntgattttcccactcacacaagaagggaagggntnccaaaccaaagaaccccagttntggaagccaag

SEQ ID NO: 1565 - DNA, 562 bp, Fusarium venenatum
  misc_feature (1)...(562): n = A,T,C or G
agaaggaagcgagaaggaagctttacaagctancctcgaagaagcgcattttcggcagctcagaaagaagaantntcgcagaaagatggcgaataacggaaatttcgagaagccagttcggtatcagcaaaggataaatcaaatgctggaaagagaggcaaacctagcaagcagcgacgtgatgattccgatagctttgattcgcgacaccactacaccccatactggggacctcagcagcagacttgggtgcctcaaccacagtatatgccacccccaaaccctcaatatggtgctcaagcgccaccaggcgcagcatatcanggccagatgggcccagtctatacccaacaangccctggctatccctcaatgcccggaatgcctccaagccagccatatcctcagtactctgtgcctccgtacccccctcaagccagccagcaacgatacccgcccggtggaagtcctatgacaaactatggtgctccagtacccccagcaggatcgcagcaaccggtatggcaaccangttttgcccctcctgcgccattacagcaga

SEQ ID NO: 1566 - DNA, 588 bp, Fusarium venenatum
  misc_feature (1)...(588): n = A,T,C or G
cgatgacttcacaaacttcgtgtcaactctcaggcataacttcaaacgatcattcttcccagctaatgtgacgcggctcatatttagtcaagtaataattgtatcaagaatgagtcagacccagtcttcacccacagtcatccagtgggttatcgacactcgtcctctgtggccatcagccctcaagactaaagatcttaccaccagtgcttcgcgtgctctttttcttctcactgtcgaggaacaagcctccgttctgagatattaccacgttcgcgacgccaagcttgctctcgcttctgcacttcttaagcgctatgttatatctcgcttctgccaggtccctggtctggagccaagatactcgagaccccgaacaaaccgtgtttatctcgccatgcggcgatgaccactcatcttcaacatctcgcatcagctggtctcgcagtctcctaccgtccacaacctcccgaaggactgctgtaggggtgagttgttgtcatcggactaggatgcattacttactacananagggtggcgatttctcanagcagcgagtcttggtctgaaaaatgaccgaacnatan

SEQ ID NO: 1567 - DNA, 533 bp, Fusarium venenatum
  misc_feature (1)...(533): n = A,T,C or G
gaggnccaaggcgcattgcaaaaggntctatacaatggccaggacctgcatagcattctacgacatattccagttgtgcttaagaagcttgggcaactggagcaaattgtgagcaagctgggtggataccgcttttacgcagcgagcttgctcatgttttatgacggtgacacatcggaggatgatgattacgaaactgcgtacgagtcaaccaccgattgtgccactgataccgaggagacgccacgcaagaaggtgaagagcaagagggagattgatttcaagattgcagattttgccaatagtgtcactcctttgataacattgacgacaagccatgcccccccgcagaacccgggtcaacctgatggnggatttcttaagggccttcgaagccttcnagatttttcttagantccaacgggatgtgangnaggagctggggttgatcatattggacgattntcgagccncatggattacnccggaaatttggacctgagtccggggnggcaggttttnactngcttgaa

SEQ ID NO: 1568 - DNA, 597 bp, Fusarium venenatum
ccgtcatcatgtcttcctttcccttcactatccaagaacatacaatcgaggcttcacatatacgtgaatacgctcgtgcaacatcacactctcaagatgagaagctatatcttcatatcaagcaatacacgcccaaagataacacatctccacaaaagggcgatgtcacaatcattggtggacacgccaatggcttcccaaaggaactatatgagcctctttgggaagagttctaccatgaatctaaacgccgaaacatccgcatccgaagtatatggatagccgatacagcatggcaaggccaaagcggtctcatcaaccaagacgcactcggcaatgatccaagctggcttgactatgctcgtgatattcttcacatgatcaacaccttccgtccaccgccaccaataatggcaatgggtcattccttcggcgcaaatgctctcacaaatgttgctcttcttcatcctcgtgtcttcacatctctcgtccttcttgaacctgtcatctcccactttggcttccacccctggcgcctcgaacgcaggcccgcgaacaacaagtatggtcgtcgcgaaatcttggccctcgcgcgcc

SEQ ID NO: 1569 - DNA, 499 bp, Fusarium venenatum
  misc_feature (1)...(499): n = A,T,C or G
caccgacaacctgtaaggacatgaaatggacggatcttatcgagttagatgacaaggccctagaggagcgtggtgtgaacgctcttggtgcacgccgaaagatgctcaaggtctttgagcaggtcaaggaagccaaggccgatggaaaactgagctagaaacatcatgaccgggcatgcatgcatagagaccttcaaaagtggattgtaaggtggtttgttttctttcagatggtgctgaatttccttcgagttcttgacttgttcgcctttgttacccagggagatgaacgtcaacctgcgcaactcagaattatagtcaagcgcgaaaaccacgagnttatcgcgaccgttatgagttgatagtaacgccttgggtcttatttgcaaaaactgtttacttatttagaaaanaaaaaanaaaaaaantttctgcggccgtcancattnatttaagggctanttncctataggagngnttacattactggcggcgttta

SEQ ID NO: 1570 - DNA, 578 bp, Fusarium venenatum
  misc_feature (1)...(578): n = A,T,C or G
ggnagagaagaaatgaggctattcagcgcgccactcaaattcaagaagagcttggacaaggtcaacgccgagctcgaaagggatcaagaaaggaggcggaagaagtctcgaaaaccagaaagactgagctggagcaacaaattcagaacttccaaaggggagattgagcagttacgacaacaagcacagaccacccagtctgcaccgaacactgcccagtcaaacgaagcctcgggctcctctgagattgtcgctcaactcgaaaagcagctggctgatcttcgcaatgagcttgacagtatcaacggacagaagcagaatgctgagccacaacttgagactctccgtggtgagctgcagtcagctatctctgancgagatgaagtggctaggaagcttgaagaagcagccacaccgtcacaccgtctgcacagactgctcccganattgtcctcaagccaccgaacaacctgccgctngtttttccgacgaaganaanaaaggcctccaggaaaaggcaccgcagctgaaactaangcngccgaattcnaacagaaagnttatgaaattgaaggcca

SEQ ID NO: 1571 - DNA, 940 bp, Fusarium venenatum
  misc_feature (1)...(940): n = A,T,C or G
ttggtcttgaccaactctctgctcgacttcgtcccaagtcggcttactgcaactcactgttaaagccacattcttttccaagttccaaaaaaacgtacacatgttattataacgaatttcatttttcttgtccttcaccttcttcgaccacctaggtcgcaactcatcatcacgaccattcgataatcatttcttttgtctgcaacctatcgaatacccaatgagcctctgaataccaacgaacaacaacaacaacaacaacatnatcaacaacaacaacaacaacaaacaatcgaccttttcactctgctttatcatcacgacactgtacattgctcatatacttcgaatcattcatatttcattgcattagcttgagcgttttcaacagcttcaatattccactccggccttcctgttttaccggttattgacaaatttcaaaaaatcgtttattcgacaactccccttttgtttatttttattcttttttcgagtactttttattccccctttattttctctcttccacaatggagtgcctcaaggaaaagttcgtcggcggtgccattctcaacggacgttatcagacaatttcccctctcaaccatggatcttttggtatggtcttcaaggcgcaggatctcaggacaaacgaagcctgtcgccatcaagtgtcttaccaagaanagcgcatgtcccgatagtaattgggaattcgctgtcgacgagaatcagaagaggagccctccacagccgcctcggagctcacganaacatcgttaacctgattgactctttcgagaccgattctcacatctacctcgtcctcgagttttgtggtcagggcgatctctacaaaccatccgaaagggtcatggtcctcttgaaantgaacatgttcgccaattcatgcttgancttatcgatgccgtcaatt

SEQ ID NO: 1572 - DNA, 561 bp, Fusarium venenatum
  misc_feature (1)...(561): n = A,T,C or G
gatgtctttacccctatcgtcgctcccgagaccgccgttcccgctcgacgcaccgttcacatccctgctcccaaggatggtggtgatgtgctaatcaagattgctgagggtaacactcacatcaaggtcaccaagcctgagccnaaggcgaaggaggaggccaaggatgaggatgactctgactttgacgattccgatgaggaggatgaggagacccgtgagaagatctggaagattggaaacacacttgctgaagccgctgttaagggcgtcaaggctggtggcaaggtcgaggtcacgattaacgttcttgccgacctgagtgtcacccgttacaaccccgtgaaagtncggtggcangggtgggtgttgcgaggaannatttaagagtcttgggattnaatagactcaaaagcaaaaacttganttcanaagccgcaatgattttatgaagtangcatttaangtggatgggatattcaaagcatggggtttatttgggtagaatnttanaagacactatagagggtctccgggatgaaataaaatggaaactttntn

SEQ ID NO: 1573 - DNA, 632 bp, Fusarium venenatum
  misc_feature (1)...(632): n = A,T,C or G
tttcangggactcaatctctactgatatcagtataagacattggttttaatgatttttgtctgactgtgggacacgttganaaatattgtcccattcacacaaacaacctaaagacttagacattgtgagctacccaccatgctccaacgacaggcctttacaaggcttgttgccctaaaaaggatgccgtcacaagtgacagctacaccctttgcgccaagattcaaaagataccaggctttcgatgccgacttggacaaagatgctctcaatgaggctcgatcatggtacgattcatttaatgcatctcaactaccgaaaggcaatactacatttgctcgctccagtggaccaggggggcaacatgtcaacaagactgagaccaaggcaatcacggnatatccagtaggacaattgctctcaatacttccccgatcattacaccccacattcgcaagtccaagtactacacatcaaccaatgactntttgactttccaagctcaagattcacggtctcgggacgcaaatgcagaanacaacaggaaaaagttgactgacgaggttgtgcccatttatnaaaaagccncncctgccganacaagtgtggagaaaaaaaaaaaacatgaaaa

SEQ ID NO: 1574 - DNA, 588 bp, Fusarium venenatum
  misc_feature (1)...(588): n = A,T,C or G
ggaaaaggtacacgtagagtcgccaggccactaccctgcactcaccgcttcgaatccatcgtattaagcatctgctctcaaaagagctagattcgaatcctgaatacacgcaagtggaaccatccctaagaccagtatacaaggtcactcaactcgactccgccatcgacgacgaagaggatacagtagccatgagatgcaacttgcctccccacagggagccgctatctttcagatcctacgatgaatacgaggtgcactacaataagtctcatactaaccgatgcctcgaatgccgcaagaacttccccaccgagcatctcctcaacgtccatatcgaggaatatcatgacccgctagtgactgtcaagagggaacaaggcgagcatacttactcatgttttgttgaaggatgtgaacgcaagtgcatgacacatcagaagcggcggatgcatctcatcgacaagcacatgtatcccaagaacttcttctttgccgtcaccaaggatggtatcgatggtangcgatcctattgaatgacggcagccaccatcgccgccgatcgtcaaccaattccccaagctatca

SEQ ID NO: 1575 - DNA, 613 bp, Fusarium venenatum
  misc_feature (1)...(613): n = A,T,C or G
cgctgccggccttgagaagcgtttcagtgagggcgccttcggtctcggtgccatggtcggacgtctgaaccccaagtggaacgaccctgccccctccgaccctgctgaggctcaggccgctgaagatgccaagttcaacgaggccagcaaccgcattggtcaggagttcgaccgcgatctcgacggctacgctgcttcgtggctacctgcccgcaccattgtccaggaggcattcaacaagcgcacacaatacgatgagcaaggccgcattctngtcctcgaaggccagtctgtcccctggaaggaccacctgtacactcttgaggatggcaccccctctgttctctacgttctatacgccgagaagcctgagcctggtgccaagtggcgcatccagtgcgtgcccgagagcaaggactnctttgtgagccgaaagccactccctgaggcttggagaggtttccgggatgctgagcttgatggaatcagtggtgttctngctgcgtgttttgtccacgcactggtttattggcggaaacaaanacttttgagggtgccaaaggagaatggcaattaaaggcccttgaggggtnaaattacgaactacccaanc

SEQ ID NO: 1576 - DNA, 600 bp, Fusarium venenatum
  misc_feature (1)...(600): n = A,T,C or G
gtcgtatgccatggcttccgacggcggatatattatcccttctaatcagtcctctgatggatcctccgatcgaagctctaattctagtcctggtccaaatatcaatcttaaaaaacacagacgatgcttagccaatgtccgaagacattatcccaagtatattattcttgtcttggttttcggatatatcggtcaaacggcatacttggtttggcttcggaatggattagctcgtattgcgaatgatccttatgataatctgttctataacctcaaccgcaatagcccagaaatttgggatgaccaacaccaagccttccttcgcaatgtcgatccagttcctgtccactcacacaacgacgaaaaccgacacatccctctttttgaagccctcggttctggctgcgttagcgtagaagccgatgttcaccttgaaagacaatgacctactggttggacattctggaaatggcctacacaaagaaaacaatctgntcgtccatgtatctggaccaatcaaacgaattttagagatgcggaatccaggcaatgacacccgtcgaagagtctacaaccgtcatcccgatcagacacttattc

SEQ ID NO: 1577 - DNA, 580 bp, Fusarium venenatum
  misc_feature (1)...(580): n = A,T,C or G
gtggactgatataagaagaagaagccatgattctctactgccaattcatccaaacaaacagaaactcgcacttgtctcgatcaacatacgatatctatcagaatgtctcttacagttcaccatctccaagtctcccaatcagaacgcatcccctggttgtgtgaagaactcaacatcccttatgatctcaaactctacaaacgctcccctcttctcgcaccgccagagttcaaagcccttcatcccatgggagctgctcccgtgatccaagatggtcctgtcacactcgcagagagtgccgcgtgcatcgagtaccttagcaacaagtacgccaacggatctctcttcctgcgcccagacaacccagcctatgccgactttctctactggtggcacttccctgccggtactctcgggaacggctctggggcgcatcatgctgatccgttccgccaagctcggagatgataaccccgttgtgcagtttggaaaagcaaagtatagccaagctttgaagctgctggacgaaaaggtcaaagaaaatgaatggcttgncggaaatgaattttactgtcgctga

SEQ ID NO: 1578 - DNA, 609 bp, Fusarium venenatum
  misc_feature (1)...(609): n = A,T,C or G
cgacttcatctccagccatatcctccccataggaatcctccgcgcttccatcctcgtcgctgcaccccaagctctccaagctgtaattgctggcctcggcgactggtacacttggcagctggccgtgtccattttcggcgccaacagcaatgtctcattctttgctctctttctgcaacttttcaacccttggcaatggtactgctctacaagaaccttttcaaactctttggaaatgactctcactgtaatggccatgtactactggccctgggagcttctcggtgtggcagagacaactaaggagaaccctaaacctacccctattctcaagaatctccggtcacttcgggcctctctttgtcttgcagctttggctgtggttctccgacccaccaacgccttgatctgggtgaccattgtccttttcactattacccgggtctcatttcagggaccttcacctcttggtctttcaacagttctcacactgattcgcgaggccatcttgtgcggttctctgatcctagccatatccgctgcctcggaccgcagtactttggcttctngacgtttcctgcttacaacttctacactttaacctatcaa

SEQ ID NO: 1579 - DNA, 588 bp, Fusarium venenatum
  misc_feature (1)...(588): n = A,T,C or G
ctgggttctcaacgctgaaacgcgttcgtttctttccgaccgtaccatgtggccgttcgctctcgctttcttgctcattgttggcccaggcgaggcattcatcaacaaccttggaacaattatcggaacgcttacgccccctgaaatggagggtctaagccatcgtacctctgcggcgacgcatgtctccatattcggaatcaccaacaccgcctcgcgaattttcattggtacacttacagatttgttggcaccgtacccccagacacagcatgttcaaggacctcagacacgctctgcagtgagcagtcggttctccatctcccgaattgcctttatggcatttttcgcaaccatgctgtctgtcggtcttctcattctacctcaggtctggtccanaaccatgctgaacgcctctggcttgtttctggccttgtgggtgcangttatggaccatcttcaaccttacacctcttattgtgacaatatctggggcttgaaaatttgctaccaattaatgtctcattngcatctgcccgntgccggattganatctngggantcatttactcccgactttcaaaacgn

SEQ ID NO: 1580 - DNA, 463 bp, Fusarium venenatum
  misc_feature (1)...(463): n = A,T,C or G
cgacgaagtcggtctccagactgtgcgctggcacaagctctgtatcaacgcggctatgaacccctcggctgtcctttccggtggccgtggaaacgcagacatggtcgcggacgacgagttgcagcgacatctactgggtgtaatgaacgagatccgngacgctgtaccaaagatactgggtcgacctttcccagactatatggccaaaccagagaagatcattgaaagcacggcgcggaataagggtgccaggccgagtatgttgctggactgggaggctggcaagccgctggagcttgaggtgatcttgggcaatcctgtgagaattgcaagggaaaggggtgttgagatgcccagattgaaagcttgatgcgcttttgaggtcgctnaagggataaggaaaaggagaacaagggaactgngacaatcggtnccatggacacaagtanaatggttatttggc

SEQ ID NO: 1581 - DNA, 461 bp, Fusarium venenatum
  misc_feature (1)...(461): n = A,T,C or G
atgggtattgagaacgtactcagcaacgctttggtgggcgtgagttctgtcgttctttggatcagccagaacatggaagacgagtactcctacaacctttccctgtaaacaccataaatcgccacgagtcgggcaacagggtcgagccaacatcaaggcgcattgatgggttgagttaagcattggatgtacgattaataacagaagtctaaagcacattgatgggaggatgataccccttctgagaatcttgtgtctcagaccgcaggcaagttcttctaaacgaaggttaaacagatgccgttggattctgtttcatgattacggagttgcatgcgatttatagtcatcagtgcagtcttggcccatgtttgggatgtgtggcaaaagtatatttggtttggcaaattgttactcattagtgaagctctgtgagcctcnaattaaatcgtttttgcnct

SEQ ID NO: 1582 - DNA, 961 bp, Fusarium venenatum
  misc_feature (1)...(961): n = A,T,C or G
ttnttttatatttgtggcgccgggaacaacgactgcgatggtgctcgcgctgctcctgtcatcggtcgagcttgggactctaaccctcgcaatgcgcccagctcgctcgtcggcggtcgcgccggcgacactacctccaaccgccagttcttcctctggaggttcggctgggtcttcatcctcatcaccctgttcttcgagaccattgcctttttcaccggcttcattgcctgctgcggccgtctcggcgccggcatctctggcttcgcgtccatgttcgccctgttctgctcctctgttgctatgtccctgatgactgctacttgggttctcgcccgcaacgctttcaagagtgcgggtcgttcggcctcaatcggtcgctacgcctttggttttgcttgggcctcctgggctgctcttttcatcgccaccgttctcttctgcctcggcatgcgtggtgacaanggctccagcggcggttacagcggtcgctcatggcgtcgcaaaacgcagcgttcgcagcaccaacggttacgaagggacgccgtgtgaaggacgactactcttaaactatcactcaaaaattgccacttaggacttatttaaacgatcggttttggaagggggcgttggcaaggcgttaatcaggaactcgagaaaattcaacgtcaattttgcagaaaccaattgtcatctagccggccaactgcaatgcccgcaaatgcggcggctcaagtgttttcgacagcttgattttgctgttcatatttgatctaancactgcctgttgtgtttggcangcttgtacacatgaaaccttttggngggaagcattgaatgcttcnaaaatgttgaagcgaaagttcnacgagatctacgagangcttgttcgcaatcgcgtaatanttatgaatatatgatctgcagtaatacaagtnttttcaaattnaaaaaaaaaaaa

SEQ ID NO: 1583 - DNA, 616 bp, Fusarium venenatum
  misc_feature (1)...(616): n = A,T,C or G
cctgcccttttaacatcagcctctgagtctagcgatgatggaatccatctaagtccggctgcagctcgtcgattcgctcgccgcaacctacgccgccaatctccaactcccgaccttgttactagcctcgtnaggccaccctccccagatactttctacgttggagcacagctccctcatcagggcaggcaagatgttagaggccgtatcgattcttcatactcttnaggtgtattaataccgaatgtcaactcggaccggcggaccggacccatggcttctcctcacctttcttctctcggaatccccaaacgctatggaggaaactgcatctttgacatgtactctttaacatacgtcacggaacccgacccaaacttactgngccccatttgccacgatcctctngnggatcccgtnacaactccttgcgaccacacattctgctatcgatgtttacggcaaagcattgattctagtccatcagggaccggttgccccatcgaccgggaacctttagcatggcccaattgnttcagcggcgccacgactnatncgaacgcagttaacaacatgaaggncaagtgccctttatcacncacgaaggatgcaagtn

SEQ ID NO: 1584 - DNA, 481 bp, Fusarium venenatum
  misc_feature (1)...(481): n = A,T,C or G
ntgaaaatttgacagaatntgagcttacacagcatnggttaacccagnaacgntacttctctaccactacgaagatactctgttctatctgntggaagacaccgtctgcgtccgacgtgaagctacttgcgactgcgatacccntgccccgaactcaattacctgtaccgnttcagctntatcgaaccttgttgtagctcgcctcaatatgtctagaangagcaacaccatgtcaggctctaacggcaacaccaaggacgttatgtcatctaacagcccagncattgacaaacaaaagaccctttttctgctgatgttggacacttttctntggtcgtgccatgcaccttgccgatttgattaccctatgaacgggncatgcggggcatgtcatttctcttgntcgaatcncactcggggatcccaaggatttgatatctctgggtggtccttnttctgcttcggnttttttcgactcttt

SEQ ID NO: 1585 - DNA, 627 bp, Fusarium venenatum
  misc_feature (1)...(627): n = A,T,C or G
tgacgaaatagtcttcaaagaacttggatcgccattccctttgaacggttcaagtactttanaacttgtggagtgtgttatccgagccgagctacctgacgttggtggaaacccaaccgagagattcatcgttggtacgagttttatcagcgatggcgaagtggaagatccgaatggcacccttggccgtattctggtccttggtgttgacgcaaaccgtcaagtgtaccagatcgtgtcccataatctaaaaggcccttgtcgctgcttagggatgattggagacaatattgtagctgggctgtccaagacagttgtggtgtacagcttttcgcaggagacaagcagttccggttcactacagaaacttgctgcttatcgtccagctgctattcctattgatatagatgtatcaggaaatatgataggtgtaggcgatctgatgcaatcactgtctttggttgaattcattccggcacaggacggcaataaagcgcaattacaggaacgagcacngcatttcgagtcgctttggaccactgcagtctgtcatatcgaaaggggaaaggnggctnagangcggattctcgangcaatctttgttgttnttcaacgaaatgnggatgc

SEQ ID NO: 1586 - DNA, 306 bp, Fusarium venenatum
  misc_feature (1)...(306): n = A,T,C or G
cgtactttttcatcgacacagcacgcancctaatgagttaccttgacacgatcaaaaaggttctgaaaccaggtggtcactggatcaacctggggccgttgntttatggaaccgggccgtttgcgcagttgagtttggaggaggttttggtggttagtgaagctttgggtttcgagtttcttgaaacagatganagttggggaaagaanacgtttgangaaanaacaataatngtcaatggaggcggcgtntgggtttagatgacagggctttgacaaagagcgcatataatgcgcagtttttggg

SEQ ID NO: 1587 - DNA, 638 bp, Fusarium venenatum
  misc_feature (1)...(638): n = A,T,C or G
tgctgcctactggatgttatgccggaccctttggtgctcggccacggngaccttttatgtggcaacatcattgtgcaagagtcggctgatggcatggaggctgtgaatggtgctacagatgtcgcaacagtgcgcttcatagattacgaacatgccacctactgccctcgggcgtttgaacttgcgaatcatttcgccgaatggactggcttcgagtgtgactacaccaagctgccaagcacgtcaacccgccgagactttgttcgtgagtacctcaagatgcacgccgaccttnatcggcaacaccaacacaaacaagactgccatatcgccgactgcgacttggcgagaaaaacaaaatcagatctaccgggtgccaatgacgcccaggtggagaagcttatgcgtcaggttgatgattacaggggattccctgggttttactggggtctatgcgctctcatccaggctgagacagcgaccggaactatcgactttgactacgcaggatatgctcaaaagcgctttgctgaataccaagcatggcgcanggtccaagatggaaatgtcngatctggngangaaaatcccttgcgtgaaaanaaatgggcgcttttgggagggcatccaaaaagcnn

SEQ ID NO: 1588 - DNA, 804 bp, Fusarium venenatum
  misc_feature (1)...(804): n = A,T,C or G
cggtcatccaactctcgctttaatccagtctctcattaatctaatacacaactcaccaagtcactnttttacttgtttaatcttcaataccttcacgatgaagttcagcctcttctctttcgtcgctctggcctcttccgccatggctgctcctgccgtccaggtccaggccaaggccgtcggtgccggtgctgtngtccacgcccgacaggttcccgccgttcccgccgtccccgctgccgtccccgaggtcgtcacctccaccgtcagcaagaccgtcaccaagaagatcacctntaccaaggtcaccaacaccggcggcgtgtcaaggttcttaccgttgctgtcgacgaggtcaccgttcaggtttccaccatcaaggcgaccatcttcaaggtcaagaccggcactcttagcaaggctgctgccatcacccacgtccaccagaacgttgncatcatcaacgacctcctaccaccgttgtcgaccaagctcaaggatgttgtcagcatcgatgtcaacgtcntgacgtcaagncatcctcggncttgtcatcaagctggtcacnagctcgtcggtgtcgctaaggacatctgagcgtcttcggtttgacaacatcttgggaagcgcctcaactcttttncgttcgtgggaactttctnaacctngttacgaccttggcggggatatcgtcccggngttttganaatntaacaacggttntgagcaccttttcggtantccctnggcccgtnattaaaccggtttcaccgttgtngggggcttaccggttacttaaacagg

SEQ ID NO: 1589 - DNA, 1043 bp, Fusarium venenatum
  misc_feature (1)...(1043): n = A,T,C or G
gcaagaaacaatcagttatacagtcttctcacggataatatcataaacaacaacaaaaagatcgacaggatcacccggcagatcctacactttccataatatctacactacctcctactatatacatttagaagccagccaacaactgctgctctatccaccttccattttacaatcacaaccacattcaaaatggagacctcaccgcaacactcacgatctgcctcttccgcctcgcgccggtcaaaccgatcaaacctttctctcgatctctctaaccttcccgccatgaccccgcctacacctccatcaaacactcttctcttcaccaacctcaccgacctagccatcttcctccccgagaaccttgaggtcatccgcgacctcatcacccactccgctcccatccacgcttttgcgcccctaaaatccttccgtcgcatcgtcgtctccttctttgacgagcaggccgccattgccgtccgccaggtctgggataacgaggctatcatgggccagcagtgccgcgtctactttggcatgcccactcctgtcgacaagcgcgatgagcatctcgcccttcctgacgccggcaagctcttcttcatctctcccccacctagccctcccacggttgggagatgcgcatggaggatgcgcccaacaagctggttcacgctgaggatctcgccgaagccctcgctaagttgcaccaccgcccggacctatggacgaggaccagaactcgcctgtgactccccacgactctgctctttcaggtcgcacacgctcttcgctctttcactctgatctacaaagccccgaaaacaaaaacaagtatgcccgctgtcattggtgatgacatgacagatgagcctatcgagtacaggcctgtggaggcaatccaaacccatcatggngcatactggttgacctcttgtcgaagctgatgcaccacgcctaaactgggcacaaaatcaatgaacaatggtggttttactttggcggttnaagggacacaatacnggaatnggggggtnggg

SEQ ID NO: 1590 - DNA, 923 bp, Fusarium venenatum
  misc_feature (1)...(923): n = A,T,C or G
cgctttcgttaataagagtcactcttgttgctttcagatcatttgaagctcactcgctatttacaacacatcaatcgttcaagtaaactacctacctacctcctaatcaacatacctcaaccaaaatgaangctgctctcttcatcgctgctgccggcctcgctgtcgctcaggatctcagtggccaacccgagtgtgctctcaaatgtcttaaggaattcatccccaaggccggttgcgagctcgacgacaccgcatgccaatgcgagtcctctttccaaaccaagctcgctcccatcatcacaccctgcttgaccgaatcatgccaggttgaagacctcctcaaggctcagcaggctgctgtcgatgcctgcaaggcctacgccgccaccgctggcgccggctccaccactgtcgttcccaccgagantctcggctccgtcaccgtcagcatcgacacctccatcactggctctgccagcgttcccgccatcttctcaagcatccctgatgagaaacccattcctcctgttactcccgtcccggtaacggaacaatgaccaagaacatgacagaaggaggtggatccggaagaagcgctgtcacacccactggtacttccggcggcggcggcggaagcggaagcacccggtggtgccagcaacggttcccaacggacgcttggtgctgctggcgttggccctgccatggggcttctcgccatttttgctgctgcattgctctgtaagagctctcctacatactggatgtttgtacataatgcagtattaccatggaacaatttgggaaagctactaactggagttattgcgaangaatcacgacatgaccttacattgaagtttaatntttcngaaacacaaaaggttgccattccccgnntgggaaaactataatagatt

SEQ ID NO: 1591 - DNA, 634 bp, Fusarium venenatum
  misc_feature (1)...(634): n = A,T,C or G
gttcgcaatcgaaagaatgctcagactgctgtatccggccattggtcgaggcgaatattgaacaggaggacaaagacatatggcttttacgactcaaactacaccatgccctgtatgacggagtcagtcttccagcactattaaagcgtttctccgagttactgagtggcgctggcactatggaaaataagggcctcttccagtggaagcaatttgctatacgccacactgtgaatgaagctcgtattacaagacgagaattctggacaacgtatcttaagggctcgtctctcagtcctgtcatgatcaactcggaagtagatgtcaagataccgaacttcacatttgaaccagtctgcgatctcagacatcggtcctatccaggtccttgctacccagtctggcgtttccttccagtctttgtttctctcggcttacgctagagcacttgccaagcanaacaatgtctctgatgttgngtttggggtgtatcttgccaatcgagctggtggngangaccttccttcaacctaccccacttgaacttgtcctntaanggcaacttgcctgcaatcganctttaatagntgccgccccnacattcaaanggatattcnctgatcacatccgacgg

SEQ ID NO: 1592 - DNA, 433 bp, Fusarium venenatum
  misc_feature (1)...(433): n = A,T,C or G
cgtcgccttccaaccattttgtgtttttcaaccttgcacaacactcntttnttacgcggccagatagttacaatggccaacgaaagtgatcctntnttatccgggaccggccacgaccgctccgatgcccatgccgaaagcaaggcccatcgaaactcgcgtctccgtgagctcggcctgtttgcctgggctttgatcgctactgccgctgttatcgtggttgctatctggactcaacatgaacagcagacaaagcatgaccacaacacgcctgcgacgaagcnaaatctcgtnttcatggtgtcagatggcatgggccccgctacattatccttgactcgcagctaccgacaacacgtagaagacctcatttgggcgatccctcacactcgataagcattttgggggcacaagcngactcgntnaaaaagtt

SEQ ID NO: 1593 - DNA, 591 bp, Fusarium venenatum
  misc_feature (1)...(591): n = A,T,C or G
caaatcaataatatctcatattttggagtcaatacgcattctcacgttatctgtcgcagcaatcaaaacagcttgaaacaatcactcgatattactacgacatttcgcaaccgataaactattcgcgtaacaaacctttaaacaaacgccaacatgtgtttcagtgatcccaagcccaagaccaagtactactaccacgaagagatcacgccttctcggcgatacaccggtcatcatcaccaccaccaccatcaccatcactcatcctcgcgctctccacgagccagctacacgagtgtctcaaggcggtcttacagccacagcccgcgcaccagcgaacgtgttgtctacgagcgccgttgatcgtccagagaggagcaatggcaaattgcggggtgtaattgaaaaaagtatgacnttntcaaagcaaagtaacacttggangctgcgttagnggtttggcaatgggtttttgtttgagcgaacctttnatttngggggggaggatattgtntgttaaaanatggtnaancgggcntttttgcnggcaggttaaccctgcncgatgaatgaaagncttgacantttatt

SEQ ID NO: 1594 - DNA, 827 bp, Fusarium venenatum
  misc_feature (1)...(827): n = A,T,C or G
tcggattccaaatcagccgacctgctgcaatatgcacaggaatatgcctccaaagatgaagacctctacgaacttctcggcgtcgatgccctcacacccaaagaggagattcaccgcgcttggagaaagcgctctctaaagtatcaccccgacaaagcaggcgataaattcgacccagaagtatgggaaaagttcgaacgtgcccgcgacatcctttccgaccccggggcgcgcggtgcctacgacggcgccatcaaggccgcctcctacggaaacaagagcgcgaagctatggatcagaagcgcaaggctctagtcgacgatcttgaagctcgagaaaacgcttggaaggttcagcgagaagaaaaggagcaacgggagaaggatgagatagagaaggaaagggcacgacttgtcgaacaaaggcgtctgcgcgaagangaggaacagcgtcaagcttcttgctgcgcaagaagtcgangatcttgctgaagcaaaagacgtctgaaggaaaagaaggagaagaagaagcaggatgaggcganggaaaaattttttgcgtaagtcgcgaatgggccgcaaagctacagatgggaaagccacancttggccaatcaacggngccattaaactgccaggagattcttcgngggtttttggcccggacanaactttctgggaattagtctgngacaacttngtgcggttcaggccgtnaaaactgccaaanaattaagcaccnccggcgaataccacaaccaaacanggcttttttaaaccaaanacaaggnttnccccgctgaaangcgatttgttgacnggcntttt

SEQ ID NO: 1595 - DNA, 793 bp, Fusarium venenatum
  misc_feature (1)...(793): n = A,T,C or G
tccaaggacaaaaagaaagataaggataaggccanggggaagcgaaatcctttcaatctcgaggctgagaaggatcagatgaagtctgtcattgccgactcctntattgcagccacgaatttgatgaattcgcttcaaagcgttaaccgcgaagttgagcgcatttcggaaaatcaagttgcggnggaacgtttcgaagcctgtaagctcctganacnaaaagttttgcgttatgttcatcatgtcnaaaaanagcagtggttaggagggttactccacgccaatgacgagcttgtccacgctctcatgtnatttgaacagttcgattgctctattgacgcggatagtgactctgatgacnaacttgctgagcaagcccatctgtaccgaatggctacaatcaaaggcaaggaggccatggccaaagcagcccgcccagtctccaactacttcgcaacccccagatctgtcccgagctgaacatttcacattctcctgctcatgctgctcctcctcgccctcctccaatgtcaaagcctcactcaaacccacctccccaacccccacggccggcagcagtgtctccgcctccacaggatgaagaggatgacgatgacccttttggagatcacatgcctcgatacaccttcacacgagcgcgaacagnctaggtggtgacgatcgaaagcaggcgtcaatatcggtagttggaatagttgaattaggcacaggctttgtnggtagaacatttangcacgacattacagtgctatatcaaatatcttaccattcg

SEQ ID NO: 1596 - DNA, 638 bp, Fusarium venenatum
  misc_feature (1)...(638): n = A,T,C or G
ctgggatcattacgtcccttcgccatgcttntttctcgccatggaagtcttcgataacttttctcacgacggtattcgctacgacatcaccaccgagcaacccctgcagggccacgtgctgatcgacagcgatggtgacttttatgagttctactcgagagaactggatcctcttgtagcacgatacttccgagttcgtcacgctgcaacggcaggaaactatcccaagccgtaccccagcaatgcggttctgcgctacatctccagcaagatgcccttcgctgccaatctttccgatcccgagttcatccccactcggctcatgcagttcttcgacgttctngaaaagtacttcccacgccaccgtcttgtgacgtctgactttgactggctacctcaagctgtcaagggaatgaatgcgcctgttgttcaaacaaggtaccacagaaggatgggcccgtcacgacacctttagttcaccaagggttatttttgacattntgttccctacagacttncaaaaccacggaagccatntaccgngccattacgggtaaagctttccggtgttccgtcgcatgggggaatttcntgccccaagnggggccntnttttgaaggacacaaaaaactcnnaat

SEQ ID NO: 1597 - DNA, 577 bp, Fusarium venenatum
  misc_feature (1)...(577): n = A,T,C or G
ctacatcttccttctcggaacagccttcatgaaggccaagtggcgagcgaggatcggcagtttcctctctgtgtacagtttgatcattggacgatgggacatggccacgttcatgggcggcatgctgctttcggagcatgatattcgacnatcatccgatctgccaccttcagctgctggagccaaaggacgtggaagagacttccaacgaacgaccaggggaaccgtgttgagatgggccggtatcatcttagcgctctacttcctttcataccccgacgccggcgccgaatacactcccggctttgcatatctttcaacctgggtgccacggtactacatcccactttccggctggatgttttaccangcgatgggtgcggttcttctcgttgcttgcatcttgcgcagtccggcacttgttcgcctgctcgaaaatcgcttcccgcagtacttgggcaaggttnnttctcactgtatcttgtgcatgggcctgtgctaccantctccggttctggataatgccccngttattgatancttggaaanatggcggtatncgtcgntgggttatctn

SEQ ID NO: 1598 - DNA, 583 bp, Fusarium venenatum
  misc_feature (1)...(583): n = A,T,C or G
tgtggttctcgtcttgagtggcgttgactcagagacccaacttggccgtaacctgcgagctgtgggactcggcaatgatggcattgaagtcatgatgttgccgaatctgaactctgcccttgaaagctgtgagaatgagttgctcaagactctctacgctcggcagaaagagatcaattctttgagacgtatatcggcacagtcagcccagaacttggatgttccttctaacaagtcgtctggtttctcatcatttgatccgcctttcaactcaccacgtcgcaatcatctcgcagaggccgctcgcgatactttgagtagcatcgatgtacaacgtccgaanaagtggcaganttttaaggaaccccttcgcctcatgcttcaggtttccagggtctgagcgacaaaaacaaggacttctggttcccagcaacctcttacttctctcgacgtgaaattccactgggactgttctttccggcgtggaaaanaagccacggattctaccttgttgancgtggtatcgttcgcnccaantacaatctcccccaaggatggtggtgcgaaacattgtcgctggaac

SEQ ID NO: 1599 - DNA, 412 bp, Fusarium venenatum
  misc_feature (1)...(412): n = A,T,C or G
acgacgcccntactcccggcggcgcactcggtgccccaactcctggtgccatgaacgctcctacacctggtgcttactcggcgcctacgcctgctgctatcagtgcaccaacgcctggtggctggcaaggcggatggggagcagattcggcacctactcctgctgctggtgctcccacgcctggctactatgctgctcctactnctggagcaagttacggtccaccagagactcctgcagctaccggtcctcgatacactgatgatgattgattacaggtagtacaagactgaacagatattggggtgtgtatatggnggatgaatgcaaaaggcgtttggggaagacaagtaattgntttaattaaaaaaattttgggcgtacccccatttagcattggaaaaaaaaaaaa

SEQ ID NO: 1600 - DNA, 364 bp, Fusarium venenatum
  misc_feature (1)...(364): n = A,T,C or G
aatacaacaacaacaacaacaacaacaacnctttnatcacaaaactatatccaacatgccttcttacatcgttacctgcaaggaagacgccagcgacgagcaggtccagtctgctaagcagcacgctattgaccagggcggcaagatcggacatgagtacagcctcattaagggcttttccgtcgagttccccgcagattccgttcagaccctcgagagtcacgagcatatcaaggctgttgaggaagacggcgtcatgacgacccagtagagtccaggaataaattataagagatgggcgacatcctatagatcatcttgagctctgttgcactggcgttctggaatataactattaaactac

SEQ ID NO: 1601 - DNA, 619 bp, Fusarium venenatum
  misc_feature (1)...(619): n = A,T,C or G
tctacaggccgnctctttcctcagcaacctagaggttgtgcaactactgctagacaagggagcggaggtcaacgcgcagggcggcttatacggcaatgctctacaggctgcctcattttgcggcaacctagagattgtacaactactgctagataagggagccgatgtcgacgcgcagactttgcaggctgccttatatggcgggaaccccgagatcgtgcaattacttaatctgaacggcgccaagatggtatccaggaagcgatctagctcgaaaaacgtcagggaacgaacgaagttacctcggctttagactctaccggcttcggttgcacctacgaccaaacctncagcctttatgctgtcgaagccatggcccctacctgtcattcgtacccaagtaattgcgttgatgttggtattcctatctttattctactccagtcgaatacagacgcacgggtaattccttaggaggattatgtttgatgcattgacgcattgagacggcgtcgtgacaaggttngnaaagcangcgggagaagaacattagtcagaatgggatagtgatagactcancacatatgntagggatttacctccagagagttgagagaga

SEQ ID NO: 1602 - DNA, 380 bp, Fusarium venenatum
  misc_feature (1)...(380): n = A,T,C or G
cgaaaagatgggcgctgaagcccgaactgctcattctgatgagttcaagaatctcgagaccgagatggctttgcnacaagatggcatggaaaagatgcaaaagtcaatgagcggctacgtcaaatggntgtctcgtcgcaatgaactgatggaagacaaggagcgcggcnccccaatgtcgtctnttggncgaactatggccactcatggggaggactttgagcaggattccgagttcggaaactgcctcttatntttgggtcgcnccaacgagccgtattggtggtatccaggactnttatgttgactgcgccaatgcgacctggctggacaacctcgaagaggagtttggcaatgattgcnaaaagtccanaacgctc

SEQ ID NO: 1603 - DNA, 559 bp, Fusarium venenatum
  misc_feature (1)...(559): n = A,T,C or G
caaactcaacgaccttgttaacgtccacatgtccacgtagcacccctttccttggcgaacctcaatacacgttatagccacagctacaagagcaattgatccatcgaatcatcatcatcactacctcatcgcgaataatccaccacctccgtctgtataatgttcacatccactcggcgctggttgcgcaacaaccggacacccatcgctgttggtgtgggcgtcatcggtgctggctatgtcgcgactcaatatgttatcggcaagcttaacgatgctcgcgagcgcatgagcagcgatcgtatcgccaaggagaacttgcgacgtcgcttcgaacagaaccaagaggattgtcattcaccgtctggctttctgccttccgaacgactgcattatcgaggcatgacacggacagatcacactagagattaacagatgaaggcaccaaggcataaagaatggcgnaccaatttgcggacaccaagcttgcgccacattgcngagaggacgganactggaggcaaacagacggtcacccntagntccacgctacattaag

SEQ ID NO: 1604 - DNA, 158 bp, Fusarium venenatum
  misc_feature (1)...(158): n = A,T,C or G
naagcncttcttacgcgacttatctacagcgtcattgtgattcaactgtttctgnggctagttgatgggttcccgtttttgggtacaatcttgacgattgtctcgcatatcgtttatctgggcaacatgagaccttcctttgaacangcaaanaggac

SEQ ID NO: 1605 - DNA, 782 bp, Fusarium venenatum
  misc_feature (1)...(782): n = A,T,C or G
caaaactcctcattcaaatattccccgttcctcaacaatcctttaggatccattcatccacaacaactcaatcaattccacccctcatcacattaccccgcctccatcatcatgtcttacgccgatattgctgccaagggtcccaagcagagccccgaggatgctgctgcccctcaacctcctcaaatcatgactgacgagtctgcctccaccgcctctctggtcgacgttgacatgcctagcgtgcacaccgtccccaacgacttcctcgagcaggagatccagaccgagactcaagcagcccgcgtcgagcgagaggaggaggctaagcaagagaagcgaaagcgtgactccgccgcctcaaaggtcaaggagaccgacaactggctgatccagcagttctccaagctgaccgacggcgaggccaccggcctgactgtcgccaacctggccaccgtcgtcagtctcggtgccttcctcggctacaagggctggggcctgtacgaaaagggtaggctcgactggaaaggccgtctcttacggngtcggtatcctcgccagtgccgcggctgctcaaggcgcttgttggaagatacctgtacaagggcaagaagggtgggtctttnttaaaaagatgatgaaaagtgtgaaagtcaacaaaaaccacaggttgcgaaagcccttgcgcagatcaactacagaacttcagatcccgnaacaaacaacgactcggactatgaagaagaataccctggngggaatttnttgaaggatgaatggaa

SEQ ID NO: 1606 - DNA, 634 bp, Fusarium venenatum
  misc_feature (1)...(634): n = A,T,C or G
cgaggctgccaagttgtttctcggaaacggtaacggtaacaaaagcgccaataacaacaacaataccactaacaacaataacgggagtaatggcacgccaaanaccccaacgtntgagacgcccattaaagaaacccccaaacccaccaaaactcgagcagcatcgcggtcaacgaagcgcaaaanagaaccagagcccgaagaacctacanatatcaacgggagcgccnaaaagaacgagaaccgacctcaggtcaagcggaccaaaaccgaaacgccggtccctccgcctacgcaactcanattaagcangggcccgagccccgagaatccggcaccagtgcctacaacagcgcccgttgatcatnctgtggcatacataccgagacgcctgtacccatacccattcctgctatatcaaccagggggtcggcaaagtctccaacacccaacccagttgcagcgtcaaatactggacctaccaagcctctggtccttctnaagaagaccccaatccccttgccgttttctgaangaanaaaatcggtgaccccttgtgctgcccagngnggggaaaacccccaaaaganaaactcggggngatgcnacaaaagangaccaagnaggcacacnt

SEQ ID NO: 1607 - DNA, 632 bp, Fusarium venenatum
  misc_feature (1)...(632): n = A,T,C or G
cagacagaaacctcatttcctatcccctggacgtaatcgctccagtttctgatttctcggctcctctgaacgacaacccccgacgagcgccgcagagactggctaaagatgtgacttattttgccacagctaagatgaaggacagaatgcttcttttctataagcgcaaggaaggtctacatacgtcgttcaaggttcttgagcccattttccaaaagtctaccgaaaagaagtcgcgactctttggtggacgcaagacaagtggaggatccgcagagacattccgtgatttcgacgagtttttcttcccaactgagtgctactcactgagtctgttccaaacgtacattgcagtcgcaacagccaagggagtagaaatgctcacactagacaagaagcaacccgatgtcaattcctgatctcaaaagcaccggcaatcgctacattgccagccgcatccagaatcaaaagcccgctnggtatgttcagactcaacgagaatgaatttatngtggcatacnaagactgngccgngtccgtnggccagcaccgngatgtaggccgccacttatnattgggtcacggccagcagaagaagctcgtggncgacatttacggcaggatntgntttt

SEQ ID NO: 1608 - DNA, 593 bp, Fusarium venenatum
  misc_feature (1)...(593): n = A,T,C or G
cactcacacttacttaccaaatacccaaaccaaatatatcaatatggctcccaaggttctcgtcgttctgactagccagtcaaagatgaacaatggcaaccctaccggctggtacttgcctgagctcgctcacccttactacgacctcgtaaacgccggcgtcgagatcgtcactgcctctcccgcaggcggtgaagctcccctcgaccaaggctccgtcgagatgttcaaggccgatgaggaatcagtaaagttcctcaacganaagaacaatctgggagcaaaccgccccctcaaggaattcctcgacaattcctccgaattacgaagccattttctaccccggtggtcacggcccatgttcgatctcgtccacaaaganacttccatcnacttatcgaagaatttttacaagntggcacctgttgctccgttttccacgaactattgtctttactcagttcanaatgatgaaacccctcctgaggactttaagctactggtttccacactctnagaagaaaactnttggttgaataccctatnccgttctcctgagaanaaatacttttggtggaaatttttttaggntg

SEQ ID NO: 1609 - DNA, 649 bp, Fusarium venenatum
  misc_feature (1)...(649): n = A,T,C or G
ttcaactcaactctttagactactttggtttcaacacacatacaatcaatcaactcctattcaactatcccttacataacacactttcctaaacacctcccaactacccccatcctcattcaacatcatgtcttcccaaaccactgctcaatacttccccaagatctactccctcacctctgttgatcatgctcgctccgtttacgacgagtgggcaaagacctacaacgaggagatcacaggcaagggccaagactatgtcggccctgccattgccgctgcccatgttccccaagccctaggaactcccatcatcaacccagacgtcgagatccttgacgctggctgtggtactggcctcgtcggaatcttcctcgctcgtctgggcgcaaagaagctcgatggtgttgacctgagccccggaatgcttgaagaggcccgcactacaggagcataccgcaacctggacgtgacagacctgtctcgccccttgtctgcaaagaatgactcttatgatgtcgtgacgtgtgttggcactctgacacagtctcacgttggtcccgaggctatcagtgaattcgtgcgtatcgggaaacccgganggtacatctggnccctgtattccgtgaaatctggcanaatggaggct

SEQ ID NO: 1610 - DNA, 657 bp, Fusarium venenatum
  misc_feature (1)...(657): n = A,T,C or G
cctatgcctcccaacatgcagccaatgcagtatcagcagatgatgaatcgcggaccgccgcccatgaactacaactaccctcccatgcaggctggatatggtggtttcaatggccctaacccttccgttgatcagtatcgccagcagaacatgcctaacggaagccctatccagccacctgtttcgcagatgcctcagatgccggctggccaaaccccgttcgcccctcccggattcggcatgggaatgggtaactacggctacggaaatatgggaaatatgcccaacatgggatacatgcaacaggagcagggtaaccctagaagaggtcgcgtaagacaaccacagtctcgcaatggacagccaagaagagggggctaatcaactattttcagagatgatcaagacgattgtagcttcgcattgctttaagagaactcaaccccgttgggccgatcnttgacanggtttttttctaagttttcanacaagttattgaacacgacgccttgangaggtatggnggttttacttggggcaatacaagcgaaaacacaaagcgttcacaagggggggnttaaatattggttngggccccgttttgcaacttttggatggcttggncctttggtttcccccctggtgnttgatttttgg

SEQ ID NO: 1611 - DNA, 468 bp, Fusarium venenatum
  misc_feature (1)...(468): n = A,T,C or G
cggtcccgctgctcaagactttaaacagatcctcgacgcagccggtcgtcaggcccagcttgaggagcgtcgccaagagaaccccaacacaccttttgtcgcaaacactggcttcgaggttgaagatgaatgtcttganaagcgtgtgttttaccgtgtcatgtcgggaatgcacgccagtatcagcacccatctttgntgggactttntaaccagactaccggagagtgtctcccacctgactgntccaacaccgtnttncaaattccccgaccgtattggaacgtntacttttactacgcctcatgacccgcgccatcgncaagctcagcccataccttcagaaggaggagtccaagttttgctgggagatccttttgaggatgctgttccccgcgcaaangtccttgaagtcaccganaaagcactagtgttcccaaatntttgacgagagcctnatgttgtaac

SEQ ID NO: 1612 - DNA, 596 bp, Fusarium venenatum
atgagacagcgacagaagagtcgcatcctctcgaatggaagccaactctggctcggaggaaattttaaggcgcataaagtggcatttcaattaatgacgtattgtcccaagacgccgctttgttggctctatattacagttttttatacaccgatacccaaggcctttaagtccccgtcgtcgcggaaggccaattttactttcatcgtctgcaatgaaaaggcggaagcttgctcgatcgctcggcacgttgagcttcgaggttaattagaccggccgctactaactcgagggccgcagtgtgaatgtgtccagggcggatcatcgggcgctgcccactcgtcattgtgccctttagaccgctattgaggactgccgcaacgccagggagcgctgggggaggtcgaagactggccttgtgtatctcgtcgagggtctcaccaaatgtcgtctcggccaaccccgttcttcggatacgcagcaagagactgccatgacgagtttggacatcagggggagactgcgaaggtgctgttgaataggattagtggtggcctcgttaatggcccttttaattgtttgcaatggtgacgcgg

SEQ ID NO: 1613 - DNA, 218 bp, Fusarium venenatum
  misc_feature (1)...(218): n = A,T,C or G
agcgattccacgacaagggtatcttggtcatgaacatggttggacatcccaagcatgcnacaaangccttggagctcggagttgatanggttngcgctcaangcggcgagggaggtggccatacaggagacttngcaaactcgatttttatncctgcgggtngccgacatcgcattaaagtaccaccctcctnttttnaaagggacnacctgcgttgg

SEQ ID NO: 1614 - DNA, 522 bp, Fusarium venenatum
gttggatcgtttgcatcattggcctccttagcttcttcgtctctgctctcgacaaaccgcttctgcaactcccactcgatgccatcgccgttcttttcaccttcattggagctattgtccttgctgccaagctgcgcgtcgtcagctgtggagagataaaccctaaagcattgccaacggactggattgcatggggatcagcgagtgatgagggccgatgtcgccgattgcaagcaagcacagtttttatatggtttttgtttgcttgtgtatctggaagtttattcttgactatccgaaatgcccgcaacacctatggctctctccgaagcgccgcttcaagaccatccatgtcacagatttcgtccagtgtgtgatgaaccatatggcaccaaggcgccatcctacgatgggatatctgtcgcacgagaatgtcgctaacgcgatcatgggagcttgtggtcggatcagcaaggctgtaccaaggctgcgtgacactgggccaatcatttgggacagtat

SEQ ID NO: 1615 - DNA, 324 bp, Fusarium venenatum
  misc_feature (1)...(324): n = A,T,C or G
caggccaagaagggcaagaaggataaggctgancgtanggctgccaagaaggctcgacagaacggcaatgctgccaatggcactagcggtggtggcagtgacgaagcctctgacaacggctctaacgagaacgccgacgacgatgctggcagtgatgatgagttccaaaaggttcaagccgaggctgctgcagccgctcaggagaacgaagtcaaggagcacgaatgggctgttgatatgagtgaggaagccgtcaaggcccgtcaggcttctctccctggcgagttcaaggcgaagcttaacattggcgatgatgatgacgaa

SEQ ID NO: 1616 - DNA, 586 bp, Fusarium venenatum
  misc_feature (1)...(586): n = A,T,C or G
gtttcgcccgagcatcattgtcctggcacggcccatggcttttgtcttcaatggtgtcttgcgacctcacttaatacccttccaaaaacctataattgttcacccgccaaactgcagctacacacaggcttcttgctcacacggaaatgacgtgaacgcttgcagttctgtggaagtattcaatagcacacccagtcatatcgctagtagggtctcataatgaggcaacactgctaaccagcacgcctcgatagcaaccctcaccagtaccaaacagacatggcccgtcgtaatgaccagcatcaatttcagcagtacgctcctcagcctaatatggcaccgcagcaacagcagcccccccagcagcaacaacatcacccggcacctgttcaacctcccatgaatgtccctcagcaaccccctaatggtccagtgccgcctcagcaaacacctacgcctacaccggctccggcaggtcggcagcnaaagcggccagcancttccgctgctcctcctccggtcacagttgccgcccctgcacctgtcactccctcccaagttcagccacctgtggcagctccgtctg

SEQ ID NO: 1617 - DNA, 503 bp, Fusarium venenatum
  misc_feature (1)...(503): n = A,T,C or G
ctcaagatcaaccctcgcggccttgtcccgacgattatccacaatggcgagacaatcactgaatcagctattgtcgcgcagttcctcgtcgacgcctatcctgcccaaagcaagactctactccctgcgtcctcggaccgtgatggggcgttgatcagagccaggatcagtttctttgctgatacctactctagcaaggtccagggccatctcagcaaggctatctaccttggaaagacggaccaagaaattgagagtgctgttgatgatgctatagctggtatcgtcaaagaggttgaacctcttctcaagaacgccgtccgttctttggtggtagcgataagctcanctttgccgagtcctactgnccgtcgtcattcgacactgnnctttcaagcacggcttctaccgacnatttttatcggcctcgaaaanaaccccaactttncaagnggcncaggccatagtaaccntgccaggggntaanaattacatngggacaa

SEQ ID NO: 1618 - DNA, 603 bp, Fusarium venenatum
  misc_feature (1)...(603): n = A,T,C or G
tttnctttcccgtacgctatgatatacacgccaaccatccgtcgacttnaacggtctttttacaatgccatagcgaaacctagtagagaactgaaaataccgacccagaacacgttgagaacttgcactccagaagcggtgtttgctggagcatctcccatcgtgcccatacttgtcggccgcgtcgcctcgaccctgacattgtccacttcgctgtccttgttgggggtataagtacgcgattcaaaaccgcacgacttcatgatgatgtccatgttgntttgcttatgtccatccacgacaatgcagtcttggcacaatgctgcgaccttggctacatngaaactcttgttcaaacaaacacagtctctntctggatcgcctgatccggtgcgtttgtttgtaggctactgtgccatgtaccactcgccgtttgcgattcctncgaagtcttgaagtctttgaagtccccgaaagtcgaaagagtagtctgtgtcgccattggtgtgtncatgagcatagacgccatcgtggtacgctttttcgttgaaacttgatncacaagtacttgaagtctccttccgagtccaactcgatgcgatg

SEQ ID NO: 1619 - DNA, 465 bp, Fusarium venenatum
  misc_feature (1)...(465): n = A,T,C or G
ctattatcatctaaagccctaaacgattcgaaatttgcgctgaaaacatgtatacagggcggagcaaaatgtgacgggcaagaccatctgatgttctatcatagcttggccttggcctctccaactggcgcccgaccctttgcgagctcatcacataataccaggggacgtccgcctctgcttccgtcctgcgtcatcaatccattatacacaccatttgtctctcttccgacgccatcgttcttcatctccctccagcgccacttctcaccaagctcgccgccctgaccttgcaagacatcggcgatcttctcaccaaggttggggaggaacttgtatccgtgcccgctgtctcctgtcgcgacaaaaatccttccaccagggtgatatcgatgaacactcgcgtctcgtgtttcggaatacacanatcccccccctccatggcgggttccngccccggataga

SEQ ID NO: 1620 - DNA, 600 bp, Fusarium venenatum
  misc_feature (1)...(600): n = A,T,C or G
ctctttgcgcccacgtcaacaaggcaagcagtcaactctgactcgacacgccaaggccttttccaacctgcatcatttcacctccgacttcctctggcgaaaaacacgcaccgccttagcgcgttctccttccaaatctacgtcgacctgtcgctactcataatctgtcgcacgcgttctcccccgacacttncttcccatcgatcgcattagcacttctactctgcggtacttattagcttaagctcccgctacatcgaatcctgacttgtttccgctcgcctattatctaccgtatcgcgacatccaaaaaaaaattcagttcaaataatacgattattcacctcctatcaacatcttcgcttcttctaaatccatttcatcatgtttttcctttataacttggaacgtaaggcaccttgcacccttntttnatgggccgcaacatgcacgagctcgtgacgggcaagctcctgaangatgtcgaaggcacatgcgctggcagctacttcatcatttccatcatggatgctttcgaaatttccgaaaggacgaaatnctcctggtcttggtttggnccanttcactggggganatcca

SEQ ID NO: 1621 - DNA, 467 bp, Fusarium venenatum
  misc_feature (1)...(467): n = A,T,C or G
ggatgaccttatcacaaccattcatctcaatttattattactaccattcgccgtcatggcttcttccctgtagagcgtcacggcttttgctgtgactcgactctcctctggaacctgcgcaaacatggcggggaaacaacctggggtatggaagacgcccttgactctcaataacgacaccaatgactcaagcttcccggnctccaacctactgcgagtccggaggtcaataacaaaatcgaatatgaagaattacaacagaacgagatccttgccctcgaggctatctatggcgatgactttggtaatgcattcgggaacccaaagngcctggaagaaaaccgaaccacactttngacatacggataaanggcatttaaaggatgaagaacttggnttggnacggtngagctttngnaatggactgcnacctatcccgaaaatcccnacttttaataaaccttgaa

SEQ ID NO: 1622 - DNA, 608 bp, Fusarium venenatum
  misc_feature (1)...(608): n = A,T,C or G
gctcaattccccgtccaattgaccagcgatagtgctcaagcctgaaaggcactgctatcaaaaatgagcagggcacttttccgctccatgctggagctccgagctcccagcgcccgattttcggccccctcatctctactgccgattcgaacccgcgcgttcaacaccacagcgcccatcatcgagcaaacgttccctgagcgtcaccccaagaatgcggccaatcctactgccaaccagccccgacctctagctctcaaagtcagccatcccaatccacctccaaagcccatggacgactctgtcaagacccttctaccattcctggccgctcaaccggatcattatatcaccgttcatgtccacggattcccgtaccttgtccgggagggtgatcaggtccgtctgcctttccgcatgcccggtgttcaacctggcgatgtcctacggctcaaccgtgccagcgtnctcggtagcagagattacaccatgaagggcgctcctcatatcgatgagcgggtttttgagtgcanggctacnggtattggaacaagaatctgagcctctgcgcatcaagatcaagaagaagaagangcagcgaaggatga

SEQ ID NO: 1623 - DNA, 510 bp, Fusarium venenatum
  misc_feature (1)...(510): n = A,T,C or G
gcggggcacaaagctccccgcatcaaaacaacatgcggagcttccataccatccgagctgtactactcagctggggaaagtcgattgttgctcgttactatccccaaggtaggtaaacaattgcaacggtagccaanctgcagtcttaactatgggtgacacatccaatctctccggccgggactacgccgttcaattagactccgatgatgttcttagacatacccgtgacgaattcaatatcccatccaaagccgatgtagcacgcaaaactctcccttcgggcnacagcacagacgcgaacgataaagctatataccttgtaggcaactctcttggtcttcagcccaagcgcacgcngaacggattcagcagtacttgcaacattggcgcaccaaagtgtccaagggtcacttcnagcccctggangantccctctacgacttggttagatgttgaagctcncgcngccaaatgaatggccctancttgggtnncaaggttagcgag

SEQ ID NO: 1624 - DNA, 682 bp, Fusarium venenatum
  misc_feature (1)...(682): n = A,T,C or G
caaacctgcaccntatttcactacacgaacacttcgaacaatggcttcaggcgcagtttccgttcctcctgnaaagtacgagtttcttgtcgtcgttcatgataancccaatatgcttganaagcgacttgaagttcggggacagcnttttgaaaacatgagtcctgatgttgagagtggaaactggaagatgggaggtgccatcctcaactctgttcccaaagacgatagccctagcagtctggatttcgccggaagcacacttgtctgcatcgccgattccgtagaacaggtgcgagaggcattaagcaaggatatctatgccacttcaggtgtttgggatatggacaaggtccaaatatatcctttcaaggctgcttttagattcaactaatcttatttctaatcttctgattgaacggtgcgttccaaacttnaaaagacgcagtaaccttcccagtatgaaccccataatccatctattatgcgatcactaaggccgtataatggatgacaatattatgccccagtgatcgtataatcgntgacattttatttttatattattggtcttatactgcaagattgctgtgctttaaagatgcgctttttaaagattgaaaagtcggntagattatcatacttaaatcagcaatagttaaagcaaataatcagttacaat

SEQ ID NO: 1625 - DNA, 337 bp, Fusarium venenatum
  misc_feature (1)...(337): n = A,T,C or G
tgcccctccacctcctcctggtgctcctcctggactgggcgacattaatgccttcatccagcagtatgctggtgcagcacctcccccaccgccgccctctggcgacgccccgccaccacctcccagtgatcagcctcctccacctccacctcccggtgcctaaacgaggcaagaccaggatatccaaggttggaagcttctgacaatagtaaattctcggctaggggctaaagattgtttgtcaaaccggatattaggaaagggaataagcgatcgtttctaatgtggcagcgactaaccagtacaagccaagcttgtatttcacttggnccntttc

SEQ ID NO: 1626 - DNA, 679 bp, Fusarium venenatum
  misc_feature (1)...(679): n = A,T,C or G
gcagntcatgtgtcaaccaggacacaaggcaaaggaactttgacactttcgcgttgggtgatgtccgacctcaagagttttttaattatgaaacacatctcgaagtccagtggaacgataaccacagaagcattcatccctggaaatggcttaaatgctggttcgctggcagattcacaaaggagctccgtatagatcagccacacgaactatggggtaaagccatcgcaaagaaccctccaacggtcgactaccgcctaggagccgagcagatcatggccgatttgacaaaaaacatttgggttcatggtttttgtcttgtcgaaaacgctgagccgaccgccgaggcaacaaaggccttcttggagaagatcggaccaatccgcaacactcactacggaggattctatgattttatcccagaccttgctctagccgacactgnttacacgaacattggttttccagcacacaccgacacaacctantttagcgagcctgntggcctgcaagccttttactgttttgcgcatgaagccccctgacacaacccaaacnaccattggggggngagttttttttggtcgaaggtttcacccctcttaaatttnttgnaacaagganncccggggaatcttattaatntcctggganaaactnaaaatcccttgggatgccc

SEQ ID NO: 1627 - DNA, 590 bp, Fusarium venenatum
  misc_feature (1)...(590): n = A,T,C or G
ccaaccgcgaaggacctccttcgccaccgtttcatccgcaacgccggcaaggtcgaggcactgcaggagcttattgcccgtcgacaaatgtgggatgccaatcagaataggcagaagcacccgatttattaccaagagaccctacagtcaatgactcctaaggacgagcagcaagaatgggtctttgatacagtaaagtcggtcgcgccgccgcccaagaggccaactgtcaagcagcaccggaatccatccatcttcaacgctgaagaggcgatgaagaagttagatgttaaggatggccctctcggtgggacctctcctgcacctggtactgttcgaaagtcgactgtccgccgatcgtcgcttgctcagagcaccacatcaatgcgatcgagtggctctccccgagggtccnttccccccaaganacctcttcagacggacatgtcgtttggaaattcgggatcgactatgcgccttttccnaanaatcccttctgacagttcaagtcagggcagccgaacgacttcgtcagannatgtcttctgtgacaanaatcacattcttccatnaacaactcctgttgaacc

SEQ ID NO: 1628 - DNA, 545 bp, Fusarium venenatum
  misc_feature (1)...(545): n = A,T,C or G
gtacacgaaaaggataacccgaaaaattgcctcgaaactatgataccataagcatcgcaatcatttcccagcccagcccagcgcatcatgtcctttaccaatacgcccgtgacccgcctcngtgtggttggtcttgtcgccggctctattctaaccagtgtcctcgacgtcaagcactacttctacatactgatcgatactcacatatggcgctaccgccaattctggangcttctagcctaccactgtgttatgttnactcaaccgaagtcctctttgctgccatgtccttgtacaacctcagaatcgttgaacgcatgtggggtctcgcaagttcgtttccttcctggctgtcacttattcacacgttcatcattccaccaatcgtctcgatcgtgctgcgactctcactgccggantctaaantanatcccggcnggcccactcccacaattttggcancctggctcattacatgccatggttcncctatttcaataccaattgcacntctgaacaccncaaaaaacggcatcntgggaata

SEQ ID NO: 1629 - DNA, 548 bp, Fusarium venenatum
  misc_feature (1)...(548): n = A,T,C or G
acgatacattgacactatcactatatcaattgacctcgcctcatctctccaacccaactcaccgccaccatgtctctngtacttgagctccccgctgaatacggctacgttcttgttgccgctacatccaccttcttcatcaacaccctccacgttgtcctcaccagcaaggcccgcaagcgaagtggtctcaagtaccctatccctacgcttcaacgacctcgctgagaaggacgccgaggcctacaagttcaactgcgcccagcgttcgnacgccaacttcacagagaaccagatctccttcttgggtgctctctgatctctggctgcgctaccccgttgcctntgctgtcctcggtgctggctggggcgcttctcgtgtcttntacgccattgggtattctgctggcggcccaaggacgcatgggtgggtctattggctctacctttgcgaagtgtcgctgaagncatggccgnctacactctatcatgtatgctatnggtaactgagttgacgtaccacaattgaatataataattgggttccc

SEQ ID NO: 1630 - DNA, 630 bp, Fusarium venenatum
  misc_feature (1)...(630): n = A,T,C or G
gtctaaacatttcccccttgccagcatcaacccctctctccctctctcaacaataatcaagtcgatacttctctcatgacgacagccacggctacggcgaccgtcgaccccgcggcgcaagcgcaccagtttcccctccctaaaatcctcgagtaccccgcgtcaaccccgccaatcctcatcacacaaggtgccgagggtcgtctctacaaaagcacttatctgttgccggatattccctgcgctctaaagtatcgacctcctaagccctggcgacacccagttcttgaccagcgccttacgaaacaccgcattctctcagaggctcgcattcttgcaaaagtgccgncgcgatggtgtccgcgtccancggnctacgctgtanatgaactgccggctggctgatgctggaatggatatctggaggactgtcgtaagaacatcaacgagagattgggnaacaggacggaggnatngagaacgaacaanagtgaaggattnatgccagaancggnaccgttttggnaggttgccaaagtggnattgttacgggacttgntcaacaaaagaggtggagctttggttanccgnagaanccattttttaacgggagtngtttaatgacngggt

SEQ ID NO: 1631 - DNA, 810 bp, Fusarium venenatum
  misc_feature (1)...(810): n = A,T,C or G
cccaaaaccctcaatccgnccatctccatctccccggagtcaccccaattgagcctctaccagccattcaaaatgctcatccaactctctagggctacgcgcgctcgctccgccgttgcggctgtttctcgtgtcgccagacccaatgccgtccaggtgaggggcttcattgctcctaccgtctccaggaaagccgacttcgtccaggagctttacctcaaggagctcaaggcttacaagatccccgccgtcaaggagtccgatgccgagggcaacgtccagaccttcagcgttcccaagacccccacttcccccgaggagaccgaccttgccggcaacctgaaggagtacgagagcatggctgttgagatcgaaggtcaagaccctccgcccagactgccggtgcccccaaggttgctgactggcttgaggccgaggaggacgaggagcctcaccactaagcggtcttttcttttaaactctccgttaccatttganggtggttcataaaactatccgtaccgcagcacattttgagggtgtctcatttctcaccgctcanctgccgtcactcggggatagaaaaagagggagggctgataccaaactcantccggggatgaaaagcccgggatgcgaccagnaaggactgaacaagtggattggggacnaaaatcctggtgtncatttttcctaaaatacagccttcggttgcctgtangaactaattgcgaanggccaacgttaaatgagcntcaagcaatcttttactattccccacccaaaaattcctgcgggccgttcgacatt

SEQ ID NO: 1632 - DNA, 678 bp, Fusarium venenatum
  misc_feature (1)...(678): n = A,T,C or G
atcatctcatcttctcaagcatctcaactaccaaacactcttcaactccaacaaacaactctctccaattctcccacacacaaacaaccaaccaccatcaaaatgaagttcaccacctctctcttcgctctcgctgccgccactggcgctgtcgctgctccttctgctcccctcgacgccgtctccatgatggccgctgctcctatgtggaccattgagtccatgcagcgaacatgcgataagcccgataccacttgcacctggaacttcaagatcaacaccggtagcggtgccgctaccccctgcaagtacgtcgtcaaggcttccaagagtgcctctcaggccaacggcggccctgccaagtgcggcactttcaccatcacctctggctggagtggtcagttcggtgccggcaacggtttcaccactctgtctgttgtcagcagcaagaagcagatcgtttacccaagctacaccgacaagcacttgctggtggcaaggttgtcaagcctgacaaaagtaccccctgcttctctcccttaagcgatggacgaatttatggatgacggattaatgggctctgggggttgggtggcgataatatctaatactcaatatctaaacgggggggataatgtatatacaatcacatagatgacnaaacatcaccttatctgg

SEQ ID NO: 1633 - DNA, 153 bp, Fusarium venenatum
  misc_feature (1)...(153): n = A,T,C or G
cggtatcatgaaggatgtcancncgcttatccncctgcccgaactggcngggaccatgcaagaactgagcgtggagttgatgaaggcgggcgttatcgnangagatggtctgacgatgtacttcctcggacgggagacatgnttatggaatat

SEQ ID NO: 1634 - DNA, 625 bp, Fusarium venenatum
  misc_feature (1)...(625): n = A,T,C or G
caaactctttacttccctccaactacatcatcaacctcatctcgaccttttgcttttacactttgactacatccttcaatctaaagtcgacaacacatactccctgcctcatattcacctcacctcctcaacttatacaaaaatgacagccgntatggcacagccgactgttacagtnaaagatccctctgcagtgcgaaagcgcaaaagacgtgcccctgccggtggcgcctctgatgattgtttctcttgtnccaagaanaacatcaagtgtgaccgtagacggccatattgctcccaatgtctcgaggtcggcagtgaatgctccggttataagacacancttacttggggagttggcgtggccagtcgaggcaagctccgaggcctgtccttgcccatnggaaaagctcctcctgttcccgngagcccaaaaaacactcaactggtttcttaagatccagctntttcnttgcacncatggaacaagangacgagacgagaaaaatgcccagggnccattgatntttctgccgngactcaagtgcttncgttctacgacgccttttaccatgggaggatcgactcctntntttttcacaggntgngcatgcancccctatcc

SEQ ID NO: 1635 - DNA, 755 bp, Fusarium venenatum
  misc_feature (1)...(755): n = A,T,C or G
ctcgtgcccccatgcaacagccttatatggcccagcctgaccaacaaccttacggtgcctatcctcagcatggatatggctggcctccttcccccgctgctactcctccctacagccactacgccgctccttaccctcccaatgtccctcaacaatacctacctcacgctggccatccaggcctacctcttcctcactacccccaggcacctgtttacgagcaccgtggtgctcctcttcctcttcccctaacggccaagtctcctcaccacccgcacatggctcttcccagagcacacgagtcccctcgcgagcaacatctccaggcagctgcacaaagcgccatggttgatgctcgacccagtggtgcttcacacactcaccaagtagctctaccaagtctcggggcggtgaccaacggtccccctggctcgtccttggcagcaatcagcacacctcccagcagaaccatgagtgttagccccactcgaaactctcgttctgaagtgtccagtctctctacccttcacgcagtgcttcatcatactcccgccaagcaagcgaaagtggtaattgccaagcctggttagtgccgncagcagcctagncgtctgntgctgcggcttgaanaaggtggcgttagcgaggatgccaaaaccctgaaaatgttggatcgcaaggtctgcattttaaaanaaggacanggcatggcgtagtccntngaaaactcgactccatgatgattcgaaaatgan

SEQ ID NO: 1636 - DNA, 763 bp, Fusarium venenatum
  misc_feature (1)...(763): n = A,T,C or G
cacgaggttgaatttctccggacaagacgatggatcgtgcctcgtatcggcgatattatggcacagctagtgggtgcactaaagttcgtatcttgtcagcagccttgtcaggcaagcatttgtctttgatgataaaaggcatctcttgtccagctgtttatgtttttgaatcatctcatctcatctcatctaatcacactctcacaacaactctcaactctcttcatcaacacttctcactcaacaccaaaacaaactatcaccatgaagttctccgccatcaccgctgctgctgccctcgtcggcgctgcttctgccgccaacaaggccgtcgtcatcaacgagtgtgacactgccatctacgtccagtccgtccccttcaacggcggtgctgctggtcccttgaccaccctcaagcctggtcagcgattctctgaggatctccgcactcctggctctaccatcaagattgccgacacccgaactctcaacaagcctctcttcttcggctactcctncgacgccaacaacgtctactacgagctcaacactgagtacngnaaccccttcgncaacaagcacaacatcctgaaccctggtgatggctggccaagaaaatttcgaactggcnanggctgggccgaatgcccaagtgggctacaagccacacccaagcaggcaaggaaaaaactaatgggtgggccctaacctgggtacccctttatgcttaagaattggngccaaataaaaaagggggggttgg

SEQ ID NO: 1637 - DNA, 126 bp, Fusarium venenatum
  misc_feature (1)...(126): n = A,T,C or G
naccgccagtancgcacgccccttancatcttcttctccaagtctctcctccgtcaanctcttgctcacagcgagattgangnttcactgnagaagaacgccngattccaatggatcattcctgac

SEQ ID NO: 1638 - DNA, 644 bp, Fusarium venenatum
  misc_feature (1)...(644): n = A,T,C or G
cagtgtgctgggaatttgcaaaagcttcccaacacccctctgaccactcgctggcttaccgaccgcgagaagcaactcgcccatgagcgcatggagaaggacaaggtctctgactctgaagagggcggttcatcttgggagggtctcaagcaggcttgcaaggataagcgaacatggcttttctgtcttatgcagaacttccatctttctgcttgctctttcaattcattcttccccactgtcgtcaagacccttggcttcaacactaccgttacacttgccatgacatgtccacctttcatctttgccggtgctgcgggcatcttctttggttggaactcgggacgcatgcacgagcgtacttggcatatcaccgccggtctttcggtcgcatcgtcggtttcgctctcgccgctgcgactctcaacactgntgccgatacgtcgcttgcttcatcttccccatgggtgcctacgctgcaactcgtcatcattggatgggcgtcttcaacactgctcaaaccaangagaaaaaagctggtggtttggncatgaccaatgttggtgggcagancgggtacatntacggggcctacctntgggccaagagcgactcttcccgatatgggaattgggttcggngcc

SEQ ID NO: 1639 - DNA, 409 bp, Fusarium venenatum
  misc_feature (1)...(409): n = A,T,C or G
tcaatcatgttcttcaagaagctgctcacttccgctgcagccctcacaggcactgcgcttgcccagagcaaggcaggcgtcgaanacctcnacaagccccgcagagaccttttngaaaaggacctctccaagtgtcccggctacaaagccacaaagcactgggagacccgatctggcttttacgctgacctttccctcgnggtcangcctgtgatgtttacggaatcgatctgcctgactgaactngaggttgaatattaaaccgaaaccgantgtttgtnaanatttgnatacnaacaacactgtanacaagnccaaaagacttttccnttcgncggggctcgacnggggtttccccaaaaactggggttaagttggatttanggggntcttttttttacttttcaag

SEQ ID NO: 1640 - DNA, 591 bp, Fusarium venenatum
agatcagtcatatttgaacttcactcaatatttaacccattgcattgttcgtccagtctcggcgctagacatgggacaacagcgaagtagacgatggcggtgctcacaacacacccagtacacgcacctatcgactccataatagacgtcgaccttgtgatcaatgccgtgtccgcaaagttcgatgtcaaatcgaggatggcaaaccgcactgccgtcgatgcgcgcagtctcagactcaatgtagtttcgaagggcgatcaagacgcacgacacgacagagtaggactagatctgtctctagcagtgctcattcactagctgttaatcatgtcccccatgatgatacgttgggccttgacaactcgttcgatatagaacatgtttcagccgaacaacacttggcgtctgatggaccaacgatattcgcagccactccttcggtgttcccgcacgaaaccgaagccccgtatcatcaagcacaaacacttggtagtgtcacagcttcaacgcagctgcaattctcaaggtcactggatgatatacagggacagacatcaatccttctggggatctcctccgaatcgatcc

SEQ ID NO: 1641 - DNA, 612 bp, Fusarium venenatum
  misc_feature (1)...(612): n = A,T,C or G
agaggtcattaaagaaccctagcgaacatgtcgataaagcacaattctacagtccttgtggatctgggttcatataaactcgaggtaacggtccacggtccgccccgacgcgcccacaacccgattgtgatcatcatccccgacataggcagcagtatcaaanaatggaccgtcgtcaccaaaatgctagcanattccatggntgnggtcgactacaaacgtgccggatacgggaaaagtgaatatattncttngggagactcaagancacctgcggccctagctatggaactacatacgctcctacgagctgnnaaaatcgcaccaccttacatcatggtttgcactctcgnggggccagcatctgngggaatttacaaagtganaaacctgcccaattcaagggttttgtntttgnggacccaaaactgggccattggatctgtntgtcaacccaaactttcaaggtttgatcntaaaantgngctttggaactgtatcnttaatcaatcggcttggaagctttttggacaaaaaggctngggcggtcattaanccccnctgaagggaanacccaatcccggtcggggnaaaaantttttttnggcccng

SEQ ID NO: 1642 - DNA, 625 bp, Fusarium venenatum
  misc_feature (1)...(625): n = A,T,C or G
gtggagaaaagttctggtacgcctgttgttgagcctgttgcggtggtggtgagtttggctgctgatattgcccttgataattggtttggggatatcgaggagcttggctctgctggtactgtgacgggggcgtaggtcggctttgttgaggttgttgcgatggcttagctggctccattgacattcggtccatgagccctctcagtctttcgcgctccatctcagcctgcgagttcttgttggatgacctctcctgctcaatttggttgagcagttgcgctccttccgatctacggttattgacgaagctatcgacgttcttctccaagctctccactgtctcgcgcatctctgcgtaccagttcttagcactttgcagacctgcgacaagatcgagaaactcctggtaagctcgcttatatcggttgataactgacgatcgttgtcgttgaataagtctcgtatttgctctgttccgactgaactcgcttgtcctgcaacaagtcggttgaatgcgcttgtgagctccttcatcaaaagctgactgcttgtgattcgcttgcaaaagtcggtttttggtgaagtcggaacttttccaattcctgctcaaacagttgcgcntctn

SEQ ID NO: 1643 - DNA, 443 bp, Fusarium venenatum
  misc_feature (1)...(443): n = A,T,C or G
caacaattcaacagaaggtggtttttcttataactatctatcaattagacaaacctctctattgccttcatcatgtttgctctcagacgcacaatggccaatatggcacctcaagcctcatccagcctcaagcaagcaggcaaggtcatatgtattgggccgcaactttgcggaacatattgccgagctcaacaagtgctaaaccaaangcagcccttnttcttccttaagcccacctcgtccatcgngctcccttggngangggggctgcctgagacccangggcnttgagatgcactacnaanttgagctggcttttatatnggaagctgactngaanattaaagccttttgatgttcanggtgttatggatgctgaaaaggttaccnttgtgccattganttaccccccgaaccgctaaaaagnggccaaaaaaaagggt

SEQ ID NO: 1644 - DNA, 622 bp, Fusarium venenatum
  misc_feature (1)...(622): n = A,T,C or G
tcaaaatcaggaacacactagaccagaccgataccgtccccatcgcctctgcttccgcctctagtaataagaaggctcgtggcccaggtcccataccgaggcaatctggtccttccctgctgacccaagccttggcttctgcccgcggtattacaaacctcaagcagtcaaaatccttctctccctcaaccaccactacaactactacaaccatctctcctgtcacctcatcctccaccacaacccttacaactacttctgttcctggtgttcgacagtctaacctaaacaagaccgcctcaccctcagcgactatctcgacttccacctcgcccaatgcgcagttgagtccctcttcattaacaggaccaccaacagcaccagcgacgttcgcttcccagtacgaccgcgacagcgcctnctatccattcgaatctattcatcacaatgtcccgctcagcgcaccgntcctcgaccgttaacgagagctacctctgaatctatcaacatgggatcatttacaggcaccacaatgacgtcgctcgccccttgcgaggctgcgagcgtccttcatncctnaaccactcaactcttgntacacttcgaggcgctcttgancatt

SEQ ID NO: 1645 - DNA, 610 bp, Fusarium venenatum
  misc_feature (1)...(610): n = A,T,C or G
tacccactcaatctatcagttgcaaaaacacacaaactacatcatgtctgactcagacggcctaattgagcctattgacgatggaggcgatgaccttttcggcgacgagggcgacgacgatattgtacctaccaaggagtcggtcgatgaagatgacgagctcgcctcggacccagaaggagacagctacgcgcggtaccgcaacgacgatgaagaccaagcacaattagagactaaggagcgtgctgtccaaactgtcacgacataccggcatcgagttcccaagcccaaagacggcgcgttgcgagttcttcgcgttcccaagttcatcaaaataatgcctgaagagtacaaccctgatacataccagccaagcgaattcgatattgccaacgccaaggctgaacatcccaagcacgtcgcccgagtccgaagagatcacagcaccggcgagctgaaaagcaacacaaacgtcttccactggagcgatggatcagtgactatctctgtcgggggagagcactacgaaattaacagaaaggcgctcgcaccaccaccagacaagccttataacgaggtccangatggccactactacgcttnttgncgc

SEQ ID NO: 1646 - DNA, 637 bp, Fusarium venenatum
  misc_feature (1)...(637): n = A,T,C or G
atagtcaacagctttgccctccatccgaacgcaaaactcgacaaaatggcgaaaggttcaaaaggcctaagagcctcgtctaaggcagtagaccccaccctcgatgctctttttgcatccagtgccggccctgtccaagctcccaccaagtcaagatactcgacattgttagaccagaaggttcgagaacctgccaagcccaaggtgcagcttgaggaggacgatgaggttctttccgagatcagcgaggaactaagcttcgaagaagatggtccttctgatgaggacgaggacgaggacgattctgagcaagaggacgaaagcggagacgaacaagaaaaggaggacgaggaggagagtgagggcgcagacgagcccatgaaggatgcgcctgtcgagctcgacgacatcattgatgcgacagaagacaagtcaaacaaggagcgaaaacgaaagcgcaagaaggacaatgacatctggaaagcaaatatcttgacaagatggctgcanaggaagaagctgancgtgccggcaaacgacagaaagaacgacgctctgaccaaagactgacaanaagtctacagcccgatganggaagatgctggtaacgaaancgatattcctgtccatgagaaat

SEQ ID NO: 1647 - DNA, 608 bp, Fusarium venenatum
  misc_feature (1)...(608): n = A,T,C or G
ccaattggcaagcgtgatattgagcgcattgcgacagtgactatttcacttgtttaagcacctgcgcatcgtcatccttgcactcaacacgttccctattactcctcacttgcacaatatctttcgcgcttttatagcccctccataaataagcattatcaccatgagcggcttcatcgactactccaagactaccaagtcgaagaactaccatggatctggttcttttgcaacgttcatgattattgcccctgtgtgcttcttcctgggtatccttttcgcgtcgtttccttacgacttccctctcctctggaccaaggcccctgtgcccgacaacttcttcgaccatctcgagacgcatctgaagttcgtgcaccaatcccccgcactcatcaagccgcattctccacattgtcatttccatcgggtttatcggcttcttaatcaagctcttccgccgagcgaggccaacttctttttganggcgcatctctcatcctctacttatcggcttnggngtctacgttgccaaacattgncaaggcttctccgaagcgttagccgcccaaatntggactaacgangggattcgacgggnaaaacccacg

SEQ ID NO: 1648 - DNA, 546 bp, Fusarium venenatum
  misc_feature (1)...(546): n = A,T,C or G
gaggaattctcccgacaggcttcaatggaaagtgagctcagcatccagtcatcactcatgacgccgcccaagcaagacatggcttcactggctaaaggccaacttggcttcatgaacctgtttgccaccccgctgtttcagggcgttgccgatatcatgcctactatgcagtataccgtcgacgagcttgagatgaataagagtctcttcgagctgaaacttcaacaagagaaggaaaagcagccgttagacgatccggtccgaaggcgtcttcttaaagagggtacattctcgccgagaactatgagcttcgcggtaccccaagaggaggaaagggaggagagaaaggacatggcgccgctatttgaagcactagaccgagcatcggacacgacaccggttggcaatggtgagcttccaatgccacgttcggagancgaagaactatcgccggccgatatcagaagacaatggggccatcatccgtgaatggtgcactgtanaactaaaggtctgatggatcatatcacattcgacgcggttaga

SEQ ID NO: 1649 - DNA, 418 bp, Fusarium venenatum
  misc_feature (1)...(418): n = A,T,C or G
ctctncttttgcatcatcacaatatgctatcaaaanggaatcgccatttcctccctcgtcctcatcgcctggcgatggccgcatcgtcgttggtctgctccctgcaggngaaagtggccttgaggctatgacctaccantntcctctaaaactgatatcgtcggctccttcgtcaagccagccaagtaccgctggtgtttctgctgtcttatggaggcggtttanttgctggagacggtataaatntgacaatccacgtcaagccggaggcgaaactcancattgctacccaaggtcacacaaaaatttttaagtcgcctacaagcagacntntgttacaagtcaaaacttggaggtcactatagacaacaacgctttaaatgggccttntaccaaaccctggtcancctttgaaaga

SEQ ID NO: 1650 - DNA, 410 bp, Fusarium venenatum
  misc_feature (1)...(410): n = A,T,C or G
gacgcggtgacccttcatcctcgaagttacacccgggtaaccgaattgtacatacaaatgcggcagaatgtctcaggctagaggcgtcaaaaagtccagcaacccagaacccggcaaacgccggactccttatgctctccgcgcatgcgaagcctgtcgtngtcgcaaaggcaaatgcgatggacgtcaaccgtgtcgccattgcgcaagccgtnaccagaattgcagctacaacagcagtttagaaaataatgaanattgncaatcaacagcaccaactttggttgcaccaaacatngctgcacccgatcaacatccttcatcgaatcaatcagggccacgtcagacngatcagancgcaattgtggatatgctatcgagtctacangcgcaattgaatagtctgctgc

SEQ ID NO: 1651 - DNA, 983 bp, Fusarium venenatum
  misc_feature (1)...(983): n = A,T,C or G
atttgactctcaacaccaaatcttcatcatcgtgatatctccgccgtgttcccgcttacttctacgtcatagcctaaccacgtctctttcaacaaggagatccctgtcagagcactgcactgagagtgaaccaggcctttgtggaagaagaaagaccaatgaattagtttcttgtttaactgctattggacacccccttacttctgtgctggtccttgttcaaacaaatatttttcttcctgccctcagattgcccaagacctgaagacgaaacctaatcgggcattaataaaaaacggaagaattgggccacgagcccacgacttatatcccatataactgaacctgcacgaaccgtgagacaagaaagtcacaactgcatttctattcgatacactagtgtccaatcctagtaaagtgagtcttggcttccaagatgcagcgctctggctcgttcgagcgacgcagctctgttaatcagagaccatcgccaagcccttcaccaatccccacgccatcatccagaacccgaacaccctcaccttctcgtggacgacctcaatcattccgaagtagtaacaaaccctcttcttcacgaccaatttcacgctcgagatctcgaggaaggtcttcttcacgatcaagttcgcgctcaccttctcgtcgcaagaagcgcagcgacgatcatgactacaatggtcttttcaaaaccacggctggtctgttggcggggatcggcgttgcgaccgtcatagcccacaaggtctggccaaagggcgttcttcatggtgatcatgaagantgggancatcctccccccaagcatagccgggaaacagcatcgacatcgctctcctggaaacgctgacgtgtnttcgaacgcaccactaaacgacacngcgacgttgttcatcacnaanaaatcagccgtaaacgcttcagaactgtganaaaatgccgcnagacatgtnaaggtgcngcat

SEQ ID NO: 1652 - DNA, 672 bp, Fusarium venenatum
  misc_feature (1)...(672): n = A,T,C or G
catttcgctattgatatcaagagattcttgacttgagcgcaagccatcccaccgccatcactaccacatatcacttacaccaccacaccacttcaaaatgggtttcggaagattcatccactatattggcgccttctttcttttggcagcaacagtgatgctcgtcgtcgtgagcatcacagctcctgtggttgaccacattgctcttctcaaggtccgatatggaggagatggcgtcaattatggtacatttggttattgtcaaatgcgaagcgccggcagtaatagttgctcaaaggctcgcatcggctatgaccctaccgacgctttcaacggcctcgatctgtccgagattggctctggcactgcaaaggccttgacttatgtcatgggtctgcaccccatcggtgctggactttgcttcatttctttccttttggctattggcgctggcatctttggctcgctcatgtcgactcttatttccatcgctgccttccttggcaccatcatcgctttggcttgtgactttgctggcctctccatcatncgacgacgaatcaaccgcgacacctntgncactgntanctnggtctggccgtatctggcttggncctgccgccgttttctttgcctaatggcacaattgccgcttcataactnntggttggg

SEQ ID NO: 1653 - DNA, 1750 bp, Fusarium venenatum
  misc_feature (1)...(1750): n = A,T,C or G
cagatgtgaaggcatcaatctgaacaatcagcatttccgctgttcagatctctcatcttgctattttttgttacttacttgatgccgtctgaaagctgtttttcgaatgcgccactggagctcagctcgtggaactgcgcacacgccatcgcgaacacacagatcatttctaatntaacccgacaatncataatacaacacaccgctcctattaaaataaccaggttaatccaccatggactactccatgtcttcaagcgatgcttcgagctcgcgatcttctagatcatctgctgctacaaatgaccccgttcttcgcaacacgttgcgttacaccatctcagcacacgaatatgctgctctgcataaatacatcatttcacgatcgcgtgtgcttcgtcgatcgacgccgacaccgaatcgcgtggaaaaggcgctgaaaccaccgaaaggaggggatgattataatgctaggacgattcgtcatgcgctgagggtgttccgttatgacgtttttgggtatgaagggttgggatgcttgttgccaagaggatgggccangaaaaaattnatgcgagtgggcaaaagaaacccttttacaagtctccagctctgagactgtctatttctctttctactattcttctcctctacaggattctttttagattctttacgcgactgcgcttccatctactcgatccccaagtccagcccttccgttcgcgcaacccacgaactgcagcgatgctgacatcaccttctgcgccagccatcggcgcatctttcgctggtctcgctttgggtatcttcccagctcagaagatgcgagtaaccatcgctatctacaccattttccgtgcgttggaattcgcatacaacttttgcgaagccgacggtcttatctggggtagcaagaacggcgtcaagagggaaagaccttggtggtttggaagttggatgcttcaacctcttgctttcggacaacttttccacgctgctgttttcgatcgggattgtttccctaagccatttggggatttgatctttaacagctcgtcgggttatttgcaatcgcgtcctcaggattgggcatctagtcttaaatggcctcaagacttcggagaatgttgatagcttggctcaaatggcgcgtcttcaactggccggcttatgtttctcctaccttgttccctggaaaggaagttcttcctcctagtttgagtgcaatttcgcctttgacttctcgagcgcatccgcttattacttctctgtcatgcgcaacactacacccgggagaccttcatgttctcgaacctacctgacattctggcttcaatctttccccccatttgctcgtttcttcgtcgctgtcttttctgcacttactgtcatccctaaattttccgctctttaccataacccccttgcgactctgcaacgcatcatcaccaaggccttgcgcatgtcaactttcgcaaccggtgctctctctacagcctgggcttcgatctgcttcttccagcaatggcttcctcgtcattttcttgcaacacaacgagtgttcctcggtggtttcttcgctggtctctgggctttcgtttaacgcaagaacggccgaagttctcttcttgtacagcgcccgtactagcgtcaanagcctctggaangtggtgtttagcgacaatgtggaaaacatgaanggtgggtgactctgggtctttatgctagctcttaaggtcactggtgt

SEQ ID NO: 1654 - DNA, 620 bp, Fusarium venenatum
  misc_feature (1)...(620): n = A,T,C or G
ntgnccctgatgctgggggggctggattcgagtcttgcccttctgaaacaaccaaacccattgcttcaaccccatggcgaaacagtcttgctgntttgacggcagtggaaactcatgtgataagggcttctactgctctcacgacaccaaggctcanacctggtgctgccctgatgctatggatcttgctgagtgngccgctgcgtatggcgtanaggatggcctcaagaccgagaggctnttaaccaccactgccactaccggtggtgagaccacctntgccgagcccactaccactgctgtccccaccaccactgctgtccccaccacttctgagcttgagaccacctnttctcaactcgagaccacttcgacaactgtctacatcaccagcacttntntggcctccacatccaccaatgctgccacaactactgntgcccctaccaccgagcccggtgttgttaaaaccacgacaaaggctgacgagaccaccatcggtgcccctactntggctacaagcacgggctggagtggttctaacaagcaccattgccactggcgnccctactaaccatttgagtctgccctggctntgtgaccttnagcatnagagnggt

SEQ ID NO: 1655 - DNA, 413 bp, Fusarium venenatum
  misc_feature (1)...(413): n = A,T,C or G
cgngacanagcttggccctcagggtgttcttctgaccactatcctcggaagagacgatccccgattaagggatcccgactcggaagaatacattgtcgcccgctcaatgagccacccaacagttggtggactttacatgcgactattttccgctgccgaaaaggttcaaaacatcgtttctgttaacggcgttggtgatactttcttcggtgtcttgatctctggtttggcgcagggagggaaagtcgagaaccttatcgatgttgctcaagcaggctcatgtttaactttgaagtctcacgagtccgttagtcccgacttgcaccgactggaaagtgtcttggcacaggccgcagctcaataatctgatattatgtagatatcccgtataaaaagtaaatgcatatttttca

SEQ ID NO: 1656 - DNA, 510 bp, Fusarium venenatum
tgcgagaccgcgcccgttccgatctttaccttgctcaactccgcagccagtctgcgcccaacactcctggcttcggtcccaagtctcccgccctcagcgcctatgccatgtccccccgtcatcctcccgctgcctaccgaaacctgtccgacatcagcgagaaccccaatcccaaccccttcacgccaggtactcagtttgttgagcctcagtctcaattcgctcctcaagatactggcttcaagcttcaagctcctcccatgaaggctccctctgctacccctaagctgaaccagtccgctttcacgcccactgaagcttcgcctcctgcaattcccaccgttcacatttccgaacacggtcccacaggctcagatgagcccacgtatgaggctgtccctatccccggtgcatacaccggacaggctatcaagagtccaccagccgcgcaaacatcctttggccaaagctactactagagggtgttcaagattgaaaacgacgagcttt

SEQ ID NO: 1657 - DNA, 397 bp, Fusarium venenatum
  misc_feature (1)...(397): n = A,T,C or G
ctcaagcttccatctcccaatctccactcctcaacgtcaagatgctctcccgcgccgctacccgtaccacgacctntntggtcaccaagcgaggcttccagaccacccgcgctcgcatgtcctccccttaccactaccctgagggcgcctacagcaacatccccttcaacccccgcagcaagtggttcggcgttggctactggnccttcatggccaccggtttcttcgctcccttcggcattgctgtctggcagacctacaagccccagtaaatttgtcgctgacggactgggtttgttgtttgattgaaanaacggaagccttgcggcggaanaatgtggtgtacataaccgaaatanacatcagtcattctcgacttttnattcgaaaaaaaaaa

SEQ ID NO: 1658 - DNA, 321 bp, Fusarium venenatum
  misc_feature (1)...(321): n = A,T,C or G
gttgggtttaaactgacattatcagtgatacgtgcaagaaacggaaattgaaatgtgtaagagaagaaggcgagcacgtctgtaggagatgcgctgcnaataacgctgagtgcgtctttgctactcctgccactactcactcatcaaatgaaaataatgaccgttcgacaagacggtcaacactggagccacagttngtcaaatcntgttttagttgcttaggaaaacccaaaggctaatcaaattggtagaccagatcttacatctctgaatcaacaagttgctgccttnaaaaccaaattaagcgccttaacaacagct

SEQ ID NO: 1659 - DNA, 825 bp, Fusarium venenatum
  misc_feature (1)...(825): n = A,T,C or G
aagtctaccacattcgcggttcaaacacacatgcgcgacacgggccattgcaagatcccttacgagaccgagcgagagcagctcgacattggagatttctacgacttcagaagcacctactctgatggcggtgatatgagtgacgaggaatctgtcgtggacgagaccagtgggggagccaaacttggggcacgccgccctgctaaggttacgggagaagatggagaagatgtcgaggacgtcgaaggcgccgacggttgggaaacggatagttcagcttcgtctcttgattcagccgatctcactgctgtccctgctgaaggccatatccaccagtttgagcgactcgacaagcacccgcatcattcatcacaagacccaaggcagaggcaccaagccgacggttggcattcgcatgcgcataagccaacccgtgctgtcttctatgatgactacgaacttcaccttcctacaggaaagtctgttggccatcgatcgctgaacaaatatttccgccagaacctgcataaccatccatctgctgaagagcgaacccgagcgtctggctattgagggctcaaaagancgggcttggcaatggctcggatgggcaacttgtncaaagaggttcaanggccgtgaganggtgcctctggaatgggnggcattggcaggtgcaccaaaacaacaaaaacgacgtgctcncagggcaaaaaaaaacaaggacggacgttggagccaggtccnccttaaccanaaaggacttggtttntggaaagaaacttcaccantnccaagaattctncttnccggagcanggggggg

SEQ ID NO: 1660 - DNA, 373 bp, Fusarium venenatum
  misc_feature (1)...(373): n = A,T,C or G
nggncaagcccccngccggacaaggcngccaaacttngccngggcnaacccaaggagggnggaggcggacaaccaaaaaacaaggggcngcgcaacngggactaaaggcccgnaacttnggccgcccannaacaaaccaagaaggggccctccngaggcccaaaaacgccgggggggaanggagnaaaaggcccaaggnccaaaccaagggggngggggccaancggccttccccgcccttggcccccggnaaggagggaggagggcntaaanaaggaaggggnaaacccgaggggacnaccaaancccaagggcaccngcccgggacacaggcaaaaaccccaacatnncccggggggcacaagggcgaaac

SEQ ID NO: 1661 - DNA, 317 bp, Fusarium venenatum
  misc_feature (1)...(317): n = A,T,C or G
cgacccttacgacaccagcatgaaggagctaccgagcccagactttggnggaccatcttcgatatcccatgatgatggagcatcgaccgatgtgaccggcaatttaatgtcttgcagtgcttgaatcactgcangaaatgggttctccgaccttctcctggaaaaactaaatcctagtttgaagggcanccaattctgctgtcaaccgagtacaacataccgaaaatcgcttcggacaccttgatctggccantttaacgcccgangggaaaattcgtcgatgaaagggaccttaagattttcaagttgtttggcca

SEQ ID NO: 1662 - DNA, 622 bp, Fusarium venenatum
  misc_feature (1)...(622): n = A,T,C or G
agatacccattcaacaacacttacagtcacactacgatgggtcttttcagaggcgacgacgacaatgacgcacctgtcacctgccccacgcattcactagcccaagatgccaagcaaaatcttgttggcaatctcagtttctatcagttcgccatgattctcggnggctcatgttccgctgtggccatgattaccatgttcacctgcaagcaactccatgccacacacctctcaaacccctccgagcaggtcaagatcatgcgagtcggcaacctcatctctgctttcgccctcatctcatttctctgtatctgcttccccacagccgaagtctacatccagccatggctccacgtctttgaaggtttcgctctcggatccttctttctgctcctctgcgattatgtatcgccccaccgagaccagcgcgatgtctttttcgcgaccaagcgaaagaacggaatgaaatggttcaagacccgctgggccatgatcttccagatgccagttcttgccgntggcgttgtcattgaaccgacattactnaagctgntggcgttttttgtnaaaanaacaactngcgcgagtcccaacatttactgggcgttatatgaccatttan

SEQ ID NO: 1663 - DNA, 139 bp, Fusarium venenatum
  misc_feature (1)...(139): n = A,T,C or G
nctgaccangtcggncgtngtccagattgatgctgnttctttccgtgaatggtacgangnccactacngtcagcccatcgggnggggaccccagcngaagacccacaccactgangagaagaagaaccaccagcgtttg

SEQ ID NO: 1664 - DNA, 529 bp, Fusarium venenatum
  misc_feature (1)...(529): n = A,T,C or G
nccgccaaggacgagacggaggcgcgaaagtcnatctgcagatgacaggagaagatcaagcanagacagggaaagggaccgggaaagggatcgaagtttggatggccgccatcagcgangaaaccgccgcccgcgaatagacgacggaagccagcatnnttccgaccaactgccagtggaaggggaacgacnccgccgacgtagcgagtcaagacaacgccagatcgagcaccagtcatccattcgatcactcataagctccggtgacatgagcgagagggatatcgagcgggaaatagagtcatttgcaagacatattcaggaagaagggctcctcgacggactcgacttggataatatcgatttgagtcccgacnacnagcttagtanganaatcactgaggcttccgacggcgtcagaaanatcgaacnccccaaaaaacncgganaaatactcccttccttgaacnacttgtgggcctcagcggaaacctnnttgttgccctgaggngnccaccagggaaagatc

SEQ ID NO: 1665 - DNA, 578 bp, Fusarium venenatum
  misc_feature (1)...(578): n = A,T,C or G
catcgagggtcgcccaggctgtttctcaacgacagtttatgttctgccaggcactcatcatgtccgctttttggtggatggtattatgcagacatctcccgatctacccaccactgtagactttggcaacaacctcgtcaactacatcgaagtcagccccgatgatgcccacaaggttcctgcacccccggccgcttcgcacgccgaagttcaggctgctgctgctgctcaggcgattgagcaagctcaggggggagtccctggaggttcgaaaccaccgccccaaccaaagggcaagcctgtgccccctccagaagcgtatcgtagtcaaattccgaaataccttgtcgactttgaccaggctgaggattcgcaagcgtaccaatacgcagttaatgcaatcgagagactaccgaatccccctgctttgccaggcttcctaagcaagccgatactaaacgcagcgactcttatgaaggacgacaatagtgttctcaacatgccaaatcacacnatactgaaccatcttgccctagttacattaagaacaatattcttgctgtttctgctactactcg

SEQ ID NO: 1666 - DNA, 387 bp, Fusarium venenatum
  misc_feature (1)...(387): n = A,T,C or G
nggcgttctcaacgtnttcaacggcaacgatccttctacactcatcgccatcggtactctggatgcgttctccgctggtatccttgtttgggtcggtctcntaaagatgtggcgcaggattggatgatgggtggtgagctcagcgatgctggtcctgtgactactgctctcgccatgcttggtttgatctgcggtatggtcttgatgagtctgcttggaaagtgggcttaaactatcgatcattaagtcgactaacaggggaagacaaaaagctgaatgattttgagatgcgatcatggtgacatccatcgcgtgtttgtcaaatggtgaatcattatattagacatagattagcatggtatagattttcacactttgatgaacccc

SEQ ID NO: 1667 - DNA, 502 bp, Fusarium venenatum
  misc_feature (1)...(502): n = A,T,C or G
tccgagcccgcttccgtagccaagaagcagactcctgttctgcctcccacattccctaccgcaggaaccccaacttctaaacaaaagaaggttaaggagagcgctgttcccattccttctattcctcactcgtcacctcccagatcctctcctgcgcctgcccctgcatcgcgggccccaagttcacctatccgggccaaggagaagcgatccaaaaagtcaaaggatagtaagaaggccgcatcaagcaagagggaaacccctgtcccaccccccgtgcctggttcttcctcggaatagcgttcccagatgaaaactcctcgaaaggaaaggcgcaggcctaanaacaagggcnagggtactctcaagatgtgaatcgcttgatcgaacgatgtgtcgcaatgacggatggcgtatagcattgttagccatacatcgggactacgctgcttgcacatggctatatataanatatcatcgttcgttctggcagtcatctcat

SEQ ID NO: 1668 - DNA, 595 bp, Fusarium venenatum
  misc_feature (1)...(595): n = A,T,C or G
caagcgtataaggctagagtcccgaaccagtggtttgatgttcccgagcaaacaatcatgttgggcatggatgaccctgaggatggtaccgacccttcgcgccactttggctgggataatgagaaaccagcacgtcaagcgaacgtccatgccttccaagctcaaggtcgacctattactaatgaagagtatgcccagtacctgtacaactccaagattgatcgggttcccgtctcatggtcctcggtcccttctaacaagcaagatggagctaccaacggtcaccacaccaatgggcattcaaatggctacactaatggaaatggaaatgggcattacgcaaacttaagttcccgactcgttcatcgagggcaagnttgtcaaaaccatgtattggnttagttcctntnaaagtacgccctttgactgggcctggatttgtttaatacnanaagcttgtcggnttgccttgggtnggatnggggggncnaatttctaccttttgaaanaggttaaaagcatttattgcccatttttgantaanccaaaaaaanggttgaacnttnaacgtttttnttttcaanaanggttcttg

SEQ ID NO: 1669 - DNA, 1063 bp, Fusarium venenatum
  misc_feature (1)...(1063): n = A,T,C or G
tgccaccaaacttcatcaaaccttaccttccttacctttacccatccatttccactttccctggcttcgacggacccttttttcttcttccttcacatacccgtttaacccaaacatcaacctccgaataccgttccgaccgtcgatcctctcgttctcgtccgcatcttcagctgcttcgcaagctttcagctcactcaaagtcattcatttgactcgagtccgactctccttctcaacgtgttcacgcgcctaatcgccgtgattcttccgtcaaataccctcatttaattcacctctgtaccccgttccaagatgcctcagtacacttctcgcgatgtcggcgacccttcgcagatcaagaagaacaagcagtctatggctgatcttaagctccgacggctaacagagctcaacaaccgcctgcgcgaggatcttgagcgagaacgcatccccgtcagcacaagcgtcaaagagcatcatcgcttactgcaacggcactcgggactatatggttcctccgtctggggcgctgtccccaagggcgaggacccctatgcgccgcaacaatctggtggctgctgtgtggtcatgtaataccagtcgctgcaattctttttcttcactacggattaccaaaaatcaactactacgcaatgtcgacgatgattcagcgattggaggagggcccgcagtcaattttgatatgtttttgacgcatttaaggggagtaaattaaggagatccgagtatgggttactcgcacaacacaggcgaaatgggccctggataccgaagcgcttgctagcgacacgacaacgacatccacgacagtcatttggggaagctgtcaggaacaaactgtcccactgacgaagcgccagaaggggggaaaagcctacatatgatccagctgtaccacagggacccggatcgagataccccaagataccatttgagcgggtcacaaaacccacatcnagagaccaagggaactatattcaagtgattttaattctgtctcggcgcatgcctcgcttcttccaactngataaganataat

SEQ ID NO: 1670 - DNA, 459 bp, Fusarium venenatum
  misc_feature (1)...(459): n = A,T,C or G
atntggcggaagcatacaataccttcataccctcggatatcgatctctttcttctgtttattctttgcctcgaacacctttgcctacccatcttcctagacaacaagaatcgacctagttttgtttagatcgacctcttcgaaccgaattcacctacacatatccatcatgagccagacatttaagcaagcagctgaatcagctcgctccaaggcacgaggtgactcggctgccatcgccaatgatattcttcacacacctctcatgaaggccgccttcccttcatcaacggtggtatcagcggtatggtagccaccacagtcatccagcctgtcgacatggcaaggtccgcattcaacttgctggcgagggaactgncactggcccaagcctagtcccttggctgtcactcgacagatcatcgcgagtggaaagntccttgactttacacangtctat

SEQ ID NO: 1671 - DNA, 512 bp, Fusarium venenatum
  misc_feature (1)...(512): n = A,T,C or G
ctaacttgacttcccgtctttttctctcccccaaacttgaccccaacatttacacacctaccaaaatggtcggcaccaatacgnaccccaaccaaggttactacccttcagcagggggggatatccccctcaaggctaccctcctcctggccagggcttaccctcccccacagcctatgcaagtaccagcaagcgccaccacctcaagaagaaaagagccacggctgcttctacacatgtatcgccacactctgctgttgttgggtctgcggagagacctgcgagtgttgtcttgaatgcctcgactgctgctgttaatcaatcacctacccagcactgcatttccccctcggnanaagcgcttgcgcataataaagaatgcatgatttttattgcctttttatcgcactaccccccgaattccatagctactgggtctctaccaggttctttttgtagctctcaataacgggctaaacacaataccacacacacatttnatcnaccaaaaa

SEQ ID NO: 1672 - DNA, 619 bp, Fusarium venenatum
  misc_feature (1)...(619): n = A,T,C or G
cgatacacattcgcttcaatgattcctcaagctgatgaagccatggccgtatccaggaactttttcttgccgcctacgagcggggccaacactattgatgtgagaaagatccagacggtacaggaatactttttcttgacacgcctgcgagcggggccaacactattgtcttgtgagacctttgcagcacgacaaagctcttgcaagatgcgcacatgacacaacagctccaacagtcttatgatattgaccaattcctcaacaacccatcacccatcgatgagacggtcatcaactttgccgacgacattacccaatcgctaggcgacgcgcttcgatctacaccctgcgaatatccttcatcgggtgctcagacaccaaacagatctcaccgtcgacccaagcgactatcacgacaaaatactacatcttctgtgggtggaagctctgtgtctagaaagtccaagcgctgctacctgtgcggcgcgactgacacacctcgctggcaaganactggtttggggantcgtttgttctgcaatgtttgcgggttgttgcactctaagaaattgattgcgcgaaagcgtcttgctgaatccagccgggggcgacaccatgt

SEQ ID NO: 1673 - DNA, 561 bp, Fusarium venenatum
  misc_feature (1)...(561): n = A,T,C or G
gttctgagtccgatgcacgcattttcaagctttgtgatcttggcatcgctgctgaggctggnaaaggttctgggcacaacacaacacagtacattggtagccaagcattcaggcctccggaagtgagtagcggtcgccgttggtcgactaaaggagatatttggtcccttggagccacgatccgtgagttgaaaaagctcaaagattccatgctggaggcctcgatacagagaatggtcgacaaatgctccgacagaaaacagaacaataggccaagtagcctanaaatgctagaagaggctcgtaatgtgctcgagacaaatcagctcatggatacattgccaatttcatcgcgactccatatccaggcagtgcatggtcttttggggtggtcacaaagggaggctatctcatgcaagccgttcaactttggngggcggagctctttggatgatatcgtgcctttccataacaagctggccaaaaatcgtcgcaaaagaagacaatcgaaccgactcttncgtttctttggaatgacggtgtccaaacagtggtttccag

SEQ ID NO: 1674 - DNA, 707 bp, Fusarium venenatum
  misc_feature (1)...(707): n = A,T,C or G
caacaataatgctgctaacaacggcggaaacaacgcctttgagcgtcgcgatgaagattttggtcgtagaaggactgttactcctgccgcggaggacccccatggaatcaggaaccgatctcaaagcaattcgagcgaacaccgagcttcctactccgacgcttctcgacgaccttcgatggtggactcgtacccgcctccacctccgcctccatcttacaacccggctccttcagccccgcgtcaccttgcttttggcgagtcatntggttccaaatactcggcacctcgacaatatgctcaccagcctggtctgcaaataacacccgtctccgncaacggntcgtaccctccaccggtcagtcgccatacaccaagaccgatgcgccctatggatacaccagccgtcatctcccaccatnatgttctttgcccgccccgtctgtcaaccgcgacttgtatgaccgtagacactccaccagcacctacgttnctccttntccgncagnctactccgctgaaggccactaccgnngagactcgcaggcattatacccccctacgcctgntggtactcttcccgtatgaacacngagtcgtctcgcggatccatcaanatttntggtntagtcgaacccatgcccgtcattgagcctcaggnggaacctctcctgaacttccccccgtaacgttggnggnaagcgcaa

SEQ ID NO: 1675 - DNA, 1112 bp, Fusarium venenatum
  misc_feature (1)...(1112): n = A,T,C or G
caacaaactcaattgcctttctcgattttcaactctttgcttatatccataggcgtcttagcaagcacactcgattcacccacaagcaacccgactaactaccaagtacctcaacgcacacacaaccaccaccatgttctctgttactcgtgccctccgacaggctgctgtccacgctgagcgaacccctctcatcaagttcctcggcccccgaaccattccttccaacctcgaccacacccccaagcctcaccccgcctntggtgtngaaaagctccccgagtcctggtccggctacggaaacggngacgccgccgnttcccacaagaactttagctcctaccgcgaccacgtccagcaacacggtcctcttnanaagtctggcttnggcggnaccaagcgctgcctccntgggttctgtcaaccctccaagggtgntgcctttgacctctctgagcttcctgcccgnttccaccgcgctccccttaacgctgccganatcgaggctgtcgagtctggcggcgctgctctcttcggttaaatatgtctcccgccataggcgaggagtcataggtggagcggagggatgaacgaatacctacaacgatgcgggctatgacgaaaaccaggaagacccccctggagcatgcatactacgcggcatagtatacgaggacccgagtggtcatgcacagtgacagcctattcacggtgcatttcgggatgggcaggtaaacctgtctcatcgacatacaatgcagataaggacagagtttccgactgcaacgcatctcgtcaggataccacttagggcactacgatactatgttgtcaagagcgtcatatgaaacgagaggttggtctaagcaccaaaaagaggaggagaattggggaaaaagcaaataagtcgggtttccagaaaataccccccgactgcgganaacattgaaacctccgtgctttgcccatctgctggcgtcaacgccatttcttctgagtagntggatactacctgcaaagctttaacagcgancaaggagcnccgcggngttnaacananganttncttttngnggaaatnttgatnccaaaaaaaaaagttttttctcttn

SEQ ID NO: 1676 - DNA, 620 bp, Fusarium venenatum
  misc_feature (1)...(620): n = A,T,C or G
ctctgggcagatgaacactggatcnacccaggaagataaattcgcacttgccaaaataggcgagcttgctaatatcaatatcgaacgacttttanaatacancccaaaanaatctggctgggatgtactaaccgaaaaactcatcgacaccttaacttcctcaaacacaaactcatccgtccnaacaagggcagctgatatccttgncaaactggtatcggaagctgccaatgtaacttcttcgctaccagaggaggctcgcggcnacaaacaactgcggttctttgaggctcttcgcatgtcactagaacctctgcttaaggganaccgtgaggtgtctcttgcaagccactccacggatattgatattcacaaaattatccttgcgggcttcaaagtatcatcgagagcaacgganaaacactagtcaagggatgggacattgcctttgaaatcattggcaccatctttgttacaaaanaactccaccacgantatcgccgcggcttagtggccaacccaattctctggacactcgatcagcaaaactcatcanggcgtcttcaactctctccacttattgntcaaactttctggnctccctacccaaatcgtgnttt

SEQ ID NO: 1677 - DNA, 954 bp, Fusarium venenatum
  misc_feature (1)...(954): n = A,T,C or G
agtactcatgtctctgctgtttcgcgccatcaggcgctctctgtcgcgacaaccccttcgtgataccaatatcgcccctcataagtgtaatcatttccccagaaccctaatctgcctctcatgtattttcgaacaagaattcatcgtcagcaaataaaacctccaccttcaattcccaagaaccaagttccctccgtactccttgttgtcgcccggctaatgaggttctcctgcttcaccgcgtccacacgtcttcttcgtttgcatcggcccatgtctttccaggtggaaatttagacccttatcatgacggcgctatccccgaggaagctcgccagagaggcaccaggacgggctggcatacaggataggggcaattcgagagacgtttgaagaaacaggtatcttactagcaagaaaggacaacgagctcataaatctggatgtcaaggacagagacgctgcgaggaagatgatccatggaaaccaagtcaagtttctggaatggctcaagtcagtgggagctgagccagatcttgatggcctcattccgttcacacgttgggtcacaccagcaaccaacaacaagcgcttcacgacccagatgtatctgtacatgcttccacagtcacgcagcgatatgccatctgagatgctcatcccaacacccgacaatggggtcgaacacacggccgcgctcttcgcaccagcgcaatccttcctctcccgtgcctccaccaacagtataattctcttcccaccacagtacttcctcctaacactggttgccaagatcataaagagtccttcaggaggaacaggaccacatcaaatttcaaaacagcgggagcagctactgtcctttttgaagcaagtggccacagcanagacagagannggcaagcaacacaaaacatctatgattccctggggccgacaaaatcatgancccgc

SEQ ID NO: 1678 - DNA, 341 bp, Fusarium venenatum
  misc_feature (1)...(341): n = A,T,C or G
tggccataatacatggctctggttgttggtagctaanaatgggtcgtgacttttccccaagatggcgccgtaaaaacccaaccgaattttgtcaaagaaattgttggcttttcatctattttacagcgcactgcgtggtagtcacaagaaaaccganggccttggcggcgtgcttgacgtggtcctcgccaaaggtngagatgaagaagtnagantgatcgtaaccgtcctggtatcgganggtcatgccgtcaatgccagcatccttcacagccttctcgagattctcgggganaactggttctgcttgtaaaagttgtcaccagtgcccacatcgatga

SEQ ID NO: 1679 - DNA, 995 bp, Fusarium venenatum
  misc_feature (1)...(995): n = A,T,C or G
nggaggaccagcatgaggacatcagtaatctcanggctgaggatgtcgctactcccgcctcagctggcgctcctatgcccgatgccctgattgttgatcccccgacgtnttctcccttancanatactcctgctccagaggcagagccaaccanggtggttcctcaggaagcttcccaaaaggagacggtttctcaagagacctctggagctgctgtgcaagacaccgcctctcaagacacgccttccaaagagatcacaacccagcacactactactgaagaagccggatccaatgaacccgcatccaaagaaatcagtccccaaagcgacgccaccaaggagagcgatcagaaaaaacctgctatccaagaggatgctcctcaagaagcagctgctgtgctcacttccgcagcggtaagtgacccgcggcagttgccacgggaggcagtggttgagaaggctaccaatctttcgacccctgcagttgaaacttgcgaaacctctcgacgactttgaggatgtcccagacccngacgaagatgacctgggacgacctggacgatatgttggacgaattctcagcagtcaagatcgaccaaaccaagtctgtcgaagctccttctgctattaaagcagaagctccaaaagacgcagctccctctggcaagcagcctgaaattgaagatgcgtttttagaaaaaaaatttgccaaacagttacaggctggtatggccgatctcttangcgagcttgagcagtcccctgatatgcaagctcaatttgaggacatatttaagcatatcgctgcggcggaagggcgctggcgatgcgccaccttcaactntgcaaangggncagcatntnaaggaccacctgaggatgcatntttccaagataccattaaccggccattggaaaggatncagccttaggggatnaanccacggtttttnttnctttgggnnccgggaanattttttcccgaaagcttaa

SEQ ID NO: 1680 - DNA, 274 bp, Fusarium venenatum
  misc_feature (1)...(274): n = A,T,C or G
nctttcgccggnggncggaagganggggaaagggntnccggggacctgggggaanggggnggacaataaagggggacngggnaggggacnttncaaaaagnanggaagaaggcnggccgggaggggcaagaagggccgggacgggggacgaaaanaatgggcaccggggggggncgggaaangggngggaggngggaaanggncaaggaggttaaaggggggnggggangggggaacngggggaaacccgggaaaanccggggaanaaangggg

SEQ ID NO: 1681 - DNA, 590 bp, Fusarium venenatum
  misc_feature (1)...(590): n = A,T,C or G
cttttgagcaagtgctcgacagacagacattcgtagcccagcatgcgacctaccaactacctaccgagaccaaaccttttggtttcggcctttgcctcgatctcaatctacggtgctgtcgcgatggcccaagacaacaaggacgacaataaagacgatgctnagaacaacgacccctctgctgtgccggcccccgctgctgaaccaaccgatgcgaanaacggtgatgctgccgagtctgccnaagaagcaagtgacgaaaagaagcccgagcctgccagcgaaacaaaagacagcgcaaagcctgcatcaactcnagaaacaaaggatgaagcaccctcgaaaacngaggagaaggacgatgaacctgcctccnctgaggaggaagattcggccaccactgtnacaggagaaggtccgacaaaaaccgaagatattcaatctaaaatcccggctattgctgagactggtnccgaanaaccatgcctactttgacaaggtacaagccaattcccacttatccagctccttccgttcccccccaaataacgcccctttcatgcgacactcaaatncccctgacnggactg

SEQ ID NO: 1682 - DNA, 337 bp, Fusarium venenatum
  misc_feature (1)...(337): n = A,T,C or G
cgcatttctcacaatagtgaaacgatgtcgttccctcatcggcacttctaagctggagggcagtgtaacgcacctcttgcgcgtcacattttaagtttgtgcactcctcggctatcgtgcaccaggtatctagtgaggatatnttttcggcatgttgaaccatggcgttttgcacactccggcaggatccttcaccatggagacgctgacggtgcctatcaaagtgtctgggacgagacagttntttagtgacgtgtgcaagacggagcgatgatggatacgaactcttgctcaccaccccgcaacagtcgcactcgacctccgggtttttccnttt

SEQ ID NO: 1683 - DNA, 476 bp, Fusarium venenatum
  misc_feature (1)...(476): n = A,T,C or G
gtnttctctttctcttattttctccgcaaactgtcagtcataacagcaagcaaaagttgactgtctctactctttgatcatcgctgttctttgtgacttacacgtgaacttgttacgtcagtgatcacgacttttactttacctcactttactcttcgttgcctcgcacttcattagctgtcatcatgggtatcatggctcttggtccacaagacttcctcgactatgtcaactacgacaagcagagtttgtacatctcagctgcctccatcgcctttaatccgctcttctggaatatcgcgccgtcaagaataccacaacaagcttctgcaaagctctttggtggaaactncaaagctgcttgctatgccttgncatcactatcttttctctgggnatnggtcgcgacttgattacaagaatgccatctntgacaagctacgcatccgnttttggcaacgactacataccggctg

SEQ ID NO: 1684 - DNA, 200 bp, Fusarium venenatum
  misc_feature (1)...(200): n = A,T,C or G
gaaggagagctcgagcttgtccccgagctgtacacgcaatgcccgtatcctcagaacatcacctttagcaacctggcctatttctggtgggcacccacgctcatctaccagcctgtgtatcctcgtaccgacaaaatnaagatggggttttgtggccaaagcgtgttggagagactttggctcaagggatttcaattggg

SEQ ID NO: 1685 - DNA, 2396 bp, Fusarium venenatum
  misc_feature (1)...(2396): n = A,T,C or G
gagccctccaagcactttttacttgcttcatttcagtgtcatcacttcttgactgctgaacatttttttgaanattttgtcgcaatggctatgatatagattttgacgctcccacgagctttttacgcgttacaccctgggcacccttactggacactctctactgtttctcgaccctcgatctaccaccataaccataaccataatccattcttttcttccgaccgtgacctcgacatggacgatccagacgtagcctggcctgcctggaaattcggcatgaagagggatgacctctataccaacctccaccaacaatacaacacctttaccttcaatctccaagaccccgaagcctttcatcatgacgttaacgaaatttcccacgatgccgataccgtcgacgaattccaccgcttgatggctgagcgaaagcaacaacggctctacgaattacacgactccctggaatctctcgccgttgagatcatcgccnaaccccaagttgatggactcggagcactggcagcatgctcttcaacttttccgcaccaaatcctttgactcgattgtccgttattttgcaagctaccttcctgccaactacatcgatcgtcatgatcgcgaacgcgatcacgacaccatttctattgcttcctcctcctattctgaggctaacagcgtcaagactgaaagcactacggccagcagcgtcgacggtgtttcgagtttctacgacgatgagcctgtcatgaagaagaagtcccccctgtctatccacacagacatgcggtcatcttctatcgtgcaggcgcctccttcgccgccccactccgaggttgcgcactcagatgagtcttcggcttcgtctcctatggagtcgcaccgatactcctctaaccccccttctcgctccatgtcgttttctgggtccgtgtcggggccttttcttcctgacttgcctcgattactcggtcacgacgacgatgagaacctcacaagtccgatgataatgacganggccgtcatttcggattcggattgtgcaaagagccagtcgtcacttggacaccatggatgaaagggagcagcttcaaaaagtatgacgaagatctagaagatgaggatgaatttcctactgntcaatttcctgaagatgctagcgacgcttattcagatctttcacaaccaattcgactcaccacttacagcaacaataacaacaaccttcttacatactctaggagccagcaccatatttagtgcttgcttacttactcacatccattgacttttcaatccgtcacaattcttcttcagttcaaaccctcttccaaaccaccaacaataccgccaagatgagtgctcagaagacctcagccatcgctgatcaggagcctgttgacgttctcttcgctatccacgaaaagttcgatcttctggacttcgccggcgcgctcgaggtctttacttctgcttgtcacaacttccaggatcctgagaacagcaaggcctttgaagtcaccgtggtcggccccgaagccaaggtcatctcggaccagggtgtcgtcgttggtgcccagatcacctacaaggaggcacacgaccgtctcgaggactttgatatcctcgtcgtcgtcggtggtaactccaaggaggtcgtcgctaaagagcttcaacccctctctctaatcaccgacttctcagagcttcagaagcgtgatcccgctcgcgagcgcacgattntttccatctgcaccggtgccctcttccttggcaagcagggcatcctctctggcttgtctgccaccacccaccccgattaccttacttcgtttgagaacatttgcagcgatgctgctaccgtaaacctccaggagcgtaccgatgtggtagaagacgctcgctatgttgtcaacaacctacgattcgatctcggcgaagacgagagcccatacatccgccgcaagtctgatgctggtcagggacgtcgcccttcggcagcccgaaagggaagcatgtcattcaaggactccaacacacgccgggagtcaattgttcgtcgtgccgccatgcgactcggnggtcttcgtgtggtgacatctggaggtgtcaactctggaattgatgctgccctntatcttgncagccccttgattgatgatgctacttcgttggagggggccaggcgccttcagtggacctggaacaanggcgttgtcgtcgatggtctccacgtctaaaatccctggcagtaagtgccgtgtaccaattaaaaatttatgatgggctcaggcatacccccgattganaccaatttccatgtatttatgtatttgacagctgagcgtgaggaaccctaanaaaataccaaaaagactaggagctntntattt

SEQ ID NO: 1686 - DNA, 588 bp, Fusarium venenatum
  misc_feature (1)...(588): n = A,T,C or G
gctaccgtgatcgtagtccgcgtcgcgactattacgacgaccgtgctcgctatcgatccccacctcgtcgccctatggaggattatcctccccctcctcctcgcggtcgatacgataatccataccgacgcgattaccctcctcccccgcctgatccttatgccaatgggcgacccccatacgaccgacctcctcgagattttcctccccnagagggtggatacccaccagagggtggctatccgcgagactatnatcgtggtggacgtttctgatctttcccaaccnaatatgcccattggcgtgtaacagtcacnacctgtttatgggtntgaaagggcaagattcaatggaagccatgattggcagacaagtgcgacaatgtntgacaaccgactggtgacattccccncccaaaggataagcanattggattggcgtccggtgcaagggcttgcaggatatacttcttggacaaatgggaaaaatccncnactaccgacttgagtttgctacgttatttgagatatattgtacnactaggccatggaatatccccaatganngtttgcttgttttgcttcttgt

SEQ ID NO: 1687 - DNA, 535 bp, Fusarium venenatum
  misc_feature (1)...(535): n = A,T,C or G
caaataaaacatcttgaccatcatcagactccgagtgaagctacatacaagcttcatctcttactccaaaagccaccacgttaccccttcgccttttctgccaggcctctagaagccttcccgcattccgtcctttgacaatcttcagaatggcttcctttgcttctcaaacctacactcccaccgaggagaccgagatccaacagtggctcaccacctctgagcgtctcaagtcccccgaggacaagtccaccatcctcgagaccctcaacaaccacctctccagccgttctactctcctcggcagcaagccctccaaggctgacgttgccatctacgagaccctcgctcccattgttgctcagtggtcccccgaagagcgcaccggcgagaagggccaccctcatatcgtccgccatgtcgactttgttcagaactctccctcttcggactcgacgtcaaggacgaaaacaagggtcaaggtcaacaagangangtctctacntaaaccncccgtcaacccaaggcgaaaaag

SEQ ID NO: 1688 - DNA, 627 bp, Fusarium venenatum
  misc_feature (1)...(627): n = A,T,C or G
cttttactctcttgcttctttatcctgaggccgccaccaatctgcaacttatttacaggcctttgggattttgcacgccctgatccaggaattgcacacccttgtatctatcggccctcataatacccttttccgccccgtccgttctgtccgggcttctttccctccaattctgcccgccttttctatcgcatcacattacaacgaaacgaaacgaaacgcggcatacactttctaccgcctgcatttcaaatcgatacttgtcttttgctgctatctctgaacaaatcgagttcttttgagtcgatttaccgcttgaggaacacataatcagtccgagtcgcgcgttactgcttccctgtcgttctacgccacctncaccgcattggctcgccgacagtaaagctgatcaatctcggtcacatattccatctncgacctgcttcaggacacctctagccatcaagtcgactgtcttttgacctcatacccaccttacatctaagccatgtcattatcccaccctcgtcgaaggactccggtgacttcgcccggactgngacaccgagaatgccttgnctcttaagaacagnttntacccttcgtaagggtgcaacctttcactct

SEQ ID NO: 1689 - DNA, 615 bp, Fusarium venenatum
  misc_feature (1)...(615): n = A,T,C or G
cttgtcatacgccgttaattcgtaaacccaaccgtttcgtcaaacaaaaaccgtttctacgatgagatcaaaaatttctgcaagagcaggaattctcccactgaataacacacgctcaacactcacatccatcctgttccctgcaacgcctgtctcgaggaatgcacgttcgacgcctgaaagttcccggttctccatgtctttccacttacgctctgcttcttcgcgcgcagcttgcaggaccttttccgtatcctctgactcccaaaggttacacctatcgcattccttacattgcctagcgtcaccttcggggcggaagtggtcgcagaagtggcgatatccctcgtcactgaggtcggcacggcaaacgtagcacatcttgtagccgcacgggcaccgtgagtttgttgcacctgcgttcttgacgaacgaagtattgcaacnggggcagacgccccttgatggccatgctcatggcgtgctcgacctgtgtacngagagctacgagcgatgattcgtacacacatgtatattcnttcatgacttgngacatggaaagacacgatgagcgacacacttngggactntggctgtgaattttgggccggggnn

SEQ ID NO: 1690 - DNA, 449 bp, Fusarium venenatum
  misc_feature (1)...(449): n = A,T,C or G
gtggaaactgccgaagatgtaaacaagtggacaaagcacggatggggttgggatactcctccctatgttagctccatgtgggttaacaagatgggcttgggacgtgccactggtatgaacgttagggaaagagacagcttttccgagtcacgaggtggtgatcgtggtggtgaccgtggtggttttggtaatgaccgacgtggtagtgcccgaccttcacgaagcagcgatccttttgacaacatggcggccaacgttcgccgtgacnactttggccgtggcggcaaccgaaccggcggctttggtggtggcggttctcgcggtttcggcggccgtaatgacaacggctcccgcggccgtggcgggttttcttcccgcaatggcagccgtaatggcagccgttcctcgttctaagttatganancggattagtgaaaaggttaaaatgt

SEQ ID NO: 1691 - DNA, 107 bp, Fusarium venenatum
  misc_feature (1)...(107): n = A,T,C or G
nncatcgagacnatcttcttcatcacaagtgangcatcggnnaagtgctcaacnggaaaagcncactaccgtcaatggtcgaanacantctttttgccatgacatac

SEQ ID NO: 1692 - DNA, 738 bp, Fusarium venenatum
  misc_feature (1)...(738): n = A,T,C or G
gatgtgcgtcataccatgtatgtgccgcctcctaacctcccagagagtggcaccgattcccctataagtggtctagcagcatctccaacccttgcaccatctccctccaagggaagtgcagttgctgcattggcgtccgaggctagcattgccggtacttctgatacacaatcggtgagatctggcaactcattgggcggtggaaaccatcctcaacacgctcaaatgactgcccctggtctcaactcgtccatcattgagagtgtgtctgctgtttttgaagatggcgttctcaagtcggcttctattactggtgaagttgcattcgtcaacaatccaagtgactccggtgatgctaagagctatgaaaccatccgtattaacaacttttcggccctcgagcgcattggtcctaaccgcatctttgtgcaaaactcatcccccgacaaccatgatcagttcaatcttgatgtatctcacctcaccaagaatgccaccgcattttcttatcgagtattctccaaagantccgacgtttcaacattggccgaacatgttcctctgctcctaaagcccgcgtggaagcctcagggagacaagcttggcttgcttctgcaataccagcttaacccggccgccaagattaccgctccgtatcactgcacaacgtggtcattgtcgcaaaatacgaaggtaaatcaagtggcgccagacaaagcctgtaggaattcatctcaa

SEQ ID NO: 1693 - DNA, 608 bp, Fusarium venenatum
  misc_feature (1)...(608): n = A,T,C or G
aagcgaaattaccttaacttntttagacatccgacctaaactgcgacgaaccaccgttttcccatctcaccaagaacctagccacgatacctacagcttgcgccttcaactttatagggcagtgaatggatactctattctgttgcacacgagcacaccttccttcgccctaacttcgatcctcgaaactttcctactccaccgccaactcctngaaagctttgtatgtctccgccggagcaatctacaccttcgtccggccagcctgtcttanacaagacgctgtctagcaaacctgatgttgatgtgacgtctactcagcaccctacgatagggaattctgatacctcggacaactacgaccatggctcgaaatcagaacccgatactcaagagggaaagttgatcgacttgagcgaccagccgaccaaccagtcgcaggacgacaacnctgacgccgccgctcaagaaggaccttcanaaacgggtaagggaaaacaagcagntgatgaccagtcaacttcgagcggngccttaaacacccgcatnttgggtggatncaaaaacaagcctattgnattacccccgtnaaacgatccccgacttan

SEQ ID NO: 1694 - DNA, 367 bp, Fusarium venenatum
  misc_feature (1)...(367): n = A,T,C or G
ttaccttaattgacctccnaccttcattggtattggtatcctttccccagagacaggacaagacaatnatgacccggacaaagtnttctacccccaccagcagnggcaacacctgcgcgaccggntngtcggccacaactgcgacgcgccgacaggcttncgcaagacctggaaaagcgagatccctcncttgtcgacaatgtcgcgatcgtaaaatccgctgcgacggcgcccgtcccgtttgcgattcttgttctanacnaggtctttgtgcggaacagtgtntttatccagagattgagcacgaagggtcatcncttngtcgcgcaaatatatcgcgctctccaaaaacgtgtacaaaagcttg

SEQ ID NO: 1695 - DNA, 870 bp, Fusarium venenatum
  misc_feature (1)...(870): n = A,T,C or G
caaacgcaaattgaaagacgataacaacattcgatatcatcttgtcttctatcaccaacacttctgattacttctcatctaccttgtacactttcccttcagatatttcaagatgatgcacccactcttcggcgtgcaaccagcaggctctctgcccgtcacatatcctcacgacgtgacgctagacgattacacacaacaaatggcatgccctcagacttcaagggagatactcgcgaagctccaacgggacagcgtcctggaggaactgctatgagagtcgccaaaccttcgagtgccaataacagccctcgatcgtctagtcttatggctcgacgcaagactctcatgaatgacggcaactctcaacgacgacagcaacaaatcatggagcaactttcttcattctgcgatattgaatcacaacagccctaccaacgaccctcgcgtcccgtgaagctggcacccgagctcttatggtcaaacttcaacacaacagcagatgcctaccttggccccaagttactcgcctgttggtcaacaagatctatatggaaactattctcactactcacctatgatgaattcaacttcttgtgggacatcccccctcgccttctcccatctnccactgccataccagtctgccgataacatggcatacaacccctaccaaggaacctgcatgtcgcagcattcaccggctgcgtctttggcgacggacgcttggtcaatgccngctacttctgctcctgtcgaaactgnatacagccatgggtgggattgggacaactttatcatgcatgggttcnggtnaacaacggcccccacaccagaaacactttccccaaagccaattttnttaaactg

SEQ ID NO: 1696 - DNA, 574 bp, Fusarium venenatum
  misc_feature (1)...(574): n = A,T,C or G
ctatcctcaagccctcatctcaacaacnaggtcctcctgccnaggaagataatatgcatcccacaagaacaaacactcgccgacacattcgaagcagcccttcaacagggagtgccgtaacaactgtaattgaagcagaagaggaggacgcagatggggtttcgaggaagctcaaaaacatgcacctcaccgcaccttccccagtggaagaagagccagaggtcgccgaggtccctgttattgttgaacaatcagttatgcgcgagaccgagtccaaagcccatgaccctcattctgaagaagccgaagaggacgaaatcgaggacgaaggcgacgaagatgctgaccaaacaattgtcggggatgcatccgaaacagatcctaccgacgatgaagacactcaaaataatgaatccgagccaacacctgacccngttgagcccaaggaaaccaaagaaaaaagcgacccncaggaagaatcgcccgaagaaatctccacngattccccngaatcttactgaagaattcgaccgcaaataccggctgangccccgcccgataccgaagaacaaac

SEQ ID NO: 1697 - DNA, 588 bp, Fusarium venenatum
  misc_feature (1)...(588): n = A,T,C or G
gctttctttgttttacactctcttcaaccacattcttcttctgttcactccttgacaagaactcttctaaatacaacgaacaaactcccgccattggtgctaaaataccctcaacgtcatgaggtagtctctcatacggcgactttggctgatagtgtcaaagtttctactccaaaatctaaccacgatagcacattcaatcatccatcaagatgacggtttgcaaattctttcaacagggaaactgcaagtttggcaataggtgtcgtaacgagcacatcaacccaaacgatcaaaaccgctttggagctctaggaggaggcaacaaccagagcccagctgaaaaatacaatatcaacgccgataccatcgaaaaagatttgacgaccgaagtaccgcaatggatcctttcagcctatgcgccanggagagacgctcctgggcagctctttggcgggttcccacgcnaaacagaattttgaaganttgcggctgcactttatgatgggcaaggnttcaggaaacgaacagcaagttttgaacgaaagcgcaagaactgtnccgaacgcccagcaacnaatgcaaacc

SEQ ID NO: 1698 - DNA, 703 bp, Fusarium venenatum
  misc_feature (1)...(703): n = A,T,C or G
gccaaatgatggtaaatatccatttcgtccaaccancttttgaaantaacctgttcnttgaagaaatgaccgacggtttcttgacggaagccgggggcattcttgaagaacttacccccccaccttccagggataagcaaaagctcccataagaacgcttgaagtgtccaaccagcttgtgagaagcccagtaggnatttggctgaaagccttagaaactgtggaaaggttgtgggcgggttgttaagtacctaggcaattgatgtccagtgagagccaagggtccgcttgcaaccgagaagagtaggttattcaggagctggtggaaagctctttgtcccgtctgaagcttgnggtattgcgctgtttcggaccccgatttgtttttaaaacttctttttcctccccttttcacttgcattattcaatcttcaactgctttatttctctacctaaattccccgaaataaaaaccaaaaaccgtcgaaatggcaccccgtccccgtttcaactttattgaacccttaatctttttccagaataccattggnacttcttcccagaactttaanggtggncttcaaanccggagcntccaacctttggggtcccttccnaaaaaggggggngaatgnctggtnccttccnttccaagtccnanttatttgnnttatccccctanaaaaaaaaccggaaccagttt

SEQ ID NO: 1699 - DNA, 579 bp, Fusarium venenatum
  misc_feature (1)...(579): n = A,T,C or G
ggatggatcttttacgacaacaagtggcaacacggccaaagaggttcagatggctggggtcgttggacaagacgaanaaagtggtaccgcgatgccgagcttgtcgaagttgatcagaacgcagactccaaggaagcttcgaaagacaaggaatccccagcagtaacgaaactacgatctcaaccatacgccagtaacgaagcaatggtttcgacacgaaccgccgaagttcaagccagaagacaccagttacgaatgacgccagctccaaagttaccagacaatccctgttngtacactcgacatccctccaaatctttccntcggtcccctttctgcgaaaaacaacccctgacgaacctggaaccnaatnttaagaaccccccgacaaacntttaaaccgttggacaacattcnnttcaccaacaaaaaccccaacctttngttgcggaacccgggnttggnaattcnaacaggttggccngaagaaaatggggtttttggcaaaaaagcaaaaaattnttaattacaaggtttttttttcgnaaancccccttccaaaattagggtttnatggaa

SEQ ID NO: 1700 - DNA, 580 bp, Fusarium venenatum
  misc_feature (1)...(580): n = A,T,C or G
gctgctacaccttgtcagcgattgcagagggacggaccctcgcacgccatcgccaggtcgctcgctgcgagcaagggcatggaagcaggtgaatagatagcctgcctacagaacttccaacagtaatcgcaatcatgggagatcatcactcaagccctggtaaaaagacctctcgcagtcttgccgatagtgagaatctttctagcgtcaacatcaaccgcaacaatatgggctgtcgantttgtcgtgcaagaaaggtcaaatgcgatggccgaccaaacggctgtcgcaattgcgaacgtcttcaactcgagtgtgctgatgacgacgctcaaaatcggggcagtcngcgtggctcagttcctgtttctctgaaaaaaatccggacttaccggtcttgtacaactgtcgtgtttcaaagaacaaatgcgacggcgaacggccgaaatgttcgcgatgctgcgcccgtnatctggantgccantacaacggaagctcggctcctcgctgggcgcgcaaccttancnaggcaccaaccgtgggctccaaatgaagaaaaattaaaatcttctttggatgc

SEQ ID NO: 1701 - DNA, 487 bp, Fusarium venenatum
  misc_feature (1)...(487): n = A,T,C or G
caatagccaaggcgtggtcaattgaagcaccgtcattatagcagtgaacctcctctgtctgagggtttggcgagggtggctttgggttcggctttggggaangtctgggcggcgcgggcatgggtttgacncttgtggtggtggctggatttcgccaggttgggagagggagaccgaactcgagcgcacactgtcgctcgttctcttgatcctcctcgttttcgggcacgccgggtgttggtacattggtagatccgggatgggaaggtttngtggttctggccntcttggtgggtttggattctgaagatcgggaaagtctctgccaccatctgggttatcnanaaaacagggatgatcgcnaaagaccnacagggcttgccncaatccatcttacacctangacccgctttcctggacnccaagttacaactgggaaanataatggtanaacattatctccgatttnctgatttttaagttcgta

SEQ ID NO: 1702 - DNA, 608 bp, Fusarium venenatum
  misc_feature (1)...(608): n = A,T,C or G
caacgatggacggcaaagacaaggacaacaaggacaacaaggcccggaatggggcgacgatcgcgagcacagcttcctcgacgacgacctccctgtcattcgcgaaaaccttcgaaaggggttctttgagacacaagagaaggtcaacggatggatcacaaacctgaagaagaagattgaagagaatttcgatgaaagcgaggagcagacacaaagtcaaggacagcctttccgtcgtcctggagagtctagccgccggagcggtgattatgatcgatatgacgcggaccctcaagtgctcagcgatgacttcgctggcatgaagttctcatctgatggaactcccatgaaccggcctatggctaacactggcatgtacaagcctccgccccatcaacttcacccaagcctacaaccggccgacgagttggcttcaaggaggaaacagaagagatcaacatgtncgatcatnancacgagtgccaccaaggttccgncctacancggtccagaggaacagtgnaacttgtcgcgtgaccagcccttgttagaacgccatnagttggagatgtgaaataaaggngcccntagaaccaggtgtagatntt

SEQ ID NO: 1703 - DNA, 536 bp, Fusarium venenatum
  misc_feature (1)...(536): n = A,T,C or G
ntgaagttcctntggtctntcgccctcgtcgccgctgttgcttctgctcagtccgctaccgattcagacgctgctgccccctcagcctccggnggatgtgacgccgacttcatcgttaagcgatgtctcgaaaccgagaacgcaaaggttgaggagtgtaagcccaacgactgggattgtctctgccctgcttacgaggccgtcgctacctgcttcaacaactgccccgacnaccctcgtgctggctccgccaagggccaggttcagatcaactgccagaaccagtntctntatggaacctccacaaggaacacaaagaccagctntgccacaagctactgcctcggaagcatccgctaccgagtctgatgatactgaanagaccggcactgcaactgagtcggcttccgccgccgaagaacaccaataaacgcctntaaaaaggcccgcaacaactggtgggggttctcctccccgttgctnggggttgttgctgcccncctgnaattccaattttnaaaaagggggttttaanc

SEQ ID NO: 1704 - DNA, 590 bp, Fusarium venenatum
  misc_feature (1)...(590): n = A,T,C or G
catctttcgcagaggttctattctttcttaacttgtccgattctgacgctcacctttctatagctgattccggtgatacttatcgaccccgtgagaagtcacgatctcccccgcagaacctcaagaaacccccgaaagggtccaccgacgcccgctcctattccccccgcagccgatcagggaagccggggacgactatcgaagaaaccgtgatcgttcgcccatgactagcacaggcgcaccangtggaagaacaagtgctggatacggtggacaggccctcaccgatcttacgaagaacgagccgttgctcgagaacaaatgatgaacaacattcgcgaatcgtcccaacaggaccgccgagtctacgtcggtaacctctcgtacgangtcaagtggcaccatctcaaggacttcatgagacangctggagaagtgctctttgccgacgtgctcttgcttcccaacggaatgtcgaanggatgcggaattgtggaatatgcgacacnggancaagcccagccgctgttgncccactgaaccaccagaatctcatgggtctctaatctacttcgtnaagaacgtgaagc

SEQ ID NO: 1705 - DNA, 489 bp, Fusarium venenatum
  misc_feature (1)...(489): n = A,T,C or G
cttgatcccaactacaagccctcacgacctctcgatctatatttttgacctttatcgcctatcagagattagagcggcttattgttttccgcatagtttgccttctactccttctcttcttcttagacactctacaccagcgtcatacaactttcttacgagctctattctaccgtcatagcatctgnttctcagggatcgccgctgcaacaaacacatcgacaatacgagtacctaggcactagcgaaactttttctcccatcatattcgatctcgaacggncagtcccgtcggcgcgcggggactgcgactgcgacaatgacaacaaacttggataacagtagcaactcttggctgaataagctggtgccaagtcaatatctttcaagcgccttcgaagaaaacaagacgggaagcggcagggtttcgcttgcgatctagngttttggccatcgcaatcaagcgcgaactttgaaagngacggaccc

SEQ ID NO: 1706 - DNA, 655 bp, Fusarium venenatum
  misc_feature (1)...(655): n = A,T,C or G
agaaaagcgaaggtcgtgatgacgaagttgaagaagccgaggaatgtgtttcggagcttaggatctcggatgaagcaagcaacaaggccccgaaccaaggagtagccgaggccgatgagaaagaaggagaggacgatcaaaccgaggaaaacggagctgatgaaggtgaagccgatgacagagatgaacccgctaaatcagagaaggggaccgccagcaagccttcagagacaggctcgcaaaacaacatgccaaactcctctaagaagcacccccctaagcgaggtcaacgaagcaaagctaagaagattgctgcaaagtataagcaccaagacgatgaggaccgagccgctgccgaagccttgattggagctaccattggacaaaagaaagctgaggctgaggcaaaggctaaagcagatcgcgaggctgaactcgcggcagctaaagagcgacgtcgtgcacagcaccagcggcaacaaaaggaaacagctgaacacgangagatccgacgcgtcatgatggaggaaggtgttgagatacttgatgaagacgaggncagtcagatgacagtgcttgatgctattggtggcacacctntttcccggggacnagatccttgagaatatnccaagttgngcttccattggaacgc

SEQ ID NO: 1707 - DNA, 627 bp, Fusarium venenatum
  misc_feature (1)...(627): n = A,T,C or G
aaataatataaaagcaatacctgatcagcagcccgcttcttcttccttcagcacaacctaagaagtagcaagacaacaagctgtcagtcaacttgcccggcttctccctattgatcttctatccttggctcaggtctcgcgttttcttcactaaatccatcatggcggattttggggagtatccgccaaatatggcgcctcaggatgcgctcattgttcgggagcaagctgaacccgatcacgctgtggtgccttttacagccgaagacctgtcgcgtcccaaggccggccccctgaatccgttcaaggacgagagcaatactttgaagcgcaagagcgtcccaaccggacatgcagaggagaccttcttgagcgaacacacattccgaagcaaacaccgtgctatcgagcgacaaggagggcaaggaggacccgagcgacagtatcagacaaacgcagaactgaaagcggaagcggcgagaatacgagctggacgtgaagataaggcagcgcaatcattgcagaaggtccngcttctacgtttggaccctgggcgcgatacaaagaaagcccgaggtnccaanatcgttggcagaaggatgaaggaactggcgaagcgatgaaaaa

SEQ ID NO: 1708 - DNA, 116 bp, Fusarium venenatum
  misc_feature (1)...(116): n = A,T,C or G
ttggcgtntacgtnctccccaagatcctcgacgaggaggtcgcccgtctccaccttgctcactgncaggctgagctctccacccttagcaaccgttcaagctgagtcctnggctgg

SEQ ID NO: 1709 - DNA, 573 bp, Fusarium venenatum
  misc_feature (1)...(573): n = A,T,C or G
ctcatgaaccaggtacctatagaggcttcccataccactgcccgacaatccttgcgcgttttaaaatatcgccatgcgtgctcgatttaaaggcccagcaggcaccggcattcttgagctaccagacgatgctactgttgaagccctctttgatgaaattcggacaaagactggcatcaacaaattcagtgtgagatacggtctgccgatggctatgaaatccctcgaagctactcagggtgaccagattgctcgatgccttggtcttcatggcgaaacgctcactattgtccccgaggagtcatcatctgaccctgctgaggctgtccaaaatcggcctgttgcatccatgccactgaaaaagaatgaaggcccggaagaccgaacgttccatggccgcaganaaaaggcactcttctgttacgagtgatgcccagtgacaatagttgtttgttcaccgcgttcgggggcgcattgcaagaccaaatccctgcccaaaatttgagacagatgatggcagactatattctcgaacatccagaaaattttcggaagctgttcttggcagccctc

SEQ ID NO: 1710 - DNA, 856 bp, Fusarium venenatum
  misc_feature (1)...(856): n = A,T,C or G
atttaatatctacttatatcttcccccctgctggaccctttttctctcttcctactcaacgacccagacctctcttgtcttttgtcttccctaccttggacaaaacttgatacccaacataaacctactactactacatcccatactatcatcatcatgtctatgggaatcatcaccattgtacatgccgttctggctgtctttctcatcatcgagttaggcctcacagcttacatggttgatttcaccgaccactggtggaccgactcgcctgcctccttcgccttcttgctcttctgttccgtctggtccatcctcatgcttctctacctggccttgacgcccctctttgctcctcgcatctaccacaacatgatcgctctcggtattctcgcccttacctcgctcttctggtttgccggcgctaccgctgttgctgctcacatcggcgttcctaagtgccacggagacacccgctgccaatccactcaggctggccgtcgcattcggttacttnatntgggccatntttactggcttgaccatcatggaggctcttgctttcatgcgaggacgtggccacactgcacacgctgacactaagccccggtcacaactacggtgcttaaaatcagataattcatcggagacgtaatnaagtgatgtcgacctgaggaggaaaanaaatggcgncggagttttgtttattggttgactttccttttaattgtcatgtcatgtcgngtcatggaaacggccgcaagatacccttctgtcagaagtgcccgttacaggtctaccttttttgtattatacgttgtattaatgttatattggttcagacaaaaaaaaaaaa

SEQ ID NO: 1711 - DNA, 644 bp, Fusarium venenatum
  misc_feature (1)...(644): n = A,T,C or G
aaacaaccaacctcttcaccactatcacataaaacttatcaatctcgactctttactctaaacaacaatctacatcaaccatcaagatgcaattcctaagcctcgtccttatggctacttcagtcctggccattcccgccaaactcccttccaaggccccagcaccaacatgtatggaaaagggcacaaaggtctcttcatggaaactcacagactttgtctacaacgtccaaaagagcacaaacaccgccacagtcgagtttgacctccacaacgctgctctcgactacacggccaactgctacggcaagtcagtctctaagaaggccctctttgatggcaagaccgactacacctgcaaggtccccaacggagccgactctgccaccttcaagtacaaccataagaagggcgtcatctccgttttccagcactgggcctgcgtccaggagggtggttggttcgaggccatcggcaacaagacttctgctgagaccaagtcgaattgtcactctacaaccaagtccgagacttgcacaaaggcctccttnctggtccgttctcgaaatgcgtgccgtcttgtaagaagcgacactaagaccgaatcgcatcttcttttcttttggcgacaacattttttgacn

SEQ ID NO: 1712 - DNA, 645 bp, Fusarium venenatum
  misc_feature (1)...(645): n = A,T,C or G
cgaataatggccacggtacgagaaggagctcgcatagcgagctcactgggacgaaggcaaatccctctacgggctgcccccatttgtgcacgaagatatgcctcgactggggccgagaagtcctcctccgatctggcagatctcgacaatgcctcctcttttgcgacaggtactcccgatcaggcggctatcgaggctttcaatgccagagaaaaagccaagggaacagccaataagcttcctggtaacagatatcagtaccatcctcccaagtattaccgtggacccctccatcccgtccaggttcccaagtcctccgacccgactgcccgagacttcgtccccggtcccttcaacttccctcgattaaggcatacatacgagaccacagttgctccggacttgatcactatgacctaccagcacattccaccgggcacagaactacccgtttccaacaagggtaacttgagagaatgggacggctcctcccttatcataagaacagacctcgccgtggacctcgtggaggaggntctttgagacttggattggtcgaacgccctatcgagtggnacaatggtnccgaaatcgaggnttttaccatcaactnattcgttcttttaagctccagaataaggggtc

SEQ ID NO: 1713 - DNA, 560 bp, Fusarium venenatum
  misc_feature (1)...(560): n = A,T,C or G
tgctcccatccagaacagtgtttacctggtcgccatggctctcatcgccggtgctcgcacctaccaccaggttcgcgcaaccgtcaaggttggcttctggaaagtcatgcgtgtctcatggatcacttctcccatctgcctggctttcgcccagaaattccttcctgaccagctctggattcccttcttcaacattgtgttcttcatcattggcacttacatcaacacaattaccaagaaaaaacgccttgcagctctccgtaagaancacttcggcgacgaacgccgatccaacnctggcganatgcgcccangccgccccgacaantacctcctcctggtatgggcggtgggcctaacctccttactaagtgacacaatctcaactgtcaatccgagcccggtgaaaccnagaaganagtttaaaganganaatgggggtggngaagantttaaaaaaaaaggaaatgtggaactgaaaaaatagccaaatganngcttcttggtngcgaacggataacacaaaaccntgctcggatngggcggcgtcccttgacaat

SEQ ID NO: 1714 - DNA, 256 bp, Fusarium venenatum
  misc_feature (1)...(256): n = A,T,C or G
ntngcgtcatgcattaatnttaggangatntatcaaagggatttatacantcattggntaatgatgtacncaactatntncgatctattnatatctaatantgactntccctggtggtaacacgaacgatattgtcgaggcattgaattttgggaagattgtgggtgcggcgttggatgtgaccgatcctgaccgttgnctaanaacaanttttttgggcgtaaaaatgtgattatagngccccaaatccctttaa

SEQ ID NO: 1715 - DNA, 240 bp, Fusarium venenatum
  misc_feature (1)...(240): n = A,T,C or G
cacanaaaaanggcgataagagggatacacaggcanatnccagtaatggtaagcagcctntgcacgtgcttgtacgcgtaaatcatggcagtgcgctcgtcggacccgacagggaagtcgaggatggcggaaagaggctgcaagtaggtgtaaacggcgagtgtcttntttccaaagctggaaaaagctggaaccaaacggacaggcaanacctggggtccaanatggcnccccacacag

SEQ ID NO: 1716 - DNA, 459 bp, Fusarium venenatum
  misc_feature (1)...(459): n = A,T,C or G
aacattttgaacaaattactatttcttattcaatatatacaacccaacaatcatgtcttctcccaacaacaagtcaccttctgctctcaatctcgatggcaccggcgacnanaaaccccggctcactgaagaggaaaagaagcaaaaccacattgcatcanaacaaaagcgccggcaagcaatccgtgaaggttttgatcgtttgacagagcttgngcccggcttggaaggacaggggagatccgagggtctngtgctcaagcgtacagtggactacatgcatgatcagattgcagagccccaaacgttgatcgcacgaattgaaccggtggtggccaggtggacnaccacacaagagggcgtttttcaacangtccaccaaatcagaaaanaaactagttagactntcctcgagggacattatcnttntggccgcggtctagatntccgaggggcggc

SEQ ID NO: 1717 - DNA, 576 bp, Fusarium venenatum
  misc_feature (1)...(576): n = A,T,C or G
cggaaccacatgtgcttgttgttgtgtttcatcaaaggaaccgaacccttcaacgtctcacattgactgtcaatagcgcaccgtccatcctccttacagggaccctttcccctactctgacctccactcacctgtccggttagctttgtcgacataactcaaagccaagccttgcgccagccccaatcaaaactggggaccacctcagcaaccatttccatccgtcatttgccaaaaggctacgttcttcatttctagacctttcgtcgtcacaacacaacgctaccaaacccacgatcaatctctccacctttccgagtcgatcctgactattatcgcaacctttttgctcgcgataccactctctgataactcgatcccgcatcgattctctctctcaatctccctcggcttctctattcccgaatacnaacgttcgccgtaagctgtcaatatgacgctcaaagaagaattccaaacgcgaaacttcagcatctacggacaatggcttggaattatttccatgatcatttgtctggctgtcggaatcgccaacattttctcgttccatgttgt

SEQ ID NO: 1718 - DNA, 574 bp, Fusarium venenatum
  misc_feature (1)...(574): n = A,T,C or G
cccgacctgcctaccgaggcaatccaaactcctgctcgagttcactatcctcacttttccacatcagctgtccatagtgggatcatagactgcgtggcattctacggcgactgcattctctccagagcatgccacgacaacgtcatttctctatggagaatagaaggattttcgtccacaaacccgcctcctgcagagagcgaagcaccgacagctcagactaccgttccaactaattacgaggaagcgagtcgtctcacgcgttcggcttttgttcccacaatctccccacaatgcccatctcagtacaccatgttgcttcagttctatacccccaactgtggcccgcagttttttatgcggtcaaattgcactttgtcctgaccaacatcccgttttggctttctgtatgcancggaaacgtgtttttctgggactttgaacgcttggtggcatatcgcgagtttattggaagcactcaagacctggcagggataagagcaaatggttcttaaccanctggtgagaccantaaaggtcgtccaagtnaactccaaagtcggcntggaggcgc

SEQ ID NO: 1719 - DNA, 605 bp, Fusarium venenatum
  misc_feature (1)...(605): n = A,T,C or G
aaaacccctaaccaaaacagcaaacccaagactgcgacagtcttcaagccgtacaagataccaccaaaagagtcgccagtgccattgccagcaaattttttggcggcaatgacatcgacaccgaatactgtggctgctgccgttggccaaccggctctgcagcagtcctcgaacaagggttcacccgttgagcccaagcctgtgcnaaaagtgcaagcaacgcaacagtcgccatngggggcgtacactccaggcaaacagccgnttggtgctaagatctctgagacgcctgtgccgattccacgactgccgggtttcatgcctgtctcgacatntanagaagttgcttcgccacaaaagtacgtgttgaatcaagttcactcaaatcgacatttgccttcgcatcagggcagtttagtgacgcctgtacccgcacaagancaggtggcatcgtctgttcgggatggcaaagcttgtncttaccaacacgaaccctgagaatgcnccccaaacngtattggcagacaagccatttctttccaaccacangatttcccgatgttcctggaagcgaatctatgaaantcatgggcagtctcctggga

SEQ ID NO: 1720 - DNA, 566 bp, Fusarium venenatum
  misc_feature (1)...(566): n = A,T,C or G
cagccgcctgctttttccaacccttggtcttcatcctcaccaccacagcatcctcctgcgggaagcagcctctttgttggtagccagccagccctcaacccaaacatgatggccggcaagccacctcaaagccgcgcgagcactagcagcacttcgtcaatggcttcttacggaagcgccatgccagtgcctaacacttctgcagacctactcagcatcaaccgcatgcaaacaacgtctgctgcttatggagaccccacttacaccacatctgcttctcctgtcaaccaccactttgcgcctacatcagctgctccctatgacacacttggttatgcgccagctcctgtgcgaccaccaccttttggtctggctcctgctgatgacacgcgagacgtttctcaacacatccaagatgaacggangactttgcgatgctctcgatgctagccacgcatctggtatgaccagagaacccgaccatctanggangcgaatgatgatctcnttgatctatggatccttctaccacctacattctcattcttctatggcattngtctata

SEQ ID NO: 1721 - DNA, 621 bp, Fusarium venenatum
  misc_feature (1)...(621): n = A,T,C or G
nancttctacagnggngggggtgatggagtcagtatctggtcgccaggtggaatattactaggcaagattcttatcgagggcggcgttgcaaacttttgcttcggcataaacggcgaacttttcatgcttaatgaaagcaaaatgtggcgagcacagcttggcagtggcgtgaagggagctttactcaatatttaagaacagataaaccgtgagataccgaatgcaaaacattcaccaagcttgttctggcaacaactcgttcccgacccaatcccgtccatttagaatggtttcctggtagtctctatccatctgagagttactaaaccaagcatcttcgaaatagccaggagaagcactgtcagagttctcccatagatagtcttcgaatctcgcggttttaacgctacccacagggaccctgaaactcagctgggctagccaaagtactgaaattggtggttttaagaattcgatcgcctgcaagaagtatttttgatcaaacatancaatttcttgcaggtttcgacccacaaaattggntgagagattggtgtttgntttaagagaacnntggggattcttnatacaaagggtncantcttgtganttttttggcc

SEQ ID NO: 1722 - DNA, 886 bp, Fusarium venenatum
  misc_feature (1)...(886): n = A,T,C or G
tccaatagttccagtttcgtcgctcttgctgttcgtgacggaatcttgtttgctggcggcgatatcagtggcaccattgatgggactgatattcgtggccttgtctcctacgatcttgaatcaaaatcgttcaactcgcagcccgcttctgtttcgggcgccaatggtaccgtcgcagctattgccgttcgtcccggtgattctggtgacatctatgttggcggctcattcgatactgctggtgctttggactgccctggtctttgcacctacaacgtgaactctggtcagtggaaccgcccaggcagtcaactcgagggtactgtcttcagcttgttgtggatgagcaagaaccaacttgttgtcggtggtgatctccgtggtaatgggtcgagccagcgttacctctcaagctgggacgcaaatgcggagtctttggtccaactttcctggttctgaagacgttcccggccctatctcagtcatctctcctggatccagcgattatgaacagctctgggtggctggtacttctagtggggatgactctgtctttgtcatgaagtatgatggcgagaagtggcataccgttcagccctccttgtcatcggacaccatcattcgtggtctgcaggtgttttccgtcactcaggatcatggagacgctgacctgctggacaagaaccaggtcttgatgctaacaggctctatcgacatccctgacttcggagtcgcatcggcagctctcttcaacggcacagtatatcaaccgtatgcaatgacgataaaggctggtgatggtccaagcactatcgccagtatcttctcttananggacaagtttctttaaaagaagagaagcacatggctttnggcttcgtgggtn

SEQ ID NO: 1723 - DNA, 659 bp, Fusarium venenatum
  misc_feature (1)...(659): n = A,T,C or G
acaaccgacattcgttaattctttcttcctacggtcgcttttaatctacctaatttaattcatcgcaatcaatcacacgtcaaaatgtccaccaccgtcagctccgcttcggcccccagcgccagcaccgcctgcgctgctcagctcttcaaccagcccaaccaagacaacacctgcgccctgccctacaaggatgaatacctcaccatgatggagaagtgctgtggcgacgcaaagattgttagctactacgacaactgcggcatctactgtgtcgccctcgaccagaccatcggcgaactctccaagtgcctcttcagtgagggcgctgccgacgcccgacgttttctgcagcggtagcaagaagaccacaaagaccaaggacgccgatgtccccgttaccgccaggcgagcgttgtttctagcaaggacgatgatgacaaggatggtgatgatgaggatagcttttctgctggttnttttggcacaagctaccggcactgttttttcaacagtgagacctnttccgagaatggtaacgctgcttcttttttggcgcccaagagcggnatcaagactggtgggtcttgccatcggggctctggtcttttctncttcgntggtggggctttcagtgnaaaatcgganttaagttgnnt

SEQ ID NO: 1724 - DNA, 546 bp, Fusarium venenatum
  misc_feature (1)...(546): n = A,T,C or G
ggtgcaaaagtcgttactgccacgtacgacgacgttgaaagcctnaaagtagcctttcaaggcgctgaagctgtttcactgatctcgacgtggctctttggggaaggtcgccgtcgccaagctcagacggtagtcgatgctgccaaagcctgcggtgttaagagggtctgctatacctcattcattggtgccggtatcgaagccgagaatgaagaggatattcctttccttcctcgagatcatcattttatcgaaaagatcatctacgcttctggtctggagtggaatatncagcgcactatctctatgtagacaacattccgactttgtttgcacagtcgtggaagttctgtggtgatcgctggttggtcaacacacatggccanctggcgcttatgtcgcacganaagactgcggaaatgtgctacttgcctactccttgnaagangaaacctacncagtttatgagatagcggtcagaagcagtnaccaacnaanaattgtcaaatggatgtcgaacagaccgntaccanggaaaaattgtta

SEQ ID NO: 1725 - DNA, 495 bp, Fusarium venenatum
  misc_feature (1)...(495): n = A,T,C or G
gccgattctggcgttcccgctgctaagaaaaagaagagcgcatggttaggttcaaggttacaccacatcgccttgccagcgtgatgaaggaccagaggaaacccattagtaatgggcgaacgtcactaccattaggcggctctagagatgctcctcctcccctctcgaacccaagatcagattcgattacagctaagccggcaagaaaaccccttccaacaggtgacgtggtacgaangcccttgcctggaggcctgcgtcatcaccgccggaaagaaagatttctttaagcacacattcaaactcaacaccgaagccaagtctgcgagccctgcgacaagtacgccaccccctggaagcaccgccccctcaaagaacgaagatcaagattatcagaaagtcgaatccacagccaccaccggctccctaggaagaagcagatnanatttcatgccccaaaacttcagtgcgcccaagccgtcatcatgaaacgga

SEQ ID NO: 1726 - DNA, 555 bp, Fusarium venenatum
  misc_feature (1)...(555): n = A,T,C or G
tgtaaacactcgtttcttacaaacataaccacccaagatgaagaccaccactttcgctgtcgcccttctcggcttcttccccgccatctttgcccaggagactcttgctccctctcctaccgagtctgtcggatgtgagcctcacggagaccactggcactgcgacggtgccaggtccactcttgcgactgaggccaaggctaccaccgacgctgagcacgatgacgaccatgatcatgaccacgataccactggaacagggtctcttgctccttctcccaccgagtctaccggttgcgaacctcatggtgaccactggcactgcgaagctgccaagactggttccgaagccaaggctaccgatgatcacgaccacgacgaccatgaccacgacgatgaagaccacacccactctgctggtgcgaccaagtctctctctccttcgcccacagaatcaatcggctgtgagccgcacggcgaacactggcattgcgacggtcctgctaccgctgcagctactgcgggcactgnctctgantcagcctctgccaccga

SEQ ID NO: 1727 - DNA, 292 bp, Fusarium venenatum
ggagcaccccaccgacatcgagaccatgcccgtctacaccgatgttcccaagcccagcaagcctgtgtacactcctcctgttgagcaccagaccaccactcacctgaccacctctactatctacaccaccaaggtcaccactgttaccaagtgccctcctgatgttgtcgactgccctgagaagcctcacaccagaactgagactgtcgttgtcggtaccacaatctgccccgtgactgagactcatgtcgtccctgtccctcccaaggagactcaccccgttgttcagccc

SEQ ID NO: 1728 - DNA, 512 bp, Fusarium venenatum
  misc_feature (1)...(512): n = A,T,C or G
gacgatagtcctgacgacacgaaactacgaaaatgcttgctaagtcgtcaccacacaanacggcggctaaggatgaccacgttgatagtttcctttctgacnacaanccttttgttngctccagccaagccaacatctgccaagtccaaatctacgggtaccgagtctgaggacccaacaccagctggtcttgccacagtcaaaaagggtcggggtcgtcccgctggtgctaanaacaaagaagcgacgaaacccaaggccgctcccaaggcagccacaaaggttacgaaaacagcagcgtcaaangttgcttcacgtcccgccacaaaacaaaccactctctcnccagcagccaaggcatncgccgcgaaaaaggctgtcaaaaaccggtactccacaatgactccgatgaanacatgctgaacctgactcccccctcctaaggctgctgcnaaggccgacctggacccctgccgctgccagacnaacaattgttgttgacaangatctcc

SEQ ID NO: 1729 - DNA, 435 bp, Fusarium venenatum
  misc_feature (1)...(435): n = A,T,C or G
aagaacgagggccaaacacttcatcaagcatacgactatgtccgccatcaattttatcgtctgcgccaagaggagcagatcgaaaagcgagtggctcaagaggaagccaaatacgtaggcgcttactttggccaaacccgcaccgatgtttcccacggtctcgaagaccgcgagttcnagaactggaagatttgggccggaaaggagacggagcgacaggagcagaaccgcaacggtcaaattgagtactttggtttggaagaggaggcggaagaggacgttgaggacccanaggcagngccggaggccanggncgaggncgtagaaggcnagaagttcccttgaggcggtgatacccgtcatgtacncaccttgttttatcgttatgtatagaaaacaactaccatgttccagaaagccttttgggtggnaaaa

SEQ ID NO: 1730 - DNA, 616 bp, Fusarium venenatum
  misc_feature (1)...(616): n = A,T,C or G
gcttcgttgttgtccgaaaatattcaccgaccaagcgattaattaatacgatcccgaccattctgtcatattcgcaacaatgccttctgaacgcgaactccagatcaacccaattgtccctgagtctatgattcacaacaccaaggctctttccaatctccacagtctcactgcttccctcttcggagtcacagctggagttctcggcctcgagtcctactacggcttcctcgtctacatcgtcttctctttcatcaccactctccttttttacgtcctcaaagtancccctgaatcgcttcccaagggtcatgctcctctcgatccttcgcggttctaccgaggactcttcgatttctgggncggcggcatctccaatggcatctcgggtttcgtcttgacgtggacattattttatggattggttagggcataggtcaacagtaccaggaatctgcatctacctttggcgtctttggagttatgangaaagaattgttaaaatggcaacgcggcatccaaaaaatgagctgngccataaaacaactnttgnagaatgagaaagtttncaagtcaaaaacaaatcacnaaatgctnccgncaatgctccaccatt

SEQ ID NO: 1731 - DNA, 815 bp, Fusarium venenatum
  misc_feature (1)...(815): n = A,T,C or G
cttcctctttttgagaggtcaaatcgtggaggtattttgtggagggcgagcactaagctttcgattacctataccacccanctggacagacaacgaccgctgtggcgtccgcaggttggggtggtatgtggaggatggcatggttgatttagttgacataaatatgcgtcattcgatgtgcagcaaggacggctcagccgagtcggacaatcttgaagacgccgagtaattcttctattaaccttcctcgccgcaaagttattttctttgcagctctcatcctagatcgtcctgtggcatcatgggattcggctggataaccaacccgctaagaagatcatatggacctgatgcgccagccaggtcccagtcgccaaaatcggtgtattcatatacatctgaagcataattccccatcatggggctaactttgtcattgagcggttcgtttaagttgaacgccagaaaatgctctaaaacacgcaggatggcaccctcgagacgaatcacagcatattgcataggctgatgacttttgctcatcatacaaaaattccagaaatacaagtttaaggtttcttgccagaaatgacgttcttgagaagatagtgaggtgacgagaagtanggtggtaaangagccgangagcgagaagaggtagggtgatgtaaagtccaaaatgctttgagatggtcgggncctaagcttatcacgaagcttatcgnctttggcttgttggaaaagcatctgcggatgctggaaagtcccnatcgtttacaacttggtggaaggctntaacgnatcagcgacccaaa

SEQ ID NO: 1732 - DNA, 622 bp, Fusarium venenatum
ctcacacctgttggacgcgactcgacgtcaggctacgaatgtatcaagtttgtctcgtgccttgaactacaccaagaagcactcatgcatgcacgcacgaacatcaatattccacatgtgtgtgtgtgtggctgtaatctaactaggtgatctctcctgcttttgggcatcttgtcgacaatcgattaactcgtatcccactttatcccattattccaaacctccaactgcatgttatataacctagccgcctcgcgcatgagcagcagatcaattcaacatatttaatctctatattgactgtcatctttcttctgctattcatttgatcttccttcattgccatcatcatcatcgacatggcatctcccgaccccgtggttatccccggcgaggttcggttaatcctggcagaagtatcaaccgacgcgtcaacgttcgtcctccaacctacaccttcctcagatcccaatgagccgttgaattggtcctcttggcgcaaatgtctcaacttcggcttcactatcgccgttacggtggcccgctttcaccaacctttccatccaaaccgcttttggcagcagatgactggtgatatgggcgttactatcacacagcttac

SEQ ID NO: 1733 - DNA, 623 bp, Fusarium venenatum
  misc_feature (1)...(623): n = A,T,C or G
actcagtcactcgcttcaacatctacaacaacctttcactccaccttcaaaacaacaaccgcaaacatgcagttctctcttgccttcctcgccgctgtcctctcagccaccagcgtctccgctgcccccactgagcccgctgtcaacatgatggccgccactccccagtggactattgagagcatgcagcgcagctgtgccaaggacgacagctcctgcacctggaacttcaaggtcaacacccacaagggcgctgccaccgcctgcaagtttgtcgtcaagggcagcaaggcctctcagcgcaacggcggccccgtcaagtgcggtgactacactgtcacctctggctggagcggccagttcggtcctggaaacggattcactactttctctgttgtttcttccaagcgacagattgtctggcctgcctataccgataagcaggttcagggaggaaaggttgttaagcctgaccagtcttacacccctgccaaccttccaagtaagctggggggacatcgattattgagtgtcggggtggacacttgtacatagagcgtctacatgtgaagacgcggtaatgcataatgttttagaatacatatacgaagaggctttttttn

SEQ ID NO: 1734 - DNA, 693 bp, Fusarium venenatum
  misc_feature (1)...(693): n = A,T,C or G
cctatttcaacatcgtctcatatcgcaagcatcttccttccttatcatatcctcaaaanggcttccaaaattcacaacgtgacagagttttcatacgttactctcaagcaaggcataaacgtntttgacgaatccgccgccgccaagacttatcaaaatgtcatcgacacagcgctaagacaaccaggtgcacgaagagtctacaccagtcttgaggttgaanacccttccaagttgtggttgttcttggactgggatactcttgaggatcatttgaattatcccaagagcgctgatcatgcccctatcatagaatctctccaacctctggccgattttgaaaattctatgaacaagcacgtcaccctcaacccctttcccccagaggacgtcctcgatagcgctagttccccggtgacagaggtcctcgttgctttctttccttcagactactccatctcagctcgggcctccgcaacacgttgtgtggaacaattcgccgctcaagctctcaaggcattaccagactggcggggcattagctacggctggagtgtagagaacgatgtgcctatccgtggtgatgaaggtaattcaggtgccatgcttgttgcgtttattggatggccgagtctggaaactcatcagaatttcgtgagacggatgattttaagcagaatattggtttgttga

SEQ ID NO: 1735 - DNA, 594 bp, Fusarium venenatum
  misc_feature (1)...(594): n = A,T,C or G
gaacgggctgatccgccgaggcaacatagaggtatgttcacaggggtttgggagttgtaaactcggtaatgatccctccgctggttcaccaacggagaccttgttacgacttttacttcctctaaatgaccgagtttggagagctttccggccctgagcggtagttgcccaccactctgggccagtccggacgcctcactgagccattcaatcggtagtagcgacgggcggtgtgtacaaagggcagggacgtaatcaacgcaagctgatgacttgcgcttactagggattcctcgttgaagagcaataattgcaatgctctatccccagcacgacggagtttaacaagattacccggacctttcggacaaggaagtactcgctggctccgtcagtgtagcgcgcgtgcggcccagaacatctaagggcatacagacctgttattgcctcaacttncatcggcttgaccgatagtccctntaagaagccagcgtactgccaaagcaatacnggctatttagcangttaagggctcgttcgttatcgcaattaagcagacaaatcactccccaacttaanaacggncatgcccan

SEQ ID NO: 1736 - DNA, 1026 bp, Fusarium venenatum
  misc_feature (1)...(1026): n = A,T,C or G
tgatcgccgtgccaaggtcgaattttggttgcccctgtggttctatctctggctttggttgaacttcttcatggttgttcctcgcagttggaagttcactcagcttcaacactcggaggaacagacattggcgaaagcagtcccaggagcaacaaacacccggttcaaggctggtgctttctgtcttgttgtcgcatggctcactattgtcttctccctttatcattcgattaagcactacaaacctcgccaccgcggtgtcttcaatcgagctgtgggctcccttcgatatgtgcccttccgtttctggcttattctgcccttgtcagcagcaactatcgcatatcagggcttcatttcatgggagttcaagtattccattgtcaagtacaatggaaacattcctgtgatctattgctggggcttcctaccagccctcctgatcctctttgtccagtacttctatggccttttcacgcctaacgaagataaggagcttgtccgactaagacgtgagcgcggtgagatgctcgaccgtgaagctcggacttgtcaataagcctgcctggtggaaacgtgttaggggcgaccatctgctcaccttcaaggataagctcacccgtaacgtccacgagattggtggcggtcgcgccaccggccgacgtatcgagggtgatgcggagcgagacctgcgagaagaagccttggcttctgccagaaacgacgacggttatgagatgggtcacatgcatcgccctctggacgctgccaacaaccctcgagtggatcgtgccggtgctgcgtccatctcctccaatgcatcacgggcgtcatacgtccaaccctacaccggtaagaacgatcgtcgtcgacatgagcgtaacatgcaagctgccggccagtatcntctttcctaacaacctcgccgaggagcgcaccgtcgtgaagctcaacttggccttgaagggtcccgcgccncctccntaataccgatggtctggggtagaagccganctctggggcgac

SEQ ID NO: 1737 - DNA, 644 bp, Fusarium venenatum
  misc_feature (1)...(644): n = A,T,C or G
tgattgcatccccggtctacaatctcagcatatactacaagtcctgccttctaaaccaacgttagacgctctgatagaatctttctttagtgatatcaaccatcactatagtataataaacccatccttgttcatacagcaatatgtcgactggtctacaaaaacagagcaagagcagtaccaagatgctcagctgacaacgctcattttgatgatttgcgcgtgtgttacacagcagctcccgcagggtaatgcaacccaactatccgagagcttgtccacggactatcatagcgctggtcaaaggcttgccatgacaacatccgctgggctgtacagtttgacaaatcttcagtggaaggtgctctcaatctgttggttccagggtgaagccaggtttattgaggcatggcacacaatcgggttggcgatccaagaagcatacgaactaggtttccatcaagcccggncttgcacagcagagtcgagaacagaggcacagattggacgtcagatctggcggacattgcattgctggaactggcaattgnncctgactctgggacgtccgatgataatgaacgatatcgactcanaacctggtgtggaagtcaatctggcgaacgtcccaccttccccgacnt

SEQ ID NO: 1738 - DNA, 586 bp, Fusarium venenatum
  misc_feature (1)...(586): n = A,T,C or G
atcccgaccagcctctacaccaatgtcacccgaaccgcagccctccgctcccgcgcaggctgaagcagcccagcaagaagtngagcaacaacaacaagaaccccccgcgagccctcccctccctcagcgccacacagccgtatcccccggtccccgcgcagcgcgtctacaagaactctatgcgcgatcgctgaaaaagacgctgggaaaggccagctggcagaatgtcgcggggtgctaccctactattgcgaaaaaggcggaaggtgtgctaaggcaggtgcagggacagatggttgataagttgggcgagaagtgcgagaaagatttgagaatatcatggtttcgagacaggttattcccaaactgaatgatctcaaantcttattagtgatgcatcacggcgacaacggaatcgacaacagaacatcacaccacccatatgctccctccaccactatctcgctgccatctcacactacactcacagccacaatcgcacttaatgccgcctacaacaacacaatccaaaacgcctttgttnacaaattcaccacaanaaaanaaataaacctctgatnttgga

SEQ ID NO: 1739 - DNA, 491 bp, Fusarium venenatum
  misc_feature (1)...(491): n = A,T,C or G
tgcanacnaagctgntcataacgagatatctgctttgntcatctgcatataaaaagctggttagcaaaagttncgaatattattcctgcaagtagctgtagtanacgtctccanagtgatactacaacaacggctgcnaacaacgcttagataatactcgcgttaccccaaaacttctcaatctggcnttcgattttattagttgcgntcattgtntatatgagctgacgaanaggcctctattacaaagatggcttacaacgatgactccgtactggcgcgactttcatcgctgaatganagccatgacagnatcgctctgntgcacaatgggatcatgtttcatagggcgacatgcanagcgaacccgtgcaactntgggtgnagagccttaaagactcgtccagcacaaanagactgacttgatttatctcgccaccgaggggggttaacagtccaaaatcngnccaagggtgacttcattattgttt

SEQ ID NO: 1740 - DNA, 617 bp, Fusarium venenatum
  misc_feature (1)...(617): n = A,T,C or G
gctgccggagtttcttcctcatcccactcgttgtcattctttagaggtttccagtcgctcattacttgctcctctccacatcaacgtcgagatgaagtctaacgctgttattgccgttcttttctcactcagtggttctggggtttttgctggcccttgcaaacctgtaacttcacaggccactcaggttacgtctgcaaccacggaggagtccactttcattgacttgactaccactatcacggcatctgagaacaccgccgaatccctcattccctctaccaccgatgtgggctcggagaccaccgtggattctactgtcgagttaaccacaaccactgcgattgccgaaaccacgtccaaggatacagatgcaaccactacaacctctgagcccgtcnacgactacaacaagcccccttcaatgccctactccagacacttgcaacaatctaagcttcgactgggcctactttagcaaccctgctcagaacaccgataccacatactccaactttgttcctcagtccttccagcaagaaaatcctatttcggtcggcaccaccagtaggatcggtggantataccaaaattggaatggcgcncaggctntctcg

SEQ ID NO: 1741 - DNA, 566 bp, Fusarium venenatum
  misc_feature (1)...(566): n = A,T,C or G
gagtcgacagtcatgacgattcgaaatgttggattcaagtggaggcctggacagcatgttttgatctggtcgcctacttttcgatgggagacgccgcatccgtttactattacgaatattcctgacccacaaacgagaacgcaggatgttcaattgacgatcaagacaaagacgggtttgacgagagatttgaacgattgggcgagaagaacgggattgagaggggatagtggaagtttgcgcgtgatggtgacaggaccttttggggcggtaccgaattggaagcagcatgagaatatagttctcgtcgcagcatctactggaggatcatttacgacgccaattctcgaagatctactctcgtctcaatcccctggttgtatccgtaccatcagcgctttgtacatcgtccgtcgcaaagcccacgcccaagtctacctcgaacgtataacccgtctactctcgcgcgccaaaganatgggtatctcaaccaagattcaagtccagtaaccagaagtccagccctgtntccgaagcagttctccagatgaaagccgcgagagatt

SEQ ID NO: 1742 - DNA, 646 bp, Fusarium venenatum
  misc_feature (1)...(646): n = A,T,C or G
aacaacaacgaggacgttcctcatctccagcgaaccgagattgtcgntctcttcaacacgtacgctcgtatcagcagttctcttcacaacattggtgaattccgtcaaatgatggaagccaaggctganaaggaaaagcttgctgaaaaacttgccgaggagaagcagcgtatcgatgctgagagggaaaagcatgcaaaagaactcgaggctcgccaaanggaggagcaacgtatcaaggctgagaaggcaaagcgcgatgaggaacgcaagaaggaaaagactcctgaccaaaagttgggcgacaagtttgaggaggtcagagaagaggacagactacgcgcaaagcttgaacccgaggttgcaaagaatgaccagatggacgatgccatgagggagtttattcggcttcccgctagaggtcccgaggaggagtccatgatgggtcacctcaagcatgaactcnccagttcaatggcgttttgcgcgttatcctcaatgggngggccccnccccaagaatgctatggacnattattaaatatgaagctcgcgtgcattccgaactacgtcggtcttcccgtggtccacnaattttggaagttttggattgnccaacatcaccgcggacanggatgaactngtan

SEQ ID NO: 1743 - DNA, 571 bp, Fusarium venenatum
  misc_feature (1)...(571): n = A,T,C or G
cacgaggaggttgatgtggatgccttgatattggagccggctggactctactttgggaatatgtattgaacctactgccagcacttccgaccccatccaaaccttttctcacttctattgttattcttattcaaatgtgaattcatccctcttcattcacgaaccaactcaatcactcatcctcacaactaccacaacctccacaacatcaacaatggcctcttatacacacagccgaagtgcggtgagagctcagcgacganactcgtcatcatcctcatcttcacacacaatgtccaaccgctcaagaccacgccttctacgctcaagtgcaactgagccttcaatcactgtctccnatgctactgggaaactcatttgctggtcccgantcgccacatanancaactgatcttctcaaccgtgttgccgtctattctccgtctcccgagcaagcctccnccccaagcggnaatcccacnccntgctggaaccatgtntntctgccgtgatnnccgggagcactctcctttccancagccctgngaaaccaatccgccgtcatgttcga

SEQ ID NO: 1744 - DNA, 1341 bp, Fusarium venenatum
  misc_feature (1)...(1341): n = A,T,C or G
ctctcccccctcctaccaggccagtttagaaaaaaccacccaaagctctccctcttacaaggtcatgcgaccgtagaccactcttcgtcgccctcaatttatattaacgccccggacggaaggcgattagcccaaggcgacgaccaaagatgtcggttgtcacaaagaacccttttgcctacctcggcaacgacagtgacggcgaggagaagcccgtcgttcctgtcaagaccgttgacaagaacaatgctcgcactactaagcgcaatgtcgagcccctagctcccgttaaggccgctggtgctggaggaaaccgccgtggccccggtggtaacgagggtgctttccaggaccgtggtgctggtagccgacgcaaccagaaccgatccactgaggagactccccgtgatggcccccgaggcggtgctggtgcccgtagccgtggtggacgtggcgctagacgcgcccacgagcgcgatgaccgacacacctctaagttcggtggacacggtggctccgaaaaacaggctgcccagtcctggggtgctaccgaaggccaggctgancttaaggacaagcaggccggcgaactatcgctaaggacaagcanaaggaccccgctgctgaagagctgctgccgctgaaggccgccgccgaggaagaggccgaaaaacaggtctcctacgaagaatacctcacccancaggntganaaaaaggccgctctcaagtctggcctcaaggtccgtgaggccaacaaggcacaagctcgacaaaaatgggccgacgccaacccctcgaaaacnaggaggaggagtactttnccgccactggaggcaaggcccagcgtcagcgaagaagcgcaaggtcaagcagaccgtcgacttcgacccccgtttcgtcgagcccgagcgcacccgtggtggtgctcgcggaagccgtggcggccgangtggtcgtggtggagaccgtggtggagaccgtggccgtggangtaaccgcggcggccgtggcggtgctcctcaggganctgctaagggcaacgctgctatcaacaccaacgaccagtctgctttccccagcctcggcggcaactagattgcccaacgcctgcccgtctctcacagancgcgcccataaatccccttgcctgctacaccatgcactcgcggggtcaacgctgaatgtccaaacgcctcccctttttcctttttttactcgtcacgatataaaaaggggaaaagatgccatattcgttgttttcgacaggttgaaatgaaaaaaattaattgaaaaaaaaaaaaaaaaaaaattcccctgcgtccganatatcaacatattt

SEQ ID NO: 1745 - DNA, 457 bp, Fusarium venenatum
  misc_feature (1)...(457): n = A,T,C or G
cgatcagtgtcagatgttgagatccgccggtacgaggctttngctcagcagatgaagaacgctggccctggcgctttcttcaagttccctgaggctggtgccgaggccgctggtggcgacgccggcaactctttnggtgatgctggcaatgatgatgatctctacgactaaggacagcnacgactgtatggacatgagtcctttgtactctaataatttctctcgtacatctccgnatcagcgtgcgaccggtcagtgaaatggatttatcccaacactttggtcgatattgaaatangagttggtagaatggtnnaggagagatggacaacaacctacctgatcatgatgcttttgaagatcangaggaaatgattgtggtcactaggtgacgtaaagacagactttgngctttgntagatgacaaattgattnccttactttnaaaaaaaaaaaa

SEQ ID NO: 1746 - DNA, 566 bp, Fusarium venenatum
  misc_feature (1)...(566): n = A,T,C or G
ccctttatcccagtgacatccacccagaacccgggaccgtctgggacaaccactaacacaacggcaggcaataagccaaaagttgtgagaaaggctcctactcccacttncactcccgctcccgctccagctccagctccagccaaaaaagccaagcaacctgcgcttgaagtaaaacgcacaactcctcccagaggcagagacccgtcgccaaacaagacaaccagccgaagaccatcgtcacaacagcaacaacctcagtcgccaggggcttataatcaacgtttcccaagaaactctgcacccggtggccttgaccggcttatgcgaccttcgcagtcacgttctcatgcagcatcagcgccaccacttcccaacgggcagtttaccctggagttaccctacgagttnctacttcgaaccggccgaggcctgtgtcagatgttggcgcgccggcacctnctttggcttccttggctcctcgancttcgtcgagtacggncatacagtcatttgttgtacaaggaaagctatagtgggtactgggnattcgatnaaaacgttca

SEQ ID NO: 1747 - DNA, 948 bp, Fusarium venenatum
  misc_feature (1)...(948): n = A,T,C or G
tctttatacaacaaccatacactatctactattactacctactatctatatcaatactacctactacctacctacttggacgacacacatcaaaatgccttcaaagctactctcaaacaagccaaacaagaccatctacatcgatagcatcgccaacctctcagaccctctctcctccatgtcatctaccttctctctcgtctctctcttgaccatggcctaccacgtccgaacaccacaacctgccagtcaagaacggcttctcacactcctaaacacaatgtcgccagccctcagaacacatgcggacccaagatactcgcgcgaggaggtctcaactccttcgtccacttctcagccccgtcctcaacggcatggcaggcatgttagagctcctcgcaaacgtcgatgccttctcgcgtccagaagatttccgtcagttttggagcctcgagcaaagcaacctcatcagagactttgtagagagtgggggacccttgcgggggatgcagggctacgacgtcccctttctcgagacttttgtcaaaggactcgtcgtgcaggatcgctcttcggaagcaaccagggcatgcttctgctagtccctgccgatgccgaggtcggcgacaatgtgtggtgggacgaggatgaacagcgtcttactgtcanaaagggtgttgaagatctcaacacaaacgccgaagcataccttgacaatggttcaaggataaccgccatggctatctcttctgccacttgaaaacgttttttttctcatcatgacttgacgaattttctacttacggacactttttttttttgggaaatgaagatgggactccgatttgatatccccagcgggatttttctctctcttttttttttnctttctctattgggaactggatttgcagcagaggctactgggcttactggaagtacaatggc

SEQ ID NO: 1748 - DNA, 601 bp, Fusarium venenatum
  misc_feature (1)...(601): n = A,T,C or G
atggagactccctttactgtcaaggctcagccaggaactgatatctggaagcagcctccttctacagacgtcttcacagctcccttccgccctcactccatcgcccccctaaagcacttcgtctcagcaacaatcaccttccgtaccacctacgttcaccaatacgaccaagcctgtcttctcctcaccttcaccaagcctgccagcacaggtgcccccaggaagtggattaagacgggcatcgagctgtacaatgagcacccccgctactcaactgtaacatgtgactcatgggccgactggagcgtcgaggcggtcggacccaatgatgtagctggtgtcaagagtggtgagaagacgttactattaaggcgatgaaggtgaaggatgcactgggtgtctgtctctggatctacagggttgacgagaacggagaaaagacccgttgagacagacaaactgggtgtacggcgatnaaggtggcgaaggatggganctcgaggtctcaccgctgtggctagaccagaccttacaagaacatcgaggaacatcttgaagctacnttcgacaagctggaaggtcaatgggaaaaacctacagc

SEQ ID NO: 1749 - DNA, 529 bp, Fusarium venenatum
  misc_feature (1)...(529): n = A,T,C or G
tccaatatcaccttcctctggggcagcctaattaatcaggagaaagccccgtaaaatcaggtacaggtacaggcgttcctgtcttttttcctcccgcaatcacctcttctcctaatcaaaggctttgcacgctcgatatatatccttcatattcatcacttatcacgatggttgacaacaccaaatcttacacgatcggcccactggagcacacacccctcgatgagatcaatgccaaggttgatctcgtgaggaagacattcatgtcaggccgcaccaaagatattgaatttcgcatgcgccagatccgaaagctttactgggccatcgtcgacaacactgagctcatgcaagatgctcttctnaaggacctttggcaaatgcaagtaccaagccgttctggccgagatcgattggtgcaagcaagaatgcattgatatgaccaacaacatggagaantggctgccgaagagcctgttnccnatggttcccttcaggttcgcttatgaagcatngcacccgctttgag

SEQ ID NO: 1750 - DNA, 536 bp, Fusarium venenatum
  misc_feature (1)...(536): n = A,T,C or G
ggacaattttggaagtcggacaagggagaagaacatcatttcagagacgggctggccaactggtggtggaacccactgnggcggtaccgcaacttcttgtaccaagggttcagtcgntggcgttgatgaactgaacaccttcatggaggactgggtttgncaggccctcaagaatgggaccaactacttttggtttgaggcattcgacgagccctggaaggagaggtcaacgaaaagggcaaggagtgggaggacaagtggggcctcttgactattgatcgcgatctcaaaaagggagtcaagattcctgactgcgacggcaagacgctcaangattacagcgccttttcctaaacnaccagagacgcaattntacgacattntcagccacgatgcatncttcagtcgataccagcttacgangataagggtatgcattggatatagccaatagccgactcttggacactcagtatttaatggctttntttctttcttttcctnatggaaccngagttaaggagtgccaggaaaac

SEQ ID NO: 1751 - DNA, 589 bp, Fusarium venenatum
  misc_feature (1)...(589): n = A,T,C or G
cttatcaatacatcatcacgaaaacaatcttgattcgttatggacgaagaaaacagccttctcagaagagtcatgttgccaatccaggctcgccgtagtcgacctaccatgacactgatcgtcatggctattgtgacatataccttttggatatggcaacccttcaggcctctcatagacaacaaccttgggttcacgtcccaaacgacaatttcactccccgatagtctcgtacctttggaacnctttcatgantaatgcccgatgcaaaggatgctctcnaactattggtgctgcctgtcatgcagcgcgtccatgacaaggtcaactttactctatcttatattggccggccaaccgccaacgatggcgtcgactgcatgcacggcccttcggaatgcatgggcaatatcattgaactttgcgcccgcgagctttaccccgaccctaagataaatctgggttttattatgtgcctganccgtgactaccgcgatatccccggacgatcccttgtcgaanantgcgccctcnaaatctgccatcgatttccagcaactgaacnaatgttctgtnaangaagatggag

SEQ ID NO: 1752 - DNA, 431 bp, Fusarium venenatum
  misc_feature (1)...(431): n = A,T,C or G
ggctggccggtccgcctcaccgcgtgtactggtccggccgggcctttccctctgtggaaccccatgcccttcactgggcgtggcggggaaacaggacttttactgtgaaaaaattagagtgctccaggcaggcctatgctcgaatacattagcatggaataatagaataggacgtgtggttctattttgttggtttctaggaccgccgtaatgattaatagggacagtcgggggcatcagtattcaattgtcagaggtgaaattcttggatttattgaagactaactactgcgaaagcatttgccaaggatgttttcattaatcaggaacgaagctccgtgatggccagatatttcctcatcaaatccgaacgagaggatgattgtgcgtcgcggcttgaatcctgaatctatcagagcctctaccgctna

SEQ ID NO: 1753 - DNA, 358 bp, Fusarium venenatum
  misc_feature (1)...(358): n = A,T,C or G
cgtgctcacaaagcagagcaagacccttatcgcagtaatctccggaattaccgccctgatgctttcagcaaccaaacccttggtatttctggtacttgcactctcctgtacgcggaagaaggagacccgttcaaaatcaccatcgaggaatctggcgtgaagactactgcgtctttgacaacctatttaccggaaatacccgatgatattcctttcgaccgcactgatctcacctttaaaattatcatgcaatctcgaacactgntggactcgctcgcanaaatttctccaacagctcctttgaagttgacagnttcagccnccaaagctcaccttttctatncttggtggtataaga

SEQ ID NO: 1754 - DNA, 586 bp, Fusarium venenatum
  misc_feature (1)...(586): n = A,T,C or G
tggaagaccaacccgtgaggggtttgtttcgtaaggaggcatgtctcaatgttgatttcaagcatggcgttcaaaggatgaacactgggagctactactagtattaatgtcattcttacagaaatcatttctgcctgtcattgtcgcaatatacccattccctttctatttcaacgccggatgtcctttacctgtattgtatcttttgctgccagaaccgccctatgcctttttgacgccaagaatttcctcccactcatgtcgcatgtcttccattctcttccatgattcagcacccaattcttcaaacctgatgatatcttccttggtcacgtcaacagctccccttttacgcccaaccgtctttttgaaaacaccaacagcggtatcggcatttagagccgccgcatcctcaaccttgccctcccagccccatccttcaacttctgtcttcttaacttcaacttgcatgtgacggtttgagctactgccccacttgatgcgctcagcgtccaattcgtcaagcgcanattgttcctgtagggcaatccaganaggcganttgggcaccngtatagctgtctgt

SEQ ID NO: 1755 - DNA, 1146 bp, Fusarium venenatum
  misc_feature (1)...(1146): n = A,T,C or G
gnttatnctcagacccacatcgcgaccacactggtggactnacagcacatccggcagaccagtcttgtcatccaaagatctccancgagcagagaangggactgtggatgggacttagcanagatggccatctagccgtactnacaaactatcgagaaaccnacatcaaggatcaaaatcatcctattcatgccgccaaaagccgcggtggtatgntcacngcttggctgggaacaccacctgangagagtctcaaagacagcgtccacaaactggtcnagaacgactgngtnaagaggtgttggaggattcttcatggttngcggcaagttgagaaaaaatacttacggtattgccatcgttagcatcngagcatgcaacgtcnatatgtgcccattattgccaaanancgaggcgagatgtggggtttgagtaacacggnctttgatgcaacagtcaaggaagatgaatgggccangatcttcattggaaagaaactcttccgggagagccattgacagttccgtatccgacaagtcgagtcaagaggagttgatttccaacctggttggacgtacttacccacgacacactaccgaggaacgaaaacgcaagcctggtcgaatatatcaacgagcttaagaaaagcgtatttattccattgatcggcgacgaaaagcatcggaaagcaatggaggcggccatggcgaaaggacccggcgagtgggcgacagacgatcaaaaagcagctgaggagctcatgtcggaaggacgaccggatccaagcataacacccatcatgggcttcgagacgggcatgtatggtacgcagcgtcagacggtagtgttggtagattgggagggtaaagtcaccatggtcgagagggcgctttgggatggtaatggcaatgctgtgcctaaaggagagggagacttgaagtttgaattctccatcaatggatggaatgatgaattttgtaatggagtaaatggggagagtaatggacatttttaatgatgctgaacaggcatggctggcccgcaagaagcataaaanacaaaatctgtaggccagtttatctctttaaactaagttatgtcagggactcactgtcactgctaccctaanaaataggaggccgtgcc

SEQ ID NO: 1756 - DNA, 629 bp, Fusarium venenatum
  misc_feature (1)...(629): n = A,T,C or G
cagttcacgcagaagaagcagaaggctgaagaaatcgcttccgataagaaggccaacattgccatgaccaaggaggacagcattttccctaacatcgacctccctggtggcatcagcaccaaggccaccgagtacaaggagcttgcccgcaagggcgacaagtgggagagccctgtcttctccatcggttctgctaagaagagtaccgatatccctgccgtccccaagatccagcgcaaggctcaccccgtatccaacctcggtcctaaggacaccaacgctgactacgacttttaccctgctggcaacggacaccagcacactggtaatggcgccatgaacggcaatggctaccacgtcggtcacggagacggtctgaacggtggcgttaacaagcaagcaccttgctggcaatggcctcaacaacgggcagatcccacgggacaggtcctatggctggacagaaccatgaacactgnttanaacccttgtgacgaggatgccaactagcccaggaaaataatggtggaggattggtggatgttatacccatgcccctgccttgagtggctttatctctttggttttgaaaccacacttgggaagcancnctggcggnaaaagaacaa

SEQ ID NO: 1757 - DNA, 538 bp, Fusarium venenatum
  misc_feature (1)...(538): n = A,T,C or G
gcagtgaacgttccgttgacgtatatacacctgaggttggcgtcgttatagacgccagtgttgacaccaacgcctgggttgtcaagctggcagatcctctagtcagaaagataaagtggcagaacgttcgtggtctaggcattgtcactattacaggacagcttcttgccacacatctcaacgaagctgcagcagccgatgaggacatcgccaacaagcgacaaaagaccgaagagcccccctcatcgactaccctaaccaacacggcggcagccatnccctcggccacacctgtcctcgatgttctccccgcgaaccttatttctgctgtacgctcagcagcccaaccactacacgttggtgacctcgcctggccgatctgcgtcgcgccatgcantccgccggccacacggcggagttccgtggtgagggcacactggtcgttgacngnactgtcgccggtcgcaagangtctgcaggtcgtgtcgaanttgaanagtgtgggcatgccgaccgctcggcgaagtaccttctatga

SEQ ID NO: 1758 - DNA, 436 bp, Fusarium venenatum
  misc_feature (1)...(436): n = A,T,C or G
ggccaggctcagggtccttccttcttcgaggaggccataggtggctctccctttccgcaagaaatacctttcgccctcatgcaacctccccattataactccacgccaagtatggtcaacggctttccaccctcagctgctatagtgccaagctgcgaggccgaacaaaagtccgcttgccaactccggtcccgagacacgcatcagctgagcataaacacttccgacgaagcaaacggtcaagctatcatagtaagatctcccaagccgaagagacgcggccgtaagcccaagggagcctccaaagattcagcaaatctcggacgacatagtgctcgatgaaacgacctcccnagggaccccnggcgtcgtngaantcttggagcgcaacagaataggntgntaccaaaggtggctccgaagcgggatgaagcat

SEQ ID NO: 1759 - DNA, 659 bp, Fusarium venenatum
  misc_feature (1)...(659): n = A,T,C or G
gaaacatagccttgaaatcatgccaggcatctcgacatttaccaatggcttccgtcacccgttcatcgcggcgcgctgaagttccgcatcagcatcatcatcactcgcaccaccacctgccatccccaacaagcgtatttgcccacacccagngcggaggagcaccangggcaaggcgcaacaaganggcactcgatgcacacgatngcgactttgatgcgattaagcccaagaaatcgcgtataacagtcgaagttcctgcaaagggntcccacagacttcgtgtcgccaacatcgacaacaaaagaggcatcgtcgccccgcgcgccaaaccactgcgacgcctacagttggcgaatgttgacgacgcccaaagataccttctcccccgaacgacaacgcgaaatcgacgcaaaagcaaggacaagaccccttacaacaacaccaaagcaaggtcattaatgggctaaaacacgaactccaccggataaaaacctcaanccaagcgataccaacacaanagaacaanggccggaanctncctctcaagggaagcancaaggtttaagancgagcttttggccaanttcccggattacaataaggtaattgnaaacaagcccaaagaanaanaaatggttaattgcgnaaacccgatn

SEQ ID NO: 1760 - DNA, 299 bp, Fusarium venenatum
  misc_feature (1)...(299): n = A,T,C or G
agaccctgacagcagcggacaaggacgcgattgcttcggccatcaacgaccttgacggtgcacaactcgatcgtgccatcgatatcatcaagcgagacacaggccagaacgagaacactgacggagagctggagctggatattgaccancttancaatgaggcattgctcaagctgtgggaactgtgtatgaaggtgctcccnngatttggtaaggactctaacgtaccatcttctcctgaagcatcccgagcggcgcctcccaagcattccaagtcntcgtcgacntcngcaaagccc

SEQ ID NO: 1761 - DNA, 1071 bp, Fusarium venenatum
  misc_feature (1)...(1071): n = A,T,C or G
gtgatatgccaccttactttattgatttgactttacctgggactgtcacagtttaatctgaaacaaaactcgacctgactcgactcgactcgactcttgcaacgtcgtcgagtctttctactccgctctgttccctctgttccgtcctcctcctcccagtcaaagtcccttttggcatgtcccatcagaggtggcccgtttcctttccccatcctcgtatcctctctcccaacttagatctcgcctctcttaccgatccaggacttgtgcctgtccatcagacactctctccacctgctagtagtagtaggttcattggggcgtaagattctcactctcaccctcaccttcactcatcccatttgttgctccttcgacaccaaagtcctctccaacctcccttctttctggactatttactttccgtcgtgcccatgataaccgggttctcgtctcctctctttcgtcactttctttcataacacaccccttcttcacaatgtcaacttttcaaaagaagctcttagcagccatcatcaagagcctccttcgagggaaatcactagttcaagtccctcttggcttactggagtagctcgttgggccatgatacatccggcaaatctcgagttggtaacacaccgcgcaagtctatccaagaatttcttaaagaggccgaagatctatttctcgaccccgtcagccaagatggtctccaacaactatctcgcaacatgcggaagcaactcctacaacgacttgagaccgacatggaatgtatgctgccatcgtatagtcaccagttgccaagaagcacagaagtcggccgttttgtagctttggacgttggcggttcgaccctcagantacattggtggaactttgtggtcgcatgtccaatatcggggaanatctangattgtcagcatgcgcaactttcgcatcactcctgatatcaaggctctanaaggaatggctttctttgactggatggctgaaaaganactggaaactctttcnggaaactaaacaacatggtggatntgaanggcctttgcctatntcaatgca

SEQ ID NO: 1762 - DNA, 535 bp, Fusarium venenatum
atcgcaatcgcagactcccccgcgctcgttcaagcttacgttccttactcaaaccgccaaaatgacccgcgctcagcagaccatctctctcgccctcctcgtctcctccctctaccttgctctcttccttgagctcatccctcttcctcccctgatccaggagcagatcgtccccgtgcttcccttctgggctctcgtgtcctttggcgcatacctcctcttccgacttggcttcggcatcctcaccttcaacgacgttcccgacgcgcacaaggagctcacaactgagattgagcaggccaaggttgagctccgaaagctcggcgtcaccgtcgactaaacgactacccgaacgaaccacgatttagatggagggcaaaaaagggggatttggatggatgggatgaatttttggctcttgaggcctaatcaaatttaatctacgataatctggtatctcgccggtgcgacctgggcaaaaaagatcttccttgacaccaacgcgccttcaatgcattcgtaaactttggcatct

SEQ ID NO: 1763 - DNA, 581 bp, Fusarium venenatum
  misc_feature (1)...(581): n = A,T,C or G
cagggcagttggttgctgttagtgtttgcgtcagaaagcaaagtgaagcaaacggaacttggctcttggtctttattatactcaattgtttctttcttatactttttctaagtttggtttgaatgaacagcgcctgcatcaatactttattacttcaaaaattctttaattaattctttttcgcgctcacgtgtcgccgattaaaagcagactcactgtgtctctgttgcaccaagcaccaccaaaaaagatcggccctgctgcgtacatcttcctcctcaaactccgtctcttcttttcttcccgcgcacaaacttcccatgaagcttcctccgctgtcttaagctttgccctcagctttggagctgttaccaagaattcgcaatggcgtcnacaatcacagaagctcaggcggagcttattcgctctcttgcccccgacganattcccatcaagctgcgatgcgcgatctgtagtaaactcgcggtcaacgcttaccgtcttccctgctgcgancaagcaatctgtgaatcatgccagtccaatctacccgcatcgtgccctgtttgggaanactcgcc

SEQ ID NO: 1764 - DNA, 835 bp, Fusarium venenatum
  misc_feature (1)...(835): n = A,T,C or G
gaacaattcgtggccgcaggaatttttttttttttttttttttttttcaggagagagatagtagtattgaatttactgagaaattgccaggaaagttggcttattcctaatcctagtctctttttttttttcccttcctgttcctttcaaccgagcgatagctgaagccctgcttgcttgctcactaactcaaccgacccccccnttgnaagattttttttgggggnggtngangnctgttaattttccactttgtccttttctgggaagcacattttttgcttttcccgtttaaatggtatcctttgttttccgtgacgttttgttgttaagaaaaattgcaatttgaatcctgagtagaaagatgatgatcgctgcgctttgccccataaacaaaaaacatattcattcattcaatcattcacataatttagtgaagaacgacatcatggaagtcatgcttgtggtcgtcggcgtgctcgccccagtggacaggtccaagcttgagaatgcggtagctgttgttggagttggagtttgagctggtgttggactcgactgatgatcgtcgctcggtagaaggacgagtgtgggagcgggcggcgggcttctgagggtatgaaggagatgtagccggtgcgagtgagaggaaggatgacttgggaggaggagtgagagggaggaagttttgaggaggaaggtcagacattttggtagagttgagttgagttgagttgagtcgagagttgttgtaagatgagttgatatggataaggtgatagttgttgatgatgttgtgttgaaagtgttgatagatagagacagaagacaaaac

SEQ ID NO: 1765 - DNA, 620 bp, Fusarium venenatum
  misc_feature (1)...(620): n = A,T,C or G
ctcgactcctcctgcttcctccctcaccccccgtttcgtgccccattccccataatcgcgcgcctcgctcgtctacttctccaggcccagtcgaaaaatcttcctttttgaacttcttcaatgaggcctgtatattcatcataactttgtttgtgccctctttcccccctcatccctccccccgacatagtccccttattacattctctattctttttttgcgccctctctcaagccgcaggctcggacgacgctcaacgaccacaactgtccaaaaatccacatcaattgcattgcatcttcgcttgagcaataaattgcttcgccacagtcgttgcggctctacagctatttagaatcacgacctgttcacggctaaggcaggccttgccttgccttctctttgcacgagcatcctttgnaataccggcggtcctggatttcttccgtcgcatcgcgctctttcaatccagcctcccggttctgtcgaatacgctcgaattaatgctcttcgacgctttcacgccngcatctcctcgctatcggtcgagggcgncccaacaacaactactaaactggttttcaaacaatttcatcttgggacttgnctttttccgccn

SEQ ID NO: 1766 - DNA, 625 bp, Fusarium venenatum
  misc_feature (1)...(625): n = A,T,C or G
attactcaaccgtatggactgaagagaaaatctattcgtcacaatggtgttccagcatgactttctattttcagtagctatttctggagagtacagcgactttacactggtttgtaacgatcgtgaatacaagctgcatcaagtgattgtgtgcccacagtcatcggtaatatcggctgctctctctggtggatttcaggaagctacaacgaaaattctcactgtgaacgagttcgatatcagtaccgtccaatacatgatagcgtttctctatgcaggagagtaccaaatccattctaaaagggcgaaaaaatccacttccgacgatgcacacaaccaggacgacacagatgaagcgtcgcagtattctataaaacaacctgaagatgaaactgtcgatgatctgatctctcatctacgcgtcaacgcaattgccgactactataatattcaaaagttggctcaactcgcaacctcaaagattcaagccatcctggacaaaggtcaaagcgccgaggtatttccacaaattattcaagaagtgtcaacttcaaacagagatcctgacatcgactcaattatcgcttcancccgcggntgcacatattgaggaactctgcgaggt

SEQ ID NO: 1767 - DNA, 466 bp, Fusarium venenatum
  misc_feature (1)...(466): n = A,T,C or G
cgaggagtgcgttccttctcagtctgtgactgctatcaccaaggagtacaccaccgtcctcaccagcgttgagtactctaccatccaggttccttgcgccactggcaccaaccctgccactcctgagcagnctgagaaccctgagaacccccagaaccctggcgagcctgaggttcctgctcctactggacctgctgttcctcctcccgctaccacccccatcggnggnggcaaccagaccatgcctactcctcccgctgcactgntggtgccgctacctttgncggctccgtttnttcgctgccgccgntggtatcnccctttcatcatggtttaaactnatccaatttcnaactccctgttaggctgctggctntggaacttnaagactnttttnttttaaagnttttaatggaaaaactcgactagggctttgaaaccnccgtttcttggcgtttttntttgn

SEQ ID NO: 1768 - DNA, 573 bp, Fusarium venenatum
  misc_feature (1)...(573): n = A,T,C or G
ccctactccgccacaagcgtcctccgggggctctcttgtcccgcctccacctcagcggcccctctctgcaccactgtcagctcagccaagcggtttcgcgcctcctcccatgatgccccagatgacaggtgccctgcagggtcaagttgctcttcctgggccagaagcctgagtgatcttacgcaagctcgcttgcaacagcaatacacggctcaaatgcagcaacagcaacccttcaacaaatgcagcccagcatgactgggattccctggacagcaagtcccggacagatgcctttccaaactggccctggacaatttatgcaaccgatgatgacagggatgcagggacagaaccagttcatgccgatgcaagctcaaccactggtttccaacaatcgttccctgccacgcagtcgatgtacggtgccctactggaagcatcaacagctatctgccgcccgctcttgaancacagcgaactggcatgcctggtttgcttcctcnagcaactggaatgtcaaaatgggtaacatgggcggcatgaaaaaagcgccaacctccaacctctgca

SEQ ID NO: 1769 - DNA, 426 bp, Fusarium venenatum
  misc_feature (1)...(426): n = A,T,C or G
tgatccccagggcagggatcctagagatatccgagagcgagatccgcgagatgggcaatggggtcgcatgggcgctgaccccagctatcgagcccctatggatcatcaacgaccacatcccgactatcctccttctgccacgccttaccctcctcatggtgtttacccaggtcctccacccgatcgatatcctccttcgtcgcattctatgccaggcccgccaggccaaaccatgccccatggacccgaccttatgactntcccgaccgagcccgaatgagtttaatgtatgcacaaaacaacaacaacccgaccgaaaccggaanaagggggcccccccncggncatagnttanacggagctctggtcnggacnacttgaatntcccgaccccgnatagngtgatgcgtanccccaaggccaggt

SEQ ID NO: 1770 - DNA, 593 bp, Fusarium venenatum
  misc_feature (1)...(593): n = A,T,C or G
caaaggttacaccatcatcaatcggtttccatcgattcctatcctctcagcacacttttaaaactgctccatcgggtttctcttgttataatcttctagaaagcacgtctttcgcaacacgaacaatgtctcgcggcggcaccaccctttacgtgaccggcttcagccacggtacccgcgctcgcgacctcgcctacgaagttcgaacggtatgtcaacctcgcccacgctcacgcccacgctctcgtccacgtccgcgtcctatcgttttcgcgctcgccttcgtctgtgtctgtgccatagcctagggactctttcgatgcaatgcaaaggtctcctgcttggccatgatgcctcgccgtccatcgtcgtccttacgtcctcgtcctcccgtttccgttctcgctcgcgcccacgccccagcactctctcctcccctgtctttccactttcttcgaagggantgctcgtctatcgcgcagtcgctcttctgctcgagcaaaccatgaatgccgtgcgcattcgtatccaaaagggggngtccgtcggcatttggctgcgttacaacgtgcttcatantatactgaacaatc

SEQ ID NO: 1771 - DNA, 611 bp, Fusarium venenatum
  misc_feature (1)...(611): n = A,T,C or G
cttggaaggaatcaaggcaacgcatctcgctcagaagaaaaaatcgaaagatcaaactccacaatcgaagaaacgaagtgctactagtcctgtcctaccagccagcaacaagcgcatgcgaaatgggattgcgacaactccaaagtccaactcagagagaacacctcgatcgtcgcctgaaaaaccaataccttggagtccgagtccggaacgcgatcagcccaagcaggcggcttctaaaaagatagcaactgatacgatcactcaatcgtcaatcgtacacgagactccaaagacagctggagggccaggcctgcgactgcgacaacgacacccaataccgacgttccaaaacccgccttcatcagaatccgaatatgacatggaaacgagaatcccagatgcccaacctctcctcaatatctcaattaaccaaaatgcggttcgttccaaccgagccgtgccgtctccgctctctacaaacaaaccaatggctacaccaccatgcgcccagccgagcaattccacacaaacatcaggccaggatgcagttgttccaagcaaaacatctncggatacgaatcgacgggtagaaangggcacaagcccgg

SEQ ID NO: 1772 - DNA, 628 bp, Fusarium venenatum
  misc_feature (1)...(628): n = A,T,C or G
gattggtctgggtcaatgagcccgaccaggacctcggcgatggacgcgtcgtcaacggaaagtcaagactcttcagcataggctatacttctacagtcaccgaatgggatctcgagacaggacggcccaanagacacgccagcggccaacatggagacatctggtgcatggctgctcaacccggtggaagcnacaaaaccggcctcggcgtcnattcccaagactctaccaagcttgtcgccggaacaattgatggcgagcttgtcatgtactcgattgaggacgacgacctgcgatttcagcgagttctgttgcgatcgcctaccaagaaggctcagatggtcagcatcaccttcagtcacgcagagtcgccattgtcggctgctccgatagcacgattcgagcgtacgatgttacaaagggccacatgttgcgcaagatgacactgggcgctgaccatganggtcgtgctaaagatatcatcgtctggtctgcaagtgtctacccaacggnaacatngtcttgggcgaatncacttggccaagttttgccttttgggatgggaagacatntccccagccccagcgaattcagagtcncaagccgggtgttnttantctccaataag

SEQ ID NO: 1773 - DNA, 442 bp, Fusarium venenatum
  misc_feature (1)...(442): n = A,T,C or G
ggacagaaggtgtcgccagctaacgatgcgagggagactgatgcgactgagaccgcggaatttgatgggttggctggtccaacattggcctttggcttggggacgcgtggttgttttggcagaagattaggctatcaacagctgaaaacgtccattgctatcttgatatggaactttgagctattgccttgtcctaaggaactctctagctatcgtaccatcgaaggtctgactagcatgccagaacattcttacatcaggctggaaaagatcgatttgacaacacccggagtagacttatatatcattcgaactggtttattcnggcagttttcttgacacatttncctttgcacttaataacaattgagtatgaaaattcagtttgaatatatcaacaactaactctcaattgaccacngaacactttgtttttattggt

SEQ ID NO: 1774 - DNA, 571 bp, Fusarium venenatum
  misc_feature (1)...(571): n = A,T,C or G
ccaagcctcaaaagtcgcagtcaacagctcccagcaagtctgttgcctcacagggccagttcactcctcccatggagcctgctgatgagctcttcttcaacaactcttacgacgaccgagcccgctcagacagccctcctcaattcacttactcgacttatcccgctcccgacgagatcctccttcatccctacggctccgcgcagcactacccagccatcacaaccgctgatgcctaccccaactacatgacagcgtccacagtgcccatgacactcccttccatgacacatttcagcgatgccatcaagcgagagccaacatactctagcgacgaaggactcgctccctacatgacatacggctacatgcccccgatggacttcaactctggtagcccatacgatcagaacctcatactcctccgctgtcgcattctttcgaccactcgggcaactgctcagaagctggctacgactaccgaccacgcctctgtcaatgcctagctcgccaatatgattcagcatcaataaggcactangcaggcatgattgtgagatgcagcgacttt

SEQ ID NO: 1775 - DNA, 622 bp, Fusarium venenatum
agaagtgggctctcaaagagaagcttcctcagctgccagcttcttcatggattctgtacacattcgagaacagggcaagtaacctgggtgctggtggaatcacccagcagaccactgcaatggcagagaagttccgtcaactcagccagtccgagatcgatgacctcaccgtcagaggcgccgccaaccgcgaaaagaaccaggagaactacaaggcctgggttgaggcacacgagcccgcgcgcattcacctagccaacaagtctcgccgtcgcctggcattcctgactggcaagcctgagaagcccatcatcgatgaacgcctgcccgagcgtccaaagggctcatatgccatgttcgtgacagagaaccactcgcgctttgccagcgccggccgccatgaggtgttcaagctgcttggtgaggagtggaagcaaatcagcgcagctgagaaggctcgatacgaggagaaggctgcggagggcttcgccaagttcaaggctgagatggacaagattgatgcccgagcagaagccatcaaggaggccggtttgcccaactagaggaactgaatgggatactgcccacatgatgtagtattatgtataaagcactattttcc

SEQ ID NO: 1776 - DNA, 489 bp, Fusarium venenatum
  misc_feature (1)...(489): n = A,T,C or G
gcatcagcaaccccgtgccccagccagggtatcatccccaggcgcaacaggccagccgaatctgccatctcgatccaacagtacccgagaagctgtcttgggctctcgccctcgcgccggctcgaatattgccggcagagatgccccaaactcgcctttccttgagagcccaccaacaccggcacctcctgctgattctgtgcggaaactcgatcagataatacagaatttctacgcaaaggcggctgtgcttgttctcgactcacgtattaaatccaagcctgcacgcggcgctaacggcgcgcggaaacccaataaatggttccaaatcgagacagatgagattgacgattttagagatgaactcaagatctggaanaaatgtggtagcctcgataactccctcctccaatggttatcgaagtttatcttgatgcctctcgaataaagganagccgaatctcgtcntgtcaataaaaacggtaaaga

SEQ ID NO: 1777 - DNA, 1015 bp, Fusarium venenatum
  misc_feature (1)...(1015): n = A,T,C or G
gaacggacggataatcccttcccatttgctttgcttcgtttcgcttttcctccaacttctcctccttgtttctttctcttacctattattccccatcatcatcagaaacaacctcccctttttaggattgagcgtgcgtgtcttggctttcaagcaccccagactattccttaccgacaacacacttaaagagctttgctgggcattctctcgaccgcaaccttttcccacaaaaaaaaacatcgttaacccgcccaacatgcgattctcaaccgccattcttttcgctggcaacgccttcgctgccgtccagcaagagtgtctcgccaaccacaacgaggacctcgctgcctttgccgactgtggcaacaagggtgccctctttttttgcctcttcaaccttaaggagaccggatgagggcgncctcaagacctgctacacctccgctggctgtgccgacgaggatgccgcccgcgaggctcactacaccctcgagcgatgctcagagcttcgcaaaggccggcgagctaaagaagcgctacgaagctgctatcatgccgactctgattnccgacgctgaggccgccggcaccatcaccaanggccccgagcgtaccggtggtgaactcaagaagcgtgctactgacacttcaaggggaacaaaatgcttcacaactttcaaaaagtcgactgagcagtgcgatctcgagaccgtttcggataagacccagactggtacctgctacagcacccgagattaagcaccagcacatgcccgcagcgatgttatctgcaccaccgactcttccggtgaggacatttgcatggttaagaagggaaatggacactgccggtatcattatcgccattggctttgccggctttgccgctggtatgctcggcttccttcctttcatgtgctgccgtgaccgcaaggnacaaaaacgttttggtcgccagtccgaggctgttgcttttgccgtgccgcacaaagaacancgcgcttgttaacgt

SEQ ID NO: 1778 - DNA, 544 bp, Fusarium venenatum
  misc_feature (1)...(544): n = A,T,C or G
ngngggccttctngggacctagctcgtccatnttgatggctgcgttgaggacaatgagacgagcagcgtctatttcgatgcgggacttggcgatccattcaataataacaccgtgctcgcggaggagtttgccgaatggcttcttggattcatcgttgactcggaggagcatccantcacggtttctaaagctctgcatgccccgtcgtcctgtcantcgccgttcccgggcgtcttgacgtagagggacagggatgcatggccacctcggcttgtgccttttcngacgtgttctnttgctctcgcaacaaacacaccgaggctcggctccgattactctaggacgacgggcatccacttagggggagctttngctnctggnggctttttggaanantatttattntatgctgcacgttctgnggggggtaagaaccgtattcanaactacctttgntngcgtgcaccaagacnagnttccggcaaancntttgtttaanaaacatatnggttggcagncnctcttaatcaaatatgtctacat

SEQ ID NO: 1779 - DNA, 623 bp, Fusarium venenatum
  misc_feature (1)...(623): n = A,T,C or G
cttcctcaaccgtgcagcgtgaccctgctttgctcctccactttgtataactgngactcgggtggcacatttncttcttccaaacacacgatatccctaccacctctcctgcgattgacccagtgtctgtgcacataacatgatgttaggctttgggaaaaaacccgacactaacgcttctgatgaagttcaccacaacgatgaagcacacacgtcgcaagatgatatccctcaacgaccttggactgaaactgccctccccgtgttcgcttgnggngccggtnttttctcagacgggtatatcaacaatgtgatcggtccgcaacaccacactgagaaggcaatacggagatgtctacgtcaactcgaatgccttcaaatatgtgccgatattgcctttgcaggcactgttgttggccaactagttttcgggttcttgntgancattgggcgcgcccaacacnctcatggggctactggtatttttatnatcttcactgccttggcagctggatcgtactggcatggacnaccccgtggaatgttcaacatgcttacccgcctggngaattttttgtggtnttggaaatcggnggggaaaacccaacanggagcgggtggng

SEQ ID NO: 1780 - DNA, 620 bp, Fusarium venenatum
  misc_feature (1)...(620): n = A,T,C or G
agccatactaagcctcgcaacatcctcacaagtccctctcaacggccatctccctataatgccttcctccgactccccttcagtccaaccctccgtggctctcggcgacatcctaggttccaaccgcggccttacatccttctcttccttcgcgcgcatgcagccctccaccgacacgcgcctctccgacctgtccaccaacaccaccgtcctcgcgccgctgaattcggccgtcgatgcgcttccgcgcaaaccgtgggagcaacctgctgattacgatgcgtttggcgcggatgcgtacgagggtgatggtggacaggatcgtgcaaaggagaatatgaggcgcttcgtggaggcgcatctcgtgccggctagtccgtggcagaaggaggacaagatcaagaccttgggcggtaaggaggtttggtgggttgtcaaggatgggaagaaggtcatcatgcctgatgaggtcgaggttgagcgtgtggccagccaagttggtaacggagagctttggattctcaaaggagttttgaactacgcttagaattgcgacaacacgagtaatgatagattaatgattattgnacacagctnacaacaagccaaatactacagna

SEQ ID NO: 1781 - DNA, 583 bp, Fusarium venenatum
  misc_feature (1)...(583): n = A,T,C or G
attattttatccttcctcgtcctccctcgaacaaacactctcccatcttgacttttgcaccctcgctctacatctcgaacaacacataaaccatgctcacatcaaccttcctcctcagccttatcggccttgcagcggcctcaccggtccagcctcacatcgtcaaggaccctaaatacccatcacgctcgacatcaaagggcttcaagcttgtcgtcaacgtcacagatccctcgctagactttgatcctcccatccaaaacttcgagctcaccggcatccacaccggagccggcctcgcccttctcggtatcagcgagaaagacgccgcatcttctaccagaacggcacaaangaagacgtcaaaacggcgaagctaccgtcatcagcgacggtggtactcctctgactccaacggtattggtctcgtcccgataanaaaacaanaatcttttcngtgctacgctcaacttcancctggtacgctggtgtcaattgaaccanctgaagaccctacctacttgttgccganactttgttgcttgttacaagacataaaatataccgtggcaaaaatctggtc

SEQ ID NO: 1782 - DNA, 629 bp, Fusarium venenatum
  misc_feature (1)...(629): n = A,T,C or G
cctagacttgaactcacgctctcgggttcgagtgacgaatccgataaatctctcgccattaaggacagttcgtcactgtcgccatcgccagcattatcaccctcaccagcacgatcacaacctccttcgcagtcgcagtccccatcatcgtcaccgtcgccatcaccccacccgaacacgggttcctataccgatactgctgtgcaacccgtgaagcccactggcctttatgttaagaactcggtttacgctggaagggcacttgctgaatgggcccaagtcattttcgagtgcaacaacttcatcgagcgccgtcgtgacgaaggaatggcaagtcttgctgatgtggaaatcctgtacttggagtcgagggtttccgcaaggtcggtggttaaaagcaatgaatctgagatacccttactattaaacacagcacaattatgctctactttctttggcacacatgctttcatttcatttatatttttatctttggttctaccatcaacagtggatngggggcatattggcttttctgccaaacatcggagtaccatcaccatacattgggggnatntttctcgcttaaaaccaaaatcagaancaggggggctcaagtcgttctttgg

SEQ ID NO: 1783 - DNA, 713 bp, Fusarium venenatum
  misc_feature (1)...(713): n = A,T,C or G
catcgatcaaagtctctccctagcaaccaaacctccaagaagtcgctcttttccaaaatctcccgtcgcctctctctcggccccagaagacgcgccgattcagtccgtctatacgacgatagcgacaacgatgacacagtctgcgtaatcccttcagagcttcaacagccacctacccaatcacgcttcgctcgccgagcctcccgattctggtccgtatcttcggcaaaccagttcgaagaagacttctcttcaccccagtccccaacatatccctcgtacgggggcacatacgtcccacgccatgcagcaagcgacttttccaagacagccaccaatcgcctgaccatgatggtagaggccgacgagacgacgctctgctcatacaactaccgcaccgacagggactacaagaagctccagcatgactgacagcgagcccgatctggatcatcgtgaacaggcactcagagccttgactacgagacgcagtagcaccctctcaagtcngacgagcaactcgaacaatgactatatcttcttctcgaacgacgcgacaagtagtgtagatgctcggcatcgaaaataagctgctgcatgggctgagcttgaacagaaatcagcagcaattaaccacagggatgagcggcaccgatcagctcatcccccggcaggggcgcacacacagcacctatctgggtttggctggcagc

SEQ ID NO: 1784 - DNA, 767 bp, Fusarium venenatum
  misc_feature (1)...(767): n = A,T,C or G
ntttcccctgttctgtcaccagtggctgaatgttctgaagagattgccgaccaagagccatcgaatgaggccaagccggaactgactgaaagcacctctcccgacctgacacaacgtcctgccgcgatgttgtctgacctgcagtgtcacaagtcggcggagatgctcaagtcgttcccagcgccgccaacctcgatgccgccaacctcggcctggctcccgccttccaggcgatgctgctttcagccttggcaactctgaccttctgccaacgtcccttgacgcagatcgctatgtccttgaaaacgggtatctctcttcatccgactcctcaattattggcgacgataatctggttggtgacactcccgcgttcaacctcaacgacgacttcgacatcagcctctggctcaacgacgacagcgccatctcatcagaatctatggcaacgagcgacttcgccgctgcgatccagggcctcgagcccaagatctatgaacctgagaatcaagtctcttcggaaaatcctatccagcagccccatcctggcgcgtccactcaaggatgcgacgttggtggcattgcggttggtgtctganaaatgcgaggacagggtcgaggtcttgangcgcggaactgacggatccgcggccaaanctnttgacaggatatttgactaacatggctttgccgtcgcgtgaactactgatgacaattctggggacaatacaatnaaaaaacgtcacnttaacgtgnaatggccnacn

SEQ ID NO: 1785 - DNA, 166 bp, Fusarium venenatum
  misc_feature (1)...(166): n = A,T,C or G
tcgtgatgttgacgaggacttttacaagctcaacagnggcgccactggtttctaccgtgtcaactacccncctgagcgtcttgctaagctgagcactcanctngacaagcttagcaccgaagattagatttctantattggntctactgntgaacttgcctttgct

SEQ ID NO: 1786 - DNA, 425 bp, Fusarium venenatum
  misc_feature (1)...(425): n = A,T,C or G
taaatacaccatgtttgaccgcaaggctaagcgttaccgcaagggtattcacaagctacccaagtgggacaagagtatcacagcgagtcaacccccctggttactagagaatcgatttcacgaggtcgaagaagcaggactaccgggtcgaagatcatatggagaacggcgtattcatcccacaatgggaattacaagcagatccatgttggggtacatgtacaacacctttgtttcaattacgaattgcgagataatgacaatatttgccaaaatacaacacaaaagctttggctgcggcctatatgaaagtgaagggatagattaaggatgcgcattggacngaagacaaaggaaaacatgccacaaaggcacataggtagtaggaattgcagggcttctcaattgatgaagtcttctggttt

SEQ ID NO: 1787 - DNA, 389 bp, Fusarium venenatum
  misc_feature (1)...(389): n = A,T,C or G
ctcaagggctactatgtccgagttcgctacaacgaccgtccagtctcagtccctggctgcaaataccagggcaagcacctcgatggcgatgagtccttctgcaccctagaagccttcaaggaaatcgtggacaagtacacacctactaattggagaaaccagtgtcgtgccaacatgaaggaatctgcgtttccttccaagcccgaaccttcgggttactgaacgtgtgagcagcaggatggctcaagatacaacgatgatgcgagtttagactagtcttagcgttggagtttaagtgctttcgttagacttagacattagaacgattgcatatttatacgcaaggtgtggctatccctaaggacaagcttaatgtgataaanaaaaaa

SEQ ID NO: 1788 - DNA, 457 bp, Fusarium venenatum
  misc_feature (1)...(457): n = A,T,C or G
gtcttcgactgcactgacatctttccgcaataccattctgcaataccttgcccataacacaccctctctatccatgtttgcgaagccttctcaacagggacccgtgacaccagtagtcatgatcatttcagagactcatcttacaacgacatccgcttcagctgacagtttcaccgcacatcggctccttggtcctgaaatattacagcatcctggggttggcatgattgagtttaacgccatcgcgccatctttgctcctaaaagcactcgaattaatcgccaaaaggaagcgcggaagtcgggacgaaggaaaaccccgggtccccaggttctgaagcgtctcgggtgagatcgggagacatcagaaacgccgcctcgtcgcttgagttctttgcttgaangngaccaacaaggcgaatggggcacaaggtggcttttngaagcagaccaagggt

SEQ ID NO: 1789 - DNA, 1061 bp, Fusarium venenatum
  misc_feature (1)...(1061): n = A,T,C or G
ctggaagaattcgcgggccgcaggaattttttttttttttttttcaaaaaatagctatcattggtaaataaaacaaaacaacacgctaactcgacaatgtatctagaaatcctttcagtgccccgaatcgccataacataatagctaacacaatatcgaacttggatctgactgtctctttgtttctcatttcttcccaagcatttctcggagagcatccacctcagcctccctcctcgcaagctgaagtctcatatcatcgcgttcattcgtcatggcagccagtgcctcctcaagctcggaaatacggtcgaggcgcttctggcggtacttgcgcgcggcaagagtgttgcgctggcgcttgagggtgacngctgaatcctcttcttcgggagaggatttgcgtttgcgagatgaccatgatgatgagggggaggggtgcaaagaaaaggtggatgttcctgggatggaggatgttgatgttggggatttgtttgtaattgttggtggtgggggatgaggagtgctggatgttgaagttgaagaacgttgctcgatgggtgtggtagacttgacattgacgagaggctgctcctgagtgaggaagccatctccagccacatcgagcgaagactgcgtgtccaaaacgttcaagtccgggatcataatgttgtcgaataacccatcaccactaaagttctgaacgacattctggttggtggtggtgttactgttgatgttcccgaaaccccacgtcgcatcatcaaacccgttgtactcggatgggagaaattccaaaaagggagaaacgtcctcaaagagaagaagactaggatcgatgctgaggtcgctgctaggcaaagacgctggggcagcgagcagactaccaggacatggccgagaagcggctgcaggcagcggacgatgcgcacgctgctcccattgattcaagttaagggggctgcggcctcccctacgtttgcagagaggccgttaggctagaggagaaagatggagatggagaaaaaacggactgtccgctttttctgttgatgatggag

SEQ ID NO: 1790 - DNA, 472 bp, Fusarium venenatum
  misc_feature (1)...(472): n = A,T,C or G
ctacggcgctccctcacactatggtgctcctcctggccagtctccctacggtgctcctccaggccagtctccctacgctcctccaggccagtcaccctatggtgctcctcagggccagtatggtcaagagggtgaccgcgcctatggtgacaacagcaacaacccttacggtcaaggagagaagaanaagaatggcagctctggttatgctcctcggtgccgctggtggtctcgcacttggtgctgtaggtggtgccctgatcgccaacgaactcaacgacagcgaatagcgacaaagaaaaacatgccgcccgctgccgccgctgctgctccctgccgctgccccccttacaacaacacctcaattttttcaacaactactacgtgctcctcccccctgaagatttccctatgccaacccttntccccaaaaaggcccccctgnnttttggcctgcccccgaatcnaaatg

SEQ ID NO: 1791 - DNA, 632 bp, Fusarium venenatum
  misc_feature (1)...(632): n = A,T,C or G
aactcaccacccatggggcgttcccaaatcattcaagactacagactatcttaacaccgacggcaagatgaagtggcacgaggagttcaacagctacctcaacgccgttcgctttacagatgcttggctaggcgagttgcttcagacttttgacgagtatggcatgaccaacgagacattggttattttcgtcggcgaccacggacaggcttttaaggaagatcaaaagtctaagatcggaacgtacgagaacgggcatgttagcaacttccgcgtacctattaccttcgtcatccccatattccccgcgtgcagtacaacgctaacgcgacatccctctctattcttcccaccatccttgacctgctcgtcaacacaggatcactgacgagaaggaccaaaacgctgcgtcagacctnattcacgactacgaaggacagtctnttattcgaccatacaaaactattacaacggtcgccgcgcgtgggacttnggtttattaaatggnggngcgagcatgttgtccatgaacttctggcgatgcaccatggnggattngcattccccttcgatgactttacgcaatattcgattnaccgatntnaaaaaaaaccccctttgaacgtagggnn

SEQ ID NO: 1792 - DNA, 394 bp, Fusarium venenatum
cttcgagaggaagcacaagaagtgcaagaagcacatctctttgagaagcatcctccaccactgcggcagacatgcttactacgatgacgcaaagaaggagtgcatctgccacgacagcggtaaggactttctcaaggagcacaagacctgcgcttgtccccaaggcgagaagtggcaccacatcgagcgcaagtgctccagacactaagagtgtgcaaggctgatttggcttgtaattatgtttcaagttcaatgttctcttactatactgttggcttctgcggcagtgatagcaaacaggtcccgacatggatatggtcattcgggatagggcttggtttgcttttggtaacattctagtctagttgctcttcaatcattaccaattaattac

SEQ ID NO: 1793 - DNA, 597 bp, Fusarium venenatum
  misc_feature (1)...(597): n = A,T,C or G
gctgatagtttgaagtcgtccatcaaaccgaaacaaaatggccgatattgctggagacgtgtccctgggactcacttacgcgtctcaccaatacggtgatcatagccgccagaagctaggcgtttggcgcttctctaatcgctccgatcagaagtcaggctattgggtggtcttcatccacgggggtgggtggcgtgatcctcgtaacaacgagaatgatttcaccgagagcataaagcgtactgtcatctcaggtgctgtcgcaaccctagatatcgcaggtttcattagtatcgactaccgactttcccctcatccagagtttccccaggaagcagccaccgcaaagcatccagatcacttggaagatatctggtcagccttgaattatgcacaagaaaagtatggattgtcggagaattacatactggtcggtcactctgctggcgcaacccttgcaatgcaacttttgatgaagtgacgagattctcccatctcatccaaggaccttgctgcgccataatcggattcagctctacaactatcgatcacaaaaatcatggcgattctggttcatgatccattggcaaganatcg

SEQ ID NO: 1794 - DNA, 626 bp, Fusarium venenatum
  misc_feature (1)...(626): n = A,T,C or G
agctcaacgaatacagcggatgtcgatactggtcacaacttcaaaccactcacactaacaacaccgagcccttatgccaagacgagcccctctgtacaacgatcaactggttcagctacacccggggccagtggctcaagactgcctattatacgcagccctgacgctcgcgccacttcagcgtcgccccgagttgaaacacccaccaggcgcacccactcgagcctgtcattccgagaaaggcttgcttcccatggttcaaatagccagcctttgccaaagccgcgtctggcatctcatttgtcaacaactgctctttctggtagacgatcatctctacaggcttctaggtccattggagatgacggcgagaacccacatagcagacctgccagctctcttgctaccgngtcgaggaggatcaagtcttntccccacccaaatcggacacgggacgagcgagtccgctgcctagcgggtgcgcgactgcatgcgcaaaccttttcagccgagccaaangatacaaagncaagggggnggactgnaaacccccgtatggncatatatggnataacaatatttcactttttgaaaaaggtgagccttattnttactggtttatgaaa

SEQ ID NO: 1795 - DNA, 572 bp, Fusarium venenatum
  misc_feature (1)...(572): n = A,T,C or G
cctgaatctcggcngaaaaacagaccctcaaatcgttggtacgtcaataggttaattcaaagataacaccgagtggatataagtagctggtgtctaggaatagtggcgagccaagtcggcaaaaccccaatgtcaagcgatctcggcaaaaacccaatagctgccgagattgaacaaataacgataggccataaataaagccattcataccattacccccacctatcatcaacttcgccttctcaactatcttcacaattcgacaaccatcacaatgtcctccttcgccgtcgtaaaagacatcgaccacctcgtcctaacctgccacgacatccaagtcactataacatggtacacgaagtacctaggcatgaaatccgaaacctttggtccgaatcagctcctcgtcatgctctcaagtttggcacacacaagatcaatcttcaccagcgcggtaaagaattcgaaccaaangctagaacngntttgcctgggactgntgatttgtgctttattcttgaaganggaacggatctgcaaggactgatcacggaatttgagaaggangggat

SEQ ID NO: 1796 - DNA, 359 bp, Fusarium venenatum
  misc_feature (1)...(359): n = A,T,C or G
ccgagacggacgtcctcgagcttacacaggcgactcaaccagnagcagtgactccgactctggtgatgaccgacnccgaagtgacgatcgccgccgacgtagggatgaggatctcgcctatggcaagtcacagtatgacaaccaatcaagccatggaggctccanccatcacggnggttcntatggtggccaacagggttatggtggccagggatacggaggacagggtggatatgggggccgatactaattnttttgcatgttgagtatatgatataggaagatataatgaggtatgaatacacagacgagacaataggcacgtcggagtggaaatgaaaatatgaatgtttnnttat

SEQ ID NO: 1797 - DNA, 834 bp, Fusarium venenatum
  misc_feature (1)...(834): n = A,T,C or G
ctctgttcggtgcactgcgctccgctttgaccacgatgcgaccttcaacctctggctttcttttggacggcgggttgcatctaagcagtgattcttctttttgaggacacttccatccatatgggcaaacgaaagggtatgggaataaagcagagcagaaccaaatcgacactcgtctttgttgatggcgaaggcttcttcttccacccgcccgtctcaggtaatggtaatgttcaagaacaaagcaatgcgaatcaatcaaaacaacgacataacgaaaccgcgcctctcttacctgtcgcaactcctccagcacagactcttcaacgccgctctcttcaaaatcaactcgtgagctgttgacaacctcgtcaatgatggccttatagacgctgccgactgcctggttcgacatgattacgtctgttgtccgaaacgatcggtcgattcgacttgaaggttatcaaaatgttggtctcgtatcttggctttgatgggtttgcgcccgtcaagcaaatactgccgttatcgtccttgttctaggcacgctggtggccttgaagtcgatgggggcaagatgcaaatagtcaatgcggcgcgaacgggagcactcctttcagaanaatagttcaaagctttttcaaatcgcaaaggtgagttttatgggtgatgaccggacttggcgtaaggaanctagatgtaagtaatctagtacttgcgctgcgtctatctgcggaagcgacnaaaatcggccaaggatcaaaataacaaatcaatttttncttacaaaacaaaaaagaatggaacnattaggttgccgttaaaaaaaaaaat

SEQ ID NO: 1798 - DNA, 539 bp, Fusarium venenatum
  misc_feature (1)...(539): n = A,T,C or G
caaatacccaactttctcaatcatgggtcgcgaactccaaaagaagaagccagatcaggccgccagcccgttagacagctcaacagatccaagaaagattcttaacccccgaggcaacgatgctattgctaagagctggaacaagaaggagactctctcacagaactaccgtcggctcggtcttgtagctcgtctcaaggcccccgctggcggaacagagaagaactcagcgcaaccacaaccagcgcctacgccaacgaccccttcgccatcgccacgatcgaaaacgccgtcgtttccgaagcgcgcgtggagcgtgacgccgacggcaagatcattcgcatcatcggatccgccaagcccaaccctctcaacgatcctctcaacgaccttgacgaaggtagcgacgccgaagacaacctgctgaagaatggggcggtatcgcggacaatgccgacnaagaaganatgacagacttgtcaagcagctcctcgagcaggccaagcacctgatctgccaagaaaaacacagantgctcc

SEQ ID NO: 1799 - DNA, 289 bp, Fusarium venenatum
tagatgatagaagtcgataatcatgttaattaatgtatacaagatatctataaatgcaacaacgccttttatcatctatcccacattaggccataatcttagtttgatcggcaagtgaagggagcatgagcggagcccgtgctggtgatatcaatgatatccttaatagtagcataagtaccggcaccaagggtaacaataccgatgatgaatgcaaggatggctcccaagctcatgagtaagttcttcttctcaaaccacttaccctcgcaaagcaagacgaaccaca

SEQ ID NO: 1800 - DNA, 524 bp, Fusarium venenatum
  misc_feature (1)...(524): n = A,T,C or G
cctgagatcaacacccttctgttcgactgcgacaataccctcgtcctctctgaggagctcgccttcgangcttgcgctggtctcattaacgagatctgcgagtctcgccaggttgacatgcgattcactggcgagactctcatcaaggagttcgtcggccaaaacttccgtggcatgctcaccaccctccaaaagagttncaacatcgacatctcccccgaggacctcgagacctacgtccgaaaggaggaagangccgtcatcgccaagctcaaggaggccctcaagccttgcgttggtgttgatgagcagctcgagaacttgctgcttccggaaagtacacaatgtccgttgtgtcttcctcagctcttcgacgaattcgtgcttccatcgaaaangttgggcnggacaagtacttccctggcgacgttgtcttctctgctgccacaantctcgagaacctaccancaagcctgacccgccnttttnctccccgctctanacaagctccgcnanaaaggcga

SEQ ID NO: 1801 - DNA, 782 bp, Fusarium venenatum
  misc_feature (1)...(782): n = A,T,C or G
gaatcaactgcgccatgcccaaacgaaataaggattcagcnggggttccctagcttacacattcccgncggactcacgaatgcgagctattcaaaatacgttttacccaaatttattntttttcttcacagcctcagtgaatcattccttgagaaaatatttctacgtccagttcgcgattcaaaatgtcacagccagcaacttcctcgacacctgtgaatggcgacaccatcgcgcctccttcatacacagctaagcctagcgctgaaccgcctacggacgagaagattgccattgaacagcgacacgttaacgacgataacctacccgaagtcgtggtcgagccagcgcatcaatatcccccttcgcaaacaagcccgcagacgagtcccccaccacccgtatcgactgtttcgcctgtacccacgaacgcgatgtcttgggacggaacacaatcgccttcaatcttgcagcatcctagtcttgcgcaacagcaatatgcaggacaagagggcatgtctattcagatgcaaccgcaaccttccatgcagcgaagcggtcncacagttacgcctttacatttactagccgnccaagctgattccgtcgactgcccgttctgtcagcaccagaccgagacaaaaggtcaagaagtcagcgtttggaatggaacacgtttacgccggcgcgctnttttttcggaaccttttttnggggtggttggccttacattttggcattgngcatttaaacatnaancactactgggaggaactgnggnc

SEQ ID NO: 1802 - DNA, 451 bp, Fusarium venenatum
  misc_feature (1)...(451): n = A,T,C or G
tcaaggttgaccgcggcccagacggtgcaggactcttgatgaagtacttccagcgcggaggaggttactacatcgatgtcggcgcatcgcagctcattgccgacggcaagatcaaggtgaagcacggacaggaaattgagactgttctccccaatggtcttcgatttgctgatggcacagagctcgaggctgatgagattgtattcgccacgggataccaaaacatgcgaacgcagtcgaggaccatgtttggcgatgctgttgccnacaaggtcaacgatgtctggggtttcaacgaggagggtgagatganaactatctggcanaagagnggactacctggattctggttccatgggggcaacttggctatgtgccgtattactctaactatggctttgcaaataagggattggaannggattgttncttatacattttgaagtctacc

SEQ ID NO: 1803 - DNA, 581 bp, Fusarium venenatum
cgcagcagagctggagggatgaaatgacaaagacgacaaaggacgcaacagttcaagtcgaagaagcaactagttatgcgcagctgatggagggccgctacaacgccatttcctcccactggcaagaccaaggcgaggaagttaaaagagcggttaccaagatgaaatcagaaatagatcacctcaacgcagaacgacgagcagacgacgacaaaatagaaacattaagagatctatgcgaccagcaagacggcaacatcaagcagctacggcatgaaaaagaggagatcgctcgcaaattcgaagaatataagaaaacgcaagagcaagacctcaaggacatcaagaccaacgccagattgagagaagacgagcaagaagccctactactagcgtccaaagaaacactcgataagcttaaatgggcactcaacgttaagaagaacgttaaaggcgcacaataagttacctctccacacctttcaccggcaaatggtgtctgcaactcatctcagtaacctttgccacaagaagtgttatccaaccatatctataattctacctcatctctcgactggctg

SEQ ID NO: 1804 - DNA, 652 bp, Fusarium venenatum
  misc_feature (1)...(652): n = A,T,C or G
ctcaaaacctcatcatccccagctctgcctttctccctttagagcctttttcatagaaaccatcgcaaatctaaacaccgatactcaacatggcttacaaccgtccctacgacgaggatgccctccctagattcgctgagcctgagcagaagccaggacagtccaggactcctgccccgcagccacaccaccctcctcctcagcagcagcagtatcagcatcatccccctcctcagcagtatcaccagcaacaaccccgatacgacaagcctctaccaacccaaagagatgcgcgatctcattcactaggccagggtccagcttctcacggttatatgtccccacctccaaacactggcggcgcgagacccaggctcataaccgtcctgctcccaactcacgactcctccttcgcctgctctcgatggcaatggctccgatcccacgctcctacctctatttcgggctgttgacaagatggatggtcatcttctgagaagaatatccgccgcgctggtcaacgtgacggacgctttgatcccatacgtcgcagatatcgaagttgatctgatcgatggcctatcggttcaagaattgcgtnatgtcttttggctcntgaaantctcacgatcaccnacgtagcgaactctan

SEQ ID NO: 1805 - DNA, 512 bp, Fusarium venenatum
  misc_feature (1)...(512): n = A,T,C or G
ttcgcctgttttagcagctgtcgctcgttatttatcgttgctaacatgcgtttcgctcttttatgttcaatcgcccttggggctaacactgccattgcgagtgtttgtaaacctcgtcagtcgagtgataccagtgttgtgtccgtagaaggttacaacctcgactgctgctgtgcccagttctcctacaagtacagagcttgagacnactggtgatacaacctcagctacaaccatcgcgacttcaggtgtcgaagtcaccactaccaccactgagtttcccacgaagtgtcgcgacgtcaatttccgaacacgaaaccaccaccgaaacaacaaccctcgccgaaatgactacaaccgccgctcaatccctagaaacattccaagtcatcgctccaggccacaacttccaagatgaacacctaatcggtcgaaaatccacctcccaacgaatgggtttcgatctcgaaccagcgccaacctcccaaccctcacattctccatcgaggcaa

SEQ ID NO: 1806 - DNA, 611 bp, Fusarium venenatum
  misc_feature (1)...(611): n = A,T,C or G
gtctcaaactgcacctcagaaccagatgacccagcatgctgcgcagcacgcgcacgctggaatgacaggcagccctcgaccgaagattgagcctcaagtgcctctccaactccagaagccacagtcctctcccatgcaacaagctcatcaccctcaaaatggtgggcaacttcagagcccaggaaacaccacacctggtgtgaacccaagcgcagctcctggacccatccctgccacgacccctcttgtggttcgacaggatggcaacggtgtccagtggatcgctttcgagtattctagggatcgagtgaagatggagtacaccattcgctgcgacgtcgagtcagtcaacattgacgagctgtcccccgagttcaagcaggagaattgtgtctacccccgcgcatgttgccctaaggaccagtaccgcggcaaccgctgatgtacgaaaccgactgcaacccgtgttggttgggctctggccgagctcaacatcccccttcgaggcaagcgangcctcatccagcgagccgtggacagctggcgcaacaagcaaccaggaccctngactncgtagtcgacgaagtccgtcgcatggcaaagatgaaccn

SEQ ID NO: 1807 - DNA, 617 bp, Fusarium venenatum
  misc_feature (1)...(617): n = A,T,C or G
tgacgttagcacgtctatggaacccataaagtccagagttccttctggcttgtccgaggccgacactatcgtgcccggatggcacaagagagatagttcatcagaaagtgaacccgagagccccccatcatttcttcccatccaagaggtcgacgagacctttgaggaagaaaatgatacctttgatggagctagggacgtcatgcccggcacgcctaaagcacccatacagagcatcgagcaggacctgatctccccaacagacttgacccgtacccctgagacccctgatttcaactacagcttctcgcacgactatgatcgggaaatttcccctgaactaccacctcttcgcctctacctctgccccgaccaagaatggatccagctcgacagcttgccgtccgttcatcaagcatgaactttgcagccttgtctagcgacccttctgaggtatncggctcttcagatctggctagaactcgaatncgcgagggccgagtctttcaagcaaggcccgccaggtnttcacccacggacttnanggttggnaccccnttggnaggcctttcttggggaccggaccgtactggtgatgaccttggatatgtcancca

SEQ ID NO: 1808 - DNA, 226 bp, Fusarium venenatum
  misc_feature (1)...(226): n = A,T,C or G
ntgacagtgttcctgtttataccncccttgcnactcatgtanctgcgtccancaagcctactgaagttgctgtcaancctaaagcngtgtccnaggtccangccgtttccaaaaccaagtntnaaaccaagtccaagtctaagcccagggccaaatctnagactgcanccaagtcccagnccaangctnttggtaatggcgcgtctgtntctggttcatccacctt

SEQ ID NO: 1809 - DNA, 459 bp, Fusarium venenatum
  misc_feature (1)...(459): n = A,T,C or G
cgactcaataccgtatcagttttcggcatctacagacaataccaatcatctcaattactccatttcacaatggcatccgagtttggaagctctcccaagagagagcctacaccaactctcccgttatcctccatccctnanaagcgctctctnnaagagggtcgtcacagtccgatcgngccctcgccattgaaccccgaagtcaaaccttacgactctctggcccccgaagatgcctcgcaaacctcgcgatcaaagtcagtgcgcaccaanaaagaaacattgaagaaacgcgaatccaanggtgccgacagngttcgtgcgactccagacccaaaaccgaaaacaacgaagcagcaaaaagaaacaaaacgagtcgagtccattccgntataagctngcnctccaaattggntgatttngatccccctnggggccttgtatgaccncccntattga

SEQ ID NO: 1810 - DNA, 487 bp, Fusarium venenatum
  misc_feature (1)...(487): n = A,T,C or G
nggttnaaatcccanccancaaactggntanttccttcttgcatttgggctaaggcttgnncccgatcagngaacccgccttggaaacgtntgcgtncgtgagtgcatatctccactttgttctcctcgccagcaatgagtgctttcattccaacgtcccttcaaggcactgataaggctatcacttgatggctgcnactttccaaggttgatggcttcaaaaagagaacccgtcatagtcaatagccccaaagattccatcgatatggtcgtcgatctaggtgtaatcccggattgaggagcccgcttcaaaaagaaggattggcttgcttggtggatgagntggngacttgtggatcgcaaatcccggcgttggcgaaggccgaaaccgnganaacctcaaacancacagcgaatntgatcaaatgaaacctgtgtggccaacaatttacctgtgatttcatgcnacattngcgaaatggctttg

SEQ ID NO: 1811 - DNA, 827 bp, Fusarium venenatum
  misc_feature (1)...(827): n = A,T,C or G
cgagacagaaaaacctgctttacccaacgtcctctttatctatcgcgcaaagcgcaacttgccccagtcttgcctgttgactcatcacagtcgcagcgcgcattgttcacccactcgcctctcgaatctgctttctttcgcaccctcctgcccatcgtgctggcttaggagcgccttttgtcctcggtcatcgtttgcttcttcgtaatcggtacctctccgaacacatatatccgccgagcgacactgctgtttatgtatcagcacgaccagcactccgtcttcagacacctctttaagctgcagttatttcgcataccgngaaagccttgtagccccgacatcaattccgacggttgaaacttagcaacactatagttgtctatgcattaccatcagcatccgatcatcattccggcctgccacatgacaatcaaaaatcatcaagagcactgaaaccctcgttgctccgcccatcctcaactaccttgtgctatcaagttcatacatgacatcctcgtcatctcacgaccataccaattactagcctcgcctacctgctttgccttaccacctttacttactacccaagtaactattcaataccgtcatcatggctctcgtcaacgttcgccgcgatgttagcgatgctttctatcgtacaagatggagcgttgcagaccaanatcgaaggcaaggaaacggtatcaagaccgcgttgcaacttannaagcgttgcagccttacttgcccgtcccggtcctacgtantnaagtcttttggtttnaacttggngccaaaccaacattntccaangangacgttng

SEQ ID NO: 1812 - DNA, 607 bp, Fusarium venenatum
  misc_feature (1)...(607): n = A,T,C or G
gtgcttgacatcggtaccggcactggaatttgggctatggattttggcgacnagttccctgaggccgaagttatcggaacagatatctcccctatccagccgagctgggttcccccaaatgtcaagttcgagatcgaagacttcacccttgactggacattcccccaaaactcggccgacttcatccacatgcgcttcctctacggtagcgtccccgactggtacgccctgtacgagcgcgcattccaagcgaccaagcccggcggttgggtcgagtcccacgaaggtgaccccatgggtcttagcgacnacaatagtgtcaagcctggcagtgccattgccgaatggggcaagttctttcacaagggtggtaagaactcggtcgtgtcttcacgcctctccctgataacctgcaagaaaaaggcatgaaggccgctggtttcgtanacttcaaaacaagaacaataaggtcctgtgggaaactggccaaggaagaancctcaaggaaattggccgaattacacactgancatctatctgatgttgaaggacacattgctttcatggtaccctcttgaaggcggacaaaaaacagtttgctctactg

SEQ ID NO: 1813 - DNA, 583 bp, Fusarium venenatum
  misc_feature (1)...(583): n = A,T,C or G
gcatcttgtcgagggctactcccaaggtactgttgccacccgaagaacttgctggtctggacaattcagactcctgagcaccttgagtggattcgcccctggatgaccgagattctcggcatggacaagagaagagacgttcttcgaattatgctcttcgtcagtcagcctcgatcaacaaaggagattcacagtccttcatccacggttcaaatgttcccaggacgtcccaacatcaacactctcttgggtatggagcaagancaacaggtcggcgccatggctgtaaccgtgtgcggccctggtgcgttaagtgatgaagttcgactggccgtgcgaaaccgtcaagatcgatctcacatcgacttcattgaagaagcgttcacctggtaagctgctttgattggtggaancctggtgtttggaattttggcacttgctggccanacanctcacaatcccgtccctggganacaaaaatanaaatatctctctgctctcgacctttatctgananatctaccgtccaaatatcccgtcctcttgggccacttgctaggcagacncatttgaaaaaattcag

SEQ ID NO: 1814 - DNA, 626 bp, Fusarium venenatum
  misc_feature (1)...(626): n = A,T,C or G
cggtatcctcctgcaagcaatcttcagccaaatgactggtcaacccctctatctcaaccactgcccagtccacaaccagcagcaagtccccacccggcaaagagggttgccttgtcgcctaccatgggcaggcccccgataccagcctggtccagcgattcaaacagctctgccaaagcagcaaatatacataacaaaaactcgattccacgacagaatccatctttaccaattaacttatcgctgtccgaggacgagagaagtcccaatcgctccagtgccgagctgcatagtcccaactctggcaagggctatagcacatcgggggcgaaccgcgaaaacagtcctgcggatgagggcgccgatcccttgtacgaatactttcactgactgtggatgattggatgccgcctgtggatgctgtgtatcgaccacacgtgggtcatacacgatcatgccacctgagatgaaaggacaacaagctnaagagcaanggcaaacggactttgcgtcagantgattgatataatataagtgcattggtattgatgaattatgaattgntggnaaagtatcggttcccggtctatatactttttggacttaggnttttgggagaagtttgg

SEQ ID NO: 1815 - DNA, 526 bp, Fusarium venenatum
  misc_feature (1)...(526): n = A,T,C or G
nttaaaatccancntggcccgantcaaagcccatatatgaccatcgcaagaccctaaaagagggcaatcctgaagataagatcagagcatggcttcaactcacgatcaacgagagcggtcattctaaacaaggagattggatgaacactctcgttcctcaccttgaactcgtctccagcaacgctgagggccctcacccatcttgtgtattctcctatacagttcagcccgacaattgcaaccggttacaaaaccttcatggtggctgcgcggctacgctctttgactggtgcacaacgttacctatcgctttggtgaacaagcctggctttggcagcatttaggtgtaagccgaacacttaatgttacctacatgcgacctgttcccgttgggactgaggtgctcattgagtgctctatcactcanattggtcggaaactggcgactcttgcatggatcaatgaggagaaaaagcgacaacttactgctagcgacagntgagcattggcaagggcaacattgatg

SEQ ID NO: 1816 - DNA, 487 bp, Fusarium venenatum
  misc_feature (1)...(487): n = A,T,C or G
ggaatttttttttttttttttttttttcacatactcaatatcaagttgccattcttatgacctataggttcgttgccatgggatatcggccanagggttgcgaggaacccagctgggaagatattcaccccatccccagtagttacctgctcccgcaggatggtcggcacacatgcggatttgactaacatcaacaccctcaggaaggtctttagggttccatgtcataggcccaanacgaccgcacagtttttcagcaccggggtgttggtcggcaatgaccatggcggtcataacagcagcgaaaacagcctggattttcatattgatttattgtgaggtttggtggtggctgcagataaacctgcagcggataaacgcatctttatcactgccgggtactacagtaaccaagatttgtatagagtcctatacgagaacttcccagatttgcgaaacaggctgccggatgaggccaataaaggan

SEQ ID NO: 1817 - DNA, 324 bp, Fusarium venenatum
  misc_feature (1)...(324): n = A,T,C or G
cttttgcatacccaagctgcggcccgcatcgcccacctcgacgaactatacaaaatggattccgtggaagacgtgaaatacgaaacctggagtaggaagaggctggatcggcttttagcagattacctccttcgccatgggtacaacgaaactgcaaaggagttgggcggaccagcgcggcattagagatcttgttgcgtcgacacctttgttgntgntagccgattcganattcctnatgaagganagtgttnttgaacttttggcttggtgcacaaanaaaaaaaaaggagnttccagganggcagaaacttgngttnttgt

SEQ ID NO: 1818 - DNA, 1097 bp, Fusarium venenatum
  misc_feature (1)...(1097): n = A,T,C or G
ccaagatgaaagatctgacatcaactttaattcacatcaactatggctatactcagtactactccgcccgacaagtcaagccctctcctccccccatccccgccggcaacagcagaatgccctgtgaaggaaatcgacatcgacatcgttgacggcgacgatagtgaccacccactccccgaccctcttcaacgacacaaaattctgtctgagacgcgtgacgttccggaattcgcatacttcactctcgaccagaaacagtaccgcaaactctatacaaagatcgagcaaaccttcagaagattcgactacgaacctaagcgcagccgtctcacgattcgcatgccttcaccaactcatgactacttcgccacctatttcagagacgagatctgtaaagaattgaacaagattgccagcaaccgtagtgacgaggcaaaaccctttgccgaaaaagtcataagcgccctaggttcccgcgtcttccttgcagagacggatgacgagaacggcccgattaagcgtgaaccagatattcagttccattaccctggggcaaggtatcctggaatagtagtngaggtatcgtattcttaggatggtaaagatctgaggagacttgcgcaagactacattctttactcgaacggcgacatcaagcttgtgattggtgtcgatctcaactaccgtggcaagccatccacagtatctctctggcgtcccaagtttaccaagtccgaanatggcctcgacttggaaacgtttgaggacgtccacgagctgccgttccgctcatccgatggcgacgccttgaatcccgaccagtcgctaacgattgacatccgcgactttgctacagatgaactatccgagacttggcccgccgccacgatcaacatcctgttgtcccgacttgcccaatacgcccaagaccccagcagcggcagaangacaggaaccaccgcccagacgacagcgtcnaatcaangcgacggctaataaggaancgcanatggtcgtccagttccgccgaaaaactgaaatccaagacaagcaatntcttagaagaagantctgttgcncgaaattcccccttt

SEQ ID NO: 1819 - DNA, 501 bp, Fusarium venenatum
  misc_feature (1)...(501): n = A,T,C or G
actcaactcaactcttcacttacaccaaacccatcttcaaaatgcccgagtccaccactatccagacccctgccgccctcggcgataacagaggcatcaagttctccttcaagactggtaatgcccgctaccagtgtgttctccaggaccgatctgtctatgagcgcaccaaggcttcccgccagaactcttccgactctgtttcctcaaccgagtctactaagaccgagaagtcttcccactaaacttaagctgggaggttacgggatcatggcaccttgaccaacatcaaccctcaatcaagcttgtctgtaacaaggcttcgaagggaacaatggtgaccaatgcaaacaaaactggggagggagtttattttataccacaattatctggcattagcgacggttttacagagacatttggcgtctccatgaatcaaaacaatatttttntatcgttaaaaaaaaaaaaaaaaaattcctgcggcccgaattcttccag

SEQ ID NO: 1820 - DNA, 308 bp, Fusarium venenatum
  misc_feature (1)...(308): n = A,T,C or G
ggcaaggtcggcaaggagcgtgctgctcaggaggagcgcagggagaagcagaacaagcgaaaggaggagaagatcaaggagcgcgaggccgactttgttccaccagaggagagtcgtcccaagaagaagcgtaagaagacggaagagtaagcaaggggagcttccgacattgcatattgcatgggtgggcaactggtgtgagttgcgtcaatctcatgtgcaagctctcgaggtgtntgataccctgaaaaattacctggcgttcttgtttctatttgaggattaatagctgagaaaaactgttttcg

SEQ ID NO: 1821 - DNA, 173 bp, Fusarium venenatum
  misc_feature (1)...(173): n = A,T,C or G
ntgntcgactangacgncctccgggcanaagagaagaagnttgccgagaaacncgacaaggacggnaccgagctnncacgtaccggaaaggagatggagatggcnaaggttgctnacgagcaagntgaacgagcagataagcaccgaactggcccaacttatcgaacttgggg

SEQ ID NO: 1822 - DNA, 479 bp, Fusarium venenatum
  misc_feature (1)...(479): n = A,T,C or G
aagatggcgataaccatgcattgtgccgatgcggtgctgaattttgcgtcgtttgtggagagaaacccaaaagatgcgaatgcccatggttcgacgctgacgtccccgactctgatcacgaagagaaagcgattacacgaagggaaagaagcgaaatccaagtctttcgtgaaggcagcactacagaggaatctcgaggtccccgaagaccacgaggaaaacagccacgacctcagatctacgacgaagaagtcatgttacgtcaaaaggaggaccgcgaagatgaactggttcgcaggcctcgctactatgccaaagacgacgagtatgatgtcgctggtgctccagagcctccctcatcccattatatggaagatagtcccaagcgtttanggcgcagagtagttggcggcgtccctccttctccaaatcaggcaganttcgaaagaagttctcgtgtcngcagaagaagctactac

SEQ ID NO: 1823 - DNA, 568 bp, Fusarium venenatum
  misc_feature (1)...(568): n = A,T,C or G
ccatggtgcacgccaaagcgcaaaaccttctccctgccatttacaagggtcgcctgactgatggtagagaagttgattccggtgacatgatgactgtgagtggctactcggacatggttgtgctcgatcctatgcagggcggaaaaccaggcaagcttgccaacaatgttcctggattcgagtttgtgaacgacactcagatggactttgagtactacaagaatcgagccgagtttgcagagaaccacggtggaggtgaaatttacggtcgcccgggaganatcggccgtcctggcaccccaggatctttggatggcagcgatttctcacgtcccggcactcctgttggtggcggtcgttctgcctctcctgctgcatttgctggcggancagcccagcagcaacgattgatgtctcttgccagcaacgttagcggtgacacaagttnctcgtcttaccgaccaggtgccaataccggcttcctcacanangactttgggtcagaaccccctgctcgaggtcgtacccgttgtttgccanaacaatggaagctcctccagtcttggac

SEQ ID NO: 1824 - DNA, 537 bp, Fusarium venenatum
  misc_feature (1)...(537): n = A,T,C or G
cttctttcccctgttaccggcaaacaccaacttgacgcgggtctgagctaaaacctcgccggccatttctttatcatcagccccgtggagctgtagcatgtntttggtgccaacacagcaacatcatacttttgttgacaaccgcgcatcgctacacactgtttccaacatcgcgaaacttggatccgaggcgactctagacacgctcctcagctctcccaactctatggaacgaagtgctccggagtactcgcagtcaggtttgcttcgccctatccaagcaacttcggcgacaccaattctgaaggttcgagggcagatcacgcatctgctgcgcaatatcctgtcaagcaggaagtcaactactcgacatcggctactcccacctncgagtacggggtttaccctcatactgccgatcangatctttccaaaacacgtncagngttataccatcctgaaacagcgccagagtggaagtntgggcaacaacaaaacagtccgtaatgcccaacangatgggggagccatnaaacc

SEQ ID NO: 1825 - DNA, 623 bp, Fusarium venenatum
  misc_feature (1)...(623): n = A,T,C or G
gaacagcagcgattgtcagtatatcgacttcactcggcgagctagtatctatctgccaagatgagccgaagtaactacagttacgacgacgaggatgactacgatgttcgctaccanaaacgtggaccatctccgtctccggcggggggcgttcgttatgtcgcaagtcctcaacgtccccaaaactatttcaacgcacctncgggacccagctacctnggagctgatcgcctcaatataacaagcatacaccgatctaattctcgctcccgttcccgggactactcccgaacacgggaacgccgtgcaagcagcccgccagctccagctcctgtgatcatcaccaacaaaatctataatgatttgtcttctgatgatgaggatgatcgtcgcaagaagcaagtatcacgatcgtntcgccggcgacgctctcgctcatcatcgtcatcgcatcgcatcatcatccgttctcgtctcggctcgncatntgcatatatgactcgaaaacatgggaagctgaaaaagctcgcaaggagctcgangacttgcnaatttgttacagcgcgtgaaaaaggatgaaccggaaattagttaaaccatttccgtgatgagnggganggcca

SEQ ID NO: 1826 - DNA, 359 bp, Fusarium venenatum
cagggaaaccagtgttacctggctcggcatcacccgcgagcgccctatcgagcgatgccccgagtgcggcagcgtctacaagatggactacgtcggtcctgaggacgatcaccaccaccaccaccctcctgagtttgaggagcccaagacttttgccgattacatcaagcctgagtaccgatacaaataaatgcattgcgccgagagacattgaggagattgggctgcagtatcaagtgaaaactagacgggtgtgatgctgcccggggggagaggatccgttttgtgtagattagggtgccttggtccctgtgtcaatttactaagttagcttgcagaagttgatgttgaaaaaaaaa

SEQ ID NO: 1827 - DNA, 586 bp, Fusarium venenatum
  misc_feature (1)...(586): n = A,T,C or G
cgacgacctcaaattcttgccctatagaaagggtctgctaaacaatcaccgtccaaatcctactctacttctaccgattgtcgaccatttaccctctgcctaattcatttancttgcgcngcgtttgggtcgacggggaaaattgtctcgtgatttccaggggttccacagcacataccttttgaagctcgcgacgaatctacctataccaacgtcttaacctcatatatattaatagcatcgcngacttgtccgcaaccaattgcaaacatgtctgctgctgtgcgcngtactgancataccaagtctgaccaagaactcgccatcnacatcnagaaagctacaaacgccgaanaaatttcccnaacgcaagcatgttcgcgcatgcattgtctacacatgggacacangtctctgccgccttctggtccngcatcaaggtcaaccgatctcccccacaaattcaaanatcaagntctcctttcaatcccaagggctccaaaaagtcaccncacccccncaaggaaacatgggaaaccccccggatntatactttaacccggcttgggcggggaggtaaaggatc

SEQ ID NO: 1828 - DNA, 786 bp, Fusarium venenatum
  misc_feature (1)...(786): n = A,T,C or G
ggaggcgcggactggaccgagaggatcggggaatgctgcgactctcaacaccgtcaccacctanaattctgtcctgttcctccggaaaacaactgggtttcggaaaggggccgggcttcattttcggcctcggggcgaacancgttactgatctgttagcttatgtcatccacgaaagcctttctcacttacnctcgtgccttggcaagaatgtcgctgatgatcttctttgggccagcttcttgctggtgggggtcttgaacagccagtccagacttctcaccacccgcaaacagatttcctcgtccatcatcatcttcggggtcggaatcgtcatcgtcatcgtctccgtggtcatgctggtgggatgagctacccgatagatcctagagtagcaattcctgtctttctctgttgcgacggggcgctcttgcgggtcgcttggctgctaccacgggcagcttccggggcaggtcgaccatcgagggttcgaggaccagtgtagttgtctggaacgggagcgggagctgttgatgtgtcgcggctatcctcttcggcgtcgcggaaccaggcgttgctggcttcggcgagatcccagttatgggcctcgagatattgtctggcttcttcagggcttgcgccgctcaggcctgcgaattcgacgatctgaccttcatggtctgccatgttgatgttataaggcggggtaattggattgagtatgtgtagttgtttccgatgcgatatggaggttgaagatggtccgacgagattaaatgaattggc

SEQ ID NO: 1829 - DNA, 329 bp, Fusarium venenatum
  misc_feature (1)...(329): n = A,T,C or G
gccgagcagatttctgaacccggtctgttggtaccaacttcgagcgtnggagtttagngaaatattcttcctcttaattttcactctcccatccgttccctaccaagatgccctcacaaccctcgaatgcgggtatcgtcaccgacnaaaacagcggcgatcgcgagattccacagtctgttcgcgcagatggcagtnctcgcagagctatcanaattcgtcctggctatcgnccacccgaggatgtngaggtctacaagaaccgcaccgccgaagccttccgagagcgcggnaagaaaatcggcattcctggtgctgcaggtgtgaaa

SEQ ID NO: 1830 - DNA, 377 bp, Fusarium venenatum
  misc_feature (1)...(377): n = A,T,C or G
cttctctccgccacgtcaacgacgcaatccaaggttctcgcaggctcgggctttgctactttctctgttgatttagctcgcaatgtcacttggaaagcgtgagcaaagtacacttcagaaacaaagaanacactgaaaatagatggttcggggtctattcaaacttccggacgtgacagcctcgcactcacaactgagatggccaaattccaagaagactatattgacttggtacctcacaactggaatgtgatctctgtctccttaagcgataaccatcacaattgtgcattaccaattccaagcngggcatantcctttcattctccactccactcgancgtnccaattcccganatgccgactcgganatctcc

SEQ ID NO: 1831 - DNA, 530 bp, Fusarium venenatum
  misc_feature (1)...(530): n = A,T,C or G
ctttattgaccccgatttcaagtatcatggtgccatgggacaggtaatcgctcttctcattcttgacatggcagatcgacccattatgccttttgacatggggtggtatgcgcaaagattggttcaatgggtgaaagacctcgaaaaatgggctatcaagcacttggagggccaacccaaaggtgagacagacgcttttaaggagctcaaggaagctgtacagctcatccagcacaacgtcgccacattcgaaaagtgggagatggactgggaccgcgatgtcttgggtaatggaggatgggaagccaccgacattggcgcgtctcgattagcatacaataacaagatggcatactttgagacngcgatgctggatcttgaaatcggtggtggaatccccaaccgcacacaattcaagagcatngtctttggccagaaacgtggtccaacnacngagctatctttccttcaatccgtgcagcatagaagagggggattggaanaccgccaaacccatcgttgccaaacgg

SEQ ID NO: 1832 - DNA, 454 bp, Fusarium venenatum
ctcattttgtctacacgctgacccacctcaaaccttctcctgtcaatacccaagcaacctccaaaatggcctgcggatcctccaagtgcgtctacgaccgtaacggtcctggcagcgccgccacttcaatcgccgaatccatcatcaagccctccgaggccacaggcaccaagaccaaatgcatcgaatgtggtgactacgaatgctgctgcatcccctgcactatcttgtaaagaagcatggctttatttttcacaacggaatgacaattatggagttcgtacgaagaagtgctgccatttctggtagcacgttctagaagggacaatgaaggatggactacaatgtttaaggaagcgctcgtcgacgttttgatataacctatgaatcaaatgcaataacaaaaaataaacaaaaaaagattcaataaagctatatggtactattattaggc

SEQ ID NO: 1833 - DNA, 525 bp, Fusarium venenatum
gaggagctatcaggtctcaaggctgccgctgaggctattgaggctcagacacactctgctaccaagcctacagagccaattcctgcttcctctgaacagcctgttatctccgaggtagtcgttgaagctcaagtcgaggctcagcctaccgagtcatcacctgactcaaggttggcgagcattgaagagcagctatcaaacctgaaggctgtagctgaggccatcgaggctgaggcgcaacctgctaccaagcctgcagagccaattcctgcttcgcccaaagagcctatcgtctcccatgtagttgttgaggctcaggttgaagcccaggctgaagctcaggtcgaagctcaagtcgaaagccagattgagactcagcctgctgagccaacaagcgactcgagattgacaagcattgaggagcagttgtcgggattaaaggatgcagcggaagctattgaagccggcatcagaagcggcaagcaataggaaagctgtgtacaatattgaagctatataatagcc

SEQ ID NO: 1834 - DNA, 489 bp, Fusarium venenatum
  misc_feature (1)...(489): n = A,T,C or G
tcagtcttcgtcactccttgctccagagatacactcattcacatccttganggattcaacacattcattccaatccttccaacggtcctttccctcaaaccaactcaaaatntttatttaacagtcctggcgacgttaaccaaaaagcttcaactccaacaactttaagctcaaacagacaagatgcatttntctgccttcctcgcttccgtcatggccaccagtgccatggcatctcctcactataaggncgtcaccgagtacgcctacgttaccaaggtcgttaccgncggcgccgagcagcccaagccaacctttntttacaanaagcctgctccggtcgaggtcaaacccacaactctccgctgggttaanaagcccanacagaccaatgtcaggctcccaagcccacctacntccccgcccctgttgaggacaaggagcctgcgaccgaacaacccgcgaccgacagcccganaangaggaccc

SEQ ID NO: 1835 - DNA, 589 bp, Fusarium venenatum
  misc_feature (1)...(589): n = A,T,C or G
tcgcaattcagaggtttctggcattcctccctacgaacaaactcgtcatactcgaatcctccaagaacagtggctgtttttagcttctacaccgatccgaactcttcgagttattgtcccatccgaagcggcccgtgatttcaacgtcccgccatcattcatatatcaacctcgaatgcagatttagtccttttcgctacctaatccaacgataccacgcgccaacgagaaactagtgttgacttaccacttagtcaagggttggaatctcatacctaccaccaccacaagcatggctgccgactcttccctcgtcgacctccatgatgcgtccatgtccgacgataaggacgacctcgactctctcccctccatatcaaccgacgacatttactccgatgtttccgactctgatgcacaagccgagtgggaacgtatctggagcagttgcnattgatattgactatgatgatcgtccctggatnggtaaatactttggtcgcaagtttgcctactggagttngtcgcganatatggagtgggngcacaacgtcaatgttcgattaacggataaaaaacatttaagggg

SEQ ID NO: 1836 - DNA, 583 bp, Fusarium venenatum
  misc_feature (1)...(583): n = A,T,C or G
aggaaatcaagctcaattgcccgaatcgaggtacgcctgaaaacttccaagatcactcgaaaacgaaacacctagcgaacacccacagaccgagccatcatgacaccaggcggcgagagccaaccgctgtccctgcgaccgcctcctgtcgccgatcgcaaacctcgaaacatcgccgaattcattgcgcgagttaacgcgcaaccgggtggctttcgagctctatcagaagctaaactcagggaggagattgctcaagagaatgcgacaaacggagactcccaagagaaagacgtngatatggacgaagccgacgaagacgacgacgaagaggatcnggatgcgaccagagatccccaagaagtgcgcatggagatgttcaagaaccttgacatcgcaggaaatacgggcctccttaccctcgacttcctctccctcctcatttcgaagcagaaccctacacaagccggcattaccctctcccaagggctacgcgacatggtggggaatcggtacgataggcgctgataagctcgacaactcgcccattaccctagcccaggngccagagcaggagaatata

SEQ ID NO: 1837 - DNA, 130 bp, Fusarium venenatum
  misc_feature (1)...(130): n = A,T,C or G
ncgaactttacagnggattggatgggaaaacttgacgtanccagnttaatcccctgcagnacatcccntttcccactggcgtaatacaaaaaaggcncggaccgatcgncctttcanatagagggccaaa

SEQ ID NO: 1838 - DNA, 596 bp, Fusarium venenatum
  misc_feature (1)...(596): n = A,T,C or G
ctggcaacaaggcccttggacgacttgtttcagtgtcccctcttctccttgcttcattctcttcttgaacccttgatatcctcctctcgtttccgacgtcatttacccttacagagacttatttctttcgaatttgtctttagttactctccactcatcaactccttgaactttgtctctgtgttactgtattctgtaacacagaccttgcttactctttcaccaccactgcaacgtcattgctcatcccgtcgaattcattgattggtctttttgaaccaaagagttgccctcagttgaccacagtcttgacactttttcgtcatgtaaactccccgtaccaagcgccaatttgctggtgcttcaaccgatccctctcagcagccaaatcacctatttcttcaatgctagaaccccagttgagtctgcggctgctgaagctcagaagcctctcaagccagttctcccctcaacagtccaggcaaacctnctcagcgtcggtatgcgagttcgcaagtccgttcccgaaggatataagacagtcngaactagtgctttcaagctctggacagacaatgctncagtaaacaccaccn

SEQ ID NO: 1839 - DNA, 589 bp, Fusarium venenatum
  misc_feature (1)...(589): n = A,T,C or G
tgtcgctgcagctcgatgatccttcgaccgcttggctatggctacaaaagggcaaagcaagagcgtttgctgactcactcggtgcaaatgtactcatccccgaagagttgctgaatagagtagcgaatgaccgggtcgcatgcgagcttcttaaganggaacagggagttctcgaaggcctgcaggatccccttatcaactttgttatttctgcacgaaagctggcctcgttgagaaaggaaatgacggagaatgcgcttctgtcagagatcacgaaaataagggacggaatattagatctcgaacttggcgacaagcagctcagtgattcactctctaaaaacggtctttcgtcggancgtgttaaatttgtcgattggtatatcccaccatcggccgatggcgccaaangccggatagtcctcttcgtcaggcacttagatggccatactcaggcgaaacggttgtctgtttcggcgcccgacgtcnaagactgggttagaaaggctttcacatatccngacatggncgcaccaccgctaagcaaaaagannggcaaccgttttctcaagaatatgaacggccttgt

SEQ ID NO: 1840 - DNA, 643 bp, Fusarium venenatum
  misc_feature (1)...(643): n = A,T,C or G
atcagaaatataccaggccaagacagtgtaactctgaccacgacaaagcaccaagagattttcacttttctccgtcccagctggccagcatatgaccctcaaggcaagcatgttattcatcctgagcatacccccgatctagatacaagcctcaaccgacgttggtcaacataccctgtctaccgtcccgagggccccaacactgttgctcgcctttccaacgttagacccagcgttctatacgtattcggcggtaagagtaatgtttcccccctggagcttcaggacgagaagatgactatcacgggaaccggggtaggtggtagcggcggtgaggcacagggtcgggtcaagaaggttgtcggagagaacaacggccacttggtccccatggaggatccccgcatgtgtgccagtgctgcggccgactggattaaagctgagcttgagcggtggtgggtaaatgagcgtacttcnaggaatggtcgagcaagtccaaggaggagaagacaaccgtcttaaacgagtttcaaaagtacataggtaaacctgnaccttggccagcaagggccaaacgcnaaaatataggccgatagacgtgccgnatgtggnaatgtcacattgaataaatggataacatttg

SEQ ID NO: 1841 - DNA, 167 bp, Fusarium venenatum
  misc_feature (1)...(167): n = A,T,C or G
ggctactcctgctgcaagaggagagtgttggagtttgaccaattcatgaagattgagggttgcaagaccaagaacaaacatttgttcgttggtagtggaaagaaggacgacgctagcagcgaggaaatggntttcaacgtcagacaccaatttttatcanacccccg

SEQ ID NO: 1842 - DNA, 665 bp, Fusarium venenatum
  misc_feature (1)...(665): n = A,T,C or G
caagaccggcggtgacaagtccaagggcgacactggctaccacggttccaagtctggctctgaggaggagtgctgtgttcagtgcaccactgtctacaatgcctgctgcgatgctttggtgccattatcgaganctgcaaggaggcttacaccgtctgcctcggttacaacccatgggaacgtcgttcccttcgtcgagcctactggtgtgccaagcaccggaaagctttccggcgatgaatgttgtcaattgtcttctggcggtgaaccgtgtccgccccgttctggctcttcattgccgtcggagcctttgctctcctctaaatgcatcgtgcctgaccgagtgcgcgcacacttttcgcttcgaagttctatttccactccgttgctattggggctcctgcgacttcacttcttaccttcttagtgggcagcctgttctgtgcagtggatatttaccttattatctttcatgatcttatgtattatgggtgcctttgtcgaatatgtcggcctaaaatagtttacgatagacacgtatgtaatatcgacgactggatggagattctctgattggcgatggctttgggctttggggaacgaagttgtattccatagtctttagactttgtgttcagaaggtcaatttacttctctatcatctt

SEQ ID NO: 1843 - DNA, 682 bp, Fusarium venenatum
  misc_feature (1)...(682): n = A,T,C or G
caatcatccacttaagcttcagcctcgatcatcatcaccgctacctcaatcaacttacaaacatctttgacaatctttgtccaacaccacccaacccaacacaatgtctgcccctacttccaccgcttctccccctcctacctctgaccttccctttgccaaccttccctcttcccctgctcctggtcgcaactccactactgctctgtccaagcctgcctacgcctccgactctgactctgacggtcaggctcgaggtggtcgccgcagcagaagcagcagttcgttgttcctcttcccacctctaccggcctctctcagccgctggtcaacttctcaagggtgccactgacgagaacggcaaccaaaagtccgccgctctacttgtcggtatcaagctcgaccttgaggccgaggtcacttgactgcccgagtcaanggagacatctgcattggactttactagacgacggcatgccttctgcttgactntaagtcacgtgctaggngatttaatcgcagaacatagccngngggcatgttatgatgatgaaaggatacctnangggcctgatttttggacnacttggcaaacaaattggggggttgaaaaaacggacgggattnttttaatntggatggnatatnaaacttggagctatganaaatatcctttgtacng

SEQ ID NO: 1844 - DNA, 989 bp, Fusarium venenatum
  misc_feature (1)...(989): n = A,T,C or G
gctatctttgctgttgctgtgattgcacggttttgcgttttacaactgtacttatggttgcgacaaatgcgcggcttggatcaacagaaccttcctgctagatctatcatctcgtctttctcacagcctcgacgactattccagtcgcggcctatctggacaatggatgagaaggacaccacaccaatggggcatcggggagatatcgatgtggaaagcggcctacaagtcatctctgcaaagaagaacttggtcatcaaccccaactggcaaagtgcagataatgccatgtccaaacacatcatatcgcgaccacctccggcaccacctttgacacctcctgagttgagcacggctgtttttacttttgaagaccgtccccgtccaggcgacgatagtttcatccgtcagccaaaccctgattacatgtcttcaactacagacgctatccttcctcctagctcaggaacagcctcagtcacccgtcggcgctcgtacaacaaaactcttcctatcggaatccctgtttctcattcatcacaggacatgtcagatgctgccgatcttgtcttgtcgcccagctcttacccatctgcgagtccgtttttaccaccggccccaccaaacgcaggaaccacggagatcggcgtccagggcgagatcattggtgttcttgataccgagggtgccagctggacaagacatacgcgtgtctatggaggcggagtctgccttgcttgtgtagcctcgggcgggaatcacggnggtggtttctacggagcaacagtccggccagaggaaatgcgatgacaggtttaacagtttcggaacgaccatggngtaccactgncagtttatgtctggctggatatgaatggcacttatggnccggcatanggatccatgtgtaaccaccgttaccacttgatattagaggnggatgngggccaacnacccgcncttntggggcaaaattttcttttgtnnta

SEQ ID NO: 1845 - DNA, 551 bp, Fusarium venenatum
  misc_feature (1)...(551): n = A,T,C or G
catcaatcgctatatcaacactcgtttaaacaactccaatctacttctctttcgacctctttctcaaacaaaccccaataaaccaaaccaaccttcaaaatgcacgcctccgctgccgtcctcgccttcgtcgctgttgcggctgctgcccanacccctgtggctcccgttgctactcccatcgctactcccggtgcccctaccaacggtactaagcccggtcacggctctggctccggttccggttccggctctggttccggctctgagccctccaacggcgccggtgcccttggcctcagcggtctcgctggtgccctcgcccggtttttcttgctctgtaaatgtctctcaatgagactttcgcagagttggtggatatgaggaccctgtaacagacaaccttgcagggttctggaggaatcgtgctggtgcgcgtttaactttcgatggagatagatcgggttttcgattgtcccgactaggatagaatagatcaatggagccgtgatcgcttcagctatattaatactaatcgcataccaccactc

SEQ ID NO: 1846 - DNA, 416 bp, Fusarium venenatum
  misc_feature (1)...(416): n = A,T,C or G
cggntccttcatcggacttttctgaggaaggtgtcttagacctttcagattcaccatcaggaaaggcacaaccttcattagagcaccagaagagtttctcggactctcctatgtcttttcactttccacgcaaaaacatgacgagcagtgctcccagctcttcctttggagacgacgagatccctcctctgatccctcccaaagcacgaggccgttctcgggcctatagctcaccggacgtggaaaaggtcaaggaacgggttgcgagtgccatgctcgaggtcgagaaactccagaaacaaatagacgaggntatttgagaggcagagctntatgtccaagccngncagcaacttcccactctgtgggtagaaacatgccgagtatgagttctantctggngacgaatctcattg

SEQ ID NO: 1847 - DNA, 521 bp, Fusarium venenatum
  misc_feature (1)...(521): n = A,T,C or G
ggatcatcagctcgtgcgagcccagtatccctggacatggtggtttcccggacgacatcctcgacgacacgaacctgaaaagattgctcctcaccagccgcgccatatttctgttgaacgagaacgtagacgtcggggtagtagtgtccgtcgcgcgtccacgagctcaaccagaagccccacgcccgcctttgaagangagcagggcgttcatngacgatccagcagcggttccgcctccaagggacgaaagaggctatctacaagttccaagccgaaacgaccaggtaacgattcacgctctgtcacacctgatttcccttcgcctttggctanggagagcagtgcgaaacgatacttctgaatcaggaccggaaggaggaaaaggtnttgaggaattcaccttctagatctactgttgggtcaaaggacnccgaaatagagaaatagtttaatatttagtgatggatagtattctagtgtactcatgggattcgacgtatcaaccgactgacgcaccc

SEQ ID NO: 1848 - DNA, 623 bp, Fusarium venenatum
  misc_feature (1)...(623): n = A,T,C or G
gtaaatcgcttatctcgcgagctatcacttcttcgagctgcccagaacgcctcggtcgtgtccaacacttcatccacctccgctgcaaactcatcccatgatgtagccgaacagtctctcctctcaggcgcaggcttttccatccccaccgctcgacaccaccgaacgtcatcgaccacgtctcagggcattgccagccagcagctgtcatcgtcctacgaagcacggatccacgctcctcgcccctcgcatgctacccctctctcgcggcaggatagtaccgcctcccgaaggagcctaacaaattctcccgggccgcaacacagcagcagcctcgacccgtccaattactttcaacaacagcgactcccgcctacgtcgatcccaccgagttccgttggtgcaacacccggaagtctcagcgagcaactgagtcccggacttatgccagctaccatgcgatacgaggagacagcattttacagaaacgagctcgagactggcaagaaggagaatgatgttttgaagcgaaagatcanggagttggagaagcangttcgncagcgaaagagctagcgatacaagtnggncaaggagtggatagtggcagtaccactacgagg

SEQ ID NO: 1849 - DNA, 689 bp, Fusarium venenatum
  misc_feature (1)...(689): n = A,T,C or G
tgattctaggccttcggcggttccatgtcaacctaaaacactcacatgacattgactgtctcttccaacctcgacacgcaactgtaaaatctacgctcgacgactccagccaccgacctatccatttcgcgcccgaaaaaaaaagtacaagcagaaccctttggcccacaatgtctaaccgtcagatggctcgcgatatgcaggtagagttccaggctcgattccaagccaaacaggctcgtcgcgaggcccaaaaggccgccaagcaggaccccatcctcaagaagcagatacaagacctactcaagaagggagagacccagaaggcgtaccagaaggccaagatgcttctctccaagcaggcactcgctcagcagatggaccagatggccgacatggctgagctgtctgctgcacagatccaggccaacaactcgatgaatcgaatgacccagatgatggcccaatcatcgcgaaccatgaacgttgccagaagaacaccaatcctgaaaagacccttgtcaccctctgagcaattcaaacagcaaaaccgaagaatacgccttgttcaacggcatttaccaagacgccattacccagtctacctcgacccaagttggcgangatgcttgtccacgagctactcggaaaagttgggccgatgacgcttggctttgacttaacaaagg

SEQ ID NO: 1850 - DNA, 629 bp, Fusarium venenatum
  misc_feature (1)...(629): n = A,T,C or G
gatggctcctccccctcctcagcacaaccctcacatctacgctcctgtgccccagcctcccagcaacatggcacccaacctgcgcattgacactcaggcaggctttggtttggatatgcgccaatatcccatgtcggccaccactgcttcccctgcagagtttcctcccagtccaggattcttccctcctggtcccgaggtgcctcagtctaactacaacaccccctacggcaatggattcctctcgcccatgggcaacggtgagggcattcctacatctgtgtctcctatctctttcaacggcggtgagccttctatcctggagcagtcacctcccatgtcgatgatgggacgtcctggttcaactgacatgtatgctgtcaacgatggatcatgcgccgtttcagatgacggaactggcctgaacgagatgtactctaaacacaccatcaacatgcctatgcacacgccttctcctggatatgttcagcatcaacangctgatctcgacatggnacaacttgtgcaattcgacgcaattgatccttcaaagcctatcccccgangcaatgtccacgctcaaggaaactaagcaagcaatactgggtgggtataagtgttgatggctt

SEQ ID NO: 1851 - DNA, 382 bp, Fusarium venenatum
gaaaacctatccatgctccaagcctccatgagccctccatcctgtcacatcctagcgactgtccagtatcttcaatgaccaacaagtcctggcttctacgctgtgcgccttaaagatctactacaggtcgcaccgtcgttgttgctcagcattgatacatattgctattatcccacaaaaagaatatcgagccgataccaaacattgctttgccttatcctttttccattatcagcatttcgacccccgatacggtgataagtgcttccacctgcgaacatcgacaatcatcccgcttcgatgcccccggctcttcctcacctcgtgaccccgcctgaacgaatgtcgtccgttaccttggcctccaactttgctcggtcgg

SEQ ID NO: 1852 - DNA, 617 bp, Fusarium venenatum
  misc_feature (1)...(617): n = A,T,C or G
cgattccctcgcgatagttactatggcagccgccctatgtctctgaagccagaaggcaaccagtatgacacagggtcccgaagcaactattttgatggccaggcttacagcaacggttatggcacaggtccatcgcggcaacggatgtctagaatgcaatcagagccgcagtaccagaacggtcacgaccaaaccatatatcccctacccaacaaggatcgatcttacgagaccgtagcttctgctgcgggaagcggccattcagaccacgcaggctatcagacagatcccacgagcagtgacaacagttcgattgatcggactatgccggctaagcgccgcgagcctttcaatgagtatgcgtcaagttcttcccaataccagccagcaaatcagtcacgcccctggcctactcctagcatgaatggcaatgccagctatcctcagatgccaccaccttcccatgcgcaatcagctccgagtcaggaccaggctccggttccttctcagaagcagaagaacactcttttgaggagaacatctacacagcaatcagcacaacagccccaacaaacagctggcggggataagcgcaagagttggntttcctcgtaggt

SEQ ID NO: 1853 - DNA, 584 bp, Fusarium venenatum
  misc_feature (1)...(584): n = A,T,C or G
gcctacccccacccgtgccgagcccaaggtcaccgttgaagctagcatcgacacctctgatctttctctcgagggtgcctacgacaccgtcatgcttgcctaccacaacatccaccgcgcgaaccactctgcccccgctcttgagtgggacgatgagctcgccggctacgccgagaacactgccaacggctgtgtcttcgagcacgacatggaccaagggaatggcggttacggccagaactcgcatcctggggtgctaccagcgacattgatggactcaagaacaaggctgctgctggtggtattaccaaccagtggtacgacagtgagatgtccaactgggctttctatggccaggagaacccccctccgacatgaacattgacctctacggtcacttcaccaggtttctggaaggatccaccaaggtcgctgtccatgtcaatgcctgcggggattctcacttccctcatgtaacattgcactacacctcaggtaacttgtggcgtacggacactctcanccnaggaacaactttatgttagaccaanactcnccgatcgaaaggccttntctttaanaaa

SEQ ID NO: 1854 - DNA, 502 bp, Fusarium venenatum
  misc_feature (1)...(502): n = A,T,C or G
caaactaatcaactcttccgtgtctgcgtccagcatgtcacacgccggaaaaacgcaatacgattctttcgctcccaagtatgcatctgttagtgagctgccctgttcnaaacttgagggtcagcttgtgaggaatgccttgggggactgtacgggattaaaagtgctggatcttggnggggggagcggacttnatgctagaagggcgattgaagctggggcgaaagttgtggatgttgttgatatttcccctgagatgatgaaagccggcaaagagatcgagacaagcctcggacgacagggctgnattcgctggttcgaagccgatgtcaccaagccagtcacagagcaagtcaacatcgaagataattacgatatcgtgatggcaaattgggtgcttgatcacnctacctctgtttccgaattacgaagcatttatgagaatgttgcaanaacttgaaggttggnggcaagttccttggcgtaagggcaaanagtatcc

SEQ ID NO: 1855 - DNA, 396 bp, Fusarium venenatum
  misc_feature (1)...(396): n = A,T,C or G
cttttcncaaccattacaaagactgtcgctcaccgtttgatctagttcatcgtcgacngtaactggattatcaatcaatcagcacctaacgagcctgatcntgganggcaacgtgaacacttcgtcacttcccgacaacttgtccgagaaactccnggccgtcgtattcttaatacccgtgacgctacgtncactgactggnactatggccancgaacaacnccttggaaaaacaagaccactganttcgacgaacttatggccgataagncctacccaagaggataaggtggctcttccaaaaccccttctngacaatncctgggtgggtttncccaacnacccttgcgaaacgaagntttgacaaaaacttattgggttattaaaccctttttt

SEQ ID NO: 1856 - DNA, 817 bp, Fusarium venenatum
  misc_feature (1)...(817): n = A,T,C or G
cccacaattcatctcttgtaaccaaaaacctacatcaaccaacaaacttgcttccttctacatttgcaactcaccacataaccttacctttcctaatttggctggganttttttnggngtggccnttaacgaactataaccgacgaactattcaacactttattttttggntggggttttatcggctacctggataaatcccgcaccaattccggaatacaacaaccgcgactttcggcccaaactcacataatgtctggcatactacacctacaacgctacccagtgcaccccgctcccatgtcgacaaccaccacgccggccgaaatcgcagagctcctcgtctctccatgtctcaacaagtccagcgccagttccgatctggtccccgtaacatgaacttgaaggatcccgaggctgccgccatcacctntttccgaccaagttcgagaccagccgatcttttgatcttgangacgatatggagttctgccccggtctggtgactgagaacgactacgtgtctatcttcagcgcgtncgagcgttcttactagccagcaacttttncganttttttccacgcaacaacccaacactggtgnttctggctttttnctnaacttcgacatccccggcttcatccccccttttaccagcatcagccaagctgaagnttaccagccttcggtantnggggcggttgagcatgcatttanaagggccaaatcgncctatagggagtcggattacaaattaatgggccgnggtttanaacgtcgggatggggaaaacctggcggtacccaaattaatcgn

SEQ ID NO: 1857 - DNA, 633 bp, Fusarium venenatum
  misc_feature (1)...(633): n = A,T,C or G
agcctaatctttaaattctgactttcgttattgattagtttccgatttaaaatctcatgcatttcacattgctctctacatacaagtcatctatctagactgaaacactcagtgtaaaaacatnatggaccgccccaacaacgccatatacatgctgtccgaagggaatcacgagcttcgcgtcattcaggaacaatacatacctaaacatgctcagtcactggttgatgtgcaatactcaggaatcaaccctgccgatactcggcacatgtacctgaatatgacgaactacgttgcgggttatgagttcactggaaccgtcaagcaagtcggtccagagtcccccttcaagattggncaaaacatcttcggcatttcccttatgtacgaccgtcgccctaattatctcggcgctcatcagagttatctgcttgcanaaccgttgatgacatttctgcggccagaacacctcgaccccatcacagntgngacacttctcgctggnggaggacagcgatggacggtctnttcaacgtcctgggctatgggttcccacttgccgattccccgggaatgaacctaaagatgaaccccttctnatntggggaggcccaggtagcngtttggacaagg

SEQ ID NO: 1858 - DNA, 644 bp, Fusarium venenatum
  misc_feature (1)...(644): n = A,T,C or G
ccaatnggcaaaaaactggcccgttcccctaaacaaaggatttgaccctccgaagaagccgtctaacgacgggtaactgccgcccaaagggaggtttgcatccgactacaaggctcctgctgcccctgcccctgtctctgaagaagcctgctcccaaaggagggaacccaaagaagagaagagcccaagccaagcccccgctctccgatctccccctcctaccatgaacgaagcaagaagggatcgatttccgctatggcctccaagataccaaggacaagcaggaggatgaggaaagaggacgatgatgcttcaagcttcgaggagggtttcgcgacctgctcaagcgccaagctgttcctgcaagccaagttcacgcctcctgctcaatcgcaagacggcttcttcattcacccccgcaagtcgcgaaagccttcctcgccgggtcaagactcctactactcccgcattctcaagctcccaccacctcttcttcctctgctcatatcactaagtgactcttccttcgccgaagatnaagcaactgctccaagggtcaagaccaaagcaaatngggctccttgaccgctgaaggttgaaggcgctcaancgcaanggtcaagcactggctctcaaggaccaaa

SEQ ID NO: 1859 - DNA, 541 bp, Fusarium venenatum
  misc_feature (1)...(541): n = A,T,C or G
cgctgtcaaagaaggagaagaccaagccagcaacgctcaacctttcggcctctcgcgaagaaaagacccagtcaaggacctcttcgttcctctcggctctccgatctcctaagaagaaggcgatgaagggcatgagcatctcatcacctctcatgactcctcagactggtgaattcccccgccaagaataccaagagatgaacgcaattcctccccgacaatatgccccagctgctccgcctccggtccccaccaaccaagtcccatacggatccccgactgtcccggccaagacccacgcgccgctcccgacgccggacatctcgcccgagagtgttctgagtatcgatgagcgcatcggaaaccagttgccccctcctggtcaccaccgacaggtatcgtntgcgccttcggagcgtgaccctgagtcgggccacttcagancactcacaggtgccgctggtcngtctgccatcgtcccccaagccnggtgcacgaatcccatcttcttcctntctctccccgcgtcccccaagcctgg

SEQ ID NO: 1860 - DNA, 120 bp, Fusarium venenatum
  misc_feature (1)...(120): n = A,T,C or G
nngccagtgtgctggaattntgcnctatntcaggtganggacangattgngtgcttcatngcncggatatntcacgnggtactngtgcagatcacaggttccntctgancganatctact

SEQ ID NO: 1861 - DNA, 510 bp, Fusarium venenatum
  misc_feature (1)...(510): n = A,T,C or G
gtcgttatgaatacacctcccggcgagattctcgacaatgatcttattaaggaatttgccgatcggtgctcgagcgcctctcgcagtattcagggttacatgacatccgagaatcccacacccgacaacgatacaatggagaactcatcgacaccaacgagcagttgcaaactgcgcttaaccaacataagcgcgctgtcctcagcgctcgcaaacagctgggtcttaacgagcacactgactcccaatcgccgagtttaaccccccagtttcagccccaacaacagccggagtctcagttccaggccaatggaaccaacactgatcattatttcggcaatgcgtcttcctcaagttctggtcacaacaacggcaaaggcaaaganacacattcttactcacccccctcaggtcctccaccaaaggcaggcaaaggaattacaagccngcccacgatgaatctgccgagaaccattcgcagacctcaaccaagcngtcctggccaaacgg

SEQ ID NO: 1862 - DNA, 612 bp, Fusarium venenatum
catcaacacagttaattcttcattgtatcctcatctcacctccaacactcatatcaatcactatttaaaagtgttatctcacttacaccacatcactcacaatggccgccatcgctaaacccgctctcgtcaagcctgctgcctaccccaaggccctccctgttgtcgtagctgtcggcagcttcgccattatcgccagctacgtgagctcccagcttgccaccacatcagccaagttcgaccgctcctttgcaaagtacaacacagtcgagagcgagaccaaccgagcaagaacctttgacggtgccatcgaggaccccaggacaagtctcttcaacatcctcggccgtcgacagtaagcgtgcaaatattcagcgagaaagggcataagctacagaaacatccatggggattcgctttgcataaacatacatacacatacttcttctttgcgttaagcgttctttattacgttggacaacctcgccttttcaagatggcgcaggtacggaaacaacatacatttggggtatctatggaagattgggaagagggagcatcgataccatataaatcatataatctaagcatcaaattaaaccggtcaacttc

SEQ ID NO: 1863 - DNA, 600 bp, Fusarium venenatum
  misc_feature (1)...(600): n = A,T,C or G
ggggccttgctcttctgtttctagagtcggctcggccgctgctggtgtagtttcgggcttagcatcctcctccgcctccttcttctctgtatccttggccgcatcgcccttgataccgtgaaccactcggaggccttcagcctgtgtggttatcgcatcgagctcgcgttttcgttgaagtcggaccttaatctccttggccatatctttttgagagacgagaacaccttccttctcaggatgaccatcctgaagtcccagctccttgatcttgaccttgccttcggcaacttcgtcatcgccaaggaacattgcaaaagcacgccattagcctcagcgaccttgaactgcgcgcgaattagcttgaccttgtaagaaaatcagcctgacaacatgttagccttttgtcattgaattgatatgtcaatgcacaatgctcaatgacttgatacagctccagactacgcacactgactacctcctcagaacctttccaggccagaataaagtcactcttgtgcgacgcagcgcttctcncgcacttggctnggatgaganatttcacgcaaaaatacgaccagggatggnctgcngaaaaat

SEQ ID NO: 1864 - DNA, 623 bp, Fusarium venenatum
  misc_feature (1)...(623): n = A,T,C or G
gaagagggttcgcaacaacaagaaccagcgagccaaaactgagaaggaagacaaagagcgtcagagacaagaggccgcggacaaacgcaaaggccgcgcagaaaggcgacgaggagaggactcagatcctgccgaggagacgccccctgccacagtcaaacccccagccacgaagagtattgaggcacctgtcattatggagacacccgcgccagtcgagcctgtacccgacacaccccctgcgagtcatcagcctgtttcaagcatccagaaacgtggcggaagaacggctcacaagaaaggcaaagggaggaaccagtatacgagagatcgagacggggaaggcgagtcgccagcgcggtcaatgtcgcgtgacatacagaagaccagtgacgagcccacgccggctacccgaaaccaacgagtgaacatcgacatggcaagtcgaagccggccattcaccacaagttgaatatggtcgacatgaancggcgtgntggcgccattatngattttatttcgaggactcaaagtagacctttgcagccgaaacttttgncagtggacgaatgagaacacnagttaatggggggggggtcgcttcaaaaagactattagctttn

SEQ ID NO: 1865 - DNA, 640 bp, Fusarium venenatum
  misc_feature (1)...(640): n = A,T,C or G
gcagctgcatcgtgctccatgaaccagctgcacttcatccaacttcgatactgtgatgagttgatagaggctctaatcgagtgtgctgaggatcaggtggagatgttggccnaccatactgttgaggtttctgacgagattcagttatcaccttatgaagacgttctgagagcttgtcgcttagagcggttcaacattcgcgatttgcccgttttcggcactcaagaatatgagttagaacgagctgtcgatcgattaatatgtgtaacgacaatcttgcgcaatttatcgttccctggcgaggcaaacgagaatcattctgttcttgcagatgagattgttatcaagtttctttgcgttgtcatcagatatctcggcncgcggatgatgcttctaagatcccanaataatacgttggactttatgaaggatgttgttattctgctttctaacatngntggcacaataaagattccaggacgagagcaggccctttgcttctacaattcctcntancattcgcgccggcgcctaatcccacagtnttggacggaactntttttttttngcaatacganccaagcctgcacgcttacctgccccatgctggtgatgccctaacaaaagttactggcncccg

SEQ ID NO: 1866 - DNA, 388 bp, Fusarium venenatum
  misc_feature (1)...(388): n = A,T,C or G
gcgcatcaaccctcttgacatgtacaagaacttctctctcatcgaatatttcacatcatcatctggaatgatcaaccactccaacctcacccgccttcgaccagtcaaccagcgcanggtggccaagatggtccgccgagttcagggaatgggtatctaccccagcgtgcacgcccatcccgaaatgctccgtgaggatttcttcacgcaccgaaagtagaccagtcgtatatacaggaaaaaagcaaacgggaaacgagttgttcctgcactggcgttctgttgaatgggatgatgtcatgatcattatttttgnggtcttatgtataacagcctcaaacctctatgtaacatattgatacaattgtcaacatccaaaanaaaaaaa

SEQ ID NO: 1867 - DNA, 470 bp, Fusarium venenatum
  misc_feature (1)...(470): n = A,T,C or G
cgaaaattcttcctcctctctcctctcaaaagaagaccaaagaaatcccactctggaagtttttgaactccttctcgccgatctcgctctctacaacagtccatcatgagcgccaaccctgaagcacctggcgccccagccgaacgcatcacctctacagcttcaaccatcaccgattacgcttatccgtacggtcactttggtcatcttacacaaaagcaggaggaagcttttgtccaatttaagaaggtcctggaggagangggacttttgaagcctggtcctcctccttctcatgatgaccctttgatcctacgatacttgcgcgcacgacgatggaatgtcaaagaccttatcccantttaaagaaacagaaaantggcgaaaggcaacgacttgaatgtgttttatgataccatgatctcaacgcctacnattcgncgtcgcttgtntctcaatggacagtcgac

SEQ ID NO: 1868 - DNA, 151 bp, Fusarium venenatum
  misc_feature (1)...(151): n = A,T,C or G
nttngggggaagaaacttcctccggatacgcccgcagnatccgctgctctnaacaagagccccatcaactggtattgctgacaccggtactaccctccttntactncctgacgctgncaactcggcctattntgccaaggacagaggtgct

SEQ ID NO: 1869 - DNA, 655 bp, Fusarium venenatum
  misc_feature (1)...(655): n = A,T,C or G
gatattccctctctcgtctcacgggattcactaggaccttctgccacatattctcgtacacgtccggcaagcccttcgcgtgaagacactgtncgcccataccggggnggcacgacaacaccaggaaggccgactntctcaaggcaatcctcggccgngaagttctctagtcgtccggnccccganacaaagattgtcgcatcggaggcggaaggatccacgattagctttgcgccgccctctagtacagattcagaaacaccaaaagccgggccgtatcgaccgagctattcaaggcagtcttctctaggcaactatccgagcaaatcgcggtccagcacacaaataacgtnnggtgagaacgatagcaagaaaatntnttttgcggagcaaccagattacgagccatattcggcccatcattctcggttccattcgcgacgtagttctcggggatctgcacagtacggaggcgattatngngatcaaatacccgaaatgctcgaaagatatcgattangctctcacctagaggangaagcgcangaaccaggtcacacnccccangggttgggagcttgtnattcaacgaactggccaagcaanacttaacnccttatttggcaacgaattggatgcgtcacanttccaaggn

SEQ ID NO: 1870 - DNA, 545 bp, Fusarium venenatum
  misc_feature (1)...(545): n = A,T,C or G
cgtctactaccttcgctacgtccaaaacaccgactgcgtcagcatccgccgctcagacgattgggatgtctctgctggcaatgttcgtgtcattggccccagctacgacctcgtcaacaacaagccctgctccatgctcaaggcttgctgggcctttggcatcatgaacgtcatctttttcgccatcacctcagtcgtcgctttcctgcacggtggacacatgagcgcttataaccgcagccactcccgtcgatcttaccactccagccgtcacagncaccgaagccactctcgctctggctctcgtcacaagcaagccgtagccgncctcactctngccgtgtctacgtctaagctggagcatggctgccgctgcgcttgactcgagtgccagcaagcacggaccagaacaacaacacatcgaggataccggctttttgggcgtctaccggctcttccacttatattcatacccnaatactacaatacccagcccaatgactggcaaatggnagntttcgcaagctcttcanctttgtccgttg

SEQ ID NO: 1871 - DNA, 415 bp, Fusarium venenatum
  misc_feature (1)...(415): n = A,T,C or G
ctaccagccagaatctcgtctccagcccacgatgcttgccacgagagtactacgagccgccgcgggcggacccaagcccaacatcactggcttcaacatgcgagcgttccaagcatccactggccagcctngatacgatccctgggagcgaaatgaggcctggcgataccagggcccctacacccgctggaaccgtctcaagagcggtttccctggtctcggnatngcgacagtcgccttcactgtctactgcggctacgagtatttcttcctcgaggacgagcaccaccatggcgaggagcaccattagagtgggcatttacggcagacgataaagcgggaagatcttgagcactgtttgggtgtggggaagtttgtcatatacctcgnaagcgagaaagngtcaccngattac

SEQ ID NO: 1872 - DNA, 593 bp, Fusarium venenatum
  misc_feature (1)...(593): n = A,T,C or G
gccgaggttaaggagtccctgatcgaggctggaaaggctcccgaggctgctgccaacacttctgccgtcgaggacaagaagctgtcgagagcgagctcttgaaggaagtgaagcctgttactggcatttacnattctgttgttgagcaagagcagcccaaggacgaatccaagcaggtatctcctgaggttcccgcccangtcaaggattctattgctgangctggcaaggccccttaagctgccgccaacactgaggctgtcgangaaaanaagcttgttgangctganctccttaaagaaatcaagcccgcggccacaattgatgaaactcctcaggttgctcctgaagtgcctaccgaaatccaagantctnttgtcaagcccgttacnccctgaggctgcacttgcaccnaaacttcganaacaanaaggaagttaaactcaactcctccaggaagcnaacttgtccctctntcngaaacccaaacctgcctttnaaggccancctnactctctgtcagcctcaggaaaacaaaatcanaactgtttctcccttccnccctttttcttccccaaaaaaccaggccgaag

SEQ ID NO: 1873 - DNA, 810 bp, Fusarium venenatum
  misc_feature (1)...(810): n = A,T,C or G
agaacttncatccaacacaacacaatcaacatcaacatcaacaactaccgaccatctttaccaacttccaagcatttaagtttataatcgacaaactttggcattgtaacgaccgggcaatcggccttctacttgacaactacaaactcactcgattcgattctttggtgtcgccaataacgatacctctacacataaacactatgtcggctcccggccagaataatgtcgacttcgacgctctcctagatcttaccgagtacgatagcttccagtctccttctctctcaccagccggcacatcaaaggctaccttcacaagccctgtaaccgctgccgttgctgctcccattaccacaactgcccagagcttgagcggtcccagtcacaactatgacatgtaccgacaacagacaggcttcgtccctggagctatcgccagcaccatgggggttaaccagaccaacaacactggttaccaagacttcccgtagcttggactactctaccttcagccctgaggctgatctcttcgacttcaacacctctcttacaaggnaccatgggcgcatcagaaatgggacatggattttgagtcacagaccgagacacacaagtcttactgttgacccagcagtatcgagcaggaaatgatggccttctttgccgcagtcttgccactcagaccacacgtcggcgantttggccggngccaatccaggccgccttgcaaggttaggctaacaggacngagnaccggtcnttaaagacaganttaagccgggattaaccaagtttgggggaggtctc

SEQ ID NO: 1874 - DNA, 336 bp, Fusarium venenatum
  misc_feature (1)...(336): n = A,T,C or G
ctgaactgttagtagagttcaagagggaaaaaaggacgaaagacatacgcatcaacttcatcctttgtaggataagcacccattccgaggatnccattctcagactggatatncacagtcnagtcggcaggcttganctnttttgaagctcgtcttgcnatacggtttcgtcgntcttgancttcattgcagcctttgggggtccatcctgaccctcctttntcaacttgaggacctcgatattnttctcggcggnggcggggacnattcnatcgacaaaaatgccggggaggttgacatcgttggggtcgattccccaacttcacaatgttctcg

SEQ ID NO: 1875 - DNA, 166 bp, Fusarium venenatum
  misc_feature (1)...(166): n = A,T,C or G
nttnattcctgcggttttctctnaccatanctacgaanantatccacccannactttacaatnatcaaaatggttntactggtgattgctttnatctcgatcctaagggncttcctattatgtanntggagagaggcctaccgntgaanggcggttttttgncatc

SEQ ID NO: 1876 - DNA, 599 bp, Fusarium venenatum
  misc_feature (1)...(599): n = A,T,C or G
gtggatgcgttttctgcgttgaacgtgttacagaaaactgggtggctcgaggaccaaggaaccacacggcctctctacagggctttgcttcggaaccgggatcttattgacactgcagcctccaccatagatactatgcacaaggagggtcctgtgcctttggatgcggtcatggttacagtcgaggccatggctaaaacccgaacttcggaggctgccatgccactctttcgcaatgcatacctccttagcggcagaagcccccggttcagtaatattggacatctagttaagcacagcgtcaaaacggaaacaaagtatgagcttgcaaagatgtgctacgtcgaactatccaaaaccaagatccctaccacgccggcatcagaaagcgaccaggctgctgcgccagtgagcccatatctgataagactacttctgaaaaagaaaccaataccgaaactacactcccaagactgttggagctgaaaatcatgcgcactcaacnnatatacatatgtcagagtagcacttgactacattagctatggtatncaactcatgcncatactcactcaaagtgtggaaaagccgatcaccta

SEQ ID NO: 1877 - DNA, 543 bp, Fusarium venenatum
  misc_feature (1)...(543): n = A,T,C or G
gagaattaaaccctgctccttcttctgaatcagaacaaacataagggacagcagcacctactaaggtacctactagacacccactccgctagacacccactgtacgatctacccaataccattgtaacgggcgcaagcctccgctatccggccggtgaccgaagtgccagtgcagtgcactgcagtgcagaagcaaaccaccaagaacggaaccaagatcaaagagacccatcgccaggccagaccagacttgcttggccagtccccacgattttcgtcaccgcaactgggtctggggaggtctccgttgctccaacgccaccacgcctcgaccaggcttagatcatccctggcctgccattgtaccgtgctgtacacacccaaccagaaccagatccgaaagccacacccacaacncacaccaacaagcaccggttacgctacgtnctctccngtacgctagaactacccccaacanaactgtcccctgcccaagcttancccaaggggcccccggntatcactactctgcttnatcatccc

SEQ ID NO: 1878 - DNA, 627 bp, Fusarium venenatum
  misc_feature (1)...(627): n = A,T,C or G
cgacgtggttaaaggtatacttcatacgatattctttcacagattctttccttctctagttcctcaaactcgtgaagttctggacctcaccctcccctatgtggacgacgatgagctcgagaccatgatagagcagcgcgtcgcggcgtttgagcgacagatagacacacagcgctcatccggcggaacaaacaatgtttctggtggaagcgcgaccggcgggcgcggacagatggttgtgcagttctttgagaagcgccggcgcaaggcttggttatctcgtggggatgaagaggtttgctgggaatgttggacgatcaaagtaaccgtcgaacgagcccagaacagaaagcgagcggccaaaggtcgacgcgccatggaacaaacccttctaacgacggagatgaaaatggtacgttcgcaaacactcataagaccacatccaccatnaccaccaagggacgaacccgttccatacaagattaatctcgaccagaaggaacacaggctgggcaacacgatgcgaatttctgaggaacccgtgaagcttgaaccagactgagaatggctaaggccttntgtatcaaatcacaaggntnaggtggcctantcttgtcgattgcaatn

SEQ ID NO: 1879 - DNA, 537 bp, Fusarium venenatum
  misc_feature (1)...(537): n = A,T,C or G
ccaggccagacagggatcagaccgaagctcggctcccgtcttgcttgattcattatctcctcttgttctgcctttgcttctactgctcctgcgcctcttgcctgcgtgcgccgcgccgttcttcttcttctcctcctcctctaaatctcctcttttcggcatcttacttattgttcctattccccttactcgcgatcaattgtgactctctggccaaccctaccaatgatggctagtcgctaaagttgggatcatcattcctttactcaaccgttcaatccacaagctcaacgccgatcgccgccgccctcatagactacctcactgtagccagaatgggttgctgtctttctcgttcttcggggcccaactcaccttacccgggtggcgcacccaatgcttcatcngcgtgctatcaatcctcccccgctgtccctccctgaagccgctaaaccacaaatccctgccgaaaagaatcgtcagcgtcgtcgcaacgaacgtccctttggaaccagcatatngacaagcccttggcgg

SEQ ID NO: 1880 - DNA, 631 bp, Fusarium venenatum
  misc_feature (1)...(631): n = A,T,C or G
aacgaccacagtcttgcatctcgactatcgcagtcatcatcccaggtcccattttcgaccatcgggaaatattgtttctgacgtgctaattctctttcaactcggctcagatacaccgcgaccgacaattcttccgattcgagccagctgatcgtcgacctcaacccccaagatgtcgttcagtttcggaaacacaagctcttcgggcgcatccaacaacaacacgacgtcgagtgcgccggcatcaggaaatcttttcggtgctgctactggaagccccggcttctcattcagctccatcggtggtccgctgncggcaacagctcgacacccgctagcaacagttcagcaacttgttngtgggtaacaaagcagcgcaacagacagaagcccgttgggggtcttttggtggcgggcgaacgcgaccactaccaccccttcttcagcggaatcttcggcggtggcagctctactactctgcgacaagcggcttttggagangtnttctactacacctgcagcaccacagttcttttagcggtggatgttggcggcggcactgtagtctactggcctgttcggangatgttggaaccaggaagaacgcaagcaacctgcgntatttttggag

SEQ ID NO: 1881 - DNA, 729 bp, Fusarium venenatum
  misc_feature (1)...(729): n = A,T,C or G
ggaatttttttttttttttaaggtggttgaacatatggaattatggtatgtttaagaaatttatcatatgtagtcgtaggtaggatgctttaagcatcatcccattcgaaatgcaccccaacgccttccaatgctatatacaagtaacttgtgcattgttcaaatcggtcccaatattcaagtacccatgtataaatgctgttatcgagaancggtaccgtcaggtcttgctcgttcgaagttgatcgaaaagatcagaatgttgttggtatatcctttacagtctaccgtcaaaggcatactggcagccaaaggccagccaaggatgacagcgaagccagggaagaagaagagggcttggctgccaactctcttgaacatcttggcgtaatcaggagaagcgggcttctgagttcggggaagacgctcgaaggggtgagattccatagctcggccggcatttcgcatcgcagtcaggagagaaaactggcgagtctgaacagcgcgggcggcagatcgaacaacgatggaagacatgttgattgattgggttgatttgtttttttggtggaaagttgtagttgagttgattaagtcaaagacttaataaagtgatagactcgaagaattgagtggcgatttggttggagtggagaagttgttactgctttgatgaagctgttgatggttgatgattgtgatgagaggagaagactactttgggaacgg

SEQ ID NO: 1882 - DNA, 701 bp, Fusarium venenatum
  misc_feature (1)...(701): n = A,T,C or G
gggcaaacgactattccggacctcgtcatcaccctcaaagcccccctcggcacctttggtttctttgaaacttcctacgtttatacgacgacctgcagagcctgtcacagcggaaatgcaagaaggaacggaggggcaatccacacctattagtcctgccacacagcccgagccagaatcgaacctncgccgccgccccaactacaactccgaaaacgaggagacctaggcccaagcgtttgaatatgcttccaacacagccagaaaattccgagctgagtacagagccaaccccacgacgcggtagcccatcttcctttgctcgacaacgcatgcgcgaaattgcagccaagaatgcaccttttgacgatcccgattctcaaagggcagcgtggttgcgagcgctttccaaggtttttcctggctatttttaacccagcttggaatgttttcaaatttcggcgacaactcatgttgcatttactggataggcatggctttttcggggttttgtgtcatgaacaaggttttagggatgggcttgatcccatggacggcaattgtttttcacgactattattaggatttattggtgcattgggtagacattaatgaaggctgttggctcgggttatgatattatatatatgcaancagggcgacaatncgccgtaangaggtagatcncattgnaatgttgg

SEQ ID NO: 1883 - DNA, 357 bp, Fusarium venenatum
  misc_feature (1)...(357): n = A,T,C or G
atcactatttttatcttctgtcacatttttggacctctacttttcaggtgttctctgtctggacctccagttctgtgcgaaaccgtcgataaagtaaagaggacagactatcgacgattttggacttttgctacgattgccactttaccgccaaatatcgaattatctaacatcctaatcaagaaccgaagatgaacgcccctgatcgtttcgagctcttcctctcggagagggtgagaagaagacgaggagaaggtcttctntggaatgtccaacacctngactttgttcttatgaaggaagaccaccttttgggaacctcctatccgagccccttaagaggcacccaacgccata

SEQ ID NO: 1884 - DNA, 447 bp, Fusarium venenatum
  misc_feature (1)...(447): n = A,T,C or G
ctttccaccaggcgggccttcgggttcagtgtcgagggcaagttcctccaagatgccacctggcttccccttcttnttttggttaccccagccccaaggatccccagcttccttaggttcctcctcgggctcggcaccccatagcgctgatggtttcttgtcctttttggttccgaatccccaagcatcatcgtcatntttcatccccaagtcgcctgtgctgcctttcggtttgncccaaggattatcttcggccttcnattctggcggcggcggcgttggtgctggttgtggttcattcttcgatccccctccccaaccccacccaccaccaccgaatcccaattttgcgccccagctggatatgctcttgttttctggagggctgagtccganatccaatttgcttgctccgaggctgatattatngaaagtcgtangaggctt

SEQ ID NO: 1885 - DNA, 599 bp, Fusarium venenatum
  misc_feature (1)...(599): n = A,T,C or G
cagggtcttttaatatctaagctaccaagccacgggacgagacaatctagcttggcaatctgtttttacgccttcttccaactttatcctcatacacaagcaacaccactcttgcacaaacaatacacacaaaatctttcataatggctccttctactactgaggatctcgtccccgagcccgtcgccgccaaggagaccaccctccctgagcgccctggtaccgccctcaacaccgccgagctccaagagcttgccttcaccgacaagtacagcgcccccgatgtctacatcaacgaaaagaccgatactctctggttcccttggatcggacccattgagctgaagccccttcgcatggagaacanaacaggtacctttgtcgtcggtctgcnatcnaaagttgctgccancctgggcaggcaccgacaccaaagtacggttacagccacaccatgtctggtgaaggggagatcaaaaaatacactgggttgccctcccggcnattgggtttggaaaacctggcgtcttccacaccttgtctgtcaagaaaaaacgatatgtctcntattccgcncancaattcttacaacaaaaatt

SEQ ID NO: 1886 - DNA, 327 bp, Fusarium venenatum
  misc_feature (1)...(327): n = A,T,C or G
nggctggaagcgtaaggtcgtcgactacggaaactacgcttttcgtcgcatcccctacgangaatggggtctcaagtcggtacctcctctatcttcgaaacgtcgtngcgaggatatccaaaccagangaaaggtagagttatgcttcccgagctccgtgataccacccagcaaggctgaaggtattctccaaacccttgcaacggancgtcagctcttcacaaaaanaagcttgtctggtgtttgtgggcatncaattactatcccgtttgcctgataccatcatcccaaccttcccttcttctactcctttacanaacccggttc

SEQ ID NO: 1887 - DNA, 1239 bp, Fusarium venenatum
  misc_feature (1)...(1239): n = A,T,C or G
cttgcgatcctttaattgctctctctactataccaaactattgcaatacttcactcgataatacttgaacacaaaggattacaagtcaacaccttcttgggttaaccccttcaacactaccttctactacactcatacaaccacacatcaccgcagccatggacttcgattcttgggctcactctttctgccttgcctgcgacaagcaagtgcaatcgtcttctgatgcctactgctccgagtcttgcagactgggccgacttcgagaagacatcaacaacaacttctcaagccaagctcacccggcctcacttctccttcctgccaatggtcatcgaaatcctctagctcgggcttctacctctcccccgcctacgatttctccaacgcaaagccatacggatcaaggcacatgagccaacccaccttcaagccctacggcactgagtcgactggcaaccaccgatcccttaccccctccagctcccacagcagcctgtgctccatgcagagcacctcaacaacagggagagcaaagccaactgtttgacaaggcgaggaaggaactccgagcgtacgctgtgtctttcgacaacgtgaggactcagcgacgacgatcctactaagcactccactactactcaactttaaccacgacatcttacatacgaaataacacctaaaacatattaccacgcaacttattcaacacacacaacttattcaacaactcaaacatcattgcatcaacacaacgcctcaaactcaacccacacctcaacgccttcacatttccttatcttgtcgaagaatctattgtaccaaagaagggcattataccggagcactgcattaaaaaaaagtttgttttaacatggatccatgacgatttcttttcatcatgtcaaccatccttttacgggnggggatcatctggggcggttcttttgtccatcggggttcatggatatgaaccccaagcaagaagggatatcttgtaccaaatacagggcggattgatatcacatgaagtttcggagcatggattacgggagcacgggaggttttcatgataccgggatacgacggctggggacatttgggtcaggcgtacaggaccgaccaggcaanaagccggtcgatggattattctattgggaggtataacttgagcttttgactacggggcaactggggcatcgacaggaactgnggggaanactgcactcactgcncaag

SEQ ID NO: 1888 - DNA, 583 bp, Fusarium venenatum
  misc_feature (1)...(583): n = A,T,C or G
cgaaggttggcgaggaaatggcagctgaagacagcagacctcactacccgactatgcntcatctatccggaatgccagctggtcctccctctacactgtcggactctggtaggttgcatgcccaggggccgatgtcttctcccggaatacaacctcatcactctggtttgccgccaagccatatgacaagtcgccagcaaccgcctccaccacaccatcaaacttcatattctcctaatttgcaagccggtcgaccattccccagccctggaccccaaaacgacaataccacacactggtcggaaacactacgaagacaaggcacaggtggatctctctttggcgtagaaggacaacaagcctttatgacacttcctggaaacgaaacacctatacccgttcatatggacttttctcatgcgtctaaaaaggcagacgaaaagagacacgaaatgccgtggcttcaacgagacatcgaaggaaaaagaagattatgcaggaggaaaactcaaaacaattgcaagaactcnggatganagacggatgatggaaatcaggattgaagaattgaccagcagcgana

SEQ ID NO: 1889 - DNA, 590 bp, Fusarium venenatum
  misc_feature (1)...(590): n = A,T,C or G
cctttttctcctccctacgacatcgcgtgtatttccttggtaagcggatccgggaggcagcccgatcaccgccagacgatagcccatcatgtccggacgatacgaaagagtcaacgcccaagacgaggaagacttcagcaataacaataacaacaaccggatgtccacagtccccccccactcgccaccaccctcgtttcactctcgagccccctctccccagcgccaggtcgacaacactctcgccgatgcctttgacgatgacgacgacagtgacgatgacgttgacgaccgacagcgtttgatgcgacaaaactcgacgccatcattcgagacggccaatgcgacgcaaactccccaaccggctgttccggcaccagcgccatctggctcaagatcaacaagaattgtaggaggaggctcaggatcggatggtgtttttgccaacttgtctgcgcgtccagagcgangcaacgctgatcccgagaaggatgaactaccaccgtcttacgaacaagctgcggccgatgctgctcctccatactggggaaacaacaatcctcgctcctggcatgggtgggcccgacaaa

SEQ ID NO: 1890 - DNA, 482 bp, Fusarium venenatum
  misc_feature (1)...(482): n = A,T,C or G
ctcgcatatcacaaattgtctagttgcggttatacagcgcgctgctaacttatatacccatctactcactgaataagatgctgatctcaattgactcgattacatgagtctgcactaattatcgatcacaaagctcaaattgttctgttttgttgtcatactcgagcaggctccacctatgattgaagttgaaggtcgtcgcttgaaggttgtttgcaatttatggaaggagtcttctgcgtcgatgcacccacctgtagagatgattcacttacacaactccgcactgatctaaactccccatcatcaatcatccatcacataatgaanaatatccttgnnctatgtatcctaaaaactacctcctnaatctntatcccaacgctctgatggttganagaaccggtgcnnactccccnnactcctggggtcattngaacaccgcttcacacaganccgantgccttganggtgcctttcca

SEQ ID NO: 1891 - DNA, 623 bp, Fusarium venenatum
  misc_feature (1)...(623): n = A,T,C or G
tcgagcccagcctcggcacgtgtgcattggtgcgtgatgaagtggttcgaagattgacagggtctcaacaaccgcagcctcctctgccaccgcctcctcccatgatgacccacgaccctcctgcaatccctccacctcagccagatcaaccaatatacgccgatgacgaccctgaagttgttctgcagaatgccttgcgtcagcttcagcaggaagagcaggccgccgaggagcaggctgcggctgtgcgtgaggaacgtgagcgtgcggaacgagtcgggctccaacaaaacagtatcatgaccacacctactgcgcgtgcctcttctgttcagcgcttcacagctacgccggcccatgacttgggtgctgatctcacactcactccgatcgcatcggagacgcctgtcgtcgagatgaacggccttgagatgcccctttgtgtcaatcagcgcatgctacgcaccattaaggaagctgcgagcatatgtctactatgtgtgngtgattaatgatcgtttgggcatacgggcgttttagctttgcaaatctggcttccataggagttgaattcggtagacgatatgattccggcaaacatgttttttntcncaaccncaatt

SEQ ID NO: 1892 - DNA, 588 bp, Fusarium venenatum
  misc_feature (1)...(588): n = A,T,C or G
ccgcactataacaatggcggacgangccgtggtggacgtggacgtggatatcgtggccgcggtggccaaggcacaggcggtcgangtcgcggcccgccccgcgatgtccaatcctaatatcacatatactcatgcatggcgttaggtgggcgagaaggggggtttacggatgaacttttttcgacatgattttttttgtaccgggacatcatttcagttttggattgtacattattcgcatattttccgcgaatggagagaacggcgaaacggacttcattgcccatggatcacaaccacttcgagacttttaccatggatcctcacgcaaggactcagaaaaacggcacagacctgcatggttcacatgttcttggaatgatagccttagtggcttccttggctcgagcctgtcattctgtaccatccccatcagctttgatattctgtttggtttggttcatgatatctacggatgatgaatgagancaagaaatggaacttccaagggaaaaggtgttctttangcatcaaccacggtagacatacccgctttggggctggcacagccaactggtgcgggaagaa

SEQ ID NO: 1893 - DNA, 850 bp, Fusarium venenatum
  misc_feature (1)...(850): n = A,T,C or G
cactatcgttgtttttgaagcatctacattcgatcttttcaccttcgttttcacgtccaacccgatacattcttttttattactcaactactaccgctcgttaataatataaaaccttcaaaatggttcgatctcttgctcttttcgctggcgccattgccactgtcgccgccgcccagacaaccaccgtcaacttcttcctccccggattcgatgatcaacctctcgtgggatctgtcgtcgctgtcaagggtgaggcgaccagtgtcgccatcaactgtcgtgagggaaccgaccccagcgactgcggcatccaggaagagcgcactattgttggtggtccctccaccatggacatcagctactcctacagccctcccgaggagtacggcggtggtctcattgatcaaagaactggctgcaaactggaccccaagaatgatgtggccttttgctctgttgaagcaacaaacgtcatttctggtgttaccgagtctatggccacctcaaccgctctcagcggatacaagcaactcatcatgcccatcaccatcactgctggcgccgaaaanttgaacggtggtgaccttctgccactgcctctgcctctgactccgaggccactactgcgacaagcccaaggatactggcgctcagctactggttnctgccactacttntggagctgacgctgatgccactccctntgccgttgagtctgacaacctgccggccccatgatgacccaaaacctattctggctgccgctgccatttgtcgggggngctgntgccatntttntttaaangtctccnccaaaaggaaatgaatatttggtaacccnttaacc

SEQ ID NO: 1894 - DNA, 898 bp, Fusarium venenatum
  misc_feature (1)...(898): n = A,T,C or G
ttttttttttttttttatgattaattaagttattgtcatattgattttcgactcgcgtcctatacgcttaagtcggaccttatccaaaaggccatgatccccgtcatctacacatactcctcattcagatctattaaaaagttgtactccaagggttctcaaaaggataacatatacatcctagcgtcagaaagaatgcggcaacccgctatgtaaacaccaaacgcccatcgtcatgctttgcgtctctaacctgtacttgcaacaccgataattttccccatgattgctcccgttcaaatgctgcgcctctccaggtggatgccgattaggtaagtgtatatattcatttcgatcttgcggggcttcgtaatttggtttcaaaccaagtttctatagccnaaaagcggctatgtccggcttaatgcagcttggttggcagcctgagccgcctntggtggcaatctgcttctccttagggatagtaagggcgttgatgccgaggtagttgcagatgctggtaacaacgagccaggcccagcggaaatacacaaccatggaaaacataagggaggcccacaggtagaaaagctcgaactgggcgctgagctgagggagtccgattcggggcaagttggcaaggatagcaccaccaacgagagggtacagcatgaccgggccaccaggggaaaggctggtgtgtcaagtgggcgagaataatcttggttgtcaagcgaccaaagacaaatgacatgataaagcagaaaagcatgaggtggttctcggatcgaatggtgctgtagggggagaagacccaagcagcgattgaganngtgtacacacccatgggaatccactcgatgaagacagggagaatgggctctccccgagacccncg

SEQ ID NO: 1895 - DNA, 512 bp, Fusarium venenatum
  misc_feature (1)...(512): n = A,T,C or G
acaacttccatttatctatttacttgtcatctcaattcttttctatagaacttgcctttctttcttcttcttccccatcatggacagttcccgcccatatgaagtcgacgttgtcggtggtgaagataacatctccatcgtcagcttcgacgacatccattccagggccaggtcgaattccagatctatgcctccgcctccgatggcgccatttcaagggtattatcctcccgcagccagatctccctgggacaaccccgaaaccctttacccaagacaagagatacttaaggtcaatggcaaggtcccggacgtccttcacgccatcgagtattttgattcgcgtgacagattataaagcgtcgacaaagcgctcgggctttcaaaaatgtacccccattctctgcagtcatgaagaaggtgaagtcgatggcgagactccaatgacaaggacgcctgtttgggaatcttacagagnctatccgctagaacacagacctcaaccggcccct

SEQ ID NO: 1896 - DNA, 666 bp, Fusarium venenatum
  misc_feature (1)...(666): n = A,T,C or G
ctctatttaagcaaacacatccaatatgaagctgcagactatcaccactcttgccctttcgggtcttgctgctgctcagagccgtcccaaccttactgcggctattgaatctgagaactctactctctcctcgcttggtgctcttgtcgccgctcagccaagccttcttcgagaccttggccgtcttcgaaatgttactatcttggccccaagcaacgatgccctcgaggagctcctcaaggataccaccgtcgctcgcatggtcgatgacaaccccagctttgtcgccaaccttctgtcgtaccatatcctaaacggcacctactatgccagcaacatcaccgacatggacgcacctgccttcgttcctacccacctgactaactcgacatatgccaatgtcactggcggacagcgcgtcgaggtcatggccatgaacgatactgtcagcttctacagtggattccgtgctcagtccaatgtcaccaaggctgacctcaacttcactggaaggtgtcattcatatcatcaaccgtgttctcagcatcccccaaaacatctctgatactgcgtngctgccaacctttncgccgctgctggcgccctcanaaaaaccaatggtgngaccaactnaacaacnaaanaaacgttcttgtttttgtncct

SEQ ID NO: 1897 - DNA, 583 bp, Fusarium venenatum
  misc_feature (1)...(583): n = A,T,C or G
ctctctgatgctaccgttcttttccgtgacatggctggtgatgccgctaccaacgccgctgcccgtgttcgaccctctcaggagcagctccagcagctcgatgagcctgctcaagataacgtctggcacgaggcccctgatttctccaaagagaacttcaagcatcaggccaagggcatctatagcggaaaccccaagcaggatgctaaggacatcgctgccgctggtgtcaactctgccgccccaggacagcagggtaacctccagcccaaccagagtgcccaacctcaggccaccaccggctcgagactggcaacattccctccactgatgctgctcgtgacgccgctcgccaaaccgacccccaggctggcaagagtgccgncaagcangtcgncgagcaaaagctcgacaacaagatcngaccctgagactaaggagaacatnctccagcgcaacgaggagtacccggcgnaaggctcacgactactttnacaagaanatgccttaagagcgcaaggaccagactatctggcgcctnaagaagatgattcttgagtgccaacaagcacgaggactactt

SEQ ID NO: 1898 - DNA, 120 bp, Fusarium venenatum
  misc_feature (1)...(120): n = A,T,C or G
nganactgatactactaggtgttctttacttaacngaggaangcacaancattgntctttgtcncgctntattcaagaacacanttctatacttgagcgctnggaggactgtncatggaa

SEQ ID NO: 1899 - DNA, 626 bp, Fusarium venenatum
  misc_feature (1)...(626): n = A,T,C or G
cttcctcccaaattcgcagggcaaaagctccaattcgcccatcctcccgcctcaaactcaggcgtcgcccacacaactcacaccctcgagttctacctcgactactgctgtcccttctccgccaagatcttccgcaccctccgctccgacgtgatccccgccgttaaagcccatgagcactgggcatcgagcctcacatttatcttccgccagcaggtccaaccatggcacccttcgtcaacgctcatgcacgaggcgggcctggcagttctgcgtctcgcacccgagcgcttttgggactttagcgcagctttattcgaggagcaaaaggacttttttgatgtgtctgtcgtgaacgagacacgcaatgatacttatcgncgtctgggccaagattgccgnaaaagacnggcgttgttgaaacaaggngtccaactggttgggattcccgcaangctggtgatgatggaccgttgatgcngggaataaggttccaacgacctaaggtnttaccagatgaaccgctgatggcgnnatattacccacnntgggttgacgggtggtnagangtaacttggtggaacaaaaccatgggtgagggttgnaanaatttgctgctccattgg

SEQ ID NO: 1900 - DNA, 650 bp, Fusarium venenatum
  misc_feature (1)...(650): n = A,T,C or G
ccgataagaagtctttcatgcttttgcatatgctaatgaagcctgctcatataattgacggagactcaattgctcacccaaagaatcactctacgcgcgggcacgtgatgtcgtgtctggcaaagccgcgattagccccaccaaattgaattccagcttgcccctcgtgaatcgaacaagagaagacgactctttgctctgacgtctttcccaaaccgtacacctccaaagatcgacaagatgactgatctcgatgacgcacacatttctgtgcgcttcaagcatggcatccataccatctacctctttatcgacgccctcgcacccttcttcaacgtcaccgncgaacttaccagcgtcataagtgagcgatacccccagggtcttaccacgttcatctnaccttccaagaacactcatgtcgacgagaactcgattattgtgtacggngcattgaagattccgaatgatctctcgtcgggatgggtgaaagctcaagacgggggacngagagagcacgcctacaaaaatgggattggagaataatagcttgcttgggttgctgtggcgaacatgagaangacgatncccagtttgaggnggagtgggccgcaaganggccaaagaggattatgagggatgngaggggg

SEQ ID NO: 1901 - DNA, 650 bp, Fusarium venenatum
  misc_feature (1)...(650): n = A,T,C or G
gccgaggagacggcaacccaacacgaacgcgcacttcgtcgaatgaagcaccagcttgacaaggcagaacgcgaacgtaacaccctggcaacgctacaacccaacatcagcaagcatgaccggcagctgagaaagaaccaggccgagatggagaaccttgagcacgatgttctacagcaacaagaaattattgacaaccttgccgcctctgaagcttctctccgacgcaagctagagcgagctcgcaatgagcgggcagcgttccgcatgagcgccgagaagttgcaaaaggatcttgagcatgtcaaggctgcagcagtcgccgctagagccgggactccagatcgacgaagcgcagtagatcgcaaggctcttgatttaactattgaaggagctgatcaggctctttgagactgtcattcgcgcagctgaaagcgccgaccagcgtcacaggaaggagttgcggggcatgtttgatgcanatggagtggatgcangctcgaatcaagcgccgaagccttttnttngagctgatgnccnatattgcaaaagaagttcctacagnttgaagctttgccgtcgccaatgcatgcaacaagggtcaacttccgngngctcgagggatatttgcanaaaaccttccttgggat

SEQ ID NO: 1902 - DNA, 596 bp, Fusarium venenatum
  misc_feature (1)...(596): n = A,T,C or G
ggcatatctggcttcgaaatatctagtcgcggacccaaaaccagccaagaaacgaaaacgcaagcgtggcgccgaagccaacaacggccttcttataacagacgatgacgactcgggttggggcaacaccaatgcgcaagacgacgatgaagatcttgatggtccggttacagtatcagggcaatcttcagagtttcgaaaaactaagaagagtaactggaaatcattagggggcgacgcgactcccaaggatgattctgctgctgctgcagacgcgattctagcatcggcggcagcagagcagaatgcagcacgcgatgaagacgaagacatgccaatggtggaagatgatggttcggctgtcaaaatgagcgatggaacacatgcaggattgcaaagcgcagcgaccgtatcagcgcagctcaagcgacggcagaaagaggaacgtgaggagtttgaaaggcccgcaaatcaccaaggaagaagaaacagtatcccgggatgcactggccgaagaatcgacatatctatgaagcgcccgaacgcgacgtgcacttgccgatgccgaaaanaaagaacacttggccaagaaagct

SEQ ID NO: 1903 - DNA, 582 bp, Fusarium venenatum
  misc_feature (1)...(582): n = A,T,C or G
ccgcaagagcgctgcctttacggtagataatgctacttttctaaactcgacatcctccgccgctgctcgtttcccatctctcgactcattcgaaacggnatctnctccaccacctccgactagcttccngcaagcggatgcctcagcaattgaccacnactccnaggtcnccnagaaagttcgggttctttcccctccgccgctctcccccgaccctcccgaatgggcatatacatcgcctacccttgcgcagtatgctgcgaaccagcagagcgaaaacgatccttttgatgcaacatccacagatgacagtgatctcgagacggtggcggctgctgctcgtanacaggccctgactggcggtcaaggtgcgggaaatcctttcagcaagacaacgcgagacctcgattcgcccattgncgaacagaaacttgagcaagancgcaaggaagaaagaaatgcactcaaggttgccaataaagctaaacactccttggacgtcactcttttaagcggctactcatgacgggcaattcggaatcggacaagctttgggactggccgaaaaagacaagaaanatc

SEQ ID NO: 1904 - DNA, 452 bp, Fusarium venenatum
  misc_feature (1)...(452): n = A,T,C or G
actaccgaagcggccactggaccctcgtcgctaccactaccatgagctgcatcctcagcatcttcatgaccttttacctccgccgagagaacgcccgccgcgaccagactcacaaggctcctcacgagtacacccgcgtngagaaggagttggagcaaaactctggtgacaacgctacctttttccgatataccgtctaaagcacagggcttgtatcggaggcgacatcttgcanaacatcttacaagataatcgtactatttatatatattaagcgttttttttggatatcacagcgaantgggttatgaaatcacgaaagagcctagagtatgaaaaggcttttnatttngggaaaatatgttctctagagtttgtttggtcgggttatgaaacttanacgttttgacatctcaatattataaatgagccattcatggctagagctcttg

SEQ ID NO: 1905 - DNA, 604 bp, Fusarium venenatum
  misc_feature (1)...(604): n = A,T,C or G
cctacaacgtcaccaacacaaatacccgcaaactcccaaagactttgcatctcgcaaaccgtcgcaagacatattcatccctcatacccaaatcagtactctagatacctatacagcgaggcgctattctagccagcggtcgctgaacacatcctcaacccttttacaaaacccatttcccaaggtaaccccagtacctccgagtttatgtccatcgaaaatctcaagacctacggtaagcctctttgctgttcccatgaggaatactctcttctccctaccaggaccgcctttttgcttgcgcagctcccttcgacccgacccctggactgaactacgacgtcttgtcttatcgcctgtacctactacatttgctggtgttaagccacatgtcaattctccactcgaccgccatgtcatcaatactatcaataaatctgaagaacatgataactaactgcctcgctcaatanaccccttcgccgaaccgacgaggacaccgganaaaccaagcagacgcagaattacattcatatacgcattcancagcgtaatggacgtaagactttgccactgntcanggtctncccaanaagtttgacca

SEQ ID NO: 1906 - DNA, 627 bp, Fusarium venenatum
  misc_feature (1)...(627): n = A,T,C or G
ggttagtacaatggctattgttgaatcgccaggatgaatccgacgacaaatctccttgtgacccggtccacggccttccgaggcgtccccacgacactacggccgtttctcgcttcgcgatactatgcgacccagcaaggtttaggagctacagcccagggacctaaacgacgagcagtaacgcctttcaatgataacggacatgtaccatggaaacaactctcagtggcggaaaaggctgccgagcgacgcaacagagcttcaattttggcatgatccttgttggtcttgttctcactggtggtgtgggatactttctctggaccgatgtcttctcccccgatagcaagatctccaacttcaaccgagcagtcgacaagatcagaacgatcctcgtatcatcgatgccatgggcgattccaagaaaattacagcacatggagacgagacattcaacaagtggaggagggcgagacctgttgtttcttngnaacaacagatgccgcggagaccacatataatggatgcatttntatgttgatgggacccaagaataacggnattgcacgactttacatggtcaagtccgggggcacagcgactttgagtntaagtttttgttggtnn

SEQ ID NO: 1907 - DNA, 613 bp, Fusarium venenatum
  misc_feature (1)...(613): n = A,T,C or G
aaaggcaatgcttcacgcgcattcgttcctgactgccgcgtaactccttatccacatcgcacaagcccgagacaatcagcaacaaatctactttgctcttttcgacgactccctaccagagacttttttttaaatctgagacggtcgctgttttctctcttattggattttgtctttctttcgagccgaacccttctgggtacacttcatccatctacacggcccgtcaaccagaccataacttcataatcgcctgccgtttaattgaatcgacaacttctcaatatgcagcttcgaaagttcttacttctgggcatgctcgtcggagccgaggccacaaagctggtcgctcgtcagaacactgactccgactcggctgccgtgccctcaaccgattccgctcctgcgaacactgctgaaggcgaccttcaccaactgacgataccgcgactacggntgctgacctaccaccgccgccgagcctaccgacgangcaaccactggccgctgatccacaaccgaagaaaccaccgatgccactaccacagctgggggangttacgttaccaaganagttactgttaccgatgctgatgccaaaactgtgaccgca

SEQ ID NO: 1908 - DNA, 593 bp, Fusarium venenatum
  misc_feature (1)...(593): n = A,T,C or G
cgtcaacacccgtagaccgcctccactctcggcttcagtccatcgatcaataacaaacactcccaccccccttcgatcaccattcccttgacatctctcctccttcattcttccatctttatccatacctataatctacatcaccgttgtcctcgctagatccatatagtagacccttggagatctctctgatccctttcaacaccgagtttacaaactgctagcaacgtcccggtgaccgttctaccaaaagtctacagtccatccgtccatcatctgtatagatagactagacttcttctcttccaagcttaatctccatcttgtttcaacacaacattctcgccatgccttacaatacgcgccgcaagtcgctatctttacccagtctcggcatacacgtcccaatganacatgctgctcgcgctgctgccgccgcctccaanaacgcttcaagatcgtcctcgtcgtcattatccagtgctgnctcatccgccttgtctcacctcatcaggtctgaggccccgagggcatccaccnaacaacaaaacgatccatacgaaganagnctattgagaganacactccttcgc

SEQ ID NO: 1909 - DNA, 546 bp, Fusarium venenatum
cttcctgaacgaattagatgcttgtccccggatcaactccatgagagacatagtcaccctacaaaagtgcccgtgacaagacttgatggtcttcctctcgatgacaacgctccacgaaatgctgtactgccaatctggttaggccagaagagtgaacatgtcgctctggcggatgcaaagattctcctcggcgactttggcgaatcgttcctccccagccaagagaagcgacagtactccaacgcacccatccgctacagagctcctgaaactcaattcccggatatctgcccatccctatccttcagttccgacatctggagtctaggctgtctcctctggaacgtcgttggccagcgtcccctcttcgacgcctggactctctccgaagatgacatcctgcaggaccaaaccgaccttcttggcgaaatcccagaagagtggtccgcatacagctccaagcgctcagagtactggatcgaagactctcggcggaagatccgaaacaccaacccaatccaatggttgcacatgggaatcccgctt

SEQ ID NO: 1910 - DNA, 228 bp, Fusarium venenatum
  misc_feature (1)...(228): n = A,T,C or G
agctgttggcttgactagctctatgcctgttcttcttgaggatgagattaagcgtgttggtggaaagtatgtcaaggctgatgactgggctgagaagttggttgttgatggacaggtcattactggtcagaaccctgcttctgctcacgctgttggcaaggccattctcaaggccatcggtgcttaaataatgaatagtcatgaataataataagtaatctgccaaan

SEQ ID NO: 1911 - DNA, 497 bp, Fusarium venenatum
  misc_feature (1)...(497): n = A,T,C or G
cagccccccaagcagcccaagacgcaagccaagggtaacacactggatttttatcatccagaactgaccgacaactgcaagttccgaaatgctagttacttcactactaagttgtccgcagggtgctaccttgactatagcaacgcgaccccttcgtcacaaaccttgaacaaacagccaggctatccccagcagcaagctgccacccctgcacaacccaacttcggggtttacacgaacgggcaangcatgccgcaacgcacggtgtctcctgtggtcaatagacaggcctacagcgcatcgccgaataatatgcagcaacagcagcccccgcgatatggcacgccaaatcaagcggcgggaaatcaaatgaataggataccacaccgttattcctgaagcacaacagcaacgaatcctcgatcaagcgaaagccccggttgctgcccangaacggtccgccatgttcaccgacaagatccgcaccaggcaccccc

SEQ ID NO: 1912 - DNA, 631 bp, Fusarium venenatum
  misc_feature (1)...(631): n = A,T,C or G
gggcactatctcattggatgatagcaaggctttcgaagagtgttggacttggaccgaacaacttgacgagccacctagcgctgatatctccacgagcatgcgcaatgaaaaggcccgagtttcaaactcgccgtcgcagacattctatccggctctctcaaggatgaaatcttcgagcccgtctctagtgcgagcccagtcgccccggcttggtagccggcgaggttcccatccacctcacatccgaacttcctcaacgcccatggntgctccgatacaagcttcgcctgcgcttaacagacgccgtgtttcgtcctacgtacaaagtcgtcgtcaatctcctgcattgcttgtcaactcccaatcggcaatcatgaagcgtcgtcgtacaaggtccccgagccatcgctttacaccaagatggactgcatcgccgagccctatgcccatgggcctcggcgatcgcaacaagcacgcggaactacacccttcgcatatgccacaccgttcaataacgctcctcttcaaaaacggcctntgcgttttgggaagtgtggccccccgctgctcaanaaaattcgatgatgactcggatttcaacatcgattttttaccaagagnggttctgacg

SEQ ID NO: 1913 - DNA, 1240 bp, Fusarium venenatum
  misc_feature (1)...(1240): n = A,T,C or G
caacttgttcctcatatctctcctggatcatcaaattctctgcatcttcacttttcgtcattccaaaccattcgcgaacttttctcttacacctatctactagatcgacttgccaaccagttaaatactgtccactatccgccccctcctgacaatcattcgacgaattggcgctataacattgtctttctatcgatacaagtcctgcgtcaagaagtgtctcgttgacaatctctcacttcaagggcaaaccaccggcttgaccaaacttgaagcaccaacacatcgtctcacgcatcccatacatatcctcaattaccacactctcaaatcgcctcgcgctaacactgcaccctttccatccagcaaaaatgacccgatctcacaaggccaacgaccgtgaccacaagggcattgccgaggggactatgctccccacggaaactgtccctcgcttctttggtaagaacggntttgccgatgtcgaccccaagaaggtgaaaaaggacggctctggtcgaggcaactggggaactgtcaacgatgacatcgctggcgagcagttcaccttcaccaatacccgccgccgntccaacagtagcagcttttctcatgttactgatttcaagacaaagtttgaggtcaacgagcccgagcccgtgttcgaggagtcgctccatggccccgaggaggaagaccatgaagacctcaccaagaccgactcttccgagagcggtcgatcttcgtcttgatcgatatattccatttcactaagggatcggcagttactgcttgttactctgtataatgacagcagcacattaggtggatgacatgttctgaaattgcgaagggcgtttgatctttcatttaccactacnaaacgaagatgcgatgaaatgaatggaaaccggaaaacaacgccattatggcgacaactacggatcaaacagtttggaggatatggcagcgattatggatgggggataaaggctcttataacttatcgatctctacgcagatcatggcttttacgacctgctgcgaagttatcttctaagcggaacgatgtatcacttgtatcaatatcttaattagctttaccatcaaagcgggcaatgcagctaggcacagctgacgaacatcagacaaagacgctccatgaataaggttacgtgaagacgaacttgatttcatatgatatcctcttcatgaatgttctatccatctcttattttct

SEQ ID NO: 1914 - DNA, 626 bp, Fusarium venenatum
  misc_feature (1)...(626): n = A,T,C or G
cagcattacaattgcgccgagcacttatctcatcactgntgttctcctacttgtctttgcaatcatctacctacctcgtcttatcgcctgccgattccccagcctcggcataccattgccatctntggcgtcaatattaaggccaatatttggagatccagcagatcatcgcccaccagccagatttgaaaagcccctcccaccaccacccttcgcagcatctgcgcttgtattcgaggatcagcaacaattggtcgtctccggacaggatatcgtccttgcgcaacgtcgtcattaccttcaacagcaattggcgcaagagcaacacctactgcttgaacagcagaagcaacttcaattccaagaaatagagcgccgtgttcgtcgagactctcgccatacctcatcaccttcaaaacatagccgtgatcatggatcctacgacatgctggacgcgtccctacaggacttcgatctcccaccaagtccatcggtgcccaccactaacccaccggagcgaagcagcaatgacagaaggggatctcgaggacttcgganaccgcgtccgngggngggtnctcccctccccctgganaaaactcggaaacggaaccggagtagtggct

SEQ ID NO: 1915 - DNA, 520 bp, Fusarium venenatum
  misc_feature (1)...(520): n = A,T,C or G
cgaagaggcgttgacaactcttcatcagatgagttcgcgtccagcccaccttcttccgaaacacgcggtggaatccttcgaccaccacctgctaggcctcgacnaaccggctcactttccagtaactcggctcttggtagctctgtaccacaatctccatctagtgctggggggttctcatcaccacagggcgttgctagtcaacaatcggaacagttgcccttctttaaggactattattctcaggatgatattcatcccggtgacaaaatcgccgctctttgggcataccaaccccgagcagccgatgaattctctttggancgtggtgatatgcttaaggttgtaggcatctgggatgatggttgggcgacangtgttatgctcaatgancgggcagatgaatgggaagctcgacnacaagctcaacgcgatagtggcgtctcgaaccatcnggtcgcgtgacagctcaccggcggcggaaggcaaatcaagcatccctcttgtctgcgtttgccga

SEQ ID NO: 1916 - DNA, 336 bp, Fusarium venenatum
  misc_feature (1)...(336): n = A,T,C or G
cagcaacgggaattggtattgctggtatttccggatacttcatggttgtgggatcaatgggaatgattgccaagctgagtaacaaggaccagatgaagcgtgtgacatgggcaccaggtacaccgctacggacccgttggatgananaagaggagcgagcggcaatggacaaaattgcatgtgcctggggattcaaggaaccttggaggcacggagaggagtctgggcctgagtgggagggtctcaaggagtacatgggataccgccagatgattcttgatcgtgttgaattcatggagggcatgagctaatcctacattgcccctttnggggggc

SEQ ID NO: 1917 - DNA, 266 bp, Fusarium venenatum
  misc_feature (1)...(266): n = A,T,C or G
tgatatcacaatcgcactgcgggatcccaatatcctagccccattactgccgttggttgagcatngagcggaagctgtaaagctgggtgcatgaaagaaggctatagtacacaacgtataagcttgagtgagacgggagtttnaggagttcggtacatttttatcatacgggttctttaacacaataaagnggttacggaactngtgaaaccaanaaacttagttatctgatatcaaaaaacgctgctaagcagtttgttaacttg

SEQ ID NO: 1918 - DNA, 795 bp, Fusarium venenatum
  misc_feature (1)...(795): n = A,T,C or G
tgcttaccaacattctagtgctccgccgcctcaaggannctattacgcacctgtccagtcaccaacgggagtctttctcgtcttacggagatgcgagaacggacgacggcngccagcttgcaggacggcggcgtcgtaggacttcagaggagcaagatgacgcctacagattacctccgccacgaagcgctgtagacgaagacccacgacgaagatccccagccgagttttccaaccacagtagcccaggtggtgttggatatccgccataccaaggtgcgagacaaagcccgcggaacccgacgagcggcactctgcctcaggctgcagcgactggtagctatgcaacttctgcacctggagggcggtcaccgacaggtcagaatgggtcaagtggtgcgtccacccccgcccgacagggacagcaatcccaaggaggaaatgcatcgattatgagtctgagcaacttggtagaaaaaaacgacattgataagaccatgatcgacaggcttaacccgacctgcaccaggtcagccaagtggtcgacaagacgccagccgttgacgggcgaatggagttacaattgacccttgccggacaggtcaacgggaagaagtcgaaacgacccacgacaatacttgctgacaagttgatgacgattggttgcttttaataccttatncaattcgatcnttccgcctacantttcggttgacccgggatgagacaggagtgtgatcgcgaagaagaaaaaaaaaacaaaaaagcggnggggcagggcgacaacaatacaag

SEQ ID NO: 1919 - DNA, 613 bp, Fusarium venenatum
  misc_feature (1)...(613): n = A,T,C or G
ntattcgcctnagcaagacagtntcttacgtcaactcaagctttagangggtctgcgatttcgtctcgatcaactttttgccttgcatcctcttcgccaacgttccactcaccccctccatctttngtggtactactgtctgncaacaccacccttcctacctctagcacatgagccgcacaatcgcccaacgacggttcgnggccatcaacccctcccttgtaccagtttgaagccattgggccagcctgcatacgatccgtggtcccgcattcgagccacgactgtagacgtggnccgcctgtcctcattcgatctctctccacatcgcttncttccccacgcgacttctttcatctcgctcgctctntggctcttnagtttctccctcggcctcattcccagctcgagcccngagagctgntgctacttgcattgnaggacacatacggctccagcgaaacaggtgcttgctctccttncccgagctggtgttcgacaggcaaccaaaacattttncaacccnggngtcgttatntnttaccgcccggtcttnaatcgactttgacacnggtcgngcctttaagtcacaaaaaatactnatattctggna

SEQ ID NO: 1920 - DNA, 594 bp, Fusarium venenatum
  misc_feature (1)...(594): n = A,T,C or G
gagatgatgacgcaggctatgcgaatgcagcgacaattgaatggagaagcgcctggagcattccctgcccctggcgctaccgatacnacacctcaagggagcagcgaccggagatacccaggggtaccggtggtcaaacacaggcaggccaacctcctgtgaacccattcgctggattatcaggtntgctgggangtcagcaaggcggaagcaacccgcctgatttcgcacagctcatgcaacagctccagggtctcggttctctctacgganctggangccaaggccaggctgcnacaggacaaacaggctcaaccaacacacctagccaaggtgccgcagatagtacaactggcgcgcaaacttccggaacaacaccccgccaagtggtttaacacaaggctcaaccactaacccacctcccccgaaccatttgctgcctcttccctccttcccgaagttccccaagcccacatccctttngcatgaacccgaaatnaagcaccaaatgatccaattttcgcgcngtgaattggcccgggtttaaccncccgcncccccnaataaagcnccctaagaacctaccccaaacaa

SEQ ID NO: 1921 - DNA, 1361 bp, Fusarium venenatum
caaccatgaatttggtgagacctaattactgagtgtcgtcttcatatccttttctttctactctctttttgttcatttatttccttcttgtatcatttgtgataacttcactttttgttcacgtcttataccatcgtcaacatccgatagtggggtcggcaacaggcgacatcgagtggatcccgttgatccctggtttttcgggcttccttcctacttcccctacgggcccaggacagggcgtctctagctagaacgcacgcacgtacgcactgcagagtcagctcattcgaaagagcatgccacctctcgaccatcaacaggcgaacgccgaacaaagacttaattcaacagtagaaccagaccacgattgatcacgacaatatccttttgacttacctctcgccatggcctttctgaccttcttttctttctccaagacaagcgaaactcactttaaagcgatacgaagtaatgacacgcgcgacgcatgagaatgacttcatttccaggaacagaccccacgtgatacgcatctcatgacaatctttggacctgcgataagcaattaagctcagatcatatcgacgccgacttcacccgccaccttctctgcgacaatattcaggaattgcatccaccagcgttaatttagttcatcttcaacacatggaaccaggattgattcaatcaagatacagtaggtattgggttttgggatgtaaagactgacataccgtctagttgtgccaaccaaaccataccaaaaccctccacctctgctcgcttccactgtgacgtcgattcaatcaatcaattcgcctttatccgaaaactttccaattagcatagcccgcgtttagtttgttagtcttcagccagacttcatctcgtttcgtcccgtacagcagcgaacagttacacaacgcgtgtcgcccgtaaatctttttcgccatcgtcgttccgataacccgtaccgtccgttacaagaagtgaagcctaagcaagatcctttccacatgcaaatttaacaccatttccgatgcacacgtgatggatggatggatggatggatggatggatggatggatgaataaacacgccaatgtcgtatacgattgtacaagtgccaatcgatggccaaggcgcggaggataccctagagcgacaagatgggatagggaagattttatacataattaattcacgatggaggacaagtttgggaaacttgggggaaagtgtacggattttgaggagcattatcagttggacagcgggaggagggaggtcattcaacgtcaacaacaaataaatcaacattttgccccggagctctcatgaaaaaaaaatgcaacacc

SEQ ID NO: 1922 - DNA, 531 bp, Fusarium venenatum
  misc_feature (1)...(531): n = A,T,C or G
ggagaacagggaaaaaaagcctgaagcagtgtccgcagctcccgcaaccactaatggcaagcccaaggtcggcactgttaaggagctggctcctgcagcaattgtaaaggccgcactccgaanaagacgactaccgctcgacccagtgccatttcgaccaaggctgccagcaccaagcctccagnaaaatcccnttctgcacaaagcctnctaccagcaccactnataaacctgagagtaagccaacagccaagactgtcccggtngctaagaaggaacccagacaagcttnagtcgccacttccacagccactcggcagctgngactacagccagcaagaaccgcaaccattgaacctcttctagcgatctggtttgggaagccaagccaaatctccacaaacctgggaacttctgatttttatggcccactgggggnttggaccaaanaggcgcagctcaccgataagttgaaaacctacgttctgttcggctggaccggccatgcaanaggaccaggccacctggaaa

SEQ ID NO: 1923 - DNA, 637 bp, Fusarium venenatum
  misc_feature (1)...(637): n = A,T,C or G
gccacgaccgctgatactgacactaccgcgtatcgcgacgaggcgcggccaacgccccgacgacgacaaaaaactaaccaaggctttcaaattgaagccatcatgaccacacccaccatggcccagcccacggccatccaagccaacggcacctcagaatcgcctaccctcgataaggcgcaatccgtcgccccgggaaagcgaaaacgcgatgttgaagaagaagaagaagaagaagaggatcgcgatgaggaaatggtttccgatgagcaaaagcctgccattaccaatggagagcccaaaaaggaccaacgcgatttgataaaatctttcgttgaagtcctcagcagctacgacgtcggtccctccatcctcaagcgcccccttcccgaatcctctgatgatgacgatgaagatgatcaccgagtaaagcgccagaagtcgaccgacccgtccactatctccgacaaggctactgcgaatgtgtatgaggatcttgaccaagtggctgatgacctcgtgtccgcaattcatgtcgctctcaagggaatcaagatgcaaccttccgagaacaaagatgagtcggccgacgatacanttgaggacacaaatcgttgatttcaaggncaaaggcata

SEQ ID NO: 1924 - DNA, 558 bp, Fusarium venenatum
  misc_feature (1)...(558): n = A,T,C or G
gacgaacacaatgaatacaatgttcacatcaatcatgcgtctcgcgcgcccggtcttgaccaagtctctggctcaatcgcccaggacattcacgaccctcgtccctctccgaccttccctgactcccatgaacggcgcaatccgaagaaccgctctgccatcaagcttcactccttcgacagctgcttcagccgatatcgtgccctcaagcgccatcacagcacaccccgcgatgggcgacatgcaaatccgctgcggacctcgaaacaccatgaacggacacaccagactcgtgcagaagcgcagacatggcttcctcgtccgtaagcgaagcaagacaggcaggaggattctcctcaggaggaagatcaagggccgaaggaacattgcccagtaggccatgcatgcctgctgagacatttaggaggntggatgacacgtcaatgaagccacaccggcatatgtctatacnggaaanggggtagagggcggcggtcttgggggattcagatgtcttntcagcaccctcgtgtgatncgaaatctgacaaagactncc

SEQ ID NO: 1925 - DNA, 427 bp, Fusarium venenatum
  misc_feature (1)...(427): n = A,T,C or G
ctgagaacggtgttgacggatcagcattaccttcctcagctaactgggcacgcaatccacagcggagtcgtaggggcagtctcgctactagtggtgccgcgtcaagccctgctatctcggcagctcagcctgtnaccgctgagcctgttccggaagaagcagttgaggaagaagaggatgaagatgaagatgaggaggacgaggaagatgaggaagacgangaagaagagcctcnccagaggaaccggtggccggaccctcttcatcccgtgcgatggaacccgaatctcctgcaccagccaggaacctggctganaaggggcttagananatcctcaaggtgctgggttacactccctggcctccttcgtctaccgctgcacagacaatatcccccctgttcgatcctcgtggtggtgaaaaacgc

SEQ ID NO: 1926 - DNA, 605 bp, Fusarium venenatum
  misc_feature (1)...(605): n = A,T,C or G
gtgtcactcttttgcagctctgcaaagacaaaacctaatattattgggcaccattctaaaaatgagcagcttcgcatgcctccaaagttcccgtcgggctctgtatcgagtctttatcgagcgcgaagctcttacactccaattcatcaaaccaacacaacgaatactaccattataccagaatcgtcgattctctgtgtcaccactacaattgaagggaaaggctcgccgaggaaaagatgttctggatgatttggagacggaacccgatgaggatgaagccagagcctttgatcgacgctacaccacccaggaagatttcatcaaatccggccgcgaccgtctccctatagatttcgagataacggatcccaaaatcatggttcttgacaatggcgtctcgacggaccaagattacgcgcaacgtcntgagccgcatcgacacttctaccgattcctccgaatggcaactccctacatcccgccgatcctaaaaacacaagccagcacaatatgcgctatgcnagatctccnccngaaggaagaatncaaagacagcgagagctcccccgcgtctcctttttttnccgactccccaanaacag

SEQ ID NO: 1927 - DNA, 267 bp, Fusarium venenatum
gggaaagccgccaaggtgaaggaggctgctgccaaggtcgcggagaaggaggaaaagcctaagaaggctgaggagcccaaggaggagcccaaggaggagcccaaggaggaagctaaggaagaagagaagtctgaggaggatccaaagactaaggagcccaaggccaagaagtcaggaggcaagctcgaggttggcgacgttgtggaccttgatgattttggaggcgaaattggaaaccaacgatggcgacaagactaccttgaaaaa

SEQ ID NO: 1928 - DNA, 559 bp, Fusarium venenatum
  misc_feature (1)...(559): n = A,T,C or G
gaaagaaaggacaagaaanagaagcgacaantccggcatctccaancccangaaaggagaaaaaaggataagaaaggataagaaagganaaanctcgccgctgccctcgaaggaaaaaggtccaccaggatgctcccgtcnccgcttgccgctgctgaaaaacgaacaactccaatgttgaaggaaggataaaggctgctgaacctgcctcttgagcgtntcntcctttccctttgccatccccgttgcagaatgacaagggcatgaanaaaggtctacaagaccattcgcaaggctgccaagaacaacacctcaacccngtgtcaaggaagttgtcnaaacctccgaaagtctgcccctccggtcctggttacacctctttcccngtgttgtcatcattgctggtgacatttccccatggactcatctcccacctccccgttctgtngcgaagacacaacgttccttcatcttcgtcncgttcncgcgctgaactcngtgccctgccnanacaaagcgaactacatccgttgtcntgatcatgganaaacctgaaggc

SEQ ID NO: 1929 - DNA, 632 bp, Fusarium venenatum
  misc_feature (1)...(632): n = A,T,C or G
atcatgcgtcccacctcaaacctcctccaggccgctgtctgcctcacttctcttgcacctttggctacagcatggcctagttggtttaccaacgccgactccgttgtagttcgacgagttgtcccggaagatctgcctctagaaactcaagttctcaagcctcgtcaagataccacgactgaagaggaagctacaagcaccaagaaaagtcccaagcagaccaacctaaacacagctaaagtcgaaaccggaacagagactgggactggcaaccgaggaagattccacagagacacggaaaaaaaaaccggaaaaaaatctgggcaccaaaaatnggaaatctgccccaaacgcacaaccttttctgncgatgttaacctgcggtttgagtatgacgctgctgacaccatgtatgtccctacgcctcttatcaagatcggcgactacgccacctttggctggaactacacctcgctcgaaggactcctactgcgatcgacgtgcttgtcagtcaatcctccgntggcgaaacctacactcttactgccaacatgacttcgagacgaacccactacgttgggatctagcaaggaggcatgatcctgatgctctntcctgtggctgtcactttn

SEQ ID NO: 1930 - DNA, 259 bp, Fusarium venenatum
agtacatgccacgaaagaaggagttgtgcgctatttggagtctcatggctttcagcgcgatggcggtcgaatcgctcatcgtgtcggaccggtggacatttctcaaagaacacgacgatcttgttcgtcacgcgtgggtcgaaacggtgtttgactatggactgagtccaagaaacctggttgtcgtaggagttaagcgatagataaactttgagctagtttagaataggaatgatcaacaacactctgaacgctattg

SEQ ID NO: 1931 - DNA, 339 bp, Fusarium venenatum
  misc_feature (1)...(339): n = A,T,C or G
atctctaccgtcaacgactccatctctgagtcctcagtccacaagtcttccatcccaacaaaggtcgagatgagccagcatgaaaagtacagtgaggcgcccagtgaggcgcccacaatcccacccccgcctgagcagtatgcttggagtagggtcaggggagaaactgtcagggatgcttttcggaattctttggtactttcattcttctcctctttggtgacggtgtcgttgcccaggttgttctcagtcgtggaacaaagggtgattntcaaagtntctaatggggatggggtctcggngcatcttggantgtttgtnggaggtaaattaagcggt

SEQ ID NO: 1932 - DNA, 422 bp, Fusarium venenatum
gtggagagcagaagtacgtacgataccagatgaacccacgagaaaactggggtcctttggcgaaggcagcccgccgatagtaatgtaaatttgatcatgtacttgctctcaatgtttcttttacttcaccggctaaaacaagcgatccttgagcagttgaaatgacgacacatgatcgttggtgtgtctgagtaggcattatctgttcgtcagcaaaagccccacaaaggcctacggaagtattgctgagggcttttgagcttgacttgttcatcatcttcaatctcaacaacccgaatacaacaccctcgagccgaacgagtactgtatcctcctttgacgggcattttgcatttgtttatttcgcgcgtatttgtgattggctattgcgccagaaatcaataaagataccatatccttcc

SEQ ID NO: 1933 - DNA, 448 bp, Fusarium venenatum
  misc_feature (1)...(448): n = A,T,C or G
gggtggtgaagcctatgagcaaggtccgagacaccgcgcgacaattggaagacactgccatagaagcgcgacgaatcactcgacagacagcgcgaaacgtaccggccgaagaacagatcgaccgaccaaccgaaacccgaaagagtancggcagcggcagcggcagcggaagcagcgatggaagggcaatgctgcagaagcgttggatctcctggcagagtcgcgtanggagaccaaacgactgcaggaagcgctgaaggaacagacagtgcacgagatgggcnagcagatggtggagatcnaggaacagatgactgaggaaatacaacgagcccgtgagcagctcgaactatcgcgacgaatgcaatagacggactcnacgatcatatgctgacgtccacactgacccgtccctacccncaatgatcnaggacttactctcctccaa

SEQ ID NO: 1934 - DNA, 479 bp, Fusarium venenatum
  misc_feature (1)...(479): n = A,T,C or G
aaggagaaaggtccagcagaattctgcgaagaatgcgcgcaacaaagggtttcgaacaagaacaaaanttgaacgggctcnactgccaccaattgggaagctgtcactccaaccatnaagaactgccaactttnggcttctctatgctgaaaccgccttaaaaccaaagtggttcaacggggttgaatcctttcgaactcnttggcatggaatgaataccatcaatggcttccaagccaagatngccgaagggcaactacctggaaggtcttattgataagtaccttctcaacgacaacaccctgactttcactatggccccctccacaacatatggcgaagacctantganggaagancaggagagacttcaccaggatccagcggcgatcaaggaaggccngaagcnaagaaaaagcncnaaagccctttgagaanccagaacaagaattgtttgtctagccgaacaagacaacacc

SEQ ID NO: 1935 - DNA, 686 bp, Fusarium venenatum
  misc_feature (1)...(686): n = A,T,C or G
gaattttttttttttttttttactaagatcattatcattattattcatcctccacttgcctttgccattctaacaatattcgtgccatgttctagaataggtaggtacgtagatttctttagaaggcaaatgctgaataatgtaaccactactagtacgctaaaccgctgtcaaacaactgtagacgataacgttatcaatctttcatgattgctacatgggcacacccatgtaaacgctgtaattacacatttggtttaaacaaaagatagcggagacctgtcttgtaagaaccagagctagcattaagcttggcaccgcttacttcgttgatatagctttctctgcttgcaaagcttcgagattgcttcatagcaatcggatcggcaacgctagcttcgttcaatgtatgcgttttaacccgaagtcaaatgttggtggcggacgcaggaacaagttcaatgatcactggccctggacaangngccgcatgggccatgtncaacgtttcaagtgcacaattagaacaaaagttaaaagaaaaatcttttggtccctaccatacaagatcaacgtcgcatatagcaacatgctcccacaagtggaaccccgacccgtaatctataaacaanctagcattntaagccagcatntaatgatcggcacccaaacttccgaatatcgct

SEQ ID NO: 1936 - DNA, 633 bp, Fusarium venenatum
  misc_feature (1)...(633): n = A,T,C or G
ggaagatatgacttccggtgaagagtctgaacttgctgaaacaccttccgaggtcaatgagatgaagagttcttctgccgtacgaacacccatcgtaatgcgcgtgcctgcgaaggctaccaattctccatccgtcatggacacagcccgttcagccagcaacaaaggtcgtgctcctgttgctttcaagaccccttcaggttctgcaccacgcggcacaactgtcgtcctttcggatgaagatctcgatatggaggatgctgacatgagtcctaacacgatggtcagcaataatgcaccttctctggttagtgacgacggggagtacgacgatactgatgatggctcctcagtttctggcgccagtgatgctcttgagacggagtcggtatcagacgtggctgaaataacacttgacgacgaccaagacccgcgctcactgcgccgagagtctagcggtgtatcgggcgctgtaaggcttcgtaaagatgattcgaaacacatcactctgatgacgcctgtcaagaacaacgccagagaaagacgggcacgcaaggtctaaattatgggaatccttcgtttttgcatgtgccaatcgctcaatcaacaacgggccgtncaancaacaancaa

SEQ ID NO: 1937 - DNA, 352 bp, Fusarium venenatum
  misc_feature (1)...(352): n = A,T,C or G
caaaggtcggcagacaacaatagccctggcggttacaggtcacaaaacaatgtcagtccttggcagcgaggtgctggttacgagcactaattgatttaactctagaggaatttacctttttattttatctcatgagagcttatacctagactnttcttaagggggtagactttgcatttcacgcacttggtctatgcgagggctgcccagcagacaaagccctcaggattttntgcttgnggatgacnccnagtganctntgggctcgcanccagtaattaacattncccccnctaagaaccgggctttattttttggtgggtttccctttttctnggagggttttttnccg

SEQ ID NO: 1938 - DNA, 637 bp, Fusarium venenatum
  misc_feature (1)...(637): n = A,T,C or G
agcgtatcagacatttcaaggaaaccttcggttcgtgcgcctaccactcccaagtcaagtaagagcagtaataaagttgaatcgcgacctttgcaatctgctcgactggatggacccatacagcagccacgactccaacggcgggacagcgaggaatcatttcacagtgtcgagtcgtggcattcgtccggcgttcccatacatccttcgccacccacttcacaagcggagtctgctgnttggggcaaagtacgaaatcaaatgaaacggacgccttgtccggtgggagatgcaaaagaaaaaagtcttcccgaaagaagaggaagctcttccaaaggccaggcgcctggggaatctgaccctgattccgacgacagcgagtcgtccagcgaaagcgcgaacctgggaatcaaagacacagtcgacgttgaaaccaaagtccactcgtcggcagcaccaccacaacggccggttataactcgtcatagagcgacgacaagtagcttatcagtacgccagcgggcactttacccctggccctgctgcgaatctcttnaccctgcatcaactatggaaagacgaccttacagaagtaggcttggagactgncaaagaacctaccaatgggcatcattgg

SEQ ID NO: 1939 - DNA, 459 bp, Fusarium venenatum
  misc_feature (1)...(459): n = A,T,C or G
nggaacctgggctccgggcctcctggaaccaactaatccaatanccctggagaatcancctcgggtgganttcaatccccnaacggttgnactccggcctggccnaacaatcgggtaatccgttacaagtacccaattagctaanctaacctaacctaactaacctaacntaaaacttggaccaagactcaatttggtccgctccgcaaaaacgggaacgggancaanaacaanagangggccaaacccccancanaagggcccaagggccaaagacaagacaagggccaaaaggccaacccggccgccgtatccaanagncagaagccacttgctccaagatttcggagctactagaactgcctgcacgtcctgaacctgccggtacggagcctggagccatttgcccacgaactaagggtcnccttgaancctgtacgcgacaatgtcgataaactg

SEQ ID NO: 1940 - DNA, 561 bp, Fusarium venenatum
caacactcgcttcaaaacacactctccaaacaaaaaaaccaccaaccgcaaacatgaagttcaccgctggcgccatcgctgccttcgtctccatggccgctgcttctcctcttgatgctgctgccggcggctgcaagcctggtacctactcttgcactcccgacaagactggctggcagatctgcgatgtcaccggcaaatacgtggctgctggagcttgtcctcccaagacttcttgcgtcttctacaagaagagcgccagcccctactgtgtccctcccggcttcaagttcccccagaactaagcaatctctcccgatgagatagccgtgagagtggactctcgataacgacttctatctctgcgacctttgggttcaaacttgagcatttggtcttttttatatacttgttttcatgcacactgcatgaggtcctttccttagaaatgtttgatagatacatggcacatatacagaaacagcatgtgggggttcaagatcgtatatagttactcaacatagcatcttcaatctactgcattgcccctttaaaaaaaaa

SEQ ID NO: 1941 - DNA, 603 bp, Fusarium venenatum
  misc_feature (1)...(603): n = A,T,C or G
cggcggggagggggaatatttntgtctncgtaccgccgacaggtcctctctcgtcaagagcaagagtttatcgaagaagaggtcatattacgcgtgaagaagaacattaccaccgtccggtgtncaaaaattcgagcacgaagactttactatccgtgaagactcccgacgagatcgacacccaccgtcatccctactactccacccccattgatctcgctgaacgtgaataccgccagcgttaccgcctgccaagctttttccacagaagaccttcttccactctcatnctcactaccaacctcaagacaacttcaaagccaacaactacaccgttgaaggncgcccgctcccaattccattcctctgagaagactgaaatcaacaagtttactgntgcgaacactcctntcgcctnagtcaaccacaccgagaagacgaattcaacaactacactggtgcaggcgatcttccgtcctcaatacaacacctgtgagaagactgagatcaacaatttcactggtgcgcccgntctttccagccacggaccgngacaccaagacactnaagtnaacagctacgccgtgcaagnccggttntngt

SEQ ID NO: 1942 - DNA, 575 bp, Fusarium venenatum
  misc_feature (1)...(575): n = A,T,C or G
tcgcggcctcaggaattttttttttttttttttttctgattcaacacgtctcgcaattaaatgaatgtaaattatttgaaatccaaacctagaggtccaactcctgaacgcccagtanattctatgcagngatgtatctgcgcctgtcgactaactttcgaatcacaatgctttnggtatcttaatctctgttttcggcggctgattcagttctttccancaaaggcagggttctgctccattgtcnaanagatgtatcctctcaacgccgcccatcgattcgcagtagccgcaggagcagtctttttctcctcgtccatattttcgtcttgnggcacaggctttgcctcatcctgagccgttaacctcgccatactaactccaaacctctccatctcacccttgacgaccttttccttnttnttcagcgcacccttcttgctcttcaaactattgngacnaatcttgccctgttgctctgcatnacctcctctagctctggcagcgcatcagctanactgcaagagnggnggcgagcttnttgganggacngcgacncttggtaaactttgaaa

SEQ ID NO: 1943 - DNA, 238 bp, Fusarium venenatum
  misc_feature (1)...(238): n = A,T,C or G
ntgaggctaccnaagttctccttnccnccgaanctatntttagcaacggggccatntacgcccgngcaggctcangcgacattgctacaatcgctactgaccttggtgtccgcgtcgcccctctttnccaaaccataaacntcaccgagcgnttgtccatcgactcnctcacttacaacganatngacccngagcaatccaccgacgnagggttccnnttgctcttngatactacncg

SEQ ID NO: 1944 - DNA, 643 bp, Fusarium venenatum
  misc_feature (1)...(643): n = A,T,C or G
ggaactctctagctttctcgctcttaatagttagttcgacatcttattttgggtgatcaaagataaactcggcctcctcacaatccgttccttttatttatttatttatttttcttactccattaatcaagcaaagagggggaatgaatagatcaacctccactctttcaacatcaccaaacatcctcagtacaaagagagagaaagagcctaactattaactgcgccgtaccaaccaactctactacaaccacgtaacggtaacttggctgttgggtcacggatggatggatggatggatatcaaccatgacgaaccaacaagacacccccacagctctaactcctactgcgtccactcctcgtacttctcttggtccccccgctcagcctgattcaacttcagcttcagtcccagcttccgcttncactttccgcttctgnttcttcatcttcccccacgcctcaagctgaactcattcccgcagangaccccngagtatgtcataccttggccacaaccaccaaccaaccaacaagcacagaattggagagnccatttggttaattataatggccttgatatggttattggtaacactttggcttttttcgnatttttggangganaacgtcgatcatga

SEQ ID NO: 1945 - DNA, 522 bp, Fusarium venenatum
  misc_feature (1)...(522): n = A,T,C or G
attcaatccaaatacaaaatggcggctaaaagagactttgaggatgtcgatgaaggcgatgcttcaaagcctacaccaaagcgatctaagaaacacggcggcaaagcgcgacaacatcaaaactctggcattgatcctacctggggccagaaatatgtctttgcagacaacgagcatgcgacaacgattcccgcaggcgaagantctgatttcgaggacgatgcagatgccntggcatatttaaactcagttcgacaacaagctgccggaatcccccntttactcgtcgcacctaaagtccagatcggacctcagttgcccgccgaacttagaggtgatgatgaagatgatggagaangaccgtccacagggagcctattccacgacngtnttggcgattctcggggctggttccaagacggcgcgttcatggcgatgcccgacnaaaccaacgacgaagggaaacttccaanaangagaatccccgaanatgacgacaaccgctttgatgaaaaaatttct

SEQ ID NO: 1946 - DNA, 509 bp, Fusarium venenatum
  misc_feature (1)...(509): n = A,T,C or G
ttactcgccgcctataacatttcctatgaatcttcaattatatcatagctactccgaggaaactttgcagaaatgttctgacaccatgtctcgccaacatacatttcacaacagcgccacggattgacaatcaagtcaagcacaaccatttcccgtatctaattctccgagtgtttcttggcctcatactaactgggattggaactgacgtcccgccaaaccaaaattcccttggcataaagacccgtgatgatccccactcgtccacccttgacaacagtcgagcttgaagggtattccgtatcaacataaaggttcttcaggccctcactctcactccactcagcggcccaagaagttgcctcggctgtctcgcagtactccttggtcttggaattcgcatgttcatactccacgggatcgttgcagatgcgtcgtgactgcgtaaactttaccaganaangcatatgcgcatgttccgcgatcatcaacttgtcaccatatccaga

SEQ ID NO: 1947 - DNA, 114 bp, Fusarium venenatum
  misc_feature (1)...(114): n = A,T,C or G
nacanccagngctaactttttggcaaancattgnacgtgatgcnccatgtacntgaacntgnggacaagngctngggtnattccgggtgncnacaacgttntgaantatcctga

SEQ ID NO: 1948 - DNA, 238 bp, Fusarium venenatum
  misc_feature (1)...(238): n = A,T,C or G
cnagcagcaatctcaccggngagtaccatgggtcagctggcaagactgaggtgncttnctcttgctccagtggcacatttccattttgacggtgacggaagtgcctnctataaagactggncatgctcctttacggagacgcttctntctgatggctnntgcaagacgatgcaataagaggagatcttncttgctnttatcgngcaaaancttgggcganaccatgggaacggnttgg

SEQ ID NO: 1949 - DNA, 1151 bp, Fusarium venenatum
  misc_feature (1)...(1151): n = A,T,C or G
aactgtcactcatcgacttttaaacgccaaagatacataatctgacatgacatttgtcaaaggcttaaaaggaaccgagaaccccctaataagcttgtctgtttcttcttgggtggggggggagataaactcgatcacattttggatatacattttgtctacatacctcttccacccataacctatccatgcctgagatacgtccaagcctccctcagcaatatcaacaactgcgccccgacccgcttacgttgtcaatacacagcgaggcctcattatatttactttacaaaagtcaataaccaggctcttaaacgtttcgacattcttctctttggcttccaggctttactactatacatatcacgtcctacccacccacctctctactatatctcgccagtacctccacacatctactctactacatatacctatccctcttatactgtatagctctataccgtgttatcctctcttacatattatcaccttcataccctcgtacatactcactgtacaaccacaacctccatcaatatgttgccataccgtaattgcccagcggatgtgcaaggattgccgccacagcctaggcgagacggtcatcgatttcacacgctgtgctcgtaaatgctcgagccctttctactgccttacccctgagcctcagatggagctgtgtaacctttgtgccacaacgtcgacactgtctacaccggtactcgcaccacatgctcttgaggacacaaccactgcagccgcagcagcagcagccgnatcggccggcacgagactttaccatcattcgattggaaagacagtggcctatccaggacctggagtagtccggcacactgcggccactagaagtttgcgacaaaccatgacaaaatggttcgattacccgacattaaggggcgtcatttgtgtaatattttgaaacagggaaattgaaacgaccgaaacgaaatttgaccaaaaaaangcgtgttttnggaaacgaacaggtattgatacgggcaaaccgacagaagggtcaangggcgcatttggacagganttnatcaangctttgntttgctttactttaatttaatttcatttttgggntaactttanttcaatttccatatgtaaatgncacttta

SEQ ID NO: 1950 - DNA, 589 bp, Fusarium venenatum
  misc_feature (1)...(589): n = A,T,C or G
cactcaacgacgacaacgaggctcgactcagcagccgccgtgagaatctcgaccacgccgcgtctttgtgatttctctctccttctacctcacatctcgactttcaattcttctcctaagacaagacagcacagcagcatcagcagagtacagcacagcacaacacaacacgcacagaaccccatcccagttccagcattcgtcctccactcctgcgcaagtaccagcctgcctgcaccagcaccagcactgcactgcaatcaattgaaccgcacgataacccaccgtcgtccaataccattctcagccctggctggttcagtgctttatcgtcctcttcctgcatgagagtaatcgtcgtatttcgctccctcgagtagtctttcttcattaggtgctgtttcagcctcctcagcttcgantcctccagctctcgcactcgcggttcttcgtccggctccgacagcaacacaacgctttcgccagacgggccctcttctctcgcctaaaaatcgtctgctaataacgaatatcaatatcattcatccctacaacgcttcggtgcattgaatcaattgcttgcgcatct

SEQ ID NO: 1951 - DNA, 719 bp, Fusarium venenatum
  misc_feature (1)...(719): n = A,T,C or G
ccccaggtcatccgtgcttttatccaccaccttactgttgacctgcgcctgacacctctctggatgcttgtctcttacgaagtccagaagattctcgcttctgagcttcgctggcgaagtttgacctgtaccgaggagcagcgtgttgatgccgacaagcataacagtgctcaaatcgagggattggctgcaaggcccgtcgtgttgagcgtgaacgantcaanatccacgaggtcaaggctgacgaaagactttatttctcgtgccaaccccgctatcgacgagtggaagaacaaccgcaagggcaaagcaagtgcattttacggaggttcgccatggatcgaccaggagcaccgccgttctttgctgncgaaaaggacggnanggcatgtctatggtcgttttggccaacttgttcttcgtacggntggcaagtgaagtgggctntcnatttcctggtgctgtcaacggngccatcgaggtctgggcaactttgcttgtccaacgtcaccggaaaggcacctttgtgcangtgtgtcggaaaacttacttgccgngaacacgttggcggaattccnccaagttcttnacgccncttacgaatttttattgacaggcttnggctttnccgnaagggtttntttccnatccaaattcggggccctgggganagganaatttacatttgttnttctaaaaaagggngttggcctgnccca

SEQ ID NO: 1952 - DNA, 637 bp, Fusarium venenatum
  misc_feature (1)...(637): n = A,T,C or G
aagagatgtcttctgcgtcttctctggtaccatggtgtccaagttccgcgactttctcaacacttcaccacagtttgaggatatgtgggacaatggctggaatcgaccagcagtcttcggctcacgacgccctgttgcggccagccagccaacagcacctcctggagagggagctgacgacgaaatggttgatgatgagaacgactatgagggtttagacggtagcgagatggttgtggatgcccaagcacagaatcccgtcaacggcaacggaaccgtgaaccccaatggattgacgaacaacgcattccaacaagctatccctatacctcctccacttcctggttttccaatagaaggcggagtgccacaacctacgaccagtcaagcgagcgcagcaccccttggccatgggggcccagcaaatggagaatcccctagtggcgcaagcacagcgacgatccaccggtcgcaggagaatggagatcaatctgactcgatgaactaaacaaccagaactttgctttcgctcacttagacaacgcaccagattggtttgggttctttccctctcatgaatagatatgcgtgcttgccacggcggntggttgacggacaacgttcaggatttgggttg

SEQ ID NO: 1953 - DNA, 614 bp, Fusarium venenatum
  misc_feature (1)...(614): n = A,T,C or G
ccgccatcttactgcatcgcgtctagcttgaccaagatcgagaacccacatctgtctnttaaaaggacccagacccaacctttcccgtgcccccgttcgtgaaacggattctacgttatactttatcgagaccctgttgctgctccgtgctcaccttagcttgacttcctacacctaccacttgctctcatttccctcctgaccctgtctcttcctcctcattcaacaccatctatctactctgtacctgccttcctgcctggacaatagcccttcctaggaatacaatattacctagntgntgttctcctcctctactctactctactctactctactctactctactctatctatctactgnttaaaaaataagcccgaccaactntttcgttccctgagcggcattgggttgccaattgccaccatcactcatcgcattcatctcaggcttttttgnccgcctaagccacctattttgttccgccacagtcactgtttttttccaaccgccgnctntgaaacgancacaatggatttaccngggcaaacaactttggcaacccttaagcctaccaacaagtttatgccgganttcttctttgacgccggnt

SEQ ID NO: 1954 - DNA, 577 bp, Fusarium venenatum
  misc_feature (1)...(577): n = A,T,C or G
cgagaaccaccgtatcatgtctagtctgccgcagcaagctcctttgttgagcgcaccaaaggctcgcttcgttgtcagctggtgggatagggaggttcacatctggcttcttcgacagtcagctaccgaaatgatcaacaccgagaacaacgatatcaaccaaaaccgcaagctgattaagactattgttgtcaaaggagattcgaatattacctcggcaactattgacgacgagggttcgcttctgattgttgctactgctatcgatgttaaggccttcagactagaacaccaggatcccgtcaggccctctgatgtcagggtctggtcttccgaacttccttcaaagcttgcgggagtcggtgccaccaangtcagctgtcgcctaacgcgcagtggctctgcgcaatcaagaangctctcgcgttgtcatgggtgcctcgaccccgttactccagacctgactgncttttnacactgtcaacgactgcacgcctacggngatcagttaacgtatntcctcaacggaggatggcaaattgacanggccattcgcaagtgctttttccggnttcaa

SEQ ID NO: 1955 - DNA, 797 bp, Fusarium venenatum
  misc_feature (1)...(797): n = A,T,C or G
ttcacttacacggcctttaccgatatcaacgactactctgacggtaaccgcgcgaccaaactgccaaataacacgttcaaatttccggtttgtcgaaagatataaagaggaacactacccttgcttgtacggaaatcacgctcagtaccaacgaccccggcacacgtttctttcccagaacagtgccctgaacgactcgcctatcgtctacacatatatatacacaaggcctcagcccatataataacaatttatggcggctatgatgtcgtctgtcaacccctttacaccggtgacccctccgccggagagcctgtcctttcctaaacttcctgcccaaaggccgttacagaacaacctcaaacgcaaagcatcgtcacaagaccctctaagtggcctaacaggtctcaacgcttccgcaatgatggcaccacctccttcaccgacttcacaaccccgacgtnctcgtcaccaaatctggctcanggncaagctctacagtacttcccaagtctagtggtgcgacaacacctgaaattnctaacatacctggngcaaacctcgatctaaatatttngcctggnattttcgcattggcgcctattattaacaaaggngccaggtgnancaaactaccacaacaacgttgcaggcttgggccacatgcntaggcaaaatgtanggaatgagcaggttttttgttgggggtggnttgggttnggaaaaccgtttcanccnaaaggaaaaaaanaaactcgtttccacccggntggaacccgggaanattcaaanagatn

SEQ ID NO: 1956 - DNA, 500 bp, Fusarium venenatum
  misc_feature (1)...(500): n = A,T,C or G
cttctcttcattcttcttttcttcaatcaacctacacttcatcgacatactcaggttcttaaccttaacgcatattctacgactcaatacatacattcagcaacatggctcctccgccaaaccccaatcttcctctccaggagagacttatggctcttgcccaaacccttcagttcggttggtttgtcgggtatgtctatcatgaacctgtcgcagtcggctgtgacggccagattgtatgatccgtgactaacgataatagacacctcaccctcatcctcgcaacgattcgatatggcttttcctggtggagaatgaactactatacccgcatggcccagttctcttaccgaacagcctttgtcgccgccgccgtcacctatggcatcgtcgtctacaagacaatgcgcgctcgtgctaagaacggccagcgtgctgctcccactcccttggctatgcttgccgatganaacattcaatacctcgccatgtctcttgtt

SEQ ID NO: 1957 - DNA, 169 bp, Fusarium venenatum
  misc_feature (1)...(169): n = A,T,C or G
nacatttcttgctncacaccngggaanatgcatattgtggcctaaagaatactcaattgattttactntgatcgcctcanntgattatataccgnctgaatnactctagtgttacctaaccgcttnatcaccaaaagtgacanacacgancccggggctntacnaaaga

SEQ ID NO: 1958 - DNA, 299 bp, Fusarium venenatum
agacctcagcagcatcaatcgcagcaagactaccgcccggatcagtatccccctccgccacagcagcatcaatctggtggttacaaccaaggctaccagcaagaccaagggtacggacacgatcaaggtcaaggccagggatacggaaacaatccccgctactaagaactggaaatgatcacgtctggtaggaagcagtatcgcattggctgcgcttcaaaagttacatagcgtcgggttcagcatggcgatgctaggtagaccttgacagattgatgaatgatatgaccattagacct

SEQ ID NO: 1959 - DNA, 390 bp, Fusarium venenatum
cgagtcgtccatcatgtcgacctcggttgatctaacccgaacttacctcgacaccattggcagaacgcatgtcagtatcaaggcgagaaacctagttgacgagttccgggatcgatacctcatcatctcctacgatgcgcctttgtcgagcgctctccgaaagcctctaatcatctttgccagtgcgatggcggtcttcgtgactacttgggctctgggtcaactgcaagtggaatttaagcagaagaaatagacgtttaaatagaacggggcatctgtctttgatcgagaaatcttcgctttgcagggttgcggaagcgaatttttaagacaggatgtaaaaagtgcaacatagaagggaatctcataatgaaacaagtttctagtttg

SEQ ID NO: 1960 - DNA, 553 bp, Fusarium venenatum
  misc_feature (1)...(553): n = A,T,C or G
catcatttctggctttacaatctaccgtccaggcactcctggcgtccttgtctcgaccaccatccatcatttccgaaatgagggcggccaagcgtgaggcggatagaaactttaattctctcaacaaatccaggtggccgcttggcctcctagatgacactagacagcggctctatgatgagaaggaagancgggcgcggaagtcaagggaggaagccgcaaaccttgcaagggaacttcgatacacgcaacagacggtggctggggaactggcagggtggcaagacctacatgaaaagatgggtcgccaggctatccgggantttgtccgtgggatggtggtgcaagaaanaatgaanttggatggcatgttgaaggcctcaggaaggtaagatccgatggtcaggtccaaagttggctggaatgattacgggcaaggtcctaatcctcnacaatggcggaactgaagctgtcatgatggacanactggaagccgtggtgatcctcctaatggcaattatacaattgtgatacgattctgggatagatcaac

SEQ ID NO: 1961 - DNA, 266 bp, Fusarium venenatum
gattcttttcaaccgtacacgacaggctgtcattaccggagagctggtcgagattatcactggtgctactgcctctgcggacatgtaaggagtgggagtacaagtcggggtgtaatgcttccctttgtaacaaatgccaacgggtcaccatcctcgcatggtctccttcattgtatcaaagcttcaataaattccttagtagcccataaagtcgatatgtatggtaatctaaaaaagagaataagtagcgatgccaggaagcttgt

SEQ ID NO: 1962 - DNA, 613 bp, Fusarium venenatum
  misc_feature (1)...(613): n = A,T,C or G
ctaggccgtttcagaggctcctctctaacccagctaacagcttgtctgtgccgtacttnanaaagttcttcatctttggtgtaattctttagagcttcaggagacgatggcctgtccccatattcacgaggtggcatcggggatcgagaagcatcaagtacagatggagatggtgaccgttgacgcatgctttgatgattcgatatcgtgctttcttcaggggatctggggtaggctgatccgggagccgaacgaggctttctcaggtgtggaggagcttgaagatgtgtgtcgatagtagttactctgcgatgcggttcgcgaatgggacttgcgggtcgttgcatgaatagaggtattggcttcaaggggctcggtttgaaggaaggtccgttaataggatcaaagatgtcnacccaaatgacagacttcgaagtatctctgaaattgctcgaagagttgctggatgtgccttcatcccctgttaccccatctccagtgcggtaaattggcggttgccncgcggaaacagactgtntatgtcaatacactgaatcaaatggcagttcacccttacctttaagctcctctcattggtggtaaaaaaaaancc

SEQ ID NO: 1963 - DNA, 621 bp, Fusarium venenatum
  misc_feature (1)...(621): n = A,T,C or G
gactatagtgcatttactaagtattcatatccatactcgtgctcatttgtatttttttttttcaatccttgatccatctcttgagtgncgatctccctcttacccgtacccctcctgcagccttanaacacgcagacccaatcccaatcacaaccccaacccgaccgccgacgcgccggatttaacgtctctacttccacctcaaccttaaccttcccgcacccgcacccgcatgcatacaattnaacggcctctcggcacgattagctatcagagccacctggccgtgagctcttgctccaaggctcgcgacgtcggtttcataagctcgacgtcgntatcgaccttggaccctggtcctgatgcctttggtaacacgtctgggaatgggtcgccggtcaaaatcttttccacgctctntaacgttacanaagctcctggtcctacaaactcgacggctccaacactnttgataacatcgggacatcctntccggcgagtttggcgggttcttcacttccaacctcaacggggacgtcacctacgggatttgnaacctctttaccccccanggttcttttgcgcttaanctccggttttttacnttgggcaaccnaaatt

SEQ ID NO: 1964 - DNA, 587 bp, Fusarium venenatum
  misc_feature (1)...(587): n = A,T,C or G
aacaaggtcagcgaagaacggtgatctccgagctcagaaccgagctctcatggatgagaacaagcgtctcacagaccttactcgcatgcttctctcttcgccttctttctccaacttcttggacaacctcagcagcaacccggccgccgctcagcagactcctcagctcaaggtcgagccccagcccgaacagcgacaggttcccaaggacatcaacccatacaacgctcagcagtcttctcagcagcagattggcatggccatgatccctgagcagaacatggacttctccatgcttacccttgatggtttcaacttccaaccccaagtctttgttgtcgacacaccccaagttcccgaagttattgacgctgctgttctctccggcaagtcatccaactttgtcgagcctatcttcgactctgaagaagaaaagctcgaagttcccgccatccaacgccttgttgccaaccctgagatttctgaacctgtcgacgctgcccgtttcgatgctgantttgaagctgaacccgaatttgncctgttccataatgaanccgctaccaccgncaccgaatcaaccaagg

SEQ ID NO: 1965 - DNA, 646 bp, Fusarium venenatum
  misc_feature (1)...(646): n = A,T,C or G
caagcttcatcaatatacatcaaaatgaagctcaccattgggctcagtgcagctcttgcaggttttgctgctgcctctcaccaagccgctaccaatcttgccaaagtttacatcctacgaggatcccaccatatcgagcctacaacgagtctcaccccgagcgaagcacgcctcatccttcaccagcgtctcgcccccgaaggagagggaccttcattccgcgatttcactgaatccgacgatgaggagagaatcatttctttaatgaacaaatttggcaaaactcctgcgccattgttttccgatgacacgaccgcgacgccgcgccagctagttatcaacattgatggaatgcctacgttcgagtatgaatcgttctttggcttggttcttcaacacaaagcccgactttactttagacccgagcaaagagatggggagcccctgaatctttcaaaccgttgtcgccaagagcggaatntccctgagcagatgtcccatggacancacttgttcaacggcaaacactttgcaactatacaatccagatgtgatccccacaccctgacaactctagctcaaaatcccnatcgnaatgccncccttatctcctccctgtggcatncaagaaattgggagacagact

SEQ ID NO: 1966 - DNA, 501 bp, Fusarium venenatum
  misc_feature (1)...(501): n = A,T,C or G
ccgcaggaattttttttttttttttttttttttttttttttatcgttcaataaaatcatttctttgccatcatctaagttggtccaatactacgccaacaactccgtgtctagatcaagagcgctccgtgtaaaccctcccatttgcttcctggctttgtgatgttgaagcctttgttatactgcccaatgcccccaaaacaaccaatccatcaagtaaattttgtgtatacgcctgcagtgctgcgccttcgtccctgaaaaagaaagtgtaccaatttatagttgcacatcgttgttgagcaaccggacctnttcacctggcttgaagggtggaagggccattttagggccttcattncaatnggaaagcntngccaagtggcagttgccacacgagcaaccttgcctgcactgngaagccatctcggcaggtcgtcggtgcaacttgatgctntgactgttgcggctgtggcacccttgcggcgtnttcagcggcaag

SEQ ID NO: 1967 - DNA, 792 bp, Fusarium venenatum
  misc_feature (1)...(792): n = A,T,C or G
ctctgatacctattccatgcaacctgctattcgcaaacgcatatattcgatgaggtttgagggccataattcagatctctcgccgagagccgatacttccttaagggggtatgttcaaaccccatcgcctccgttcgaataaccatggtcttgaacaattctcgtccgccaacacccaaccctccccagaacttcaaatcttcccatggttatacgcccataaaccgtcctccggtccatcgccctcagaattggatgctcgacgtcgcgccgctgaacgtcgctacttgaagggccaaagtctactaatacctaggcagtacggcattcaacaacaaccgactgcagggccacattcacgcatgcaaacaaaacgtgcatcatcaatctcattgcaatgcatatattccgtttnaggcgctgcaggagcgttcacgctgtacttggtaaagaaattcngcatcgtgctcatctcctcttgacctgtggatttgcagcatgaggtaaaggcttacatnagcaaaacttacaatatccaaccgccacaagctcaccatcgatccaaagttgggggtacgttggncaatccgcaaactcttgagtcctgtcggacctcgtcgtcgncaaaatgtgaaaaatcatcttgatgaattggttcgacnaaccaaccactgctaanaaacccctgggggactggngggcctttatnaaaaatgaaggggggcttaaaggtttttaaaccttgaaagttnttttttttttagggctggttttctttaaanaaattgtccc

SEQ ID NO: 1968 - DNA, 649 bp, Fusarium venenatum
  misc_feature (1)...(649): n = A,T,C or G
ctgagatgttcccttntttatctacctaagccgaagctaaggtacaacaagacangggaggcatnttatcaagcaacgtgganacccaagcttaatcctcacggcacgaaactgtgcgccatcataggcaaccaactgcctaccatcagcccatcaatctcaacgtaatatgaggctttgagtttgactttttcatcctcaaagtaatatttctgctattcgacgagactttgttttccttctaccaaaagtgcatccaaaataaaaccccagctattcggcttgccacttccttccgccattacagccctactaaggcaaccaagctcgacagcccaagtcaagacgccttcaggacaaggaacggaccttgaaacaatcacccgtcttctagtgcataaaggtcgcctttttgatctttatcttttatcctnnggctgcttcttgctacgaagcctgtgatggaataaaatctcttcctgttctattatcacctcgttatggaacaagcaagatcctcaaactttccgccttattctaccgggccccgtgatactgaacaccgatcaactcgncagtctttattggtaatcaccttgacctnggccgnttacaccancttcccgggcgccaccccacgaantttttt

SEQ ID NO: 1969 - DNA, 611 bp, Fusarium venenatum
  misc_feature (1)...(611): n = A,T,C or G
aatttttttttttttttttttttaatggaaagcgtcgattatgctatcaatgacaatttcgtaatcaaatattctgtgcttttcgcggatcataatctaccttcggctggttgaaccaaatccagtgctctcgtgacggttagactcgtttgatgaagatcctgagcgaccaccccatcctccgcccattcctgatcctcctcgtccgaaactgccgtagtcattgttgtgattattgtaccgattttggttgcgttggccagccagatatcctgcggcagcttctccacccgcaccgttcagaaaccaggccttcaggagttacttgattgagaagagggcttggtttcngggtatggagggggaggatcgtcaccatcggggacccnaaccaggaccccattcaccaaaagaccaaccgtcaccacggcgccgangtctgntggggttgctgncanctttctgcgctntgtagcatgccgagtagataatcancccgagtacgccaacaaaaatgatggtaaagaaaaaanctccncaatntgtaccggccgcgggcatnactgaaccaaccttcgttggcgatgttangataacnaccttcgnccttt

SEQ ID NO: 1970 - DNA, 589 bp, Fusarium venenatum
  misc_feature (1)...(589): n = A,T,C or G
tcattcctgagacaaagggaacaaggttgcacttgttcaaatccggatcttgcagagggcggaaatcctcaacccaactgattaaactcttaactcgaacaggagcacaacatagactagaggcgtctaccatgccaactttggcgcttcatctttgaaatctttcacccttccgtcttgcgactttgccctgcctggctgttcctctcatttgtgattgcgattattgttcagtctcttttttttatcttaccaccactgcgcctcaatttcgactcgatctttacataccatacatacgtacgccattcctcttaataccgaccgtctgcccatcatgtcgtaccttctctactccatctcattcttctccattgtcctcggcacgaatctcttcttcacccgtgccactggatcctcacctccaacatatgcgaactcgactcccngcgccgantacattactcgcganttcccaacagcttcgccngcganatcaagctggtctgantaatacactttaatttgtcgaaacttgaatntggcgatcngcccggctcgacanacaccaaggcgaagtctgcttctg

SEQ ID NO: 1971 - DNA, 392 bp, Fusarium venenatum
  misc_feature (1)...(392): n = A,T,C or G
ctactgctatcgtctcaagttcaggcagcgcccccaagggtaatcctgagggcacagatgacactgagcccgctgacaccaccaactgtgataccagcagcttcaaccaagaatgcggcaagtcaggctctagtaagagcagctctgaagatggaggttccaacgctgggtcaaggaatggtgcgagtgcgttggccatcatcattgcaggcggagccctgttctggctgtaatcaacatattcgtctgagtgttccgtcctgcgattccttgccatcgagtcctctctcaccgtctttattatatagcatctcactgcgctttcccttctgctaacatattttttcatggggggtgggtggattaganactttttgnatgaatcgctttct

SEQ ID NO: 1972 - DNA, 439 bp, Fusarium venenatum
  misc_feature (1)...(439): n = A,T,C or G
nacntaaaanatgcgttntaccgntgctctccgaatgttcaggcagacccntcgcatgntgngacccgtccccaaggaggaccaggctggccacaccatctctcagcgactccgaaagctcaagcagatccctcctgagctgtaccccctcgctgtcgttgtcggnttcgctctcggcgctgccggctactccatttctcgcaagttcattgtcgacaagaaccttccgtctcgctcgacagggccctgctgcgcgtcaggcaagcagcggtcacnggtgagaagcgaggagcactaaacttataccgaagaatagaagtgactcttgggggaatgaaattggttgaatatcctgggacgggcagtactgtacattccanaacgnacggtagcagggaaatccgtcagacataaaatatgaatttcngtgattgatatt

SEQ ID NO: 1973 - DNA, 512 bp, Fusarium venenatum
  misc_feature (1)...(512): n = A,T,C or G
aacacctctctcttcaactcgcgacctgttctcacctctcaatccagcccgctctcgtcaataatcgcattgcaaccatgaagattctcacaaaggaagaagaggaggcgcattattcggccgtcgtcaagggtggcttcatcggaggcagtcttggtcttgcaatcggccttggaggcgttgtccttgcttcaaggcgataccctgctttccgcggcctcactcttcccttcaggaccttcctcgtcacatttgccggtacattcggcgccatcatcaacgccgatcggtggtccatggtttatcaaaagaagcagaaccctttgaacttttacggggacgagacttagggcgcgcagcaaattgttcgggagaaccatactggaatgggggcgttttatggactcccggaaagggagacccgatactctttcggtttcgtctcatggcttgcttncatgggtgatgattttgccatggtnaggccgttcgnccatgaacacagccaacaa

SEQ ID NO: 1974 - DNA, 767 bp, Fusarium venenatum
  misc_feature (1)...(767): n = A,T,C or G
ttgaaattaacacatcaacatacttggatgatatcataagacgtcaatacttttactatccggataacaacaaaagacagcccgagtgcgtctgaaccgacaaatactcacatcaactacaccatatatatacataacctgaaaatggccaccgagaccgagactttatccttttcactaccaacgagcactgctcccaccgacgtttctgagtcaacatgcatgcctcactctacgccctttcaccaacaaccttcggcatatccgccacagaacatacccgccgagtgggatactaggataccaccaatgcaaacacctgcaacgcacgcgcaacaattttgtagcgagggctcatcacctggaagcggaagcggctgtttcaatgatggtggtcttttatacagggtccaggctgagcgagaatgtcgggagggacccggcaaaactgtcgaagaggcttgccaacgttcgctaaatcactttccttgcccgggactcgcctttccgatgccagctctcgatttcgattttcgaattgcggttcgtttgaaccaagacgctgtccatgttgagtcaggcaacaccaanggaaatcactaccgttgcaagccggtggtatnggtccggatcntttggccaccgccgtgtcattgcaagcggttatgatcttggtcaacaccngttttcgggcccatnaagcttgttgaaggccctttgttntccanacaaatgatgaaaagnccgcattactcgaaaatgcgcac

SEQ ID NO: 1975 - DNA, 102 bp, Fusarium venenatum
  misc_feature (1)...(102): n = A,T,C or G
naaggccaatctgtaattgtgtntgccctcctataagaggatngagatntgggaatgcatatnatggatattggatatngagcgagatttcgttttggcaga

SEQ ID NO: 1976 - DNA, 846 bp, Fusarium venenatum
  misc_feature (1)...(846): n = A,T,C or G
aggaattttttttttttttttttttatttgcgaccgtctatattttataagtccaacctttgacaggtgcagcggaaatcaaaatctagtctaaatgaatggtcgctagtatgaagtattaaatgtaaaaattagcatatctataaagtcgttttgcatatcgcgttcggatctcatataatgcattcccccaatcccgtcatcgctcggcccaatcacattggtgtccaaagcggaataaaaacaaccccctatatactaacgccgttcgctttcacgaacaaaaatcaaatcatgcccaagtgttatgcttttcatgcatcatgtaaggatcgtaagaagttttgaagaaagaagtaaggtggagttgatcaatcagttaatcgatcaaccagaagaaggtccaatttagatganggtaggcagcggcgaaaccgacaatggccaagaaaccagtgacggggttcatgccagcacccggcagtnacaggttcgggaacataagaaggtggaaggctcgtggtccctcgttaaaagtcggaaccgaaccgganccgganccgganganctgtcaccaccgttgctacccttgcttccactgtcgctaccctcgctgccactgtcggtgccgtcgtcattgctgggttgctcgccctgaggagtctttccaccctcggaaccggagtgaggaggaggaggagcgacaccggtagggtgagcaccgccagaaggaacggggtggtaggtgtgggaagggtaaacagcggtaccgttgtgggcgtgatcgacaggaacggtgtaagtgatggtcttgctcacactctgcccgtggttggtggggtgag

SEQ ID NO: 1977 - DNA, 635 bp, Fusarium venenatum
  misc_feature (1)...(635): n = A,T,C or G
ngataacatcaactgcctggagctcatttgtacctcccccaaaacgatcgaattgaaacggcgatcatgggtgtcaaagatctagctatcagctacgtggtattcaccgtcattcatttcttcctctttgcccttgctctggcaacctgtggtctatatggcaccgacgtccatcatgcgaaccagcagggcaagtactccgactcgaaatgggtctacgccgtggtagttggtagtatttctgctgtgacgtgtgtcctctacttcgttccctttgtcctgcgtatcgccggtgtctttgttccggtatgggactttattctcttcgttctctggatcgccctttttggcgtgttcggcaagatgtatatcaacgaggacgctgaagggtgatggaaaacgtcagacgcatgaaagaacgctgtctngggttgaactcgccagggcccttcttctgggttatcgcaacaattggggggctttcggatactgggtggaagcatngngaacatagancngggctttactgggcgcgcttaacggtttaaattaaaatatngggccccaganattgcattgttaacgccccctaataaggggnaaggattaaacnaaagccgtnggttcgnacancg

SEQ ID NO: 1978 - DNA, 633 bp, Fusarium venenatum
  misc_feature (1)...(633): n = A,T,C or G
cgaccttctttacaacgctcagcgtccatctgagatggctggctcgcctaccacaccccctctgatcaactttgagcggtgccgtatcgccgcctctgttgtcaagacactgctcagactgctggaagccagcactcgatacaagttccagcctatcgagggcatcacagagcgctgtctctggatgagcgccttgagcgacgaggatattcgacgccactcggagatgctcgaataaacctacacaaacatgtcgatcacccacattttcataacacatcacacatatgggaacgataattacgatttatgacacaccgactcgacggcgtttcatctcctatgtctcaaaatcatcacaagagcatacccagcatgtctctacattataccccatctcctacatcgtataatcatcaactggctacacaacaaagccatttcattcttcaactactacatacaacataatcattatcaaagcatctgggactgcagcaanggagttgggaacctttctttttttactttccggttccattttcacaaggaaattcattgggggtttctaggnctaatttcaatcataccccgcacagcgcaaggggcaaacctggcgtctggtcctttttt

SEQ ID NO: 1979 - DNA, 609 bp, Fusarium venenatum
  misc_feature (1)...(609): n = A,T,C or G
ctttnatgttcatgangctcggaacggctgntggtgtgtatggcagcttctttgttgatgtcatcccnaccatctgcgattatcttgatatctggtgcctgaccatcaagcacccttatgtcgagaacgaangaccccaggccaacggtactaagaaggactagataattccttacatgtctagacctggcncgacagcaggattctgaaaatcaagtccttgttttgcctcgtcgacctttcagtcgtgcatctcgtctgaacactgangcatgaatgacttattgaaagggaaataatggaaacgttatccaccanagcagagaggagagaacagaaangggttacttatcttaaaggggggagaaagaaagtaatagcgatgggtacatagaccgacgtttgagagacatggtttcnggtaggtttaacgaaggagatatgtatgattttacgacnaanggttttgggttttcttctggagttctncagcgtatctttggtttgtattatttgcctcgaaanggtgccagtggctttcaaggttggagtttagtttggnttaccggnngctctttttgttgtaaaaaanaccccananacaccccc

SEQ ID NO: 1980 - DNA, 530 bp, Fusarium venenatum
  misc_feature (1)...(530): n = A,T,C or G
gacagaacaaaactcaatagaaatgactcctccggatttcaaatttgtatttgacgagactgtctcanaatggaacgtcaaccaccgcgaatggctcaagacgcacgacaaaacgtgggattntttagcgacaggagccctcgtntttgacgcctctaaccgtattctcctcctgcagcgcgcacccgatgacagcatgcccaacaagtgggaaattcccggaggagcatgcgacgacgaggacgagagtgtcctgcatggttgtgtgcgcgagctctgggaggaaacaggtctagaagccacgtacatccgtcacgttatacctgacaaccaaaacgggaagcccgggcggtgtttacnaatcgcacgggcaananattcttttgcaagtttanctttgaggnggatgttgcttttggcggatgtgaagctggacccgaaggagcatcaggattacgtgtgggccacaaaagaagaggttaacagcantgccttgggggaaanggagattcntttaccaatgccaatat

SEQ ID NO: 1981 - DNA, 385 bp, Fusarium venenatum
  misc_feature (1)...(385): n = A,T,C or G
cgcagcaaaccctaagactggtattcctggtcaccttcccccaggaccaaaaccatcatttcatcctccaccgtcattccctggactcggttccccaacattggcggcagatatgcagggctctcatgttggccgaacagggacggagacgggacgtgccagaagccgagcccctggtggacgcggcccacgtatcggggttatgccacaaccttctccaatggcgtctatgctgcttgatcagcatcatcaaccctccgggggcaatatggtcgcacggagtctgtatgcatcaaggtatccacnaaggtatcggggggagagccaaattatcgaagaaactgaagccagtgccatcaggcgaagcgggaagatgatgaactgt

SEQ ID NO: 1982 - DNA, 574 bp, Fusarium venenatum
  misc_feature (1)...(574): n = A,T,C or G
ctcccgccaacctcactccagcttcccgtgtcccattctcaacttgaattctttccttcttctccatcgagaagcattattctcactcccgcgactccaaaacagtatcacaaactgcaataccatctattcttaattctaccgcgttttgcacatttgcgcttgtaaaccagactcgctttgcgacaacaattgttacgtcatcatcatgtcggacggaatcgctccagctatagacaaagtcggcgcacctgcacctacggcccccgaagctgaggctggcgctcccaccttgggcacagcagctccttcagagcctaccaagtcagaggagagcaagcctactggtggtgccggtggtcttcacgcttccgcaaagcccgtcgagggtgcttcggttccacaaacgcccatcaacaacatgaccccagcaggtggcactcctcgacctgtgctcaacatcgaaaaaaaacccaaggattcccaaaagaacgaagatganaatgctttcgtcaccaccggggtaaaaacaacctttgccctactgtttggaccnaatgatgtaaacgggacc

SEQ ID NO: 1983 - DNA, 679 bp, Fusarium venenatum
  misc_feature (1)...(679): n = A,T,C or G
cgactacaccatggagccacgagaggaactatatggtagagatgccatgagcggaaatgtccatcagacatcaagctatccgcaggcttcatacgagccacaaccttcttatgaccagcagcccaactacggtcataccaacggcaatgctaacggtggtgccaaagtcaacaactacactttaacaacagtgggagagggtttccctagacttgatggtggcgcgacccatgagactcagccatcaactcgaaaggccgaatcagtgtacacggagcgtgactcagttttgctccagacagacgatgaagatgagacccctatgcctacacgacccgtcggttaacaacccgtccgagagccataacactatctcaaacttgcacattncttggcggatacccaaagagcagttatgcacataagcaagattttcgttggcgtctttattttcctttctttagcttattatctccttggncaactgngtatgaatgggacngacaaagatgactagtcttgaanaatgggcaagaagtggtaaaaagggttggaaagcaagtggtattgntnggaggcgttggcttnagtggggaagtttaggnggaataattatnggtatttgggaaatncctcgcttangtttggatttggttatncttggatcgggtttcaaaaa

SEQ ID NO: 1984 - DNA, 610 bp, Fusarium venenatum
attttgttactctcaaatcgacccgacccgtctcgttcatcatcgttacagtactgaacttatacagtagaccgtatatccaccaattgcttcgcctcgacgcctctttctccgtctttccatcacagtttgaacggacacaaagaaccgcaagcgagaaaacctgcgacatcatttggcacctaaattacctagtgtgcagtcgatgatcataaaagaggggcagctgttgttttggccgaagctccagctacactacatcatcaccatagcgtggtaaaccttgtattgtttgcttggtttagaaagtattctgtactgttcgttcagagttcactacctcgcattgcattgcacaacggtttaccgtcgctaacaagctcaattcgcctcgcctagaagttaagacagattcactttactttttacgttggtctttatttgaaacggcagacctttttgaaagtatcattgagggttgccgggccacctttccagccaccacaagccaggtatagagcatcagctcgacctatcctatccaaattgccggactctgtgggaatgcgccaagcgtttgaatcctttgtccacaccggcaacaagacaa

SEQ ID NO: 1985 - DNA, 630 bp, Fusarium venenatum
  misc_feature (1)...(630): n = A,T,C or G
caaacaggccatcgctaacggcgccaacgatactcccgacgtttctcgcacttactcttcccctaccgcccgggatgactcgccagtctcctccgcaccccctccttaccaatctcccaatgagcattcctatgaggagaggcccaaatctatgcagtccgacttcgaagtcaagagtgccatttcccaagctacaacatccatcaaggagactgctgagctgacctacgaggagcttaaagctaagcttgcccaagctgagcagcagctcgtctctcttaaggatagcggtctccgtcagcgaaatgttaagtccgattccaacgacgatgagaagcggcccatggcccaaactgcccaagccattcagcagactgtcgagggtgtaccagtccagatggcggctatcctctgcttggtcaagcttcctgctcgcttatttcttcttctaaaaataanaagatggcagcccaggatcttctacaaanaaactaatagacaggcctgatgacgcttatgataactccactgggaagcatggaattctangngcatatatcttcaaaagtaccggaaaagcaangcctggaaagcatatnataatgatgggtaggatgnggcaccantcan

SEQ ID NO: 1986 - DNA, 659 bp, Fusarium venenatum
  misc_feature (1)...(659): n = A,T,C or G
ccagaacaaattcgacactctttatcaatactttcaaaaattacacaacatggctacaaagactgagacaatttctcattcagtattcaacaataatggctgttcttctacacatttgtatctacctcccgattatgaagtaaccgaagccatcgagctatcccccatctcaccagcatcctgctccacaaactctctccccgattacacagacatatacaacaataacacttcgaatcccgaagcaactgacttctatcctaccaaacaacttcagatccaagcatccggattacctctcatcaggctgcctttacccccacagccagatcccatctacatcttcaatgtcgcaccaacaggaggacatagagggaagcagaatacgtctctattcgaccagctcgtaattcaggatcatgcttcctagcccgagcaaacgattgcgcacaaataccactttgcacgacgacatatcgctttggaccaggtaaacctcccaagatccgtctcgaaacagaatcacagaacggaaaaacagaggatatagagatcagttgcaagggagtcttgaccgtagcgtagttatgcgaactcatctcaataccttcgaatggcgatatagttccgcgctgagcgtcgngccggacaaacctttg

SEQ ID NO: 1987 - DNA, 487 bp, Fusarium venenatum
  misc_feature (1)...(487): n = A,T,C or G
ccccaacagcactgacaatctccctgtgccaccccaggctgcccatttggccaacgctgtcagcgggcaacaggaacctcgaccaatccatctcctccgagttcctagcttcaacccccctgcgttcgaagacgatatcgctccacctcctgctgccgagctcgttcatgacgcacccgagcctgtgatgacacctccaccgcagtatgatgtcgtggtcggaactcctagtgtagacggtatggccgactactttgcacgactggccgacgctggatatgagggccaagatgactcagaatcggacccagatgattcacccccaaggattctggacagaactggacgtgtcaacgtcgctaaccctcgaactcctggtggccggagaatgccgagtcgaagcttggaaatctccagacccagcattcaactgaacatgaatgcactccataaccgactgggcgtgcagtgngaagagcactacctg

SEQ ID NO: 1988 - DNA, 609 bp, Fusarium venenatum
  misc_feature (1)...(609): n = A,T,C or G
tgggaagcagctcttcaggagcaacacaaccaaatttgctcgactcttttgtattgtttgatattcttctcctctctttcttttctaggagcattatcagacagaaattctacgactttaccccagacaacaaacagcatctccgctactcttcgtcgcttaatcagaatggagcctatgaggggcgtctctggtggtatgggcaagcagccagctcaacaagaaagccctgaacagcttctcgacgtcttcaaggcagctgctctctcggtgaccaagctctacaagatctctgctgccggacagtcaaaggcacgagccgatggatatcaggattgtctcgatgatcttttgcagttcttggacaaggagggattgggcctcggcgatggagaaggatggaagattcgtaaatgggcgaccgaaaggctcgacggccgtgagagcagctctctgaacacggagagtgaggatgaagcggagaagacggagacggcttcatcgcctgaactgagcccgtcaaagtgttccttcttcagcaagccaagccaaatgcgaaccgactctgcacccccgagcattcctnctgtccacgaagagccaacgccg

SEQ ID NO: 1989 - DNA, 490 bp, Fusarium venenatum
  misc_feature (1)...(490): n = A,T,C or G
ggtcaatggtatcgaagactggcgttcttctttgaacaacatctccaacctaattacaaggcccgcagacgaaagattaaccaaggcttatgagcatgaactaaaagtgctcacggactgtttcgaagggatatttggccagggacaaaatgcttctttgaatgttgttggcaaactcgagattataataagctggatctaccagctcaaagatgattacatggaagggttgcatcaaggagatacggtcgccatagttatcctgggacacttttgcgtattacttcggacatcggaggaaaagtattggttcatgcaggaatgggcagttcatatcatgaaaggtatccttgctatgtccgaagattttcgtatatggctttcctggcctctcgcatatctgaatttanattgccagagatagagataatgggttcttggcaatactgtntttaagtaatcatgctattttaattcaagtctgnttgac

SEQ ID NO: 1990 - DNA, 612 bp, Fusarium venenatum
  misc_feature (1)...(612): n = A,T,C or G
gacaaaaccttccacaggcgcaagttattttgtgctatagaaaagatcagcgaagatggcgtccaacggcacaaaacggagaaaggttgctcacaactcttctgatcacgagtctcgaggtcaagccgagtcaaagagcgcccagaaatctttcttcaagaacgcttcgaattgggatctcgaacaagactacgagtcgcgcccgcgcaagggcaagaagcanaaggagagcaaccgactacctatcaagacagcanatggtcgaattgagcaaggcaaaaggtcaagaggatgatgaagcatcgattgaaagcgacaccgaatggctagaangccgcgaggatgaagaggaggtagagtttgaggaagangangtccangaagaacctgagattcctgagcctcaacaagattccaagatgcacaaganggattgggcaagatttggtacgcaaatgaacgagaatcccggaggaacacgtccggngcattcaaggnaccttgcaagatncgggcaatccaagaatggtcnccaatcaanatgctcnccctcaatgacacaaattgactgtctacaaagntgtaanccctgggttccgggatancttccgc

SEQ ID NO: 1991 - DNA, 705 bp, Fusarium venenatum
  misc_feature (1)...(705): n = A,T,C or G
ccagcatacacacatcttcttcaacttacaccacaacttcaacacaaacaccaaaaccaaccacatcaccaacatcatcatcaatatgcccgcctacgagtactgctgccagtgtggaggcatgattgtcatcagcaccacctgcaccgcctgcggccacaagcagtgcaacaactgccctctctgctaaatgcccagtcttgacaataacaaccccttccctactctggcctttctnggaggctacaatacccacgagatgagagtcaaaacacaccctcgctctgacgagacatgacgacttttaacgatggcgcatctccttcttctctacaataacccggntgcacattcatctttcacttctccaacttgatcgatacccttcttcgacattccagtatcagcaaaactggttccttttcaggtctctgttaagcttccaatgtgcttttctttctcgcgaggcgcacaaaggaaggaaatgacgtcgatggtctttgtttctttttttatgcaagcagggcgtttatcaattgtactagcttggggctaaacttgtctcgaaggaggaatgggttcaaaacggattcattttctaagtgtacaacatatcgatacccgtgggctnttttatggccgacttcttctcttcagaatcgcagacaagaatacctaatacaaggcttttntttttctgccccn

SEQ ID NO: 1992 - DNA, 573 bp, Fusarium venenatum
  misc_feature (1)...(573): n = A,T,C or G
gccatgaccatccgctccatgcacgctgtgggctctggtgccaacgatgctatccgcaagatcaagtctcttggtattgctttcatcattgccctgctcatcatctgtgttggtcagtacgccgatggtatcctccacaactggcatatctttacctggttctacgcctggtctggattcaaggccactggtctcctcgagcctgaaaaactggggttngtacatccagctcactcccgccttcttcggttccggtatcctcgtcggtctcaacgctgccatctcttggtggggtggtaccgtcgtcgcctggggtctcattggtcctcttctggttcactacggcgagtgcatcngtattgaagtcggtgaaggcaagtgggaangtctcactcgattcaacgtcatgaacggcgtcaacacctgactacttcctctccgcanactgatgcctggccggggtctggtcccatggtctatcctcatccaattctcctccacggaaaggtgtctcnanggttcaatttgcttgcgcnaatcgccnctccatcaaaacgctctcccgtgggctca

SEQ ID NO: 1993 - DNA, 659 bp, Fusarium venenatum
  misc_feature (1)...(659): n = A,T,C or G
naaaatggtggtcttcattccaaggccatcgcccccgtttacaaccacttcgccncaagcacagtggtcccgacgntttggccnttgccaaggtnaccgtgancattgtcaagaccccgacgccaatatngnattactgcctgccaccttatgttcttnaaggaaggaaagcaggtcggtgtaatnggcaagccctncttnaaggtgctgacccanaaccttgganncgctgttgaaaattnggaaggttacccaaaaccaattctggcgcttaagggacacgaaatntnaaaaaggaccccgggaattgaaaaaaccgaaaaaaaaagggtttgaagaatttactccagggtttccgacgaaatttgtcatgggacgtnaaattaaaggaccttttgtggtncctgcattcgggaagttaaggttaagcgttttcgacaggaatgaggggtcacacgtggaggaaaagggggatcaacggtactggcttggatcgcctggatcgagaacgagctacaggatataagacatgactgtttgcggatatatttataccccgtatgacgtctgccgaatgagtttgccatcatcgcgatnaaaactatantcccatggtatgttgttgcttaacaatgggttatgaaggaatgtntgttacg

SEQ ID NO: 1994 - DNA, 452 bp, Fusarium venenatum
  misc_feature (1)...(452): n = A,T,C or G
gccagtttccctgccgagccgcaagggatgcccattcaatcatccatggagcctccggcgcctctttccatggtaaccaacgattcagaacacccaccggttcggtcccagtacacctatatgcagacgacgactgcccctccgcaattatctatacagacaactccgcttggaggccatgagcaggcgatgaatatccctcgttatgtcgataacccgagaccttgaaaagccccggcatatgaatcaccttcgataangagtcgggctctgtagcgaacaacgaaccatccccggaataccgatacacccttatgctcccgtgcacgcgagtccagtgaanttgctcaaccaactaccaccagagactctggaccaccttcggtgccttccagaaantactatgcactccgcacacctggactcngcagtgganacataatacaaatttg

SEQ ID NO: 1995 - DNA, 898 bp, Fusarium venenatum
  misc_feature (1)...(898): n = A,T,C or G
cacaaacacaaaccaatcggcaacaaagaatgcaacatccaaatncngtacccctncttaccgctatatacccttttncactggcagctgctggcggcttgcctaaaggtgtcggccctgaaattcgttctcactacaaaggcaaggaagaattttccttgcatcaccaacgctgctattaagctcagtctcgatcgaaatcaacgataacacgtgcgattgccccgacggctccgacnaaccaagttaccgctgcctgtgccaacatcgatcctctttcccccgaacaacctctcgccggatcctcctctggcactaccaacacgaccaatgctcttcctggattctggtgtgccaacaagggccatattggcatgtatgtgccttttctctacgtcaacgacggtgtgtgcgactacaaactctgctgcgatggttcanaagaatacggtggtgtcggcggcataaaagtgcgagaacaagtgtgcagagatcggcaaggagtacagaagattagaagacgagaagaagaaggctatgcaaaatgcggctaaaaaacgaactgctatggtcactgaagcaaaagatcttcgacaaaaggtcgagaacaaggttgccgacctcaacaaggagattgccaccctcgaggcaaagaangaggatcttgcgcagaaacaccacgaagcagacaacaagataagggcaaagttgttcgcggaggtgacnaaacngcggnggaaagcttgtgttctcccggattggccaanacaccctnaatgagcttcgcgatctctcgacaatgtcgcaccaacgtgatgtcttaaggagcaatcggggagctcgaggacttnttacaaagtcaagaccgattttacccccactttaccnatgagggggt

SEQ ID NO: 1996 - DNA, 589 bp, Fusarium venenatum
  misc_feature (1)...(589): n = A,T,C or G
taaggagtcatgttaaactgtacagccttgctgcccaacgttgagataaacacaaattatcacaaattatcacaatagcctataatcaacttggacggatctgttagttaaccaactcaattgtcgactctagggtcaaattctatacaatccagggtatcaatcttcctttccatcctccaagacaaagaaacaagcaaacaacgggaagacccatctcccatctcagaatcctccccaatctcttcatcctcctcgctgataaccccgagctcaggaccacaatctacacccacagccggtcttgccttgccttcttcttgctctttctttttctccccttccatctttctcttcctcgtttcttctccaatcctcttcagcgcctgtttgacatcctcaatgctcttcttagcttggccgaatttgtcttccatcacgatacagctgctgcactttctctgcaactttcgcgatntangcacgtganggctttttaccaancagtcttggtcgaacttgttcgcctggaantctcggcggtctggcacgtctttacacataaaccccagcgctcgtgggcgcagaa

SEQ ID NO: 1997 - DNA, 1000 bp, Fusarium venenatum
  misc_feature (1)...(1000): n = A,T,C or G
gacagggtagccttactgctccacagttaattgatgccttcttcactctntttgccgacacctcctnaaacgctcttggtaccatggtacgagaggttgcggatntttacaaaaacaagggcaaggccgacgctcttctnaaagcctggcaagattggcgagctatcaacgaggattaccccacgcttgcctggcctgagtggtatgcatggcccaacctcgagttcaagtggttgggctggcgcagcatcggccaacccagctgttcccaatgccaaggtcacccaaaagtactcgaaccgtgttctcaagctcaagaacagcacaagacttggcggnccaactactgtatcctcaaagnggngcatcatcatggactggtcgccctgccgtaagcgctccacccccatcctccaacggcgttcccatctctcccttcttacaacaactcctcctctgcatctcgctccaactggacaactcccactccctcatcatcgcaatccacgactctcaatcgccctcgaactgctcccaaaaccacaggtgaagacgctttcccggctcttccagcggcaccaaagcctaccaccacaatttttggttacggcaacggccgcgctgtacgacgtgactacggaaaccgcgagacaaatttccaatggggtagtggaccgagcacaccagctgacgaggagcccgctgatgacnaagcgggtggtaagaagaagggtaacaagaagggcaagaaagttcttgttcagtggggttaaatgtctcgtatataaatcggatggctaaatagtgtcggatcagtatgtatgctcctcaatgggcanaatagccgtcgggttttggaactggataaataaagtgacnaagcgaggcgatttggcgttgaaacattccngnggaagggtgagtgacnatatgtagggcggttataacaagaatggaactnttggaccncctttgttcaggttaatnaacgatgttttng

SEQ ID NO: 1998 - DNA, 573 bp, Fusarium venenatum
  misc_feature (1)...(573): n = A,T,C or G
ctggcactggtcaccttcgttcttggacccgccgcagcaaccgcgagcatggctctcttggccctgagagttggtatttcaacattttccccagccttgtcaacttctttcgagatcactcagttggccctcgctttgctctgtcacccgaccttccagcccactgcagcgtaaccatcaaggatggtctgcgaggtggccacaagcctgtccttcacctgcccccagcatcccctgaccttaaccccatcactgaaatctttggcactatcaccgctaacttgaaggccgacaaagccaactccctctttgggggtgttaccgagtacaggatcgacaacattgtacganacacttgggaaggcatctccaaggantactcngtgagctgatcggaacatccaacggtgccangccgtcattgacctgacggatggtacactcctttttaacttctaatgacgggacaataacanccnggatttacgancagataaatgacaataaccggacaaacttttattttatttttgaaaattacaagctgaaaaaaaaaagaacccgggacaaaat

SEQ ID NO: 1999 - DNA, 518 bp, Fusarium venenatum
  misc_feature (1)...(518): n = A,T,C or G
ctcactgcttcaacaatgcactgccttcttctcctgaccgctgcgtctctcgctgtggctcacgttccttcagtcagcgtgcccgcgtgtcccaaatacggcaccgtcaagttttccaaatctgtccccgacggtgatccttttccgcgtaccgaagtcgatctctgttacacagacaccgctttgtccctacaattcacggccctagacgaaaaatacttttacttcaacgaatcccaaggaacgaacgacgatatctgggcttacgaagttgttgaggcgttcatctacaagggaaccgacgatccgcagacctatctcgagtacgaaatcaatcccaacaacgtaacctaccaagcctttgctacaacccttccaagttcgtgctgaaggcgcttcgtcgacatttcttatctcggacctgaaggtgatggattgcgnagagaacaatggacaggcggcaaagaatggtaanaaggacagatccgtggggttgtaacgnanccggattgacccgg

SEQ ID NO: 2000 - DNA, 617 bp, Fusarium venenatum
  misc_feature (1)...(617): n = A,T,C or G
ntccanttcanttcgntttngcctgtcactccaaccctgacgatgcatcaaccttgcttgatttggctggtggctaccctgctttgaccttgacctaccatctcatcactcaccaccatggaccacatccattcaattacattacatcagccaccaatgtggaaacgagatgagatgagtctctctctatcatttcnaaaaaagcaatggccgaagtgttttaccttgttccactcgtgcgtggccttccgttggcgtcatgcgaccccctcgaactcaacatccattggccctcttgccctcttggccctctgtgcagtcgcaacaacagaggcggcagcagcagttaccgcgcaactaaccttatcttcgacgccgagatgaatttactctaaatgaaacaagcgtttntttctnattacactagccacacactctacatgtacgcaggacaccttnataacaaanaagctcagccgcaaatgttgaccctncgcatgcatggcagatgcactgatcccctttggggnagtatcggggatcttnaatattcggtccccggcacaacacttgggtcaatcccatggacacgttcttcttgcattatgctaagtgga

SEQ ID NO: 2001 - DNA, 936 bp, Fusarium venenatum
  misc_feature (1)...(936): n = A,T,C or G
acacctttcccctccgtacagtatttctcatttccacacaattctctctcctacttcctagatctgactcaacgtactcttcttttcccttcgtatgaatgcgataggaagtaatttcaactacttttatcgtcgtcaaacccactagcaacacgtatcaaacaaatctctactataaacaatggagagccttcagctatcccaggtcttggccgacctcagcaacctgggcgccgccgaccctggagctgccgaggccattgtcagcgccaacaacgctgctcattccagttacccccgaaccgacgcaactgtgaatgcccttacctcgagtccctctaccaacaaccagaaacgtcctaccggcctgcagcgccactggtcatccgaaaagttcgacaagtttggccgacgtattctctctcctagctcccacacagggtcagccggaaactcagttcctggcactcctcgccgcggcgaatccgatttcgaagaagacctggaaagggcaagcacgctcatgcaactatatgatattcgttccaagatcaagcagcaggataacagcagtttgctcaaggcccgtgagaaggttaacgcgatagcggcgcgacagcaagctcagcaagcagcggaacgcaacatgaaggcggncgacgagctccgacgtcaacgatactcttttcctcgggctggcctntaagccgaacgacccttcatgaattcactgtacatacttacganaatatgtggctcatgcgaagggaaatgcgcatgatgtacgattttgacgtttgccggaanggttatttgacngcgttgggacacaaaagcaatatgccntcngtaatggatctgccctcttgcnaagtttaangcaacaagcgtttgacttttaatattatatgaagtgatccctgttttgttgccatc

SEQ ID NO: 2002 - DNA, 533 bp, Fusarium venenatum
  misc_feature (1)...(533): n = A,T,C or G
gtaacgactaccaaacatcaaaacaaataagacaaaatggccaaacgcaagnagacaagccgtcgcacagagcgagcccgcttctgagccttccgtcatcacgaagaaagtcaagggctccaaggttctcaaggaaaagcccgtcaaggaaaangcttccgcgcctgcgaagaagactacnaccaccaagaccgcctcgaatgcgcccgagacaattcaaatcgttgtcggctcctacgatcgaatccttcacgggattggtagtgacagttggaggcaaggagaaggccgagttcgcggactcgtttttgtttaacgcccatacttcagctatccgttgcgttgctgtatcgcccatttcancgcccgtccctggacagacacaaaaggtcatgcttgcttctggtgccactgatgancgcgttgaatgttttcaacctatctgcgcatcccccaagccnaaaagaaccaggaacttntggcccnangtggctcccnaaccgattctcganaacnccaaaaatccaaaagtt

SEQ ID NO: 2003 - DNA, 511 bp, Fusarium venenatum
  misc_feature (1)...(511): n = A,T,C or G
caacgtcggcgtcgccatgatgacctacaacggcgacgaatccttgcccctcaacgttcctctcggtaccctcaccaccggcaagggctataagatcaccgagctggaggtcgcacgtatctactccagcgttgagggtgtcaacgctcccaaggccgatcaggtcacttgccagatgtacaaaggaccaagtgggggcactgtcccttgctagcaaaagagttcaccgcccaagaaanggtgctctcattaagtaccaagcctgttcctctgggctggattctctgccgtgtcaatgcttccaaagtagtgttatactttggtttttgacagacaaccacgagatcatcggaagaatatgtctattttatggaaatgcttttcttgagtttgtcccgagcttgactttaaggaaagttggaaatggngggatatgggttttgatgtggtcatatatggccaaaccgacatgtncattatatnaaagacacaataaaaacacaccntactt

SEQ ID NO: 2004 - DNA, 588 bp, Fusarium venenatum
  misc_feature (1)...(588): n = A,T,C or G
cttcattcttatccttccaaattaacagtattcgagctaaaccctcggaccatatcacttacaccaagtcgatactcggaacaaacctccatcatgagaatcccctacgtatctaaccctcctgagactaagactgaggagcatgctgctattgtgaaacgcatagaggagcgccgtgctccccgacctctccaatctttggatttggctctccttcactcccctcatgttgctgatggttggaactcgttcctcggcgcagtccgcaccaaaacgtcgctaagtgatgacttgcgggagcttgccatttcccgagttgctgtgtgcaacaaggcatggtacgaatggaagcaccatgcaccactggcagtcaagggtggtgtttctgaagctggtcttgaagctattaagcaagacacccttggcgagcgacctgctgagttgtcaganaancagtgggttgtaattctcttcacggatgagatgacnaagaatgttcaagtcaaggatganactttaaccgtctacaaaattcttcaacgancaggaaattgtcganatccagcgacagtggcatgttacactgtt

SEQ ID NO: 2005 - DNA, 102 bp, Fusarium venenatum
  misc_feature (1)...(102): n = A,T,C or G
nttacagcgtcggngacttggcanaacccttgccgttactcacnttcatngcttncacacatccccctttttgctagctggncgtnataagcgaattaagcc

SEQ ID NO: 2006 - DNA, 567 bp, Fusarium venenatum
  misc_feature (1)...(567): n = A,T,C or G
ctctttgggcttttcttttcccgtgtgacgctcgacaaggacgacagcattaccaactcgcctactatcatcaaacctccatcatagcagtaagcatcaacccaaactttgtcgcccgcgccgctcgtttcagcctcattctccgaatttaagtcatgtcgctagtcattgtcgcctccaccagactacgatagtgctgttgttgtttttgttgcttttaccgccatcttcctacattttatctattctctagacgcccatggccaaaaancgacngtgcaaaccacgcaagggaacaccagcacgtcncaaccaatctcagacgaacaccatgtcctcggaagantcgtacgctgtacagagcgggcgacaatccagcgacgggacaccaagtgagcatgccaacagtgacggaaataatacagccatgaacagtatcgtngggaacagacgaagancctcatcatcacaatgactccgaactcgatgaaagatgttgacgaagaananatgatatccatntncctgcctcacnatacctggaatttctgcagcccatcaagttga

SEQ ID NO: 2007 - DNA, 398 bp, Fusarium venenatum
  misc_feature (1)...(398): n = A,T,C or G
tttttttttttttagcgtcatgaaaatttgtgtctaaaccaatgccagtcgtcctactntatataatccgtccatacaggtatcctgtncccctactctgtctgatcctcactcatagatcgaatcttnttttttcttcctcgcgtgctgnaaatcaaggcgtcgaggcggnggcaggctccttgtccttgnccctgnggaggnggaaggacttgcggnccttcttcttgagatcctcttctttgtccttcttganggcggcctcggcgacaagttgctcaaagacnanatagtctccctcttcctcaggagatcgctcagccctgatnaaaacgtcaccgataagaaccagagcttgngcgcgctctaatcgcttgnngagatggaccttcttgtcg

SEQ ID NO: 2008 - DNA, 595 bp, Fusarium venenatum
  misc_feature (1)...(595): n = A,T,C or G
gtcattcatgccactgcccactcaaggccacccaggtcaccagtctttgatgccttcacccgatcctcaacagaacgcaattcaccacacctttccaaaacacaaaaatggtgccttcccaacaattcacctcnccttcaaggccttcgcctgcatcgtcggctcactcacngtnggggccatcaaaatcncaccngatgctccnccagcacngtcgcccttggaaaaaccgtgagcttccgctaccacctccnctcaatcttcaaggaacacgaaaaacggngaaatcaatgaagggaatttcgaatattccccngcccccncgtattttttgaatgaattgggaanaattctcncaaggcgctgttntttgaaacaagcctggcccaacaagcatancggaaccaccccccnaatgggggnagtgggtgcagtatttttaatgaacccccgggtcgcctccttgagctcnccccccaagcccctcttttgaaactttgggaattttaccgaanccaattggctttttttgtttaccccaaatttgggtttggncncgttttttcctttgaatcnaacatttatcgaaatgctg

SEQ ID NO: 2009 - DNA, 197 bp, Fusarium venenatum
  misc_feature (1)...(197): n = A,T,C or G
ntttggncaaatgccnagagggggggggntccatnaaanccaggtnaataanaagccggagaagggaggggggggggcaaataagcannattggttggaaaggggggggccaggngggcccggggggaatggggccgnctgggaaggccaatngccattaaaaccgganaatgggtcccccggcccccggngggggg

SEQ ID NO: 2010 - DNA, 376 bp, Fusarium venenatum
  misc_feature (1)...(376): n = A,T,C or G
cggggagtttcccgtanacacaactgaagcggctaccaccactgcagatgctgcccccaccattatcccaagaaactttgttcgaagaggtcatccagagatagttgtcagggatgtcaccagcggagagcccgctatgactaccgaagaggctgccaccactaccgaaactaccgctaccacttctgaagatgccaccacttntggagatgccaccactcaggcgatacaacctcnacttntgaagacaccactgntactacaagaagggccccaccaccacagaagaagctaccaccacagcttntgaaaccgncccggttgcntaatacatggnaaagcctcaccttaangcgctantggggtgcaagagggt

SEQ ID NO: 2011 - DNA, 634 bp, Fusarium venenatum
  misc_feature (1)...(634): n = A,T,C or G
ctctcatcgtacatacttgatcatacttcacttgaagagtcgcttccccgtgcgtgtcgagaaacgatccacgccatcgttttgctgcgcatgccaaagctgctgcacacccacacctcgactctctcccgaaactcgatagcgtcgccaggcctcgcgtagatgatcaggtcgtaacggaccgcgcttgagatcgacttcctcctcagctgcatccgggtcgtcattcgtagactgtggcggcgtaggcagttcgctttgtttctctcccgcgtgaatccactcgccttgaacgttcctcgcagcttcgatgatttctcccgcaaatagcttggctaccgctttgacggctgtgctgacattttgaggcacggattgggagactgtggcgttgacgacctatgactggtagcaacttggtttatgatgtaaacgcagatgtcgcttactcgtttaacgacactatcggctnatttggccgcgcgccagaactcatatcgggtgnactgntgagagtcgaatgccttgacagcatagctcgtaacgaatctcctcttgcttntgctctgagttcgngcaacaacatcttcaacgncatttaagctttcataactttaatggcattttcntaaca

SEQ ID NO: 2012 - DNA, 558 bp, Fusarium venenatum
  misc_feature (1)...(558): n = A,T,C or G
ctttccaactcttttagcaatgtttccttcattaatgatgtcgtaggtcatgtcgcgatagtctatgctccttttttgcctctctcaatagntgccacacatactaccacccgatatactccatcatcaccgatcgaccgttcaattcgcctggtggaatccatcatgacctaccattaaacgaccaactctcccaatctacatacataatccaaccgcaacgatgctctcgatatcgccccgtntttacatccgacatccctctccaacaaccgncgaattcactgnaacgacccttcggccactcccgccagcattacataccctnggtctactttctcgnggggcctctccatcttcacccttnttnttctcacgcacgcctaaccctccatccactactcgcctatgctgcaccgtctnttntgaagancataccgccctnttacctccgngcgccaacatnaattggttccgcgcgcangatataccactttcatacttgttccagccagtataagctgngctatggntgccaanaaaaagggctntgtgagc

SEQ ID NO: 2013 - DNA, 519 bp, Fusarium venenatum
  misc_feature (1)...(519): n = A,T,C or G
cttgctcgaggagattgcccgtcggcttatgtccatcaatgtctctggtgctggaactgatatgcaaactcccctgactctcatggagtttcccattgatacagttggtcagttccgctctcgtatgggatggttgcaccccgaaagaatccatcattccctcagttcaaccctcgcaacttcactgtccagganagcatgccttctactgaacactatctgtatgggaaccctgctttcagctacagcaccgaggaaatgcccatgctcaacgcctcaggacgccaccttctgcagtgaagcccgctggttctatcaccttacccaagccagcaatacctcaatgttccctccccagcttacacggggancttacagccggcatcctcgaactttgaaggctcagttgcgttcagcgataccgangaatacggatcatggganatgancacctccaggggggggccttcttccnccattcatgantctcctcaaaactatggggtcgggatgaaaaca

SEQ ID NO: 2014 - DNA, 554 bp, Fusarium venenatum
  misc_feature (1)...(554): n = A,T,C or G
gtttgggtccnaaaacttgggcctggttgattttctaanacactgggcatatcaggcccgatttgcttcatcgtcccttgcgccacggttgaacgcaccctgcccggaagatatccgccgtcaagcacaggaaacccctcgtgagatccggtacgatgaccttcttggtgatcgatatgatatgcagggcttggactggaattccatgaataccactcggaggtatgcgcgtcagagacgcaatgacactttcaagaattacgtcaacaaggacggctcggatagatggagtcctcacatggttgacgttgacatcccatcttcggagagttttatgagattaaaganatacatcgttcgccgagatgtctaccttgctcattttcagcttcncagggncttaacttgtccatcgacctcacaaagtntactacccccgtaacgaangagtcacccgtattaacctcnctttagggnaaactgnggntgccttcacaacaaatatatgactggngttgggactcttatttttcccttgcncaaaccacggggcc

SEQ ID NO: 2015 - DNA, 495 bp, Fusarium venenatum
  misc_feature (1)...(495): n = A,T,C or G
ncagctgggttctgtaacttcaagcgtctttctctcttttccccacatattcaccagnctatctatctctctctctatctcttgagtgccgcttcgaatatcacgccattgcgtattaaacatcgtcacaatgaagactacaatctttgtcacgcttctttctgctgctgcgtctctcgtcagcgctggcatcgtggttacacctgttttctttgaccagatcgttgagaagatctctggtgattgccctttggtgttgttacgcctcagggctgcggtcgtcagcgtggttagagggtcgtggttacagatggaaagaaagtattggattttggttatgggatagacccaagtctagggaactgttcaacttggtcgtaccgttctttgatgaacggagaaataataccattcangcgtgtcttttgatttacacgccacacaaagaacttntggggacgttctggcnatactataggggaatatattccacat

SEQ ID NO: 2016 - DNA, 539 bp, Fusarium venenatum
  misc_feature (1)...(539): n = A,T,C or G
ggtcgacctcactgccttgcttgtataaaacgacagactgaatgcagatatgcgcatgttgctaatctactcgaggagaccacacggtccgcagccaatggcaggcgaatgacgaaagccacccaagaagaatcgggatcaagcggaaagtctcctatcccaaatattgcggatagaggcatgtccaacgatcccagagcaacctcccggggtgccgttgcactctcgattggcctcctatctaatgttccatactctctaccctctgcgagtaacatctttggcattggctctgaacaccccttcgccaactactggacctgtgaagcggcctgtcggaagtaatttcagttcttcccgacaagatacangccgacattctgctcagtcgctactttgagtgtgttgacccagtgtttcccatgatacatcgccaaacattctacgcagattacaacacttctggcngatgagtcnccagacagagnaccngatctctttttagcatgatatctcatgctncactggcccaattgtga

SEQ ID NO: 2017 - DNA, 658 bp, Fusarium venenatum
  misc_feature (1)...(658): n = A,T,C or G
attgagccatccatttccacttgcgtccgtctacactccataacgtctcgtcggcccctctcacctacatcgcctgatcttgtaaactcgtcaccgctacccccaacttctctgctccttactacacaaagtgtataagtagctagacaccgccgactctttaccacattcaacaattaccaaccacaatctccatcacaatgcctagaatcaccgcttccgtttccaaggtcactcgcactcttgccgagtcgcatcgccatgccggtgtcgctctcatgcccaaatatgccgagctccttggatcttcgtctgagcagtcccagcactctgaggctcgtggctcaagactacccaccgtccactcctnagcatncatcgctggtcgnacacggcctntgatgcaagtccttnagctcttctgcatcttctcgtgcgcctggtcaaccaacgttgacaccatggtgttgcccaagattacaggaattccaagnttaaacgagccttttccttcgaatgccacttttttccggataactacgggttttaccaaaaattttatggctggatgccaccgaanttgacaagtaaccgacctggnattttnggttttaacctgganattggcngttccnggggttccaanggcnaaaatggn

SEQ ID NO: 2018 - DNA, 149 bp, Fusarium venenatum
  misc_feature (1)...(149): n = A,T,C or G
naaacggtgatgttgacaaggttccaggtccaggtggngaagatggagttgctgtcggnagaaatgaccttgatgaactggccttggaagagcttattgccgtaaaaaaagacatcgttacagaaccaagtaccagaagtagccaaaag

SEQ ID NO: 2019 - DNA, 602 bp, Fusarium venenatum
  misc_feature (1)...(602): n = A,T,C or G
cgatgaccagtctcctgccaccacccctgatgtaacacccgctgtcgctgtcgctggcgatgtctccgatatgctcgaggccgcccccgctcgccaaaccgtccttcgtgtgaccgataccgaacccaagaagcagaacaagaaggcacccaaggccgaggctcctgttgagaccaanaagcagcgccagaaccgcaagaaggctgaggctgccaaggctgcccgtgaagagaacgagaaggaacgcaaggctctcgaggagcagcaacgccgtgccgctcgtattgctgagggacgtgctgccaaggatggttcgcagttcactgctgcccaggccaagtcgtctgcctggaaggagggagctcccaaggctgcaacgatgcccccgccgccanaccaatggctttcaccagcctctcgatactttcgagaaggctcctccacctncggtggtgccccaagggcgacaacaaatggattgagtctctttcttttgaagaggaacancttcacacttcaaaatgatgacnaatggacactgttnaaaacaantntaaaaangntgttaaaacgcccttnaantggttttggcaaaaaggttg

SEQ ID NO: 2020 - DNA, 544 bp, Fusarium venenatum
  misc_feature (1)...(544): n = A,T,C or G
cggagctgtacctccaatgatgagtttcggtaaccctaaatctaatgtccttgcaccaccaaatacatctcaaagtattatgccgcccactttgtctactgccacccctaccaacaatgcctcatctatcatccctgactctcgagcaaccccttcgacagcagctgctccagcatcttctacgacaaaatcttcaaccagttcctaactcgtccactcttccggccaaatcctctactctcgacaactccgcagtagctcaaacctacgaatcccagcctcaaccatcaaccggagcccgaaatgctatagtatttcaaagctttgacgaaaatgccctcaaggacccgtagcatccaaaccagatcatcttcgggcgcaagangaatagctctcaaaactcccctgcaccgctttgcgtcttcacaaacatcccgctcnggtatcgtgatcacgcactggtctcactactataacactacctttcgcganatcaacgcctcacccgcggaaantacgatggagcatatcctgggtgctgggt

SEQ ID NO: 2021 - DNA, 547 bp, Fusarium venenatum
  misc_feature (1)...(547): n = A,T,C or G
gtttatttgttaacactttgtcttttttcgtattttgtaggataacgtcgatcatgataactttgacattgactcggcccttgggtcagacgctgccagttttctatatcccgaatcaatagcagcaagtatcctcgaatatagaaccatccaaggccgtacctatcacagtgaccggcatgatgccgattactatgctcccaatgacgagcagcagctccaatctgtcgatatcacccatcactacctcaccatcctactcgacaacaagctctttttagctcccatatcacctcacgtccagacagttctagacgtcggtacaggatccggcatatgggcaatagatttcgcagacgcacatcccagtgcccaagtcgtcggctcggaactctcgccctgccagccagaatgggtccctccaaacgtacgcttcgagatcgcagatgcctctctcgantggcctggaaagatgactacttcgattttgtcccgttcgctactgtttggntccattcnanaaagggcacactcttccgcgaaacat

SEQ ID NO: 2022 - DNA, 572 bp, Fusarium venenatum
  misc_feature (1)...(572): n = A,T,C or G
gaaaatattcaattcgttcaacatgtcctctgaaacagcttgtcctctttgatctcccaagccagaaatggtgcctggtctctcaacccatgggaagaccgatttctcctgaacttcaaggggcatcgactacaagactgaatggctcgaatatcctgacatcaagccgactcttgagcctcacatttccgccaacccagccaccggaacatggacgatccctactgtcaagttccccgatggaacttacattatggactcggccaagatccttgagcgaattgaaaaggactgtcctgaaccctccgtccacaaggactcgcctgtccttaccaagctcttcgaaatcatgccgaacattatggccgccctccgacccatctacttcacccacgtcccaaacacattctcaacganaanatgttccttactggcaggagaccgaaccgaaggggntggagacctctcgacaancttacaaaaaaaaggcggcaacaggctgggataaactaaccactttncaagaagtcaagctctctccaggaaaatcnaaaggccatctcctaggaaaa

SEQ ID NO: 2023 - DNA, 575 bp, Fusarium venenatum
  misc_feature (1)...(575): n = A,T,C or G
aggacccagcctactggacaacatccccaactggtcctcctcgacctcccaaggagcccattgagcctaccggcagcccttcagctatgtctcctcaacaaagaggcagccgtatctcgaagctggcaaagggcagccctgcaccacacccaagcgatgagagtggttatgccacaatgagcggtacccatttcagcaactacacaagcagtcccaagcctgagaaccgcaacttgaacgctgctttgggtgttcctacccgccgacccagtggtcctcgagccatgactcccaagagccccgaggatgaatctcgccgacgcaagcgagaagacacgttcggtagtgttacctcccacaacacggatgatacggagaccttttagaaaggggctcaccgtggcatccgaccgttgccgggatattgatcttttgtcgaagaatgacacngcgcttttgcttttctggcataatcttgcatcctaccacgcgttaggctttcaatatgtgtcaactgtntgaagaatatatggatatgaaacgggcttcaactgaatnacttttcatcngaagaa

SEQ ID NO: 2024 - DNA, 615 bp, Fusarium venenatum
  misc_feature (1)...(615): n = A,T,C or G
tgttactgcagccttcacctcggtctacctaaaattactgattcactcttgagccagtctcagcacctcaattaatttgtcagaccctagtggttcggtcgttctttaatactgcaactacctttagttgcaccacctgctcgctcacagcttacaatacatacatacctactcttttttttatcgccaactcactcaaaatgcgccctcaagctctcgcagccgttcttctctcggcctgtgccggtcagtctgctgcccaggatgctcctcgagtcaacgacaaccctcctggtgttggatacaaggccactctcccgaaggagcccttcttcaaggatgccgccatcgatggaaatgtcaagggctacatccacgcccaagctaccgattctggtcagggtgtgaagtttatggtcaagttcagcaacctccctaaggaaggtggacctttcacctaccacattcacgttgatcctgttcctaacaacggcaactgcactgcgactcttgctcaccttgacccttttgcgcgcggcgaagagcctccctgtgatgccgagaagcctgaatcntgccangtcngagacaacaacgggaaagcatggaaagatt

SEQ ID NO: 2025 - DNA, 312 bp, Fusarium venenatum
  misc_feature (1)...(312): n = A,T,C or G
gtaggaatacccgctgaacttaagcatatcaataagcggaggaaaagaaaccaacagggattgccctagtaacggcgagcagcactaagcaactcataccacggatcaccggatagatcaggcaaagcgtgtgggggggattatcagaattcagcgagacctaaaccggctcgccaagatcgcagtgggatgttacagtcatcaattgacggaactcaacatgaaatcgctattcattcagagcttgacttttccatagtctaaactagtgtacaagaatatctacacatttgcactctccananaaaaaaa

SEQ ID NO: 2026 - DNA, 501 bp, Fusarium venenatum
  misc_feature (1)...(501): n = A,T,C or G
aaatgctgctgcttccaaatacccgcaatacgtcactcttctttcctactttgctcctactcaggcgtcaactgctaagtccacagaccctacgaagatgcagcgcagcttgtccaagttaggctcgaccatgcccagacttccatcgccgccgcctccagaagttccctgggcggttgcaacgcatgaactaagcaaactccttattccctcctcacgcgaaaccggtagctgccaacctgaggatctgaacgcagaagcaagccgggccagacgtgaccggcaatcgatattgatgggagtcgatcctaaccctccaccccctgccactgcttcacgcccaacatcgcgtatgtctctgcgtgagagacngaccaagctagtaccaccccctgagccaaccattgacaagtcatccaaaggtcgcagaaggacgatgggcactactactgtagcttcagaaaagccggttgctcgtgatgttccctcacgaaaaaacag

SEQ ID NO: 2027 - DNA, 346 bp, Fusarium venenatum
  misc_feature (1)...(346): n = A,T,C or G
ttttttttttttttttttttggnganacatatagagctttatttcataactcctactcgcctcccagttatctacttaaaatccanacatgctagtgcgccgtacaagggcagcaataattcatnatttcggcgtatccgtagccgattccatccatatccataatcaaacaagcaaacgccggtccgtcaacgtcgatgcataacctaacccgcccatatttttatagtatttagttggcgaggatggttcgcacgaggtcagtgtagttgacctggcctgagctggtgtcaacggccttgaggagctcgtcgacctcctcgtgggnattttttccccaggtttg

SEQ ID NO: 2028 - DNA, 1053 bp, Fusarium venenatum
  misc_feature (1)...(1053): n = A,T,C or G
gacgagctcaaccanaaagcccncntcgaagtacgaggaaagcaagactttttctgctcgcacttcgtcgttctgcttgttnccaacctttgtccgtgccggcntagagcnccgtaagggcactgccagctcttgtgccagcatgagcccagtttctgagactgccgaggagtcatcgactcctattacttgataacgagtctgactctggccgcagcggatctggcagcctcgccggtgatctggaatgccctagctcacgcacatctgctagtggaagctggggtgctattggctctgaccgtcctagctcgcgcgagctagagacggtcaagagcgtcgacagcatcgagagtgtcagctccaacggcgagagtgagagcaactcttttgctgatgtgtttaagaacggcgctctgcgagctgccaaggcacacgactcgaccgacaaccagcgcaaggcacacaggcgggttttcaccaagagcactccttctgcttaaaggtggtgcttcggcttgaaacccttctcactgtcacgatttacgcgctcggacttttcatccttgtcccatgactgcgcggactggactgcatttttgatggttgtcggtttagtctttttttgatcactacgggagtcttgttaccatctgcatgggaggtggatgaaacacgtttttctttttcttttgcgaacttttactattacagnaagtttataattcgctttacagtctctcctttagacttttctacttcgtcatgacattagggggaatcgcccggggataatcttgtctcagcctagatggacnaatgggttacttggggggttgatgaaggaatctttataccaatgaggatgagaagcatcaccggggaacaactctgcctgaaagcctntgtgaggantaaactagccnctgatgtggttacggncggcgttcctgcnggaatnttggttcggcaaattgacatttgcttccgtgcatccgtatgggatgctactggctttngctgccgncgcaanttctcgactgcaaaggataa

SEQ ID NO: 2029 - DNA, 623 bp, Fusarium venenatum
  misc_feature (1)...(623): n = A,T,C or G
ctagatcccattcttctttcctacttgaattgccattgtcgttcttgacattgacccaaaggcatagttttgccctcgttcaacagcattcttatcatttcccatcatcgacgcttccccgcggctcttatcaacatggctatctacagctccgtcccgccaccagaacagcaaccgaccacaaccacttcaacccctactgcgacaaatcctcctttggctgctatccaggctcagtcgcctcctacgccagtcaagaactcttctattgatatcgatgcttggactatctcggctctgcaatccctcagcgctcccctgtcgcacgtggaacttgtatccctctcgctatcccattgtgaagttggccaaaagctcaacccaagtctnctgacgcaangncgacttcgcgaagcattggggtatccactntattccaaagcggccctntttcaaggagggacagcagcgaagncgcgaactantcaaaagggcaaggagggaatngccagcgtcgtcgntggganaagaccgttgatgcacgttccaacttnagctcttgcctcgnattccaagtcacccacgatactgncataagggcctntancttgtaatttggaccg

SEQ ID NO: 2030 - DNA, 634 bp, Fusarium venenatum
  misc_feature (1)...(634): n = A,T,C or G
gcaatcttcatgtcagatagatcacatactcactggagatatgtcgttcgcttgtcaagcggtcgattttacaacccctcctactagccctgaaagccagccatacccagttgcggcagacgggcaacaacttcggcccgtaccagtcagtggacagggcaatatgatggtcgatgctgtcttggaccatggcgattgtcatgacacccagggtcatccggatcccccctcaacttgcacacagtctccgcggactaccagcctcgtngaagtggtccaggcgccacctcangaaagcgaagtacgcgccggcaattcgtgggacgacgccattcctgaaatccgcaccccatctcccgcaaggccctcactcgaaccgnatcaaggacaaggcttggatgatgcaagctgcgcncccagcgatgccgagtccgaagtcacggaggctggatccggatcgccatctgaaagccaagtgacttcccgtcgccgtcttttggtcgtttccgtcacaaatccttacagaaacataaaacgatgtattcaaagggcggtgatgcaaacagtganganggttcagggagcgangacaacctcacgggctaaaatcttcaacttccgggaananaacttt

SEQ ID NO: 2031 - DNA, 581 bp, Fusarium venenatum
  misc_feature (1)...(581): n = A,T,C or G
gagcactttcgccgagctatgcgctccgatgcttccgcgtcaaacatcatcgaagccaacacatctggaaagatcacagccaccatcaccaagtccagccagaatagcgacaagtctgattcatcatcaaagtcatctcttgtcaacaagctgtcccgtacttggacgtgggggtccaaggacaaggacgctaccaaggagcgcaagaccaagagcaagaagggaaagaagatcactcaccctagcgagaagcctttgacagcccaaaatctccaacaccaggagatgctatcacagttcagcttcacctttggtgcctcttctcctgagcagattgaagaagataacttcttgggcgttagcccttgttgcacacgagctcccagtgttgtcaacttctccctggaaggcgacagcgaaagcgacgatcagacttcatcatcttcatcctctatcaaatcatcctagtcaatttcctgaattggcaaagccgatggtgatggatgggcgggcatgcgggccccnatagtccacaggggcgaaagctggaanattctanaacgcccgctttaacgcgcccg

SEQ ID NO: 2032 - DNA, 939 bp, Fusarium venenatum
  misc_feature (1)...(939): n = A,T,C or G
aggatatccaaaagacatgtacacgcaaaaatgatttgaagagacatattgaggatttccacaacaccaatgctcagtggttttgtcggcaaaagggttgcgacatggtttttgactggcagacggcatacaaaactcatctcaagcaagcccacggtggctcccgcatgtctcttgacgaagccaagattaacctttgcccccaaactgtttttgcttgcgggtttgagaactgctcccaagtttttgaggctcccagcgacgacgaagccgacaccgtgttcaaagagtttgtggctcatgttgtgaaacactttgacgaaggttccaacagcggagaatggtcctattcgggacggttgcgaaacttacttcgacagtcaggccttgttcgtgcctggcaaggttcgtcttggggtgcggaagaagcgaagccaactgcagtggcatcctcaatccagtggcattcttcgaaagcgcctggaaacaaggcatttaggtgatttgcaacttcttgttcaatatgctattgctcttggtacagagccatcatcaatcacaaagtaccgtgacgactttatcaatcctgtcaaggatcaatgtcgccaggttatcatgggacacaagtctcgggcacctcctctgccgccttctggcccctctcccagcgcanatcagtatcagttccgcatttcccgaggaaacacaacccacaaccccaatttggcagcatacatggncacgcancgccgagcatatccagccagaaccggtcctgttcgttctggccgttctgcccngccaccgcggcaagctatgcctgcaacttcgtcggcccctggtccgatgccacaccatttccagtatcccacatgaataccatgtttgatccaaganaccagccccagcagcaacaatccctatgatgcacaagccaat

SEQ ID NO: 2033 - DNA, 334 bp, Fusarium venenatum
  misc_feature (1)...(334): n = A,T,C or G
aagcgaggctcgacttccagaacccgcctaaaataaatgagcaccagctcagaaccacgaccgacgtgttcaagagtggagcccaagtaagggatcccagcttcaccgactccctggccacgtccaccaaccagcagagcagagatggaaaaattaaagggccccgcgtgggccgnagcgcaaggaggagccaggccagcctgacctgacctgacctggcgctgttcagggcctgtcaaaggtagaagaaaaaaggggggcggaaggaaggagaaccgaaatatgactctcagaggtaaaattgtcgataaatttatcggttttacaagtcacc

SEQ ID NO: 2034 - DNA, 450 bp, Fusarium venenatum
  misc_feature (1)...(450): n = A,T,C or G
ctnnaggagaaatttcgccgctggncaaggtcaaaggcctcacttgtgacgttttcggcactaccgtcaactggcgctcaaccgtaaccgaggaactcacactgcgagcgttccgcaaaacctcttccgatctcgaccaagatctcaagaccagaatccagaacctcactgaagaagactggggtcgcttcgctcaagagtggagaaaatcatatggcaagtttactcatggctttgatcctgagaagcatacatggaagaccatcgaccaacaccaccatgacagcctgatcgagctcctagaagcctgggatctgccgagctttacagccctttctgagataaagtcgctgagtctagtctggcatcgcttggacccgnggggatgactcctcggatgggcttgagaagcttcggaagaacgtcaagantagcacggttntcaacggg

SEQ ID NO: 2035 - DNA, 631 bp, Fusarium venenatum
  misc_feature (1)...(631): n = A,T,C or G
cttacctattctcactctcactctcacatctactcctttctccttgctgtgcgacgagaaccactcaactttaatatcgtaacacgggcacgatacggaacaaccacaagagaaaagatatcatcgcaatcaattgctcgaatacaaaaatcatcgacaaagagaagtgaaatttacacaacgaatcacattctacaaccttttagagctccagctcagtcgctacaatgagttacggatacggtagacaaaatccctacgatgcccctgaccagggctacggcgataacggttatggcaacggtggcggttacaacagcccacaagctcagggctatggtggtagcgtcgaaatggagccccttgctcacaaccggtagctcctttgctcaaagtgaccccaatgctattctcaacgagtgtcgcgatatcgaccgcggaatcgacaccgtcgagcagaacctcgagcagcttcgtatgatccagcagcgaaccctcgacgatgccgacagctangctctagtgctgncaaccgcagctcgactccttctgtgcaccatgtcgtctaccgcgagctaccgacgagtcgaccgtnagtcaacccgaggcactttgcaagaacaaccttacg

SEQ ID NO: 2036 - DNA, 341 bp, Fusarium venenatum
  misc_feature (1)...(341): n = A,T,C or G
nttacccgactccacgttattctgactgnttcgctgtgactctccgactcctcgaaacgtccaaganaagtggatctctganggtctgacttttggcaaggtctcctatattcttgncggctggaagaaggattgcgatacaacagaaaatcatcgaggactccnaagacaaccaaagccgtttccccgaggaggggagganatcgaagaanattntgcttacaagtaccttgaggcttanccaaaacaacaaggtgtccgngaantggtcgacacctattngcgcttgtttgtggacnaanaaccggacaagtttanaaaagngtttggtctgtaaaggc

SEQ ID NO: 2037 - DNA, 271 bp, Fusarium venenatum
  misc_feature (1)...(271): n = A,T,C or G
ggacctcagacaacggacttctcactgccacccagaagcttaaccgacgaaagatcactgagcacttcaagaaggacatttctgccacgctcgagcgctcgtagataacgacagaatcggatatgcaacgaaattgtggaacatcatgttttgaagttgagacgatgaataccaggatcgaaagagagacgagagagtgtatcgacttttagcttgattttgtttttagtgtctaatgtattgtcgtggcgttggctccnaanaaaaaaaa

SEQ ID NO: 2038 - DNA, 690 bp, Fusarium venenatum
  misc_feature (1)...(690): n = A,T,C or G
ggctggtatcggtgctggtgttggtgtcgctggtctgattgttatcggtggtctcatctacttctgcctccgcaagcgccgcaacgccaagaacaaggctgagtacgacgatgtctttggtgcatctgaggttcctgttggtggtcgtggtggtggtggcggcgccgccgctgctgtcggtaccagcccccacatgtcccagacctcccctgctgccgcttccactctggcccctagccgcaacactactatgtctgagggttaccgtggtactgcccttggcgatggacgtgccggattcgccaagcctcagcagtatggacgtaactacgcggccgttagccccgagaccaactactcccgtactgctggtagcgaccaagccttctcagccgtcacccctgagaacaactacgccaaccttgccggacactcaccacacaacaacgctgccgagatgtacagccctgctaacacagctganctggcatccgacagcgctgctaccaagtggcatcaaaatgatgctgccganattgacggtaacaagtctcaagtgctcgcggtacancaccgcctgancacgtatatgaaatcctgcgccaccctatcngtaaatgaacatngtgccatgtaactaacacanaagtcctggcaaaaatccgatggaaggatgaaataaaaaaatcc

SEQ ID NO: 2039 - DNA, 493 bp, Fusarium venenatum
  misc_feature (1)...(493): n = A,T,C or G
gcttatccccgagtctttccgccgtgccaaggatggtcccgctggagatgttgtatccatcttcttcctccagtctctctctcgcctttatccttccatcaaggtcgaggactacgccaccgacattgttctgagccgtattgctctcgctgaccaaggctgcctcgccaccggaggagctctctacggcagcctgactgtcaagcaactctacaagaacaccagctgggtcgagcatcccgattttgttgactggcagaagcgcttcaacggtgctggccctcataagcttgctgcccccatgctcgttatccaaggcgaagccgacatccttacttatcccgagtacgccgaanaaaattcaacgagacttgcaaggagtccccgagtctactgccgagtacaaatcttacctgatcttgaccacggtgctgtgctgcacgcttctgtttctgacttcatgccctggaatgcggatcgtttcaatggaatt

SEQ ID NO: 2040 - DNA, 625 bp, Fusarium venenatum
  misc_feature (1)...(625): n = A,T,C or G
cgagtatctgcaaagacaaaagagcacctcattcagctccattcgcaaacctccaagcgttattgtctacgatcgtccccatcctcgagtttccgaagaactctcccctcgatcaattcattacaagcacagtatcgatataccttcgacgccagtccttgcccgcgcccccaactcacgcccaggtcttactgatgaggctgtccaaggcgaagatgctttcatctcacccatgaagcgtcaaccctcgcgattggcgaaactccctccttcatctcgccatagtcgaactcgcagcagccgcagcagtactatgagcgcggtttcgccccaagatccttggcatggtcactatcccgatgcgttcaacggcactcgcagctccagcgaatacctgcctcggacacaccaatcactggatatcagacgacagcagccacgaatgcatttcatgtccaacacgagtcgtctttcatttgacgaagaggtttacctgggaggcctttcaccacgaccgcttgttcgccaatcagagattggcagagctatcggntgagttcggatgttccatctgnatctgaattatataaccgacaacccaaaaagcaaaaccagacgtttctgc

SEQ ID NO: 2041 - DNA, 637 bp, Fusarium venenatum
  misc_feature (1)...(637): n = A,T,C or G
cttcagcttcgtcgtcatggcgtatgcgaagcangtgctgcagaagtacatgcaactgatgatccttgagggccccggngttgatgaccaggagggtcccttcgctgaggatctccctgacggtgagggccgccggggacgccttggccngnttgatggtttcttgtggtcgggcttactggctggacagnccgagaatctgacgaatgggcccccagcctgggaggatccaacaaaccagccggcgcgggtacgctctcgggcgaggtctataaagtctgtttgacacgtgggatctgncgcagactgttgaacgaactcaaaagatatacacggatacttggaacatggacactggcggccangccggttgctgcctctttacatttttgtgatgcaagtcaccaccagtggctgatgctctgcgattcattttcatgataaagggaccaacatacgatagacggagttntgatagggggaaagttcatatacggaaatcatnatggaaacttgtacaaagtccatgtcngacacaaaaccgacgactnnggccgacgcggaggaaatgcngnattttctgcgaaaactccgnattgttgtggatcttttgaacggnggntgcggatggngtgaa

SEQ ID NO: 2042 - DNA, 624 bp, Fusarium venenatum
  misc_feature (1)...(624): n = A,T,C or G
cttgatcgaacaaacgaattaatagtagccgattcaatctttgagacgtgtttcttcgctttgaaaaatggcagaatcaaccatggatttgaccaatcgtccccgaactcgccagagagcgtataagcagccaccaactctcgacgttcctgacatcgaccaagatgctgcggaaagaaaaagggttctgaatgtgttggctcagagaagatatcgtgaaaaaaagcgattgagtcgtctcaaagccaagtcaacaagcaacgatgtgactcaaaattcagacccagaaccatttcgcaatgttaatggagagccatttggagacgatatcattgaaattccgagaacggtgcaagacgatgcgcagttcagcaaccaagctgccagcatgttcatgccaacaaccaccggcgatgctgctgacatgttggctgggcttgatttcagtctgacatcgttgagtcccctttcagaaatggcacttccatctgttttgccagatgtcaacattcttccagaatttttatgcgangaaagnaattagcgatgaagcntcagcaggagcttccaagaggattaacgacacattttgaccgggcctgatccaancacattcctncgatt

SEQ ID NO: 2043 - DNA, 632 bp, Fusarium venenatum
  misc_feature (1)...(632): n = A,T,C or G
gacttcagtggtgattcagctcactctcccgactcaccactctctcccgtctttgcaaacccataccagcttcctgtctccaacgactggataaattgggacgacaaagctgcgctatcacctgatctcgacgctcttcccaagcaggaaccatttgaaggcatcaacctttctgccattccctcaagaaacagcatggagcttagcccagccatcaacccacacgacctctngggtactatccctgatgccgncccctttggccgagtcggtctcaacgacatcgacactcaacctcttttccaaactcccattcctgccatctcttctcagcctcctcatctccagtccagtatgatgcgtcccaacccacctcagatgtcttgttctctcgacagcatcacctccaaggatgccaacggtcgatatccttcgcgcaagcgcaagtcatcaggctctgggaagttcttcttctcgttcttccacctctcctccccccgcgacccgccggccattgctctcctcccaagaagaccgcgccataacatgatcgagaagcgctaccgcaccaacctcaacgacaagatcggctgctctccgaaaggctcgtccaaacccgttcgcagtcatgg

SEQ ID NO: 2044 - DNA, 533 bp, Fusarium venenatum
  misc_feature (1)...(533): n = A,T,C or G
ggattctcaagggcctctttacagaggtagatatggtaccctgtacccagaaatgaaggtcatgcaagagtacgacccgcaagtcgcatacttccccaaactgtccgaaacccccattgcagagggcaccattttcaaagcaccacctcttaagaagtcacacttctcttgttatcatggacataagacgatgaaccgccggaccaacagatattacccattaacatgtcagacttgcgacaggtcagatgttgaagatcgatggacttgcactttctgtcatttacgaatatgcgaaccctgtgtgaaaaagcttcacaacaacagcaatgacctccgctgtatggttaacagcctgcagcttacggcataattctacttacaccaacactaccaccaccaatttgttttattagaccattagtcatctacacttttacagccgtgatatcgccttatcttatggcctttcttgtgctataaagataccngatggttgttgancatgcttntgcaaatgtgaagaatgcgga

SEQ ID NO: 2045 - DNA, 106 bp, Fusarium venenatum
  misc_feature (1)...(106): n = A,T,C or G
ncggatttnaatctcgaccngngcaaaantacaccaatatngaacttgnaatntgcancattcngcactgcnttaaagagttcncaccttgatgctggcatgaaac

SEQ ID NO: 2046 - DNA, 835 bp, Fusarium venenatum
  misc_feature (1)...(835): n = A,T,C or G
agtactcgcccgtcgcggctgtagaggagtctaaccgagaagctctccgcgcgacaccaagagaaaacattcaagactctctcaagaaaaagatgcctcttcaaggcactgctgatattcccaacggcgagcgggactttagtggaaacatcatcaactatgaggagggtgctgatctcatgagagaacccgacgccactggtggtgcatacaagcgttgggacggtattcaataccatcctgatgacctcaagggcaagggtgagccttcttacacatacgagaaggacctcaaggaacacaagcgcaaccgtcgtggtggacccgccgagtacgagctctctttcaacatgggaaccagccagcgcccagctttnacccacaaccgaagcttcagcgagagcccccgcacaacccccgaattctnaaacgggaccgacattcgtcgcaacaactctacaggtcgtcacaaaatgagcgacggtctacgaaaagcgctttcggaagcattcgacgcaagaaggcttagcgaaagttgagttaaaccaaccaatgtatcttttcttggtttatttaagccttgggaattggcggttatngggtttattgtattttnggcggacaggtttttatgctgggaatggaatcatgatgtatacacttgtcaagacgacatgatggaatgggtgttgtatatgtatcggatgaaagactactgatatgatatttttttggtaaaaagggtttcgggaaaagaaagaatgttttatcctgttggtttgagatctgatagatagacatgtaaagtntanaacagctgagttnttcacttaag

SEQ ID NO: 2047 - DNA, 271 bp, Fusarium venenatum
  misc_feature (1)...(271): n = A,T,C or G
catgaagtcaacaccggcccctccgttgatggatctcctttccttagatgagccagctccgatcccccccaaacaaaccaggaaaaccccacccgcccagcttcttgggcccctggcgtttgggagctactgctacaaactatcctcaagctccaaaatcgccctcattccaggaccgtaccctttcccagaactgggntataaaaacgcctatttttgntggccaanggaagtgattaaaccaaaaaagcacttccgntacagggnggcc

SEQ ID NO: 2048 - DNA, 632 bp, Fusarium venenatum
  misc_feature (1)...(632): n = A,T,C or G
ctgaatatcctcaattgtaattcttcactcaccattcacgtggaaccttgacttagtgcgactccatcacactactacaacaaaagccaccttgcatctacgccaagcattgcatttaaactttacattaagaaacgcatcatcgtcaagaagctcagaaaagggttcattcatctatagccacaaccaatctcactcataaaaactcaacatattcataatggatcccatggctcaacaacaagcccaaggcgaacagcctgaactcaatgcctttggcaagttcactgctcagttcttgcagtacggcgccaatgcctccaacaacatttcaactgcattcgactcaatggacacaaaggcatggatacgtcttatcgtcatcgtcggcggttacatgcttctccgccccttggccctgaagtttatcacgaaagggagctgttcagaagatggaggacgacgatgccaatgacaagcgcaagggccagatctcccctaacaagctgcgcggantggctgaagaacaacccgaaatcaatgcggaaggcgacggtccggtgctgantggggcaaaaggtcgtttaagcaaaaaatngttgaaggacccttgaactgagaacgacaaaaaa

SEQ ID NO: 2049 - DNA, 636 bp, Fusarium venenatum
  misc_feature (1)...(636): n = A,T,C or G
tttttttattctcttttcccacaaacacttgattgacagattcaaactacaaaatggtggtcactactagagcaagctcccgcggcgcaagcgtcggacctgaattcgcaccagaattcaataccgagctacctaccatcccatcaacgccaacaacacgcaagagaagcgccgccaaaaactcttcctccaacggtacaacggcctcggccaagaaacgtcgtctatccgtccaagaacctaaaaaatggagtcactctccctcttcagccaccatcttctggctcgcgttgtctctaccgctcgtggcttgggatagcggttatgtccttggtcggccgcataccatgcctggaggtcatcttcagtggcctttgtacatgccatacgctctctacggacaggttgattatatttatggttccaaggctttcgatgccaagaatgggtttacgggtgcgcagtcngctatgaatattgcgagaatgatcttgtactttatgtacttgtggatgatttggagacnggctgataaaagtgaccaacaagaaggaaaagaagangaggactggtagtggaangagtggtgctttggcagtcctgattggattcaagcgcaactgtcatgactctgan

SEQ ID NO: 2050 - DNA, 645 bp, Fusarium venenatum
  misc_feature (1)...(645): n = A,T,C or G
atctacatcaacaactctactctacactacactacgctacactacaaaccagatctttttctctttacctcactaccttcacaatggatttcatcaagaacgctgtcagtggtaacaaggagggtgcttccagcagcaacaacaacaacggcggcgcccagagccaggactacgtcgacaaggctttctctgccgtcagcaaaaagtctggctacaacatctccgccgataaccaggagaagatcaccgacgctggtcgcaacatgtacgaaaagcagactggcaacaaggtcgaccccaagatctccaactaaggagagaaataacttgtaatgagataaatggatggatgctctcaaaagcgataaagagctagtatgaattaatatgacataattattgatccacnaanaaaaaaaaccgcaggcgataacgcaagcgcatgaagagcattgcaatctttacccccgccaaacaatggggaccaagttggcttaacacaacctaccccagaanagacgtgcgcgactgtgcgatgactacnccccgngtggagtgcaactgacaactcctcaccccaatggcttggcctatccattggggctttntgcgccaaacttctttagagcggnaggatctttaccc

SEQ ID NO: 2051 - DNA, 605 bp, Fusarium venenatum
ttttcaacctttttctcttcacatctcacactattgaactatccaatccctatccgcacaattgttatacaaaaacttcaagatgcctgcttcaacttcctcccaaatgcaaatgccccgtgagccggcccccgtagcgtttgctgctgaacgaactagcaccgaacagcacactaggtggaaccatccaatccctatccgcacaattgaccggattctttcaaacatctcattttctatcagcccaaatatgagtttgaacggcgagcgtttgagtactgaacgaactagcacttcgaacagccgcgaccgattcaacccatgaccatggaacaacctgaactgagcatgcgaggaggcaagaatggcgacggcggtgctatctgctgtggcatttgcgctggtctatgttgctttgaatgcctagactgctgctggtaatgtgattccatgatcaaacacggagagaatagagtatagctctggcgttcaggcattaatattaggaggatttatcaaagggatatatacaatcattggctaatgatgtaacgaactatttacgtctattcatatctaataatgactataccacgggaaaaaaa

SEQ ID NO: 2052 - DNA, 573 bp, Fusarium venenatum
  misc_feature (1)...(573): n = A,T,C or G
cgactagactcgattatccgatcaataggaacaagacaaagacactcactcgttcaacctcaaccttgggaaaccataacccacaagaggaaatccttctttttcgtcctctcatccacgatttcaccccgcctttctgtcaaccatgtcnaaccttttctctggcatcaacgctcgtttccgaagcggttccggtaaggctagcagtggtcctcanaanacccaactggttctaccgccagtcagcctcctcctccagagctgccaacccaagggaaccagtctgcagctagcctggctcccaaggtccctcctctgcccagctccccttcgttctctcagactattggcatgggacgaatctaacggcgccatgggcggtgacgatcttatctcatcctatcaccttcctcgacctcttcctctgtggntcaacgcccagtncgccnaacacattgtcaagggttactttatgacattgagcgcncnaactaaaaccgtcgaaaaaagngaatggatcgctcntcnggttgttgaacactaccgtaatctctggaanttgtccgtgttctg

SEQ ID NO: 2053 - DNA, 361 bp, Fusarium venenatum
gggcaaacagcgccgactccaacgcccgtagccgctatcgcaaccactgaatctccaattcccacccctagtagcagtcaagctgactggactcccgcgattgatacacgcccacatcggatggaatcgcaacgaaacacaacgtcttgagcctgtaactatcaatctccaaagaaaaggaacacgttacgcaaagtcaattctgacaaagttcatcctgactacgcgtgaccgtgtcgcctgtgtccctctcgagtcgttgattcgacgtttgacaggtgttgaaggattaaaagttcacctttcagacttagaactgtggaattgaccactatactgggtcgcaatcatgctacaagtc

SEQ ID NO: 2054 - DNA, 626 bp, Fusarium venenatum
  misc_feature (1)...(626): n = A,T,C or G
cccagctgtcccagccgccgtacagaataaaccaagccgaaatagcacagtttgaattccacgaaattcgcgatacccaaaattttcaataatggcttttgacgacgacgataatccccatgccttagcacaaccagctgggggtgccaacggagctgcgacagaagatgccgacgaggacgcccccgactacaagctgttcctgtccatgttcgataaacatggcgtctcaagtaaagctattcgcaagggcgagaaggattttgagtcgcatggcacccgtgcgcaggatggtcttctcgaggcgagtcgtcaggtcatggataatgtgcttggttacacgaggatccatcgcgaagatgcttgggttcganggtggtgtttccggactggtgggctgaaatggagcaagctggtgagaagaagggctctgctgtccacagaattttcatgattgacatgancccgnacttggcagaaggcatcggangaaccatncnagcaagattgaccnttggtncgggcgacttngtgttnccggagaggcattantttgtnaagggggccatggantttntggccaatcgacantngaaaaatctncttatgcntggtaaattaaaccg

SEQ ID NO: 2055 - DNA, 558 bp, Fusarium venenatum
  misc_feature (1)...(558): n = A,T,C or G
cgacatcgcaattcatccctctctctcttcctctccctcttttggttcctctttccctccaaatttgtgccgtcctctcaccgacgccgactttcgtctcttcttctctcctcggatattcactcactctgttcaaaagctctcgttgcttctgagcagatgcagtgtcgtctctcttccttctcttgagacaatagttttgggcttcgtcgacactcgttccggccatattgctttattaatacttttacctgctcgctcgtcttcctctggatattatcctaagccaagccaagttacgcactgtcgtgatttacgtttctcgtcgacctttcgatcattcactcttgcaatcgacaaccatcattttgcatcttcagccttgccaaaacttcctgtttcgactcggccgaacatttcaaattcgaatccatatatactaaatggtgcttnctggaacgaccttttttaatcaatggagctcttcgcctattcccttggatacgtcgatncgcttataatctcgattttatcgggttatctgataatactacttca

SEQ ID NO: 2056 - DNA, 594 bp, Fusarium venenatum
  misc_feature (1)...(594): n = A,T,C or G
caccgcggtggacacaacagtggccactacgaagcattccgacnacagaacgttcccgcgcccttctccaacccgaataccttccagccttcagaagcattcagcaagacgccnacacctatgggaacaccggtgctcggcggcggaacaacacacagcccggccatttccactcccgatctcctgtcaggctcgtctggtaattcttcaacaccttctctagattcattgcctcccccacctaggaatgtccggcagatctacncggttcggcgagcctaccagcaatcggcaaaccaaaggatcccgaaaccagcagcctccgttccgtggcagcttctactaaatctgccatctccaagctcacatctcccaagcagaacaacagcagctcaaccacgcccaagctcgtgccatccaatgtctcgaagcgatcaaaaaagcgcaaggnaacatcagacaaatngtggcgtgtcacgacaaaaaantcaaggaagccaagacaacgaagtcttgggcatgcagaaagaatctatcttctattttacganctcgaccaggaanaccttaggaaggcgaccatcgcgctctgcg

SEQ ID NO: 2057 - DNA, 560 bp, Fusarium venenatum
  misc_feature (1)...(560): n = A,T,C or G
gtttaaagaggggagagttgaccttttttctcgacccttgcaacaaccctctagtcctcctcttatagccaacccatagttagcagctggctgcgtatccattccgattgcgaaagccttataccaactgcgctcatcgtcgcatgcttcagctgcgacttaatcttacgcttaggacatcgataccgctccttaaaccgactgcgaacgaatccacacacaacgcgacacgctcaacttatagcttttaagcactttatcgatgcgaaaacactcggttgtattgtctacggaatcattaccataagataaaacatattacatcatggcatcttggtactccaacctcgtccaaaagactcttctcaaatctcttctctccgccagaactcttatcaggcgaacaagacggggataccgaagatgacacacatgtntgccgcgtctccgtggctattacaccgaaaaaggcgccctttcctcttggtgccaccagatccaaggtccactcacaaccgtcagccgtgatganccccagggtcgcgtttgggtgcccagga

SEQ ID NO: 2058 - DNA, 505 bp, Fusarium venenatum
  misc_feature (1)...(505): n = A,T,C or G
ataataaggtgctgttatcgtccatcgagtcttgggagctttccttttctctccattctctccttaaacctgcgcacactctttcttcttgggcctccctatacctctttttacttgattttgttccatcaatcgtcaatcgactcacacatcaatcacaatggctcagcaatactcccaaagacctaatgtccagaaccagggaatggcagagcaacctttgcaactgctcgccctgcgactcttgcatgctcagcactttctgtccctacattctgttgggtaaaactgccgaccgtatgagagaccctacaatgacaaactgccgatacctgcaacagcgatactcttattttcactgccatccaatgtgttaccggctgtggctggattactccatgatgaancgtggananatccgtgagcaatccgcatcaagggtatggcatgancaatgctgcttagttacggtttcttgctgcncctctccancaganacaagtca

SEQ ID NO: 2059 - DNA, 559 bp, Fusarium venenatum
  misc_feature (1)...(559): n = A,T,C or G
tttttttatgttcaacagaataattcctgcaatgcccagtaaactatctttgctagagcatgtcattccctttgcaggttaggagagcaagacagcacaccatcttctgcgtataatacatgtatcgtcaattcttggcctgtggtatcatctctacagtcccagccatgtcgctaattccgatatcggnggtatggccacttgaagtgatgcgaatcacctcagtcttcgattctaacaacacaaatcccactgcaccatctctcacatgagtctctaaccagtacgtccaatagttccgtatccttcacccccagtctgcacgttgtcggaatacacaccgggcgccggtccaagtcgcaaaacggccctcgcgggcttgctctcggcggtcgaaagtaaatgtactcaagatagaaggcgtggatgtgaccaggggatgtacccangatggtcangcaaatgttgatgaacagatccattccncatcccgagattgcccataccccgantgggagggaagaaanagagtnatgaggataanaaaaacntcccgant

SEQ ID NO: 2060 - DNA, 627 bp, Fusarium venenatum
  misc_feature (1)...(627): n = A,T,C or G
gtcggcgaagctcccagtccagctcctgaggtcggaacccaggatgcgacagttggaagtgccgctgccgctgccactcaggctccctacaccaagtggtacaacgtccatgagcgtcactccatctccgagttcaggatggagggcctcatcctcctcgtctcaagtttcatcttcttgttccacatgatcggcgctcgtcgtaaccgctctanagccaagggctggatgcgtgctcacgctcccattatccagaaggagtacgctctcgtcggcttcggnggtgttcccacagtgaacaacgagaatctcaacaccgacaccctnatcaaggagaaagccctnttgaattcgctactacgctacgggcgcaaaacacggttttaccgatgtcaactcactctgacaanaagtcaatnccattgncaactgtttgagccctcgccggntttttngtcgagtntgttgcccnccaaggatgtcctgaggcctgacctacccctcgatggaaggaaagtttactgtcctttnttcccggggtggggtcgaaggaaanaaaacnctacatggtttnttggggntntcaaaggattatgccccntcctgaaaaanaaaaantttttnttn

SEQ ID NO: 2061 - DNA, 635 bp, Fusarium venenatum
  misc_feature (1)...(635): n = A,T,C or G
caacaacctcaaaaccttgctccattgctaattcgcacgacgtcgctacagcatcaaatnacgacccattcggcgactaatcacacacgttctttgntnaattgcnacaagtctnttgctcacgcnacgcgcattactctccatatattttattacttaacaacgcgtttttgactggaagctttgcattcaatcccacttcgnggggaattcttcctccacccaaagctatctcaacatattcaaaccgccctcacgactgcgcagcgcttnactatgcccggngaagtcagccttaacacgcccctggcggaggctctcaatgctgccattcaacccaagctcgtcgaggttggatggggaactggcggtgccgatgattccgctctaacagagtatattgcctcatgctggttaatggaaagacccaagatcagattgccgcagaactctngggagacctacttggtctnggatccgacgaccccaccacccgngatttttctcagnggctggtcnaacagatcgacgctnttaacacccaagtcaacgggggnaacaacgcaggccccggagcaaaccaaaaaccctgcaacaaaaggngagatggatnccnacatgaaaggcaggcgatt

SEQ ID NO: 2062 - DNA, 251 bp, Fusarium venenatum
  misc_feature (1)...(251): n = A,T,C or G
ntttcatnaaaccctcncaggnaagaccanccccttggnggcgagtactggacactntgacaattttaagtccaaatccncgacaaggaagggtttntttttacaaaaactaatgattttngtttggannaccttgaggatggacgcnccttttctatncaaataccaaangngtcaaccttttttttttcncccccttttggggggngggaaaaattttnnaaaaccttccagggaaaaanatccccttg

SEQ ID NO: 2063 - DNA, 660 bp, Fusarium venenatum
  misc_feature (1)...(660): n = A,T,C or G
nacagctgcgttgactatccggtctacggacatacagngttntttatgacncttctgacagataattccgcccaaaaacccttcttcgccttgccttgcacacaaaccaatatctagtagttcgacttgatgaggtagtcggcgagaccctcgacggtagaggtggcgttaccggcgacctgggcctcgccggggnggccgacgacnatggcctgggtggtctttgcgacagcgacaccggaacgacccgatcgaancgtanatacttcgaccctcagctcggccatacatatcactctttccaacgacttctacaacaaacctctactcccaatatgaagctgaacattctccttgccgctgctctggttgctgtccctgccatggctgcctcaagcaccacagagacacacaccgaaaaacagacatctaccgagaccctcaaggcgagccagaccagtgcttcctccaagacttcgaaggcggctgctgctcccactatggttgttgatatgatgggcgttgctggtgtcgcaggtgtccttgctgctatggctctttaattgactgtctggagcatgtaccatgatcttagcgagagcagtttaccacaaccccttcaattctatataataaatctttcttgactttataaaaann

SEQ ID NO: 2064 - DNA, 594 bp, Fusarium venenatum
  misc_feature (1)...(594): n = A,T,C or G
gttgcttcacttgcctttcttctttctcaacgacgatctctgaatctgaactgcttcatactcttcctcgccaatacaacatttcttcctacacaccgaggaatatgatattgtcgcctaaagaatacgatttccttttactctgattgccttatttcgtttatacgcctattcactctatctacctcccctcccccaccaaaagtgacaaaccgcgcccgctgctcgccaaaagactccccgccattctatcgttgcttctcagtcgcccgatttcgtgccccacgacgagccgttgcgagcacgacagcgaaaacctcactttttcgaccctcgcgaatgcgaatttgatcgatccggcctgcgatggttattaacgactccggcgttagagtctcgcgtcccaacctcgccatgtccgctacagcccgacaaacgccgccgctgccggcatgcacctccaccaccgacgaatctgcctcaaccatcactgtcacacaaagangccaatttcctccccaaagangganaaacccgactcccntntgcggtactgcactcttcgttcccgatggaaatctcaagcgaccaaag

SEQ ID NO: 2065 - DNA, 513 bp, Fusarium venenatum
  misc_feature (1)...(513): n = A,T,C or G
ntggcatgagncttaacacncccaatggatccgatagccgcagtagcacccctacacctagtttaggtggtagcttggccgacgctctgctagccaggaagaacgctatgcaaaaggagaaggaagacgacgacgactggtagccgacataacgagtttatgcttcacgatgttaacaaggagtcgaaaaacaagaaacttgatggtgtagggcacaggaaaattgtctgcacctgcacgcacgatatacatatacacacagccgcgctagagcgaggcggaagaggagacatggcatgttgcttttttctgttgtatacaaacaagactgaattgggcaacccgaggtgtagaagccgcaaggaattcatggccgagtttggtttttattcttgatgctttggggcaagcgtatgcaaaagcgtcgttctgaatgactgcangacggggacattcatatacataaccangacattacaaattcttagaaggaataaatgcttttttgattcn

SEQ ID NO: 2066 - DNA, 357 bp, Fusarium venenatum
ctgttaatagtctcaagccattctcgctcaccgagaccaatgaaaccaaccttgataccgttggaggtggtcatcatatgggtctttttggcatggcccaggggcgtgtcgttgccaatatcaaggtcaatgacattggcgagcagccaggggaacttgttttgacttgagagatgctcaaattgcttgacaccaaagtcaaagtcgtggttctatagattgagcctcgttagttaccatgtcggtcaaggatggcatgacctacacacccctacgcaagcgcaatcggtcccaacatgatcaaggacaggaaccatgtgctgacctgttccaaatagtcaatataaattaaatctc

SEQ ID NO: 2067 - DNA, 543 bp, Fusarium venenatum
  misc_feature (1)...(543): n = A,T,C or G
aggactcaatgcccccatcgcctcctcaagcaatcctcacattcaacgagaaggacgccaagaagcaatcgcaacaacaacaagaatccaactcactctacgaagaggagtactaccttccacctcgcagtcccgcgaggcttgtgtcggccatctcggtctactaaagcaaggggttttactctgactctgcgtcttatgaatgaattgtgatttctttagcgacttgttttatacacaaagcgatatggcggcattacacttggcgttttttgttatacaaagggataccacaacgggattttgggatacagcaaaaaaaagccttttttttttttttatcatatttaaaggatncacttttacngattttcaccctctccctattgaaggaataaagaaagacagaattgtccaggcaatgaggaattggatcacatcatgggtangngccgttccactaaaaggtgagtggcacccgatcagatagatagttcaaaaacagacttttaattaagtcttaaaaccaatggttaaaccttc

SEQ ID NO: 2068 - DNA, 411 bp, Fusarium venenatum
  misc_feature (1)...(411): n = A,T,C or G
cgccaccatctttgaaacgtatatcctccccactgcgaaagtgactgcccacccagccatgtccacaacatcatgtctctgcttcttctgatctagagcctcctgtgcactgatacctaatgcaaagccacgcacgccctcgcgatcgacccgtagccatcctttccagttcgctgagatatcaccagatcccaaaccgcctacgacgatagttccccaccactcacgtccagcgcttgcgcgaagctacgtcgccgtaaagaaggatcccttctgcttcggctacaagggtacgtgtatgttctggatcgtttcgagcgggcctttgaacgtaaacgtgtcgcatatgagatggcgaacaatgcaaccnggtggcntcgaancgaccttctatgtcgataatgagaatac

SEQ ID NO: 2069 - DNA, 457 bp, Fusarium venenatum
  misc_feature (1)...(457): n = A,T,C or G
naaggaaccacaggaaaacaactcctcaagaaccttcagggtttggctcagaagagaccacgcgacattggtcttgccctgactatcatacaaatacagcttaatgacggtcacgtcggttcancattatcgattctngagtctttccttcagcgacttgaaaaggccgaaaatgtagaagcactgaacgcccggtttagcccaggcctagttgccctgaccgtgactcttntgcgcgtacagggtcgagagtcatnatcaaaggccgaactcgtcaaggctgcgacacattggcagttccggcaggcgagcccggccagctctnttctagaggaggctggcattgagttaatgaagtcattcaacgacaaggacttgcaacttgctggcgcttcatttcagaactaatcgacgagcaagaagggctcagatattgncacancccgggcttgttgca

SEQ ID NO: 2070 - DNA, 589 bp, Fusarium venenatum
  misc_feature (1)...(589): n = A,T,C or G
ggaagcttaccaaggatttccaggatcgattcataattgcttattctaagaacgagctgccggaaatcgattttgaggaccctatggactatgactggtacagtttgattgactggacactcgagctgccgcgacgaagaggcattgatcttccagtaacgaggggtgccctggaaaatgactttacctttcaggacgtcactccccatgatgaagaagacccccgagagaaattctacaaccctcagacatctgttttcgctcgctttgaggccgtcgctactccatctgttgttgttgtcgaaaagatgctcagtggacccagtgttgagcacatcgaaatcactgaaaatgacattgccaggtcttgggtacgatccttgtgctgcacagatgananccgttacacggttgagcagatcaagcagaantctctaccttggcaggtggtgaccaggacaagatcnacttattactgaaggaagccatcgatgctctgacacagcagcgcatcatctgttaaancaaacggncgccgctttctgggagactttcanactccacgancaanttggacatgtgctttcga

SEQ ID NO: 2071 - DNA, 721 bp, Fusarium venenatum
  misc_feature (1)...(721): n = A,T,C or G
cagcgtgcaaacgatgctgagcaaaaggtggccctcctgctggaccaggttgagcattctgtcgataattaccgtcggcgtagccggcaagtgcccagtgtgaattctgaagtggctgncggtgccaatggcctgggcttagggcattcgagacaggagagctccgaaggcgagagtgtctatggaagtacaaacggaaacgggaatggaaatggaaacggaaacggaaacgggggtctggaagctagaaacagcgcacccttggacaagccttgccaacgagcttgaaacccttcggagccagtgggaggcaccaacaagactatcgattgagcaccaactttgacttcgatggatcctnttgcgccaagaangaaagcgatactgctgttggcgtcggcctcagcgagagtcttgcggattggcgcaagagnttgacacggaggaaaaccacaatgacngggacaagccttcgacacacctaatcgcaagtaattnctggataccgataccctttcatgacacaaatatcccaccctnttcgtttgatttatggtcgatggtcaatgtctgtacatnccgatcttcgcnaaaggtggaatggagttttantttgtctttaagggacactnttgtcanttttcgcgtnggggcnttttttntttntttccactttttcgacgtattccaattttntgnaactaattttttttgaanaagg

SEQ ID NO: 2072 - DNA, 624 bp, Fusarium venenatum
  misc_feature (1)...(624): n = A,T,C or G
cgccccgtcgtctgtctaatctcaacctcgtttctagggcacgaagctaccctgatcaaactcctccttattgcaccagagttctacctgttcaacacgcagtcaccgttttcgaacgctcctccaccacaggtccaagttcgaacgtcatactcaacctaaccaccaaactcatccaccagcccgccatcatgtctaccgccaacaccaacaccaacgtgggacgctgccgttaatgacgtcgccaacactcttgagcaatacctccatcaagcaacaagcctgccgatgacaagactgccgccaacgaggccgcttcagccagcgctgctgagggtcgcccgcctctatattggcaacctgcctatgcgacaactgagggggagttgaaggacttcttcaaagagctaccttgtcgagtctgtctcgatccctaagaaccctcgcaccgaccgcctgtcggctacgccttcgtcgacctttccactcccactgaggccgagcgtgccattgaggagcttntctggaaagagatcttgagcgcaaggtnttcgttcaactcgnttncaagcctgagccgttgngagaagtaaaaggngctnacggngatggntttggngctga

SEQ ID NO: 2073 - DNA, 649 bp, Fusarium venenatum
gatagacttaggagaacaggtttcttggcattaccatgacttctcacgctggtctacagaatgtcctgaattttcgtgatgtcggtaagacggtcaatgatttcttgggtacaagacgaattcgtgagggcttgttctaccgttcagcaagaccagatgatgccaccctttcagacagacaacttatcagggatggtcttggcgtcaagaccatcattgacctaagaaccaaaactgaacacctcaaccaagccaagagacgcaaagagcaatccagtattcctgcactcgtcaagtctaatgaagctcttgctgagccactccaaatctctggtctgaactatcgagacgtcaaaatcacaggccgcccgttcgagctgtttcttctgagtcagttatcatggtgggatttttttcgcgttgtttttctctttctatgtggctatcgtactgaagccataaatatcatcggagagaaagttatgatcccacgtgggcttgtaggactggggtttagatacgctcgaccagtccaccaaggagattcacgaagccttgtctctctatgctgccccatcaagctctcccttccattgttcaattgcacccaagggaaagaacgaacaggcctcatctgtgctttggtgcc

SEQ ID NO: 2074 - DNA, 566 bp, Fusarium venenatum
ctcttacaatcggctagccagcatgtcgactaccactactacagagacacaggcacaacgcactgtcccgatcagccttcaagcaaacaaatatccagagcctttaaaggcttcgggggcacttgacaagttcaactttgaagagtccacgcccgtcatcggacgtgaataccctactgtcaaccttgttgacgatattatcaatgcaaagaatgcagatgaactgatccgtgatcttgccattaccatttccgaaagaggagtcgtcttcttccgtgcccaagataatctcacggatgacctccacaaggaacttgtccaccgtcttggccaactcaccaacaagccgtcagaatcaagccttcacattcaccctcttctaaacggcagcaatgagtttggtgtagaagataatgaaatcagcgtcatctcatcccaatctcacttcttccatgacaaaaaagacagagatgaccgcaagcaaggcgctgccagctggcacaagcgatattcagtttgaggagtcccagcggactacacgagtctgcgcctaactaccctttcat

SEQ ID NO: 2075 - DNA, 435 bp, Fusarium venenatum
  misc_feature (1)...(435): n = A,T,C or G
ccttgttaactttgcaaacaaaccgatcgatacagagaaactttccttgcaatctcctttaacaggttttccaagagcgagccgcctgtgcacggnttcatctaaatgatcccccttaccggtacggaagagccaaggtcgaatcgggctggcccaactttaggagatcgtnangggtcccctacctgagtacgagacatccataataatttacgatgcgctagtttgtctagttccagncgcccanagaattggacgacagtttcaatgcaaacgaaggacacctatcagctattctgatcaggactatcccgattcatcaatgcgttcggcgttgattatggaccanaaacattcaggaacaggccggctcttgatgcctgttgaaatcgcactactcatttctcttacctggcattctcgacatatttcagg

SEQ ID NO: 2076 - DNA, 950 bp, Fusarium venenatum
  misc_feature (1)...(950): n = A,T,C or G
gtgcgagcacgcaacgtcttacgccatttgtcacgccctttgacaaaaaagacacatcatctaatcttcatcttccatctaaccaagtacatacctcttctcttataagttaatcgtcgtttaacttatcagcgatgaggtatgtcctttgttagctggaagatgaagcttgggtgatctcccagcttctatttcgcagaataaacactttcccatttcttcagcgcctagtaccgtcaagacccgcgcccacacatcccggaatcactttgtccgcgcaacagccaaacgtcaagcccagcacaaaggcgcgaacctatgcctcgacactggactaccgtgtacaacatcgaactggggtgaagccacttgccatcgctgtggtcaacaagatactactaccgcttccgcgcgccgtcctcagctcgaaaagatcctacattttgagatctcgacagggaatctgcagcgcgcgaatccacgatggacacacgtccaccgtaatcgcaccgcccggaatcacgcccattctaacggactgggtggttccgatgagctagaggggagagacctagcgagaagcaaggtccctctccctagcgaccgatatcgtctcgtcagaaggcctacacttgaaagagaggaagcgtttcgggacgcttccacggctagagggaatgtctatctgggccgaaagatgcccatgacagaagatgaccaagttgctgagctgtatcgcatgggtttgctgtacgacgatgagcaggttcgcggagagggcttcaaccttgatagcatcaaccaccaagaacccatctactccatccgcaccgccaaaccaacccgnaaatccaagcgctcccaaagtttcagcttcaaccagcctctacatctagacctctnttttaccgattngggcggngatcaaaccatcgctcaactcctctcct

SEQ ID NO: 2077 - DNA, 588 bp, Fusarium venenatum
  misc_feature (1)...(588): n = A,T,C or G
aaatctctgaagcgtcccagcctcttgctctgtgattcagctgctgtactgtctcgtctcatctcgctacttaacttcagcctccccgacaatctcaaaaataatgctcaagttgtcttgtgctgcccctcttccactctgctctcaactgtgtttccactacaaactgccatcatgacgggcgctgtcgctacccctcggtacagcaacgacaacttcgaaacagcttcggttcgttcagctgctccatcttatgtctcagaagctccctcttaccactcaacaaacccgtttcccgagaacttgccttcatacacccctccagctcgaaaccatgcggttgtgagaagctccatgattccttccagcagcggcacatccactcccactgcgcgccaacagactatcggcctgcctccagtgcccgcggcccctttgcgatcccagccgaatttgaacaactttcgtattgcgacgtggtcatctgtatccaagcaatcccgccgcccgacactaccagaacgtngccaacngaagattgacagcacagcgtgatccgntagacagccttcgtcgcgttatgactga

SEQ ID NO: 2078 - DNA, 637 bp, Fusarium venenatum
  misc_feature (1)...(637): n = A,T,C or G
gctcaacaacctaatttattcttcactactctcttttcaagacaaacactcccaaatcatcaacatgcagttctccgtcatcgctctcctcgccgttgcgactggtgctcttgctgctcccggcggaccttccaagcccaacaagcccaacaagccccacaagccctctcctcccaacgtcaacgtccagagctgctacaatgatcaggctctctactgctgtaacagcgatggtcatggcgcagaggtcaagtgcgagtctttctccaacggtggagttggcggcatctgcaccggtatccagatgtgctgcaacaacaacgaaggtgctcagggctgcagctttgccgtcggtggtggcatcatcgtcgtcggtgacggcaagggttggtaaatggtcaactcaaaagacgaggtcgatcatcgcatcctctgggaccggggtggctagcggataaataacttacatcgacattcacnggtcttcacnggcaccatggtcagacagangttcagattgatatgangattggatgacggatgattatcttttttggtttngtaggggatggctntcgccatttaaccttaaccataancacccactttatttaatagcttttatcaaggtggatta

SEQ ID NO: 2079 - DNA, 626 bp, Fusarium venenatum
  misc_feature (1)...(626): n = A,T,C or G
caacttactatgcctctgccgcctaagcaagccaaaagcaagcctaccaacaagaccccagcccagccagcttggagccccggacctcgtggtattgaccctaccgtttcggttgctgcagcggccatggaaaacattaaacgacgagccggaaacgagaagctttgcaacaatcattatcttcgtggaccgtgcggtagaatggacatttgcccctttgtccataattacaaggccacccaagacgacttactcgcgcttgcaatgctgtcacgtcagaatccttgcacagctggtcaagaatgcgatgtagatgattgtatttatggccatcattgccccaatgtcgttaatggcatgtgtacacgacagtattgcagattctcgagagatgcacatccgccaaacaccaaatttatcaacaagaacatcgatgttaactagaggatccgaaccttcactggctgtcgtctcgaacaactngcaatataactagaaaggattagggataggagttaagagaatcagggctttgggactgttttggaacgggatgtgtcaaagacgataaattgaaagcttnatcttgnttngaaacaatgctggtngcgctcactgaggnggng

SEQ ID NO: 2080 - DNA, 623 bp, Fusarium venenatum
  misc_feature (1)...(623): n = A,T,C or G
acgagtctctccagggttctttcatccgacggcccatctcatctcctctcaactcttcgcccctcacgtttccacatcgtcgttgcctctgacctgcgaaccctcttgaccccggtttgtcatcaggcttgtttttcttcctgattcgatacgactcaactttttcgagtctatccatacgtcctcgaccgaacacgattgcttcttgagcttaaatccttgacaagagctctatttcttttaacgttttcacgcatttgtttgccctgttcctgcgatacagagagcccgccgattgcgcactcgatctaattttcgctctcccgtcacactcgccatctcaatcttcacatcacaacagccatcatggcctccaacgctcccactacctccgccgccgatggctctactaccgccgccgcttccgccaacagcaacttgtccaaggatgaggttggctggtactttgtcgagcaatactacaacaccttgagcaagtcacctgagaaactccaactcttctaaggcaagcgctcgcaattcgtccaaggncaaagaaggcgaggtcgccaacgtctctgttggtcgacaagcttatccaaagaacgaatcaaggagctcga

SEQ ID NO: 2081 - DNA, 453 bp, Fusarium venenatum
  misc_feature (1)...(453): n = A,T,C or G
aagaaaaggatggagcggaggcggtctggacgatctcctggagaggggacaggatttatttgcaaccgaggaagacagcgcaaacatgggcagcggtggcggcggcgacacaccaaagctcttttcgatcctcccgcccaagagcatacttgccgatacagggtcagaactatccaggagccacgctagaggtgacagtctcctgatggatacagaacgctaccaatcacttgctgcgctggcttcagatatgagacccagtggtggtggcgacaccgacagcgtcttctcgacagactttaacaaaccgcgtaacgcaagaccgtctcaccacagctattcgccgggtccaacagatgtacctatgactcgctagttgggccgagcagaaggtataggaaacgacgatgatgaattaagtcgatctgaattacttntgctgtggctgaatca

SEQ ID NO: 2082 - DNA, 524 bp, Fusarium venenatum
  misc_feature (1)...(524): n = A,T,C or G
gaactgaacaaatcctcaagcctcgcgccttttctacctgaggtagacttccgcccaacaacgtcgaatccacccgccagagataacgttccctaacgaaactgcccacgtncatccatctatagccgcgtcgcgaattgagtacaatctatacacattctgctatttcctttccgacgcggcccttccgctgcgccgcgaccgcgaccgcgatccacgccccgtaaaccatctaaatatggctgctcagccgtccgcgtcctcgtcaacggcgccggctacgggcccggcatctgcagcangttctgagaaagatgcatactcatcaacccccccaagcgatataccagtacgcacaaaggaatcatttgataagctgatggtggagcgtttcatcacccgtgatgccatcgccgccgccgcgctcggtggtcaactcgaccagacccgttaaataatgagcgacacgcgcgaaaagatccangaatatcgccaggttcgcacagantaccgccaatngttcc

SEQ ID NO: 2083 - DNA, 416 bp, Fusarium venenatum
agccagtcaccgtaccaagattaccctggccagcaccccagtgttgccaaccttcgtggccaggccaacctttcccctgctaccggtggcggtcacagcagatcaggcactgctctgggtttcagcagtggctcccgctctcctatgcctgatgccatgcgatcacagtcatcatttgacttccagcacggccagggcggtcccaccgacatggctatcgttgagtcaatccgctctgttctctgcgaggttgatcttgataccgtgaccaagaagcaagtccgcgctcttgtggaacaacgtctccagaccgagcttgttggcgagcgccgcacgttcatggatcgacagattgaccatgagctcgagaatatgtgatttgaatattagagaaatgtggaaatttgtgtttttat

SEQ ID NO: 2084 - DNA, 508 bp, Fusarium venenatum
  misc_feature (1)...(508): n = A,T,C or G
tttagacacaaccccacgatcgccaacgctttcaagagtcaaaggatatccatttgaggggacaggaggccgcaaatatgggtaacaacacgttttcgtcctccaaaccgaccacgccgactacttcagctccaggttcggcccacggtcatnttcatggccacnaatctccccgccatnatctgcgcaaggatgcccgcaatatnattaccgggcacacgcatngntctgccgcgccgccggagccttntatggcccaggcccagggctcaacggtgatcaatcggcaaagagtttgcctcctacggnggtgtcttntnttagcggctctccacacagcaactttaccggggngcataagactgcttnttcctntgatgctaaggccatcgccgaaaaacaagngctgcacccctgaatccaaatcgcaccattgggannaaccgacaagcccttgacgtncctatggagttttttttttacaancacataaatcccccacgtccac

SEQ ID NO: 2085 - DNA, 254 bp, Fusarium venenatum
  misc_feature (1)...(254): n = A,T,C or G
agcaagtcaaggacaaggctgctgaggccagcgccactggtgctgagaaggttaagggtgaggtcaacaagcgtaccacccgcagccagtcgtaaggggaagacagaaaagatctaatcggactgggattgtattaaaggaatcatacacttcaaatcgttcagaggaaatcaaggagtatgagaagtaagaagcaagttgcggaggaaatattcacaattgttatgaaatgaaattttgttcttttggcgaan

SEQ ID NO: 2086 - DNA, 520 bp, Fusarium venenatum
  misc_feature (1)...(520): n = A,T,C or G
catatagtttatagtagagtcaccaagctcttgttcgagtgcctctatcaggttgtctatctctttctgggggcattcttgtctttcttcttgcatatccttgacaacatggactcttactttaaccanaanacagatactgggaccagggtcgaggcgatcgctgttgactggtcagctagcgttctgtacagtccgataccccttctaatgtgcacctacaggggaaaaggctgctcctgcaggatgcgaatgatcgacgatttttctgttggtaggatacggacgttcaaatcacgaaggccattggtctcggattggttctcagctacattcgctgcaanacactgtcctctgacgtggtaaggtggtgagacttttgatcggcggtagttgcaaattgttgtcgggtggcaaaggatcccagccaccctgttgcatgaaaataaacggggactcttgctgtacatanantctctgtcntatagggtggncaaangggaatggatntttccaagac

SEQ ID NO: 2087 - DNA, 655 bp, Fusarium venenatum
  misc_feature (1)...(655): n = A,T,C or G
ctcgaccctgtgacgatacagtgcgacgtgacttgctgcttccccgccattgctgcctcgcgggggctcttgtgattcaccgagcatcatgaagctaaaccatttatagtttagccatctagccccgcgcgcatgtccagtcaacgtgagttgggctgggtgctgctgccacctgctaaggtgccatctgccctgggtttctgttaatgcccactgtaacccgcgttgctgcctctcaagtcaaaacaagtcaagacaagtctgcgctggccgaccgctcatctgtaggtgtttgcgcgtactgtgtctgtgtcactgccaccttctgtcactctatgcatttcctcacctcacctaattattctgcctgacgcaagcaaaccgtaacctagttntttttctcatttccaacccttnatctcccttttcttccccttcttnccttntttctcaaccacaactttncaactattttgctgnctgaacccaacagtcattgngacacttgaattncaccactcttgacagcacacttaccgcntcacaacaaccatnaacgtnaacatgcgcagnaaattcaanggacgaacaaccttttcaagaagcgcaaaggtgnggcggccntccaaaaaaanactacgtttcggtttttgga

SEQ ID NO: 2088 - DNA, 667 bp, Fusarium venenatum
  misc_feature (1)...(667): n = A,T,C or G
ttttttttttttttttttaaggcttncaatgttgctgtattttattgtgatggtgtaacatcacgatgatagacatgagggctttgggtctacgtttgcagacccaacatgacggcacagttcaattcttgtgaaactctagtccgcaaacgtcgatgacgcctttcattccatgttgtccaggcaaattcccaagtcgagagaggttaaatgtgagtcagatgcagccaanaacgaggcgtccggggttagataaccgacgcccttgtgataacaactccaacacaacctctgagtttggcaagagggcagcagtctggggtagttgtgacttctncaagctgggaggcggtgctggcttccccggcgctgagggtgaactcgacgaggaagagggcgacgacgaagacatgcccgcgctcgagggtgacgacaagaaaggacgcccgtccccgctgctgccgctactgagaagaaggattaaatccaacaaatatgattgtttgacgttgccaaaggcgagcatttctgaactatagnacaggattaggctgggtaactttggcgtngtgcctatcaaggnaggcttatttctcggatatgtagttngcactgcattgcctgtttnnatatggaagcaaanaaatggaaaaatcgttaacctatg

SEQ ID NO: 2089 - DNA, 512 bp, Fusarium venenatum
  misc_feature (1)...(512): n = A,T,C or G
tgttttgttcctgaatcaacccgtcgtcaggccagtgaatgtcacgtcaccgaaatacatacaagccagcacctatcacaccttcacttaacctttacatccatagaaccaaaagccaatttttttgtcgcaaccccaagctccaactgctcacaaccgtctttgcttcttgaacgactctttcatctccattttctcacgcaatgccatcatcatgacctctcaagcttcatcatcgcatcctcctgcctcatctaacaatccgnttnttaacatcccaaccagacctggaactcgacatccctcccccaaanaacaaccgtctcgtntaaaatacctcctccgcacacgttatcctccgcagtanggtgcgttaatctacaaggcgatcctcctgagcctcggggtcagtnaattttaaacgcctccccgcgtgngcacatcgacaatccaaaagnaaggggaagntgcaangcccacgtgatagggctacgtaatggtccatcggggag

SEQ ID NO: 2090 - DNA, 136 bp, Fusarium venenatum
  misc_feature (1)...(136): n = A,T,C or G
ntntgccaangtccttntgngcgttngttatangagcactgcccttttnaacacgggctgntaccgancaatcttgtcattgcgcntcnaaaaaganancccaaacntttacantggcccanggcattataaccat

SEQ ID NO: 2091 - DNA, 431 bp, Fusarium venenatum
  misc_feature (1)...(431): n = A,T,C or G
aggaatacccgctgaacttaagcatatcaataagcggaggaaaagaaaccaacagggattgccctagtaacggcgagtgaagcggcaacagctcaaatttgaaatctggctttcgggcccgagttgtaatttgtagaggatgactttgatgcggtgccttccgagttccctggaacgggacgccatanagggtgagagccccgtctggttggatgccaaatctctgtaagtctccttcgacgagtcgagtagtttgggaatgctgctctaaatgggaggtatatgtcttctaaagctaaataccggccagagaccgatagcgcacaagtagtattagatcgaaagatgaaaagcactttgaaaagagagttaaaaagtancgtgaaattgttgaaagggaagcngtttattaaaaaaaaaaaaggccacga

SEQ ID NO: 2092 - DNA, 616 bp, Fusarium venenatum
  misc_feature (1)...(616): n = A,T,C or G
cagggcctctgaaatctgtcccctagttgatctccgagctagtacttgaacttgaacacgcgcaatttccatatccgaagcaattcattttctacgacttatttcctcctatacactcaatctttgtacttctgtcttctcgattccttcactcgtcaacacttgaacccttcagacacgatggcgcaaactccccagcaacgacgacgtaacgaggcctttgccaagggcaatgagaacaagatgggcaaggccgagcagcaagtcaaaaagcgggttgagaaggtccaaaagtcacccatctctatgttctggctcagtgtcctcggcttcgttatcttcggcggtcttgtcttcgagggtctctcccgattcttcggttaaacctattcttcgatccaacctctctgtcctacaaaacacaaacacaaaaaaccaaaacaaacaacacacaaatccccaatcaagcttcgctcaagcggnggcattgtaattctttggagatataagaggtgttggcagcnttggcgccgtgcggtctacatacgagcgngggtcccaagtccaccatccaangagctnaaaagggggcagggcctttactggntttnatggt

SEQ ID NO: 2093 - DNA, 167 bp, Fusarium venenatum
  misc_feature (1)...(167): n = A,T,C or G
nnggggatttttaccaaacgcatgcttaaccaaaaggatntgnccccgatngggntttagcnacccggggatttttttaggaaaagggaaaacttgacctgggcgtttactccggctaaaggcntttanagggcntttttttgcaaaccgggggggaccaaaagtta

SEQ ID NO: 2094 - DNA, 546 bp, Fusarium venenatum
  misc_feature (1)...(546): n = A,T,C or G
cagctcctcgtagctccagactttgcttgttacgaccgactgcacgactcaagccaaaatgtccgattctaccgttgcccgtcctcctcccagcgccatttccaggccgnttagcgagtctnttctcaatgagaagngggaccgctgcctctccaacctcctcgtcaagtcatccctcggtctcggttttggtgtcgttttctctgtcctcctgttcaagcgaagagcatggcccgcctttgtcggcgttggcttcggtgccggccgtgcctacgaggagtgcaacttcagcctgaagcaggctgcgcgagacttgaagaagcanaccgcataagggaactgcggattgggcgtcnactaaaagacgagtcgtttatttgtaccaagaacaaacacaccagaacatggnggggtgttaaaaaaagggcacggagatctttgccatggactccagggagagccaatgtcanaatangacgttttttccagatcaatagaggnattatgnacaacanccctggcattttttaatntttaccccagtct

SEQ ID NO: 2095 - DNA, 555 bp, Fusarium venenatum
  misc_feature (1)...(555): n = A,T,C or G
ttcaaagtaaaatgggtatcttagtattcatattcataacactagaaggatgatccctgggaaacacaaagttgggccaaatgtctattcgacgtagcagcataggtacacagggcagctacatcggagaaaattgatcaagacaaataacccaaattgggttttatagttttttcctcaatacattaacaatccagaaaaccttccgtctcataaataccaacaaaagaatcaatgtatgtgcgcaacagagtctcaatatacccagactgctccatacccagaagaaacgagaaaccctctaaaatgcagtcatgaagtcatggaaccccaccctagaaccaaagatcaaatggtgcgtgactccgcttacaaagcgaaagcggccatgacgaagaccagcaataacggcaacgggagcaccgaaacgggctcaccatatttnttggtctggcgcatttnccctaaagacgcccagcgaaacagctgccgcagtcggcaacggcacagcaacancaacagcggagtcgacgagcctgccctttnttccccgaa

SEQ ID NO: 2096 - DNA, 1004 bp, Fusarium venenatum
  misc_feature (1)...(1004): n = A,T,C or G
cggcctcgtcgctcgctttttgtcgcttcaacaacttcagcctctccgatttgggcttttactaacctttaattcaccgttacaatggccgaccaaggaggagctggcgctggagcccccgtaactaccatcgtccctttcaacaaccaacaagttcttccagcttgtgccgccgcctgtggtcccctctacgatgccaacggcgcctgtgttccgcctcaagtagccgctgatgccggccccaaggcctacacatcatgtttctgtctcgaccagcgagtcgccgctttcaagactgcaacccagggtgtatgcgatgaagcatgtggtgcagaaggtctttcctcaatcgctggctggtttcgcagcatgtgcggtaccgcgaccaagacgaatgggggatcaacacaacaaactggacagggttcaacaagctacgacggctggagattcttcatcaactgctggttcaaggctttccaacaacgagggtggtggtgactggatttcaaaccattggcagtgggtcatcatgattgttgttctcgttgtcggcatcaccgctatctgggtcggtgcctgcatttggcgtcgtcgctacctgaagaagaaggatcgccaatctcatctcattcaaaagcattncggttccgctcgcgaccatcctggggtcccggtatggaggcctctgagggcggcataccttacgacgacgaatcnaaccgaaattcgcatggcctcatgcttcccggtgccacccgctngtgctgtcgaaagaggagccaaaggagaagaagcgatngatcgtcccgancgaacatgatgatggtcatcgttccattaacgccttttccgacctcgtaccattntctttgcatatccgagttcaatcaaaagaaanttcgacctactcttntcgcttacncatanacgggcnttacactttcggcttgtttntttgagggatccactgctttgatttgnagtttactggcggtttnccc

SEQ ID NO: 2097 - DNA, 590 bp, Fusarium venenatum
  misc_feature (1)...(590): n = A,T,C or G
gctgaaatcttagcaccacatataagggcgcggctgttcgtgtcacagcttttgcgcgaaaatgactttgaatgatgcacatagaaggtctattgttggcaaagcatttgcgaattggctttcccgaaaggaagcctcaatggtgcgtgtattggtttcggaagatcaggtcggagcgacggatgcttgattctaagacggatatgttacaaaatctcaagggttggaagacaaaagtgacttgattactcgccaatgtcaagggcttgctttctttggtgttgacggtcgagtctatacggtatggacttttgtttgctggggccgctgtctgttttatatttcacaagcccggaagcgacagaatctcgggttcgacattttttccatctcgacatgacggtaggggaacacacggggantcattgatttgtcctctctgggcttcatgggacggtggcggtactactggaaaatcngttacgggttnggtgcataccaaaggggantttttaaggtntattttgcttggccttgtnactcaatatccantcncccgtgtcgctcatactgaaccnacacaaactaac

SEQ ID NO: 2098 - DNA, 153 bp, Fusarium venenatum
  misc_feature (1)...(153): n = A,T,C or G
ngtaagaggcgttanngtcttggcttgancaccaacttgggtcaganttaggtctatntatgggatactcaacggtnagagagaatttnngtggagcttcgcgacggntnctacatnggacagccatgcatgaatcatcatgtnnagaagtta

SEQ ID NO: 2099 - DNA, 508 bp, Fusarium venenatum
  misc_feature (1)...(508): n = A,T,C or G
caattatctaaaaacccttctctccacacttcgctcagaccgaaccacgtcagacgagaatcaattctgctgtagccacaataaacatctccacagtcatcgccgccaccaaagaaaatatttctgccaccattcaaagctttgcttcgctcaacctctgacagccccgattagtacccggagctcccgactctcccctccaaacccatcggccctaccgaccagcagattgcgaccgatatcgacccacgatgccggcgtttcaaaacaaaaagtccggtccacggccgacatgaaacaggatcggcatggcggtatcgcaacctcatgaaacaagcacccattcctcatgtncgggctgcccttcctcaccgtcatcgttgctagctccttcgtcctcacgccagccatngcggtccgctatgaacctacaacgcnaagttcgcngatgacnaagganaagaactcacntgntcgattgccanaaaggtggactgaaggaagaata

SEQ ID NO: 2100 - DNA, 539 bp, Fusarium venenatum
  misc_feature (1)...(539): n = A,T,C or G
gcaaaccaacactcaaaagggaagcgatgaatgcgagtccaagatcgagtccaagtgcgccaagcagaaccctcctaagaaccttgctagcgacgacgacggcgatgacgataccagctccagtgccaccgacactgctactgcctcggccactcagacttcgtcggacgctagtggcaccgcanangctgtgtccacaacaacttctgatgcctttgctgcccctaccatggcgccagcaggcaagggtgccgccgccgctgttgctctcggcatgttggcatacctcgtctaagtgttttcggggctgaagcgtggggtgctgcgatcagcagtgccacgacaccatcccggcaccccaccgccacgtgccgtaccttgccggtgggtgtcntgtcggggttgctcaacacttattttcacttctactgcccattttattacacagtacaccttttcgacatgcaacgcgataccttttgatgaattaaagaccnaatgatgcaagctttggtaaagcttggatgaagtaatgacac

SEQ ID NO: 2101 - DNA, 561 bp, Fusarium venenatum
  misc_feature (1)...(561): n = A,T,C or G
cttcatctttcaacatcacattgcataccttgttcataacataaaggtcttggcctttatacatacccacttcctcattcacatcatatacacattcgtacacacaaactcatcgacttgacatgatcgcatcgctctcatcgtcgccacccacgtccatgccttactcaacttcccccgactctcacatttacaacaccgacaacatggttcgatcatnttcagcagagcccgcaaagagctcaagcgaaagggccccgaagcgtttcacactcacaccatnacaacttgcgcgcaaganaccaacgaccgagaggntnagcgagctatnagggcgcgaaccaaggacacatttgtcgtntggagcgcgaattggaggactcaaaancaagcagagccgtgatcanaccgtccaagactttttaacggaccagccttgngagggcttntgcgacttaaggaaacatgggcgtttaatgacctatnaccttatttgnactgggacnatntttaaacacnaaccttgtnggtncctacaacctcacggatatggggttctta

SEQ ID NO: 2102 - DNA, 492 bp, Fusarium venenatum
  misc_feature (1)...(492): n = A,T,C or G
gttccaaactaatgccagtaccgacaaaattttacctccttgtgtaacttccactaatcaggtctcctctctaaccttccagccgtcaagtcgtcgtgttatcggtggagtatcccgagattgccacgcttacagagagaagagagaagagacaacnacgctnaagtacagaaaagacaaaattaacaagtcagcttacgccatcaagacctaacatttagcctgtttatttttgcaccacaatccaacttttctttgcccactcccgcgtttagcatcttctccacgcaatccctagactgacctgaaaatggagtcgaatgcaagcatcctagtgcaaactgtcatgtgatgattatccttgttggtccttctanacccttgcggtaaagggtgttcccntagacaacatcagatacaactgcgctccncttcaaggcacttccaccagcaggacattctcctttccacctgtcactcaganaatccttc

SEQ ID NO: 2103 - DNA, 631 bp, Fusarium venenatum
  misc_feature (1)...(631): n = A,T,C or G
ttataattgactttcgttttcactttgattttgtcttctcatcgactgtcgtctgtgtcattttcatatcaaacgccaaagtcacattttcactcgagtcaaactgatctactagtgtagtcaactcaaacgcccaatatctgaaccatttatcgttgaccccgccggcaaccaccggcttctcctttggctttttatctngaggctcgtcttacccttgttaaagttgcatcaagctcggcagtaagagctgcaggaggcttcgtcaacacttaactatcgatatctttgtgttcacgatcctgatcttggtctgaactattcggcactccttacgagtccaaacaatctcccagagctggaatatctcaagtgtttctcggtgaactctatagactcgaacacgaccttctcactttanaactatcatatcggaagaatttgttcggctgccagccaacatgggatactntttacccgcngagatcggggggncaacgcccctttgtncccggcggaaaanctcaacttttattngntgccattcangaatattccccatgggcaagatttggccccacccanctttaaaagaccatgtgttgggccgattttttactcccgggcgttn

SEQ ID NO: 2104 - DNA, 531 bp, Fusarium venenatum
  misc_feature (1)...(531): n = A,T,C or G
agcgttagtgacatacatgaaacgtttgcgcacacagcgcgaagaaacctcgaaaaaccagaaaagccaagaagaagaaagaaaagaaggcccgggaatnaaaaccgaaagaacgaagcaacgcctccgaaagctcatctcgccaaattcgaaggatcgtgttcaatgaaattaaccgaatcgtctgaagaaaggctgttcgcgaaacttttngaccgcagagctgaactcgaagatgaaactggtattctcagcgaattatacgacattnccagtgctgaagcgccccaaccaagacactcccggaagaacnagacaagcgatgaacagaaggctctagcgtccttgaactttcaaagacctgctggcngaaggagcggaatacaaaaatntgtctgccnccagcggtatgcctcacaacactacgcngttcnaaaactctgggccgatgccgccgccggagaaaaagaacactctgccngaccctcnccccggttcncccnaacggggaaaccttattggacccgctgc

SEQ ID NO: 2105 - DNA, 320 bp, Fusarium venenatum
  misc_feature (1)...(320): n = A,T,C or G
nggccagcttcgccaccagtccctataaggcaacccancaataacatcaatagacggtcatcangaaggaactcncaaacagtcnttcttctgaaggagctggactctgcccnaaaccnaaatgcttggtatgcttctgaattggagctggcacggaaggctggctacgtccccaacacttngtatagtcctttgcttgacancaangccactgatactttcgacgatgaggatcgaccnctcataagaggctttgttagcaatgagatccgagctttgccaatgtccacaccgnantttaaaagccagccgtgtctctt

SEQ ID NO: 2106 - DNA, 177 bp, Fusarium venenatum
  misc_feature (1)...(177): n = A,T,C or G
nggctttttcttgtngaaaaaaaccntggttttggaanttgggacnaaaaaaaaaaaacccccggattcnggcctttcaatgggataaccctanccanttccttgggaaancccgtaggatggggggtcctttgggntaaaccccaaaacaattcccggacctgnaggcttttgggc

SEQ ID NO: 2107 - DNA, 473 bp, Fusarium venenatum
  misc_feature (1)...(473): n = A,T,C or G
ncgcccgcccttaaacnattagattttggatgccaacccagatgtgatagctctcaaatnggggatatntatnttgcaaatacagagacaacgtgccccaccgatattcaagcgctcagccgcgcaaaagatgaggctgtacaaaaccctgaagcntttataagtgaccttgtcgcgaacaagatnaatacacccaccagcgacgatagcgacagcgatgatgacgatagagagatgagcgagcagggtccgggaaacaagaagcaagaccccggngaaggctncttcaagcagcgnattgttccgaaccaccagcctggaggaatnttcctcagccgcaaaacgttgttcgctgcccccataaactggncttaatatgctgnagntggcgactccctggataagctgcacaacgaacaagtcgccgttcaaaccanggcacgccggcaaccgngggcgcaaacggtttgtac

SEQ ID NO: 2108 - DNA, 628 bp, Fusarium venenatum
  misc_feature (1)...(628): n = A,T,C or G
tttttaacaaacaaatcatcatgctcatggtctacgtctgctactaccaaattcatttgaatcgtctaatggccttaaaacgcctcccaatccanatcaaaagctccttcactgatctcgaaagatatatcagtgtccagatgcccactcaacagcaccacttcacatgcaccacgctcactactaccaacaccatgtcatcctccgctaattttggtatcattgaatgattaaacgacttcgccggcaatggcgaacatctaacctcagcttcacttgcctggngaggtccataagccttcatatctaggcatacaagcagctgacgccgtcatgcatcgtgtattttcgttgcacccatgatgggatttcctcgtcgcaagatgtttactgggaagcgcactgcacgcgctcaccaccggggnggccatcctcgtcatcgcatccatcatgccgcggagccaccgaaaactntgntttgggcaaaagttgtcngangtccttcaggctggcaggctcggacatggcatcaccaggaagaacgttctggacaacaggggggggngaaaaacctttcggangcttttnaaaaacttcggngttattcgggccaattntttttggggaa

SEQ ID NO: 2109 - DNA, 132 bp, Fusarium venenatum
  misc_feature (1)...(132): n = A,T,C or G
nttatataannaagttgcttngnaacacacttctatcatagncaattagaacntttgngagatgcgtccntntttgcanaatanttctaatttnntttgctttctctggnngccttttncncattcatttat

SEQ ID NO: 2110 - DNA, 616 bp, Fusarium venenatum
  misc_feature (1)...(616): n = A,T,C or G
caaaacatcaatacaacaatttccatttcctttttctatatttccttatttcctttgtcaggtcttatttccttacaaaccttcgcttcttctcagtcgtctttgccaacagtttagtttcacttcattgtttccaattgtcaattatttcgactcttctcccatacaacgatattcaaaatgcattctgccatctttgccatctttgctatctccggtctcgccgctgcttctcccaactccaagccccagaccgaatgtgagggcctcgctcccctcggtctcgagtcagtccagtactacgtctgcggcaagaatggcttncgtggatactgctccgaagacccttgcgacaagaagtggtgccgagactttgcctcaagacttgcgaccttgncttcatcactgagcctgaaccacctgtcgtcgncaaccctgtgtaggtggcacgagtgggagtctgagacagttccactgncgccctcaagccacttcactgacttccatcggcgaatgtgctcctggaacaggatttttccagaactggtccaacggcttcgtgggatgctgcaagtctgagcttgcactggcgatgccggtgtctggcccgatacca

SEQ ID NO: 2111 - DNA, 526 bp, Fusarium venenatum
  misc_feature (1)...(526): n = A,T,C or G
ttcatttttctcaatgacttcgtttttttgtattattctctcttttttctaaccaattgatattattattctgtcttttttctttactatagttatttccgttctttatttccttccactgtcttttacaacaatacaatcaataccaatcgagaacctacgaaagaatatattttctctttctttcaatatcaacaacaaattccttccttattctcattattctataccggtttcttaatgcttggaaactttatcggggtcagggaccaggattcctattcgaactcgacatttctatctcccacgtctgcgacgggttacagcagcttctctaccaacaacaatcaatatcaacaagaaaacgacacaatatgcgcaaaggaacacgccctcctccgctgaactcagcatcgtccgaagccgcggtctctccgnantctcgacaccctcagccattgccanggaagtcactccgctactgacactctccggaanaattgatnaacctcaggactgtcctcgg

SEQ ID NO: 2112 - DNA, 409 bp, Fusarium venenatum
  misc_feature (1)...(409): n = A,T,C or G
atcgaactcaaaaatgaggttcctccaaatgggccganacnagttattcggtccaacggtccaaatctaacaaaattgctggtggttttggaaccggcaaaatcgcagcatgagttaattaccttanttcccctccgtacggnagtggatcacccccctacatcgaatggnggctaccccgaggncgcactcanattttgttgaacctaggttatcaaggatatcaggacatcagtgcatnatcgcgggctgcacagcgcaagctgtggctaaaatcctttcattcccattcatgcntgcataataaactgcacaacacttgtcatganaccattgtttatgcaacaaatcatggattactggtcctgactggtctactcaggtaattaccgggcgatgataccggagg

SEQ ID NO: 2113 - DNA, 626 bp, Fusarium venenatum
  misc_feature (1)...(626): n = A,T,C or G
ttcgcgtctacgagtttggccctgaggatggcgaaaaggtcctttttgtccatggtatcagcacgccctgcatcacacttgctcctattaccctcgccctttctaagcgaggctaccgagtgatgctcttcgatctattcggtcgtggcttctctgatgggtgtcgctgatattcctcacgatgcccgtctctacgtctctcagatgcttctcgttctaactttcaagcccctctcgcttgggaacggggcacngaatggcttttcccgaactttggtcnggttaccttcttctcgggnggcgggtaattggccaatcccacttttggcgaatggcttttcccaaaaccctcggtnccggtgaantntttggtccctttcttcgcccncaaggctnggaactttaatcccggcgcccggccttnctttccggcccggtggtcttccccggtttcccttcttncggtctcttggtctttcgtccccttgaagcggtnattttnggccttgnaanccaaacaacgttccggtcgttcnttcaagaaaaccccattcgcttgcctttcggcaaagggcccggttttctaacggnggcccaatcggaaatcttggtcacggaacgcccac

SEQ ID NO: 2114 - DNA, 620 bp, Fusarium venenatum
  misc_feature (1)...(620): n = A,T,C or G
gtctgagccagcacactgtcgacttcttcctcaacgataccattcccaagtggcacaccgctgccaacctcaccacccgagttattcccccggtcttccccgtccagatccccgaccctgatctccagcccggcatctctctgtctctccagggtgattactcttccggccgacgcgactacaacggtattttcaaccatctcggcagcgttgttcgaaaggctggcgaggaggccgagggccacagccccaagaacgtcagcctccatgttatcggacatggtactcctcctgaggtccctgaccatgttaaggaccacgtccacttcgatcagggtctttcataccccgacttctacactctgctgtccaagtcgttcgctctccttcctgcgttcgcctctgatacatacttcgaccgcaaggcttcctcgactattcccgcatccctgatcgcaggagcccccatcgttgcgacagaggagctgctcaaggcttactcttacatgcctcgcgaggctacttggttggcccgaccaggtgagggcgagatggatgtcatcgagcgagtaattgacgaccgagacggnttncttaacgaagacaagcccgtgagggat

SEQ ID NO: 2115 - DNA, 412 bp, Fusarium venenatum
  misc_feature (1)...(412): n = A,T,C or G
ctcactcatggtagccatttgctaccacaaatcgtccgcctcacgcccttgaggctcgcataaataccgccgctcctaatatcctccttccgcggtatccatacctcctacaatatcttttcgacatccctcccatcccttccggcgcctgtcgacgcagcacgatccgaacaatgccttccctaacggtcctcatacctctggtcattttgatcgccctacctctgataggaaaacttcttcgcacgtttcttgggatggtctcttcgaaaacaaacanaaggtcgccgcgcccaccttctgggcctcatgacaaaggaagnacacagctgctcttcncaagggacccccaaggtacgctgaaaaaaaaccncgtnttccaactttnanaaaaacccngcaaaacccctga

SEQ ID NO: 2116 - DNA, 624 bp, Fusarium venenatum
  misc_feature (1)...(624): n = A,T,C or G
accatttccaacgatatgaccctcataaagtctgggcatcattgacagacgtcgttatacataccagcatctggtgccggctcaatccttctgtcttccttattcctctcgtcctccaacctcttcatttctacctgatagtcgatactatcatccatcttcataatgaggtctcttctgactctcacattggccacggctagttcagctttcgtcctcccagagtcgctcaatatttttaatgatttcaaagacgatctcaaggaaactctagaggacattccaaagcgtctccgcaagtctcttgatgaagcgaccgatcagctctccactgagatctcttccgccattcacagcaagcttcaagatgaagatgctttctttcacgacttcgtcgacaacgatgtcaccagcagcgacgagcccctgtctgtctttggtagaacangtggcgacttcacagaccacaccacatatgaactcatcgcttagagtaaccacacaaagaagttcttcaagctcgttcaggagcacgaaaacttttgggaagcttctgaatagcactgataagaactatactctntttgtacccccccgatganggcctttgagcatattcctgan

SEQ ID NO: 2117 - DNA, 623 bp, Fusarium venenatum
  misc_feature (1)...(623): n = A,T,C or G
ttctgcatctctaactaatttcctcttggctattcatcactctcgttcttggttctgtcagtgttaccaactttgtcggtaccgacaaacgcttggtaatcactttgacagttggaattcacctgacttttgttccttcttcggtcgttgtcttggtgatctcccctattctgtttactgatcgactctgcaacaactatttgacactccgcttctcaagtctactaccgacatcatgcgtttctccaagcacgtccttcctctcgctatgctcctgaccggcgccattgccgcatcagacgaggagtctaccaccgctgtcgaaaagtccaaggctaccgacgacaaggccgnaaagacaaccgccgacgaatccaataccgaagacgcgacaggggaagccacggcgactgccactgccccggaaaaaacgacaaggactccaagagcgacaagtccgatctgagaccaacaccaacactagagagaaggnggccgnttcaaaacggttctgagaagggaacggacctacaatccttgggacccttctttacccaaantaccgttnccgaaattaacgcggtnctntttacccatgacccntggnggtgggggggtttatn

SEQ ID NO: 2118 - DNA, 417 bp, Fusarium venenatum
  misc_feature (1)...(417): n = A,T,C or G
cggcatcacaaacaaagataaactcaatggcaccgtnaaaagatctaggttngggtcaagtcctcgcccganccctntcctcatcaacactctctcaaccaccaactctcgtctcccgccaaaccgtcnanaccgtcaccgttactgcanacaatggaaacagcncccaaactctaagcggcggancaattgctggtattgtcattggttccatctttggaattctcctccttctntggatcattcgctcgtgcaccaacctaggtgcgccgccacaggagagggagaagtggtatcactacaaggaagagcctcgacatcatcaccgctcgcaaagtanacggtcgcatcggncgancatttctgccctcctccattgtggtagggactcgagatcgagaattatcgccggggaag

SEQ ID NO: 2119 - DNA, 774 bp, Fusarium venenatum
  misc_feature (1)...(774): n = A,T,C or G
ttggtgtatatatatactcgaggaaaggacacctgcagtttgatagcgtcatttcgatctaccaaccgccaactcagctcaagccaacacagccttacttatcaaccgacgcctcaatcgctggcagccaactctattgacttttcccaaccaatattcctaccctcacaaatttcttgcaccaaaacatcattttaccctactcgaactccaactaccgcaaaaatggctgcccctgctgaaaagaccatcaccgaccttagtggtaaatgggttctgaacaagacactttctgatagctcagagcccatccttgccctccagggcatcggctaccttactcgtaagggcattggaatggctacaattaccattgatgtcaaccaatacagtgcccctcctaaaacaccaaacacctccactgacgtctttactcacatcgacatcacccagtctgcttctggcttgacaagcacccaggagaaccggtgccttgactttgagcagcgcgagcactctgactggctatttggtgctgtcaagggccgttcccgattcgtcactcttgatgangtcgaaggacgacttttttcaagcagggctggctcgttgaggccgacggcaaattcgtccaaagcattcgcgganagtggtgacaatgggtgggtcgccaaccanaatctggggctttcgaagaaaatcaagggtganaagaaatatntcaggcacntcctggttaccaaaggttaccaaaagggtcccggccaagctcat

SEQ ID NO: 2120 - DNA, 543 bp, Fusarium venenatum
  misc_feature (1)...(543): n = A,T,C or G
ttggccttgttcagggccatctcaccatactactactctctcagcgaagggggcaacatgttcttatacaacgacgctatgtatctggcagagcggctctctgagtttgctgatgcgtggaanaagcgcgaagacctgactcccagagcccggaatatgctgcgacttgaaaacgacatcaagagcctacaaagctttgctaatcgcagttaccccaacgagatgaacatccagaaaaccatccttcgcgatttcctcggnggagctcaaagtctgatgcancaggatgaaatggagtcttgcgtaaagtggcaacnggtcgcattcncgcganggcatctgtctggaaatccattctggctcgtcaanttggacacangctttaggtncctgntgatgctggccaacnaactgacacaacgtccttgaaatgtcttcattgggangaganggctcaatatanccaaggcnttgtttgcacaaaactnatgacctttctgccnccgtttacggtctgaagggcaatgggnggtctnaacacta

SEQ ID NO: 2121 - DNA, 636 bp, Fusarium venenatum
  misc_feature (1)...(636): n = A,T,C or G
naagtactcttccaaatattgtacattnatggatagccatttnaagcttacatanacttaaggtagntggtctccttaatcttggcctttctntnctttcgcatcgccctcttgagctcttctcgcttttgtgcggcctnaacgttgtgtncaacacccttgttctcctcgccaagaatgttgatagactgctgntggatagggatcttgggagctaaggcttcaaggttgccttcggccaatagctnggnctcatgagccttttgacgctttgntgccagntttctttgcttcttggatttgagaattcgtnttnagcgtctgcgttcgcgaatcancgtcttcttcttccatccaaacacntncacaaccactctgggtactcgcggtatgtttcnaacagggtnctgcccaagtcttggtgtagtncagtncgctgagaactcttaatcccaatactctctcttnccttcccatcggggaatgggcaatctttgggatgcggaanggatntggtcatnanaatttgcctgaccattctgggctacattcctgggtnaaataccgccttttatnttgagtccatntactttgaccgnnaaaggcaagcccgggaggccgttttgaaatggaccg

SEQ ID NO: 2122 - DNA, 298 bp, Fusarium venenatum
gccagcgacaagaagagcttgcccttgagaaggagaagacccgcaaggctaagcgtgatgctgagctcaagggtcttgacgccaaggctcagaagcgatacctcgagaaggagagggagaaggagatgcgcaagagccaaaagcgacagactcagcgagcttaaagccgctgttgggaatttaatatgtgtaaggatatatcggagggcaaatagtgggaatctgcaatgccatggttgtatagtgtaggagcgaggatctgtattagtagttattaacagcctaattccttatgatg

SEQ ID NO: 2123 - DNA, 429 bp, Fusarium venenatum
  misc_feature (1)...(429): n = A,T,C or G
atcaattggtcctgggtcgcatgtaatgcagcaagcagtcagagaatatctgaagctgctgtaatcatgcctcctcgagtgcgcggcgcatcgacgccgctggctggcctcgatgccgccgtttctatctcctccaggagctcctcctccccattcctccgaacgttctcgacaacgccatgccgcgagaaaatgagcaagggtcgcgcgaggatgttcgagtggctgaacaatggcggtggtaggagtcttgctgaggctggtaccagccctaactaccttggtcctcaccaagatcagccttttcctctcaaccccttgttccgaaatcaacctgtgctggccgatcagacacgcgagattatctacgacaaggtgatangcaagggtgagtcgctcaaggcggtgtctgctgaaatgcacatcgac

SEQ ID NO: 2124 - DNA, 792 bp, Fusarium venenatum
  misc_feature (1)...(792): n = A,T,C or G
ctttgactggtattggattcaaacaacgtattccgacttcggcactgcgccagtctcaatacttcaaaacagcgacgatcaccacccagcaaaaaccgctacaatgcgttcagtgacgcagcctctgctgcttctcgctgccgcagctctttgctctgctggcccgctacctagagatagtctccatgatgctggctactcatacctcatgcgccgagactgtgactcatactgcggttccgacaatcaatactgctgcggctctggcgagacctgcgagacctccgacggagtcgcaaaatgtgtcgctgcnaaaggaggctgggttggcgactataccaccacctggacagagaccaggacttacaccagcacactcatgacccgttgggaacctgcaccagaaccaaccaagggcgttgattgtgttcccaagaatgacgagcaggagcaatgcggtgagatctgctgcgctggctggcagacttgcgcctacaagggtcagtgctcggcaaaacctggttacgatgcgcccaccgccgttgtcatcactagcgatggaaaactcaccacccaatactcgggtccctaccgaatcnctggtaccaccaccatcgtcaacaacggggcacctactganaacaatctngttctgcgactgagaccgacnccnaaaccccnncccctgaaacaatnatnaagctgccncctggnaaaaccgtactngcgcgaagtttgaattcccgncnattctggtttcccnttgttttttccccgggtttcactgcnccg

SEQ ID NO: 2125 - DNA, 263 bp, Fusarium venenatum
  misc_feature (1)...(263): n = A,T,C or G
natttttnaacaacaatntgaccaccgttgccatcantggaagtcgcnnaaaagaatcttcccttccataanactcctcctggntgcctcgctctacttgggccatnataaaaactngggnaaactttttcnggaccaaaagtgcnctggcccctncacttggaactggaaaggatccgnggggctttggnttgattcttcttcggaaanaatgaactggaaaaggtgcactactgaggnccctcctcanttnaaaaaggaaa

SEQ ID NO: 2126 - DNA, 519 bp, Fusarium venenatum
  misc_feature (1)...(519): n = A,T,C or G
gcgatggaagttgactcgcttgtggaccatgttccggcgatcaagcgatcagattccgagttaccacctttgtttcctgcgtctggtgatgtccccatgacagatgcctcgtcgccagctgcgacccctgttctaggttcagcagtgggcgacacgtttgcaaaaaccaaaactccggacttgagggtgcaattgcctcctgtaccgtcgttcgatagtactggactgggaattcacagtgcgacaactccccagcctggggctgtcgcacattcgcctctttcaaatccgttaccgagtccttttgcaccgccagccgtcaatggcatagctgctcatcccagtcaagtaaagaagaaactcagcctcagcgactacacgaaaagtcggatgaacaangctggtggcaagantgctggcggccacgctgttcttaaacctccatctcaagccctgaaganacaaaggtcgacatantaatcgactcacctcgatcganaacctacggagagcatgatt

SEQ ID NO: 2127 - DNA, 577 bp, Fusarium venenatum
  misc_feature (1)...(577): n = A,T,C or G
tttgctttccattgcgacctcgtctatggtatcaggccatcttttcagctagacaacaaattcattgggtcgcctattatcatgatgaacatcgaacttcctgcatcacaagtctgcgatcgatccaacgcgactggtgtagccaaccaggtccgcgatacccttaagataacctccaatccatcgaacatatccgctcacatccacacactcgcctacgagaagtctcctcagcgaatatggcaagcattcctgggtcgccgcatgtattggtaacgacttgggcacgagctggggttatggaatcgattttgggcttggctctacatctgtctatgcanaaggcattgtccggagatggatggcaatgttttatcaaagaacacctgcccctccaaaagtattggactgataatggngccatatatcaatccatttggnaaccggtgacatgaacacctattaatggactcctggtgttccgcggcatccttannaaaaaaanactttttgatgnccccnggtntcaaaaaaataccctggaacataaaaanaaaatnttngccctttttntctt

SEQ ID NO: 2128 - DNA, 540 bp, Fusarium venenatum
ttgtggcatcaatggaaacatagcttcatacggacatggccagccatcaggagaagctcaccccccggatggtcttcccatttgggatcccactggagccgaaacttcatacgaggggccgtataatcaagccgctcagcgatgggctagagaggctcaaagacagcagccctcgctacacccacaggattctgcctcaacagacttttccatggaaggcacagcagaccgtagttcatatgggacgggctaccagaaccatgcaagtaatggccatggaaattcatggctttcacagccatccgcctaccaacagaaccaaaatgcatttgcgcacaatggccatcaagagtacgggggccaaacaggctacaatccgggtccctcgcatcagcaattagatggacagcattggtccgggaaccctcgggagcctactgcttcagctgaagaaactcgcgatcatacctatagatggtattgatccagttcggcattgaagaagaatttgaacaagactcgaagacaaaaggtttatga

SEQ ID NO: 2129 - DNA, 643 bp, Fusarium venenatum
  misc_feature (1)...(643): n = A,T,C or G
cgacggtgcctctgtcctgtcaacccgaacttcatctcgtcgccacaagtcttctcgctctcacaagaagcgctcaagatcaaactcgagcgagcgcggacgcggcttcgcagagtccatctttggtggcggcgaccgttatgggaagcacaatgcctctcgcgcttccttctttgggctcggaggcggcaacagtagccgctccagcttctttggaaacaatcgctcctcttactacaaacgctcccctcgtcagggcttcgttcaaaagacctacaagcagctcaagcgtctcctccgcgatctggttcactgggccaagcgccacccctggaaggnctttttcatggtcatcatgcccttgtaaccggcggagctctgactgctctcctgctcgcttcggcttgcgcatccacccgccattgagcgcatgctcggcgtagcctncaaggctgctacgggcgactcgtccggcttgtggcgaactgttcgcatgggccagtggttttggcgnaacacttctggtcgcgtggagcgcgatcgcactanttcacatggangaggaagagtggtgcnctcatggggtgnggcttntgaatggncagaagtgattangngcctcttttaagcagcgaacagaatg

SEQ ID NO: 2130 - DNA, 589 bp, Fusarium venenatum
  misc_feature (1)...(589): n = A,T,C or G
ctcatccctgaaagcgataaccaacaacgcctgctgcagctgaaacttatcaagaaggcgggtatcgacgtgcttcagtttgtcaagactcaagcgtggctgatgtatgatgacctgggcccaccacagcacggatgtccagccaagggatcgttcagtatcatcgcacccggtccacccacggcaagacaaggtcgacctgtgaaaccagatttctttggcgacgacgaaaagttcattgacacagcacatgaaaacctaatccggtcactagaatggctcctactggtgcaagaaacatggccaagcgtcttctcaatgggaactagaatttacaagttcttcttgcgaaacatgcatctcaatgctgctcgccagctgatgaagcgggtgtcctttgcggatgttttgcaggcagccacagaanacagcagtgatganatggatatgtacgaagacatccccgagttctgggctaagcacttgagcggananatattcgtgacgtgtcacctcagcaagccctctcagacgccccgcaagttccgcgaactggaaaatctagtacgaactctggatacctcnaaaa

SEQ ID NO: 2131 - DNA, 305 bp, Fusarium venenatum
  misc_feature (1)...(305): n = A,T,C or G
ttcgctgtgacaagtgcggtaaaggctacaagcatagcagctgcttgactaagcacttgtgggaacacacacctgagtgggcattgacttccaagttgctcatttcaaaacatcaacaagtccagctgcttgaagctgcttctgttcttgtaaccatgaacggcattgaaggcaacgctgccactcctcctgagtctactaaggactttcagagtgaggcgggcatnatcgctgctacctccaatactttgaccctgaggagcgacagagntttgccgacantacaccacctccnttaccgaagg

SEQ ID NO: 2132 - DNA, 259 bp, Fusarium venenatum
  misc_feature (1)...(259): n = A,T,C or G
cctcgcacagccaagatgcctcgngcaatcagaggcgttcttatcgaatgcgatccctccatcaaatccatcattgttagcatcgatagtgccaaccatgactacataatcgaagatctcgacgacgaacgcgtagtcgtcaaagaaaacatggctcgatgctcaaggccaagcttgaagatcgactaaaggaaaacctgcctnccgaggaggaatctggctnanataggaataagaatagaacccctcggcnggttcc

SEQ ID NO: 2133 - DNA, 487 bp, Fusarium venenatum
  misc_feature (1)...(487): n = A,T,C or G
gggggcggactcggtgccctggatctcggggagatcgcttccagcttcttcgtcgagtccgagtaccaggtcaaaaagaaggatgatgaggagtacaagcccgctgccaagtcggccctgaagaagctgtcgcctacgctgctggtcaaaagaagaagctcgaggctgctgccaagcgtgccgagaangatgctcangatgangctgctcgtcttgctgttcttgaggaggccaagaagatcaagatcaccaacgaccttccttacccgagcctgtctcgatcggccttcaggagaccgatcctctttgattggtactctccgaaagancaaggacgacctacagaaggcgtcaagcgtgtttccgttcagggccgtgtcaccgtgtggccaagcanggttgtcttatctttgtcctctgcgacgtggtctttactacatgcagtgtctcctttctggcgatctttccaagactacaangctcttac

SEQ ID NO: 2134 - DNA, 635 bp, Fusarium venenatum
  misc_feature (1)...(635): n = A,T,C or G
gatcgcgacgtcaacctacgcattccatcttgtcttccgtttcgtcaaggcttgcgctatcgacnaaaccagtttgtgcccaaaaccttcaacctccatgttacggttttcgagtctctaaaacagggttcctggaatcaattgatcggcttgtcgatctaactgaataaagaagcgcgtatccgaaagcagcagcacatgtcggactatccaggtgcttgtcctcctnanaaactccgcccgccaagtctggttttccagggcgatagcgacgacggttttgacataacgaacttcnaaaagtttgcanacggnggtgttgataggaataacnactctatcgctatcaatcgccaagtcaaccataacgccgtcgctcanaattcggcagcgaatctactgataccctccacgacaactacgtcctcttctntttatcactcccgacaatgaacgccgaanacganacagcggactcttcttcgcccctgggtttaanaaccctttcaatttccagacgcaggtgatctctgcaggccctgtcaagtcaaacattgggacaacgtcgcggacacagatacaaacacagtagtatctcgtctcaacatcaaatctttaaaaaaaccncccggaga

SEQ ID NO: 2135 - DNA, 245 bp, Fusarium venenatum
  misc_feature (1)...(245): n = A,T,C or G
atctccttgacactagatccatcacccaggcacagtcaagaacttcttggagtacttgggtgatggatctagtgtcaaggagattgctgcgctgcgagatgaggttgctgagtgggttggaggattccctcagccttggctcaagtcatgatgtttttaatgagtggtagcaagattaattttggcgtttggaaaatagtatattgatacagaattgactttaaattatctattccnaaaaaaaa

SEQ ID NO: 2136 - DNA, 552 bp, Fusarium venenatum
  misc_feature (1)...(552): n = A,T,C or G
ctacctctttgttacagacaccggaacctttctcagctttactaccactttaactattcatcatggagcccgagactcgagccacttcttcctttgagaaggatgcccacaagacaaaggacaatgcctccaagggcaagaccagaagcaattctctcttcaccatcagctctggcttcaccttctttgctgcccttcctggaggatccagttcatcctctttcaggtcatcctctttccgataaatacccaacaccaactcttgttccattctctgttttccgtctttccgtttatacccagtccttttgtttattgttttattttccttacacattggattttgctngctccactactttttatgaaaccccggttttgatacgggcacttgcttttcccgtgctttacttctcccaccacaatgaaataaattacggtctttccacccanccgttngtggcntccaacttcnaacaactcaatcanaaatttgccgaacaanatacaagtttttcccttnacaacttaatgttcaaantttttnttctc

SEQ ID NO: 2137 - DNA, 621 bp, Fusarium venenatum
  misc_feature (1)...(621): n = A,T,C or G
cagttctctgttattacccgaaaacaagtcgatcaagacactcactcagtctcatctatatatctactataactacttctacaactcatcatgccttcttctgtcaagagctggtttgcccgccattgcgctcctccaccacctctcaacaacaactctcaatgtccctgcacaacctgcttcaatggaggctcccactccaacaactcagccgcattctctgtgtcttcaacaagaccttcaggactgtcaagagttgactcggacaatgcttctctcagcagcgccacaaccgtcgctgcttcatcatatatcgagacacccaccaagcaatgatcgcaaccaactagtcatcatgactgattgattgaccctgggtctttgacgaattactaccggaacgaatagcgagtttcatgcttatctttttgccctttcttcatcctttaatctatacccacatcatctttacgtttggcgtctgtcgggaaataaacaaaggatagatagccaagtatctatacttgagatacgcatnctcatcacaagctgaaaatcttacggggccgaagtggagagttggtcgattcngttcnggttccgaggcggagacaaacccat

SEQ ID NO: 2138 - DNA, 116 bp, Fusarium venenatum
  misc_feature (1)...(116): n = A,T,C or G
nanaggcctttgccagctcganaagaagcgcaaggccttcgatganactatacagaccngctcaagcacanacaacgaactgccttcgatgcagcatcgaccatganagagctata

SEQ ID NO: 2139 - DNA, 603 bp, Fusarium venenatum
  misc_feature (1)...(603): n = A,T,C or G
gcacggtgaaatgcaaacacccaagtgccatgcggggaaggacggatacaaccttggcaaggaagtaagccagtcgtgaatgacctgcttcagcctctctcctgtacaagagtgtctcctcanaaaagagcttgacaccaggagcacctgcgacaagaccgatggcaatggcaatcanaagagcgaattggggcgcaaaaaagaaatcgatcgaggttgacaatgcatcatagggctcgtggaacaaaccaacgaacatgatgccttctttggggttgttggcaagaccaagcagggcgcctgctaacacagcgaggcccatctcagcaaagaaagcagcccctgcgcggtattgctggagcatagcacggcaaagacaaagccaggcttgtttatagtatggcgcacctcgtttcttgagggcctggcgcatgcctgtgtcgccaancatagtggacctgatactcctgcctcataagcctnctnttgcttgntttggccatntttcccaatgcganataagggcttcttggacacatcgccacctgttgtcttttcacccgttccagtggtgatttcantaatcccctcaccgngggtgtn

SEQ ID NO: 2140 - DNA, 617 bp, Fusarium venenatum
  misc_feature (1)...(617): n = A,T,C or G
gagaaagcttatncgagagcgnanggagtcngctanaaagcnaaaacaagaggaagaagctcgtgaggaagccgagcgcagagagcgcatccaaaagaagttagatgctatgggacctgcgccagagaaaaagacagcaaagaaggagtctgcagacaagtccaatgatgtttcgcatcctacacatattcaacaacgagagagccctggagcttcgagccagcctcctgcagtgcaaaatgatggtgatcattcggctgctcatgagcggccacaagattctgaaagccaaataacgaattcatctccaaggcatggagctgctgccaggcgtgtatctcatagtcaagaagccaacccaccgagctttggggagcanctgtggtctcacgacangaccgagccgtttcgacatggggcaccggatcacaggcagtggcccgcaatgtctggggctccctaataatgacagangccttggtaatggtctttcagcacgggtatcnggcgnatgccctttggacagccgncctggttgttaaagnagcaangggtcggnaactattgctnnttctaaacgntacccaacaccnttanaagctttagnggccccggnt

SEQ ID NO: 2141 - DNA, 663 bp, Fusarium venenatum
  misc_feature (1)...(663): n = A,T,C or G
gttcaacagctttatcgacgagatccaattgggtaattacgttggtgtctgcaaaatggctgcttcgctcagaactggtagcgcaatgctatcgagaatagctacgccatcgacatgtctcgctaaaaggacattcaccacatctctcgccttccgaacaggacccaagattaccacagacgaggaaacttcaccggctgtcaatccccttgcccggtctgatcctttcgttagagatccatctgccgaggcccgatctgaagctctaggcaaggccgcttccgaaacacgatcgaaccctcttatcggcagtatccctcctgcccctcctcgcgatgctcctgaggccgccgaatcaaagaccaccagccatgcctacgatgccaccaaaccatactcactgggatatcgcccaagatcattgccaacaagtccagcgcgttcggcaatgaagaagcttcaagaccctataacccgtccccaaattcgtgcgaagcctgttaccggtcgcacaatctttgtcaaggattacataaccaaaaccaacggtcctactcctaagggtgctctcaagattctcaacaaggattgtccgaaaaggaccaagtcaagaacaaataccacaagcaaaatcccgacgaanggtntaagagaagaggttgc

SEQ ID NO: 2142 - DNA, 562 bp, Fusarium venenatum
  misc_feature (1)...(562): n = A,T,C or G
gaaatcaacagtcgcgtgtcacgcttgacaccaaacttcgagagaattacaggaaaacctggcaactatgcaagctcaaatggtactgcttacactcgacccgaaaacctagcctggaaggaccaggacaagcctgggtttggtggtatcaacgttgtaggaggtcttactaccagcagcgtntcgactaagagcctcgntgcagctcattgtggcgcgtggcccatggccgtcaacatgttcgaagaggccgaactcgagagctatcagccctgccttccccaagttctcgaactattcaacaaggtcaaagccaaccagacagaaaagcgacagtggtggggatcgaatcaatggtggggaacangtggaagtcagcaagccaagttcacgagtaccaatggaagcccgnattctttcaggcggttacagactctatgaccgacaggacangttngattccagatcggttcaatttcaagncacgaacccaaactcgatgaagaggcctnagaaccccgtatggaagagtcaattttttggattcccgagacagatctga

SEQ ID NO: 2143 - DNA, 168 bp, Fusarium venenatum
  misc_feature (1)...(168): n = A,T,C or G
ntggcnatatactgagtatacagtctngaccatcggcaatagaaaccatgtntatcaacaaacatgaaaaaantanccgtactgnccccaccagggactttactgagcgaagcatagcggccacagnaccactcanaccaatgccnncctcagccantgntctaccaa

SEQ ID NO: 2144 - DNA, 626 bp, Fusarium venenatum
  misc_feature (1)...(626): n = A,T,C or G
cgccctttggccagagcccgggcaatcctggctcgcggtctatgacaccccagcaattgttccttcgatctcagagtggctttggtgacgcaccacccggcatttccagccaaagcaatgccttccagaaccagagtcagggccagggccagggacaaggccacaaccgccagtcgtcccgattcagcttcgccaacgacagcgctggctctgtaaccaacgtcaaggtttcgactaacccgcgcatcatggcccaacaatcttccatgatgcccaacaccttcaatcccagggcaacaaccagttctacggtgcttctatgcctggaccttctccggcctnaagtcgaccggnacttctccaacatgtttgggcagttccggtggcaaggctttaatgcgccnaanggcaacttgagtgagattctttnaaagttaatgggccgaatcgggttgcaacaaccgnnccatgatgcggnaaaccggggantggcctananatcttgagacccgagtntcttgaggtgcnatgcagntagtttaaggcacggcggntcggnagggntttttgtggccaaagtaagggggtncattncacatttgatgttacacatttncggngggggg

SEQ ID NO: 2145 - DNA, 192 bp, Fusarium venenatum
  misc_feature (1)...(192): n = A,T,C or G
cgagaggttatcacacactaccgtgatattgaccatggcatgatcaaagctagaccccctacaccttctccttagcccaagcctnaagcctcgtgccccatttngagtccgagagcgggagactggacatttgacatntctttntcaaggaacaaagaacgagggggacatttttttgnacaanttgcactt

SEQ ID NO: 2146 - DNA, 494 bp, Fusarium venenatum
  misc_feature (1)...(494): n = A,T,C or G
gaggaggaatacgagccggtcacgacgactatgtcccaggaacgcccagtggatgaagtcgatgcgatacctgtcaagtctactactccgccccaaacgcagccatcggttctggtggatcatcacaacgaaagcgtgcgtcgcactcgtgtacactctgaaagccctgcccgtagtcccggtcgcacaacacactttgcgcccaaagccgatcaactactcgtcaggcacgagccacctccacgatcattgtcacctcgaaaatctgctctcaaatattcaagccctcgtgacgcgtctccttcagaagatggctcagacgcatccgttgcatggtcaggcatgactcgagaagattcagatatttcacgaaagaaaagtgtgcgggttagttttgatgatggaaacacagcaattatgggcgangctacgccggcatctgatacggattcgccacggttagccagtcctcagtctaagaagccttggcacag

SEQ ID NO: 2147 - DNA, 563 bp, Fusarium venenatum
  misc_feature (1)...(563): n = A,T,C or G
atttattaaactaaagtcacgccatgttacggtactgtttataacattttaatttaaaactaccaaatgtttctcttttcttggtttttaatgtgattgtcctctattatctcttgttattcaggatcattttcacaccgccgctattatatcatggccaccgatgtaggagacgaagaaagagcacatttacttcctgtattaccatcatcatcgccatcgccagcaggtgtaataacaacgccgtatcaacccctagaccaatatgagagtatcaatcaaggcgatgacgacagttcaagcactcatagttctgagtggccatcacccaaagcgctcgcagactctatgtatctacaccctctcaacatggaactcgcgcgctttgaattcggagtgttctatatctcgctctatctttcaggacatttgaggctctcgcgggnattcaatgatcgaggngtgntggcatgnactatcatctnggttgggcctatatngacgcaaccgccgcctaagacgggagacttnaattgngtttnaaaaatgggcgtggcggatcg

SEQ ID NO: 2148 - DNA, 638 bp, Fusarium venenatum
  misc_feature (1)...(638): n = A,T,C or G
aaccaacccaccaatccatagcctatcttacactgtattcgtttgtatttaccaacgattaacctcggattatcgctttttcttcttcgtctctcctaaacctgtttattttccatctccgctcgtcaaacacggacggccccacgtacaagacaatgtctgtaccggctacatacaagccttcgcctcttggctatggctcgtctcctactcgcagctctccatttcgtcgagccgaatctcctgcttcaccgtctcccctccgaaataccacagtcacaccgactggttcccctacaaaggccggaccctttggctctacttcgcgcttcgctagagctaccacttccacaagcacacaacccanctggacagcaaaagcccaagactctgtgaaagacgaaatggtttcccatacctccgcgattgtcagacctcgaacaccggatcaaagtcactcggcagtggtaacgcgctgcgcaattgcagaacacaatgcgacactacgagatcctttagatcatggaccgagactgtgatgngtgtgaccgagaagacgtacagatatgcttaaccagctaggttaccgtcacgccagttgtgctgcnggttttctacatggngcttaaacatagcta

SEQ ID NO: 2149 - DNA, 847 bp, Fusarium venenatum
  misc_feature (1)...(847): n = A,T,C or G
gctttgtgttttcatagcaggggagccgctctccctcatctctctggtcgcaacatcaacaaacctcataactaagggagcaaccgagctcaccacggcttcggccagaacgatacacatactaaccaacagggacgctacagtgggagacatatcgccatattcgagttggagcgaagtgaaagagactttggcctgtatcttgcagagcattcaagagctccacggcattcgacaagctacacataagaaacctatattagacaccctcggcctgcctcaaaatgggccactccagttcggacagctaccattgccggcccctcagtgaccgacagccctggtacctggcgtcacccgcgactcaacgagattactagacgtcgtaatgcgacgaccttttcagagaagaacgtccgccagatcgcctacaatgttattgcgctgctaggattctggtctgcgcagctcctagcgaagctcaacattggctctcaagccgttcccagttcttttagagtatacttgggctgggcttggtttattcttcaacttatccccttcatcaacattggcattgcctgtttgctttgattcgaccgaaagacgatctatccgacatccntntaaatctgccagcgccactgntggggctagatccttcgtcggncgngccaacttctgacaccaaagttcagcactccccctngantcttttggacacctttcatcggcgggtcantcggaagcccgaggaagttacaacaggtngctttttttggncgaggnagtccccttggttnaaggatccccatngggtagccctntttttccanaaaaaccccnt

SEQ ID NO: 2150 - DNA, 590 bp, Fusarium venenatum
  misc_feature (1)...(590): n = A,T,C or G
aaggaacatcaagattcgtattagagtctcttgtcacagtccagatcatcgcgccagctctgcccaggcctgccatactatcgccatatttgtgccagcaactttgtattgccagccctccttacatccggcttctgaatagactcgttctttcagaagcgcataccaataagaccgacatcggtaatcatggctaccatggcagcggctgctcgtgatatctcccaggcctccttgagccgagacaacttanctgttgtagcggcccgaggcgtccctgcgactgtgacacgctctcaacaacccctccctactcccccaactccatctctcccaacctgccgcctcacgggcttaagngcagctccagaagccaagcttgacctatcgactcagactggacttcacgaccttcggatcnacgacatgatctcccaccctcgaggctcgggtgcatatggctctctcctcgcaaatacactgcanaaatcnctcatcatgtccttggtatccnctatatgggtactaacctcgtaccggatccggatcctccacaagngcgaaatatctggacttgaagtcagagaaag

SEQ ID NO: 2151 - DNA, 276 bp, Fusarium venenatum
  misc_feature (1)...(276): n = A,T,C or G
cnttacaagagtatccattctttaccttgaacgcgcaatcggctttcgtcattcttcgngatcgataattctgttgcctatataccaaggccataaaagcattcactctcgattcgcttatactntttccacactacaacactctacgatactacctatctacctacaccaaacaactcgcccatnatgtctcgcattcagatcccgctcgacgttattacgtcccgcctcaactttggcgaccgcttcagagccttcgatctggtcctctcagcg

SEQ ID NO: 2152 - DNA, 140 bp, Fusarium venenatum
  misc_feature (1)...(140): n = A,T,C or G
gacggccactatcacgaaggcgaattcccntccatnaactngccattgacctcnagccanaggccctcttgngagactatatacatnctgtcccanttacngccgntccctctctgntcacactatacaatggctactct

SEQ ID NO: 2153 - DNA, 588 bp, Fusarium venenatum
  misc_feature (1)...(588): n = A,T,C or G
ctgcctatgaaaccatcccatagaaaccgcctcaagttcaactggttctcttctcatatgggacacgggaacttatagtatcctgcagcgaaaaagcaaaaactcaccatctgaagatccatcatcaccgccatcttcaccagcatcatcccttacatcaacaccacaagctcttctacacgaagcttttcagagccgaaaaatccgtatccgcttgcacggatctcacttacctgatccttacgtcttgaaccttcgcttgaccaagtcagaagatatcgctggtagacggaaaagtgggagcacgcctcggaaacgaaactcccgcatgcgaactagatactcatgggacgagtgaggaggacaaaatgangatatcctgcgatcgctgatcagacccaacgcagaaagcctctcagccatggagcgtgagatacgcaactanaaacaagagtcgtagacaatgctatccaggggctctatactcgcaagngcgactctccaaatgagagtganattgtcacttaagtgaacatntaaccatttcaaagnaacaaaacncaaactttgtcaattttgttcctntta

SEQ ID NO: 2154 - DNA, 699 bp, Fusarium venenatum
  misc_feature (1)...(699): n = A,T,C or G
gtggattgacccgcctttcccctctcagatcacagagtcagtccatatcataaacctcaaccccgctattcatcatagctgtctgcgttgatctctgtgctctttcaactcaaacgtatacctggatcactatataacgccagcctcaattaacacaatgggcgccgacattcaacaatggacgatagagaagccttggcttgagacgcattgtctcttgggcgaaggacctttctatgagaaatctaccgacactttgcgctttgtcgacattcgtaacaagcgattgcattacgtcaaggtcgctgagggcctttcatccctcagaacagttcaagttggatgtatgtcctactgtcacggccaacattgttgggcgtcgacccacaggagcgaatcgctctgggtgtcaagtattggattggcgatttttgatgtcaagaaggagacatatgaactcttccagccattcgaagagccggcgaatgagcgtttacttagtaatgacggcggggtggaccctcttggccggtctggctcggatacctttttcagactttggtctttgaagacccttcactcctgaatgtgagctgagttatctcttggattccaagttgtttggatgtggaacttttcgatggtgactattcccaaaacaccacnctggttggcttccggatnggaagacactatttt

SEQ ID NO: 2155 - DNA, 556 bp, Fusarium venenatum
  misc_feature (1)...(556): n = A,T,C or G
gccaggctacgtgaactaacgcatcgtaacacaccattccttgtgatatcgcatcaaggggcttctgttttcacatctcacgattcttggtactaaacacactctagaaattcccactatgccccgtcgaggccgaggtggcaggatgccctcagggccttggggaagattgaagcccgtcgagcaagacccgttgctagatatgggacttccctctaaaggagacgataggttgcttaaccacaaaacccaggaatggtactacaaccaaatcatttcacgcttccttgcattttgcaccgaagcgggtgataaggactcaatcatacgcagttttgaagcccttgacataagagcagtcgattcaacccctgccacgcggtatactaaaccttcacctggatatgtaccaacatcagcagcaacacccacggctgtagtgtcatcaaagacctcttcgacatcagctgcagatgctataagagttggaagggtgctgatttggcatcggacgatcctgcgctttantcacattttcgctggcaggcccattgga

SEQ ID NO: 2156 - DNA, 574 bp, Fusarium venenatum
  misc_feature (1)...(574): n = A,T,C or G
ggtaggttagggtcttatcctagtcgcagtcgcactacactccaaccacctgctcatactcttttaacaaaacaacaactgttgctgctgctgtcaaatttcgcatcaaacttggacattatacaacctcaaaccgcaaacatgcttcttccgtctgcgctaccttgcgatgcgtcgcactcgtctcattcccgacttcaacaatctctcttctctcctcctgccagtcccccggctccttcgcacagttctttcgccaacctcatgactacttgtcgctctctccaatcgctcttatcaatgcccgcgcccattggtatcgactctcgtcctgctccttacaataacgctcaactaccaacccaccgntcgtnacgcagttcttcttgaagtgcgcctgcgaccgggccccacgccgtgagctgtcgacccaagaagtacaaagcgcgccggacangcctgcacaaaaacgccgngttgccacatattggccgtgtatacaggatcggnaggatacgnngtgtttgngcaaggacttanaccaacgccnatgtccncaatcttgctgacgttg

SEQ ID NO: 2157 - DNA, 703 bp, Fusarium venenatum
  misc_feature (1)...(703): n = A,T,C or G
caggttttcgtctcgaggatccatttatctaccgtccacaacaaaaaacttcaagtgatcaacactttactacttgctatttagcaacagctatagctcttcgaagcttcaatcacaacattcacctcgaactatcatcacgaaccaccgcaacaatgttcggttcatacagctccattagctccatgtgcgcttcttctgcgcccatggatatcgcgtctcgcaacatctaccgatctcaggactccgcctgcgctttcccttcatggcctcgacgcgactctctctccgagtctgatcgtgaggagcgacccacttcttatctctccgacaacaacctgttcctctccgatccattcgacgatgatgcccagaagcgtctccagcgctggcagctcttctcccggtgccatggcctcgcctcccagccgcatctccgacttcgagcttctccaggctgaagcgagaacgccaagctgccattcagcgagagtgcatccgaattgtcaccctcgagaaggagcgtcnacgtgccgccgcacgaaaagcagcgccgtagcaagtctnacaagaagagcccaagaacaaactcancttcatcaatgaggaggntattgagtaaacaatgnttcttgggatcttnttnacgactggtacgaatttacgatagcgctgntttttgcattacaatggnaatatgatn

SEQ ID NO: 2158 - DNA, 668 bp, Fusarium venenatum
  misc_feature (1)...(668): n = A,T,C or G
ccaaaagccgatgttatcatggttcaggacttttcacggtattccgatgatctcttacgacgaattgaaggatcttcagcctgtttatgggctattggagctcgtccagatccctcccactcccactcacacaaagacaaggcctatcttcaccacgtcaatgttcaactacctttatacgccgccaaaatcatgagcgagcgcatcgcgcccaaaacgccagcaggccaaaagttcaactttgtatttgccagcaacaagtcaagatcatcttcactgctttcgcttggggacccgcgcaagcccaagtcggaggccgaaaagggcttatgcgagattgcagacgccagccctgaaacgtttagcgcttggatcttgaggcccagcaccatcctactcgcctcaccagatgccatcccaaggaagagacgtagtcttgttggagggcggtcaattatcggcgttgaggtctctcacatggcaaaggcttttgtcaaaagttgcctgcgagggttacagggagcgtgtcattgatagtgatgccatattaaagatgacatttatctagactgggcagcaactaactatacagtactatggagatgtctttggtggggagtaattttttgtggatttatagcggatttatngcggagtcgcgggggccg

SEQ ID NO: 2159 - DNA, 592 bp, Fusarium venenatum
  misc_feature (1)...(592): n = A,T,C or G
cgcttcaacaagaatggccgcaagagtnnttttgcaacatctcgcatgtcgtgcgatcgagtgtccactagcattgacctccgacccagcatctcccgcaagactacaggcaatggcaacggtnacggcgttggtttgggtctcaccaatgagaacgaaaaggtcgagttcgctgcgtcaagttacgatactgcgcatagaggcactacgcctggctcccgagccgacnatgtgcactttcagtcaactcaccgagccaacaatgccaagagaaaaaccaccagtgcctggactgcctttgttttgtggttgagaacgcgactgctcaagcttggtcgacgatggagaaatacaccaatgagaccaagaccaaactcaagaccaggctgtctggcaacaaaaaganctttgttgtcaaaactccctatcagaattatcacccacaacaggcggcgagtccattcaacagctcctatttcccgacaccatntnccccacgccgattgatctacacagactcngcactaagcggcaatcacacatttaccgcgangctacttccttacacgataccttgatttttacaatgcgt

SEQ ID NO: 2160 - DNA, 886 bp, Fusarium venenatum
  misc_feature (1)...(886): n = A,T,C or G
caccttcaaaccaaatcaacttcacttacaatcttctgctttcacgcaaaagcagaaccagctacaacaaccagatctatccgatcaattcacaaaccccaatcatcatgacagaagaactctccaaggtcgactcagccgtccaaggtctctcaagctcaccccccaaggaagagaagaagacacggcgacaaagctcagcagcggcacctggtgtctacaacgtcaatgacctcgaggccgagggcattgagctcgagctccctattgagagtcaaaagactggatggaaaatcaacaagagctctagcacagtagaagacgctgctatcctcaagcttcacctcacgaaaccccccgtcaagagaattacccttcacttcccattaggggtggaggtgcaagcacgaaacctcaagggtgtaacaatcaaggacgcacttgatgccatccacaagcagtacaagaagcgggccgatgatgagctcgacaagccctacctcgctggtttcgagtgggacaaggaaaaatcatggacccgacttgttgttcacttgcaggcccagcccacggccacagactccgccggtgggnggnaagaagaagaagaacnagaagaacgaagaataatttctctcggcaactatgatatctcttccaatacttcctataattcttgttcctttccctggtttcgttgcgagtcggcgctcgggatattgcgtctagatattctcggtccggtcatattctgcgcgattgctgggagcatcgcctggtgtactcctctactcatagttctttgtatcgctggtcgattcggtcggcgttctaaggttccatgatgtcatggttcccttacataatatacattcccaaaccaacc

SEQ ID NO: 2161 - DNA, 666 bp, Fusarium venenatum
  misc_feature (1)...(666): n = A,T,C or G
cttcttttacgactcaccacataccatacctaccatacaatacatacaataacagagtcgtcaactgttcgcagttgattcaacctattttcatacgttttatattcacgatacgagagcatcccataccattcactgctttcgtcaccctccatcctccggtttaggccccgctcttctggcgcgctactcaactcagtctcacttttttcggctccctctctcgtctcgctcaactataacccgcccagccgcgcccgacggggtttattctctccctacctaccttcggacagacgccactacccgcgatcagcaaatacataaactagccgacgttccccctcggcgtcgcccttggccatgttggaaccacaggccatgagagggcctattgaccaaaccgttggctatggacactctcgaacacaaacatcttcttcaaacgcctatcccatgcaattccaaacctctcaccttgccaaccgggccccaatttctccanaaccgtcgctcgccttctgtgaatacctttagtaccgnatcgagcatcctctnctgcagcctaccggtcttcttcaattctgatcttcgcgatctacatctaccgttcagggggagccagcaaccagnccctccagctatgtggctctcttgcgcaagcaa

SEQ ID NO: 2162 - DNA, 568 bp, Fusarium venenatum
  misc_feature (1)...(568): n = A,T,C or G
cgacgttttcgaacaagaactgtgaaaaaaagaaaagaaaggatggaacgttgttgaccaacaagggcattgaaagtgcgcccgtgacaacagagacagcgtaaatcancaaagcaaagacaagcaccgggtcgtcacacccgccgcagaagcagaacatcccgaggcccgagcccgcgtcctgggaacgccaaagaagaaagctgggacgtgtttgattggttggcacacaaaaaaggcccccctcgcctgttgcaacttgcaaggggggccatgaattgcaactgtacaacgcgactgttactagggggagagactcagtcaggacttgggttggcgtcagaggacagggagtactcagccagatagcgagccttgactgtttaaggagaatggacttttggtgaccggcttatcaangtgagattgggggttgtttgactaaggatggaatgacatnctttttnctgtgaaaagcaaccgtgatgggaangatcttgacatgtccttggtaatatttggtcatgcagtagagattactcaaccattacatcaatattcacattcn

SEQ ID NO: 2163 - DNA, 425 bp, Fusarium venenatum
  misc_feature (1)...(425): n = A,T,C or G
tttgttttaatagtattggacccgtttctggacatgtctttacatttctcttctcttctgatcttggaggatnctcttggatgatgtatttttggatgtgttattttttttactcnatacggcacaggatangggggaacancacacaacacaagttttgatgtgttnccagataatgatctctgaacatggtcacctatttcaactgtcatctgcattttctcttctacttccctctatcgcattcatgggatggttcttctatttatgctttgttatgactggggatatgcatgatttgccatatagcgcaaagttggtnattctgactctgggntngcacatttttataatggnatctactttcaatatcccattaaacacacgattcaaggcatntnatatatttaatttttttctttcat

SEQ ID NO: 2164 - DNA, 465 bp, Fusarium venenatum
  misc_feature (1)...(465): n = A,T,C or G
gaattatttcattatagcaagatctgcgacccagcaggacgatcagcacagctgtgaagaccctgaacaatttggccagccactttacgatgtcccgctatttcagacaaaggccatttcatcgaacctgactgcaaagccggacagtcaaaacacatatgatgtacaacttcattcccaaccacgtacacagacgccttctcgaaatccgcccagactgcacactgaacggcgtcgtcaaagtctgaagaggaatcacgttagtcgctcgtgcttcagtgaggaatctgtctctgaacaggagaccgtatactcgcggcaggcgaaatcagaccagccaaggcctctggatcgtgtcggcatgcacgttttgcgacgagacagagactcctaggtngcgtangggacctgtngacgccggacccttttgcaccgtttgccggttaatctttccaaaaggcggtc

SEQ ID NO: 2165 - DNA, 146 bp, Fusarium venenatum
  misc_feature (1)...(146): n = A,T,C or G
ntacgagcgcgancngatcccanactggggcggccttcccccgncctttgnctttgagcntctcacgcnctttatggcatacggtttctgcatggctcctgtacagatnaagtggttcctattcctngggcntatnttccccgcac

SEQ ID NO: 2166 - DNA, 454 bp, Fusarium venenatum
  misc_feature (1)...(454): n = A,T,C or G
caacatcattcaagcatctccggttcaagtctaactaccaacactctaccaaacgcctagttcgtgatcgacacgactccagtcggtcgaatcctgaacatataccaagtcgccggcaatggcctcatccaaagtacgctgccctcaaccctnggagggaccgagcccgagccctgtcatgatctttttcacgacctgctagatggcataacaacctatcanggcccagatttgctgatctcctttcgtcctcttcaggaaatgcagcagtcctngaggccattgactcanacccgttctccgatgtcgtccacgtcgtcggccctccccggccgtcaatcccacgctcggacgagctcgcactcgntgctcacaggcgctctcaacgccaaccatagagtgactcgacgcaagtctgtcacaaacccgaatgcgaacgttaccgcgatcgccg

SEQ ID NO: 2167 - DNA, 337 bp, Fusarium venenatum
caaaaggggacccgttgatattcagggttcctttttcgtccatgtgaaaactcttcacggccaaaagcggatgtgaactatcctcgtcgaaccagggctcgatcaaagcggcggaatcggtcgaaagattgaaggaagcaatacgcctcgtccatcaaccaccaaaggaatagatttacgatcaggcgatgcatcgatgcccagaccgacaagcatcacgactcatcactcacatactgatgacacggaaatgacagcctgcttcgctcccgtctagatcagataaccgtgtggatcctcgttctctgccaatacaatcacatcttagagataaaaa

SEQ ID NO: 2168 - DNA, 830 bp, Fusarium venenatum
  misc_feature (1)...(830): n = A,T,C or G
canaaacttgctgagttcatggctgancaagctgccattgcccgtcgagctgccagcactaaccctgcgacccccctcgccgagcctatcaacaagcacacgagcaacatctacagcacaccttcaaaagggcacagtgcgatggggttcgatggatacctaactcccccgatcacccnggacggtaacactttaatgggtaaccacaacttggccaaggaatnatatgttttgcctccgcgatgcccagtcacccctacgcctnctcaccatgcggnagtatatggtcatcaacaacaacaacaacaaaaccaatacgtcggatacgttaaccagcatggcatgaaccaataatgttcttcatgacaagatattgaatcgacaattcgacctcgacgttcacccatgtacatcaccttgactttcatacacaatcttttgcgacattctattatttgttcgaaatcattgcatggtcgcacaacaagaatgatctttcacatttgttatttttttggcatttagcgacttggtttcctttttttcccccgcgattcaacaacattttttttttatatcaacatcaagtctagcggcaccaaaaaaaggaaatccgcggaatcatactcctttcttcttcattttcagcaaacttctgcattttattttatcangctccatacactgctccccggtgtggaaagatcngcataccccgaagaagtctacaacagtcacatctgggtaacngtggtgactanattacagttgaagacctctcacaccggantcaagacaaaagaacgagaanncccaaagtcctccantga

SEQ ID NO: 2169 - DNA, 545 bp, Fusarium venenatum
  misc_feature (1)...(545): n = A,T,C or G
cgggcctcaccatgacaagcctgagcacggtcctgagggtttccgcgccgagggacatgagggacaccccccaccaccacctcctcctcaccatcccatcattgtgattctcggcgtcctcgccattgcactcgctcttttcagcggcattgccattgcctacatccaccgccgcatagctcgtctcagccccgagtctcgacgtgccatccgccgcgcattccgtcaatctcgggaagagcgccgcaggggctccgctttgaaggctgcgtaccgagctttcatttctcgatgtgtcgagaacgacgaagatgagaaggaggccatgcttcacggtgaccgccgcgaaggtcttnttctgcaagcagcgtgaccatggaagaagagattgcttctttccgcgaggctgctaacatggtcgacggcatcnttgctgccgaanaagccacaacacacacgctcgctnttacagctatgtccaagccctctattttttttcgcccaacacatcaccaccctgtggcggggnataccgtactttccga

SEQ ID NO: 2170 - DNA, 349 bp, Fusarium venenatum
  misc_feature (1)...(349): n = A,T,C or G
gctgatgccggtactcctgtctcttctggtgatgcccacggacctccaaccgagccaaactcccgtcctcacagcactgtcagccctcaggctgctggacccgccaacaaggtcttcgataacgctcagagccgcactagcacatccagtccaaccggtggttccccttcccgggatatgacacctggctccaagtctaaccangctggtgcctcggtggctcccatcggaacccgcccctctggtacaccacaaacctgcttcatctaagcgatcgacaccccctcgcctccctggtggttnggggacntggaaacggctttggggccantctctgtctcggtgcccc

SEQ ID NO: 2171 - DNA, 358 bp, Fusarium venenatum
  misc_feature (1)...(358): n = A,T,C or G
cttancaatatganctctacaaactgtgctgcgngtgttgacgcctnctttggtccatttgttcctcccgaatgccgccatggcttngactttaccctcatctttgaacagaccattcttgtgcttttaccagcctctcttcttcttgttattgcacctttncgtatcttccgcctccgaaacgctcaagtcaaagtcacgggccatcgtcttcgttctgtaagttggcgcttantgctctcttggctggcttcatttgtgctcgtcngtgctctgggcaantctaactcgtgcttccaaacgccgtntagacgcgnttccattgntggtgcatgtgtntnctttgcctccagtttaa

SEQ ID NO: 2172 - DNA, 198 bp, Fusarium venenatum
  misc_feature (1)...(198): n = A,T,C or G
naaggaagggtttttaccgatttngagngtttcagnttttccgacttaaanaagcagngacnattttaaaanagcgcangggtttggccaagggnaaggcctcccnaaaaangggtattaacttggaacacnggaggtcttaaaagttgggttaaaanaagggcccggaaaaggnacaaaanaaaaancggttgaaaa

SEQ ID NO: 2173 - DNA, 545 bp, Fusarium venenatum
  misc_feature (1)...(545): n = A,T,C or G
tcatcatcaaccgtctcaactcatcaatcggcattccgtgacgggatcatctcatatcgggaaggtcctccaatgcaatttcctcnaaagttgaantgcaaatcgtggtggaacgcaaagtgggtgagataacaaagaagggtcanagcaatctcaacaattgtctgcataaaaaaactccatcctgcactgagaacccantatccgactacgaaatatttttggcgacaccgtgacttcacgatgtctgagaatcaaacacaagacccaaacccaaggaagtcgacgtcccgggcgtgaaggacaccgagaatgttataactgacaaganggaagccattctcctggctcgaaccgcaccctatcntcgtcatcaatctcgtcgggcccgaagaagctccctttgggatccaaaaagattcctccggtccncgattcgagttctacgaaaagctccttttcaacggnggaaaagaaggggaaanttgggcacantttncaagccttccggngaacaacnaanggaagtttttgggcccccccaa

SEQ ID NO: 2174 - DNA, 456 bp, Fusarium venenatum
  misc_feature (1)...(456): n = A,T,C or G
gctttcgacaatcttcagattacagcctccgaaatcgcgagtttgaccaagtgggagggaacaaaatgggctaaggaaaagtatgagaaggagcngggatncattattcatgacaccaccgccgatggattccccgactggaccgatattcaacatttacctcgcgcttctcgcagtcattccgcagaagttggttatatgggacttgacgacctggataacgacatggaagttgaaagtgaagatgagctgggacagtgtaggcgttgaactgaacgagcgtctcagagatggagttgcaagacgcgaggctgggtgatacttcagctgtcctcgacgaagaatgggaacagtggctcaagaacgccntcgaatcaggcgagatcaactttctgaacgaccacgtcttccangaaagtgaccagtanctgctgcgcccttcccacangtttgctc

SEQ ID NO: 2175 - DNA, 419 bp, Fusarium venenatum
  misc_feature (1)...(419): n = A,T,C or G
gtttaaagaacaatcgcagtcttttgagggtggtggtgatgccganacgacgttgtcgcagttctatgatcagtctttagctttgcataatccagtcccttcatcccagcttgacagtttccaanaaacgacttttgaggagacttntttngagggaacttcattcatgactactcttgctgnaaaacgggttgatgcgacagagtctgnaccgtcatatctttccgattnggaggacataccacctgcaccgaaaatattggccctgcacccccagactatcacgcttaatatcattgntgggataatatccatcgcccagccgcggacagtcaccacgcgctggggccgcaccctctccctnatcgagattctactcggagacnaaacaaagacaggttcgctgtcacattttggct

SEQ ID NO: 2176 - DNA, 621 bp, Fusarium venenatum
  misc_feature (1)...(621): n = A,T,C or G
cttattcaaggccacttagtgtttcttttaagaacatcgtctctgcccatcaaactatcaagaggcgatacgatcaacaagtggttcctgcatatctcaacttgcaccagtgttcttcctcccatcttacacacttacccaccggacctccatcttcatcttcatcttcaccctgaaacaactctcactcaacttacaattcgacatcatcatcactcaaataccatccatctttaagacaactgacgagtccccggaaagtcgaccaaaagaggatcctttaccgtgtccaatcccacatccgccagaaacatctcagaccctgcgaaactttgattcacaacaagcttcactcccttctggaatgcaaagtgcagataaacgtggttgcactctgagctttcaactacaagtacaagcttcgcctgccgatacacaactcttcacatcttcattcacatttacctctcacatttcccacaaagacatcatgacagccttgtcagatccgtcattcgccatggtccattctcaacctgacgccgaggactatgctcgatatgcccgacttcaacgtcatcttnactttanggcccatggacgtgagcattcccagccgat

SEQ ID NO: 2177 - DNA, 616 bp, Fusarium venenatum
  misc_feature (1)...(616): n = A,T,C or G
cctgcgttacccacatttacatgagattgggaatcttccttccttgctgcaccgtatcttactctctgctcatatcttattatacgatttgaccattccgttttccctctcaatttcttgtttgctctgctcatcaagtgccctgtgcgacccttaactctttctgggagacagagagactgctcgttgtccccgttttaactatcacgccgcacctctctgtgaaacgtctcgctcgcgccccctttaccacctttacacagcccctctggttgatcactgctcaacaaaggaaacaagcgagccaagaattgagattactactggaaggaccggatacagtggaagaattgtcttggacaatctctttctttcaccacttcacattcctgtcaagcgtcaatctttgggccaaaagggccctagacgacttgccaaggtgtaaacggctaagaaggaattgaatacctcgacttctcgcagatcagaacccccgacaaccaccaacctacttcactactattataagcccaaacngctgagacgttggctggtcaggaacgacgacnactctttctttcaatantnactttccaacgaccgggcccttngggtt

SEQ ID NO: 2178 - DNA, 360 bp, Fusarium venenatum
  misc_feature (1)...(360): n = A,T,C or G
attgngattccagaaattggcttgacggaatgaatggctccacaccgctgatgatatgattgttggccttcaaaaacaccttgacgccaaatatggtgggctcaatgcgtacctagatggcatcggatttggntctgatgatcgagccaagctacaggatgtcttgctttactaagaccaaggttcagtgtagggaacgtcatcacatgagggagggattgaatgttcatcttagggtgntgcttctatttctttctaaatcgaccctgtaaccagcatctatacatnttgagcttttgagctctgttgacgagcaatctgtngatcaacagcaaggttcttcacctcgaatccgggatg

SEQ ID NO: 2179 - DNA, 520 bp, Fusarium venenatum
  misc_feature (1)...(520): n = A,T,C or G
ttttttttcttacaaagagattcccattttttaaatgtacagtaatatgatacacgctcatccaccaccactcctctacctcctcttgatccatccccttgagttggagatgcctttgatgttcttggtgtacttccaaaggtggcggtacttgggtccttgtcgcttggcttcccatccgcgaggcttgactggtggcttgagactgtgaacacgggtacgacggaactcgatatcggaaccgggaatgttgtgtcgggccatgacaagctgcggtgtctcatcatcgctggtctctcctcgcatgcctctcttctgcatgccctccgcgtcccgttacccccgaaaccgtaactacgctcccgtcgtcttcgtcttcgcatgcttggtttcttggaatttggtactggggcctgggggccacaagaactacctggtcccccacaaacgaggactagangagtaatactgtctnttgaggcgaacangatatatacatgcttttggcaatttattttgg

SEQ ID NO: 2180 - DNA, 612 bp, Fusarium venenatum
  misc_feature (1)...(612): n = A,T,C or G
ngggggnggggaacatgatacctggctacgattcgcacgacctaaacaagtctatgaagctgcgggtcgttgtttatgtcaaccggccgtttatgtttacttttttgttcaacctacgaaccgactccttggccatggaatctttatatcgctccctacatcatcaactggctcctcttcgcaaacctnttctcctctccacaagatatcgtcccgagcgacctggcctcgacaatggctctagcagcagtaacttgaccaacagtatctatgatttggtctgggaccccgtttcattgactgttcacacatntatacccaacattcccgacacatatgatgattcggatccttggactcgtgccgatgccctcagcactcatctccaccttgnaaatctctatgttaatactcgatcccgttcaactgctcttgagcgcactgaaaagtctagtcgnggatgggggatcgttggacacccctgctcgatcggttggaggacggctcgacaagtaacaatctctcaaccatncaaaaagggggngccgatgcanatncggacacgacgcattttttggaagaaggatgaaaaaaagtttctgggcctgcccn

SEQ ID NO: 2181 - DNA, 539 bp, Fusarium venenatum
  misc_feature (1)...(539): n = A,T,C or G
gagcgcctggggatgcanaaggccacggcggtgggggggttgttatanagcttgtcattgaggacgtcgacaatgaggataatggtgcatgggaccaacaagctgaggacaatgagatgccccaactagatcttctcaacgatgagaacccagtgatcctgccagctgaggagggtgaagaagacttacctcctgccccgatcgaagcacctcaaaacccggccgcagaaccagctgttgaccttgcgcctgtcattgttcccgaacctggagccgagaacaagctgctcagcaaaaccaacacnangctccccaagcaccgcccgctcgtcgtcctgtctgggaacgatcctgtccggggtatccaacgcgatcgttaatgccttgatacttccgggtatctcttatgccatgggcgancttcttcncatggccttcctnaacaaatgactgccacgcatcacctcccaagaagctctgcgccangtctctccacancaatggggacaatcttgtggtggttttacttgtgatcaaaa

SEQ ID NO: 2182 - DNA, 427 bp, Fusarium venenatum
  misc_feature (1)...(427): n = A,T,C or G
ggcaaaatgcctttcactttagtagagctgggcttccaggactacgcaagctcaaacttccccttgaatttgcccccagattctcaatttattgcatcttgtttattttatttagaacttctggcaagctctatcctgattacactacactttcttttccctgctttgcgaaaaaagcaagatttgttgtcttcttttcgtttgctcgcttagacaaactctccccactccatctacgcctcacctacttcttctctcttacatcctcagtctctcttcatagagcagactcattgtacagtataacaatgcctaaccatgttattctggatcangtgccgtagttgccgtctcggtcgctgtcgccaacgctgttgcantttcgagtcgcctgaagtgcgacgatacgccgatgatgttcgccgca

SEQ ID NO: 2183 - DNA, 262 bp, Fusarium venenatum
  misc_feature (1)...(262): n = A,T,C or G
gtcggcagcaggatgctttctcgtcctgcttcccctacgctgggtggtccgatgactaagaagagaaaatcgagcgcgtctagagtacctaacgggctgaccatgacccgcatggacaccacgccctcaccgggttcgcaggcagctcaactggctaacgccacgtcttcctttacccctggactttggggggttcttccaggccgagccttattnggacaanaaccaattttttttcttatgccggcccctnaccttgggg

SEQ ID NO: 2184 - DNA, 566 bp, Fusarium venenatum
  misc_feature (1)...(566): n = A,T,C or G
gaaatgacggaacgaccttctacatttacttttgctctcattccaagattcgagctgctcatgtggtattcttcttttcttcttctcccattgtctttgtgtttccatatattttggtcttcaagactgctctcttcgctggtatgaactcttccttgaacacccaagcatatatgtcggtggggaggctatgtgcatcttaataggcctatttggcttcaagaattgcttatagtatttggactcgccgggatagangantcgcacgggtagggttatggaatcgctgcttgcctttttcttcttctttttttctgttacctgtctttgcttgtgggtttgactttactctgggttgatttggttgantacatgtgcgaaccacaacataccatgttatttcttgttgcaagccggtgatggctaattgggaagcattggatttggttcgatatatctctctttgggcaagctattggttggttttcttgtggcttcncaattttattttgangacactgctttncttgcangcgttttgtgctgcaagcatattctactaggct

SEQ ID NO: 2185 - DNA, 787 bp, Fusarium venenatum
  misc_feature (1)...(787): n = A,T,C or G
gttttgatcgtttcatccaagttacgccatggagatatccgtggtaaaaatttgagttcagactcagcttcagtcttccaacactgcacaatgtgagtgagtcttccagccagccctcgtctaggtgacatcggtcagtcgaacattctgcgggtacagccagacttggtttggacaggggataaggcgcgatacctaacttgagggaattaacaaggctgcctgccatacgaattcgacagcgggtcgtatctctgttcgtccatccatatcactttctccccgcatcgtccagtcccagcagcgatgatgattgcttcattcccttcgtttctcgtacgatgacctctttgttacgaagtccagtgaccagaggcgcaagtgaccatcaagggatcttccgagtcttgagatctggatggaggctaaaccttttcttctctttccaccacagaaacttgntgcggggacttggtgatggtcggatagctttgnatgtcatccttttgcgctataagcttatcaaaccgccctggtcgattttttgttaaactgnaccagtagtggggatcatnactcgagtaaccgggtcggnatggtgcccgtacgctcgaacccttaaaatagcggatgccatganggtnaaaagcaaggggtaagtcaattgggaaaagtcgattttttgaaggaactttgaataatcggcgtgatgttgtttggacacaanggaatttntacattanggaatattncaggcaacnttgatcagggtttttttaaagacccc

SEQ ID NO: 2186 - DNA, 615 bp, Fusarium venenatum
  misc_feature (1)...(615): n = A,T,C or G
ttggcgaaagtcctgtgtccaacccatccagcaactcgtactctgtcggagagcacgcaagtacagtttcgaggtcgacagagccacatatctcccaacccgactctcctacggctggacatggtggtcatactcgcatgacatctgatgtatctggtgtcactgaaaacagtggcagaccgcctcggatagcatctgatgtgtctggtatttctgaaggcgacgcttctgctctccgacatattacaagccctataagccctagaagtgacgatggcaacatgccttcgccgccattccctggtatgacagaggatatccttccttctcctcctgcagatctcacgccttcatcgncttctcttaatacagcaagtggctcctgntcctgtgtcttcttccaagtgccaacgaggcgcccggtcgggactatnttacaggcaanggctcatcaagcccgaatagaaagaagtatgtttaaaggagagcgaggaagacatngggcaaacaaagtaagcacacttggggtgggngggggntatttgcaaaagcnggggttctaatattttgganggtatattatggtcggacatanggnacatatntaganctcgg

SEQ ID NO: 2187 - DNA, 230 bp, Fusarium venenatum
  misc_feature (1)...(230): n = A,T,C or G
naacgtgntatacaactacatntacatacaanggggggngaanctaaataaaactgtcacngaggctttcaccccncgccgnggggaaaattatatataacgtttctcatgctcacaatttgngccatgggngtactcattgtctggtttngggganatgnagaaacaaangtatgccgcncaaaaaanggaccgctntttnggagaggnattcaaggaggagatntctt

SEQ ID NO: 2188 - DNA, 647 bp, Fusarium venenatum
  misc_feature (1)...(647): n = A,T,C or G
cttagttatgatcgagcttgcggtagttgttcatgcctgttattggtccaaccgagagatatcgaataaaggctgaatacccgtcttacccgtcaagtccttgtctagtctgtccctatgttgcactacattcatgatcctcccaacagctctcccctctctgcagtgcctccagggtacagagcctcacatgcagggttccgcccaggcaagtaggcagatggcagaatctggtctgtctatatgtagggggccaagccatcccgtcttattctccgattctttttacttctgacccagatgtcagcctgccatgaccattagccaaacttgttggtcgacactcgacaatgccaggcgattgtggatcgacctgtccggcctctgatggcttctacgcttatagcccgagtgtaggtggnaacgccgngttactcactgctttgctctgcttctcttgctgcactatactttggaattcgatccaagaactacctcttnttcctngtactcacaaccggactctttctcgaagtgctgggatttaatgggcgaattctgnttcacttaaaacgggatgaacaaggncacttttttnttggtatggtttggaacaagtctgggnccatcgctaatgagcctcgcca

SEQ ID NO: 2189 - DNA, 353 bp, Fusarium venenatum
gtgacggcgggcagcgaggcatggtcggagagtgttggtggtgatggcggaagatgctgtcgcccagcgaaggggctgggcagtccctcgccgaagggccgagctcattatatgagatgtggtggtggtttttggaaaggtggtcctaggtggtgatgaagaggtgagactggatcagtatggagggatccaggcaagtgtatattttacaggagacgtaaagtggtcggtgcggtgatggaagataagttaattctatctgggttgagtggtaaagagcaacgggtggaagagagcttaatatatttgtatctgtctggcagtgacactaaactgtcggttgaaaaaaaaaa

SEQ ID NO: 2190 - DNA, 385 bp, Fusarium venenatum
  misc_feature (1)...(385): n = A,T,C or G
cgaggctaaaagtggctattcgtcttaacaaacctgtaacagtgcggttcatcggcttcgtgtaggaaggaagcttcagggacgtgtacacccttggtgtgacacggcatgagtgtatgtatatatgcacagcaacctccaacctcccttccattcatttgcctcgcagtattgacacttttgaccggttgagtttcactgcttctgtaataaaataggttgtttgtgctgacgttgagctctgatgggtatgtgacatgttctatgtcgtgatctgctgcccaacactgtcgcttctgagaaggattttgaagaggagaccgagcaaactccggtnttagttatgagagaattgagaggaacgatccantccagttnaaaaaaa

SEQ ID NO: 2191 - DNA, 594 bp, Fusarium venenatum
  misc_feature (1)...(594): n = A,T,C or G
cgacctcggtgaggattctgtcctgcttgagtcgccgcttgataagattgagccttaccagctgttccgtaatactttgatgaaaatgcaagcagaacagccccaattttacgggagcttggctggacaccttacagccgatgaccagaacgttattcagaacgtgatggtcaaggccgatgagattgccacacagcaggctcaacaggcccagcaagctcagctcctcgctcagcagcaggctgccgctatggccgccagctttgggtgcacagaacggaggtgctagctaatccagcgaagattgtggttgagagaaaatcaagttattggaatggtttccccctttgttatatccccttcctctttcgcgttagggcaggagtcaagattccccggggaccaagaaacgtgttgagcccatatcaaaagaaagagactttagaacgtgcaacaatgatggacnaccccgccgtggaaggccttccaaaagaatgccgnggtatgattggtattgggcacttggattgaaacctattaacgagtggttatatgatgggaaaggacacggtaggaacnaaccggttccacaga

SEQ ID NO: 2192 - DNA, 602 bp, Fusarium venenatum
  misc_feature (1)...(602): n = A,T,C or G
ttttttttnncagctcgtttattgttttatactgtacttgcacgatttgtctgccgtctcggcaaggctcgtacaagatgaattcggctacaacaacaagtacagagacttcgaatggctctgcttctgcctctatttctaaacgcaacggtcacgacgtcacccgcaccaacggaaatggaacagccacgacaggtcctccaaagaagcctggtcaaaagtacanacacgttgctgccgttcataagcagacgagaccatcatgtttgagccacgattcagatgctgctcccagctttattggctttcgcaatctcatggngattgcctcgnggttggaaacttacgattgatgattgaaaacattcaaaagtgcggtgttttgatctgcgtgagatgtcatgactacagtcgccaggatattttcttgggctgctctctactttctcatccatgccatnttnttgccccctacttgattgaactggctgctgctaacaagcgcgaagatctnttaaacgttacaacgatagtgcttttnggngcccttnaaancaagagccccacaagtttcacaaaacttgggcattggcnatgggcct

SEQ ID NO: 2193 - DNA, 673 bp, Fusarium venenatum
caacactacaccaagattgtattgctatcgacattatttcaccgcacacactgggcctcaagacaacatcgcttgtcggtcccacatcactactctacctggctgttgacccgaaacagcacgagcctttgatcaacgattgatggatgctcacactgcttacagccacaattgtttggcgtttacggaattggacttgtgcaagcctggcatggcgcgccgggcatccgcattggagtttgggtcttttttaaactgcgaagtttgtttcattttctctttgctatcgcggaacatcaccgcctttggtttgactctgctgttttaatcatcatgtctggtcgcctcaatctttgaccgctctccgttgaacgggcagagacggtcttaataaggattgagcgcgcaacagaatgagcctgctttatttgtatttacgcagaagaaaagcgaagcctggttttacgcgtgtcacgatgtctccgagagtgcgtccttaactgcgcctacaacgatgacttgattgaatgcaaagactgtataatggcgcaggggaaaagggaaatgaaatgttagtgattgatttgggaaaggaaacaaaaagtttgcttccttgcgaggaatgcaatgcaatggatttgtgctttttcgaaggaggagttgggcataacag

SEQ ID NO: 2194 - DNA, 605 bp, Fusarium venenatum
cggcacccagcgatgagaaagtcatgggaggactttgctcgagccgatgaatcgcccaagtctgaagatgcgtgctggagttatctccatattcctggcgtttaaaaccaccaggagcttgtcatatacgacaatttcgtactcaccattctcttcactaaaccgtcataatcttcgaggagtctttaacctccttttctatttccagatcccatttcccgcataccgatttcagggatcatgatgatttatgcgatatttacacggacacacgccgccgattaccctaatgatcccaccagcgttgagggaccacaggggaacgaacgacactcaagccctcctccctacagagctctgtatcacttctctacaaaggcaacaggacgtggggcgcttctctgcaaagacgccgaccaacggctgaatcttctaggattctctggtgtagagtaatcccagggaggatgctgattcaaagtcctttctctagtcaccaagttcagaaggtaaccttgtcaccatgtcatggcttggggagggatttacttccttcgctgggatagaaaaaagcgactttgcattccgaagcccctgggcttcaa

SEQ ID NO: 2195 - DNA, 242 bp, Fusarium venenatum
  misc_feature (1)...(242): n = A,T,C or G
ngagangactttcccgagacttggccagtactgaanaagtggtttggagaggttcgtcccgctgcaaccatggtacagtctgcattgatgaaggaagagatgaanattgaaatccaagtccctgctagaataggatgtggnaaacaggaaaanatagacccatgtttgccatctaaaaaaaaanaaaaaaaaaaatttntgccgcngcttngagcttgctttaaccgggcccacttccccct

SEQ ID NO: 2196 - DNA, 517 bp, Fusarium venenatum
  misc_feature (1)...(517): n = A,T,C or G
gcaagatgcttccagtcattcattgctttttgtagccaagccgaagcagttaccagtcactctttattgttcaaaatgctgccaaggttatcgctactcttccattctttgtttgtccctctctgcatcgcgcgcgacaacaacaacaccagtcaatatgccgcgaccagcggcacagtctgggccacgccccacgatagttactcgtcgtcaataggcgttctcggttgcaaagtcgacacgaatcgcatcgcttattggcccaattccatcgattgcgacaatatctgcatctccttgacctaccaagacgctccgtctatctcctccgcatcgatcaatcccaaggcgcgcacgacgttagctatgatgcatggaattacctctacactggctacagcgccaccgacaagcctacagccggggggcctgtcgaaatgactacganaattcaatgcttccaaatgcaagcacttgatcgatacaaagggtgcaaattacccttagcgccgccaca

SEQ ID NO: 2197 - DNA, 633 bp, Fusarium venenatum
  misc_feature (1)...(633): n = A,T,C or G
ggggatgcaagcaaattgattgagaatagaagcaacttgcattcatcttcgcatcaccgcattaattcccacgatggctcattacatcgatttcaccactgcctctacccctacctgttccctctctgctatccctcctactacccaggatcccctgttctttactcgtcttatcgacaagcaattcgggcttgacaagaccaaaaatggtccggcggatgagcatcaggcttgggccatgagctacaacaaacagcttgcctctcagcagctacggtctagccagcaatatgatcagattgccgctcttcaggggatgacctctgatctccatgcgaagcccgcagaccctcagctccttcnaaacatcagccaggctgagcagcttcttggagcttcacccttctaccgacgctcaaatcttgggagcggagcttnttcatgcccagggctggtccaaagaggccgttgctaagcaagtccaataccagttgcctgaccaagttgccgctgaagctgcctcccgccttgaccttcgcatnaaagctcgtgctcaagctcgtnttcaagctcgcggaaggntaccccgtcatcttctaccctcaattcccttactntntcattctacccaaa

SEQ ID NO: 2198 - DNA, 461 bp, Fusarium venenatum
  misc_feature (1)...(461): n = A,T,C or G
catttattgttctcttctccaacttcttctgttcatctcaactcaaaccaattgacttgtaaccaacatgtcatgacacggtcacgatgcttccggaaccaacaatcgcacttacctttcctagcataaacgatggaaccatcttgattgccgtatctaccatcctctctcgctagctgcgaaccagaagcgccaacatggctgaaacatgccgctgtggtggctcatccgtatgcacccatggggaagatgctatgatgatcctgtnggtagganctgcggctgcgcaattgcttccggaaaggttncttggtagcgactttaatttccgaagtgcacatggatctgccgganggactcattggactcgaaacccgaacaaatgatatgcaacgttgtggcttttgttttacactacntcactatctcgatccttcaacactatngaaacggnctgcgaa

SEQ ID NO: 2199 - DNA, 585 bp, Fusarium venenatum
  misc_feature (1)...(585): n = A,T,C or G
cgctacgaaagccatagccgaatgctttgcccgtttacatccacaccgtctaacgcgctggctaccgagtagcgcagtagcatgcacagccctcccactcgcgatgcacatggtagatatcaaaatgtccgcggcctcttccgctgccgagatctggtcccgaccagacgttgcttcaaaacagtcacgactgaatgtcctcattcaagtgttcagagaactccatcctaaatacgacggcgtgcattctatctccaagacaattcggtattttatggaatgcgttggcgtcaacgagcctacgcaaatgatgatcacaaacgaccagagcgatgtactcgcacgaagtcctgcccaatatctacgcttgctttgacaatcgacgtgtgtctgaccaagatcgtctcgtacaaganaggatttcccgctgcctgagagttcgtcagcaggatcatcacttatgccatacttcgggcaaccagcatccatacgancaatgacagacatntgtgcctgtcagcatcgccgccgtacgccatatttgcagaacttccgcggatgagagatcacgnngtcccctcaatg

SEQ ID NO: 2200 - DNA, 106 bp, Fusarium venenatum
  misc_feature (1)...(106): n = A,T,C or G
ngggtcgccatgacaanattgancgtgtactgnaaggngtatgccntaatcaagattacggctntaatggananggaccaanancgtatgattnngcctaaggacc

SEQ ID NO: 2201 - DNA, 269 bp, Fusarium venenatum
gcctcagtcgacattgtgacacttctcggagtcaacggttaccttacttatctctacagctccattgactcaactgctgcttggtgccaggtcccctaccttggctggctcacctttgctacctacctttgcactgccattggacacttgaacaactgggacctcgcaagcggcgagatcaacaagaaggagtaaggtgatccggtagaagaatattgtaaagttcactttttgatcacgagctttgaatgcagctgtattgaaacttc

SEQ ID NO: 2202 - DNA, 101 bp, Fusarium venenatum
  misc_feature (1)...(101): n = A,T,C or G
ncntgggttgggggggaacctttttgacaatgggggncccccaaanttgatnaacttggggggggcctaaanaaccttaccgggtgggggggngatttttt

SEQ ID NO: 2203 - DNA, 455 bp, Fusarium venenatum
  misc_feature (1)...(455): n = A,T,C or G
ntagttgggcatcctaacctaactaatgcctacattagtccaaagagtgtgatgataccctcagaattcaatcagaacgccctctctttccctctttggctcttgcgccacttcatgttcggtctccggctcctcttcatactcatcctctgcttctacctctgacgcctcatccaagtctactggtcttgcgtcgacacgcttcgcacgagctctggaccgaggcttcctcttggtatagctcatgatcttcctgtccattcgacgagcactcgatgcatccgcagcacgaagcatctctggaggcattggcatgacaccacgcgcctggagccaccagtcggggaactgcgagaggccgacttctgcaaggccagttgacgttgtgggcattgtgtgctcgtagtgacagtccagaccccatttgcagactccatggtggcaccagtgtcgac

SEQ ID NO: 2204 - DNA, 105 bp, Fusarium venenatum
  misc_feature (1)...(105): n = A,T,C or G
ntggtgtgttcacacgagancntggaggaattggtncggatttgagnctaatacatgggaaagttgagggttacgaattccaagntgctgnagaatgggntaaaa

SEQ ID NO: 2205 - DNA, 862 bp, Fusarium venenatum
  misc_feature (1)...(862): n = A,T,C or G
catcaacaacaactcactacctaataatcaaccaacatcactcgcttttcccccagtcattcgcttttgttaagaggtggatttttttgtcgatttttaatggtgatttgcatgatcgaccttttaccgattgattcgtctcgtttcgtggctggatagctgaaaccggatttaccgaccgacacaactgtttgcttggtccgtcagcaaaggggtcgatttccaacaacaacaaccaccactgcactgtcactcttttccaccatcgttaaccatcaatcgaattaaacgtttcttttcatcatggtgtcgcgatggtttacattggcgcttctcctcacaccttcattggctcttcagaacgattttagcttctacccgaaaggtgcacaaaaatgccttgagaagaacgctgacgacgcctcatgcaccggcgccgactcaaaggagctcaattactgcctgtgtggtttgggcaattacaataatgacttcatccttggctcancgcgctgcattggacaagagtcgcctaacgacattgacgagacgtacgatatgatggtggaggcttgtaacaactnccagacaccaatgaagacctngaaaacggactttcagcaggctgcccatgatggagagacgactacgagcgccacaggaacgactgcgactgcttcagcgactgcttcagcgactgcttnagcgactgataccgcttctaccgcgtccgacacggctgctgcttcgacaaccgatgcttnaaatgcagatgcggacacgggactgtcgacaggtgcgacgatcggtgtgggcgttggtgcacancaagaggtgcgggaatcgcgggttagtcatttgg

SEQ ID NO: 2206 - DNA, 746 bp, Fusarium venenatum
  misc_feature (1)...(746): n = A,T,C or G
ttttttttttttttttggatacttattatccaattgccaggcacctatntattctgagcaattaagcactatttatattcaatccatctactggatgtgatccttgaggaatcccttgacctgttcctcagtgacacccttaatacccagcaacacattatcaagcttctcaaacttgggaatgctcttcgcatcaaagatagctcggaacaaataaggtcccagggtaggccagtcataaatgcccttggccacattggcatnaacttcgcagngatattatcaatctggcatgcttaaccttccactcctttccagggctgacttccttttgcaagctcaagaaccttgttttgggtgaaggactatatcctggacgtanacaatgcggnctgtgtnttttcggggnggccaagacgccgatacagaatngccgacctagcgaaaagtagtaggctgactntgcatnaccttgatcccaaaagngactcaggtgggaaaagtcaaaaaaaagtgngcttgatccccaacgaggaaaaaccgtgnaacaaaggatactaatntgccttgattggaagctnatgagttatcttgatgngaccttgtccnaaacggaagtttcttacctgggacaacangtnggatccttttngagggangaaaccttgaactgcannaacggggggtnaanaaaaggtttggtggggatggaaantgccactgtnaaaacanacntttggccttgg

SEQ ID NO: 2207 - DNA, 638 bp, Fusarium venenatum
  misc_feature (1)...(638): n = A,T,C or G
ccatgtctttcttttttgacatgggaaccaacatttgttattctttcttgtctttctttctctctttgtgtgccttgtattgattccctccttgttctttttttctgtcccccggctcgtgctttcatcttctgcccacttccattttctctttgccaagcatatccctgccttattctgcctgtctgcgctgtctgcctacctctaccttgtcgcttgcagcattttagtttaggttgtcattgtcccatcagctgggctgggctccattttcataataaggtatcggatcccaacctgcgcccaaagttcttctttttcttctgggtgatctgcttgttatcgtcgtgtttcacttatttgcttttttttctttctcttgccgtttaaccgaatgctacatcgtgctcgtccatggcactgtacctgtaccgtacagctgcgccgttgcatcagttatctatctttccgatcatcgacatcgatatcganaatcgaacanctgaactgaacgctgaatgtctcatcgtcacntttcccncgaattgccctggatgtaaaacgctactgccgtgattcttgcaacatctttctccattcatcacatcgcagttttcaatttctacaacaagggggcc

SEQ ID NO: 2208 - DNA, 408 bp, Fusarium venenatum
  misc_feature (1)...(408): n = A,T,C or G
gcgcgacaagactggcaaatagacacatgaccaatacaagccagcggaacaatgccattggttcttccaactcacagccattgccttcacctgggatcttgcgccgaactgccagtttgctcttcccgtcattagtcaccaatgaagacaaatcgagaccaacaacaccaaccctgcctcgatcaccctcaatgaaactcgtttcgaaccaagtgcctgtgcctnccgaacaaaacgatcgcacctcagcgcaggcattatacaatgttgcgcatgaaccatattcaggcgcattcaaagagcgagatttaacaaaaccccccacactnccacttaagagcagattcctggaatggnncatttgatactttcgtgaaccacagatgaaccaanccgangcangcccgc

SEQ ID NO: 2209 - DNA, 627 bp, Fusarium venenatum
  misc_feature (1)...(627): n = A,T,C or G
ccggatgaaggctgggcgaggtaatgactgagctgttgcgcgagatcatggcgcgggtcgggcttctttccatccgtttttcatggccccctttcttctttctcacctttctgtggattcttttctcgcgcttgcttctactgtttctgttgcttccgttactttttttctcagtatctccaagcattactacagtatgggcctgtgataccccctttccgtgttctgggagaaaagggcaaatttcctgtcttgccttcaatcggatgtacacatttctttcttcccttcctgttatgtcgataaagccaaagagcgctacatgtttctcagtctctctatctctctatacgagcgcaatctccaggatacctaccaccagtatttgacctcgactttgttgcatttggtcaggtgtcaatctggcatttcaaatttccttatctgacgaagtcatgagcgtttcgtccantcttgtatgccacgaagcatctgatatttcagtggctggcgaaaggggtggcagttccatctcaaggattttccanctgtgtatttaacggtgacatttccttcctaacgggaacaattttttttccaattttcacttttttcnttactganaaa

SEQ ID NO: 2210 - DNA, 225 bp, Fusarium venenatum
  misc_feature (1)...(225): n = A,T,C or G
nactgatgtgggtgctccaaataatgacggacgctgccacgaggagaatgctcttaaggataccactgagagtcatgacaagtcctgaagtcttaccaataaggaagacactgatgacntttaggatgaatgcaaaacatgcgttagcaaaagagcatgccataccctgcaggggctgcatcttccccttaaaatcgaggacntttcantgaagcanacgacaac

SEQ ID NO: 2211 - DNA, 234 bp, Fusarium venenatum
cagaccttcccttcctcttttgccaatccaccttcaaccctttcgatctgacgggaacggattcgagtgaaggtatctattgtacatccctcttacaaggactacagctccagattcagttacaatcaccccttcgtcctcaaacttgtctagcagtggatccactgtgtatctgcatctgcatctcattcatctggatctgaccttgttcaactgtgatcgactacaacaagc

SEQ ID NO: 2212 - DNA, 47 bp, Fusarium venenatum
  misc_feature (1)...(47): n = A,T,C or G
tanccagggtntctaccctctcnanaacgtccacatncgaaagttat

SEQ ID NO: 2213 - DNA, 630 bp, Fusarium venenatum
  misc_feature (1)...(630): n = A,T,C or G
aaacatctcaggacacgtcgctatcaccttcccgtggtcgcaactctccctgtcccccgctggcttggtagctttgccatgtactccgcccagcaaaccggcgctgataatgcgacaatcaaccccgccgccctcagctcacctattataggtctttcacatcaaccacaacgctcactcaagcgcagccattctcctgtactttacgacgtgctacagccgggtgatgatggtatgtcggcggacaagtagtttgatgtcgctgtgctttctgcgacatccggctacttcgtgccagacagcgcaatcatttgcatttttttcctttctagaccggnaccattattttnaattttttttttttttaatttttttgcctcgattttcgtacagcgtctgctaaaaagaaaaagttagtataaggggaaaggctaaccattatcattatcacaggtgatacaaagccactccggaaacgagccaaaccaatgaacaaacgatcttcgggagcatttccgaggttctgggcagctgaacctngaccttcttangcattcttcgccagattctaatctaagntcgnattgcacaagccagcctgctntcacagtgagaccaaanccnccagac

SEQ ID NO: 2214 - DNA, 604 bp, Fusarium venenatum
  misc_feature (1)...(604): n = A,T,C or G
atttcgtttattctttgtccatacttcaccgtactgcacttggttccatgactttgacggatacgtgcagcaatcttaacccattataaaccaagccccgcctctttaggtcctgtcagatccccgacgtcgccgctacacgcgctcaggctctttgcccccctcccgtgtgagcctggtttggcagagagcttgcttggatttggtatcaaatctagagtgtcctgaaactcacttctttcgatttcaaataattttccatccttcgcgacactcttcttcgaccagcctcacatcccatcactcgcgatggcttccgccggcactggaggctctttgcacccaactttctcttgacccgcaacaagcagaaccttctcttcgntgccttaacttcaatagcaagaanttgntggtctaccggcaacacgctgctttgccaanacactnttcggacttttgccgccagcaaagccggcaggcctaagtttcagganagnccttcttgaaatatgattcacttggcnatttgnttcnatttnttgcnacaggacaaccgcctgatgggnacttctggaccacggcgntttcaaaaagcgttttg

SEQ ID NO: 2215 - DNA, 959 bp, Fusarium venenatum
  misc_feature (1)...(959): n = A,T,C or G
tgtcagtcaggatgttgctgatctgaatcctcacctacagtacctgcctgcactaccacggaggtactccctnctcacatcaacgaagcttcccttactcagttgtcttacctgcttttattaagatcacacaatctttcatcaacctctctacagtttctcataacctcacaaattcctttcctataacctctcagacaagtacataacagtcaaattccaatcagccaatttctgcagcagtgacaatcactgtgtttttgttttgcttctcaaagcccgccttcgcgaccattcttacttgctgcttctcatcacccttcaaagctcgcaaagtaacctctccgctcccaacacaatggccgccatcaagtctctcatgacccgcgactcggtcgcccaccagctcgtcaagcgccagaactgggcttctaaggaggctggtgttatcgttgtcttctgcatcgttggtgttgtcgccattggtcttctcagcctcttcctttacaagaaggccgctgcccgcaaggccaacaaggcctccgccgtctaaaccgaatgttcggagaagaccgaggttaggggagaatggagggtgacctgaggcatagtcatgagcgtctttggactattggcctcaggtagacgcggtgttacgtcaaaagtgcctcctgcgacacttcgggtgaccgacagtgaccccgtattccagtcatacatcggctacgtccctcatcaattcctcgcttgccggttgccagtcgaaccccaacgatcagcaagtcttggcttgcatttcatcgtacatatcaacataccaccggatctcgtgggacaaacgtgctggaaggacgggttctcgtcgagtgttcgcggctaggtggctgngttctatattctaatgctactgatacctacctgtttgaagcaaacaataatgattctttacatgactnttn

SEQ ID NO: 2216 - DNA, 564 bp, Fusarium venenatum
  misc_feature (1)...(564): n = A,T,C or G
ccgcgagctgacggcggctatatcactccttctagttatcttggatttggcccttaacagtcagtcctacaatacttccctaaaccgaagaattatacctacctctttatcatcccggattgtacaatacaatgactatagggcaatttcacaatgatcagaagtttgcactcttgactcanatatggccaggaatgctgcgcgcggattttgacacatacggccacctttacnaaaaatactatctgtatcttgacgatcagttctcatcggtccaacagaaaccaactttatacactgcacgtactgttggagatctcggcgatttgattcatcgtattcaagggccaaataatatggcaaaggccgatattacagcccatcaatcccaggcatnatataacaccatcgacatagccgntcgcatgtggttgacgattcatgttcaacactcaaaccccattcgcctgaatgctttcactggcctgaaaacgaaattctatcagacgccctcgatgaatgggtnaatcaaaatattttatcgaagcgacatctagttgacgg

SEQ ID NO: 2217 - DNA, 548 bp, Fusarium venenatum
  misc_feature (1)...(548): n = A,T,C or G
ncgggacctctgcgggtgctatccaagaaagaaaacccgctctaatgccccggctgcggnccgtggtcatgacgttctgctcttgagctcgtgggggctacgacgtttgggggtctcgactattngcgctgctgcgaaagaaggaaagccatcaaagaaccaaaaacaagcccgaatcaagaaggncttttacaagcctgtcgacggcttggataanggcaagattcactggatcaccggcgatttcttcaagcaaagaatngtccaaaaagtggtcggtgatgacggcaagttttgatctcatctaccatatacgttcctntgcgcgcttgnccccaacccaagaacaaaatgggncaagcgcatganaaaactgntttccatgatggccgnttattttgcttgagtttccttttgncgaaaccatgttcgccaacgngccccttggggngtttttcggagctttncaaaaccttttgnagctccggcgnaaaaattggttcaacgaccacgngcccgncccagggatccttgttaaacttggccgc

SEQ ID NO: 2218 - DNA, 627 bp, Fusarium venenatum
  misc_feature (1)...(627): n = A,T,C or G
ccttgttttacacgacttcgcttgacacttgtttcaagaacatcaaccacaccgnggttttatatcattttctgttgatctaagacgttgagatgattacaaatactaatattcccaacaattgaaagtacacgaaatctatctagtttattcatactggctcttacaccagtttatcccatccgtcctcccaataaccaacagtacaagacagaacacccaaccaacgccaaattataaaacccataacaattctgtcaaacgtcgagcttctccctctntggcgacgcactcccgttactaccctnagtacttgtatatgtaggacttgccatatctntgtgttcatacgaactatacatcaaagacttttgccgcaactacatntnttcaacagctcttcacaccgctcaagtcttgccaggagttcttttgtaggtttgcgacaactgcgcttgggagccggtgtacttggaatacattgtattcccgcctgttaaagggtagttactaagtcaagtggtatgctagtagtatgtatgtcctttggcaaaangaacacnggcttttgcgacgcactttttnttgngttggtgaaaaaaacacaaactaaaacttggggggggn

SEQ ID NO: 2219 - DNA, 597 bp, Fusarium venenatum
  misc_feature (1)...(597): n = A,T,C or G
gtttttaatctatgacaagcgttttgcttcttacctatcaaagctccccgtctatgtgtccccagtcaaatacacctattcattgcatggctttgatccaaaatgcaggccaatggcctcggtttccagcgtcatcccaggttacttccagttcctttactgcaagatcttccactagggacgtcttttcttcatgatctctcatgatttcgttgacgagcgtccaacttgcgtcaaacaacattcgttgcgttgcaagtgttttgcgcacctggatagccaacgcttcaccagtttcgatggggcttctagccttgcattcccactcgttcagcacaagctcacactgtgagccatgaaaagcaccgtgagcccccctacgcatgtgaatatcgtcaagtaggttggccagttgagcctctaaggtgacaatgagacgacctacatatacgagattgtcgacagcctcggcgaagtatggtgaaattgtctccatgntgcgggtatacctttggggaaganatcgtcaataacgtctacaccttaatccagctctcaggtacttctgaaggaagaagaagaaaggctccaaatgga

SEQ ID NO: 2220 - DNA, 239 bp, Fusarium venenatum
  misc_feature (1)...(239): n = A,T,C or G
naacacgacctnaagcgcatcctgcncacctgcctnctggcttnaacnaaatcctnnggctgcatttggccctgatgcaaagcntgatcccacgctccaagctgntaacctggctggngcattcngcgtttttgcaatactggaaacccacaaanactataccttcgagagggtgcataaaggttgacggtntcgncgagctaaaangaaagacggctgttatggccgacctagttgca

SEQ ID NO: 2221 - DNA, 612 bp, Fusarium venenatum
  misc_feature (1)...(612): n = A,T,C or G
gcgtgcataaaacaagcacaatcaattgaatcaactcagtttgcatataagattaaacaatattcatcatgtcattttggatcgagacagaagattggcatacagccggcgaaccttttcgcatcgtccaaacccttcccaaagaccacctcccgatcggtgcaacagtcaaagaccgtcgcctcaatgtgatcaacactcccaaccatcctcttgatcggctccgccaatctctatgccatgaaccgcgtgggcacgctgatatgtacggcggctttattacagaaccagacgacgccggcgctgactttggagtcctgttttggcacaaagatggcttttccactgcgtgcgggcacggcactatagctctaggttactgggccattactaagaaattgggccaagtgccagaaaatgggactgtcgatgttgtgatcgatgtgccttcaggacgagtagtagccaagatcactcttgaacagggaagaccgattcatggggatttcatcaatgttaagagctatcagatcgccaaagacttgtcggtcaaccttncttcaanggatgtcgatntaaangtcaacttggcttttgggggacccgnttacc

SEQ ID NO: 2222 - DNA, 615 bp, Fusarium venenatum
  misc_feature (1)...(615): n = A,T,C or G
ctactaaaacaatcctattaatgcgagtttcggtgcagataactttattatatcttgccgatatattaaagcgacattgatagagtcctacgcctaacacactctacactcaagccgcatcctttctactcaacctaaattaaccccgccttcatcgagcttacagccggttccaacgacgaagctatcaccatgtctgaaaccgctttcgcccanacatttctctcatcgctcgagtcgcgacctattcgactatcagccgatcatgtcgaagaccctaaatccttcccagctcggccaccctatatcatccctcgcatgccaaagggcatgagcaagcctaacaacctcgcccctggttccgaacgaagcatcactgtctcactcaagtctcttcgcaacccttccctgagcatcaagcttacctcttaacccctcgatacctcgatcctggacatcaagaacaacatttagaaggagacgaggatacccgtcgccaagacgaagcttctgcacaacaagaagccttttnccgacagtaagatccttaaggagattttgggtgagacggatatgtctgtcgagttacggtcatggtcattggcggggctgttg

SEQ ID NO: 2223 - DNA, 626 bp, Fusarium venenatum
  misc_feature (1)...(626): n = A,T,C or G
agaggtctcactgcatgccagccttttgaccatcaatgatccatcgattctttactaacgagaagcgcgcatctgtgactattgtgcctggaccaatataacttttgaatccatcacttgaatcttacattgtctctcatcctcacgattacccaagacctgcttacatactctaatctcacttcaatgagaaaccatacacttcctcgccatgagtgagacaacaaagatcaagangggcaaagcgtcagccaaacgcaacagcgaagcacgccgtgaacaaaatcgtctcgccagccggaactaccgagagaagcggaaacagaaactagcgctgttgaatgagcttctcgagccaagtagcatagctagtgatgttatcgataatgctcaaatcaatccctctcagggactgaacggcccagtgacctgctgatacccagctgcaagaccaagcattgccaaagctcttcaacctgaatcggcatntatcaaccaaagcatgggaagttttgacgatactataccatataatgnaccacgtntgnggggagatttatctcaagaaagtgggttccgctnttttaccaaggnaaccctaacatnctaccatggccaacttgggn

SEQ ID NO: 2224 - DNA, 535 bp, Fusarium venenatum
  misc_feature (1)...(535): n = A,T,C or G
ntttttagagatatagaaattcgctgggcattaagtcacccgtccctccaagactngntcaatcgctgncgtgtctagtaccattcccttgtatgtgacgtctatagaagcataggataaatttggtgtaagtgtccattgccacgcagcagatgtaactctagcaccctgctatcaagatttgatatgagggattggcgatgcttttctgctccgctcttgtcgtggacttgatgggaaatcattctgattagaagtccatggcatgttgcaaatcccatatccatctcccgctgttgggtccacccaaagcgattcttgatgtcctcttggagtaacagcatctggatctcgaattctttttggcatctaacgtagtcgacaccaggttttctatcctcggcatgaaaaggtaagaaatccatattgacaaacttaatagatgtgatgtgtgtttgacagtatgacaacaggaccccgatgccatgggtgnncttcttaactaccgggaggacngggttaccccttacatcat

SEQ ID NO: 2225 - DNA, 616 bp, Fusarium venenatum
ctaactttgttggtcttcggcgctttgaagagaagcgatagaaggtagttgagagcactcatcatgttctctcgccgactggtaacccagagctgtaaagcgatcccccgtggattctcattaactcgagtacgtgctcaaagagctagtagctacagaaagttggccagcccgcctcccgtcttcgaagctcgagactcttttgaagccaaaaatggatctctcaccatttccagcgccgaccgctctatctacgtggtagagaaaaagaagaagggcggctggacaagtttagacgccatcctcctccgcgacagttgtacttgtgcagcatgcgttgacacagcctcgggtcaaaagacctttgccacaacatctataccatcggatattgccattgacaagattcgctcgacggaagaaggtatcagcatctcattcaagaatgacatgtacccagaccacgagatggtactgccctggctatcagtcgataaagcaatgggttacaaaagggtagagaagatgcctgctccaaggcatgaacttgtgtatcccaaagacaaggcggacgttttgggacaagggcattatccaggaacgtgttcgcaaaatt

SEQ ID NO: 2226 - DNA, 591 bp, Fusarium venenatum
  misc_feature (1)...(591): n = A,T,C or G
cgaggacacttctatgacatactcacctcataacgctgctaccatagaaatctacggtgacatacccatccggtgctattgcactacctcaagttcagtgggacggtttcatgtctcagtcagtcgctgagcccaaggcacactccataacctcaagcgcgtccggttcattcgagtcacagccttcctttaccagcggagctgcaatgcagccccagtccaacaaccaactgccccctatcaacggccaaaactgcaatggtctggttcccgctttacagtcgatgatcaactcgttaccaaactctgccgccgcgccaccatccccttgggtttcagagtcctctaaagctggttacaaggctccagaagtgttgggtgacgangaacgcaacgccatcttggacaacattcgcaatgcagacagcgancatgccattcccgaaggcttccgtcttccgggccttggatcattaaatcgatactgtcaacatacttcgggctatccaccaccatctacctttcctacaccngcctcatccacctaccaaatctcncccaactgttgctacatcctcattattggtgcct

SEQ ID NO: 2227 - DNA, 536 bp, Fusarium venenatum
  misc_feature (1)...(536): n = A,T,C or G
catggattagaggctctcgcaatgataggaatgaaacaccggcctccgctagtcgtcgacgcagaacaggtgatgctccggctgggcaggaacctgctcaacagactgagcagactcagcaaacagcagaagttactcaggcatcaaacggtggtgttctctcctccatgcggggcgctttacgatttggtcgaaggcgacaaccagaagagaatcctgaagctgtaacaccatcacaacttgaagcggcaaaccgcgcaccagccgccacataaacatgtgtatcacattttccattcttacataacgacacgaatctttttagcgatggtttcccctcattccttcctggcaaccacactgctgggcacaaccgtctggaatcttgacattataaaggaattgatttttgacgacacggcatttgatttacaccgcatgatatacacgtggagcgacagtaggtttatnagtgggagaaaagtgaggacgtataacgctcgatgagctatatataccccctgatgacgatggtg

SEQ ID NO: 2228 - DNA, 409 bp, Fusarium venenatum
  misc_feature (1)...(409): n = A,T,C or G
ggtgtgggatactcccgcgtcttttgtcgccccgcgctcaatacgcatactcatcgacatcgaaacctgcatcgcttttttttactgctaccccggtcacggtcatcgtctttttctagatcgtcgatttcccattcacctgacccattatcggtccatcccatttccatccccagcaacccatccaatncaacaactagattggctttttgnactttactttatctcgcaccggtcgccaggaccagcaaacaggcctgactttgacgatcttgaacgantaccgtttgngccccgccaccatccatnatntatacntaatttttggattcngtccccgtttggnagttaggaaactcncacctttanttttaccttaaaaanaaaattttttggtnaanaaaccaaa

SEQ ID NO: 2229 - DNA, 302 bp, Fusarium venenatum
attgtcagatgtctgtcacaccaagaaccttcagttaagatatcatctataggcttgacaagctcctacttggcagactttgcccagcaagctggtgatgtaaccgttggcgagctggtagagggtagccatggtctgacgctcgatttgccaaaggtgcagaacctggttagactcgttctgggtgtcctggcaacgagagacattgatgagaagctaggagcggaagctgtccaggttcttgctttcttggctcctcgtctccccgagggtgacggagaagatgaggaagaagaggagga

SEQ ID NO: 2230 - DNA, 581 bp, Fusarium venenatum
  misc_feature (1)...(581): n = A,T,C or G
cgctctcaaccccgcggcccgggcagcttcaatccgttatcaagctcgtctgcccagccttcgcagctttcaacaaaatcctcgagacctgctctacgccgagtcgaaacctcagacgacgaagacgagaccccccgaccatccataacaatacccaagtcgcgacaaccttcacaactgcagccctcgtcacccgcgacaccgatatactcacagttcacgacacacggaaactcaagtactgcaagcataggtcatcacancttttcgagaccagcgaacgcaaggtccgttactcaagggtcgccggcgacactggtcaagggccatgcgcgcaaacattcagctacacaaggcttctttgaacctaccctaccgncatgagcacttcgaatctatttcacatctcggaatgtctcaacaaaaattcatctaccactttcatgtccgcgggggcggctgctgctgtggctgcctctgcctttaatgttacttggccgcnancaaatggngggcangcgggtgtatgttcattaaaacattacgccagcgcttgganaagtcctttcttgngatctaac

SEQ ID NO: 2231 - DNA, 578 bp, Fusarium venenatum
  misc_feature (1)...(578): n = A,T,C or G
tttcgtttcattgatcccattccatttcatccgctgtatatgatttcataaattcgtacaaccaaagttgtcccatcatgaactaaaaaagcccatcacttgcaccaataacaacatgtctgtagttgcaagaggtatccattatccagcacacggttatccttctcaaaaatgaccttgaacaagtacgccaacaaacaaagcagacttaacggagatagcctcggggagggcggctatcgtaaaacgtctcgcgctccgtcacctcatcccagcgaagatggctgtgtcggctacggtcgcgctcataatcaaactggtattctctctcatattcaagctctcgtgcgcgctgctttcgaaaccgtcggatctcgtctgaaatgtcaaccaggcggaaaacatcatcatatttganataatccatgatatattaaaatccctggtccctcatattcgtatccagaactctcaatancctccccgaaaacaagtccttaatgatctcngccacatatccctgggtggtggaagaacaggtcaaaaaacnatcaaatctctcatgttnaattccacct

SEQ ID NO: 2232 - DNA, 824 bp, Fusarium venenatum
  misc_feature (1)...(824): n = A,T,C or G
caaatgtctcttctcggatgcaccgcggctctccagcttatggaagagctctacgagcaaaaggctgccgccgagactttcaactcttctcttgaacgtctgtctggtggtcttcgtctatggatgggtggccgctcctggcgagaagtgccggcgttcctcggaggtgcngagagaaggttgtaaaccggtgcctgaccatcaccaagagcatggtgggaatggattcagacactggatacggaagccttgacgaatgcgaagacgacggatgttagacgacaagcagcgatctcttttttgtattattattattatctcatttgtgagcgacacacacctggcggcatctttcatcaactcgatttgcatcatctcaagaggttgaatctaccgtctctgacttcttgtgagatgactttctgtatgaacatgggtacttgtttttcttagaaggggctgaaatcccgggttgctactatcatggagttatacttggtatcgggtaaaaggaaggtcaaacaaaatacaggcaaaagacagatagttcaagggcacctttgttaaangacacagcgacccaagttgnggcatagtgatttggcatcaaagaaatttcttatcatattcaatcctttaccctaaaatccccggaaataaaaccaaaaaacccgtcaaaaatggcnaggcttgngagcgttcntccncgggggacttccaaggtttccggaccggcggttttcaacaaggagtttgagttnttccnctaccattaacctggganaataccgggaacgnccccaacgccaagcgagggtttccct

SEQ ID NO: 2233 - DNA, 592 bp, Fusarium venenatum
  misc_feature (1)...(592): n = A,T,C or G
gccaagtaatctccttctcagagaatgggttggcgaaaagttccgcaatccagacagtgacaccgatagcgataccagtttggacagcctcgagccagccgctgcgctcgttcttgggctgcttaccacccttctgctgttgttgcttcgacttgttggccccatccttgccatcctgtgacgtggcttcctggtccatgcggaaagatgagaattgaccattctggccctggttctcctctagatcgatgattcgttcagtgacctggtacacgcagcgcatcaatcgtcctttgtctagaattgagaggttgccgttctgtcgtaacttttggaggagatcgcgggtctcggatggtgcgccaacaatctggagcttctcaaggatatctttcgccactggcttttgagcctctggaacctagatgtgaattcttcgagatgggcgaattcctctttgcttaannaatccaaccctccngcagaagtggcggcttcggtgcctcanatttgcctcctcgantccatcatctccttcttttgaattaggggcttactgccatgttcgttactctgtctgggtttgaccggg

SEQ ID NO: 2234 - DNA, 601 bp, Fusarium venenatum
  misc_feature (1)...(601): n = A,T,C or G
cttctccacaacttaatccatcattacataaattcactagcaaacaagctccactcatctacaagcatcaccgcagtccataagaattccatcaagaatcatcacagttcatcatgtcagaacccctcagcgtcgccgccatcctcggtggcatggcagaagcgcttcccacacattctcccaacgacgaatcatctgatctcgcatcctcttatgaagttatcgctctgctcattcactcctatctctccgctcttggcttcaagatccagggctttgacgaggacgaaaagctagctgaatgcgactcactcgcccctcgcctgccatcacaatggaactcgggcttcaaatcctacagctttgtgtattcgcacaagcagtcagccatgacctttagcattcgcgtggatcgcatgggcaagaaggttgaggttcgcggactggctgtggganacgataacattcgtcgtttcgaacgatcaatcagtgaagttgnggactctaagaagctcctattcgcatcaccatcaaggacaaccaaaaagaccgaagtgaccttggtgaaaagctccgcgctgngttcacatctganaaagct

SEQ ID NO: 2235 - DNA, 558 bp, Fusarium venenatum
  misc_feature (1)...(558): n = A,T,C or G
gcttttgtcgcctgacgactggtcgtctcgcatcatttgcattagggctacattgaccatcgacttggaactcgactggagccttttgatcgaccgccaacctacggtactcaacgtcttagcgttacggctgacttgacgttcgccgcttcgaccacctctgtttggacaagaaagacctacctcgagtgttcaagactgcacactgcgaatcgagtatcgcattgatttctttggcgcagattgtctttgtctaacgcaacattttctatcacttcgaaccccacgatcttgacctttccgcgggtcctctgttctgcgaccgcactgatttatccgtcagtcttactgaagccccgcgagaactttgctgcacgcccatcttccggcggttgcgcggccgtgtgcgccanatccacaactgtcgcttgactctgtcttgaaagnatgtcngcgacggagttatgtcacaactctctcagtgactctcctcagcagccgcanctcttcccgaacctaatcaccccgctgcaccttaatcacatctccgtcatccgc

SEQ ID NO: 2236 - DNA, 536 bp, Fusarium venenatum
  misc_feature (1)...(536): n = A,T,C or G
cggcacttgaatcgcagctctcacgtctccagcagagcgaggaccagcaggcagtcagcccggatattgaggccctgactgtcgaggagcttcgcttgaagtacacaaagctgcagcagggatttcgattcgatcaacatgggagttgcccgccattgaaaaggcgttcaagaagatgaaggaacttgctcatangaagcaatggacttcagcgctacagaagancgcatctcgatcttgattgcggagaagacaaggccgatcaaaaatacttcgctgcccgaaaggatgcggatacncgaaacaacgagatcagatcattgcgccccagaacagcnagactcggaaatcattgcccactcaaggatctcgaatcacaaaatcccacttctgggcatctanaaaaacagttgccgatctgaagccatcaaacgctctctgatgaccgagaaccagaaatggagcnacaatcttgatctgtcgccgtnccaattcctgaacaaccanttacgatcttcaaatttggtcaantccaa

SEQ ID NO: 2237 - DNA, 763 bp, Fusarium venenatum
  misc_feature (1)...(763): n = A,T,C or G
cctcaactcaagtcttgaacaaaacaacaagaaaagatcgtcaacgctcatcacggacccctagctttctatccccccatacacacattcccggtcgccacagcttctattatacggcacttgcaaaaaacctgtatcacgtcgatcacaaccgataccaggaaaaaaccatgactcggtctactttcacaacaatcacacccttgccttcaaacttaactcgccagcaagtggtcgactttctacacgatcatttagcaatgattgacttgaatcctctcatcatagaacgccaccaaatctctcctccctcacacgccccggatgatgagaagagatgtgtatggtattccatgacggatcgcattgactacctccctggtggtatcgcctccggtcaggtcacatacacggctgccttctttgactcttcggatggtctccagacacacagttacgctcccatggggcttgatctccgtggccgctggtctgtgggcggaactatgcccggagagcgtccgcaacctgttgagcttggtcctggggcaacggcttcgggtctttatctccgcgaagatgtttgacatgcgctgtaacatgctcatggtatcctttgttaaagaagactattaaaaagtctcatggaactctggtcgaaaaagttgtcgcaaanaactttcctnaagtctgcaaaaacactntatgcaaaactttgggaccaactcccccgggagctttttnaaacacccccccttccagc

SEQ ID NO: 2238 - DNA, 314 bp, Fusarium venenatum
  misc_feature (1)...(314): n = A,T,C or G
cgatgagggtttcggaaaggaggaccccacacgatacaaactgattgttgttgacgagaacgagaaggccaaggagcaacctctctcctcaattgaggttcctacttacaaggccttctattcccagctcgccaaggccattgagactggaaaggaagaggatgtacctgtcaaggctagcgaggcccgagatgttttgcagatcattgagggtgttttcgaaagtgctaagactggcaaggacgttctttttgctttgaagcctttagggcacttaagatataatgaatttaatgaacaataaaaagaaaaan

SEQ ID NO: 2239 - DNA, 690 bp, Fusarium venenatum
  misc_feature (1)...(690): n = A,T,C or G
gtcgatatgacaaaacttgatgtttcctgccatcagcttgtctgtggtcgtcatcgtaagaacatcaagctcatcgaatcttctactggaactgccatctacttcccacctccgttctctgctatgtaccgttactgtcctccaaatgcgacccgtcgcgatcccagcgatattttcatcaccggtgaaacccctcaggccatcgaactcgccaagcaaaaacttcacgagactgttcaacgcatcaggctttacgttaaggacgtaactatccctgctgctaagattgacagtattctccttggtcgcctggataaggttcgcaaaatcctggaagctaatggtacttttatcctgtttccttccttggccacccagcgcaacatggttcgtgtccaaggtagcgagggccttcatgtcgagcgaaccgtgcggganatcatgtcgctggctgggcaattctacagtgggggctggtacatacagcatgcaaatgctaggcagtttcctggtcctcgtgacatgcggagcatgctcgttgatatatgtgctaactctgacgccgacattttgttcgatanggcttaacttttgccatcactgggtttgaagacncaanaaaatcccctctccaagttttttcaaaaaagaaatttgtatcgcagnccaacaccaaatttgtgtnaagat

SEQ ID NO: 2240 - DNA, 964 bp, Fusarium venenatum
  misc_feature (1)...(964): n = A,T,C or G
ngtccggatnaccattaccgagttacatctacttatagtacctacctatctcttggtgctgttagactacggcccccccttgccaagtcaagcccttggaaaagaacctttcgtacctttcctttccttccctctcctctcctcacgtctcctctcctcacgtctcccctcctcacgtctcccctcatctcctcttccttcctcacaatgatgcgtgttcctcgacaagcattttccactgccgcccgtattcaccccaatattgttcctcatcttcgtccccagaagagaatgtcttttggaagattggccaagcccgtcgcggctattgtagctgttggctacggggcaaagctctctcttgacatggtggcgaaacgacgcattgctcagatggaagccacagagcgcgagaatgccgcctaccgagagcgaaatgaagccttgatgaacatgtatggcgatcgatcaagcctcgacgagctcgaaaaggctgtgcaattttacgaaaaacgataaatgagatccacgtcaaaacgaaaagaaagaaagaaacacaaaccaagccgagccgagccgagtaacccttgtcctacacttccttcgtttttatacatctgaagcgacggcgatcactcactcccatgggaatggaatatatcggggtttattggcacggataccaccacgatctgaaccctcgaaattgcatggaacagcgttaaaaggaataccatttgtttgccatgttgcttgaaagaaacccgattatccgacttgttgatttaaccccaacatttactctgcctgggcgtnttatnattcaacgaaacaacatcgacaatgaagtgtctacgaagtcgatcgatcccctgtgtcgaataacacctggtctggtctggtctggtctggtcttcttgatgaatggtgcccggtgtagtgaatttaatagattattacactg

SEQ ID NO: 2241 - DNA, 531 bp, Fusarium venenatum
  misc_feature (1)...(531): n = A,T,C or G
agacgatccttctccattggtcttggtaagaagcgcagtggcagtgttcaaggctcaggcgacaagcagaaccgtcgattttctttggccaaggctatgggtctaggtagaaacgagggaagcgtgacggggtctgaagcggattcacagcaggatctgcccattcagcatccccgaactgagcaactccgcggctacagcgctcacgatgagccccgacacagcgagccctatttcgatgcaccctacgaacaatacccccaacgtgatacagcacaatccagccctgtgtacaatacacgatatggatctcagcaaccagatggccgaagacctaatgccgtacccacttatatgcagggaggtagccatttaaatactggttcagattcatcagtggacatgcgacgaccgnacgactcacgatcttgccgtaccaagaagactttccggtcttgaagatccatggtcgccagttngaatagccgcgaggccgtctgnntgcttacaaantacaagaagtcgcggttc

SEQ ID NO: 2242 - DNA, 295 bp, Fusarium venenatum
  misc_feature (1)...(295): n = A,T,C or G
nctgggcttgctccnggattngaaaaggggggaaactccaacggcatgcccgcganaatgaaccgacgaggtcatcacttaccaagctagtttggggggcatgggaaanaggattcggcctggccatccaaggaggcctgaacgggggatggttgaggaggaggtgccaacnaaggacgctnggcattttatgtttcatcaaagcnaaatggacnaaaanacttgttaaacgtggaatggaccccgttanggngttcccttgaagcngggttggcaacttattntttgttttttn

SEQ ID NO: 2243 - DNA, 576 bp, Fusarium venenatum
  misc_feature (1)...(576): n = A,T,C or G
gaaccaccaaagccaacatcaccaccacctgactttccatcttcgcctgcacgaagcacaagtcggcgctgcaccaaacaagtaccgagtgcgcatagtcttcccgtcttcgatctctggcctgcaacaatggnctctcttatgctcagcgtcttcgttgtcgaagttatcgtcnacctantcaacacattggagccccgcgatcaataacctgctctggacattgatcaacttctcccatctcgacntcaaagggtgccggcgaaacagcgcaagcttcaggccgattacctcaaggtccgacnanacctaaatggcacgagctcccaggatgaatttgccaggtgggcaaagctgcgtcgccagcacgataagcttctcgatcnactagagaagaccaagaaaaccaccgaggctgcacgatccaactttganagantcctcaccgtcgtccgtatcgtcgttactcgcgcgccgcaatacttcctacccttttggtacgccactgancctatgttctggctgcctcacngntggtttccttactggggggaatggatctgtctttccctcgtg

SEQ ID NO: 2244 - DNA, 125 bp, Fusarium venenatum
  misc_feature (1)...(125): n = A,T,C or G
ncaaanaacacgatnntcttgttcntcncgcgtgggtcaaaanggtgtttgantatngactgagaccaacaaacctggtgtgtcgtatgagtnaaaacnattnacatgtttgctnctaacttntg

SEQ ID NO: 2245 - DNA, 384 bp, Fusarium venenatum
  misc_feature (1)...(384): n = A,T,C or G
ctcgagtattcgacgactttgtcgagtattgtttgttacgcgaacgctcttttgtctcacttgcgcgctctgcgctgattgatanctgcgctttgttcgtgagcctcttttgacgtcgttatcgcagccgttgcacaacgcgatccgcgtctacgcatacagctccatcacccgaccaangtgatacaacagccactccgggaacgagccataccaatgaacaaacgatcttcggggagcatttccgaggctcctgggcangctgttcctcgaccctccctcagggcattcctccgnccagactcctcaatctcaaggctcggcattgccacangccaagccctgcctatcaccagtgcagacacaaatggcacccaaagacca

SEQ ID NO: 2246 - DNA, 593 bp, Fusarium venenatum
  misc_feature (1)...(593): n = A,T,C or G
tttccatccatctaatcacttctcccattgattgaattcttgctggatccgccatctatatagcattgttgctgccgagggcacccggatgcccgagcccgtgcagagacaagacgagccacacaccaccgatacctaccgatatctcgcccgccgttccgctccgacctccgatctgtgtctaattgtctctgcactcaactattcggtgccccaagtctgaatggaccctgcggctgtccgcgaaaggccgtgtttcgaccgcgcctctaaataaagctctaactttggtcatacaaaacatccacatacggacctcgcaaaccgatactcgctcggtgctcggtctgagcctcaatcactctntttccggggagcgggaggaagcaatgactactggagcaaattgggtcaccaagatgtacaggcatcaatacaattgtatactggtggtcanttcaactctgnataagatgttaccgcnttgaggacacccatgcgaacgacgtntactggaagngcgcgtctgaggcaaatnccttcaacgttataacntccaacgaatncgcagtttcangttttaactcncgttn

SEQ ID NO: 2247 - DNA, 1025 bp, Fusarium venenatum
  misc_feature (1)...(1025): n = A,T,C or G
cccgatcctttcataagttacgctatcgctagcctttagttcgatctcagaaaccataaatcctatccaacttcccacctactaagcagtgcatatttctaaacctccaaggctcccatacattgttctttgactttatatcataccacattaccacaaccaacctacttcttgaaacttggctgtctcaactcaaggataaccttaaccagtatcatgcctcaatctccgtttcccttgcctcctgtgttatctcagtatgatcaagaacatgtcacagtcttgatagaaactggatcatactcttcaacagaaacacataacttatgctctacgcacacaaccttggaactgtcaccagttctgtccttcggcttcaggtcccagaaagtacctggaactcgctgtcccacctgcgctctagcaggtaaagaagtatgggtgattccaggccgtgcctgtggctattgcggaactccctgtgttgattaagaatagcaaaacagtcaaatgacttatataacatttctagctgatgcgctcagcaacccggacgtgcaaatttgttcaacgtctgccgccagtacctacaggacttgaagatcccaagtcagtcaaaaaccatggagcataataagagtaaccgggttggcaaaactttgctcgttagaaggacgagctacgccaagatgaaaatggtgatggtcgcaacagagcgttggtaagcttacaatatggagttgacggcttcatgcgatctgatggcacaaacaaacttatctctgcactctcggtatttgagagtagatgacacaaaaaggtaatgngctcttttaccaatggatctatcgtcccgtgagaatccgccatgcgtctgcgactcattgggttcaaacntaccaaacacgagtcaagtcaatttacaaagtccgnggcttgagcttatatatgactgggaggatnggggcgtttgcccccgtttactaagggcgaaggttccaacatgtttgggggatgtanttggn

SEQ ID NO: 2248 - DNA, 585 bp, Fusarium venenatum
  misc_feature (1)...(585): n = A,T,C or G
caatattctacctatggaactcagacattctgcaccaacgagcctgcccaccctggcgagcaacccgactgcagaggccactcggacatgattcacgcttgttccgaggcactcaagtacaagcacgccaaggatgtttgtaccccatcagtgatgtcaacgttcctcaaccgcatcaccatcacatggccattctttggtctggttgacttttgggctcagtttgccttccttggtgtgttcctcgttgtcttcattacagcccctttccgcacacccaagctcgacctttctcaaattgatgaggaagccgaggcagatgaggaagaaagccttctcgcgtctactggtagacgctttggtgctacatggcaggacgtcagaggaaaggttagctcangaaatgactctacgaataacggtaacggatcgcaatccgctgcttgattggtttcacgtataaaatagtcaagtttttcagaatgatggangtattggttaacgcaacaacattgatggtttggagttggtaattggcatgtttgggtatntgnctttacgccatgttttgagaaagaatacttt

SEQ ID NO: 2249 - DNA, 591 bp, Fusarium venenatum
  misc_feature (1)...(591): n = A,T,C or G
atcagcaacaccatcggtcgtatccgcgccaactgaaccccagactaatggccagccgcgagctgcggctcgtcgccgcttctccatgaaccgttcatctgccacaactcgttccaactctcctccctcacccagcgataacggcctcgagatgaatcttacacaccgagaacgtgacggtgacaagtctgttcctagccagggcgattttaaaaagaaccgcgcctccactggatttaccttgcgcaaccgagccatcaatttcgttggtgcgaatcacaacggtcgaggaaatggcaataagcgccctgaatacaaccgccgagctagtagctatgacggcagccgccctaatacacctcttccaccacccgcagaaggcgacgagactatgtatccacctgagcggagtggttgggcctcttcctncaaagtccggaactggtgccaaggctcgccgatgagtttgaatcttcctgaaaaattttgccgtggatgtggctgagcttgcaaaacgagttcaaatccacgcaggttttggggtcggatggaagcatnttgnaagggaccggtcaaggtacactatgatgc

SEQ ID NO: 2250 - DNA, 441 bp, Fusarium venenatum
  misc_feature (1)...(441): n = A,T,C or G
nngcatgaccaccccatacaagcagcacaagcttgagttcctacaccgagggccaaacccaccacccacggacccaatntgggacgagaccctgacgtgggagtacgangacnacgagctgntntttttgcgcatgctcattaagagcgatgatagttgggcncgaaaccccatgtttgctgtggcagcattgccactactttatgttcagccaggctggagttttattcgcatgctggatctcaagggccntgagacacaatgnnccatcctngntaactttgagattattgatgctnagaaggcggnttctnatgagtatacnaattatctatggtnttggcctttggngtttaanagattntgancttgccnccgtcagaaaaanatggaaaccccctggcnagngcacgtttggttgnaaaaanttcctgcggccga

SEQ ID NO: 2251 - DNA, 631 bp, Fusarium venenatum
  misc_feature (1)...(631): n = A,T,C or G
naagcacttgccttgcttataatgaggtgttgcttcccaatacacacggggaggttgctccttcccatcgctatgagcctgtagctgaacatgggctgttgagaagattgaactggaaggagctccttccttcatgaactacacgattaagaccccatctcctttgtccttgtccctccgtctcccctcgggctcatccctgagcatctccggtcgaacaaaacaatatccctcatcgacatcacctcgcatgatccaaagcccccatggccccattccagtgggcgccttgctcctacatttcacgatggcgtaaagagaagcccccacgacatagcatcccgactcctgtcagccgagttgccgaggacctgtttcaacatcccacgccttgatcacaaaccgatcagaagctcgaatacgtcctggagataatattacggaccgattcgacactgggccaaggaanggcttggttcaaccgtgaggggatgctgcctaaggtgttggagtcctgccgaacgtgatgactgactgggtgtgatgatgatgtanttaccaagaatttgtgagtaccacggcagaagatgatganatgcttgatcaagtacgantgcttcnacanatacaa

SEQ ID NO: 2252 - DNA, 461 bp, Fusarium venenatum
  misc_feature (1)...(461): n = A,T,C or G
ccgncttcaaagagcatcactggaggcagggctgcggctggcatcgatgaccaacccacctcctcatcgctacgctcaagtcttcggcttctgtttacttttcgagcccaaagagtcaataattaatcgtatgtccaccacgttgtctaggattagccaggaatcgctctttgtgtggaggtatcctttcacaaaccttggcggngctggcacattctttcctgatggtgaaggtgctggtggctattnggcagcaggtcctgacggtccaggctgcatttgggtaaccagggtttggttcagtctatgaagccccaaaagatgactggtttttcaatggggcccgtttggcccggatntanaaactacgaagaaannctattgactaacncatccnaatgatgttaanggattttgagggaatttttcgccnttatnaggctganacgttttacnccaaa

SEQ ID NO: 2253 - DNA, 603 bp, Fusarium venenatum
  misc_feature (1)...(603): n = A,T,C or G
tttttttttttttttatttcaatatatatcttgtttagaaaccatctatccttgttcctatactcttttcgcttgcgaccccgatcagatgtgtccccaccaccaaatccatcagtcctagcccgacactcttgtacactacggtgccgtctcgtaaccactgacaaagatgatcttcagacttcctcttttctttgtccaaagagctgctggagctctttctcgagtggaagaacgagctggacctcctcccttcggagtcaacagagcccgtagggcttgttggcgtttcgctagtattacttccactaccatagacggntgacatagagctcctgccgngtacatccatcttatccatgtctgaagtcaaagacgtctggctgntggtaaatccatcagactcttntatagccagacgatgaagcatcaccagttctcctagctcgaccatctgatgagggccaatattagccgctatgatttcccccgcatctttgagtactcctctgatattatcaacaacgattactccgccttcaatggcattgcttatggaaatggcgatgngggcttggccgccctnttggctgccaagtgtat

SEQ ID NO: 2254 - DNA, 365 bp, Fusarium venenatum
  misc_feature (1)...(365): n = A,T,C or G
gctcactggattgggtcctcgtntcgtcatgacntgcggtcttgtgggggctcaattcgtcatgtacgcgcaatgcaaggcgntgacaggagctccacctgntattgagattcacaaagaagagtcactgngagatgtnatgtaacgactaaaaagtaaatatcnatntggaaacggngttgaggtgatagacaggaggatataagatctttaaagcgagttccggtattagattaattgaaacttnatattntgctacnaaaaatggctntgcattngacccaaatgcaaaaggttctttaaagagaatcgnatgangaataataatttcntgcggccgntcgagcatgcntttaangggccca

SEQ ID NO: 2255 - DNA, 148 bp, Fusarium venenatum
  misc_feature (1)...(148): n = A,T,C or G
ncttaaaaaactttgncgtaatntggaaaaagncccccactttnattnttctaagngcttggccttctttggacntgngactatnggggnggantgtttaaaaaananttctttttacagcctgttagaggggtatccatnccntttt

SEQ ID NO: 2256 - DNA, 568 bp, Fusarium venenatum
  misc_feature (1)...(568): n = A,T,C or G
ggaattcagacccctttcacaacttgacattgatttaaggaaggcggctgaatttacaacaaccaagagtttattctctaccacgcgaaaacgaaaaacaatcacacaactcctactgacctgatcgaccaccttatagactgctcacgacagcccctgttctcgacaactcattcccctactccgacaacctcatacccgccatgtccgaagcctacgaacgagagcgccagaacaatgcgcgcctcgacgaactctccgccaaagtctctgtctccgtggggtgacagtcgacatttacgataacgcccgagcccaagatgtcattgacaacacctccgatactttctcctctatgaccacacagatgaagggctctgccggcggttggactcgtatgggccgcatttggtaaccgggttgcgatcctcaagtggcaggaatcgnaattggcatctcttagtgctggtctacngngcaaaactgattttntaaaattgggagcgcagcgtctgntaatttgggaangcatatgattagagcggaatgggtgcctgcatttttcttt

SEQ ID NO: 2257 - DNA, 223 bp, Fusarium venenatum
  misc_feature (1)...(223): n = A,T,C or G
ntgaagctgttcacatcanggttcataattgccacgganacacccnctnccaatacantcaggntgtccganncattctgttacttcatntgggccaaatttactgnctgtaatntcatggaggcnnttggataacatgccaggacgatggctaacactgntcaaagctgacactaatccccntnacaactactgggcttaaaacngatnattcattgcaacg

SEQ ID NO: 2258 - DNA, 568 bp, Fusarium venenatum
  misc_feature (1)...(568): n = A,T,C or G
atgctatactagtagaaagacgccgcgcctactccagatgccgatgaaagtagcccaagacnagcctgcaaagcccactcgccgtggccgtgccagacctgctgtcaagtatgangnaggccgatcccaacgaaattcgtcgacgacgaagccncagggaagaaggaagaagaaagatgaagcccgaaggaagaaggangttgaaggaaagcggaagaaagagaatgaggagaagccnccagtccgtcggcatattgttactctcaaactccccagtggctactttgctgagttcacgcctgagatggaaattgtcgacaatggtgattcccgtccaactaccgcctgctctgangaatcttctcaaactgccgagtcgtcttactccttccggcctaaacggcagaagaatttccgcgacaaccctgatggangtgaagactcaagccaagcgccgcccatgaaganantcaaacgaacaagcggcggtacngctgtcaccgaaactccatctgctgcatccncacctgcccatctactgagccggccaagtcctcagcaaccgcaa

SEQ ID NO: 2259 - DNA, 647 bp, Fusarium venenatum
tggaatttttttttttttattttcaaagtaaaaatcgcgaaagcgtcatatgtgaactatgggtggttgctaaacttcagcccactcttgtccttctttctacactgggcgtgaggtgagaactgactgatccaacccagaactctcgccacccattccctacaacatgtgcttgcacatgtaaccagctttaaatacgttcaaacatgtcgatttaaggatatccttccttgccccacttgttgtacttgtcgtgaagctcggcaggaagggtgacgttgggaacaacgacaacgttgagggcgctgggagcgtccttgggagcctggttggggtcaccaccggggtggtactggtacttgccagagctgccgctctcccagggatggctggcaatggtgacgggagactcggaggtagcgccagtgggcgatcggccaaagtagaagccagcaccgccaagagcagcaaccataacaccaccgagaatcagaatctcggggttgcgctgggactccttcttgagctcattcttctggtgctcctggaaacggcgagcagtggtggagaggaaacgacgagagacgatgcgagaggccattgtgacgacgggcttttgcggctgtggttggagaatgggtttctac

SEQ ID NO: 2260 - DNA, 213 bp, Fusarium venenatum
  misc_feature (1)...(213): n = A,T,C or G
nttggtgccgacantnaggagttgatgcncaacacngccgaggttggacgaattatcngatattgagacggcagaagacctgtaggagattcctgacaagctcaagtcggaataggnaaacgaaacacatgaggagagaaatacggtggagcagcaaaaaccatatatcatgacatacataaaagcgtgnggttgnataagnctgcatactca

SEQ ID NO: 2261 - DNA, 601 bp, Fusarium venenatum
  misc_feature (1)...(601): n = A,T,C or G
cttgagcaatcatcaactttctcttcctcttcccttttgccccatctctgtcataatctcttcctctccctcccgatcctcaattccaacttcattgtcgcagcccacttgagcttgtgtgcagtgaattgattcaaaaaaggaatacgccgacactcgccagctcattccatcttaccctttctccgttcctcatcaaatcttcataattcgaaatgtctgcaagtcgattctcgaggccgacggnaaggccatcctnaactaccatctcacccgcgcccccgttatcaaggncagccttttctgcgctacactnaaaccccccaagcaactcgctcntgcacttcctgaanatccaacgtgccgatatctgaacaagctgaggcacctaccttgggttctcagcccgacccaagttcgtcgntaacccgatcagtnatnagcgacgaggaaanagcggctttggccctaanaatctggctgagntaaggntgggttntgaccaacccgnaagacacangtgacataccatggngtttgaggaattcttgggagcctttggccccatcccanaatgngtctnttaacatcactcngccgg

SEQ ID NO: 2262 - DNA, 608 bp, Fusarium venenatum
  misc_feature (1)...(608): n = A,T,C or G
gtcgcattcaatacaagttgttgctcatcaagcgcattccctgcagatctttaaaaacagcaattgaacatacaataattctacacagtcgtcagataggccagcgacgcctctgagcccaccaaaatgcacgaaatctttcttacagccctcatcgaggacaaagacttcgccggagcatgttccgtcctgggcggcctcactaacatggacccctgggagtccatccaacgagttctatacttccaaggaccaccgcgaccaatgggcatcttcaaccagagctcgattaagaaacctataagccctcccaacacgggctttctgtggaaagagcttcatcagaacttgacgcggcagtcctttatcctcagacacgctacgatgtgctcaaggatcgcgacatgggacctaatgcgccggcgatggaccttgatgcnacacanggaatcttgaagtggactgactttccggatccgccgggggggcaacctttgcttaccaggggaacaagggtgagctttgggagcaaaaaatgttgctttaattatgcgcgaaaaccaccacccgttcaaaantgaaactnttgggggaaatgtcccgctttt

SEQ ID NO: 2263 - DNA, 575 bp, Fusarium venenatum
  misc_feature (1)...(575): n = A,T,C or G
agcgactggtcacgaanagagcgttttgtcaagtgaacagtctgtcctttacatcctcttggagtgcaccctttcgtcattgccattgccatcactgcctgactcatcacctttgacaaggcaacgacaatcaagcctagtccctgactcacacttacttgatcgagtcttgtgattctcgtggtggaacgtcgctgcctgcactttatgcaactctaatactaacggccatccccataatatctcatctgttcccactggatatctgatattggagaacatcatcaacaacatccacaactgcctctttcacacatcacacaacacccacccnaaatggactaccaacaaagcttgcctatcgataagtttcaacactcgcccgccgagtctctcatgtcnattccagggganagcttcacatcgctgttcgacgtcacaccccagtgccacttcacaatgaaccccatggagatgataaccctnagtcttccagacaacaaatccttcatcccttcctcagatcagccagaagaagaaatgtntacgccatcatcatctcctgcccctgagaa

SEQ ID NO: 2264 - DNA, 436 bp, Fusarium venenatum
  misc_feature (1)...(436): n = A,T,C or G
caaccaggaccccctcctgcaggacctcctccgatggctggtcccccgatggacccccctcctcagcaatccgtgtatgactatgaggaaactgttattcgagacgtttcgccatcccgaaccatgacttcaatgtcgagctacgactcttatacaggggatagttatcatcaccaccaccagcctggaagaagcttgtcgttcgaactcgctcaaaatcccgaacccganaaactttcnaagggagattaagggatttgnagcgtgagcttgccaccgacctngaggccgttccaccgcggcgaacctcgttcgcgcttaagcgcttgcccgatggccaattggtcattaagggnaagaacgtggttgaaaaaggaagtttgcacccgaaaacttcttggattgaaaaaggacaagaaaaggtcttccctaaact

SEQ ID NO: 2265 - DNA, 153 bp, Fusarium venenatum
  misc_feature (1)...(153): n = A,T,C or G
ngggcgcngagtacaaccacagtgaacaactctggatttgnaatctcgaggangatccgcttgtntacgataaccatgaaatggttcgcttctaggttatcgatgangagtggcacgancaagccccacaggaccaacccaaccagaggattc

SEQ ID NO: 2266 - DNA, 918 bp, Fusarium venenatum
  misc_feature (1)...(918): n = A,T,C or G
atcatttcctctgttttggctagaggcgggctgatcctacactgtctcgtcatcgaggttgtgttccagctcaaatggcggcaacctcctttgcgactgctcaaccactcatcaacgactntttgtattgtgaccatcacacttacgtcaatggccgtggtgatctaaaatctaagccacgttcacttgcctntttgcgtagtaacggacacttcttacctcgactaacagattctcaaaggcatcactacgtacaagcctcagtcgatgcacctcaccttcctagagctagcagtcagcaggcgaagcaaagactcaagctttgcggggtagatcgtcccagtgatactttcatgggcagtatataaacaccccatcatcgaactccttgtcatcaactttcccagatacctacataccaacaacttcaaactactcgataccccttaccatatacccctttaccaaaaacctacagcttgattaaaccggcatcagatccaaaccaaagaacaatggaaggacaacccatcaacaaccaagaaaccaccacacagcctntgaacgaaacccccgtggtggctctcntctnaanaccgccggcaagtgatgctggataccaccgaagaatgagtgatgagtgggatgcctcaaaggtccctcccagtcgtttccagaagcgcangggatccatntatgctacgcccggttctcgtgacggccacgttgacaggaattacgcanacaagtattggagcaagatgaccganaagaattggggtagtaaataaactccaaccattgcaacaaataaatttcggacggnggtcctttgtaagaagacagagaaacgggaactaagggaataattcgtcgngggtaaacgagctacatatatgacttggcgcaattgaattc

SEQ ID NO: 2267 - DNA, 584 bp, Fusarium venenatum
  misc_feature (1)...(584): n = A,T,C or G
aggtggaaagaagaacttcttataggaacccatgaaagaccgcgactgcaattccatgggcgggcgcgactccgggccaacagaattctgtcggtttgccaagtcctcagagtcaagcaagtccacaggcaatgccaaaccaacagacacccccgcgagcagcaccacagagaccgccaggtattgcaccgttcaccaaacactcaccctactttcgacccagacagaccaacattaccgttatcgatgatatgccggcagctttcagctcgttggatgangcccatggctactggactttactacagangtttatggttcagtacattcctcttctgactgcgacaacggcgcagctcgctttgccaaaggtcaaagacagggatgaacttttagccaagttgtccagtgtgcgacaaacccacgaatcgccaaattcttggaggattcaagatcatggctccatcgatggtcaacctcgtttagccctttgctccaatctgtgtcggataatcgacagancgactcacagtcttacctaaacgccatcaatttgcacattgagttcctcatcctctatgttt

SEQ ID NO: 2268 - DNA, 507 bp, Fusarium venenatum
  misc_feature (1)...(507): n = A,T,C or G
ggnaccgacactgtctctattgttggaattgaggattatgcgcgcgccgttatcaactcgctgccgagtacaacaggtcaggacattaagtgccagccagctgttggacgggatctaacggactgccaatacgactcttcctctctgactcccaacttgtataaggacaagtcacccaagcagctagtctcgatcgagacggttcacggcagcgatgaatngaaagcacgaattcgaatcgacgcggtagattctagactttgctacgttcgcacatctcgacccgtttacggatttgctgttgatggcgcgagtgcgcgagatcctcgttttggaaaatttccttcggagggtttnagtagcgttcaactctggcgacgtgatcgcgatcgaccctggaccttgaattctactttgaatgagcgtaatgcattgggccgnggcagaattaagaacngagaaaaaaacgaggtgcttggagacnagnactgaaggctnnaagaggta

SEQ ID NO: 2269 - DNA, 454 bp, Fusarium venenatum
  misc_feature (1)...(454): n = A,T,C or G
gacgctcttcagcctcatccgcaaggccgggtggactggcagccggggccactggaaggacttggatctcaaggttacgcgttaccagggcaagaagactactctggagtatgatgactacaagaagtggcgggacactgttgaggcgtgagctggcggtttaacagatgctgcttccanacatagaggccctggcgtttacggtgacacaagggtaaatctcttgatgatgacgatgatttttttttctacttctcttctcttttattctacatttacaaggtagagttgggtttgtcaacaccctcatctaacagtcagctacagacaataaatctcattcatggttaacctgaactnaaaaaaaaaaaanaaaaaattcctgcggccgngaattcttcnngtaacgacttctnttgatgactncttaccatttcctttgtcaagcgtngat

SEQ ID NO: 2270 - DNA, 112 bp, Fusarium venenatum
  misc_feature (1)...(112): n = A,T,C or G
ntnctgatgcatcnactggtcaaggccngacggccaaggtcgcancgantccacctncccctgcgggtgcatggangncatcccattgngaanacatgggnanaacttacgt

SEQ ID NO: 2271 - DNA, 529 bp, Fusarium venenatum
  misc_feature (1)...(529): n = A,T,C or G
cgaaatatccagtgatgcagtcaactctgtgtcttccggttccgtctcgaaancctcttacgaatttcttcggtgtcagtccaagaagggctttcgcgtgcgcaaaccatggccgagaacacaataactacttcagctatacgctgtcacgctcgatcgttgaatactgcgatacggaaacaacctttagcattgactacggcatgcgaaaagacaagtcacaactttgggagccgtcgctcttcgacagagacctgttacccgaaagctccacatcgaaaccaacctttgacatcacaaaactatttcagtacgagccgaaatgcgcgcggtttctggagtggacggaagtcganctcgagttatatgccaacctggaacagccttttcaagttggcagggaagaaagataacaagntctgaagccagacaactaccgaatcatgacaatttagtgacactcgtctatttcacaatcggcgaacacttgcagccaaggcgnatctgagctcactacccgcacggaatt

SEQ ID NO: 2272 - DNA, 559 bp, Fusarium venenatum
  misc_feature (1)...(559): n = A,T,C or G
gtcgaggaagagcgaattcagcaaagcacccaaggttccgagattgaggatggccaggttttgagcggccacactgccaccaacaatacaaccaacaccgatcagaatggcgattccaagtccactcgcgtcggcaagttcgtaccaggtggtgctggcggtgttcagaagaagggtaacttcttctccaagtggctcaagccctggatctacgccgattacgccaccatgcgccagctcgtgccccatgagagcaacatgggactcgactacagtgaggaggttgagagagacgcttacttncaccctcaatcacaangcgagactcccatcttgtggatcccgctgccctgctggcattctccaagcaggaggtgcttcacacgagcaaggtgatcccatctcaacganggttgccactgacgacaagacaacatcgagtgggacacttgngggagcacgacctcttntctggaccgggagattactcttaaagngatgatttttttntgtgataccaacataaaccggctttaagttnnttgtttganaagatcaa

SEQ ID NO: 2273 - DNA, 129 bp, Fusarium venenatum
  misc_feature (1)...(129): n = A,T,C or G
ntaattngagtgcgctnggcgttgctggcaactaattatngactaccattgattgctntttgatatagaacatgctgnacaatagattcaaggaatgaaacagcttgacgatgatgacaatgatagaca

SEQ ID NO: 2274 - DNA, 379 bp, Fusarium venenatum
  misc_feature (1)...(379): n = A,T,C or G
cgagaggtctgcaactccaaacgagaatatgccccagcaccgatcagcactgtcgctgcagcacggcccgcccttcagcggtcaatgagctcagctatgcgtacaatgacaactncttttcaccgaccaacctccagcaactnttcgatttttaaacacaacaatatggccagcgcctcgacacattccgacaacgcctccgtctggtccggctcgcaccagaccgagaaatcagattcacaagtcagcaaacccaaagcacgaatggncccaccaaccgtatnaagctcggttcanaactntctcgtgtaaaattgnncgacgagggggcncccaacanaccatttgaatttgntgggggggccanctnccctggaaa

SEQ ID NO: 2275 - DNA, 526 bp, Fusarium venenatum
  misc_feature (1)...(526): n = A,T,C or G
ataacacacatactcaaatactctgcatcgattgaatgctaaggcagacacaatgcagtacaacaaccccatctcccaccacaccagccacaccatgggcgaaggtgctgctagtagcaacagcggcgacaatagcagcggagcgaatagcgtgggtcaccatactagccacaccatgggccagggcgccagcagcagcagctctggtgcccatgggggaggtggggttgctgaggctcaaagagtcgacaatggcatcaccctggaagccgcctaacagacgtcgagacctacgagaacgaaaacgatacgaatctgatgatgcaagctccttggcgacagtcttgcagtctcaacggcactgttgctntgtagcgactttcatgcgaagctctggtagtctttncaacttcaanatcatcgacaccccctgccgagggcaacagtttgcaactgctcttcaacactganaccaanatnaaatcgaaaggccttgcacattggtgtgaatcctcnattgacgccc

SEQ ID NO: 2276 - DNA, 590 bp, Fusarium venenatum
  misc_feature (1)...(590): n = A,T,C or G
gtgcagcagcaggaggtgcggcaatcgtcggtttagtcatctggctctggctacaccgtcgcaagaagaacgtcgaagaatcgcacccaatgctccccaactacgaaaccaacaactcaccctaccatcctggagagcccaaacccgcgtggggcactacacctacgtcaggatggcagacacccgaccccaacgcatcaggatactacgcacaaccgaagcagcacgcgggtcccgtcgaactaccgcccgacaaccttgtagctgcgccggctcctatattcgagatggacggtacttcttcgggagctgttgagatgcctggatcaacgcctgttgatcttcatcaccgtggtagtgatgagctcagcagancaggattgggctcttcagctggggatactgctatggtttcacctcagacacaacctgggacccgtatcgaccaaacggagagatgcaccggtaaaatgggttggatttaatgatagaatgggttggattggataactagattgaagtaatggcctcggaattttgggatgagtgtatatctattgtacatcatcatcgggttgcatttagcgtta

SEQ ID NO: 2277 - DNA, 620 bp, Fusarium venenatum
cgacgagagttgcaaatcacaaagggtgctggagcttctttgtacgtttgtggcggtaatcattgttactgccaacgacaaacgcacagcgctctctcattcatctttgtcctccttaatcggagagagggcccccattcttgcgtttccttcgttgcggctttggctttcgtacgcccagctcataaaaacagcggcctcactctcggctcaccttgttggatgacaatgtgacaacgctcctcaccatttctcattagactttccacaccggcaaatctttctctcctcatcaacggtctcctccaaacttaacctcctaaccttcaatccgcgaactcgatcgactaaacgtcacgcttccacgcttccgccctgctcctacattgatcgacataaacattcaactccgcgaaatttctcactccacggcctaccgaggctcgtgatatcctccagtatgaactcgctcaaggttcccgaaagcgggctgcagctcgagggctcaactggcaaggacgctagtctgccttccaggcctttgctctcaccctgagcgatgtccttattgaggacatgatcaagtgtgtgcagaatggcgatggcgttcaactttcgct

SEQ ID NO: 2278 - DNA, 119 bp, Fusarium venenatum
  misc_feature (1)...(119): n = A,T,C or G
ntactgggntgaccatgcnctgaccngncgtcaggaaccataagnccgngtccagaagcaaactccgagcnggtcatnataacacnaatttagggcattggntatcgtnggggactccg

SEQ ID NO: 2279 - DNA, 428 bp, Fusarium venenatum
  misc_feature (1)...(428): n = A,T,C or G
nggggtcnatatgaggatcgtggatcgaggggggtgtgggctgagctggaagacggggttgatganataccggtngggcccaaacaagacgtgcctccgtccggcttcgacggggtatagaaggggaatggaaatgcggcggntnttttgttcgagtgactaggcctgcgatcgaaaagtcagggccagtccagcgcagagcgacgtcagccgtttcganggggcccacgtagaancnacctcagatgaaaattggaggtgagagtggagcggaagctgtcnaaacgtgagggtgtgggatgggaangatattgaangcnccggaagagtggcaagatgaggcttccgttttggaccctccaatntttttttnaagaaagcgattcccctaaatcgattatcngtccaatccattngggttctgtgcg

SEQ ID NO: 2280 - DNA, 613 bp, Fusarium venenatum
  misc_feature (1)...(613): n = A,T,C or G
cttcatctcgttcgccgacgttgtacaggctgagcacaatcctgcttcaggtattgcgggctcccgcgacagcatccatcttgcgggtcttacatctctacccgcagcaatgaaccgctcaccttcgcccattcgatcacctgtatcgagccaaggacccgagacaagcccccctacgagcaaccccggcagtatgaagggcattgagatgagcccctcacgaagaccactgggtagcccaaccagcatcaacaacctcaagcttaacgtttcagggggcgatttgaacattgagacaatgagccaggctctgcgaagaactggcagcactgatctcagccatgttcgaagcggtcctgcaagcccaattgagacctcccaccttcgttaaagacaacatttagtatgattcaattaagacacttggcgagtgagagcaatgatgatatccacacagcaaatgcaacactttttcctctaattcntttctaccaattggggattatacttcctcactttantcgattcgaccacgatacctcnggcatcgtcantttggggggaatgggaacactggggatttggcaactgggaatttgaanagaaagttctn

SEQ ID NO: 2281 - DNA, 286 bp, Fusarium venenatum
catgttcctgactgacaactacaccatccgtgaggttcttactttccccttcatgaaggacgacaagctggagcagaagaagcaactggccgctgaggtggttggcattgagcccgtgcctgaggagggcattgctcacaagtaaaattgagaaatagtatatgtaagggttttgtgatgaggttgggagtatgatttaacgttgagacaatgataccaggagggacaaagatttcatcctggaaatagaacaaaaaaatgaaatgcttttggtttgttaagaagt

SEQ ID NO: 2282 - DNA, 482 bp, Fusarium venenatum
  misc_feature (1)...(482): n = A,T,C or G
cacatgcttcttacgcgtcgttattcatcctcggataccttggtcttatcacggcagacttcctcttacatgtaagcttgnaaaggaccgatttagcgataatccgcgaattcttatctacctcctttccgccacccagcaacaccttcatngttaattcanaaacgaatgcatcagcgcaattaatcccggtcttacttgatgtaaagtagtgaacactacggagaacgatcatcttcgagtcgcgacgactatactacganaaaaccgtacatcggacgatacaagtgcatttctactacatctctcatctcatngggtggtcgcgacgcgcttctctcatcgtgccttncaatgacccgacaaaatgcatcgagttggccatgtcaacacagcattanctcggcggtgnanaaattaacntgttttgccagcgacctttgaacccggcgcgtgtnttactgggnaatccttgttcattt

SEQ ID NO: 2283 - DNA, 589 bp, Fusarium venenatum
  misc_feature (1)...(589): n = A,T,C or G
cttgcccactccttctaagcttcgagacgacaactntttcctcatcaacgccgccgactttgcccctcccagcaccattcgtgatacggcagccggccgttctnaaagccccttcggngagagacgaccttactccccctctgtacctgctgctnaaactctagcctcgcccttngaggagctcgccgcccttcctagcccttacagccatcttctccgcaagtctggtacattcactggtctcgactttgcgccccccaagaagttcaaggattccgacaacatgagcgatgctggaagtatcaggagtaaccgtagtggcatgtctcaagcccagctcggagccatccgcaacggagctggacgtgtcagccgactgcctggcgaccaagtgttcactgntgatgcactacaagacacgctgaagccatcctggggcatccgaccttgataaaccaaaaagcagcgcaaacattattgngaataatccgagatttcggcatcacaagaagtgtcaaaaattctnttagcggtgncttttggcattcattatacagngggcgcgggcttggccactttgcacattttt

SEQ ID NO: 2284 - DNA, 485 bp, Fusarium venenatum
  misc_feature (1)...(485): n = A,T,C or G
gcccgagtcccaggaaagatggtacagccgaatccctgctttcaagtccactttcctcgccacctggaggcccatcgtcatcttctgggctgcttctcaaatcgtcaccctcggtggcatcagcacattctacgccatgggcactgatggccaagaaattccccagttcgacggtagcgaaggcagcgtttggggcatcatgatcctggctctcttcctccagatcgccgtccaaattcctgcctatgttgttctcattcgtgtccaggcctctcttcttccgccgacgccgacaccatcattcccttcgaccgctctttcaatggccgcatcgagcctgtcgntgttggtggtcggggttatgccactgttcgtgacgcttggtccagcttctccaagtctgcctggaaacgcattgncatgctcgagctcaaaggcggtgctgnctcttttgcctncatctttgncctgatgggtgcataaat

SEQ ID NO: 2285 - DNA, 606 bp, Fusarium venenatum
  misc_feature (1)...(606): n = A,T,C or G
gttggaatcggtgtggcaggtgctggagcatcaagagcaagtggtttataaaacctcccgccgctcaaggcatgccgcaattgggtgccaatgtcgaatccacgcaaagcccaaaatttccatatcctgaagctttcaagcaagtcatgtctccaacgaactccgttccgcgacgtgacgaagagcatggaaatacgggcagtaattcggctgagcatcagagcccaagaccatcccaagcagtattgatcgatcggagatcagagaggattgaggagaggggtttctcaacaccggttttcggtgtgtcgcatactacagctattgagtttgaggaacgaatccagccgacatatgttgtcctgggcatatttcctcgcggtgctctcaaccctaaggaacaaattgtgttcatcgataggcccgaccaatttttctcaaagctcaggtgggcgacatttcggcttcgtgggatgagaggaacattattatctttgaagcatctcgcggcgtttagactgtacaagtgcgatgctaataccggaaaacacgaccacatcaatctagatgctaatggaattgctgatttgnatcttctggtgagtn

SEQ ID NO: 2286 - DNA, 609 bp, Fusarium venenatum
  misc_feature (1)...(609): n = A,T,C or G
ttcagttaggcctttatagcctcaatcaattaacaacgagtattatatatcaagttcatattataatactcttttctctctcttttcattaccaccacacaatagacaccatgcatgtactacacggattcggtcaaagacgaaagtcgtctcgtcctcgtgaccttcatatcagaaaggtctccttctcaggatcttctctctcatccggctgctctctatcatcatcctcatcatcaaccatctccgccctctcaacaccagctgctaggacacctaccgcctcaagacccgaaatggaccctctcgcctcacaccccgccttccacgcaccaccaagattatacgaacgacctttcaagcgcatggacgatcacgagcctgtattctacggtaccgaggaggcagtcatcgatgaggaggattttgtcgagcaagatgtcgctgctcagcagcctacagagatggctctggcttctcatgtgagccctatggatgctgccgacgagcaaggcaacgaaccccaaggattacttctttaccacantatcagcacgaccaccaatggccaaatttcgtnggtccgaatccccatccaagcattcagac

SEQ ID NO: 2287 - DNA, 647 bp, Fusarium venenatum
  misc_feature (1)...(647): n = A,T,C or G
cagccctgaaccgtaacttcagcaacattctccgcaccaagatccgcaaaatgaagttgcctgatggctccaagacggccggccgagtctacgccaagtgtatcatggactttganaaccgaatcaaggctgacttccnaaacaacggnnaaaagtgggctgttgatgtcggtatcgaggccgagttccctgaggccggcattgaggagggttacatgaccttcaccaacgaggagatccttcagtgcttcgagcctgttgncaaccgtattctggagcttgtcanaaaccagattatcgntattnaggctcagaaccgtactcttcanaacattttggttgtcggtggtttcggtgcctntgaatacctcttccagcaaatcaagctccacgttcctccccagttccagtccaaggttgttcgacctatggactccgttgccgcattgagaagggagctgtcactgntggtatcacagagcgaatcgcacccaccggggttgcccggcnacactacctgatggctactcttcagcctttgaanggagggctaccaccccgaggcctaccgngtcccttttttgaangaaaggatcgctggaaagttcnccccccanattttcgccaaaanggccaaaaggncaana

SEQ ID NO: 2288 - DNA, 270 bp, Fusarium venenatum
  misc_feature (1)...(270): n = A,T,C or G
cgagaaggccacccccatgattacgggtcacgaagaattataatatcatgcacgcgccgagttatttcttgcttcttttttcacggcaatatttttttaacgatatcctaacgtacatacccacctttagcacaagtcccttttggcatgggaccagcccgttgagcgaggtgctgggctttatactcttgtttaatactacgagcaacgcgcgatacagcccgcgttgccaatttcagtgttgtcaanaaaaaaaaaaaanaaaaaaat

SEQ ID NO: 2289 - DNA, 271 bp, Fusarium venenatum
  misc_feature (1)...(271): n = A,T,C or G
cctgaagctatttagacgagaantttttttgnnagaaaccccgggtcacggcgntaaaggaaataccagggcgggaagtcacctggaacctgtaagagggaattcagggaccatgggggcacacgtatgtgatacagcntgatacgaggacaacgaaggatcgggtncttggcaaagggtttgtactgcacgctgggtcgctgaacagggatataanccagagccaacaggagcgcanttttttaaagatnaaacagagtctttttccgtc

SEQ ID NO: 2290 - DNA, 190 bp, Fusarium venenatum
  misc_feature (1)...(190): n = A,T,C or G
nctctggcctncctngccgcggccncncagccaccagcgcnccgcggccccnacggagcccgcggnaacaggangccgccaccccccaggggacaanggagagcangcagcnaggggggccaaggacgacagcnccngcaccgggaacnncaaggcaacacccacaagggcccngcccccgcccgcaagg

SEQ ID NO: 2291 - DNA, 639 bp, Fusarium venenatum
  misc_feature (1)...(639): n = A,T,C or G
ggcgctagaagagccaccggagccactgcaggtaacatcacaacaggtcttcccatcgaagataaggacaagggacccaacaagggcgatatcctgaacggcgctgtcagctggacccgggatctcatgtggatgctccatcttaagcttcaacagcaagaagagatgatgaacactattgctgaccttggcggccacttcccctttgagatgacagaggatgagcgacgcatgcagacggagctcatggacgctttcaacaagagtgagaatggcactttctcatactctcgcacagctgggactggcctgcgagtgcctcaccatactgattatcgcggcgagtccctgtcgggtgggggtggcagcctcgaccctgttggcatcaacccanacgacaacctcgactgacgatacaaatcaattttgcatgaccccgatgacaacaacagtggccatgctttcgtcaatttcaangngggaagacgagtacnacatggatctcacgcactaaagtgtggncctgttaacccatcttntggcttngagagcatattttcttaacgcatattntggaccccccccgtcaatgggacgggccttacttgttggggttcgcaatattacttggnattggta

SEQ ID NO: 2292 - DNA, 372 bp, Fusarium venenatum
  misc_feature (1)...(372): n = A,T,C or G
tataggatagtgtgaggccacgcaattggagtgaggaaagacaggagcgcagaattggttatcgaagcaggggtctccaaaacaaggccngcaaaaaggaagtgcgcgaagccttcagtctacgaatggcttttgccaacgcttgaagtttttggacttgacacatcaacagctcnagtacatgctacccgtgtggcnccgggctcacactagactcttggcgaacttngctggacattgacagcagaggacgatcttttanttttttactttgttaatgggcgttacggatatgggaaagcggctncaacagcatttgatcattcagggcacaattcgttacccacaaanaaacaggggatttgaaagtan

SEQ ID NO: 2293 - DNA, 569 bp, Fusarium venenatum
  misc_feature (1)...(569): n = A,T,C or G
atcctctataccattttattaaaccgtttatttttgatcctacaagaaaaacaatcatggctgccgttcaactccaaaccncccctcaccaggtcggcgtcttcaagaaacctcatagccgcccaaactgagacgctcgttctcaaagaaaaatcatgtcccttaccggcgatagcttcgacattaagctcgccaacggccaacccattctcaaggtcgaaggtaaagtcatgagcgtttccggccgcaaaaaggtctttgacatgcagggcaaccacctcttttccatcgtcaaggagctcatgcacatccacgctacctatgccgtggaggacctcagggtgtcaagatcatggaagtcaagaatagcttcaagctcatgggctccaaggccactgctaccttcacctccagcgacggcaccgcagaagttctggagatgaanggcaattggttcgattacgcagctgatatctttgacaagtctacaaatactgtagtcgcgcgcatcgaccgcaagatctcagcggtcgtgacatgatctttggtcagcagaactacgctctaat

SEQ ID NO: 2294 - DNA, 628 bp, Fusarium venenatum
  misc_feature (1)...(628): n = A,T,C or G
catacatcaatttcgtctcgatctcttaatcgaaccttcctttctatcacgaactctctcactctacctcctagtacctacctacctagcttgcccacgctcgcctgtcgcgtatatcacatcctcctcttactcctggcttcttccgctggncatttaaaccgcgttttactactctcttttcatcccattttgtccatcttgccgtctctcaaagtcaacggaactcatcaccaacgcgtgcaccaaagacgctatagatggtttgaaacctgacattgctgactactaacctcccaaaatcacttccagtttcttccttttcaaaaaggacgtttttcacaatgtcgtacttcagctctcaatactcttcctctcctgtccttaccatgtctccccaacatgcccaccaagtccatgggcatggcaagctttggncaccacacaccatcgcgantcgcactatggcaaaccaagtttgcagccgctcaacctgtacgaaccgctgcagctggnanaaagcgttctcnggacgaagnttctgacaaccttgagcctgaatcaagtcctggccgttgagganctgaagaagaatggtttaagggcctggnatgancctcgtcaaaaa

SEQ ID NO: 2295 - DNA, 421 bp, Fusarium venenatum
  misc_feature (1)...(421): n = A,T,C or G
ggtgattcccggccttctgggggctttgctctccctggtctgcccaatcgacccatgcccaaagacgagcagtcagatgacgagcgggaggaccctcagcttatgagacagcagcagaacggggacggtctccttcaccccctcgcattgctgtacctgtcagccgtggacccgagcctgacgttggcacccctcctgagcagcgtgctcctcctccactcccccctagccaaatcgatgtgcccaaggagtcagaacttgctgatgacaaggangtttccacgaccgcccgcttcgcttgtggtgcggctgcgggtgttgctgtaagaactgctgccggcgttggantcgctgccgccgctggtgctttcgatcgtgagcctagcccccgaaaaanccccccccccccaaaagggggccc

SEQ ID NO: 2296 - DNA, 611 bp, Fusarium venenatum
  misc_feature (1)...(611): n = A,T,C or G
ctggctaccgtccaagctgtctctgctcacttcgggcttgtcttccccacatggcgaagctgataccctttccgaagaagaatgaggaccgntacaaccagtggacttatccctggtgctggcgtttgactacaataagaaanacctggaccgactgggccnttcgaggggtggttctcttacactcgaccttcaccacgaatgggtcctacgtctttgtcaacctcggcctcggcgaagaacaccaccaacttcaacatctcccttacacccgagttcctnaacgccaccaacgctggtactnttttcattgaaaacttgccctttcctnaagcgtcaaggtcttcggacngagactttgccagtatncaaggttgtgactgtcngtgaaaagcggcagtgcgctctacaactgngccgatatccgnttcaaggagaatgcaaagggacccagcaacaagactggcgatgtcgactatgtcatgatcaacagcaggatggtaatggaactgaggatagnggnttcaacttctcgtcctnaggggagganggtggntacagtggcaaccggatcacggaatggttggtgtnaaaacaaagggtttgacctt

SEQ ID NO: 2297 - DNA, 627 bp, Fusarium venenatum
  misc_feature (1)...(627): n = A,T,C or G
agtcaataagtcgctacttttcctcaattcaaagacgaggggcgagctttcatgttatcgactatcgatatatatgttcctgcaccatagtttattcgacgtcgatccgtcgcatccttcattcatagtcgccgctccttcactccgacatttcggactacttcattcacccttagttcacctcggcgtggcatgccactagcttgatcatcatggcttctatgccttctacgactcgtcctgaagacgataaatctaccaccaccataccttcagcaggcgatggacaaactgtaaacgtacaggtcttgtcaccgtctgttggcgtgacccgacccctgctgtttcccaatcttgccaccagcactacggtcaaacagctcaaggacaagattcgacagacccttcccttgcgcccagccgatgagaatcagcgcttgattcatcgcggacgcgccattgttcgcgagtccgacaccttgcttgatatattcggcgcagatgtggtccgcaaccccgagcaacagactattcatcttggtattcgcgatgtgcaagacaaccaatcctcagccgcgaccgcatctnctgcgcttnctgctcccgtctcagcaccagcgtcaggtc

SEQ ID NO: 2298 - DNA, 270 bp, Fusarium venenatum
  misc_feature (1)...(270): n = A,T,C or G
tgaagctggagccttaatcgtcactcgcgacgaaggtntcaaaacaagattaggagaagagcaactttggttacaggagcatgctacaaaggcaactcgggacgactttgctcgaactgaaagaagagtcggtctcaaagtcagagtcgccatgtggattgtttcgctagtgggcggagcgttgtaaaaatatgtaaatcagtgtaatcatctagagtgactccccgagtccaatgatacccaagagttaatcaacatccattcggcatg

SEQ ID NO: 2299 - DNA, 1143 bp, Fusarium venenatum
  misc_feature (1)...(1143): n = A,T,C or G
gctgtttgtgccatcgtcgaaaccactctggcgccactgctacgcatatctccccatatctcaccgttaccaaaactataattatcagcgacaaaagtcgtttattagttgcccatcatgtccgcagacactgctccccccaacggtaacaacaacggcgaaaatgtatacacgcaacagacgaggatcaatcacccaggccgctctgaccaatctcttccagaggggaaattcgatttccaatggcaacggttttcctggtcagtcttctggccccgtcgatactggccgtcgacgcctttctgtgaccactcttggtctctctggtacttcacccacaaacacatcttctttcgttcgtcgaggaagcatgtcgaccaactcgaacaactctgactccattgatgagagcgctatcgaagatgacnacatgtactccaagantgcgcctactacaccatttgtccggcggatnancttcggtcctgccaacatgcgtaacatacgtcctaatggcagccctggaaatgaacagcaaggtttcaactggtccgaacagcttaagtctcgtgccgagagttctgtcataggtgctcctcgcgcttccttctcgctcgcctcctcctctccgccacgaggctccatccacgatcgggcaaagtccgtttcggagatgcctcagcctccagctcaagcttcttccgtcaagcagcagcccaggcagcctgagcggcccaagcctgatgctttccaggagagaattctgaagggtgacttttacatggactgagtgaagcagcgcctcaaacgcccatacacccaaatatgatgacgatgatgatgatgacaccaacaatgacgacccgcctactttaccacaactgtacgacgatcttgataagctgtctgatcccttgcatctgtcgaatgcactacgcaatgtggttcctaatatgggtaacatatccagccaatttcccttgaaggagatctctcgctaaacacatggctggaatttaatactttttatgggtttgcaagcaaggctttttttgagctgggttattttaggcaaaggcgaaaccgaccaaaaacatgcagccatattgaattcgccatgggacccatagggggtgacaaggt

SEQ ID NO: 2300 - DNA, 583 bp, Fusarium venenatum
  misc_feature (1)...(583): n = A,T,C or G
ctttctagtgatacaagaagatttgacttaatcgcccatcatgacttcagcacgtccacttctctacgtcgccctcggcctactcatggtcgtgtctatcatcgaaactctccttcatctctagcatggtcggttggctacaccgtaccgcgagcggaactttctctttcgaatggcagggcacagagcaccagctaaaaggcgaaccggcaaacttgattgtcgaccaaggccatacaagcaacggagccgcaggaacagcattcatccctatcggctgcggaggtattcttgctctctggctccgaaacagacacaaccctggaaaattcagtcggttcttttacaacttttggctcgtttggaatgtcctcagtctacttctcgttctttcagctcttatctacacctttgtcgttacaaccgaacacaacggacagagcatcatccccagcgttgcagccaagcttaacgatggtcaaaaataccctcttgagtcgtggacgccgcaaaattggttctcggctcttctcgaccttgaactcaccaactcgaacganaggaacgacattgaacatcacct

SEQ ID NO: 2301 - DNA, 505 bp, Fusarium venenatum
  misc_feature (1)...(505): n = A,T,C or G
gaattttttttttttttttacgaatacaaacacgttcgtttattgcttgcttcattcttgagctgtcattgcagctttagtagtacaattttcaccttggtcccattaccgtcccttgccattatgtcctccatttgaatgtaaatcaatcaagcaccctcacgttctgtgaatccaggcccagtattgacctgcccaatcttgtccatgtgcatctcatgctttcgctcctcaggactccagctctgtcgacgctgaaatgaaggtgtccagctattcgtgtggcgcatgcaacggtcggcaccagcttgagcggatggggaagttggaacttcggatgggggagaagtttgggttgtggtggatatggctgttggttgacgatccatggtgaagtttagttttgaacagatattttttgatgatgatagtgtttggtggtgatgaagtctctttataggttgtttattgtagttggtatgaagagtgttgcctggaanaattc

SEQ ID NO: 2302 - DNA, 596 bp, Fusarium venenatum
  misc_feature (1)...(596): n = A,T,C or G
cctttgataatctttaccaaactctgctcaatcatcaggccgagccaaatagtctctctattttcacatccttgttacggataaactagaattgagcttgaacagataggctccttcagttctcgatgtttaattacagaggccgtggcggtccatcgcggtcaacgcctgccaatgtccagtgtcagaaatgtctaaaacgaggtcactactcttatgaatgtaaagcaacggcacaggagcgtccgtatgtgtcgcgcccatcacgatctcagcagttgcgaaatcccaagctcgtgcccaagcttacaaacgagaccctgaaccctctggaaaagaaagaaggtgttgctgatgcagaactggctaaggtagatgctgaacgcgcacgcaagcgcgagcgggaggagaganatgatgagctgatcaagtcaactgcaaagcggcataaatctgtttcttcccattctgtgtctactatttctactaatgcttcnaagtctccgtcncctggttaaaaatanaattggatcacctcgtgcacgaagaaaaaattctcattctgacactcacgaaggcgaagtgacttcgaancc

SEQ ID NO: 2303 - DNA, 575 bp, Fusarium venenatum
  misc_feature (1)...(575): n = A,T,C or G
catgaacgacccttacatcttcagcaacagtggagatcttaccacaaaggatattctgaagcgttttcaggataggcggggacagatttcaattgctgatgtgaacgaggtttacaaccgtcaggacaattccacccgacctccagctcggcgagtagaaactgaccccgcagtatggcagggtgaaaccaccgttcgcaccatacaagatccttcgatgcctatacccaataatgggcatgcaactccgccggctcggttcagangacggaacgatctgaatccctcgccttatggtccaaccagttcaatcagtcagacagtcaactcgatagcgccgancatancaggaggcgcgaatggccaatctggcataggaagacntcaagcancnggcttggtgtttccggcaactcatgatactttctccattgatgttcttgattatagcagggctagacaacgcccggtatcagaactcgttncgttcttacnttcantcagggcgcctgattgggtttngaaaaatattgcatantcaangggccccctctttgggtcttcttaacccagct

SEQ ID NO: 2304 - DNA, 502 bp, Fusarium venenatum
  misc_feature (1)...(502): n = A,T,C or G
tccaataacaccaccaaattacgtcgatcgcccctcaaactccaaactaccaacctctctcgagtatcacgttaccaacaaaggcattcggccttacccagcctcagcagactgcaccccatgtgtagccaataagaccgacaaggcgtttgaagcgcttgctaatgcacttcaaccaaacaaataccaataatagagcccgtcacaatttcttcgaccaagcaaggacagtcctttacctataatcgatcgccaacacccgattcgtcctaagattatatcacaagcatcttgaaaaacgcagttttggcagaaagccaagaggatttcgacaggttcgaccgnaagcttttatntagtccatgagtccaatgatggtcgttggacttcccttgatacaagaatgggcccgtcagacggagaatgnaccatgggctgcaattggatacgaattggatgatttntnaatggganggtaacatgttgcgcatatggtattgga

SEQ ID NO: 2305 - DNA, 590 bp, Fusarium venenatum
  misc_feature (1)...(590): n = A,T,C or G
tgggatatgactggcatgcaacagcatttccctcaacaagacactgtcatgggtaatgtctacatggccaaccagcaacaacccgtcgctactcgccctgctactcctattcctacaaaacgacctgggtcctggggcaagcgactgagccttgagaacctgcgccccaagaagaagactagcgtctatggtagccctgcttccgagcacgaagctgtcccgcctgtaccagccatgtacgctgagatgatgcccacgtctgtaccagcgggctacgaactgccaatgcgaatgggtcaccctcaacaaggctacacatcgaaccctggcttcatgcctcaagcacagcaacagcagttcggttcaccacaagcttctacttggatgacagcgacatgagactataaggcgttttaatctcggaacggaaaacattttttgagcatcatgatttcattttctttgcatattaccacatatctgtactaataatcattccgcacacggtccaaagtggaagacgaagaactttacgacaggatacccatcctctaccatatgacaactttcgccttntcnccttgtttgtt

SEQ ID NO: 2306 - DNA, 564 bp, Fusarium venenatum
  misc_feature (1)...(564): n = A,T,C or G
tgactttatcttgcataccacaaccaacgtcgatcacgcgacactcgatcatcatttcagacaggtcttacatacgaaatagcttgacatttccctaccgatcaggttccctagactggctaccagtctcacaggtagtgaattgtgcccaacctcaaaacaccacaaccaccatcatgagtcgacaaacaccacgaaagcagcgacacacccgtcagccttcgaaccgcataccggccgtttcagactacgaatcagatgccgcagttatacataccgactacgcgccaccgcctccacgcacaaacaccgaactcaacctctctgtgctccagcgctatctcccctctatccacaccatcctcagcatagcagccaacgctgttatctacacattcaatagcacctctgaaaattgggaaaatctggcgtggaaggcaccatgtttgtctgcgcgcaaagtccgtcttccgaagatcctgcccaacaaccacaacctgcgtgtttgtccttaacagaaaaaggnttganaatgtgaatgtagattctccgggtgttccatgc

SEQ ID NO: 2307 - DNA, 588 bp, Fusarium venenatum
  misc_feature (1)...(588): n = A,T,C or G
aaaggcttgagggaacacgctcgcccacgacgacgtcgttgctgtatcgtaccaaagatttctctggtcgccatgcagccgttcgcccgtccagcggcaaggcttgtctggagccatgcgcgaataggactcgaccggaccacgangccgagcaagtcatgctgggaaccctcaatattccagaattcaacaatacgaatgcgatacaaccccngagccattggccttcaatcacgactctattcatcagagagacccccgaaagattcngagaccaactctaggacaaataaagacgtcgaagctgagcttgaatctatccttaaacctcggccaaatattctnaaggagcttcagccgcctgtcgaaagaacgaaactggaagatgtcnagtctacttccgcagatgctatcccccnagactcaaaactcgagacgcccnaaactgaagaaggcaagcccgaaccnccaaactcgacgatgctgctcaatcacncgaaccccctcgactactgatngcctcccaattctccgtgaccgcgcgccacatcctgtntncgaatttaaggagaaatttagccctgctat

SEQ ID NO: 2308 - DNA, 656 bp, Fusarium venenatum
  misc_feature (1)...(656): n = A,T,C or G
ctcttttcatctcttttctgacctgacttatccttagggtactttttttccttctttccgttctttcgtaatttcaactttttgcatattgattatctgctacatgagtatctattgctaaaactcttatgcaactcacattctcttattctccctctactacaatattatcatgatgggtcgtgtcgcttttatatctctgcgagttctgcagctagctctatctattgcgagcatcggcttgagctcatatgttgtccacgattacgaccgcagaagtcgaggctcagcgccttcaccgttttcctacctcttgacctcgtccatcgtttccatcgctctcatcgtctacctcgcgatcgctcctctgtttgcccgcgcctctatcatcaatacgccgccgttgtcgcgaaaccgcaatgctgctctttacttcgccggttcatcgccattgctgcttcattggggtccctcattatgtgtgangggaaccgtctgctcgtgcgcacgcnccgatgccgtgttgctgttggncaagttacggngtggataacgacaacgggcttcacagccaagagtgttccaaaggactttcaggactcaaaaggcattgccaccgnaaagggncggctaatgacttnatgccctnaaaacgc

SEQ ID NO: 2309 - DNA, 606 bp, Fusarium venenatum
cttgtttctttttttattttattgccggccggcccttacgtagtgatgcatagaaaagagtcatggtgatgggacataggatcagtcgttattcccgcaccgtgggctaataatgaagcttacctcgctatcttactggttcttcggactttttctcttctccatcagcctaatgaccatttttgtttcgactcagacatggattagtttgtttttttgcttcttttatgtaggtgcgccccaacccccccttgtcgtccctctcatcttgcctgcctgactcaagttcaaggcaggccaagacctggcctggtcaggtcagatcatgtctaatcaggtcaacaacagacaacgaaacgacctggtagacagggcccaggggcagatccaggtccaggtcctggtccacgcgacaataacaaccgtgagttgagccttgttcgcaatcttaaccgcatgttcatccagtcgctctcatccgtcacctgtcacgtcacatccagcctaaatggatgggactgcacatcactttgattacccacgtagtcgggttgggctgggatcacaaaagaacgaatccaatcaattgaatggtcactagactaa

SEQ ID NO: 2310 - DNA, 570 bp, Fusarium venenatum
  misc_feature (1)...(570): n = A,T,C or G
ctgctctactggaactcggtcatgttggagaagcaagagaaggatcagaaggacaaaggcgagactagcccatccgtaaccgactcgcaacgacgaggctcttctttcgatgatttccttcgtcaagacgatggcgctgagcaaggggacatatgttttcaacactggagctgatacccgaggaatggatgagggcctacgacgtcgtggcgatggtccccgtggtttcactcctctgtacatcaacccttttgccgacgaacaccacatcgaccatgacgagatcaacgaggagcctgaggaaacccgacaaaccgcccctgctgccgacgaagtctctgatatctacagcgccccactcaggacaaagacganaagcctactgccgccgttcttattgatgccgacccactcccgcccgctccgagacagcctccactgctaccctcgagcganagatcggcgttgatgaattcatgaccgccggncaggaaaaccgcgacaaggctaccntcttttcngggctgggcgccaaacacnagcaccgacttttactcnccacttccgtcc

SEQ ID NO: 2311 - DNA, 622 bp, Fusarium venenatum
  misc_feature (1)...(622): n = A,T,C or G
aatcggactccgattctcatcctctcttcttctcctcaaatattgtccctgcttctcctttgcgacacgatagcttgagacattaccaatcccatctccgacggctgcgccacgcacgcgtacctacagcacagtacattggtctactctacagtgctctctctctgtacaacccattctgtctagactcctcgcctcgcctagattcgatttgtcctgaccactcacgcacccactggtaaccagaactgtactcaaccaccggcctcctccgtcgttgcgcttctcgtactctctaccttggatcctgttttccctcgcgccattgtcactctcttgttcctgtcaaccaacacaatcgaccatcacgaatactttggccccatttcggcttcattgacgcgattcgaattactttatcaaactctgtcgcttgaccaccaccgacacctcattaattacttcagcgcaatcgattcgacacgcagaaagagcgaccacaggccgagggaaattgncacgggtagtgaaactggaggaatagaacgccctatcgcctgaaagangccccttggccatggccgacaacgagaaganggcctnctcttncgangctcaagaa

SEQ ID NO: 2312 - DNA, 602 bp, Fusarium venenatum
  misc_feature (1)...(602): n = A,T,C or G
gttgagaagttctctcgcctcccctttgcggacaaccagtttgatctcatttctgctcgagaacttcacagcatcctcaagctctttggcgagaacggtgaagatgagtgggacacttgcctcaaggagtgcatgcgtgtcctcaagcctggcggctacctcgacttttcccttcttgactcagacatcatcaacgctggtcccgtcggactagccaagagcgtcgagttcggttttgctctcaagactctgggatatgatcccaaccccaccaagctctggcttgcccgtttagcccgcgccggcttccaagatactcgtcgcatctggatgtgtcttccaatgggcgccaggcgaagcatgtcaaagccccccactcttccatgaaggatagccccgatgacaggacgtcaagactgncagatggacgccatgtgatggaanaatgatgacattgcagcgttngagatggtggcggtgaactggaancatgntctccgtgtgaatgaaaggtgtggganttgnattgcgtccacatatggactgcatgaanagttgcagnttaangggccccgttnttcaggaagccaactgaagncgnt

SEQ ID NO: 2313 - DNA, 563 bp, Fusarium venenatum
  misc_feature (1)...(563): n = A,T,C or G
gattggcgcgtcgctagaccgaagccatactcaagcaaaaaggcgaaggcccctggaggggaacgccgaccatcatgatacccaatgcatccataccacgactaccgataccaagaacaacgtacatacttaccctagcgctgagtctattactctgtgcttttggaaatgccgatgcatcagagctgntgcacgactctatattcgacaccgaagcacttgtcgagcgaagcgatgcatccattctcatatacgaacctgacttcggcgtattcgatcgnagnatactcggtcgngcaacaagcagaacagtcgcttttgacaacaacggcccggatagncgaaaattgagtcccggcgcaactgnttgntacgcggggataagaagacattggtcggcaaggataagaagggcgacgatcccatgaaccgaggagcaccgaggacgatctgggcatcaaaaacctggcgagctgggctaaaacgggtacatatctgnaaaaccngntcgagggccagcctggaatcaagggtanggcacaatctggaacaggacncaacta

SEQ ID NO: 2314 - DNA, 608 bp, Fusarium venenatum
cgcatgactcgagtctaacacagctcgtgtctagtaacacatttgtatccttattggcgcgaaacgaactcgaacatcagtcgcattgcatcgcatcgtgtcacgtacccatacgacttacgatccatcatggccgaagctctgagggagttgctggcccctgaacagacaaacgacccagctgctctggagtatctcacataccttgccgagcgacaatccagctttttgcaaacaacggagccccaagtcctatcccagacgtcgcattctctactcctcgctatacaagctctttcgaaaagatctcataaacccatcgtcgattcagcagccagtcatgcttccttaaggaactctctcccgacgctagcccagcgagcttccgatctcgtccaagcagtacctcgtctagatgctcaggctgaacacttctcgtcagcctttggtaaggctagcgacagcaagctgcttgcccgaaggaaacagactctgctattgcttcgaaactccgaacgactagtcgatgtcatgggagatgcccctgcttctctcgtctgctggtttcaaccggccccagtcaatcattccaccacgctcgaactcta

SEQ ID NO: 2315 - DNA, 812 bp, Fusarium venenatum
  misc_feature (1)...(812): n = A,T,C or G
ccccgcttggtcaacctgcaggctggtccccgaagaattacaaattcctcagtcaacgtcacacgatacgccaatgggacaacgctacatgtcgataatgtcccgaccgnccgagtatctggaattgatcgatgcttttggtttcatggcttgtcaagcacttcatgatatcgtcaagggaatttaggctatgttggcttttggttaagctctactctggtcccgtcaacgcataacatacctatccaggcattgtaaacaaatactgtctcgtacagtcgtactcgaatatgcagctccagtttanaaagacaacacacccctaagttgaagatcttgtccaacgtcatccaatcaccgccccaccaacaaaggctttccctgttcatcataccgncacccttaacatttgctaacaggagttcgggacttgcctttaccccgctacgacccctcatagagctttcgagagctccttataagctttaaaaagcccgtcctctcccagacttgaaagnggtgttagtccanacattcatcgccgactttgaacaatacaccagcctaccactntatattccaaatctttcacaatgccttttttccggacatgctttggaaaagccgtcacctacaaggtcgacgaagagcctctcgttggtggcttacaaccactgtggacaactgccagcgtcagaagcggttccacctactctctcgttgctgntgcaagaaggacaagctcaccatcaacggccccgtnaagacctactccggcaccaagggctnttntggcaacatcgccaccgtct

SEQ ID NO: 2316 - DNA, 619 bp, Fusarium venenatum
  misc_feature (1)...(619): n = A,T,C or G
attaacttcttttcaatacaacgcgccatatcacatctttttcatacgagcatcacatcacgacgatgttagagactgatatagtcgtcacttganaacacactgctatcatgatgccatgagcgaatcanacaagccccaaatttaccctcgatattgttttcaccttgcacccactgtgaatcaatggtgccctttccgtgtgaccgatgtccacggtcttcagcagcacgcaggcttcgaaggcgaaaacttttacttttatgggaatctaccaattaaatgggtacgcgtagtcggcttagtcgtcgccattgacgagttcacgggtaggcgcgtctatactatanacgacagcagcggcgcatgtatcgagtgcattgtgaanatgcctatattttcgggagtggatggcaacgcggctgcagcaacanatgctgctntgaanaaagcanacgcaaatccgccactacccaccgatcccttcccgaccatttgatgtcggggtgtgttggccacatcaangggggtctttccagctttanaaaatgagccgacngctcctnttcaaaaanatgcttgtcgtacggaacactcaacaagaaggtgccctntggga

SEQ ID NO: 2317 - DNA, 626 bp, Fusarium venenatum
  misc_feature (1)...(626): n = A,T,C or G
ggaaattgtagactatcgtcttggagataagctctatttgtctaaaaaaagaaaatgttcttacgtcaaatctctggataatggatcttcctcagctcaatgcaaaggcagcaccgatccgatttccggattgttgtctcgctatatcaacaaaattacttcagctcttatcagatattttttccaaaactacagtctcanaagaccatccaaccgtcctctccatcggaagcggctctggcttgctcgaagcttttctgctcaatcaacaagatagcgcccactacaactatccttctttcaacgtggngggggttgaagttcagcaacagaatgggaaagacgctgtcaacaaatatcttccanaacaagccatttatacggttcgtggtagctgggacgttgtctcgaggttacaagatccagacgttacatctctcttgtttgtttatccacgtcaaccagccctaattctttgaatacacgaaagccatcgcgcgaagagggctgaaccgtgcnaggttatcgtttgggtggggccaatggcttgactgggangtgttccaagtcttcttttgatgcnagggcatgaaaatgggccaatttgcactcccttgaaaaaaagc

SEQ ID NO: 2318 - DNA, 506 bp, Fusarium venenatum
  misc_feature (1)...(506): n = A,T,C or G
caatcttctccggaagattcaaagacgttggagaatattacagaaacatccaagccgcgcgatagtacaggggaaagatagagaacttgaccacatagacgcgtttgtcgatcaatcgtcgcgcggctattatttacatatctcataaggacagcccgcaaactaagtgagtataattgctttttgcggctcagggggagttatttatttgggcagctggattgagagcggttcatccgaacaaatcgcatttgtcacgcgctatcaatgcgattggctccaagtatctgtatatttctgaaacacatctctatggttcttgcatcacaattatacatatggtaccgggcaacattggacacgggtaaggatatgaagaaaacctggggcttggaggaaaacggatttcttaaaatgttatttcttgtcaaaggattggtantggttgggggaatacattaacantgacagaccgggccagccacggttgctacttgcaggcanat

SEQ ID NO: 2319 - DNA, 497 bp, Fusarium venenatum
  misc_feature (1)...(497): n = A,T,C or G
ttttttttttttctatcacaatggcattgcatattttaccctttctcatatttgttatcccctacagtatcttagcgctcgtgtccgtggcattgactgcatcaggacacgaatgtcgttccgccgatcttggctcatgatttattatacaaaagacgctcccaacgccccttgttcccagtatgtagtctaaaattcagtaactcccagtgcagtcggtattcgccgcttcagcaaaccgatagcactcagtgttgtccgagaagagcttggcgtgcctntgaaggaggagctttaccctgaggagaagtaaatggtgccatagtctcaatattttgagccttgtgtatactggatgttggccgagacggaagggaatcagaccaagaggtagaccccggaagtttgattgcggcagccccaaatcgattgggtttagtcccacgcgaaaaaacaatttctgccttatgttgattcccaaagtcgaaatgctttgt

SEQ ID NO: 2320 - DNA, 621 bp, Fusarium venenatum
  misc_feature (1)...(621): n = A,T,C or G
tatcgccggtcactcgccttcacttcccanaaacaccttcaccggctctggtgctgaacaagacgtctacggaagtaaattngggggtcattccccttcactttcacttccaagaggctctttcactggttccggtgccgaacaanatatctatggcggnaaattcgctggtcgctcgccaccactttcacttcctanagactctttcaatggatctggcgccgaacaggatatctttggctctcacttcaatcgcacctcataccaaggtctcaccaccagcactttgggcctgatgcactctgtcgttctaccttcctttactcttcatgctggtctttctgccgtagcctatggaatttcccgatacaccgatcgtgtcgagggcaaggattttctgtgggcatctggtatgacactgaatgcttggtggagcgctattggttctcgcgttgcaatgatggtctctcgatctctgaggcctggctgatctcatctacccgcaaaaacttcttnttnttggtgctacagcttggggggccgcttacttctcgtgtgtatccccaanttgaaacgtggagangatgaccctcggtntgctctgaaaaaaaggatcctggt

SEQ ID NO: 2321 - DNA, 616 bp, Fusarium venenatum
  misc_feature (1)...(616): n = A,T,C or G
gacgaaaccaggcggacagcgcaggtataggtgcagacccccctataccgcaaaggtcgtgatcatcgcattctgcccgcgattcgcaaacttttggttatcgttgcacgccttgcatcgaagcccgcccacctgttctgttcatcgctccacatcagcccacgggtcgatcacaagagaaccaccagtcgctcagctttatcgaccgaccgccctgtcctgacctttcttcctgtccaggaccttggtcaattgctgcactcgtattcccatttgcctctagggtgtcctgttcgggaccaccttaaaaaccgtcgaacaaggnggattccgcccaanaaatcgtggcatctcccgggccttacaaaacgtcacgtnctacctnaacggggcgctggctaacctctnatctgctttcaagattcgggcgaatacatattaaacactcttggggccctccaccctngtttatagcancctcgcttgttntatcgccgtcccctaaaatgtcgcgaaacnggtggtctattggccgcnaacanattcgcttanaagttttatgccccagnggngtccccntttcaccgacnacaatttaagctacttacctnccaaa

SEQ ID NO: 2322 - DNA, 232 bp, Fusarium venenatum
  misc_feature (1)...(232): n = A,T,C or G
natacccagaaaccctacngttgngccnacaacctgcntnactgggtcaaggcggcgaactgcctttgaggntatgctcacgntgatgttttggctgttnagaacaacacatcacccnancctgggtagactataaaactgctatctcaagtggcctcgnacgttcgcgatgangaacccgcgagttgncgctataccacaatgcctncaacagatttcttttgttttttca

SEQ ID NO: 2323 - DNA, 591 bp, Fusarium venenatum
  misc_feature (1)...(591): n = A,T,C or G
atctaatttgcgtctacatccctctaatctcacatcatgcccgctcaatacccgcggcctccccagcgcgaatcatggtttgcgccgctatccattgacctcgtcctcaaggtcctcaacacaactcttctgcacccttttgtctgctggattattccactgtgcttccgcgcgcagacggtgaagtgggaggccccgcctatggtggccgccattgcgtgggctaccataatcacgcttttctggatggccaatgtgatcaaccagcgcatcgctcatggcatcccacgtgaagtggatctgagcgaggaggttatcgtcatcactggaggtgctagcgggctgggtctgctcattgctgaggtgtatggcatgcgaagcgcgacagtggcggtgttggactgaatgagatggaaaaacacggagtccagaagtgttacgtactacaagtgtgatttggtgacaaagacaagtcccaaattgcctccaaatcnanaagatcttggtacccaccgtacttattaacaacctgctattgttattggcaaantctctttgatctctccatggacaaaatcnacanattctcnc

SEQ ID NO: 2324 - DNA, 459 bp, Fusarium venenatum
  misc_feature (1)...(459): n = A,T,C or G
cgacaaagctggtagcttccggtggaagcatggatgcatgggcttttgatgcctagatgcaaacaatgcaaatgactaaganaaattgtactaaagctcaaatgttaattaaaatttatctaggattgaatcgcggaccttgaaaagccattcccttcacctacacaactctcagcaaattgcatgttggacaattacgcgacacgcttcaagctaaggccatgcccaacatggganaaactctttcccacaacatctcctcgacaattgccatgccgggcgttgaatcagaagactcctagccaaggaccacaggaccatatcgcnggccacaggnngataacaaccaaactactgctcccccgccagcttcaatcgccggttcgcttgccggtgaaccactcttctcagtccatngaaaaacgngaaatgcncngaattcccggttgaaatngattt

SEQ ID NO: 2325 - DNA, 112 bp, Fusarium venenatum
  misc_feature (1)...(112): n = A,T,C or G
ntatgggaggatttttatttattttacgtccnngaggacaataacncggattttgntgncttcttaaaattnaatcgttnaagcctggnantggaaaaaaacganggtttga

SEQ ID NO: 2326 - DNA, 556 bp, Fusarium venenatum
  misc_feature (1)...(556): n = A,T,C or G
aggtacagttgatcaactcgaagttgtttccgccatgctggccgataccaacctanaanaaaatgcnctatcaaagaaaaagaanaaganggggcancccatggaaacacatgcatctananaaatgtcaatcacagcggcttgggcctttggccagnatatcccagnggttcgactggatttgggcttgcccactgttaccgaggaggagtacgatggccctgaggatcatattgctctgcccccttctgccatggagcgggtgatgcagtatggcgacgaggcgcatattgtggtgacgacgaggagacgtcgcggagctcaagggggcagtcaaggtgaggatggcttntttgaggatgattgcnaagttctcgattttgcaaatcaaagggtgtaagtgaaatgaaggagtcttctntcaacaggcaatatgtgcaggggttttgnggngtatggattggngaactttacttnattntatggatttgangctcgggaacaacaatccattggttatgctnttcaaatatggaaccaaattncaccttgtcct

SEQ ID NO: 2327 - DNA, 645 bp, Fusarium venenatum
  misc_feature (1)...(645): n = A,T,C or G
cttaagatggaagccacagaaaccgatcgaaccatgcccctgaagccaaaacatatgggcaatgacacgcatccgcccactaagcgacgtgtcctgacccctgccagaagagagcagaaccgactggcccaaaaggcatacagagaacgccaaaaggaagagagaaatatcacaaaagaggtcattgctcgagcaagaagtaataaccggccaagaccacttctgaagcgacgagtcccttgctccaaagaccaacaacttattcccttcaacgatacctcatcatcggatgaaacagactctgatatatcatcaagctttcccgatgtctatgtcaacatgcttcagttcttcccaacagccttctttggatcttgcctcgccaatgcagaatcactgggcttcgatctcaaccttgtcgcagactgnaccgcatataatttctccccgtttcatcaacccaacctcttcttcattgncgattactcaacccttggtcaaaaanggtcagactttctnttcacctttgncaattctagnggtcctattcatttacgaactacaatggngcaagngctcaattccacaatatatnaactttaaatttaatccctttcccgttctgggcggaacaaaccttatttt

SEQ ID NO: 2328 - DNA, 580 bp, Fusarium venenatum
  misc_feature (1)...(580): n = A,T,C or G
tggagcgtgatgctggcatggcaagatacgaaaagaagaacccccatctttggatctttatgctcttgggtcagattgtagctatttcctttgctgcgaatctgtctttcctggcattccttgttttcgaggatccggatacgtcaatcgataccgttaatcaggagaagaccgtatcatcatcctcaaccaagagccactcactgctacgcaaatcatggtttgcagtcctagtagttacaatgggctgcgccgtcgccatcccaagcaaactcgatcatcccaagttcatgtatcttctcctcgcccctcacgctctggcctttgtaccactactcatgaacaaactcattggcagtcgggagcccgtagtgatggatgaacaaccaccgcaaaaggttcgggctggcgtcagggcccttgttgctggantctgcatttatcacttactcagtccagcancaagctgctggggaattgccacnaaagctctgtntgancatccacagtaancagtgttngggtgggangtcatttgctgttggattantttctttgcttggttttatgttcaatgggc

SEQ ID NO: 2329 - DNA, 659 bp, Fusarium venenatum
  misc_feature (1)...(659): n = A,T,C or G
ttanttactaggttcttaacaagcacagttgttattctgcatttcaacgcagagatagtttgataccgcaattatacatattacattataacggaatgcaaagggtcatggccaacgttgacctagcaccttatcggcgaattgtgcaaatattctgggacccagagcccaccaacgatgtcgttcacgaccaaccagtctggtgtttgggacgctcctatcggctcaacggcaagaagaataccaaggccgatgaccaccatccacagacacctccaccagtactgaaggctgaagcagaaatccaacaagctcacgatacaagctcaaccgccaaacccgccaacaaatgcacccgacacacctccggactcgatatcgagtagcttctcttcatcactggcatacgacgacccagtggacgacgggggatggncaactgggtttataagcgatttcgaatccaagatatggatgacgtaccgatccgagttcgagcccattccccgatccaccaaccacaagcaacatncgnactttcattgnncatgagactcaagagtcaacttcgggggaccaaaagtccattttcttcggacaagnggggtgggggatngatgattcgtttaaggacaaagttgggtcgcaaatgccataac

SEQ ID NO: 2330 - DNA, 593 bp, Fusarium venenatum
  misc_feature (1)...(593): n = A,T,C or G
atcttggcggttgtgtccccgttggaggacaaggtgcagatggagttcaaggggtggttccgaaagtatctcgcagaacatgttgtcgtgagacaggaaaagtctgtggatatcctacaggctatcctgatataccttgggtggaacgacttccacttctacggagagctccaagttacgaacatcgtccagatggccatcgggctggtcatcgatctaagactggacaagttcgctgggtcatttctgggcgggccaaagactatgctcggagacgcatggacgacaatgggcagatcttgcttgaaagggaaagtctaccagtcatcagccgataaacgtgctgtattgggtgtctaccacatcacaaatttactcaactcaaacttcagaaagagcacgctcttgaactggagtacacacctatcccaatgctgtgacagtcttgtcgagggcaacgagttcgagtcggatgcatatcttgtttcgctagttcgcatgcaacacatggccgatcgtgggtatagtattataccagctttcgattttatggatcccacccnagaactttcaacgctgtgacagcgatggct

SEQ ID NO: 2331 - DNA, 477 bp, Fusarium venenatum
  misc_feature (1)...(477): n = A,T,C or G
cgctcccggacagcacgcctatttgtacctgcccgccgtcagctactggcaatctcatcccttctctgtcgcctggtacgatggcgtagaggaccccaagaatgagagattggccagcaccaaccaggatctgttggccatgcagcagcagcgaatttcattcgtcattcgaggcaggactggcatgactgacagtctctacaagaaggccgtttcagcacctggaggaaggtttgagaccagntgntttgccgagggaccctatgggggcaccactctttgactnatacggcactgttgttcttttggtggnggagtnggatacccacccgttnnttacataaagnttttgtggnggctnctccaaggtcttgtgccncccnaaaattttgtggtttgganaataaaattctgacccttggggggntcccccntggangaccnaattttnggntggaaaaaaaaaaaacttttttt

SEQ ID NO: 2332 - DNA, 595 bp, Fusarium venenatum
  misc_feature (1)...(595): n = A,T,C or G
ctttttcagaaacgcccagagattactggatgcggaccaatcgaggttctgattgatgaggggtcactaatctttgtaaagactccgtaaacaattcctcatctcgatctcgcccatgatgtaatcgacctatgacggcatactattccaccttcgacgtcaacttgcaatcattctgtgtccgtgatttcttatatctagtaaacatctgattctttctctttctcttctataatcatctgagacaattcaaccacaaacttcacaccctttcaccaccaaaacaaacacacaacgatcatcatgcctgagggacgtcaatctcctgctcccgagcaacagagcggtcgccagcagcaggatcctcctgcctctggaaagggtatcaacgagaccgataacaaggaccccaaggctcagcttgagaacctctcatcaaaccccaagggtatcaccgacgatgaggtcgagaagaagttcaccaagaccgagaaataaataaataatacccccgatggtaatgacttgatggaattattgcatggatagaattaattaatcncgactgaaatatcttgnaactgncaaaaaaaaa

SEQ ID NO: 2333 - DNA, 1172 bp, Fusarium venenatum
  misc_feature (1)...(1172): n = A,T,C or G
gcagggcgaattcggaaagtccatcggtggcctaaagggcttctgcgtcctcaacagctcgtttaacgcctttgatctactctacagaccttctgtagatttacaaaacctggctttgatacagattgatcaagcgttgaagaagtgcaatcgtcttgctccatcctctctgatagagacgcttccattagagttgatgagcagcatctatctgcaccttcagccaactgatcacatcgcccttgggctttgctctcgaagactatggatccaagcggtgactactattcaccactctcgccgtttatcatcatgggtggatacaccgatgttcattgggggtagtggacagttgcttgctcttcggcaggccagccacgaccaggaacttgaacttcaatcacctcaaaagggaaaccgagatgcagttctcgaggcaatgattctgcagaacactcaactgtttgacgtgctgaagtatgcgaagnattcagaatttgttacacgactatgctacctgacttcctcggacttgaatcctccatactttcgagaactagtccggctcttaccgtcgactggttatttcggaaaatcttcacccattgatggagtcgtgcttattccccggggaatttgacgacaaaaggcagtggtaccttcgcgatttcaccactaacgaatacatccgaatggaacttgttcaagatcataccatctctgagcatgatacgatctcgctaactagaaacccttggatgaccctagatatcttactgatatggcttattacatggcaagcgggatatgacaaaccatcaaaagaagtccctagagggaacccaagagaccaaatcaagaagatctttaccaacggtgtcagcgttaccgcctccgatattgctcagatccgtgcatatttcatggacatgtactttggtcgatgggcaggccattctttagatgttgtacagctggtgcagagcaagatggaaagcggctggactgatataacgggtgagattcangatgtctccaacactggtttgctgcgatataccttgaagcatttctacttaaaagaaacgaaatatcttgagtactggggggcgttttgcaaaaagancagatcaacaagtntgatcacaagcctggtggctggtgatgaatga

SEQ ID NO: 2334 - DNA, 288 bp, Fusarium venenatum
  misc_feature (1)...(288): n = A,T,C or G
ctggaanaattcgcggccgcnggtagaaagagaaaagcangagggacgggcatgaacgataggttgaaatgaggaaaatttgtctattcaaaacgaggcattcattgcctttccaggtcttgccagcaagtcttaccagcacaatggcgaggccacgagtgggcaggaaatcggagcgtgtgtgattatgaattgaccaaggatcttttgacttgtacataataatacggagtgtcagtntcatagctggtanttaatgagaaatgaanacttgccccctattaaaaa

SEQ ID NO: 2335 - DNA, 141 bp, Fusarium venenatum
  misc_feature (1)...(141): n = A,T,C or G
agcttctcttcttgagcgacgcggttgtaagttngaaagttttcctctacgacaacacaagagccactacaagaaaggaagagtggttcgtctgtacaagtgggtagagtgagcggaagttcagaatagacaagataaatc

SEQ ID NO: 2336 - DNA, 448 bp, Fusarium venenatum
  misc_feature (1)...(448): n = A,T,C or G
ccaaactttaaacacgcatcagtcttgtcatcataccactcaacgcctcaaagatcgacgctactacaagatcaacatcgtcactggtcacatttattggataaacccaattcgaaccaacaatacctactagtcattcagcattctagcagctcttcataaacttgatttaagatctctgcaacgccaacatcagctaccaacctactctcaaacaatatctacttntatcaccaaccaaccaaccaaccactttcatcnctttgataccaacaatcaatcaatcaatgngggtggtggagccaccacaacaacaccacaacnagacctcccagaagggttcttgaccttcaagcgagatccgctaaaattacgacaacttctatacagnccctaanaagagnggcgtcctgtctganaaaagtcacgctttttctcgngccacata

SEQ ID NO: 2337 - DNA, 550 bp, Fusarium venenatum
  misc_feature (1)...(550): n = A,T,C or G
gcgtnattgncccacctcaacgcaatcgcttnanggccctccgattctcttcggnttctgcacctctccggcaggagcttggccatggcgaaccaagagactcactatggcttcgacgaaggcggagatgacgaccagtccattgtgtcgacgcgcggactcgaggntttcagtcgaaaggttacaactacagctactnatttgatcggtcctaatgccgaagccacggntcatcactaccaagccgccatggccgaggttcacaagcaaatgaagcgaccgacggtccagcgaagcatgttcgcgatggcaaggacaacccccacagatctcatgcgctccaggctatcaacccacgaaattcagcatcgcgccttgacgtatctgcccgaccaccttntcgcaatattcccgancacnaaaacccgtatttgttattttanggctttcaggccagtttnccaaaacttgcccaaaaaagcaaaaaatttcanccgacnggtgactngggggcccaaaatggtnggaanaattaaaaangggccccngg

SEQ ID NO: 2338 - DNA, 555 bp, Fusarium venenatum
  misc_feature (1)...(555): n = A,T,C or G
caatccaataaataccatcttatcccctgcnttcaccacttngctcacctacaaaccacactcacactcacactcaagtcttcgcattcagacttgcaataccgtcaaaatgacttacacaatgactgcccacctctgcaagcagctctacgcttnatggcgccagacccgacagccttctcccgaactggccctcccaaaccagactccctcatctttgatgcgccctgcctctcgatctccttcacctcccgcccaacgctntgagcgacgtccatcgaacgcttcagactcggactgggccccgaacagacgtcactagacaacaaagactcgcgaataattgttttcttactcacgacttatgagatgaagtcgactcattgcatttgggacacggtcacggnatntggcgcatataacttggttacacctgacggagttctccctttacaacatacattgnctacgactttntgaaagacgccggcacctaccttttgacgacgtttttcgaccccgaaatttttaccctgnaaaancccaacaaaaaaa

SEQ ID NO: 2339 - DNA, 216 bp, Fusarium venenatum
  misc_feature (1)...(216): n = A,T,C or G
tctcacagaagaagcaatcaaacaccgcctttattacgaaaaaccctgtcctgtatgtggntgagtcataattgcgcgtgagtactcgagtttgattcataattgatcaaacctgaaataccantacccaacaagagtcaagaggaggaattaggtttctgtctnctgtggcancggtagggcgtttactgtctgcatggattatttgcgacagan

SEQ ID NO: 2340 - DNA, 129 bp, Fusarium venenatum
  misc_feature (1)...(129): n = A,T,C or G
naaagctggccnatgaaacccctgattnggcagtntccggtnttccgattttgggnaaaaagnggttgttttcaccccncgcgaaatgctttaaaaacncctttancttgtnttttngggaaattaaat

SEQ ID NO: 2341 - DNA, 483 bp, Fusarium venenatum
  misc_feature (1)...(483): n = A,T,C or G
caaccatacccatccatcaagatctaaacttacagtgctaataagcgcaaacactatacgctgatatcatttgtggnttctgtgcccctncatcattgccccacgttcaaggtttttggccaacgacaacctcaaacacaggttcaatacaccaaacatcaccaaaaatcccctccaccacgatcgcaaccaattaatcaggtcatcatggatcccctcgataacatgggccgggngcccccgtgcccaagaactttgacgcccgagaatgcncaaaaacaacgaagacatcgagaagcaatttcgcttgtcaagggtcgtncancacatgcanaccttacttggtncattcttcgagcggtgtcaaaggggcttttcccttccgtctnaccaaagatcgaacgacgaagattatgggagcaccttaagganggcctttncccgagtttcgaacccgccgccnaggtcaacgagggacgaaat

SEQ ID NO: 2342 - DNA, 136 bp, Fusarium venenatum
  misc_feature (1)...(136): n = A,T,C or G
nnaagcggccanccaggccaacgcgggccacgacgagnggaccgagcaccagaagccncacatcaccaagaacaacaggaccccnggcgaagnggcgaaccaggaaccncccggggcganaaaanacagaagcgac

SEQ ID NO: 2343 - DNA, 552 bp, Fusarium venenatum
  misc_feature (1)...(552): n = A,T,C or G
gcagtgtccctgtacctgcggggcgaatcatcaaccttaaacccctcagcgactccagcaccaacgctcgcgtggggagcgcatttctcgaacgctgcaatccctttagagatattcccaacgatgcgcgactcgaaaacaccctctgcgaaattcgctacatcgaccgtacctgcgcgatttgatggttccaacctctttgccggcgacgantataactctgctccaaactgctgcgcagtcttgaaacgcgtcccaattgacttgttgggtcctccgcgagacggatattaaggatacagtcagcgctattgcgcgcagaagtggangaagactctattcctgatgancctcatgatctcatcaaggtcaagntcttgaacgacttggtcagcgctggaaaatgcnccccancttagaaaatggancccaataccccccacncaccgccattgttagaanggcngaagatatgcccnactgacaacaacaacccactgcggaattgattcgcgaatgggcccgatcnaanaaaaaggttcatactaaaat

SEQ ID NO: 2344 - DNA, 658 bp, Fusarium venenatum
  misc_feature (1)...(658): n = A,T,C or G
atcgcaagtccggtttctgtttttggggtctcttacccttttccccctttgtgtttctttgtccccctcatagagcaggtctcttatacttctaatttttgttgtctctaatcccaagaaatcacccgcatcaacaatctcgaaactcaattcaatcaagttgctggtcagcttagagacaacatcccttttaacgacattttttgttttttgttatccaatcacgcccgctataatagtctaattacagaaattcacggatttcacttgctcgtgccaactatcaaatcaacatttgcactcttttcagcaccctgctacccaaacaacttcatataaaataatcaagtcaagtcagcatgtcggctattcaactttctttctctctccgcgtctcctctggcgtcaagactgtccaccttctcggtcctgggacgggtatgccggccagcttcctctctccaaggacaaagtcctcttcaaagtccggctnctggaanggcacctttcgattccagaactcaactcttgaggntggccaacgatactggnactactacatcatcgacgggtaccacggttggccacaaccccagcgntaccttaactggtgagnccaccancggccgtgagctgnacaatcttgacgtccaccgnt

SEQ ID NO: 2345 - DNA, 555 bp, Fusarium venenatum
  misc_feature (1)...(555): n = A,T,C or G
gtggcaccagccaaagcattactctctccttatcgcatccatcgagagacaaggcttcaccgtcatcgctccgactttggcctcggcaggttacgatgactcagtcgatggcaaggccttggatgacgacgttaaagctattcaagatatgattatgccgtatatcgatagcgggcggaagatcatcgcagtgggacacagctatggtgctgtaccgctacaggtcgctgtcaatggatactctcaggctgagagagagcagaaagggcaaaatggtggatttgtgtcagtgatatttatcgcgccgacttctgtgttacagaaggatatctccatgtacgactctgttggggggcaagtatacgtcagcttggtttcatgatgtatccgaatacgcctacctntgaagaacgagaacttatgggggcttcttactgatgtggacaagantgtcgccgatgagataatcccacactttgncatcaaagtaaaggcccttcgaagtttccgttccttgaccccggcggactgatcatcccagatatggtgttgtca

SEQ ID NO: 2346 - DNA, 574 bp, Fusarium venenatum
  misc_feature (1)...(574): n = A,T,C or G
ctcgacagctacactatcagaatatctttctttcactcaacttctgactactaaactgcagcgagccgctaatctccttgactagcgctgacacctatctcctcttnaaacccgattaccacgttgcccgcttggctactgccttgcctcatcagccccaaatcaacgttctcagcaacgccaagaaggtcaaagaccantccacttcttaaaagtggagacgtggacaaaattccgctgagctatcagcctttgnggagacacattcgcatcttcgcgtctacacacctacaacatttataaccacacccatccatacctttactgtactcccacgccctgggcccgatctgatctagtggggcactgcgtacaagcttgagcttggttctcacgaggcccttntttataaggacgctgacgacctaccaaggnactggatcatttacccaaaattnttntttttttgacctcctccgcccctgngnggactgtcctatntttttcttaccaataacaacaacattacctnacatnacaacaacgttacacacctttacaatggaaacgtacc

SEQ ID NO: 2347 - DNA, 549 bp, Fusarium venenatum
  misc_feature (1)...(549): n = A,T,C or G
ggttagaagtcctccgccgcgctgacgacagctggctctagcttagtgcatcatgggacactctctgtacgcccgcaccacttcctttccactacgatcccctgcaacacagtgccacaagtgcgaacacgggcgcctctcgtaaagaggctgcagcagccgccgcatctctgattaatggcggctcaagcacggagaaacctgagccgagccctgaggaactgcgccgacatcgcctgcgcgagcgcgaccagcgggttcgtgttgctctcagtgaccagagagtttgcgatgaggatacgttccgcgcatctattgaggctcaggagaagcgtgcagagcangaaagaccgtgctgccgctgcgccacgcctaatggtgcattcaatgccgacngacgtccgagcgatggggtggttgacncagcgaattctacccgttgtnccngagggccacataatgntnatgggtttgcgaacaccctggtccaagcccacaagngcaanaaagacaacggnccaaggaananagaacattggttactttgga

SEQ ID NO: 2348 - DNA, 631 bp, Fusarium venenatum
  misc_feature (1)...(631): n = A,T,C or G
catctttaatcaaagcaacaagtccgtcaccgacaatggcagccagacgttcacagttcgtcgacaccacagccacagaggcacctgggctctactatcaggacccaagatacatctaccatgttccccagacttcgctccnaaacatggcccccgcgcctattcgtatgaccgaagattactacaatcagacgtatcctcttccagcaactcccccaaccccttacattttcaatgcatgttgccgcggtcgtagccgcagccgccgacgtcgtgcctcgcgcccctccaacacctatgatagcgatggctcaacggatggctatccgtcatatggagatgcccagccgacccagcanggagtagatcgccttccgcctngaatcgctctgaaacaactctcagattttctttacgcggctgntattttctacgataaacagctcaacgaattcgctcacaagcattataatagcggctatacttccaacaaagctcttcgccagttgctatggaaggactggatggcccgacgcgacgatgtcacgctcgaatnttttacgtctacaaagatcaacaccacaacgctgtttcccaggtcgangcaactgctgaaatgccatggntggga

SEQ ID NO: 2349 - DNA, 726 bp, Fusarium venenatum
  misc_feature (1)...(726): n = A,T,C or G
atagtattattgcccgagtactcactatccatntgtactacaagagctctgntcggaaacaacagaacttnttagaatattcctatcctagggtcaccagagacatataggaccagcagntattgcaagtggttgttaggtacctttttggttaccccaaanacgccantcccgnaggggttnaggccgataggttgaaaggaagtntcgagtttttacctnagttaccttacttacccgcaaaattaacttcgaacaagacacacgcccccaagttcactaaagccagacgtcggaccggtccaagancccaaagaccccttttttntcgtctaccccctaatcgacaattcctnagtggcgnagccactatgacancgtactgacacaccccgtaggggtaagactcaanttagtctntgagcatttnaactnaagctcgatgataaaacggggccggtccttcttcttctttttcttcatttcttggntnaacttcatcggcattatatttccccnaaatgggttctggtcnaaattnctggcgaagcgngcccaggcnctgaaaacctttttttggtttggacnaaatcaagggcgacnaagtnccaaaaaaatgatnttgggttcgggcatccganaagaaaagnnaagccctnggngtggcagtcgtaaaaaaggttatgaancttcgaaagaccttgaattaacnccaatccccccaat

SEQ ID NO: 2350 - DNA, 811 bp, Fusarium venenatum
  misc_feature (1)...(811): n = A,T,C or G
actcagcttatgacggcccatcacagacgtggctatcgttatccccactgagaactttaagaccgagacagtgtcttcctccatcttgaatctctacttggatctatttttctgtcaacaattacttgggaatagcctcagcacaaaatgggttcccaaatcgcagagccagaagaaattaccgtgcttgtcacgggctttggtccctttagggaacaatatcccaccaacccttcgtgggagatcgccaacagtttgccgtcacatctgccaccattgcgtgccaaagatcctaactcgaggcacgcggctgctcttctaccaaacgtacgcatctcagtacatccagagcctatccgagtcaactatcaagttgtgagaagcttggtgccgcattctacgatacgcctcggccattcgacgttggtatccacattggcatggcgggtccgcggccttctacttcatcgagangagangtcaccgtgacgggtacaagccccagacgttgatggcgaaaatattgactcggacgaaaaatggtnaaaaggatgactggggccttggcganggataccagaagagatagaaaccgactgnattttgacaggttcttttttatgnaagggcccagttcaaagttgatgatctccgatatccgaanagcaggnactactgggcantttatttactattcagttggcaaactggggaacacaaccggcaaaaaananggggtcttcntgtccggnaangcttttcttaagggtganaagggaggcttgcattgaacctgaaccaaccatggcna

SEQ ID NO: 2351 - DNA, 633 bp, Fusarium venenatum
  misc_feature (1)...(633): n = A,T,C or G
tttgatttcagcaaaaaaagcccatcaattgagcttcggtcatggtagacgagaataccacgtcgaactcttccgggagacccgctgccggtgtaagctccggcttcagcgccccgccctccggtcatgggcttcggcgttccatgaccgtgtcagtcgccgaggaagctgcatctgcatctcgacgtcaacccccggcatcgcccagcttcgattcgatcccccttcgccgcagttcaaatttttccgagtacagcctcaatgaagctcgagatttcctaaacccccaaccgcgagatcctagtaatggcgattcatctttgacagaggaatcatcgtctttaccgtcgctgtctttggcttttgctttcctaccagctatttctggtcttctctttaagaatggcagtgcggtcgtgacagatttcatgctcctgggcctggctggtgtttttctcaactggtccgtaacgcagccatggacttggtatcactcagcgcagcaagttcggatacagcacgaagtggtaacggncaatgtcattgacgatgacagtgancttggntccagcactcaagggtccgggggccaactcaactcctgaccatgttccaaaaagatgaanaagtgca

SEQ ID NO: 2352 - DNA, 679 bp, Fusarium venenatum
  misc_feature (1)...(679): n = A,T,C or G
acgccactgcctcgcatgattattctgtgagcttgctatatctaatgatagcagatactttcagcattctatcattaaatatcctttcaatatcacaacatcacaactcataccatggcgaattcatcaaagactgtcgcgttcttcggtgccagtactggcataggactatcagcactcaaagaaaccttggctgctggtcaccactgcatcgccttgtgccgagtccctgctaaactggaaaccctcatcgcagaacatgccaatctccttgatgttgttgagggaaatgtttatgactccaaggccgtgagcagctgtttactcaacaaggatggcaaccttgtggacgagatcctcttctcaatcggtgccaaacctgtcctctggaaaatgactcttgatgaccccaaagtctgccaagtcggcatgaatgttgttctcgaatgtgtcgcgcaactcaaaaacaaaggcgctaatggaaagccacttatcgttgccctcagcacaactggcacgtctcgctttggccgggattatcccatggccttgttcttgatatactgctacgctttgaaagtacccncgaaggacaagatcgccatgggaagaaaatttggctnggaagtggcgaaaanttttgcattgttngaaaccatttgttngtttaacgggcaaa

SEQ ID NO: 2353 - DNA, 592 bp, Fusarium venenatum
  misc_feature (1)...(592): n = A,T,C or G
gatggacagagagaacttcccggttacagcagttctcaaatcctccaagaaagcatccactctacgctcaaaatacctcggagagtcagacagcgaagactaccgcgttgaaagccaacgaaccatcatcactgaattccttgaggctgttcacgactttatctcagagagctcctccgctatacctcctcctccaccagccgacgatgaagagggcagagatgtcngcaacagcaacagcagtttcgccaaccctgaaacaattgcttcatctcctcactcagagacaaacgaacctcccatcccagactacaatgccatcggtataacatccacaacacccttcgcatctctcttcgccacctcgccaagaaagaactctccaaccatgaagttatcgaaacagcctactctcgcgccatggcgcctgcacattcgccaccagantctcgagtccccacacgcttctacganatgaaggtcatcaggttcatgcctcngaaacagcacgggtgagcatgatntctctcnaacggcgcagtggngttctcancaaaaaaatggaaggtttcacgcnccacccaanggttna

SEQ ID NO: 2354 - DNA, 543 bp, Fusarium venenatum
  misc_feature (1)...(543): n = A,T,C or G
ctcaacctcacaattcttctcactcaacaacagccgccgcaccgtcttggcttccacgcccaccagcaaagcagagaatggctctatcattcaaaaacctcgtgagctccgtgctaggctccggaactgccaaggacgacaagccgccatcggcatcggagctgttcgttaagacagaccccaaggtagacggcgaggagtgtctgcacgattgcgacaactgctcggcccggtatccaaggggctttaagatcgaagaggaggatgtgctgtatggtctcgttgcagcttggagtacgcatgttcttgttgggacgggaaagacagattgggtgagggatgtggaaaaanaaaaaggcagtgtcatgcaactttttccaaagcagttgaaccttcnaatggaaaactcaagctgtcggcatctaatatgcccactcccatgaccagatgactactctgaaccacnacacttctactcttgccggcattcaagctttttgtaatggcatcctttcagcgngcctaaatattacagaggcatna

SEQ ID NO: 2355 - DNA, 112 bp, Fusarium venenatum
  misc_feature (1)...(112): n = A,T,C or G
ncatgccctggntgncgattctacttatgcggntagtactagganaatcttnaactgcaccgactggncttctganattngggaatanggcttttgggaaaaccctattggc

SEQ ID NO: 2356 - DNA, 748 bp, Fusarium venenatum
  misc_feature (1)...(748): n = A,T,C or G
ttttcttcttattctttcgttgtgtttgttgctgtgcccgtcatatcccaacatttagttaaacaacaaaatctccgtcggtcaccatgatcatcacgcgcgccctctccatcaccaactttgttgtcgccagctcagcgctcagcttccaggtcggtgtgctgtacccatggcacaagcagctggatgacgatttcgaagccctcaagagagagcatcttcgcgtcctgaccgcagtcgagggcaagatcggtcgaacacaagaacctgcccttcttgaagagaaccgaccgggcattctgagcatgatcggaaacttggcgccatggaaagcctgagtgcagagccgacttcgagaccgttacccaaaacacaacacaacaacaacctcgcatacccagccatcatggnatcgaaaaacaaatatatatcagaaaaaagaactaaacgattcaaaaatccttttccgacgacgaattacatggtgttccatctgttttgcatcaggcgttcctcgtttctggctttcacattcactcgggcataaagtgggggccggttacgggtcacgcganaccggnttnacccgacgaaagggatccgaccggntgcgaattgattaatggtcatcagttaggtatcggcacnggatatatttcgcatattgttatgtttagatcattcatatccatcgtgttttagtttgcggtactgttactactaaataaaatatttacaagctctcgct

SEQ ID NO: 2357 - DNA, 556 bp, Fusarium venenatum
  misc_feature (1)...(556): n = A,T,C or G
cgctcatcacatacttattaaaagggtcagggtcctaagaactgaacatctttttcctaaaacctgggaaacgaatccgccaaatccgcctaagcaaagaagaagttcacactaatccacgggaagggaatggccnatgtttcagtactttaaagaaaaaaagaaaaacgatcaaactaccgtccatgatgggactcttcaatgagaaaccttccgtcacttcaccaaatactctcccttgcccaggtaccactgtacggggttataantctcgttgttttgtccaatgccacccagatatcccacgtcgtcgagaactcctgctccgtattctcaatatgatcccgcnactgaaagacatcaccatcgatnacttcgtcagggtccccaanaagatacttgtgttnccaaagatccatacacgatcccccncnttggtttagcatncaagaaaacgccaaaatccactgctgaagatccatttgtcttaacctccggtcggganngatatactgaacccctgaaccttccnctgttttgatgccaacatgatttc

SEQ ID NO: 2358 - DNA, 160 bp, Fusarium venenatum
  misc_feature (1)...(160): n = A,T,C or G
ngacagctacagaanttagacttgatgcganngttacaagnaaccntgacgggctnagaccagcaggctcgaggtagaagaacntggcaccatntacantgcaatagnccatnatcaaggacaaggagggtantcctcggaccaacanaaagtgaacttc

SEQ ID NO: 2359 - DNA, 575 bp, Fusarium venenatum
  misc_feature (1)...(575): n = A,T,C or G
gccgcaggaaattttttttttttttttttttttttgaacccaaatcgagactgtattgaaaatgagattgtatgtagtcgcttctaataccgaaatatgaacccatcttgtaacgccctaccactatttacgttctaagcctgccttcttccactgtacgctataagaaacccaagcatgaanagtgcaaatacatagtgcaccatccaatagtgagagaatttcataacttgagaccaagacaaatcgctcgaaaaacaccgataccgccgaataaggaaaatctaacaaaaagaaaagaaacgctgttgcgggatagcccgtctgcccgctattccttgggatacaactcggtgggtaccttgtccttcgggccccggccactcgagctacttcctatgatcgtccgatcgtcaccatcgcgctcagggtcgtattccccaaaatctctggtgtcgggttggcgaaaagggttcccaaaacgcgcggtagcttatcgacctcattatccgactcggtatctgtctcgtgctctgaatcgaacagtctacgcgcgctgtctcatcctcgctgtc

SEQ ID NO: 2360 - DNA, 459 bp, Fusarium venenatum
  misc_feature (1)...(459): n = A,T,C or G
acctccaattttccggaggaacagcgtgcggacacagcatgtgctttacaagattgggcagatctttaaacaccgacgatacggctgggtcggtgctgtgaacggttggaccgaccagggtacgcgacgtttacccatgccacatactgtggctattgacgagacgctggacgataacagcgatacagaactgcccaaccggcttngaccccgcaacaagaccttctacacgtgcttacgcacaacagggcccgaacgccatgttgtcgccgaggataatatcgtgttgattgaggatncgagcgagattccagattctntgttcggcaggctgggaaattttcaagcgatttgatgcccgagacatgcacaattcgtgtncaacattaaggaacaataccccgacgactagaaggacgnacatttttacgctttcaganctttcgtgatgccgtgggt

SEQ ID NO: 2361 - DNA, 671 bp, Fusarium venenatum
  misc_feature (1)...(671): n = A,T,C or G
ctgggnttacactaaatcaaagggacttactctggtcgcataaacgaactacaatcacggcgggacgaaatagancattggcaaaaagaccaatcatcgcatctggtttaagtatcaccgcatcgcatcgcaactacaatcgaattgacactcgtctcaacatctaatcaccaacaaaccgaccactctttgcgcaactcgaagaaccctttgtcgccaccatgacagacacaagtgacaagcaatgggccaagggcttatctacttgatcctttaaacgaacctgaaccaaaccaagacaccggtatcggcaacctttcagctcaattccgcagttattctctagaaagctctagctcaacttcaagcaaaggtcgttccgagagcaaaaacaagcatcgatcaagccgtaaacatcacgggaaggttatcctaccccacccacttctgccagtccaactcgcgacagctttcactattcaaacccattctcagacgcttgcaagcttcgcgacgggaatcatctgtcccttcaagtctcaaattctnttcaccaaacttttcttctggcccaaggtaataacccattcactatttttttgggcaacccggtcancccngcgcccgagtttcttgcnattgnaagcccgancttaagtncaacacaaccg

SEQ ID NO: 2362 - DNA, 637 bp, Fusarium venenatum
  misc_feature (1)...(637): n = A,T,C or G
atgacatgctacatgactggtagaaacgtgggtggaaagaagagcaaggagcccgatatcaccgtggcctttttccgagccaagcacgactcgatattgaccatttacgaacctaatatggcccgggttgagattgaggaccgaagaggtcttgaaatcactcttctaatgagtgcagaaaccataaaagatctctatatgaacccaagccaggatcctttcaacatccttacctcatcgaatggccgacgtcgccagaattctcgtccagcagcaaactcttccaccggaccaacaatggctggagccttgaacaacaatcggccatnatcacctnctcgcgcccagcccgcgcagcaaaccccaaacaacgatgctcaacgccaggccggggttgaagccganacaaaacggttacaagccatggtagcggaggaggagcgtganaaactggagcgtgagaaggaagaagaggaagagccccagaggatccagaggatgctggaaactgangaacaanaacgtcggaagcggganggccgaggttgatcaaganacgganccctacntcnagagtttggcatgggccggccaaaatttcnacaaccaaacaggcgcaggncanccatcancaccg

SEQ ID NO: 2363 - DNA, 345 bp, Fusarium venenatum
  misc_feature (1)...(345): n = A,T,C or G
actttttgagaccaactggcagcctcgaacaacaatatgacagggtgtttgatcgacaggggaacttgtagttgtttcgccttgggctttccgcccgcaggaggtattgtgatcttgcatgatgttggtaaatgctgtgcttacagcgaggacatggggactgagactgtacacacgttgaagagggcagggtatatagcgggggagccaacgaatcacggccgataacgacaatgatgataacgataatggtgctcctttggcggaatcttcggtatggtttggttattaaaaggcggtcaatggngggcgaaggtatagagaaagaattgaactgattttggt

SEQ ID NO: 2364 - DNA, 1008 bp, Fusarium venenatum
  misc_feature (1)...(1008): n = A,T,C or G
gggacggcttcttaagaacttcttcggcttcaatcaaaccacaaagggggcttcaatcttctcttttccgcaaccaaacccgggaataagccttcaagccacctgcagagcccggtgttaccgtaccgtatcttaccgtaccttttttaccgtttcttgaagggaagcacataccgcatctccactatccataaatcgaaactgaacaagaagctccaccatttctgttccacacacccctcccctggaactctcacatctctctttttcttttttttgctcaaggctccagaagcctagtccaagagacagagacagaccccccctggtcaactttctnatccttcttaaactaagcacccatccccttgaaaaccaagcccgggcgaagtaaaccaagaccagaagtcaaagcgccaacacattcccatccacttgaaacaaacagaaaaaggctttagcttccttgctttgtgctcccatctttccctttgtataaccaaatcttctggggactcttnaaaaaagaacaactactgttgctacctactacatatatattcacactacccaccacatatcatancctctcttctctcctttcatcatgtctggcagaccttcaagccaccactttggatcaaacagctcaacatcatcttctcgctcatcatcatcatcctcttccgactcgggttacagacacagcatggacgccattgctctccccatcgcctcagttgaagttgttcgctgcatgcgatgcgctcgctccgtcgaagctacttctaccgacgactcagcacaatgggcatggtcgcatcgccacaacctttactactgtgaacgctgcgcaaagatggtcggctacaaataaatggatagcgtcaactgcaaaaaggttgaaaacaatttcgaaaacaaacagcacacgaaaatttaccttcgaaactggcttcagcttctaatttcctccttctgggtggaagggaacaaatcatcaaccaa

SEQ ID NO: 2365 - DNA, 499 bp, Fusarium venenatum
  misc_feature (1)...(499): n = A,T,C or G
gggaatggtactgagaggcgccctctgcgaaccatcaaancttcgattgccaagctataaggatatcgccgaagtcaacatttcctcacaatcaggacaatatcgtctgatggcctatcaaaatacccaagatgtccttccgttgttttacttgcccgagcttcacagtctttcaatagcggttgacagcccagaagagttcgaatggccatcgacagcaccccgggtcacatcagttcgctctttaaacctctataggctcagagaaattcgccttcggcccctcatgtcggctctcaagaacattgaaacgctcaaatgggacttgtggtatcagcaagaccttgataagacagtgagcaagccagtcgtacagcttgtcgaactggcatcggccctttgtctcatgagcccgactcttagagacctgacgattacaggcgacagttgcccagctttttcgtgtggcgactacgatcccccacctctgtacttcgag

SEQ ID NO: 2366 - DNA, 463 bp, Fusarium venenatum
  misc_feature (1)...(463): n = A,T,C or G
taagtgtggccgacttgatgacagctaccgatgagagagtatgggataggatatctggatacacaatgttttcaacacacctgggcaaccaaacatggaaggtcacgaacccgcttggcaacacgcataacctggaataccctcgcctgtaccccgacaagacctacgaccactacctgacgattatgacgcttttacgacgttacgtctagacagctatactggcttctcctcatcaggctgtgtacatcgccagcgatgggaggagttgcctctgcgactacaacctactactatacccaccaaataatttctgtctaggcgctgtcctggcatgaccgngacgatgaagacgatatggagacgcccgagtncggctattggactattggcacgcaaagcaaagggcggntgaagttggagtgaaaggccgcgttggaatggaaaagaaaaaagttacaat

SEQ ID NO: 2367 - DNA, 643 bp, Fusarium venenatum
  misc_feature (1)...(643): n = A,T,C or G
ctttttttgactataattatgacgctcaaagctctgcatcgatttatttacccctccttacagctggtgtgaacgtgggcgtcgggtgggcggtgaatgaatacctcactgccaacttacctagcatcgaacaaagacccaactcagacaacctgcgcccagcctgattctgagtccagcgcatagatttgctggacaacacctgcgactgataggctttgtttcttgttcaattatccaagggaaatcaggtcgataatcgaaactatttcctcgtcaaactcatacacatagacaacaatattctaacttcatcctaccgtcatcatcacaccgagccggcgnacgccatgggccgacgaacgctcccgatgccagtcccaagacgaacccttaacgttgagacaaacgaagacgcagagacacgcgccacccgtcgcgaactaaagcaatcttccatctccgatccttcaacatctggcctgaagatgctgccaacacctcggatgcgcccgataaggatatgaaggagcagatcacttacctaagaagaacgagcacatgatcaactagatgggagcaagaggaagaagagaatgatccaatgngtanttcgtccgatcggcaagaaggtcctacgang

SEQ ID NO: 2368 - DNA, 569 bp, Fusarium venenatum
  misc_feature (1)...(569): n = A,T,C or G
gttaccctatctctttgtcatatggtccttgagaaagagctttatcagcaataccaaactctctagtccccgagatcgccacccgtttgatgattaacactaacttgcttctcccctttggcatcgaatagcgctccacgccaggacaggactttcaacttgcatcgtccaccaggccgacttgataccctcgatttggttttattcgtgctccagactgttaccaacactgcgtcgatacactcgctgctaaattgtnctgtactccatcacacgccacatacaatgccaacgccatcatcgaaccagcctgtcgaagcaccttcaccgcgttcctatagtttctcaacatgtcctgacgacgtccaaagccaaccacaccctgcctggcaagcacgcaacgaaaacaagcccgtgctgatgatgttggtatccagtccggnancgtcaacgcgccaactgcacctgggtgcccgaatgacganaccatcatgttcganngtcgcccatcaaacgaactatcttcaagatctacaaccatgttnccacgccccaaaacgccacaacta

SEQ ID NO: 2369 - DNA, 633 bp, Fusarium venenatum
  misc_feature (1)...(633): n = A,T,C or G
ggtccanattaggtatcttagggaggaactgcaacatatggggctntattacaacaaccagccanaccctactgctttggagttcgagccctcggcagctcctcaggaccccagagatagtggaaacttcgactcgctttctcacctcaactcgccaccgnacaaccagttcccaccacccgacgactcattttctggcttcagncgcgcaggattcggtcaaatattgtttatggaccacaatgcggctgacaatgccgacnatcatcagtcanaagccgacttcagggctaatgccggacctntcagccctactgcccattctnttatcccttcaggtatcttngacganacatttgaggatgctgccgagcatctgccaaaccaatatttgccanaatctgttacagctgcanaagaggacaatccgcaatcgccgctgtcatcggatggacnctccctgaacatgttctccanccctcacggntaattttacaacttgccctttccccagtacaangacntggactcttaatcgctcaacatnaacttatnttcccagaaccgtttttccataaagcacaaacttttaagttngntggctaactttcaacgcagtagagggccaaacct

SEQ ID NO: 2370 - DNA, 584 bp, Fusarium venenatum
  misc_feature (1)...(584): n = A,T,C or G
gtgaccaattccactaacacgacctttgtacttatctcaggccattaattgtactttaccctctttgcgcgctgaatcgaagcaccgtctcttcgcctgtcgcggttacgcttcgatttcattattctgaggtcatccatattggtcgcgccgcgccttatcttccctacgataatagacatcatcatacacgatggcctctcaacatgagcgcagactgccatccaagcacaacatcctcttgatcgagggtgttccagatcatatcgatatggtttcgcgtcgacgccttgggcaaactaagcttacgcctaagatgaccggctctaacgactccgaacttggtgtattcgactacgcgcatcttcgcgctcctctgcctaagggcatcgtctctggaatcttcaagtccagccctagcagctatttcctcatgcgacgcagttatgatggttacgtctcggcaactggcatgttcaaggctagcttccctatgctgaagcttccgatgaagaagcagaacggaagtatatcaagtctcttccgactacganccacgaaaaaaacgccggtaacatctggat

SEQ ID NO: 2371 - DNA, 504 bp, Fusarium venenatum
  misc_feature (1)...(504): n = A,T,C or G
aattaattaattgactcaagaacaacattgacaaccttatcaataatccaatcactttccaagtctaagatgctttctttcgtaaactacactcctcgaactcatcccgagcacaaaaacaaagaacattgccgggtacactctgatccatccaacatcccacgcgatgtctcccagaaaacacccgtcgttgaacccaagtcctccgttccacgatctactggtcctcctgctcccacgactcaagcttaagcgatgagcataggcattggtcctacgaggcaaatcccttggaacagttcaacggaaggatacccgtggagtacaaggcgtttttattagctggttcgctgcaacaatatcgataatgggatgcaattggcatgtatttgtctgttcaacaggcgcacttggtgtaatgaggatatagtagggaaaatgaaccatgggcaaaaatcattagctacttggggtagcttggttgggctttggttnanaaaaaaa

SEQ ID NO: 2372 - DNA, 575 bp, Fusarium venenatum
  misc_feature (1)...(575): n = A,T,C or G
ttttcgcctccaattttttgaagagtaattcgccccctcaccagaaaagtaagacaacttgttcttatctcttggccaactctccaagttccgacccagccaacgccaagacaaccgctgatcttggcaatgatacagttcgaaaaagacaatatccgaaatgatacatacagtatccgacacaccacatggggaatggtccgaggttatctacaaccgctcacttccgactccgatccaatgagagtctcggtaatcaatactgcttctcttggcgcatgtcttggctgtcggccgcacacactcacgctctgaccgttggttttgggcgtaaggatcttttgtgctgccagcagccactgactctcaattctaccaggaccttgttttgctgtgactaagaaaaatctgaataaggacaaaaccgacgcgacgagtctggggaaccagtttgcggggtaaacttgacctggggaaacgtggcaacnttgttggagagatggaatcccncaagtcanttntttgcaatagtttttttgactgncgccgcaaaataaagataacctctctggtcc

SEQ ID NO: 2373 - DNA, 296 bp, Fusarium venenatum
  misc_feature (1)...(296): n = A,T,C or G
ngttgttngggtcactcttgttccccnttaacatgccaaagcgttngggaaggatctcnccttttgtttccttcccatgttgatcggttcgcttangcaggtatgatacattgngttctcctgggtcatttgtttaaagcacaccttcccaaacagatattggttatttgtagatcaggggtttggcaacaaccagagatcaaaaccattactagctctcgatcaaggtttctgtganaaggcggaactgacaaataccttaataaataatgcataggtaataattgctcctctcc

SEQ ID NO: 2374 - DNA, 258 bp, Fusarium venenatum
  misc_feature (1)...(258): n = A,T,C or G
nttgtaaccacttntcttgatnactacataccattttcctttgtcatgcgttgannaaaaaagttaggggtgcgtcttttgataatggacgactgcncttttgggctccgatagacggaatgctctgttanactaccaccgnggaggaacgaggaaatgacatgggggattggaggatcccaactgtgtttganccctcaacatggtgggtttggaggttggcaaatagttagagccaaaatagacttgattacgatc

SEQ ID NO: 2375 - DNA, 650 bp, Fusarium venenatum
  misc_feature (1)...(650): n = A,T,C or G
agcgaaaacggtccagcggtgcagcaaagattggagagccgcaacgacccggcaaagtacaaaagcataagcgaacatggtccatgtcttcagcaagttctgctgggggcggtgcgagagtgactatggaggaagacttacacttcaagcttcaaactctgcaggacatgttcaccagtacacgccctgtcagtgtattatttctcaggggtgacgaacccgacgaccccgatctacacccagtatctcttcctggagatatttcacccctaaccaagccaggcgaaggtcccaactggcaggccagaagtggacgaagctccgccgcaggttctatgatatcgccttcgcctagctctttgtccctagtatcacaggcgtccggaattggcgcaggcaatcaatggaagaattttgactcggtgccaggtggtgaaatgtcacgcaagggctctgagcaacctacaagaattaacaagggcgacgatgagggcagcctcagtggatggatcgaggccctangcgtcgactcatctatcgaccaccacangatcgcagcccgnaaccggtggnctgcttttacattcaacaaccgaactcgnatgactcttggaaatgcttnttancaccgngctatttanctggtgcng

SEQ ID NO: 2376 - DNA, 204 bp, Fusarium venenatum
ggctctgaaatatgggagtttcgtgtggcccgcacgatgcgtttatgacaatgggtacatgaacttctttttttatgatgggtcttcgggattcacggcgatagaaagaatggactcctcagattatgggtgttctggtttcttaactcatgagcgaggtaaattagcccgctcaacccgaataaaatatcctcatgcatcatg

SEQ ID NO: 2377 - DNA, 627 bp, Fusarium venenatum
  misc_feature (1)...(627): n = A,T,C or G
atttcaccattatccccttacgaaactgctttctctccagagttgaccatatatcattggatacttgattcaaaatcaacacagtccattcttatactacattgtctccagttgccctttctgtctttttcggttgttgctccctggatttgacttgtctntttcgactcctcagcaacctacactatccaaacaacaacaacaacgcttcctagccaagactaccggaacttgcctgcttttctacatctctgcagtatatgaactctacaccagacgccttgctacctatacatntgnggaaacatccgcaaattcgtcaccgccaaaactacgtctctctccctttgcaaacgctgctgagtatccctgtcgcctttcaggtacacacgcaacagcccacgagaaacccattagtctcgtgttcctaaaagcggaggcaattctgagctatcaatcccttcttcagtcccccgagtctanacaggctccgcgactagccatcccgttatttagcccgcttcacttcactacgcctgngctggcccacattcagcacataacatagtattagagtcccctggncataccaacaggcggttttctaccaantctncaactttacnc

SEQ ID NO: 2378 - DNA, 590 bp, Fusarium venenatum
  misc_feature (1)...(590): n = A,T,C or G
ccgacaaagaccaccaataccgccgcatacgttgcaaccattgtctcagtataacttgccttggagaaaatagacaaggcacccgcaattgcaaaaccgaaatactcaccgtcactaagctctttacaaccgtaacctctggcagccgcataaccagcatcggcacgaccagcattgatccccccaagaatactaccaaaaacctggctagatccaccatcggagatacctgttcaggaggctcgttattgaaatatttctttgtacggttctggtagtcgtggtttacgttggtcattgagaaagggagatggcgctttagaacttcgcaaaggttatcggtgggaggggtccggcgaaatgacgataggccggagcctttgtcgacgaattggtaagactttgcgcttaaaacgcgttctaaggtcgagacgaccacgttgggcttgaaggcccgtgatggggggtcaagcggntcaagtttcataatcgcggattgnaattgcaatggggccggtgtgtantggncaatgagtttacgatgatttggcccgaagtnctgaattgggtaagacttgcnaaggatcact

SEQ ID NO: 2379 - DNA, 478 bp, Fusarium venenatum
  misc_feature (1)...(478): n = A,T,C or G
gttgtcctggaatagctatgatgtttctcttgcacctttcatcacattggtgtttacgaccaagtttagaccttttgggcgcagcctcaccgcgctattccgaaccctccccgcatcatcgccataccccctcaattgtcgtatcattgcaactgcccaagggaggatttgtttgcggttgttagccgaaaacagaaaacaggctaacaaacagccttgacgtncaccacaccacatcctcagaccttgactcgtctccaaaatgggcacaggaaattttcgcacgacgtggcaaacttaaatttctcgggcgcaattggagacgaaactttggacctcgaactcaacagagatttaacgttatggcggcgttcgaccgtgagaatgaaatgatattatgaacattgtttccatatattaactttgacagggggattctcaatccanacnatggctctggttganttcgggatacttc

SEQ ID NO: 2380 - DNA, 568 bp, Fusarium venenatum
  misc_feature (1)...(568): n = A,T,C or G
ccccccgaagggccaaaanggttcaggcctttactggnttttttnggggaccagagcgcacagagtcctncgaagccagnaaacctgtgtttggcgctgccaagtgganaaagcgtgaggctgcccgngacgctggcgaggcacctcctgccgaaaggtcccgattctaatgaccgacaatctgccggnggtcctcccanaatcgcccttgctggcaacaagcccagttggcganagcgtgaggctgntaaacaggcggccggtggtagcggagccgatactggatcttccgcccctccacctcgcttcgcacccaggggtggtgcgccacctatggaccgaagcggcttctggccgtgctgatgatgatcgaaagccgtntccaactcctccagcggaatctcagcctgcatcacgaacagctggcaagtgggttcctcctcacatgaggggcaaataagtggttagggatggcatttgcgactcatggcgttaatagttttgcttccatgtaggaaaagtagtagtagtccttatgaatcaatacaagcgactaagcacactgaga

SEQ ID NO: 2381 - DNA, 350 bp, Fusarium venenatum
  misc_feature (1)...(350): n = A,T,C or G
gatcatgggccagcgagagacaagccgccttgcngngggcatanctcanagtgcaattaacggtctangaagcctcagttccgggttcagagataccattggtcaagacgccgatgtcattgccaaagcggccataanagctgcgcagttggcgaaggagggaaaggcaccgancaagtattggattctcaacgcaagcgatatcattaagctgggcaggactgagtggccangcaatcanactgcagctacagagaccaanacggagactgctgcatanagtgcatggaaaggaatgcancggcgtttagtgtcttacttggttcctatccaaaatgaaatataacccg

SEQ ID NO: 2382 - DNA, 110 bp, Fusarium venenatum
  misc_feature (1)...(110): n = A,T,C or G
ncacgacgcaccaccgtagtgaaatncctaanatngcgcttnagcaatcgcgttggnaagacangganctctgnccggtnctctttcacaggncncgaatganccctaca

SEQ ID NO: 2383 - DNA, 289 bp, Fusarium venenatum
  misc_feature (1)...(289): n = A,T,C or G
ttttttttattttctaatttattttacctcatatattttgctcatttcttcggcctctctcctggttccttttcggtacctctttccctccatcaaatgctcaccgtgagcttctcttttccaaatcatncgncggcatganccgaaatggaaaccggntccgccgtaaaatcgcccggccgaggccttngccnttccttcggcggagcccgttgtcgccgatnnacttccggcctntgagcttganaanagttcccaaaancggaaaacnccaacccaacgtcaanaa

SEQ ID NO: 2384 - DNA, 354 bp, Fusarium venenatum
cacatgtgcaagaggtcgaggctctcctcaaggagaactccgaaggcccattcttcctaggaaagactcctagctatgctgattttgtctggggtggtttcctcatcttcatgcagcgcaaccagatcattgatgaggtgtacaagatcagtgggtgatgctcagcttcacaaggacctcctagaggctactgctccttggcacaagaggaacgaccactaagttacaaagtagacatggctcgaaaagaaattccaaagatgatggaccaagaactggaaaagcaatactactaggctaccagtgataaaagacccagacataaacacattcattcttattcgtgaaaaaaaa

SEQ ID NO: 2385 - DNA, 147 bp, Fusarium venenatum
  misc_feature (1)...(147): n = A,T,C or G
nnttaggcacatatactgaacatttactganttgacggggtatgtnantctaaaggnttcgtcttgaanaaatatgtntatcntttgtgnataccaaganctnattgaattaagtaangancagaatagtgctctgggaatactcct

SEQ ID NO: 2386 - DNA, 297 bp, Fusarium venenatum
ccatggacatgtaagacttggtataatggtctattgaggagggtaaaaggcatacactaagcgctttatatttcttatttattttcttttgagaatcttggagatcctacagcggattaggatgggactcggcgtttggggcacacaggatggaccacccatgagcggtgctactgcataacatgcattgttttctttgatttagtttcaggacgaatgatgacacaggaaacttgtgtagctagatagaaaggtttgtcgccgctcgacaccacaaatacaatatttgaaggatac

SEQ ID NO: 2387 - DNA, 103 bp, Fusarium venenatum
  misc_feature (1)...(103): n = A,T,C or G
ngccnaactgnactnggatnacaataccaggttncgacagatgattgtcttgacggnatgacagaanagttgngatcattccttnganttgcatactagacag

SEQ ID NO: 2388 - DNA, 623 bp, Fusarium venenatum
  misc_feature (1)...(623): n = A,T,C or G
attgttgtaaggtactctctaaacactaaattcaaggatccatatatgttacaaacttgatatattgaattaatgttcacaaaaaactaaggttctcaatgagtccacgctgtggacacgggctgaagttcttctaacctaaagaccctcaaagtcgtattccaaactattccaatagcctataaagtctcacatgggaatattgcctcgtggatacagagcagggattacgcatataggcatccagcctgagtgagttttaatacacatctagagtgaggctgagtggcgacacagatatactgacaattggtccatatccatctcgaatggctgcctttttgagttgccttgaaactgcgaacctggtgctgttgttagtgtgcagtgcaatatgcagggagagacttgcttgacagcaggcagccaaaggcaattctttgnttgntggtagcagagtttgccagacaaaattaatgagttagctcggagcacaataaagtagctttcagttactcttttgnggtcatnccacaattcacctgcagtgccagagaactggcactggcaacagntgtcacggnatcaacttgcaaccttgaacatctatnaagangcctcat

SEQ ID NO: 2389 - DNA, 612 bp, Fusarium venenatum
  misc_feature (1)...(612): n = A,T,C or G
atccatcgacccagtgtattgtattttactttgcgttagattcatcgtcatcatcatcatcgctacagcactttttattaccacttacacgcaaacagccaaccacaaaacgccntctcaaccaacaaccatgagtcgccgacaggaccacgaccagaggcaatacagccagagatactactcggacagctctaggaactggagtgaggaagctgttcgaggcagctgggactccaactaccaaagaacaacatcggccaacacatctcccagagaccagtcccaagcttggagtagaccaagtcctcaagcctatgatagaagccagaacatggttaaccantggctcggtcaacagtatcagaaccagncaccaatgatncatccatgggcggtgatcctgatnccaattcactacttctacacttcnctggctttaggactntctaacntttnttttggacttagnacncccgggattnaaacccaagtggngggatgatttntgcccactttaangcttttttccgatngcagtataanaccataccanggggggccttttttctttggggatntcatataaaccaatcgtcgtttngacgacaaatt

SEQ ID NO: 2390 - DNA, 146 bp, Fusarium venenatum
  misc_feature (1)...(146): n = A,T,C or G
ncacnatctnctctcaatattaacccccttntcccacacacncaaagcttttataacttcacccattcngaaaatttctcatcncaaatnctcacctcnaaaaacttttncncacccccctttttcnttnttataaantaacctct

SEQ ID NO: 2391 - DNA, 212 bp, Fusarium venenatum
  misc_feature (1)...(212): n = A,T,C or G
atagcacctgaagcaagatttgcgatgacagcctgaaagtcttcacgagcatatccganaacagatatgtacgagctcgaaaatattgtggaggatggaataaaggcgcttattcatgataagaataaccaagtgaaggtattggtggatatgagcgacaaatgattgcgttcttgtagaggtttatttaatattcaaagccctccctggtc

SEQ ID NO: 2392 - DNA, 299 bp, Fusarium venenatum
  misc_feature (1)...(299): n = A,T,C or G
ctctacctcggcgagcagtcatctgcttttgtcaaggtcgcttgccgcggcttgataacttctctccggtatactctacctcggcgagcagctatcaagcagcggcaagcntgtgcagcatttgttcatcaatgcatnatggggatattgcgggttatggcgtttgaaaagtcgaacaggtgttattctgcaacaaaacggcggttatgtccatcgtcgttctatttttgggcttgcatcttaatttcagcaaagcacancacggtacagaacaggggaggaagggtngataattatga

SEQ ID NO: 2393 - DNA, 621 bp, Fusarium venenatum
  misc_feature (1)...(621): n = A,T,C or G
agggacagagagctcttgtagagtttcaattcaagaacccttgaccgctcttcgtcatctacatctagatcccaattcataacgtcctggaacctctcacgaaacaccgaacctttnttcagacactcanaaacaaacatcatcgtcagttcgtatattcatcatcatgggctcccacgactntttgaaccaggccgaaggtgcacctcggttctggtaccgngataacttnttcctcacaaacgacaagtcctatctatgcccccgaaccttcaacaagtctctcgatgacaactggtggagcagccccttaccaaacggacaactccagagggtactggataactgcttgaccctggccgtgtactatactccccagaccgccgaggaaatgaagagaaacggcatcncttcaccaaaagatggctccccgcacaagatggcggtttcgctcgtgtggngaccgactacgtaactntggcctacctacagacgttttcgtcgtcgatganttccaccggcggggattggcgtcgtggctgatgccancctcttaaggggatagtcnacgaatgggaacacatgcgcnggcttttttttatgaccatgancaaaccgcaa

SEQ ID NO: 2394 - DNA, 106 bp, Fusarium venenatum
  misc_feature (1)...(106): n = A,T,C or G
ntgngcgtactaagggtgnattttcggngcntgtacgggggnacccctatattatnataaggctncncgaatggattangatngtgcnagccntacaaaaaaaatc

SEQ ID NO: 2395 - DNA, 110 bp, Fusarium venenatum
ggtattgggtggtggcggtcaaggtggtggacctcctggcggtaagtggaactccccctgcaggccaacctactcctaccccctcgtcctagatataggaagtagtacaa

SEQ ID NO: 2396 - DNA, 631 bp, Fusarium venenatum
  misc_feature (1)...(631): n = A,T,C or G
gatccttttctgagtgctgactcgtctcaacttacctagctcgctgcctgttgctgcacgtcactcatccatgctgcgctgtctcgctcgtgctcgtccgtcattatcgccatcactatcaccaccacgaagtctcattcacctctcacatactcgcaggactatggcaactgagcacagtcatgggcacgctcgtgtccctaatactctcgagtggctcgccaagactaagaggggcgattaccttgttcaagtagcatggccattgtgctggggcgaggatcgtgttgcccccaaagatgagaaggtcaacctggtttatgtggtcgatggaaatgcctatttcttcacagctgttgacgtctctcggcgtttggaatatctcaatagtacaagaactgncatcgtaggcattgggtacccgccagtaaatatgtctatgacttncgcggggcccagatctgacccattcgctgnagagtatgacatgcctcttgacagacatggnaaggcctcgtacccgacatctcatttggtgaaagccgagcaagttcctanactggggatgaaagacagacgtcatgccctatggttganggacaaagctntttncccaacgccaacttacann

SEQ ID NO: 2397 - DNA, 595 bp, Fusarium venenatum
  misc_feature (1)...(595): n = A,T,C or G
gttcctcagcatatgcctgatcccgcaattggctcctacaagctcctcggcattcgggacgatgtttgcttcnaccgcttcagtcgatatggcccttacggcctgggctatancagagctcaaggtggtctggataccggtctggatactgaggcgtctggaaatgaggcagtttgggcggaaactggcaaaatcaactacatcgacgtgaactgggccgatgctcaggaagattgctacaaagccaacaagcatngtttcaagcaggtcaacgccgacaccggcgagctntnggagaccaacaacaagaaaggacgcattgccgtcgttgtccgtacatacactggcttnagtggactgagctttgctgtcctcaacttccgtgctctcatnacgaactttcgctcaatcgggnggngaatatcaagttcatttttntgatgcaggtaccaaacatcgatgagcccatctggtcaaataagtggacggngcagccgcattatcaacnacaacgttcccccccgagtttcganggcttggtttcntttggagcgagcctcaaatganacttattgtccccccgcccgattttgga

SEQ ID NO: 2398 - DNA, 170 bp, Fusarium venenatum
  misc_feature (1)...(170): n = A,T,C or G
natanagtgccaaggtatatatactgtgcgttgcgcatnttacaatgagatgtgttggcctctttgctngtagaacgaatatatgtgngcctatgggaggacctgagnnatggataaaaagggtaaaaacntttantttcaggtggccgattgacaataggcataaggtg

SEQ ID NO: 2399 - DNA, 630 bp, Fusarium venenatum
  misc_feature (1)...(630): n = A,T,C or G
tcgctgctcgctcataagtcttctttgctcctctccttccgccattttcgatcaaagtctattagcggcgcggcttcattctctttggcaacataatctcctcgcttcatcgctgcgnaaagacgtgccttttcctccattcgtcgctnggcgcgtgccaactcttgagtttcttcctctgngccagnaacctcctttaattgcagcttttttgatccatcanactccttgcttcgttngggttttgagcctttgaatatgtcatctttgccttctttttgagagcgagaccggccagctgatgtcgcgcctgatgaggagtttgacatcaatgatgtcaattgagcagtgaaatcaagcgaagtagataatgttgcatcacgcttcggctttttaagnaggacgttgccgtatanattcggntcctgnggcattttgctgtattcgatagntcgcgtatgtgtttttgantacttgggtgntgatgatcgcgangaaataaagtaccaaaacgaacgcaatgcccatgggcagncaaacaaaaccggtggtnctcaacctggggnaatcaccaccaaggttggacagaacatcgacggcgggncaacattncaatcactataaanaaan

SEQ ID NO: 2400 - DNA, 461 bp, Fusarium venenatum
  misc_feature (1)...(461): n = A,T,C or G
agacgagacaacaatactcttcggattgtcgcatcattgttgttttcacgtcccaattggttgtcaggtcgtcagcctagggaacgggacatgacgggctggatccagcggacaggttgagctaccaggtctagcgaacganaagacccattccggatgacccatagcaagacatcaagggctcggaatggaggtcacgacggatctgtcatccggccggggggagtcgtggccgtggcccaaccgtggatgggatgctggtgtttgctattcgtgcaggatcccatctgatctgagttgttcttgtcttgctggttaagactcattcggtctgagatcaaagggctggacaacatttgcttaaacaagattgggctttaaanaccaccnctggggtttaaatcgaanaaacttttttcaagangcttgaaanaaccccttnttntcgttgaaaaaaaatt

SEQ ID NO: 2401 - DNA, 524 bp, Fusarium venenatum
  misc_feature (1)...(524): n = A,T,C or G
agctttatgtctccagcggtccgcgaagagaatgatgcagctctgcgcgcatctntaaccactcttntttcttgtgcgcatgcagctagaggcttaccgaaatcaaaggaggaagctgaagctcagcgagcggccagcgcaggcgtgggacccagcaatcagccgatggagctgcgacttgtgccggagtcggagctgtcacaggaacaaccaagaccaagangggtccaacgccccgccgcgccatctccaccccgcaaacgggccgggggatcaggatctccttcaagaacctcaanaacagctntgggttgcaacgaccccacggnctaccaanaanaagaaggtgacggaagagcctaccactatctcaccaactnttctcacatgggttgcaacnccggcgttgtcattgttgtgtctgnggnggggttttggngcaaggtatnttatccgccgtgaagctggtaaanaaaaagcgctggcggccantgttggcanttgtcaacaataccacatttttg

SEQ ID NO: 2402 - DNA, 541 bp, Fusarium venenatum
  misc_feature (1)...(541): n = A,T,C or G
ttttctttttcttttccttggtacatctcatattgaaagaattacctatnggtatatggtatcttttctcttcgtttgaacgtttttgtctatcctgggtttacaataataaatcgggatgcttagcgtaccgatcactacatctgaatctgcaggtcccttgatcctaaatcgccgtngggatctttattagttgcctacttgattgtcatcgtcatcaattttcaattcaatcatacctctactgtgatctactttgcaaattaagggacttcatgccatcatcatagttccctcagtacccacactgtcgagttcatnacatacaagttcacacacccacgctaggatcccggcctagttctctcatctcatactcaaaggtccggtataacaccccccngccaaaaaattacttggcttggcttggctcccctcncacaactctngggccagaaaccgtnaaaatttanccngtaaccaagctaanttacgnggtgttttgaaacaaaccgtaccttanttttgccaaaanacccng

SEQ ID NO: 2403 - DNA, 605 bp, Fusarium venenatum
  misc_feature (1)...(605): n = A,T,C or G
aggctgtagaccacaagccttacctgggactctttgaggccagcctgaagatgcaagagggtcccacgtcctgggaaattcgcgatttgcgcgagaatgtgacagacggcgacaagacctggaccgagaaagcctactgtctgatatgtggtacttgtattgaatgaacattcaatagcgagactgcataaccgcacagagcctgctccggtcagcaggctcatcgagtctcgaaatgcgcgactatatattgcgcaggttggcgagtcagcttcacgcagcttgttggtagccttaaactccaatgtggccagctcgactcaaccgcctactcgataaggctttttggaatgacgaatggcttcagtttcttttgtcaaaatttcgaagtcacttaggcgattcgcccaactggtggattttccgggcgcggcgttggaggcgaaattggctgtatcgtgggttgagatggtggttcggtctagaactcgcgagaggcgaggggatacgtactctgnttcttttttgaagttattttangcgacgcaagagtaactattcatatgggtcactggactatcggganggactagaccggacgttga

SEQ ID NO: 2404 - DNA, 818 bp, Fusarium venenatum
  misc_feature (1)...(818): n = A,T,C or G
aggaattgaaacaggcactgaanaaatatcagcgacgacaagcgagactcgtccatntttacctttggctccagaatcccaaacccgacttgaacctgaaattgaggttgaaggtgatgaagaggaagtggtanaacctcctcctnggatagaccttgcccggcgactcagcacaacgtcatacaacaacatgggaatcgaccctgtcgacggaaaatggataccagaacatcagtggtcgagtgctcacgacttgctgtatgccaagctttgttacagcaaccttcttttccgaagtccccgcaaaacgccatacatcatcaataagggcaaaaagttctatgttgattggaccactggccgaatggtcagggttctcccaccagcctatggggagatcgactattttggtgcttggcaaacgggttcataccgaaaacagactcatctaagggcttggccatacgcatatatgatataaacatcttctaccccatgacactcctccttaccaacttaactatgtcctctttctcttacacaaaaatactactgggaccggtcacatctcatacgacatcacacacatttctcttatggttgattcaacattttatacaatctaaaacaccactacacagattcacactcgaaaacagaggcacagcacctcacatctcgtcttttttacgaacgtacatagctactttgcatatctggcgcatgaaaggctgcggattgcatcanccaacggtgatgatggcttacgatcatggaacggagtttacatttgatttaatgctttcttggtaaancaa

SEQ ID NO: 2405 - DNA, 510 bp, Fusarium venenatum
  misc_feature (1)...(510): n = A,T,C or G
ctggcgttcgcctcattcttcgccaatatcacaaggccgtgcagagggcagtctccgcgaaactccttaagagtagagacatcaaagggaagggcatcgaagcagcggcatatcagtgaggaaactcgcgaaaactatatgagaggaaaacagcactctctgaagcacattcaagcagtcctgcataaataagcaatgttgcttcaaaacacttatactaaagcccagtataaggcaacggcattatgaattatttacgatttaacgagaacaacaaatgattaagggcggctggagagctatggaaaaaataaaagtttgtgatcaacccaaatattcttgacattgcggtatcaataaacaaaggcggcggtacaaataatcgctaaagatangtagtgggaagaatgaacatgttgagagctcgactatatcattttcacgtctggttcatgtgcaatgttcacaacatggtttagcaatttgtcnatgttgattacaatgtncgta

SEQ ID NO: 2406 - DNA, 936 bp, Fusarium venenatum
  misc_feature (1)...(936): n = A,T,C or G
cgcattattctcattcccattcggcctcattgtggtcaatcgctactccatgtttctctcatccctccaatcgatcaacaaagacatctctcaatgctgagatttctggggaaagatgggataatatgatacaatatgccatctccacctgtcttgttacgaagccgctgttcctcttgaccagtcaaccagtcttgtctttgtcttctccagacacacccttcaagcaagggtgctgattgctcactgaggagaaggaggggaccttttgggttttattttttttactttgacttgcctttttcttattatccgacgtgaccgagcatatacaagttactgactgataaccgtatagttcatggacccnatgcacgacacccgctntgcctgatctgatattacgtctctcgcaaaagcgatccgcagaagacgaggggaaagaattcgggtccacgattcactgacccatcgagggaacctaggccggtctcagntcgaaaatacgatgtcgncttattgactaatctgancattggctaaggaatgggaatagctttgggttgagatggaagctgttttgagcaacaagctacccctcatttttctcctgtnccgtccatcccaagaaagcctcccatttccgcagatccgatctttgtcttggttcacccaccaaccaacctttaagaatantggtggaagattgggnaaatgatcttatgggtcttgggaaactgccttggaatcccgttttggctgggtttantcccgcctccctggttccgagggctgtttttcgtagggngtgcagaaaataataccaaacttggtgtagaacacggttggccgcggtntacagtaacaccatcatancgcatcangtcgttgaatcaaaacaagggctgagtgggagcgtatnnattatgcggaccc

SEQ ID NO: 2407 - DNA, 503 bp, Fusarium venenatum
  misc_feature (1)...(503): n = A,T,C or G
gtcatcgtgaatcttctctctttcatctgcctatctatccatctgcatccgcacctgtatttgcatctcatctgcattggtgaacctttaactgcgtgcactgttactaagcacaagacgcccaaaagcgctgttggtccctacatcgagaccctgttgccttttgtttggactgtagctcatctcgcgattatccattaattttagttcgtcagacncacgcccacatcaagctcctcacagaaacaacaaggcataatggcaagtgctgcangtgttccggagcgttttccttctatcgangatagagaaaccgagccgctgctcggtagacctggtgatgccgcgcaagaagatggcgttcctatgatcaagaacctcgttctcgggaccggnatagtcgcccagttgggtgttgtgctactcacgattctggtctgggcangcgtcctatccaaggccgttgantcncttccaagcgcaaccggctgcttcagtcactg

SEQ ID NO: 2408 - DNA, 145 bp, Fusarium venenatum
  misc_feature (1)...(145): n = A,T,C or G
nggggtttttntcgggggggntgttttantgnaaacccnccganggttngaaaaaagggggaacaacccttaaaaaagnngggtggggccncaatntaaaaatttttcnttaaggaattggtggtnaaattgttgaaaaacaaaa

SEQ ID NO: 2409 - DNA, 217 bp, Fusarium venenatum
aaaaatcgaagcatgaagggctggaacacagactacacaccagtcatcacggcctgtgagcattgggaaatcaactataccgtcaatatgaattataccggtggccgccaatcatacaaagtcaccaatcgagattacaagcaaaaagttatcaacacaacatatatcgatgagtcgtctgtcgacgatggaacactcgacccgatatttgccgacc

SEQ ID NO: 2410 - DNA, 307 bp, Fusarium venenatum
  misc_feature (1)...(307): n = A,T,C or G
nacaagtttgcatgatagacgtgttttcttggctttgncactctgtgttcttgtgaccccagagccactcattttacgctgtagggagcgcagcaatcatggcattggcaaggatctttgggcggctctatctgtttttccagttttctattttccataacatcattggcgttggggataccacactcgctcgggtttcttatctactcggatgacgagagggttatattaatatcatatagagataggaggcaggcctttgacatggcctggcttcattagaaatgaaagctaattcgcctccccn

SEQ ID NO: 2411 - DNA, 303 bp, Fusarium venenatum
cgacagaacaatattagcaatcctgacctgatttacccaggacagactctccaggtccctggtggtggcagccaaggtggtggtggattcggaaactcggtgcgaaatgtgcgccttgttgatggaggccaaaggctagagggcgagctgtctcgtgatggtgattgggttctgagctccatcatccttgacgagcggatcaagaacttcaacggtacattggaagttggtctagatatgtgtgacataataacagcgagttttctgcctaatacattttcgtacaaagtcattttaaaaaaa

SEQ ID NO: 2412 - DNA, 343 bp, Fusarium venenatum
  misc_feature (1)...(343): n = A,T,C or G
ngcccagagccgagacaatgaccaacaacccgcttcacgacgtgcatgaagttgccggtatgcgatttgtggaaagtcccccgactccgggtcagggtttgttctctcctcgagccggnatgtttcctngtgaccctttctcaacatttgggagaccaccagttgttgcagatccaaggagtccacctaccaagggcgaagcacctataattcgatcaaattgatganctcttatgatgaagctttgaccatagtntcatgtttcgaagccgnaacgatgcaacttccaatggaaggaaaacgtacganccttncggttaaaanttttntttaatanttaaaa

SEQ ID NO: 2413 - DNA, 630 bp, Fusarium venenatum
  misc_feature (1)...(630): n = A,T,C or G
aaaatcttattcacagtatcctcaaagcagaaggaaacagacacaaaccacagcagccttcttttcaagcccaaagacgcttgctggtcgctcaagcatgtcgaaaagatcaactgctccgcatggcgctggtccatccttgaataatcgtcgatctcgtgtagaaagcggcactcgtacacacgtatcaggtttaacaaaagtcagccagggccagagcccaggcaccagatcagtcagaccgtcaaaaagccttaaccagcccgttttagcacacaacattctgggacgctcccatagcctgagcgccgacatagttgtcctnaacgtgtacagtcggccaaccgatacgaaaagcctttaccagagccacctnaccctggatcgacaacaagctcatgggagaagattgcaggctgctactgaggntgataccttggcattcacgccagagaaagntttccgcgacaaaaggcaagggaaacacgccncaagataaaaganggcaatcattaccggtcttngatttcanctaatacgtcaccggttgntcaangggggttttcnggcacaagatngggcgggcgnacgttccaaaaaagaatgntattngtttgnagccttnaaacg

SEQ ID NO: 2414 - DNA, 930 bp, Fusarium venenatum
  misc_feature (1)...(930): n = A,T,C or G
gggcaccatctgtggttcgattgacaccatgccaatgcctttgacactcttgacacctcatggcccgttgatacgacccacgactgtacatcatacgttttcgtttcctttttcctgagaactacttggactcaacttctttgatgacgtatatcatttgactcaaccgtctttgacgacattaatactgggatgcatagcaagtgcaacgtccatgaccgtactgcttcaccatcatccgatcttatctaggcgctatttcgactcggtgctgaatgcttctcgaacacagtctgcaggcctcgtacttgttggctttctcacaatcatggtgcttgtggtttgacggctcacgactaacgcagtgatgacatgtgcgatctttgatgcctgctcatccatgggtctgacgttcatcctgaaacctgcaacctgcaacctgtcgtgatgcggttgagttgtgaattggtcacttgaatctcttgaaagttatccctcagcccgaactagacagtagtgtcttgctggacgtgagcccgatcgtacttatactcttttncagccagacctgtgcgttcttggatgaaatcgattgtgtcgtgcaagtggtttcattgtatctgnatgtgtgttgcgtgccatgcgcatggctgactacgttggcgggttacgctttcatctacgatttctttgagtctggcttaactccggactgtttctcatcattgcatgcatgtcatgaggagangganatgtatnttnttaggangggggattggagaaatggagttgggggttaagttgcattggataccaccgnacatatgntaaccttttaaaaaaagtgtctcngtgggcntgcnacaaanagaaagcnattgaacccgttaaaggatggtcncaaaanccnttcgggaattncttccgaaa

SEQ ID NO: 2415 - DNA, 723 bp, Fusarium venenatum
  misc_feature (1)...(723): n = A,T,C or G
agaccctttcaaccccagtccagaagtcctcatgtctggcttaacagcccatgaactagcagacggcacacgcacaacagaatgtcacctatgcgataaaatcgttcgtctaaaagacatggagacacatctcaaacatcacgaactcgacaaagtatcccgtctcacaccaccaatatgtcgcaacgcaaactgcggtagaacaatgtttggcgtcggatcaagaggtcaagtccgtcaatccccatccgaagatcaagcctccaacgacattggtctttgttcaatttgtttcggaccattatacgtcagtatgcacgatcccgaaggcaaagccctcaaacgccgcatcgaaagacgttatctaggtcaactcatgactggttgtggaaaggcacactgcgcgaatgagtggtgtaagacagggcgcgtgaatgcangtcttgaacccaaaccttcgagtgcganggangtgttgccgttggtgaacccgttgctgggtgatgntatggatatgaaccaaggtgttgtatttttgcacngatgaaggggagtcaaaagggggaagaaattgggccgaaatgatggctnantgaaggganttttgggatgttgaatggngcattgtttcttgcggaaactgaaaaaggggnntttggattaggatgaggggactggtttgcnaggctttgggccccccanaaagttnaaagggtttttgtg

SEQ ID NO: 2416 - DNA, 255 bp, Fusarium venenatum
  misc_feature (1)...(255): n = A,T,C or G
nctttgttncctnactcttgctcaatattatttctccccanttacaacaacctggtcaccanacacggtgttaacctcaagggaaaaagaacccttatcacccttgngtcctntaatgatgtcataancggtccttcctcatgcgtaatngaaaatactngcccttgaagcttgngaacccgaaataaactgtgttacagaatccctccaggatggggataaaccagcttgccggttccgtgacnattggncttt

SEQ ID NO: 2417 - DNA, 551 bp, Fusarium venenatum
  misc_feature (1)...(551): n = A,T,C or G
catccagcgctccactgtataaacacttacaacctctcactttcttgatataattgaacctcataaacaatccaacaaactcgagacaattcccagtgagagcctttatatctcagctggtatctgcaaaacacacattcactcaattcactgagtgaaggcatatacaacacaagccaaaccacattatgcttaagcggttcccgcgctttatcatcacacgtctaaacaactaccaccgccacacaccatcagcctttcgcttttctagcacaatgtccaaggacgatcagcagcagcctgcgcaggcagagaccaatggcaacaagaacccctcccactaccagccccaggctcagacaccgccgcctctaacagcaggggggatggcgtgacngactacntttggaaatctgtccactcgantccatggggccctcgtggtcacagaaanggaacatggttggaatggaaactgggcgggcttaacgaacataaaaggccaaacttgaggttnttggnaaaaagaacaagaacgaaggatttcttaa

SEQ ID NO: 2418 - DNA, 628 bp, Fusarium venenatum
  misc_feature (1)...(628): n = A,T,C or G
cacaaaaaaacctataccttttcaccagtgcaccatttttctttttttaaaacttcgatacccttcaggtggattgtgatgaccacacctaccaaccactacgacgcggtgatcagcttaccactacgaaaaccgttccgcatgagcccttaactcgaaacgttcatttaccatgctcttccttcatcatgttgagacgacgatgcgatatccgccttgctcttcattatagacttgctggtcggtaggcttcccaagcccagcccggccctacatcattttcccattacgcctaacgcctccacggggtagagcccccacgtaccttttactcattccttcggctccatcctggcgacctggcccaccctttttattaatgcctttactatttcttttctcttgncattggttattggatcttgtcggggaggaattggactgtgggtatgtaagaagaagtgggaagggatggcaagggataaatgggaaaagtgaaaacttggcttctagacaggcgtttggggcaggatagagcaccagactggggaaaacgggttctggatgcaaggaacatgtaactgggtattggaggatttgttgggggcccnnttttgggtggtatccn

SEQ ID NO: 2419 - DNA, 194 bp, Fusarium venenatum
agggtgagaagatccccactagtgtcaagagtgccgacggaaagtctgaggtaggcatttccagacatggtaccgaggtgttcagcctgacatgggcctaaatcgactgcgatctatcggtagtgtcaaggtagaggatgtgcaaataaagagaacaggtacttaatacacaacgccgagcctatagtttgatc

SEQ ID NO: 2420 - DNA, 159 bp, Fusarium venenatum
  misc_feature (1)...(159): n = A,T,C or G
nttccattggaccgggctttttgctgnggatggagggtnttttatangctcgattgncctatcagccnggtttntaantactgggngacatttcaacgangtgactgggnaaaccttgcgtacccacctaatggctaanacncttctctttttccaaat

SEQ ID NO: 2421 - DNA, 500 bp, Fusarium venenatum
aaacggcccccctgattccattcaacgtgatggcattcctcgtcctccctctcgcatgaattcaggcatctacaggccaggagacgacctgggtcgtcccatcaacgggtccaagtctgccatcaagagaccccttggccgagacgttaacgaggaaggaccttccagacccccacctagccgtggtcctcagtaccaagcgaaggatgccaagcgtcgccgaacaagtgatgattttgccgatgagctggatatggaacagcctcccaatatcaagggacctcccgttcgtccatccagcgcttttaagaaggacctgcaggtgaagagcttggccagcggctacacccaagccagtgcacataaccttttcaagaccaacattgctcaaagtcacatgaagggaggtaaccctatggacatggcgcagatccacaagggaactattccctttgctcccaaccccaaccctgcaggacctgcatacaagacaccgggac

SEQ ID NO: 2422 - DNA, 339 bp, Fusarium venenatum
  misc_feature (1)...(339): n = A,T,C or G
tcttgcttcacctattttccctttccccttcttttctctttcctttttttgcttctttcctcctttttcgtgcgactcgggtttccttgccccccttttcgctctcttcgtcctttttcaacgggaggattcaactccatcccccccccccccacttggcaaaacgtcgcggccaacacccacaatcatgtcgtcgctcgaagccaanatcgtcgtcctcggcgctcaaggcgttgggaanacatccctggttatganatactgtaaaggcgctttcaaccctgctcanatcacttccaccgtnggcgccagcttnctnacaaagcggccgggtttttc

SEQ ID NO: 2423 - DNA, 606 bp, Fusarium venenatum
  misc_feature (1)...(606): n = A,T,C or G
ggaacggcccgtgctactttcgaattttcatcanaacaaatggcagacacgccagacaatgggcaagactcgaattcattgaggagtgttggagggggatccatagaccgggctatggcagcgacaagactcaccgcctcgtcctcatccaacatttccaattacgcctctagcgtctcaagcgacaaccagagccagagtcacgcccacagccagaatctgacagggagtggaagcgggagtgggggtnttcctggaacccccgtgagccgacgctcaggtggatgggatcggcaaactctttcccggccgccgctgcaagggtgccacacgatgattctccaatgaanacttgctcttatnatcaaacagtctgnggcctacancgaactgtggaanactttncgattttcanatnatatgttcgcttataaccattaaaaactgngtcacgctcaaacgttttttnaatntatggcaaaaattaactaaattttttttcgttacggcctttccaacaccnggaaaacaaatanaaatgtnttcacncctgcntttcatgtttnaaggaaacttttttttctttacccanacaaaanggccttg

SEQ ID NO: 2424 - DNA, 641 bp, Fusarium venenatum
  misc_feature (1)...(641): n = A,T,C or G
tttatgccgtcaaagccgttcttcgccgccctctttgcttgtcanaaattttcgttcttgtttcagggattggcgtcgtatcgtatcgaccggtgtgaggcttcacatganaaccggaggtaggtgggggctgtaaaaagccgtcatcggccaaaacgtccgagttcaggctctttgccacaccatgtcacgtccactcccacgctcacgatcccacggaccaatacgtagcgtattcagggtctacatcgacccattgcagcagcgagcagtaacttgatccctttggtgaatttccttcctctatgctaagtgcctccggtactaagactctctgccgcgaccccttgcccgggagtggccagacctagagagttcgccaagaccacctctcgacgttttgttcatgtcaatcttatctgatccttttcccaccggcatcgcatcactttcgtctaattccgcgcttcgttaccgggaatccctggttagctctgcatcacattaaaagaaaaactttcattttctccgaccgggcattaacacttcgntttgcacangcnaaactgggggangaatggagatacaatgctctcaaccgaaaaaaagcgttcaagtaaaacaacaaatgggccgagaag

SEQ ID NO: 2425 - DNA, 296 bp, Fusarium venenatum
tacgagcacgagtacaagttccggattgcctcggtcttgcccagggaggtgtacgagcccagcacgacggtgacaatgggagagaaaatcggaagatcaggaaatttgattgtggaggacatctcactggactcggaagatgattcagacgacgacgttgatgacgaagacgaggaggcggaggctgtttaatagaaaaagccgtgaggcgatgagtaggtcgttgtctattacgtagattttgtaaaagcggtccaagatgccagctttttgataagaagtaaatgcgtttttgc

SEQ ID NO: 2426 - DNA, 785 bp, Fusarium venenatum
  misc_feature (1)...(785): n = A,T,C or G
gagtcttcgtcgaacgatagcagggcctgccactcctttgtttgcgtgtctagtacatagcagtccactccttcaaaaccaaaactctaaagccaagacttccggttgaaccgttgatatatctcacgacttccctcaaaatctcatctccatctgatctgatttacttacctaccgcaacatcaattcaagtcgtccttccttcggttcatccttctgtcactcctttcgtcgttgaacgaccaccattgttcaaccacaccaaaccaaagctttttctcgagactccttgacggaatctcaaatccaacagtgctgtcatccgctcatcagactggttctgaatcacatccgataccaacagacaacacactaaagttcaccaaatttccactcgtgcctcttcaccgatcatcatgaagacatctttgtttatggtcggcgctagcgccattctggcttcgggcagtcccattggaaacgcttttcaggagcgtgccatggagaccaaatgggtctacgaaggttgtcactggtgttgtcactgaaggtgctgagcccaagaaggtgntnacaccgccctgnctacgaggcccccaggctcccaaggtcanccaggaagtgtcaaggncgtcaaggagcagcccgcttctggtcctgttgttgtcaagggggaggcttctggttttgtcgtcaangaggaacctgctnagcctnaaagtcgcactgtctgggtcgaccttaacctaccttcaagggtgtcaaaggagtcagcgaggagaaag

SEQ ID NO: 2427 - DNA, 549 bp, Fusarium venenatum
  misc_feature (1)...(549): n = A,T,C or G
caacctagttcaacaactacaatgcanaaactctttcatctcttcgctggagccatcttggccactaccactcccgttcaagcctttccgtccttgggcggactcagcccccgagacgtntttgttccttcgacaacatgcaaagattttgtcgttggaaatgacttgaagttttacggccaggtctgtgtcggcatatctgacggcatggtgaccgtgacctacccggttttgacaaccggcacatactccgacatccatgtctacatcggcacaaccatgcccaccgaaacctcccctggccagctcccatacactctcgggaataaagcctgctccctttccacanacaaaacttccgctacttgccgaatccctgtccaanactcgnggcgtgcgtgcgatatgaagctntacattgctacacatgcctttttcaccggaaggacagggtggggaacaggtccttgttccggaaattaaacgggactgngcaaaatttggnttttaanaccaatgccgggcccagggntatnaatttnaacccat

SEQ ID NO: 2428 - DNA, 103 bp, Fusarium venenatum
  misc_feature (1)...(103): n = A,T,C or G
ntctcttnaatnaattatactccnttntcatcatttcntctatattttcnaaactctctcattaaatcaaantcnattctttccctcttntntccctactaaa

SEQ ID NO: 2429 - DNA, 474 bp, Fusarium venenatum
  misc_feature (1)...(474): n = A,T,C or G
nccccaancccaaagggtanccntgaaaaatggcnntatgaaatntggtttttttccgacnaccgcgttgtctacnccattcatggagggtcccatggccggccgaataactaccagaccgtcgctaccatggtggtccgtccagaaaagttttgnagatcactggctanaaaagctggaccattgttcctggtgtacacatcnccaataaancatngcggatgctaggnttttcaaggccatgggacatgcgangatgccacggngataacgaaaccttaaagaattcaatagatggaagagcttntttcttggaaagcagacagagangttatctgacggacangccatatnttgaggtttnagggcanggtgacttgaanccatnacgagtcggatccacatttgattctccttggattttntaatggtcanagaattgacccaagcttttttngacgggaactgaataat

SEQ ID NO: 2430 - DNA, 285 bp, Fusarium venenatum
  misc_feature (1)...(285): n = A,T,C or G
tcgtgaagctttctccctttgcccccaagtttagccctatcaggtccagtttaaaacggttttacattggtgcattaaacggagaaacttgtcttgtttccagttgattattagtgatcaaatctttagagngatcgagaatgctacagtagcacagcataaacttgacgggctttgaaactacttctaattaaaacctatacatctcgatgtttgacaagccctttctggcaacggaaancttggaagcagatagataaatcccaccaatgtttcttcttatcc

SEQ ID NO: 2431 - DNA, 205 bp, Fusarium venenatum
  misc_feature (1)...(205): n = A,T,C or G
aaaggattctgctaccgccacagtatctggccgagcaacacaggaagatgtcctccgaaatgtcgatgctatgatcacccgaatgcgtggcctgaagcgtaagctcattacaagtgctgctgaggaaagctcttttgcatacccaaactgngggccggatcgccaactngacgaactaaacaaaaanggattnccggggaagaag

SEQ ID NO: 2432 - DNA, 437 bp, Fusarium venenatum
  misc_feature (1)...(437): n = A,T,C or G
agttcctctcgttggccccgatggtcaaacccaggttaccagcgttgaaagctctcaccaacggccatgctgagaaatcctaccccacttgccaacggtgtgcatgctgaggcatctcaggtcactgagtcttgaccttctttgcaaaatagagacntcgcttatgatggggatacggggcctgcatttccctgtgatgtagtatgaggcatatcccaganagttttccccacaccttgatctgggtcgatacgaatttacgcgtcccagattttaaaatgttttttatgatttcatttttttttcgcttccaacccatcattggccacgacctctgtcaattgcgtttgggtttttttgtttgttcttttttgggaaggggttcacgaacccacaacacctggttgtatctattacttgacggggtcttctaccaa

SEQ ID NO: 2433 - DNA, 423 bp, Fusarium venenatum
  misc_feature (1)...(423): n = A,T,C or G
attgaccaatcgactactcgttgactcaagctctcagacaatatgcgtctcagccttctccccttgatcgcctttgttggctgtgctttcgcatctggagatacaatctctacagccatcgacaacatctccaatgccactttggctctggacaagtccgtgacaaactggcctcagacacttgtcggagcactccccattaccacaaaatcaacattgctgctcactgcgatccacgacggtactcttgccgttcgcaagtctgaggcttttatccgtcgacgagacttttcaagttngccaagggccacttcaagaagttggacccaaagaacgtcaaggcgccacaaatcggaaaaccatttattggccggccaaggccccaaagttttcgaacnaaaactggatgggncaagccccttg

SEQ ID NO: 2434 - DNA, 563 bp, Fusarium venenatum
aaatttcttctcaactcacctgatataatgagtgaatgttattattacacatgttcttccccacgagaaccccgcgttgcgggggagaaagctcgtagcagcgaatctattcccgtgccattcccagctcatcgtagctcatgtcgttgcaattaacaccatatatagtgcagggtcgttttgaggctctcaacatgtcgtatccaacatcaccaatgttgagttgcatctccgctcaacgtcgccacgtgtaacataggtatcgtacgatttattctcactgataactaagaacactcgacgtatttattcacccacctctcagtcaatttattcattgatatcattcatcatggccacgaaactagcaaaagacatcaccctcaagagctcatccactactatgccaaaactcatctacggtcagcatggaagaaggaagagtcagctgaccttgtcatactgctctgcgatatgggttccgcggggtcgacacagctggccagcccaagcattacaacgaagaaggtgtagggcaaggtgtacaaagagctatcagagac

SEQ ID NO: 2435 - DNA, 625 bp, Fusarium venenatum
  misc_feature (1)...(625): n = A,T,C or G
ttttagttgccaaacttaccacagtcgctcattaagatggttcaactcaacatgatcgtaggctctcttggccttttcgttcttggagctagcgctggaccatgccgtcccaccgatacgactaccactgtcataactgacttgaccaccgcaaccgcgacagcaacaactgcccccgtcacaacaagcagtgctgtcccggaaggagaaccagcatgcagtatcgaaagtccacaatatggccctactggtgaatacgaggattactgcgacagcttcaacggcagtacaacacccatcgggggcatattacctctccaattctctctctgaatgcctggatcactgcgacaaagctcgcctggttgtgtgggcgtaaactacatcacgaccaatgtacctaattgcaccatctgggcttcacgctggaagatttggtgaactgaacggtgtcatttaggcgaaacgcgtcgttgcaacgactctggaacccactgcgccttgatgangangatgangtaatttttcnggtgccaacttatcacnggcacgaaaaaaatgctncatttacaaggactggatatctgggtttcataatctgcacatcaatatgcacaacgaaccn

SEQ ID NO: 2436 - DNA, 382 bp, Fusarium venenatum
  misc_feature (1)...(382): n = A,T,C or G
tggcgagaaccaattcgcaactggtcaaggagtttattgaaggctacaagtcggtatgctcatgggtggaacctacagccggtacgaccgctttcgttcgatttaacattaagaatggcgaacctgttaacgacgtcaacttttgcttggacctgttgcggaagaacaacgtgttgcttgtggcgggttcaaagtgtttcggtgacaacaaggacttcaaaggctatgtaagaatgggataccgtttgtgagactgatgttctggcagagggattgaagtgattgggaacctatatcgagttaaacctgttgtaactagactaataagtgcaaaggtcagtacataggtagcaaagtaacttagtacccatattgcgccnaa

SEQ ID NO: 2437 - DNA, 649 bp, Fusarium venenatum
  misc_feature (1)...(649): n = A,T,C or G
gtaggccctttgggccacacagaagaactgccaccttacacaagatacccagacaacgcctatgtgcccaggccaaccgcacaagcacctgtttccccagtatctcctgtgtcggaaccatcctccccaattagagaaggaccagttgctcaaatacccggtgccggtggaattggaatcgcaactcgcgaccccgagttctcttcgactgatgacgacctggctttgccgaggacccggccttctgtgagaagcgccaactcttcagacaacaagttnacatgacatcaatagtgctgccgctggactttctgagaaacctcccgtcaacaaatggcaacggcgggctaagaagaagctatgcgggatccgtgccttactgggccatatgtctcctgnttggtggcttattctgatgggtattattaagggtgctgngattgggacgatgctactaaaaatnaaccacttcgcccctgacgttgacgataacaaattttatancttctacttcaacaacatattaaccttgaaattttgaaattataccttagcgatttaccacccatgggaaacaaggccgttttggcctttccaacattgacccttagccccaagggatataagggnttggttttaatgaaacaat

SEQ ID NO: 2438 - DNA, 504 bp, Fusarium venenatum
  misc_feature (1)...(504): n = A,T,C or G
tcctggaagaccttggctcatctacgaaagtaagttaacgactaagctgaagataaacttgctgactcgatatagtcgcgaatccgaactgctgggcgactccaagttcccaaatcacggtatacagaagtataaggacgacagtattcgactagtgcagtacttgtatcagacctattgtgcactaaacctaacaaaccctacggaccgctccaaggccctcctgggattggaaagtcgtctgggccgcacattccggtcacgggcagtatatggtcttctatcggcttactttgagagattacttctttggcaacgcgaccaagtttcccccatggaaaatataccatatccaaaaggtcagactgttccttcgtggtcatggatgtctttcatgggaaagatcaactatcangatgccccgtttggcaaagtaaattggactggagatgtggagaaccctttcatttctcaggattatgttcactgggaccgaaggttgca

SEQ ID NO: 2439 - DNA, 444 bp, Fusarium venenatum
  misc_feature (1)...(444): n = A,T,C or G
attacaccatacaaatactctcaccaaaactaccaacactaccaacacaaccacttcacaataaacaaaatggttcctactgctgcttcctctcatctcggccctaaggtcctccctatcatcttgactgttggaggcgctaccgttgcaagccgttctatcgtcaacgcaaacaaatatcgagagccggttcgagcaaagccattccaaagtgttcctgctcaaccccgatcacaatactttgaaaaggtcttagaatcaatctttgcatagaatgttgaaggttaaaggataatgaattatgatgggcggcgtatttatgttttggcgttcttgtagccactctcgaatttgcttttatcaataaattcatataaaaatcacnaaaggttcttcaagcgaaacaattgctggcctgcctataccgataagcaggttcagggt

SEQ ID NO: 2440 - DNA, 451 bp, Fusarium venenatum
  misc_feature (1)...(451): n = A,T,C or G
ntaaaattagcaaacggttnntttttttnnccagtccaanaacaaccattttttacgagcaacaccaaaataccaatcacctgcanaagacccaaagagccctcccaccaagacgacgatgccgaagcatacctcgagcagagtgaacagcaccaggatcatgattatcgtcttcttacaagcttgaggaataacatgggcttttataacaagatcgatgcgaggttgacggggcaccaacttatgaacccgacgcttcttgaactccctcgcaatgggaacagtacccacgactttttggtcatcgcgcgcgcaccccacgtatttaaaaagatcaagggcaaacgatacaaactcgctcgacaggttgcgacgtttgcgaaccttacatacaacaatctttggccgtccagtgctgaaaacgggcgagtggtcgagaattnttggtcaa

SEQ ID NO: 2441 - DNA, 935 bp, Fusarium venenatum
  misc_feature (1)...(935): n = A,T,C or G
ccccaactgggttggaggccacgcgcagagacttagggatgggctaaatggtaacgccccagttcaagccgctacccatgaggccaacaacatctcagcgacaccgttcgatctttcagcgcaaaacttcccttatcccggtcagggccctttgggtccatcaacgcccacagtcgtagacaacgctgtcgccaatatggatgtcagcctcttcgaagactggaaccatcaaggcaacgagatgtggtatcttcctcctgggccggccttcttccagaatgttgagaatccctccgttgcaatgggtcccgagggcgttaatgtcggcggcctcgatctcctcgagtacatggccatggatccttctcagttccctggattagatccctcttctcgccctccgacaagccacgcttaattaaactgtcttggtcctttcatcatcgatttgggtcaaaagtcttcggttgcacataattatcaacatacacgacagatatgctgacctcaggtgacggctatctggttatggttttctttcggtttacaaggtgatctacggttggaaaccactggcagaaacccatgaagacaatgactacaacanggangggggattatctgaacgtcaatgcacccgtttttggaaacagaaatgggggcatagtgaaagaacgaccatacacttgttgcagcggtagcagtgaggagtttgtcgaatggcaaaaagccacggcaaaaataacagaacatattcagggcgttggttacatactatctagcttctatttggagggcgacatggaaacatcatcacaagttcggatttgggtttgaagttcagttgcatagtctgcaggatcgacaatggcagaatcattatgatgatacgaaagattagaaaagtcctataaaaatataaaaactctaagaac

SEQ ID NO: 2442 - DNA, 466 bp, Fusarium venenatum
  misc_feature (1)...(466): n = A,T,C or G
ntttcacacaatgtctgatattatcgcctggntggtccctacggcacgtaactntctggccganaaaacagcccacctcccctccaacatntttcgcaccgtccaaatatcatcctctccaacactctcctcacgcctcccaaatctcctggctagtcgcccaacccgtgccatcaagctatnattcgactcaccccccaagcgcccgggctctttcgttntgggctctgacccttccacgtgcgacatcatncttcccaccatgccgggcatcgacgcacggcactgcgagttgagcttcgatgctgagggacgtcttgtgctcaacgactattcacaggctggtacccaggtctggtatgactggganaacaacggcgaccaaaaccgactattngtggatcttgagcccgggcgcggaacatgggtttncgaatatggngcagcccatcacgggtgatattca

SEQ ID NO: 2443 - DNA, 350 bp, Fusarium venenatum
ctcttttgaattcagggtcggacctcgggaatggtggtatgtgtgtctgcataactctgtaatgactatggcggtaaggggattgagaagttgaggggtttggcgttacggaatggtctgggttcaatcggctggcgagaatttgaaaagtagcaaccagggccacaagaggaggggtatgatttgtattcgaatgtgtttaggcccttgaagggtcgattgtacgccgtactatttatgcatctctggtcgtggttggtgggctttttctgggataacaaaaaaggaggatgactagatatcaggttagccagtatgaaatattataatcattatcttaaaaaaaaaaa

SEQ ID NO: 2444 - DNA, 350 bp, Fusarium venenatum
  misc_feature (1)...(350): n = A,T,C or G
acaatttcccgttgttgctcagtctcacatccgactgcgggagagcattatcaacagcgccagctttgccaaggcgcattcacaagttggtgttaaatacgtcgatgagaaggtaacagacgcgagagaggcagttgagggctgggttcagaagggcaaataaagggtttaaaaaagcaagctgagaagagatgtactatcacatagagttccgaacactgttcatttgtatcaatagccggtcccgcttagagccggctaccggagcgctgtatgtattttgaataagcaggtttttggtgtaaaataccacaccattgcctgctatttattgtttaanaaaaaanaaa

SEQ ID NO: 2445 - DNA, 331 bp, Fusarium venenatum
  misc_feature (1)...(331): n = A,T,C or G
cgaagccgcaatatcttaatgatgacgatgtgctgtcaactttggtgcagggggaggatgattacctcggccttgatcacgtagatagaacaaagacactgaggaacggcgttggggacctattccttcgataaaaggtgctagcagaggaggactttgtcgttcnaagcatgtaaagtttgaaggcaatatgtgtcgtnaacgatatgacagacacgagtatacatcatttgcctatggtgcgagggtgccaaaagcaccatacatnaangaagttcagcatcggcngttatcctttgatcggcgaacgcgtagttgnaaagagaataaa

SEQ ID NO: 2446 - DNA, 558 bp, Fusarium venenatum
attcaaaatgtggagcaatcccaacccccccaaagacatagcaccatcacgacaccccttcccccagagcagtttttacccgactgtcgtttacccccccatccccatgatatcacacccataccgcgtctttttaatgtatctggaaggttataagagggaaatcatactccctcaaaatacaggccctatggtagcttgaaagctccagcctgagtgaagaagtgaggcgagagcggagtcagtggaggcgtctggcttctcggtcacaaatgcagaagctacaaaccgacgagtttacgtgtgtacgcaggagacatcatgatggttggtgttcaggcacatgggactcgcgcaggactatcgccaaagctcaaggcagcgtcaattgaggacggggtgccttgggaagcctatgctagtgcatcaggacttctgagatggtgaagctcgaaattacggaatttactgccaagtggtggtgaatctggttcaaaaatagccaggaaccgtaatcaaagttgtaaaaaaaaagaataacaggagtggttgcccctc

SEQ ID NO: 2447 - DNA, 487 bp, Fusarium venenatum
gaatttttttttttttttttttaacgatgaaagaccttttggtcgattgtgaaagggcagctaaactcgcttgccatttagtgtacaagcctgtgtataaaacatgttcctagtgaacgccttgattatccccataaccatgatattccctcgtgtcaaagcaaaaaattcgttatccttccatcaccccaagcgcttagttgcgctcgcctcggaggcggcgggcaagctggatatccttgctctgaattatttatgtggttgcgctccctatcgacggtgccaacattacagttgctggtgagagcagcaggttcgtctttcaggacatcactgaagaggtggattttatgatctcccccgagagcaaggacgaagcgcatgaggaaatttaaaaggcccaacagtaagagggtgggttttatgtcacatgaaatatcactatataattacatcccaaccaatatgcagttattatgtattgctg

SEQ ID NO: 2448 - DNA, 347 bp, Fusarium venenatum
  misc_feature (1)...(347): n = A,T,C or G
caagacaaaccacaggtagagagccaacactgggcttccctttcttccatacttggttgtctttgtctcttttccggcataattttgcgggttcgcgggctgttcggtttgccagggagttagggcgcatgggaaaaatgaactgtggttccgtngctgngtgcgtgcgtacgtacgtacatgcttgacaaagaacaacaaactttacgtggtgtcgcgttcgttgcttggagaatctctgtccgagttgagctagatagtagatatcacggcgccttcttgaaaagtactagaaaggggctgccaacttttttctttctttttaacagatcatgatttatgaaata

SEQ ID NO: 2449 - DNA, 102 bp, Fusarium venenatum
  misc_feature (1)...(102): n = A,T,C or G
ntngttgggcatantaaaaaagcattattggatnggctttngaaaaaaaaaaaataattgctgngtccgncctnttactataagggccnaatngcctaaagg

SEQ ID NO: 2450 - DNA, 542 bp, Fusarium venenatum
  misc_feature (1)...(542): n = A,T,C or G
ttttttttttttttgnnaaacaaaaatnaatccccttggccggaaattccaaaaaaacaactaaaacgataactacatatacaacccaaagataatcttacaacttggcgttggggaagttcctcatagcctgtctcacaccaagatntcccaagacctcctcggcaccaccgagaatggatcaaacttgtaggttctgtggaacatctcgatgaacttgcccataccggtctgggggattccacgaccacccaagattggcaccgactcgtcggcgacctcgtaaccggcacgggttgcgctcatcttaagaaggcccaataggaccgccaaggtcctgggcttgctggctgtagggcatgtggcacatttaatatgtcacggtttcgagccaagaactggtgggcttcgacganggcgatcatcctgacaagtttttgtcgatgacgggctggcaattagcgactgccaaatacttgacntggttggccacttgaganatcctcgacaagcttcttgaaagacgaanactcanaacatgg

SEQ ID NO: 2451 - DNA, 387 bp, Fusarium venenatum
  misc_feature (1)...(387): n = A,T,C or G
gtgacnaggttngttganagtgagtgantgagtganagtgagtggtgaggtaagatgagacgatgtttaaaagctgntgcggtccacntcanatcgagtgttctcnaggtcttccttgtgaaagacaatnccacnacgcttncatcctncgcgtcggataaagttgtcnacgctgtcnaganatcgcataggangtcgcttgggtgcaagaccaggtcgggtagtatactttgacggtagacttgcgcttattacgaanagatgtgatggccctttttcttgtagttcgcgtataatgcgtgcctaggggtagaagccgaggttgacatacaaatacttttttactttncgcttagaattgttnaaatcaaacgagttgatgaccaa

SEQ ID NO: 2452 - DNA, 1005 bp, Fusarium venenatum
  misc_feature (1)...(1005): n = A,T,C or G
gtcttctccaagccagggacgccgaaacctggccgaagcactcgcagcgatgcgatcaaacaaacagaacgatgcagccgatgtttacacgcgatctctcntttgggaccagatccccaacgatgtcgtgcgcaacttcgcnaaaatggtgtccgaatgcaacagcgcagaatgagcagcaatgcaatgaaatgagaacatgaacgacgaaacgaatccaagactgaaaagaatatcgcaacgacgaattcacggntttcatagccccccactgatctacatcaacccccatttcctttgtacattttttcttttgtcctacctttccttgaagtcggcttttttccttcctctataccggggatgagctgccatatactcgatgtcgctctcgcgcacttcagacatgttgctcacgcacccaaacggatggtcttctgtcttccagttggcgtttcttgngtttttcctatttcggagtcgtttttgatttcctatggatctagcaagcgagcgtgcattgatttgttttggggngattttggcttgnctcgaaattggatacctntttttntttgggtaaaggcatggttggnggtggatgtggtggcacttnggggtcnaaagcancgggnaaacagaagcccgcagaaagcaatcagactctatgagggcccagtccatcagagtctgtatattatcacggngcatgaagggaggcaggatggttattnccttttngggttttcttttttgttatggagatggaaattggcatacgtcgagagacgacaatgactggaatggtcaatgatgacaaaaaaacgagctcgcggngatcatttatttgtttattttggaatttattcgattctctttancaacctccattcccaggnggtctggtctgttggaccatatttatgatgacatggatgatattgagatagtatttacncngggaatatttgaacccgaaaaaatttgatttctctcatatcggat

SEQ ID NO: 2453 - DNA, 468 bp, Fusarium venenatum
  misc_feature (1)...(468): n = A,T,C or G
tttttctcctttcatatcactcggttcccacttccttacccgcattgcatattttgaccgttgtccaaatgaattattgaaacatcagtcgataataggaactatatcatcttgcgagttgaagtttggttcagctattattatcctgtcttcaaaacgcccgactacacaatagtcttcctaccctgcctactgtggacttgaaccctgatctgcttgagtggagagggaccactgaattacattttacgaatattcgcgaaaacctggggaagttgaaactgcgcgttcggatacgcggagttacccaaaacggaatttccaaagctncttcaaaatgagcaaagacgaccagactcatccagagtcccataatcaacaccatcccctcacgcgtgaaccgacacgagaaganaagacccgggaggccatagccgagggccacgatgccgacatccccagcaacat

SEQ ID NO: 2454 - DNA, 751 bp, Fusarium venenatum
  misc_feature (1)...(751): n = A,T,C or G
cacaagtccaccaacaccgagtttcagtcttatcagcgcgtctgactcggacggcttgaacgatcgagaaggtagtttctggaatctaagcagatggagaagtacccgtcagagcaaccgtcactcttccgtgttgtcgagtcccaacggatctccgaacccgggccaaagtcgtccagggagcgacttcctcagcgtcaaggaccggtcatcccaaaggatgagtctgggtatgaatgactcaaagcctagtcgcgaggaggtaaccaaccgacggagatcagcagggcctcggttgacatcgagattgtcggtgcagggcgatagcaaaagtttggttgaagaggaagtcgatacacccgagcagataaccccgactaagaagcgggtggattctggcgttggacgtataagtgacgagtcggcgacttctattcagccataacattgaatgatggtttggagttggttgatattaacagtatacaaaggggttggccgtttttggttgttagtctattttaggctcaggccgtataccatttggagaggcgtctgatggagtatcggtgcgcaacacatggtaccatagcacacttggttttttttttttttttcgaagaggagcaacanaaattntggttaggaggaggattgaaaaaggtggttgataagaggacttctncagaangcgagaangagtatgatgaccggtatgagatccgagattccagcaaaaagatacgttctc

SEQ ID NO: 2455 - DNA, 569 bp, Fusarium venenatum
  misc_feature (1)...(569): n = A,T,C or G
aaaacatctgatctttcaagtatcacccaactttcttgatcagtagcaaacaatcactaccaactatcaatcattcttctcgactaaacacaacaaaaatcattcacaatgtcgtccactgagggcatgatcaacggcggaagctcatccgcaaaggctcccgctcccgcctacgctcccgagcatacgcatgcacctaccgaaggcaatggaggtttcgtttctcagaacaagatgtccgtcgagccgcccaagaaggaagatctccagcgcaagtatgcgactgttgttgaacacgaggccggtaccaacgactggtacggaggcatgatgaacgttctcggaggtatcgtcggaaccatgggtgctattccctgctgcatcatttgtcccaacccttacaaggaatccaccagggcaacgttgggctcgtcaccaagttcggaaaattctacaaggctgttgaccccggtctggtcaagatcaacctctcagcganaaacttctccagatcgatgtcaagatcagaacaccgaantcccagaacanattgcatgaccaaggacatg

SEQ ID NO: 2456 - DNA, 677 bp, Fusarium venenatum
  misc_feature (1)...(677): n = A,T,C or G
angtaaggcantggagntgatggtgcatgcnanaagaactccgagcgtttgattgctcacttcatcttcactatctactatcctgatatgtcctcagcaacaatcacangtctgaccactgatatgtatgcaaacatgaggctcttcaggccaagagtaatcgcatccggcccaaggtagatctatcatcatggcaacatcaagattgcaatgcacgaagagaacgttgaaacagtcaaggaacagataactgcaatcagtgtgtttccagacacctgaggttttttgaacaaccagaaacgctatattggtataaacattctatatacaggatctcaagtatgcgattattgatccctaattactccagctgttccaagactagcttcaaacaaaatcatgatattcgtgtcacattttgacgtcgcacaatctctccaaattaagccatgatataggcaaggccaatggcagcaacaacaccagcgaagggagctccgagagtaccagctgcgatgtcggaaacctccttgctgcccgaagacttgccagagtccttgtagtcactatcatctgcgtcggnatcatcaagagtcaacaagcttgncaccaaangcttttctggccaggggtaacaccggancttcagntnttatgcccnctccttgnagtccgga

SEQ ID NO: 2457 - DNA, 770 bp, Fusarium venenatum
  misc_feature (1)...(770): n = A,T,C or G
cttcatatgtagggttcaattcagcctacggctcatgcacagccacgcacagccacatactgtctgccaactcaaacctactctccacttagctgcaaactcattctccatcacggatccctccccttgcctagccgccgccatggttggacttggtcgcgactacacaagccaagccaagatggggaacgggaacaaacaaaccagcttccggacacgccttggttggtcttgaacacttcgtcatcccttcaaacatccctgaatcatattcatcctgcttcctcatcccacctatatatacaactatctctccctctccgcagttcttccttcctcgaaatacgccattcattgagttcccaccgctctttgtaaacacgaaacaatgccttttgtcgcaaatactcccgagtcttatctcggtcgatccgattcaaaactcactgaaggaacatgccgtggtttgacatccaacggaaaaccatgtcgccgcccagtcgttcaacaaaaccccgcaccaaagaccgacaggcgcaaacgtccgtgacccctgatccacgccaatgaaaagtctctactggtgggcagcatcgtgaacaaagccaacatctcagcacaatctanccctgggccgcgacccaatgcgacaccaatctttggaangncgtacgagcttggatacgttgacngatagaattgggaatggngggnctgaacgaaaaagaaacatgggaacnggagaatggatgggtcgnaaccacaatcga

SEQ ID NO: 2458 - DNA, 276 bp, Fusarium venenatum
  misc_feature (1)...(276): n = A,T,C or G
nggagtttaagggttacccttttaaanaaanacccttntcctttntttggggatntccanagggatntttttgacccccccgggccancggatggggatncccctggccagggcccntttgttgaaaaaaaaagtttccgggaacttttccccggggggcaanttngggganaaaaaccggcccttnanaccccccatttggcccngggccgggctcgtttttggggnaaaaangggtgatttcccccccggnaaangaattaaaacccccttaac

SEQ ID NO: 2459 - DNA, 589 bp, Fusarium venenatum
  misc_feature (1)...(589): n = A,T,C or G
gacgtagtctctgcttacacacacatgacagcaggcctaaaaacttacgctaacttgttattgttgattatatttacaggggacagggcttgatgcactggccacgcgggagctggggagctctctccactaactcgaaaagatttcggcgctgaagggttcagatcttggatcgtgtatgggacgggagtatgaacaatgaacaagtccaaggcgatcccgattctttcctggcaatttttgctggttagtctgtgcagcagcagagttatcttcggtacaggacaacttgtagtactaagactgctgctgccaatgtcacacggatctaccagcccatctcgtgtaagccaatatccaaaaggatgtattactgataatcgattcgtccacaggtaaccctggtctatagctcaataattcccaaacgagattaccgcacgaacatgtcagcaatgtctttccaagtcgagtctctgtggcgtttattctctttccaaaaatgaaaangatgcgcacctcaactacccttcggtccaaccatttcgaaccaagacatgcagantccatcgtcaagtcgaaaaatgca

SEQ ID NO: 2460 - DNA, 594 bp, Fusarium venenatum
  misc_feature (1)...(594): n = A,T,C or G
ttcaagcaacaacagcagagacaacaacgtcatgagcaggaatggaatcgcccccggacgcagccctgacaatttcgtcgactagcgtatgtgcagccctcatcgtcgcccgctgcatctaccgactggtgtttcgatgtcacatccacgcaacatgccatcgtcgctggcgcatcgacgacttttatatgaccatagccattctacctctgatcggtcgcgccttgtgtattctgttttcgttctaccttaacccgggaccacacgtatgatccagcgacgcaagctgaggcagatggctgggatgttggtgtgcaagatttgaatagcgagagggagctttctcacaagttactcatccctgcacgaatcttttatgcattatttttatggtgcttgaaacttgggactgctggccttttattcccgcttcatcgatgtctttcgttggggcaagtntgttacagatgcgctttggtggttcatcatggccacatttgtcgcagtctttataacaatcctggcagaatgccgcccactatctctaatgtgggcgctcaattatgatgctagcaaagttgcatgcaccgcgcc

SEQ ID NO: 2461 - DNA, 290 bp, Fusarium venenatum
  misc_feature (1)...(290): n = A,T,C or G
aaaaaagtaaaagttgagtttggtgatggctctgattgaatgctgtccaagtgcttgacacatgctaatcgtacgttttaattgataaattaaaaagtggtgtacaggtgagtataatgatattcttcgccggccttaaagtggaggtaaatccttcataataattaaaggaaacangggggtgtagtaagaaaccgctaataaatgggtcgggctctagtgtattagttgacaatagttgagtgagatgagatattccttgctcttgaattgaagtttcttttgtttcg

SEQ ID NO: 2462 - DNA, 562 bp, Fusarium venenatum
  misc_feature (1)...(562): n = A,T,C or G
aaatcantcaagaatgactcattccaacgaccagaagattgccgagactcaggccaaccttnctctccccgaccagccccccactgcctctgactggcaagtccgctgacgcccgtaacgtcaacgttggcgccggcaaggtcgagggctcagttggcactgatgcccatgcccagtctggtctccgtgagcccgctaccaagggcgaggaggtcgacttgagcaatgtcggccgcgagggtgttcanaanaaccagcaataagtgctgtgcctgtntgtacgatgttgagagaaatgaaaaggaaaggggacggagagcgatattcgaggaggttaatgatacctacgtataatcaatgaagcgaactataagcattgaaaaaaagccaagacaccaatgactgccgtgtcaaccgggtacccncattcncccngaagtttttgtgtttttgtttgcccaaccttggctttcctttgataccttacccccggngaatccgcgcttacaaatttggacncccgatttttntgaacaggcttggaccnccaatggcgatccct

SEQ ID NO: 2463 - DNA, 112 bp, Fusarium venenatum
  misc_feature (1)...(112): n = A,T,C or G
nccacaccngcataaagcccgnagccaatacaanggccaccgacagcatncaagaccccngcggncacgacaanngagcgcgacnncgaccgcaangacacacaagcccccg

SEQ ID NO: 2464 - DNA, 620 bp, Fusarium venenatum
  misc_feature (1)...(620): n = A,T,C or G
ttaaaagacaccaagaatcaaggggcgacctgtaccaccagcaatgcaacacgcgagcgcgcacacagaggggactggatcgatatcaaggggacttctttttcttccaattcgagatacccattgtttatttccatttggaatgacgcgagcaagcgaagccaaagctatacggcgagaagaaaggatagcaacgaacgaggagagggatcgacaggacacggcgattattattttatcgttctggaatttttgtttcggagcttggatatctttttgacacttttactttttctttgtcttctttttttgttacttttgattgggaccaagcgcgttaggataacaaaaagtgattcgcacttagaacggaacagttttactacacggtaattggaggatctaacgtctttaacgttcctcattgatggatgttttggaaagcaacgcccctcatgcactttttatttanatgggtatgaaganggtangaagttgggggagccagggaatatggctgggctattggttatccataccactttcaagttggatattattttggatcngggttttattttaaatattttggcaaaaaaaatcgcaactttatttnccaa

SEQ ID NO: 2465 - DNA, 264 bp, Fusarium venenatum
  misc_feature (1)...(264): n = A,T,C or G
ncgctaanaacatacctaaaatatcacacagtgtcaccaggaggcctcgcaaggatagtgcgaacgggatagagcccggggcgtctcggactctgggtagtgtaaactagtaattatttctttcttcaagcatgatgaatggaaactatacggcaagatgcgtggcgtgcgctcgaatgttattaggttgagtctcgagtgggtgaagagcaaacaatgatagaattgtcnctaccctaaaaaaagaaaaaattcaaaaaaaaa

SEQ ID NO: 2466 - DNA, 633 bp, Fusarium venenatum
  misc_feature (1)...(633): n = A,T,C or G
cgccagcgtnttaaccgaacccacctaatcattccgcatacattctcacacactacacctgtctcactaccaccacctttaacagcatcttcccatcctcgtctgtctcatcaggtggcattgacgtcaccgccggctactggaccgactacgattcatgattgtgaccctgcaagctgaagaagcaccatcaaagtcgtgcggaaacgaggggtagcaccacattatcccggggtaggagaagctagaggcgcatcgatgcatcacctgctgcggcttatttcacttactggttcaaactgcaactcacacccacgacccttgggctggcacccatcaagtcattcttcaaccccgctattatggatcccaaccagcgattctaccatacttcttgaaaagtgnaacggttcttcaagacctnatcgatgggtaccgctattgccagtgttggcggagagcgccaggaggccattgatcacatctcggctagcatcgnaaagctacagaacgaggtgcggatgctgaaatatactccttcctatgatcgaaaccatactcagagctatcaaacttacaagnaaagtggacgagatntactngatgcnccaagtcgaatttaattcgccggca

SEQ ID NO: 2467 - DNA, 633 bp, Fusarium venenatum
  misc_feature (1)...(633): n = A,T,C or G
accaagcatcaagcttcctttctcccgtcgtcactcgacctcctcgagctcggcagaatctgccacatcatcagcagtgacaacgccagcaagttcacccccgaacgatggcctttaactaagaaccggcgaaggtcgaattaattcgaccttaccaacacgntgcgtgcttaacatgcttcgcaaatttcgcctttgctccaagtnatcttcaaaggcttnactggcccatccgnncggcgtttnttggtgcgccgccgntntcctgcccttaaactttgaatacattcggattggcnaaagtgaaaatcgacacttgtacaaggtggcatggtggtgcanaaattaactgnggggcatgcttcancaaacttnggtggaaatatgtngatgcaaggagcaagggcagaaataccaaagtcggcaaattattctggaaatggagcnggtcgtgatatatcgaacttggaagacncatcgatgaacatgaagagganaatcccgcgacctccaanaaaggtggtgaatgaaggaaggtgaatttgantcttaccatgatgatgaatgnggaaggattttttttgcggcnnttgggatcttnaattttggnaaggaggcnaaaggaaaatgatg

SEQ ID NO: 2468 - DNA, 626 bp, Fusarium venenatum
  misc_feature (1)...(626): n = A,T,C or G
catagctgggcctcctatttaactgccaaaaagtgtgtaagtcgcatcactccccactgttacataccgagtccaatcccatccattgcatttgctcttcaacggcgccgctgtgttggcgaccccactttaccgccgaggatttgctcaacaacgtcagtaagctctcactagccacctcgagtgagcttgctgggggagcgattttctggacaaagtcttggtccgacgaggatgctcgaaccaggctggtctatagcggagacagggtggacaacatgatagagagcagagttgtgagaggaagagagagtagcgcagagaccgagagaaggtcagagaagacataacggccgcggagccaccggagagccaccgggcaacggagctcctgggaacttgaatcgggctgaggtgtgcggtgaacgtccgtttctgcatgggatgatccctatcatctcactggatggtgcggcgcatcgttcaacagtctcagcccattcaacagtcctggaggtccgtggaattctgnatacnggcccgtgactctcagctgattcgtaacggacgtcgggtctcgccaattgagacgcagaatgctgcaagatgaattagaaaaaaaaaaa

SEQ ID NO: 2469 - DNA, 355 bp, Fusarium venenatum
  misc_feature (1)...(355): n = A,T,C or G
tgccaacgaaatcgacgtttctaccgtgaatggtatcctcgcagccggtatggtcacttccaacgtcggtgctaagtggatgggtctccttaaggaaggttccaaggtcacactcgagatgtcctctggctctgatggggatgttatcatggaggagagcaagaacgacaagacgggtggagcagtgagcacttactcctcttggggacctacttgggagatggacntcaagccccaattggctctcccggnggaaacattntttcaacttatcctnttgccaanggggggtaccctnttttttntggaantaaaaaggnttgccccttggcgcccgntactattgnttttattg

SEQ ID NO: 2470 - DNA, 501 bp, Fusarium venenatum
cagaggtagtttcgcctctgtggcaccagaagatatcaatgtcggcatctcattcaatggcgcaagtgttatgcccgttcagcccaacgatgtgaacggcacaggcttggttggcaagaagccaagcatgagcaagagagccgatggaggaatggagttgctgcgatcatacatgctggttggcaggatcaacgctgacaagatgacgggtaatatgactatggacgagctcgaatcccatctcatgccaattcttaccctcactgctcgcaacagcagtggggctatgattcggacaaacgtctcagtcaacgaagccgccttccttaccggtgtcttctcccaagacattgtcttgggcgactttgccatggcccaagccgcagtcgacgaacagattgccgctctcaacaacggcactgtcgccttcatcctgcctggcgtggactcatggtcttccccatccgattgatcatcacaacatatggctgctccctttgt

SEQ ID NO: 2471 - DNA, 539 bp, Fusarium venenatum
  misc_feature (1)...(539): n = A,T,C or G
ggtaccaatagacttgtccatcgcaaagtcatatggagagctaactgcaacaacaatcagttgcttcttctggcctctagttcgcagcatggtacgctccctggcacgttgcggaagagcaaaaaagtggtcaagtctaggcagcactggctggtcgaggagtacagctccggacgtgacgcatcgggattgaatgaccttcttcgggctgtccaccgagcaagtgcaccagatctacaattcttacgtgcaacaacggccgcctcgtttcagctgaacaaccccagcattgccgagtcccactttgttgtcagaaacagtagcacaaatgctttgtatggatcgctgccacttattatgttcatggcgtcggcgtcatgggtggtgtgtttgtcaanccaccaancgtgattgtctatcngaagtctctcnccgacggcaatgaagaactcctgccactcaaagctcaacaagtcanaatgnccgctttccggaatttcctnggtacccctgaattcaggtaacccataaaaaaggtc

SEQ ID NO: 2472 - DNA, 522 bp, Fusarium venenatum
  misc_feature (1)...(522): n = A,T,C or G
tagacatttcccttctcacgagattcccgattgcacattgactttcactattcgactatacttttctcacggcgttaagattcccacggttcctcacttttcttcacaccaggcgacgagacnaccaccacacgcttgtttcagcctgtgcaacgcatgggtattgtttgatggagtaatttgggacagggtccccggtcattcgacttgacagcctcactttcggggtttggctttggctttgacggagtatcacaagacatggcaaagcattcatcaccttcgcacccggcacatacgggggatcggtcttttggaattggatgggacaagacaagacaaggcctggattcgctggcactggggtttatttcatttcaggggggtttttatgcaaaatttggttttttttgttggcacagattttattgctgttgtatttgactttctggcggatgatggcgtttaaggatgaatgaatgtttgttgttaattgcctctctcaattcatattatcacttg

SEQ ID NO: 2473 - DNA, 104 bp, Fusarium venenatum
  misc_feature (1)...(104): n = A,T,C or G
nctttgggcggatgtatcanccaaaacacatccnatggtgagggacanacagccttggggaaccaccncnttggggggacttctgatgnggtgaanagaggttt

SEQ ID NO: 2474 - DNA, 571 bp, Fusarium venenatum
  misc_feature (1)...(571): n = A,T,C or G
cagcttcgactccatcaattgaccacccgcagccggtctttccaccccgaggagctccgatttcgattctacgaggcatctggctctattttcacagtctcaaccgccgcaatgtcttctctcactcgtcccatgctccgctcaccggctctacgtgtcgccgcccgacgcttcgagagcaccactgctcagaagctgctgagaacgctaagcaggctgccaccagagcccaagagggtctatcgcgtgtcacatctactgctggtcctgctattgctggttacgcaaagggtgttgctagcactttgggcaaggttggcggacgaacgggcaagatcatcggctttgttgancgacagtcccttcgtctctactactccaaggtcggctcaactcggcaatttatttccagaaccaaaaangancctcccacatnggcacttccaancactacaaacctctcantctcaaaacgcacttatcatctctaaactctcacaatnaaantggctccactngtcggngtnttgcgtnagtcncgttctcncgtgggaatatggcaatcactttg

SEQ ID NO: 2475 - DNA, 475 bp, Fusarium venenatum
  misc_feature (1)...(475): n = A,T,C or G
ctcgaaaagacaagacaatcagaaccatcgattaaaattgcaaacatggcggccaagactccactttctcaggcttcctatcagcctgtcccaagagacgaccctactgctgatttgctcganccctccgagagagacgacagagaggatggcaagccagctctcttgagggtcaaattctccttcattctgttgttgaggttgttgattgccccgctcgtcatcgccgatattgttttcatgtgcaatccctattactctcccgcctcagccggnatttttgctaccggaggcatcttgttagccttctggcatggattccgtgtctngaagagctgcttccctagtggaagccgcgacaacttcaacctcaagatcggaagcctgttctgcatgtgcggcacaaccgtcnaattctcccaccanaccctccaaggngngggcgtatctcgtcagccttgncgactttttcttt

SEQ ID NO: 2476 - DNA, 461 bp, Fusarium venenatum
  misc_feature (1)...(461): n = A,T,C or G
caaagttcctaaacaactttccaactactaccaaatcacacattttcgagtaattcctcgtcttcacaaccgacaacatgcctttcaccgctaggttacattcccggtattatccacgctctatacatcatcctgaagtactaagccttaccgcacttgacttctcagggctacagcgcatcccaaatggcttaatgagtaccccgcttcccaacaaccgacaacaactggtcagccatcggttgtcctggaccaagcgacattctgtctgacagccaagacaccaatgactgccgtgtcaaccgggtacgcgcattcgccggaagtttgngtttctgttgcgcaaccttggcttcgtttgataccttacgccggtgatncgcgcttacgagtttggacgccgattttattacangnattggacccangcnaaccagttcttntttttttggtatttgcgg

SEQ ID NO: 2477 - DNA, 567 bp, Fusarium venenatum
  misc_feature (1)...(567): n = A,T,C or G
attaattctgtcaaacgaagggaattctcgcgcatgatctcgaactttacagtactttaataatttcatcgaaatcttcaaatctgctattgccgttggaaacgcaaaaaagtgtcgacgtgcacgatttcaactcagagaccatcttcggcactctagcctctaaaccaaggcaaccgtgattcatgttgctcgttcattgaaaacctgccattctcacacttcaacaactaccatctctaatctccttgctcatttccaccaggcgcatgacaacgatataaattattcagcacgcgcctccttcaaccatggcagtccaagatgcgggcggctcagaaaaccaggaagttgacaaggcggcgcttcttgatcaaatggtagctgcggctcaggaaagcgtgacgcaaagcgaagaccaagaggagcngccaaacaccgaaggactcaacgaagaagacccctgcggaatttgactggcactgtccgagaccagaatgatctggaacgtgacatcacactacaagccaacgctgccttgaatgaanctgaagatnaaaaaggacc

SEQ ID NO: 2478 - DNA, 633 bp, Fusarium venenatum
  misc_feature (1)...(633): n = A,T,C or G
cttctaaacagatggagcaggtttccaacatcagcaagcaatacgtcggcgactacagcgacaaggtccagggactcctccaaggcaagactccttctcgccagaagatcgacatgcctcagaactccaactctgctctccctgccaagcagcctcagttcccctcccctcctactgatgagcccattacgtctgccaaccctccccaaattcctactcccgccggtttgagagaggagattaacgagcccactggtattgacactgcagctcctgagcttccccacnaaanatgttgttcccgccaaggagcccatgcttggtttttaagtgatggaagcagtgcagttgccacatgtacttgagctgaaaaggggcatagattgcctgaacaataaatatgttttacggcattttggggcgcacgtctttccttaaatcgggagcaaaggattttcagattggacagggcgcgaatcggtttttgggatcattgctcaacacgcaatacaaacagactctaattgacgtatgatgaacgatggttaaaatatggatggactggacggatactcntctcttgaagagggtctgaaaattagcaccctcgcttaatgcgtttgtggagggatt

SEQ ID NO: 2479 - DNA, 593 bp, Fusarium venenatum
  misc_feature (1)...(593): n = A,T,C or G
cttttcgctccaatggttctggccgtttgactgtcgccgatatcgccagcttgaagatctagtccgctcccaggaagtacagcccgccatcatgcctctttgcggactcatacnaagccgcagcgcaaagggtgacaagccccggcgcgcgcgcaccatgtccatctttggcaactcgaatatccacgccatagatgctcttaagggcatggttcgtttcaccaccgccgcgtntccagctcacatgcacggttgggattcggatacaacgcataaacctcccccgaccgatnaatgctccagccagaactcgaatccacaagcaccaatcaccaacatccccgatattcatatcaccaatgagatgggggaaaccctcgaccgtacatatgacgacttgcgaggcttaaaacctcgactntaaaaggcaaattggtggaatttnttcnaaatgttcagggcgagagtganagtgcnatcagcgaacttgtccaaggnggattattcactaggngaattaaatacccatgggattctgacttntaatgggaagnttttgcccntttgcccnaaaaanacttttaaagccctta

SEQ ID NO: 2480 - DNA, 376 bp, Fusarium venenatum
  misc_feature (1)...(376): n = A,T,C or G
ggagaacctngggggttgttcaccgaggagcatacagagaacatacatcatgaacccatagattttttgataaatcgcgangggggaagagtctttgtcgtcacagccactcctgagacccgccattctttcgatttcttgatgttctcgnggccttgtgaggcggttgtagtgggggtggctcgctcatattgacgtttaagcggggggtttgatnttttggagactggagatcttcataaaacaccgaagtgaggcaaccataagtgggtttggggggagttaactgngaaaaagttggaattggtgaatatcttgtctcgctnttgttcagttgaatcgtgacgtcttcctttctnagcaattgtgtctncct

SEQ ID NO: 2481 - DNA, 546 bp, Fusarium venenatum
agccgctctaataccggtgtctagatgaggtccatacgcatcacggctgccgaatttcccggtaggcagtgtcaatgttattccatgacttccgtgatggtgctattgccgtcacattgactttcaccctcaccctcagctgcataggtcttcaattcactacgactacaagctgaggtctttttcttcttccaagtcggtcagcgacagcagcttccgtctcacacccccaaataggctaccaataagacaaaaccgctgtatctaacctgaaataaacaattgtgccagacgggctacagccccgatgtcataacgcaccccatcgccgtacggaaggaccttttagctcgccgaatggatgacgttggctcatgcgtcaagggttctcttctgcttgtcttaatgctgctgccttgatgtcacaaacgggttgggtgacaggaaccacaccgcaaaatagaacaagaaatgggaaatgaaggggaaggagggaaaacaaataaaaaatagaaagaaattaatgacaagaatcattgaccaccg

SEQ ID NO: 2482 - DNA, 509 bp, Fusarium venenatum
  misc_feature (1)...(509): n = A,T,C or G
ctgcatcgcatcctgaagccttccanaaatctctcatctacgcgtatggcttgcgcaacatcggctcgggactcaacacgcttggtctgtttgctttttggcaattctcgcctatctgccaagtcagcccgttagctgcggnggtggtccaaagatgtatgggaatttgtttcatctgtggatccctggttgcagctggcgatgcagttgttgcaaggcgttttgcaaaccaagaacacatccagggagaggccgaggataaagctaccaaagctagcatcagtcacgccgttactggcgtggttatcctcgcgacaggtctgtttctatatctttgagctagtgtgttttgnggnggacattcggatcttgtaacaacatcttcgcctctctggtctttatgaatcattactgtattttgcaggccgattgccttgatcttcngaaatgtatgaacaaatcgctctctcaaattgaatgccgataaattctntttnaaaaaaaaaaaa

SEQ ID NO: 2483 - DNA, 494 bp, Fusarium venenatum
  misc_feature (1)...(494): n = A,T,C or G
caacaaagaccattggaagatgcatctcgatgctgccatcacaatgtttcaacagatccttcctcagcccgagcattggaaggaaacgctagaagctctctacagttaccgttggccacctcctgagatgggcgtccgccgaccctttagcacaaaccaagccgcgcttcgtttcttcacagctaacgttctttacatcgatgtcatgtccagcataacgctcgagcaggcgcctcgccttcagaagtaccaggaaatcatcatgcccagctgcaaggcacacgtcgcaccggaagaagttcgtatctcaggatcactcttcatggaagagtatgtcggccttcataattgggtcgtccagatcatcggtgatatttctgcattggacgcctggaaaaaggatcaaaaganatcaaactccctatccatcaacgagcttgttcaacgaagtaaggtgctggaaggtgctatcaggggaagattgagtgtcattg

SEQ ID NO: 2484 - DNA, 541 bp, Fusarium venenatum
  misc_feature (1)...(541): n = A,T,C or G
cgatatcattcctcaatccattcctcgtgcttctcgagcgtgggcagtcccaggctcaaccaacatcatcccagccaaattcccctctgcctcacccaaacccacaacttccgacccgnaagaaattgccaccagcgtagtcaacgcgttcaacanggccctacagagcaaagactaccccgctctatcgcaactcttcgccgaagacggtttctggcgagatcatcttgcgctcacttggtcctttagaacagtccaaggaccanataatnttttatnttttttgaagcaatcttctcaatcaaaaaatgggtttcgntnggccaaaatcggtctcgataccagctccgcagngcgaaagcctcaatccatccctatcgatggcangggtgaaatacaaggggtcaatttttttcactnttganccgtctaagtaccggactggtcttgcccnatggnggaggcaatggccagnggaanattttnctttctaccncccnttaatgatctcaanggtatgaaaaaactgncaaccaccttc

SEQ ID NO: 2485 - DNA, 1008 bp, Fusarium venenatum
  misc_feature (1)...(1008): n = A,T,C or G
ggcgtaccctccttctgttgtcaactctgccaaacgcgcacaacccggacatagcaacacatcatgaagttttcccacgtagtcgccggcttcgctgccacggcgcatgcttttagtcccaagttcaacatcttcggcgacaacgataatgccgacaccaacgctcctcataggatccctacggcccatgagtctgttgtcatggcgcgtcgcatccttgctctcaccaaggtcgccactctctcgactgttttcccttctggccaccccaacggtgatcttgccatcgatgaaaaacgcccgaacggactcgaaggtgtgcctattggcatgatggaatatgtggcagaatgcgaagatgaaggtaaccctaccattctcgaaattaagatcgcaacaacgttcaagaaaatccggcgctggatcgaaacttacactctccatgaactggggtccgccctatccgcccgccaagcgcatctccttctctctcgtctctcggcatatattcccttcctccctagctacaactacaacaatcgtgtcaaggaatcttccaccccggaacaccgttccttactcagcggccaatctggcccggttcgcccttttggatacctggagcccattgaaaccactcccgtatnggctgtcaagcttgcagcatgctttacgcgcaagcatnaagacgctaagtactggctgcangtaatgncattcatgagagctcatgggcgcgcctggntgtgaccaaaaaatattgggttggcggntttggcgaacgggcgcgaantggctggctgcctgttgacnaatgggaagagcgtcaccagagataaatgggagaagcatcaaacttncccggtgaggaaanaaggttggagccantggtnaatnaactnttgggggagagctngaaaaggngggatgacctgnccttnttggaaaaagcttaacttttantggtgggtttggggggannttcggcgggnnaaacttttgctatgg

SEQ ID NO: 2486 - DNA, 527 bp, Fusarium venenatum
  misc_feature (1)...(527): n = A,T,C or G
ggcagcccctccaaacaccgcctgacgaaaacacttcaagcaagatcaaaactgtacctgattttaggtggtcttgtccatacctcttttactgccacctcttttactactacctcctttagccttgaaacgacacganagccgcttacacacattacggctccttgttcttgaacttgaccaaatcttcaaaaccggctatcgtcattgtcgactttggtcaatttataccccgctcccgcgacaacaattgaatntccagggacctgaacttggccggagacnaanaacacgatggcgcttccgtccaggaaaatcttgntcgaagcttgccgnccgcnacaccnttgagcttctcgacnantgcctagagtcgaagaccgacccgaaatctcaaagctcntctccaaaccaagaaccgttttnggcaacactctacatgaaactgcctctcgccgaaattacnaatctccaaccctccttnaacacccggaattccaattggntcctgttaacttctgggaagg

SEQ ID NO: 2487 - DNA, 834 bp, Fusarium venenatum
  misc_feature (1)...(834): n = A,T,C or G
ctctaggtgcttcgttcgacaatgttcaacaaactgctccttctgggtctggcatctttcacctttggccaggatgatgcacctacaaattccagtgtcatcgatgaggagatgggccctgccgctttcatgtggcccccagaccgtgtttggtcgggagacatggataatagagctccttgtggctcacgggctcctgcaggcaacagaaccgagtttccactgactggtggtgctgtttcccttgtcgcgcaagatgattactacaataccaagattagtatttcatactcaaatgacccatcatcaaacgacgatttcgatactctcatccaagagaagagtattgcagacctcaacccaggtcatagctgtgtaaaagtctccgacgcgccatcgagcgtttcagcaggcgataatgcaacgcttcagattatttaccgcgccgactgggacgctccccacaaccaaacattctacgcgtgtgcggacatcacattcgtctcaaaggctgacttcgactttgccattccatgcttcaacgttactgaccaggagacgatgacaaagcccgccggtgcaacggctgatcctagtccaagtgcgacacatcttcatacctctgatgacggctctgatgatgaggatgagcaagccaagcggtgccaagaaaattaagggggggggctattgcttggcattggtggngggctnttgnggcgggtgtagtctttgattggttggccccggntnttgttattgtgggcggcgaaanggagcaggccaagaaaaaacttacggattgnccgtttggaggataatgttcgtaagcat

SEQ ID NO: 2488 - DNA, 522 bp, Fusarium venenatum
  misc_feature (1)...(522): n = A,T,C or G
cctgtttagcgattttatgctgtcgacaagaagcccgagctcgatcctnttaagcaaccagtattgccaacttcccaaactgtcacatccganagaatccacganaccactatcgacgatgtcggcganaccaaggctgttattggagaggttccnaaaacaccccctccccctccccctcctcctcccgcacctaaaaagaagggtttcttccnaagactgaanaactttgtctttacccttctcgtccttggtgctgttggcttcgctggaggtgtctggtactctcgtattagcgacaacttccacgacttttttactgcatacgtcccattcgccgagcaggctgtctttacctggaggagatggattacaagaagcgattcccaacgccaccggccgatccaaaaaccaactacgggggatgctgtaaanttcccnttnaaagcggtctttatggaaagttgttgaggccaacttactcgagngtggcctgttgnttgcnccaanaggtaaggaaca

SEQ ID NO: 2489 - DNA, 631 bp, Fusarium venenatum
  misc_feature (1)...(631): n = A,T,C or G
caattgcctcgatttgcttggttgattgaggaagacgaagagtaaccgttccaccgaccagccgctgtgctcaacatcgcacgcgtattctactaaatcccgaaccccgagctgcgccttgaagctcgtacgaagcttgaagcaaatctacaatcattattgcagagcccgtccacgttcttcctacatcatgccggacagcattttctatacctttacggcctatgccaccctgattggcgtcggctatgtcatttatcatgtgtccacccaaaaggctcgggctcaggccaaaggtcaaatcaaacctgccaagaccgtacagccagagacacgtaaagaagatcgaaagaagaacagccgccaggaggccttcgcaacagaggccaaggatcctctaagaagccaaggctgagccagacactatgctggtcgaatagtgncaaggagaaagatgaaacatcgccaccgcnagtcgccaggagttncaaaggccaaggagggaccaagttgntncaagttgatgctggnaacagcgagaaagctgggaagcatnttgggccacaaggttgccagtgttccgaaanaaggagtcagcccagnatttaccatgggngccgacccgcaatnn

SEQ ID NO: 2490 - DNA, 404 bp, Fusarium venenatum
cgttccacctcaaagacctccgacaccacaaataccaggtcgacgcgcaaacaatcgcgattcaaaaaggccagagacactgttccacccggccctcttgacgtccctgccactttcattgatcaagatcgccccactgcgcccactggccccgatggcacaacactcgctgacacattagttgagcgtgaaccaacaagggctgctcagccacctgacgaattcgacgatgagttgatattacaagaagttgccgatgagcatcacaagctgcgaaagaaattcatccagcgggaaggtgggttcctcaaagaagatgagtctcctatccagcctctggaagagcaagatggtggacgggagcgcgtcaagtcgcttcaaggcggcgaagctctcgaaatatt

SEQ ID NO: 2491 - DNA, 464 bp, Fusarium venenatum
  misc_feature (1)...(464): n = A,T,C or G
ntttatcaccatggtggtaaacacattctcaatggcccaagttgctgtcccgatccgccatgttggcaaaaaaatggttccgactgcgtcgaagtgtcacgggtgaacagggagaagtcaccctttgaaagaaaagctaccgaaaatgatttttgccttgcaagaagtgcaanaaaatgcttcccgaaagggaccgttacaagaagttccgagggagggcttgaccgaagttctgcccccactggtgacaaccactttgttatcgatgcgaagacaccccaggcgggcccttgttcangtccgaggagccgaaaaaccgtggccgaatgggaccaacaaaaatgcttcaggggacccgacaggacaaanaagacccaagacttnagggggccttcaagggtcccntnttttggacccccgtcaaatggatggccttgacaaagctagggattaaatggggaagc

SEQ ID NO: 2492 - DNA, 354 bp, Fusarium venenatum
ttcggttataaaagacactggaagaccaaaaaatccttcttccttcttttttcttttctccttcccctttttcgaatcaaggcacattttcgtgggtagcataaagaaactgggctgggttaggttgggacaaaggcagtgggcaaacgggacaaggcacgataccgcacaatggcgttgaggaaaggctgggcagttcttctttggttcttttgttttatatttttctctgcttttccagcagcatggcgatggatgttcatgatgttggcctatttacccttttttcttatattttagtttacgtaaagcaacccgcagcattgcgtgaattgataattcttttgaactgtt

SEQ ID NO: 2493 - DNA, 573 bp, Fusarium venenatum
  misc_feature (1)...(573): n = A,T,C or G
ctgcttgcgggtcatgaaaggtgtggccggaggtataatagtcggcagcggcattgactgggtccaagacgatgaactgcgggatgttgtactcgaccctgagactgatgaatgatcccacacaccctttccgaagtccagaattaccaactatcagttgtctacctgtgcttcactaagatgaccatctccttgtcgatgatcccaccacacggcacgaaagtcaacacccgtcccgtcccgtcgggaaggatacgtaccgtcttgaccaggacgggattgcaagatcttccgacgtggagacaatgggtgtctttgagagaatgcaagcaagcaagactccatactcatcagctaggctttgcaactagcgatgcacctttgcggctgtccctggaagaacatgcangtgccaggcctcgagcctctctagccttcatcctcgtttcaaggtctaacaattcacgaacaaccgaatcatgatctcattcatcagancatcccggtagggtttantagaancaagganctatgaccatcagtctgttgggatataccgtgatatctcttggc

SEQ ID NO: 2494 - DNA, 768 bp, Fusarium venenatum
  misc_feature (1)...(768): n = A,T,C or G
atttaaacagttaggttatattgagatataattaaatattatcagctctattacgcccacgacggtgtatacgagcattctaagtatgacaaccgggacaatcccagcaagacggctcatcccaaacatggttaatattcggtctagtgacaattgcctctggagtaagagcattatcagcagtgtaacattgaccgtttatgtaactagatccaatgcaccgactgttcgcccggcaaatagcagcgcacttcgcagccgagctttgatcagggtaccactcagaactcataccgtgatatccggttgacaaccatcctgaagtgttgcaaacgccggtcgcagtggtcgaacgtgtgcatacgtcgcttgcttgtagttgcacgtgggactcttgggaagaggactgttattggggacgcaagctgggcacgttcagcaggatttatgactccaccggcgcttttggggtcgaagctgggatcatcatagcttggatcggcttctgaagatcaaaagctggtatcttggtgatgtaaagatacagtgggtttcggaccccagaatgcggaggtttacaatntttaagggtgtccaaatgnttggcattgttccggctttctgnntggatttttgnaacagggttntccacttggacccanaaaaacccttggatggcaacctaagngnttttcgaccccggtgagnttttttncccttttccnggggtttttngaaaccccnggggngggggggttaaaaaggggg

SEQ ID NO: 2495 - DNA, 577 bp, Fusarium venenatum
  misc_feature (1)...(577): n = A,T,C or G
gtacgagctagacatgatcagtgtcttgcaagctgcccgttcacgatggcaaacgttggtcaactgccctatcgggcgttgttaagttaaacccggtgacacggcaacgaagacgtcaacgcaatgtgaaacaaccatagggcgatatatcgaggaatgagtggctttgctacatattactggtatatgatgttcaagaacggcaatcgattgtatcgattgcctgtttcctattctggactcattgatggctatggaaaggtgcgcctatcaatgtatgaggttcaaaaggagatgataaggatggggacctggaaaaaccatgcctggggctggtttgaagangtcactttgtccaagtgcattggacacgtttaatgacttgatgtaccgatcgtgatggcaagcagtggactgcttantggatctgtgtttcttgcgtaactggagttcttacacggatacggagaccaacggaggcaacctgttggttgggagattggagttgtgatccctcattaatcctatcttgcatcggagttgggggtgttttggtaaataacatttgcttaattnt

SEQ ID NO: 2496 - DNA, 526 bp, Fusarium venenatum
  misc_feature (1)...(526): n = A,T,C or G
ccagaacttcataatcagcaaaaactaacttggtcatatttacttgaatattggccatcatggcgattccttgggactcactccgttccctcgtcatcttcttcggacccatactcttaccaaaagctatatcatactaccgatcagtcaagaataacccccacggccgtcatgtacccatagtacccgtcccgtttcgaatcggagttgcgctcgcgcttctcgctatccttatcatcacctacatcgccagacgctcccgccttttcacccgagaacctnttctcgccacgcagagccgtctgcagatcccgtcgatgtcctcttcaaccgagttgctgtggaagatcggacaatatncttacaaagcaggatgaggcgctgaggggcaaattcgcaacttggagagcgattgtctacctccaatttggncccgatggctggctaactgccgttctgacctcggangaacaaanacctttttaantatgccctccacagttttgnggcctacatngnaaccttt

SEQ ID NO: 2497 - DNA, 611 bp, Fusarium venenatum
  misc_feature (1)...(611): n = A,T,C or G
gtgttatctcaaaatttcgacctcgatttttggaaaagagacgggctggtctacaatactttctcaattgcatattactgaatccagagttttctgggtcgcctgtactcaaggagttcctctttgcataacgctgccattgttccagcatcttctcttcgttacaaatgtttaccttctgaccttgaatatgaggcctctttgtacaaaccatatatatagcttcggcctggtgtcacgcacatacatatgcgccggtcaggtgtccatgttaatgataatgagttggatgacttacgtgttaatgtcttacagttggtcctttatgctgctacgaagtcngagttgcattaccccggctttggttgattgggaggccaagacagtccaagatttggcaaagatggggaaagagcaagactcttcaaatcatncagttgtttgcaaggcggagctgtgactnantggcatgccatccttggcgttgagattcgnacagaanggcggcataccnccnaggcggatgatgttcggcaatcaaggntgncaatttaggcnattccgggggtaagtggttttcttggnccactttnttaaggttganaatggtt

SEQ ID NO: 2498 - DNA, 105 bp, Fusarium venenatum
  misc_feature (1)...(105): n = A,T,C or G
ntggnctggttactgggttgannatgcccttggccaccttgctggtatggaacnaantcctctacgaggnatatnattatnacatntgagnttactgcactgact

SEQ ID NO: 2499 - DNA, 362 bp, Fusarium venenatum
  misc_feature (1)...(362): n = A,T,C or G
tnggcatatagaaaaggatgtcaatgaccaccccgtggaagtcaagcgctatgcagatgctgttgctcgactaactgagctcagcgaccagcgcaagcgattaagaacgcaagtggcacgcttaaatcatctgaaaaccatcgtcgagcctcttcagacgacagataatggcgctggtatccaggaaaacctccttactcgcaatggncctgttgaaaaggaacttgagaagatgcgcttnttgctggcgagagtcggtggtngtgtccatgcgctaccanaacgaacttccaatgacgtttctaaggagataaagtctttttgagacaggctctcatggtccggaagcgacntgttgatca

SEQ ID NO: 2500 - DNA, 292 bp, Fusarium venenatum
  misc_feature (1)...(292): n = A,T,C or G
ggaccgtccatgcagggtgctatctcgaagaccctgaacgtggctacggngaaccgcatgaaattgctgaaatattcgcgggttacctgaatggcatcaatggtacattgaactgggagcctcagggaataccacgcgatgtctttaatattttcgaggcccctatgtcccaaaaccaacttntctttncagtgaaccagttgcatgggaatggccataancgaaagtttatcgacggcgaggttgttgatgcccaaacnaacgcnaacacttttttttttganacccacca

SEQ ID NO: 2501 - DNA, 576 bp, Fusarium venenatum
acacaccaatccaccaacatgtttaataacgccatcatctccttcctccagctatggctcgcgacgctggcctttgctgctcccatcgctgatgatgccatcagcgcgacctctgctaagccctggcactacggtactggggggggaatcattggaattaatggtttaagtgcttggacattctcgtctggatcgaaggttctcaagtccaaccgccccgtttcccacagagattctctggggtctcgttggcttccttttccccatcggccggaatggctcgttaattacctattctccaaccgccaggctcaacattgcgaagcggaggctacgagcccgtccctaagacatcgctcgattcacgcgacaagaataacacgaatggctgggatggacaagaatgtgacagaacggaaggattggcatgcccgagatggcaaatggatggaggagcatacgatcttgagccagcgattatctttttattcatgaattaaccggagtaataacatcagaccaacaacctatcgtttttaacaattatcgaccttggtactttttgataaagcattg

SEQ ID NO: 2502 - DNA, 328 bp, Fusarium venenatum
  misc_feature (1)...(328): n = A,T,C or G
caaccagtcctcctccgccacctccaccgagttggggagctggctggggacggatagaccgaggaggaccacctccattgttgaactctgttcagttacaggatgtcggtagccttcttacaaaatgatgttttggatgatcaaaactggtgaacgattggcatatcacaggcgttggtggaataatgaaatttagactatgataccttagatgtttgatttgggaaatatgtcgaatttaatgtcggcaacaggagaattgcaggcaggaatgactgcaaattgtacgaatgaataacgaataaaaaatcccctccnnaaaaaaaaa

SEQ ID NO: 2503 - DNA, 577 bp, Fusarium venenatum
  misc_feature (1)...(577): n = A,T,C or G
aataattccaaaaaagcttcaacgaactccacaaatgcccaggtaactcttttgggtcataaccgtctcgagagagttaatacacaaaaatgagccaggataatcgacaacttccaaaaacccaaatagagggcaacactccctggatttaaaaggcaaaggaaaacaaaccaagaaagagaatactattcccatcgtcgacagacttcaatcttccgggagactagttctcgatgcttttggaagcggcccagagctgagtggccaacagccagcgagaaaagctgacccaagtggcagcaacagcaacagcattgacaagatctcgtcaagtacgggagaagcatcctcacacagattacgctcatcaattcaggcggaaaccttgcgctcaaaaacaaatctggattctggaccttccgcgcaggcattcaacgattttgttagtgccgacgtcacgctggacgttgacaatgacaatgacaatgcccaccttgatgaggaagcacgaaagcaaatatccactcgaaatctacacatgcatnacacgatgntagtgnacaaganaaacttggat

SEQ ID NO: 2504 - DNA, 634 bp, Fusarium venenatum
  misc_feature (1)...(634): n = A,T,C or G
gttactcctatccaaagcggattggccaccgaacacgaacccgaaacaaatgggctacggcactcgtcttcacatgagggcattgaccaaaacacaccactatccaatcacagtttacattagacatgggaacatctcatcattctagaaagcggctagcattttcaggagttttccgtcattcacgttatttcatttatttattcccctttcttatcaccgagcggtggagaaaaaagcacgcgattatcagaacaaagacatggatttacttcttgtacacaacaaaattttcgtcttttctctacacagattggtctcctcggcatttgacccccgcccacgcgggattggccagagttgagcgaaatttcggctcactttcggtgatctggagttggtgagacgaagttcggagaacactcccggtggaggagtcattgtatttgttgcaggagttggctggcactcaagaccggcaggaacagagcattgangtcggcgaattttggnanggattttttatttttattgagcaaggacttggtaattttactggtacatatcacacagattacnaccgccntttgagatggcgagaccaatgggcgcagacacacngaaggnattgggc

SEQ ID NO: 2505 - DNA, 597 bp, Fusarium venenatum
atgcaccacaagggacagccggctcaaaaatggaggatgttcaggtagagccgtctccggaggcaaagtctgttcaacaggaggaagggtctgagactgttacagaagacaatatggaagtcgactcttctcaacctaatgatccactggcacctgtcaacgtcttcctggcaccttcagggtcaacacccgcagcagctttggctcctgctcccgacacagacttcgctcccaccatcgcgcatgcgcaactccaccaagctcgattacaagaaaactcaagaaacaaacgattgctttcggataaggagttagaggaaaaagctgctgcagaaaccgccaagatcaactctatcaaatccattctcatcaaggtcaggttcccagataacaccagtagcgattggcaggtgaacccgttgcatactggaaggtcctgtacgacgctgtccgacacgtcatggctcataacgacaaaccttccatctagtcctccccggaaccaaaattgtgatcaaggacgacctagctccaacaatggactaataaaagcctataaaatgtcgggaagaactcttatcaacttggtgtggggac

SEQ ID NO: 2506 - DNA, 549 bp, Fusarium venenatum
actaaccctgaagatagatttgtaactccgtccattgccaagaaatttgactttgaagttccggagtataaaggtgtcgatcaggtcgttgaggttgaagtacccgagcagaaactctaagagaatggtcgaattggccgtgattcgaaaatagggggttttggtcaccaccctttgtctcttctggatagcaaacgtatcacataattcgacaacctcccctcaaactatttggacagactggacttgggcactgcccatctcgcatcatagtccggagaaatatgacgccttgtggacatacaagtaatggcggacggaataattgacaaaattcgacatagacgagatactctttcccgcagacgtggcacgcagccgaatgctgcgtgcacatttatctgtgagctcgagctttgtccttagatttcgaataggtgatgatcgagccgtcgattgagaaagggtagacctgcaccaacgacatggacaatgacgtggaagaatggcgtacaggtagagggaagaaaatgcaagctgacaattctc

SEQ ID NO: 2507 - DNA, 267 bp, Fusarium venenatum
gatgaatattgaaatgtacgacaaatacccctgaagtcaaagttgacaggcctaaaaacccttggataatcttaatcttggagcccgcggacgcctttggtgttccacattgtggagatccccttgttttctagagggtctgtacgaagcattgacacgatgatttggaagacgtttggagaaacagaaactgtaaagtctaaaaggacaagcttaaacttttatacgaagaattcatatatatagagtactattaaaaaaaaaaaa

SEQ ID NO: 2508 - DNA, 620 bp, Fusarium venenatum
  misc_feature (1)...(620): n = A,T,C or G
ctccttgcctacgacaagaccgactttgtcaagtacattcacgatgtccccatgattggcagcaccgtcttcgccccatcaaacgaagcctgggcacgtntcggcccacgcgccaacgctttnntgttcaacaccgagacaggcaagaagtatcttcgtgcgcttctcaagtaccagatcgtgcccaacatcacactctacagcgatgagatctactacggtgatgagaagcanaccctcaanaagacggatctcggtcacggnggtgacttccacattgagctgcctacgctacttgagaggggcgttggtgttgatgtgcacactttcaagagttggactaccattgtgctgaacggacacgtcgttgttggtttcaacgacgctgttggtaagaatggtgttatccacgttcccaggaccattcctatcccttctcacagaagggacgagcattcttntgagatcgacggnganatcaagtgtcgaggagctcaaggaaagactggaggattatgtggngggcgaatgatactgantctgactggcagggnggngagctgngangtttctcaaacccttattggcataacaatattggnggttgnggttgaatggaa

SEQ ID NO: 2509 - DNA, 912 bp, Fusarium venenatum
  misc_feature (1)...(912): n = A,T,C or G
gatgatatgagcttcagcatgcgccatcgcaatgatagcgattggctattgcgaacaggcgcgctcatgagctccgaagctcgtgaattcaagggtcagacttggcttgtttcgcgtcagagctcaactagccttgggggaatggaccccgacgaagatgcctttgagaatgagcttgcccgtgaacgcgagctcacgagtcgccatgctagccgacgtggtagcgttgctccaattgccgaggatgcatctccatacgctagccgcttccccagccgcactcatagtcgctcccatagcttgacccgacctcggagcatacttcattctcctctagagctatcaacagctgcagaagggtcttacttcccccatcaagaagtcaacaatgaccttcccggccctgattttgtcaatctcgacnaaaaagctggaagagcttgagcaagatgtgttgcaagatgatgaggccactgtgcgacggcttgttcgaaagggccaagcaggcacaggcacctggtttggtagcgtctggtctcttttctcagtagaagaagacgacgaaaattcggacgaggacagtgatgaaacaccacgagacaaccaatccgaactcggccagtctcgtagttggtcggtcccgcaaattagcaggcatatcaacagttccagaanaacgcgtnccccctcaaaggctgatgaaggtggctggaangatncccctggttgtgaccgtggccnccaaggtgatgttctanacagaatgagttttgccacccaaacnataaccgtgtccacatttttcaagtggtaaaagaaccggtttggtaaatnaaaaaaaatggccaaaagcgtatatgtaaanattggttnccngattatagcctcgacctcgtttcananagaaaattt

SEQ ID NO: 2510 - DNA, 604 bp, Fusarium venenatum
  misc_feature (1)...(604): n = A,T,C or G
tccaactcagcacacaacttcacaatggcgtccttacaggcgctgtggggtccaatggcccgacggctcctgcgagtcgccgtggccaaaaccacaaacgtggtgcggaccaaatttgtcgtcatgacgcggcccctgcaaaaccaacttacactgagaaccgccagagttgctcgtcaacctattcaccctgttgctgctcttcgacagcagaaacgccatactagccgatggttctcgagctccgcagctcagaacgtcaaccgagttattaggagattcgttagctccgagcccaaggctgctcgtttcgaccgatccaagttcccgagctccaacacctcacaacgtgttgcgcagttctctggccgagctccatttgcgaacgccctccgtcccaacttgatgggcggtgctttccctcgaagtgctggtggatatagtctcggcggtagtgctcgatacttcttccacggtccggcagcttcnggctcaggtcgtgcagaatgtctctnaagccatganagcattcttcttttntggccagaancttccgttatgacggcctcnggccctcgaaggtgaccccaaagtaatcaacggg

SEQ ID NO: 2511 - DNA, 483 bp, Fusarium venenatum
  misc_feature (1)...(483): n = A,T,C or G
aagaatcctctaatagaacttaaattcaacatcatttcttccaaatgtctctttattagtaactatttactgcgtcaactgaatggcccgtgtcgattttctgaaaccatcatgggcatgtcaagagactgctctatctactatcaaggatcccagtaccttaattaaaccttaataaacatcaaagtttattgcgctccgctagagatctttgggttctagaaaacgtttcaggtgctatttctgaaggaagagatactaattcctccaatagaagaaatagttcggaaggtggaatccgaaatccaacatccgaaagtgggatattacaaagagcagtatatgtatttaataaggagccggctcataaaaggttggtcttggnatctcttggtttcaactcattcactactggctagnantcacttctctgcggtcatactttntgctatcactggttcacacccttaccatgccgctgtt

SEQ ID NO: 2512 - DNA, 619 bp, Fusarium venenatum
  misc_feature (1)...(619): n = A,T,C or G
ctntctcaacgcacatacactccctcacaagacgttcaacgtccatttatccagctactnttttttgagcagattcattcctgtggaaagaatctcctagccttccttaaccaatcgcgttgagatacccattcgtctacacaacagacgtaccacagttacaaccactccttggttgatatacagaactcgaaacaaaaacaaacatacaaaatgaagtctttcactcttgcttctgccttcctcgccgctgcggccgttgcccagcctcatggcagcccccacggaaaccaccaccgccgtcaccaccanaacgacaagcgtgatgtcgtcaccgaggttgagtgggttactgagatcgagtacgttaccaagatggtcgatgccccaccaccgtctgggttcgtcctgaggtcgccacctctgctcccgttgtagagganacccccgagtctgacctaccttntgctgctcccanaangagganaaaaaacctgctnccgttctacactaccttggtcaacagcgtttanacttcccttcttccccttccaacaanganggttgagggtggttcccaacctancttntgaggnccttgttcttgtaganantacct

SEQ ID NO: 2513 - DNA, 1342 bp, Fusarium venenatum
  misc_feature (1)...(1342): n = A,T,C or G
cgaatggttttctcaagccgccgcacaatacgccaatcgatatcctcaacctcctgctcatagcaccttctaccccaactcgcgccataactcctacagtggacactaccactattcacaaaacatgtgggagcatggtcttgctgagtgtagttgcactggctgtgttgatcccatgaagcagcaggttccctatttcgtgcctcacggctacagccaacccgtcatgggttaaagtcttaccaaaatgcttcatttaatgcctccgatcgagggcggttcgatcttggaaagaagaaaaaagttttaaaaggtttcattttcacggccacgattttccttattatacgcatcccgagaacgataaattcgcattcagataccccaggcacgacaaaaattgttcataagatgaccttttcggcggatcattctcaggatttctactacagccatgaatggatgacgagacccggttagcctttgcaacgctcttcatgagcaaacaaggcttattgtttcctggtcatgtccggacactatggcattctccttattgtttttttatttttattttttacgttctgtaatggttacactcggcgttcggctttctcatcttacactacacggttctgttcgatagacttgcagtttacagtttccaccggcactcgcgcccagcagcattcacccattttgtcacgtcacgattcaaagcctgtcactcctttgcgcggcactggctttgattctgacgctgacggcaaaacgacgaaaacttcaacacaacatatcctactatagatggcgattcggtagcgttgcattcctgccactcgcttggacactacgttctgtggtaaacacaggatgtcacaaacggtcacaatctacttcgaccatttcttcctcatgttcccatgtctatgcacaaatcaatgcaaattgattcgaagcaaagatgattcgttactgntcgatgaactccgcggcatagactttttgaggatggtatatacgttcactttttttcctttcacttttttcgtttggtattgcaagtggcacatggattttgaccacagggaacgggcttacatgacggggtttatgcattgcaaccagcgggtaaaacaagggatttggattgatcggctgatcatcggtttgatattgtattattgtttcttcattttttttttaaacttcctggtttgtcggtgctgacatggattgtcaatgtcagcgtgcctaccgccagaagaacnggctgttgcgctcttgactttgctttgcacanggtttggtgtcngcctgtggcaaattacttcaacgccat

SEQ ID NO: 2514 - DNA, 227 bp, Fusarium venenatum
atcctcgacaaacggtttgggaggccatcttgcggtatcgcgcggaggttctttgggggactctgttgaatgttcttcagaagactcgtccaaaagatcctctggaatctcttctttaacttcgtcttgcggctcaggtggatgctcaacaggttttgattttacgcgtgaccgaggaattcgctttggtcgttcccgaaccagaagctcattttctttctgcagtg

SEQ ID NO: 2515 - DNA, 389 bp, Fusarium venenatum
  misc_feature (1)...(389): n = A,T,C or G
aattgcctatatatgcgctttgatctccccgaggccactcaaaggatttgctgtcctcctccgtccctgcaaagtctcgagtattggtggagctcagtacgacgccaggaanggtgtcccgcattctaaaatccccataaacgacgacatccatcgacttaatttttgcggcgcatgtttacgcgcgtgcaattggattctgtcgtatcttcccccaacccattccttcacctatgaaggctcaattgggacgaacttatgctcgtatagcccgtctatccattcatcccaatcactggcacgccatatcagttgcggtcatctgtcctttcttccggcttactgaggcttctcttaccaagtccgaacaaccctgtcttgacaagaat

SEQ ID NO: 2516 - DNA, 529 bp, Fusarium venenatum
  misc_feature (1)...(529): n = A,T,C or G
gaacatcttgatgaagctggcacttctgagactccctaaaggtgtactcagtgcttctgatttgataggccggggatactggcactggaactagccgagagcagcgtaggcgcagtggaatttctatacttggactatgcatctctacggacgatcaatcagcaatagtccattgcgacattctatcctttcagcaatgatcagatcacaaccctcacttgatcaataaaagggcctatacaatggctctgagctcaatgtgggcgcgccttcgaagtaatgggcagcccagcctggccagatcgacgctttgagagtttttggtttcgcaacttggatccccgtcatcgccatgttcaacctgcacgttgcagaattgacctttgtggacgcgcatccatgtaccctctgataaacgacgacaaaantcaactctgcngcgggatgtgatttcactggaaatggtcgccccccgaaaattggaaaaggnntggtggtgacattacctacaaaggantcactactccca

SEQ ID NO: 2517 - DNA, 403 bp, Fusarium venenatum
  misc_feature (1)...(403): n = A,T,C or G
nntctttacttttttttggtttgttttttgacgtcaccttccaaacctaaggcagccaaaatcgatagctgcctagagggaagcttcacatgttttaatcttagtacctatatctaacattgatcattctgcctgtatttacggcatcgttctcgctacaatccactatttttcttcttactctctattcacttccattatttttttctttcatactatacaccattcgtaatgactcccaacagcgagaacgccatggctcggttactcttggccatgttgaatnagaagaacctcaaggatatcgactggaatgcagttgcctcagacccattacttctagagccatcacaaatggccacgctgcaangatgcgatcactcgntttccgtgatactggcaa

SEQ ID NO: 2518 - DNA, 634 bp, Fusarium venenatum
  misc_feature (1)...(634): n = A,T,C or G
gctggttcttgacgtttctgatgaattagagcaaggtttctgtgcactcgtccggaggcgcagcgcanctttgagcgtcgatgaagttgtacagcaagtcgttcttgctctcgaaagactgaagaaacaagccaacgacgaagtagagactcaacctttgcctggaagcccgccattcagccgccctgggaccgnttctaccactaatacgaatcaccccctagctcgaatgccaaagacgacaacggattcaaacagttctaaacgtcgatcaactgtcagtgacgcgagaaccagaacaaacagtctatcgatgtctcaacctgttagccagcctcttcgatcaccaacacctttcggaagtctgggggcgctcgcgaggccgcagttcttgatgatggaatatctggcaagccatttgtacgcgtaggaagtcccgagacacaatcagaaccaggatcccttctttatctggcattagtggcccggcaccccgatgtctcttgaaacgcaanaacagttccaggcactggtgggcaacaaacttcacacaaaccgacnattnaaaaacgancaanggttgtggacccctccattttgctgagggtgcaagnangggttataaaaaatannt

SEQ ID NO: 2519 - DNA, 203 bp, Fusarium venenatum
  misc_feature (1)...(203): n = A,T,C or G
ntacactcatnataacntacccananatacactccncggtttcnacattcgtgctnatttnatgccantatggcntagtctcncnacatgacgctctactaaggcgctcntantcttcgagagngagaactgnntctacccgagaagctgnaaggtgcatgaccngntgggtganctcattgacgagancttttcanaacatc

SEQ ID NO: 2520 - DNA, 137 bp, Fusarium venenatum
  misc_feature (1)...(137): n = A,T,C or G
ntttggtttttttttttggcttaaaataagttcgntggccaagggctacattgggtacacccggaggaacaagaaaccaaactccatctatgcctggctatacccgccggatatggcattaactaattttgcccctc

SEQ ID NO: 2521 - DNA, 553 bp, Fusarium venenatum
  misc_feature (1)...(553): n = A,T,C or G
cattcgcatacgattattcacatcatttgtacaactccatattttgcctgcttccaaaaaccccaagtccatcacatttgcttcctgattccccgacgtcattcccctcaccgttacaatggcgccgatcctccgcgttaccgccaccacattggcttcaacgcttctcttctctctatcttcagcccaggattgcaaattccaaaccctnaaagacatcatacccatcccccgtcactgccgagaattggagctatggccttgttgccaacgagcttagacggccccgaggcattctgtttgacagcaaaggggccctcatgncatagattctggaaatggtttcttcatttcgactcgaggatggagganggacatgcctgcaggtcaggaagaagacaccctgctcgaacangacacttggaatatggnctcgccatttccaaagatggccgaactttttttgctntttgnccaatgaaggntttgcatgggcctccaccccncaaaggtnccctaacaattttcagtccanaccttggtnacaacatgg

SEQ ID NO: 2522 - DNA, 729 bp, Fusarium venenatum
  misc_feature (1)...(729): n = A,T,C or G
ccatgattcaacatgcgatgcttacaaaagacacaaaccatcagtctctagtcatggtgattcaacgcgacaagtttattccagtcaatctaccctagatcattcactcactgataactacggggctccaatttattagtgcgctcactccagcatccaaaactccataccccagaatttgcgtcaagcgagagacgatccatatcatggaccaccgacagggacgggactccagtaaaataataacaccgagatctttcacagaaccctttttttaatcagatctctgacatgtctgacccgacagtttgttcatccaccgagatcatgccgaacgtctgtggtttttaaagttgacgagccccgcgttgatcaatcaatgggtctgagatgggacgagatgagatgggtttatctggggagatgtgagttgatcaagagataacagataacgattgcgataataggccgagtaggacgatagccattcagttatgctaaaccgaccatccgtatcgctctctcgaaaatacacctacctcgaagccatcggcaggcgtncaattgctnaaccaaacgtnccgcgccttggacgcgtctacaattaaagtactgcagccgaattgacgcgacaacggngaatcatacncgcgacaacttcgngggcgacgaaatctacttgcaagtgtcaactnaatattcttcaatcacggcgcaacctnttttgga

SEQ ID NO: 2523 - DNA, 627 bp, Fusarium venenatum
  misc_feature (1)...(627): n = A,T,C or G
cagtctatgctggagagcctgaaggctcgggtcaaggctgttgatagatttgtcagtttcttcgagtcgatggacaaggcgaaggaatcgatcgtagccgagtcagtgagcctgaaggaagttaccttctcttacggacctctggcatcggaggttagtaataaggaccanccctctcgactttggaggatcacactcaacctatcccaaaacgatattgaccttgtcatgggcgaaacaaaccctnatcttccggtcaccaatttgatgcaaaaacttgttaatggtgccaatggcatcggggctctgatgaactggcttcccgggtccctaccagcactagaagcggtcaagaaaataagagaaacatggagggatgttgaatcacnccatcagggacggttcaggttcatgatggattctgtggatganatgtcaattcagtacttntgttacaggaactggtcccngaaaccatccgatccattgcgacatcacgtttctccccacatcaaacatcgccgangcganccgnggtggcatatnatgcncaagccttttaacgggctttcgtgtnaaacgatgagttttaaaaacgcttaaacccgtntgggaaacaacngggga

SEQ ID NO: 2524 - DNA, 524 bp, Fusarium venenatum
  misc_feature (1)...(524): n = A,T,C or G
gcaacattcgctcttggtcatccttcaacgcttctgccattctctctctccctggtgccttggcccttcttaccaaccctgttcccgcgcctctgctttctcaacctacctttacttctcgtcaccctganaacgaggctcaactccactccatctatgcttcatactacctacccaagctgaactcagccctagccatatcttctactcgtcccctgcacctttnggtgcctcctaagactaatggcatgaacgatcttctcttcgttgccaacgcctntggggaatctaccactgcggctgctatgtttggtggcaagcccactgcccgtgtcgtcggtctggttcgcagcttcgatcgtttcaacactggtatgcgtgttgagggcaacatcaagcgtgtcgagtacctccgnggcctctcagctatccatcatgctatgcgcnancatgggtgccgctacngcttcatccttacaaaaatgagctcgtncttgttcnaaacggcactggaaacacccctt

SEQ ID NO: 2525 - DNA, 611 bp, Fusarium venenatum
  misc_feature (1)...(611): n = A,T,C or G
cttcaccatacatttgaaaataggaaagagtgatctagaatggacagaagtttgatattgtctagacggtaaagattcaagttcctagtacctggtttcggtcgtgttgctagtaatcttgattgattgctaaactaagcgctagccgcttcgtagcccgatagcgatcggcatttcggatcccagtcgacaaaacacggtcaattcaacttcaaccaccaaatcaaccccaagttcaccctgcaattcatccgtagccggcacctccatcataacactcactcgctcagtaactcacgttaagtcaacttccctggcttcgtgacctccgtatggccctactcgacacacggaacagagccgacagggtcccgaaatctgtatttggcctnattagaggcacctaacctttcaacgattcgtttcagagtagcctgaaccacatntaggcgacgcattgnagngggctcgtttgncatcattcanggcatacactacacgtgaatgccctgatgggcgacctgggacacttattcttttttaaagangncgagacgttcctgaatatcggctggcnttgggctantttatcgaatgnttggaaaaacccn

SEQ ID NO: 2526 - DNA, 568 bp, Fusarium venenatum
  misc_feature (1)...(568): n = A,T,C or G
ctacgcatctcgaatcagctctctttggtttctcggcctttctttttgattgagcccattcgttttatacattatcctacgagtcggattcgctcatttatagtgtgcgcagatgacaccgcccaagcctatttgcggggaggaaaagcctcaagcacgtgaaagaacctcggtcagctacgantttgtgcttgaggatgagtttgatgcgctgtgcgttgaggtgaagangaacgacggtgactctagcggtaaaagcagcagcggtaacaagtatcctgcaaaacttccatgcgcgcaaggttgccaaggancttggcgtttccgaatgcctcatctatcttccctggttgagccctacgcgctcctacaaagactccaattcaatcgcccccctttccagccacgganaaactttctactatatganccgcgcccactttccgactgtgtttccccctttaaganatcctacgattcncctcactctcctgaatcccctaccccgaccngccagtttttttntcatnggcccactcccnaccccnccgaagccctgcaaaataca

SEQ ID NO: 2527 - DNA, 240 bp, Fusarium venenatum
  misc_feature (1)...(240): n = A,T,C or G
ngcacgctatgatacgttgtattngagcttcaatcgaccgtgnactctcaatttggtcgtgtacccagacgtcaagaacccggcaaattaccgcatnagatatcggcctactggacaaagctttaacagnattaaatcatgggctttgccaccggctttaccggcggngtcacgctnaccctctccctcggctacctctcagngctcgctcaccagcgcactcgtgagcaacaaggctca

SEQ ID NO: 2528 - DNA, 589 bp, Fusarium venenatum
  misc_feature (1)...(589): n = A,T,C or G
gcgagcatgtatcatggtactggagccaagttcgtcagccttgccgatatcccgcaaataccgcaaatctccgacgcgcctccatcctattgcgacagcgaaccaccgccgcctcctcctcccatcaacgagaagaagcgtcgccgagtcgatagcgaaagcaaaggcaaagacagcgacgcgatttctgagatttgggctgagctcaaagcacgagacgaacgcgaccgaaccgtacaactcgagctgtcagatttaaagcaggagaataaatccctgcgagaagcgctcgagcagatccgtcnccaagttgccacgttccaccngaacctggatgacttgaaacaggatgtntggcaccttcaaggtctagataagtncaatacagacacgttggaagggttcgatacaaggctggtcgagttgcgtgatgatctggaagatcttgatgcccaggtcgattcaatccaagancatcgcgacganaacggtgtggctcgcgactttcttgataaagtccgcagcgacgtgtncgatgatattatcaccgtctcacnggctgagcaccattaccanctgagantcantc

SEQ ID NO: 2529 - DNA, 545 bp, Fusarium venenatum
  misc_feature (1)...(545): n = A,T,C or G
aaaccctgctgccttcttcgccgcagcccgtcataccattatcgaggtgcaaagcatgcctagcacagaagcgctacggggcatactacaatgccgccgcacatcttcgccgagcgcatttccggccgcatcgggtnggcaaggccagtggcgattggccatccatgagtgttttgaaggattggatgcgggaagtacgccaatcagttgacgtacccgatgagcatttttccagcggcgaagacgatatggacgaatttccttcaccagccaactacagggactcgatgtcgcatcaagctcccatgattcctgaagcccaaccgcctgccgctgtactggggccacttctctcttcaagtnctgttgaacagtcgataccgattgaacgaaccagcccatctcgacaaccgccgaaaaccgaacgaagtgtcccntccagacntggtcnaaattccgtgactgggctctcccatgctcccccccncaagaaaagccgaaaagtgccgatgttacgtgngaatacatacaaaggttgggccaat

SEQ ID NO: 2530 - DNA, 598 bp, Fusarium venenatum
  misc_feature (1)...(598): n = A,T,C or G
gctgcgactgtcatccgatccaaaagtaanggggaaataataaaactcgctcccgtctcttgctgngaacgatctgtggcataccaaacgatctcgagctttggtttggcttgacaaacaaagcgggctgtcctttgttcataacgctacctgtaagtgcctacctgcctagatgaattgcaacttttgatgtcgtgtcgtgtcgtatcgtttctttatctcattttattctgcctatcccatccctctcgacatgtctatccaaacttttctatattttgattctttcacataacttatctgcctggtgtcgtcatgcgtcagacgcctgctttattccagggtccagtcaatcagacaggcgttttctaggattctctttaaaatttttgntcctcgattacaattaagtctagtattacgctttgtttcttcggggggaaagcttgcagggaaagaccatntacttaaaacagaaaatctcccctacgatctcgactcgaacaacccgaaattttcaatatctgntttatggccttttggagtggtttccctcatgaaatcaacgttatcaaacccgccntntttatccaattca

SEQ ID NO: 2531 - DNA, 702 bp, Fusarium venenatum
  misc_feature (1)...(702): n = A,T,C or G
caccacaatatacccacacaagtcactccgaattccctcaaatcaaaatggtctatactatcgttgttcacctctacgccaaggacgatgaggagtccctcaagaagctcaccgccaagctgattgaggctagccgcgtctactctcaggacaaggagaccctgtcgtggcacgttatgcagtccacctctgacaagcgcgcttttaccattgtcgagcgatacgagcaagagagcagccnaaagtatcacctcgagaacccttactggaagactttcgacccttacgtcattccccttctggagaagcccatggacttgcgacgatttgaggagcttgacactagcaaggacgtcgaggttccccnataaattatcaacaaggtcaattgactatcaaatgaaagattcaatactaagtgcccagtcatgtgtttccaaacgagaaaagacccatgaaccgactcttgatagatgtatcctctgctttccctccgttctttagacaatcactcttcctgggtgtaaccctagtgctaaccatcgatcccttaaactgggctttgtcaacagccgatctccaagttctgctccattccgactgggggaatatgaagcaatttctcacactcagccggtcctatctcttccaaaatgcttactctgttctgacagtctgttaaactcctatattctctgttca

SEQ ID NO: 2532 - DNA, 292 bp, Fusarium venenatum
  misc_feature (1)...(292): n = A,T,C or G
tgtggagcagaggcgttgaagaagaaggtggacgacgatttagacgatgaagacgatnccccgtcggtccagaaaggtacatcatagaagatgaagggcgaacagaactcagggacacatgataagcaagggaatagtggagatgaaggtctcgaacacatcggcaaagtttcacaccaacaagtcaagcgatcaactactaagcatcctctggagaggatctccaggatacccatttcgtgcaactctagctacgaccctactcggcgtccggtgtcagttgtcacaatgc

SEQ ID NO: 2533 - DNA, 577 bp, Fusarium venenatum
  misc_feature (1)...(577): n = A,T,C or G
ctcatcggcccaatcgatgtctactatttgcccaccaccaccatctgcagcgcgataaacgtggaatatccattttaagggacttggattttatgcaaggctgaaaaggtccactcggcctatttccccgagctgcgcaacaganttgagagctcgcctcgaatcaaaatcaaatcattgtactacgccgcatccacatcgatctcgtccgattacctctctctttcttcacccttttctagtcgagcggtcaaactggaaccgagtcgtatcataaaatcgacagaacatgtctccgtcatccacatcagcatcagcatcggcgtcggnanctggcccacaccactggctctgccgcctactctctctcccgatactctcgangccctatccganctctccctcgtgctcgcacgcgttcgcgccggcattcaatcatcagctggggantaccaccgaacctgcgcctggaaacacnggaaacaacncgcctggaactacactgtctttcaaggatgttgccaggaacaactgaanggctaaagcataanctgcaacaactcgtgcacaaattcgc

SEQ ID NO: 2534 - DNA, 573 bp, Fusarium venenatum
  misc_feature (1)...(573): n = A,T,C or G
cacgctattagcttcttgacttgactttttcatcatcgttctgcatctttacactttcatccgtcaggaaggcctcataactgccggcctatcttgtgcccagtcatcgtaacactgatacagataggtgtacggcagacaggcgcccagtcagtcatgtctgtctttaacaaccaccttgcgggcgcaactgagcgctctttctcgtcatcgctatcaccggaccgaatcatcgcaagctcagaggatgataacacagcaaccctcgaccccgaaatctacaagagtctgacccgacaagagaacaacgcgtgatgggaaaccaaccaaagaagcgaagtcccaaanccaatagcaaacctgcttttgactcntccgtcaagaanttgaatcntcaaggccaagcgaacacaaccgagagaagaaaaagagctctacatcnaaggcctgggaagatgaaatttctccgcctcaaaggagggtttcaaacaatggtttcccttggntaagggagaanatggcttgattgagaaacaaacgccttgcggganaacctttggaaaaagctggggc

SEQ ID NO: 2535 - DNA, 250 bp, Fusarium venenatum
  misc_feature (1)...(250): n = A,T,C or G
ggttctcaaggctaatgatgagaccgtgccacaaaaggacgagagcagtttagctgaggctgaggctgaacagacggctgaccagaactctgagaaggcaagggagatggccgnagggattgtcccagagtcagtgaagaagaggtcgcaataaaagaactcgtcattgaaacgaggtgtaccatattatgaggagggccaagctctgcacaaaaactgtatcaattactgtatcaaanaaaaaaataaa

SEQ ID NO: 2536 - DNA, 137 bp, Fusarium venenatum
  misc_feature (1)...(137): n = A,T,C or G
ngccccagaagngttcnaaggatgggcaacatgagcaagcggcccccnnaggcgagangaagctgnctggagccgaanaggagangagggccaaagaggagaagccgttagacgcgcacangccaagggtgcccaag

SEQ ID NO: 2537 - DNA, 514 bp, Fusarium venenatum
  misc_feature (1)...(514): n = A,T,C or G
cgcaggaatttttttttttttttttttgcgattttcagtcgattcaaatgtacaattattcgtgtacaaacaaatgcatgagaattttctatcagacataagtctaagataagccatgattgagatacaaggatatcgaaaaactcagcacgaaaaaggttagccgctgataaaactcaatacacatatgacccgtttcgttgagtgacggcatgcaataatcactccaataattcaaacatgaaaactgaagtcgttgtgttgaagatgtgtttttttgttattttgcgatccgccgagaatgggcgatgtcggagatcccgacctttcccgacgagcaatttacagcttccgataaacccatttgaacataatggacccaaatctcgaaaaaagggcacagacccaatcagctatccagcagtcaaacaatctagggtcttgattgacttctttggctaatgcacaggtgttgataaggggccttacggggccacagggcgggtggtntttt

SEQ ID NO: 2538 - DNA, 594 bp, Fusarium venenatum
  misc_feature (1)...(594): n = A,T,C or G
ggacaaccccgcctcatcacatcaccaactctacgaaaggtcccccgcggaacnaacggtggtgttactctactgggactgggtgcaggtctgctagggtccatgattattgtcactgcctctatgctgtttctgccatcgtgcacagaaaantcagctcaaacgcccgcaggtggtggtgcaccatggacaatgctggagcgccgcaaattcatggggttcatggtgctctggggtgctcttggcagtgtcttggacagtttcttgggangtctgtttcaacgttcagttcgtgacgtacgttctggtaaaatcgttgaaggtgaaagtggcaaccgggtgctggtcccgaatctactganggtcctgcagcgcatttgaaaaagaanactcaaaaaaaatcggaaggctccccattgcagatgatcacaatctcacccgaagtttacnacccaaggacaacaccgcaattcattttggaattcaacaaccatcgcngaacattgaaaacggttggatcttctgganaacaatnangtcaattcctcatgcactatanaaacttcgcgcatgcgctgcaattggtactggant

SEQ ID NO: 2539 - DNA, 340 bp, Fusarium venenatum
  misc_feature (1)...(340): n = A,T,C or G
ngtatntttgacgatctttccaagcagntgtcnttaccgcaaatgtttntgnttttccgtgnccccccggacgngagggttacccggggacgtttttacttcaattttgtttctttgacggctgccaaangaacnaaaagttngggggggtntatgaccgtttacccgggatgaaaacaggngggacgtttccgttacatttacanctttttcatatgngggaaaanttttggggtnggtntttaanggttccactgccntaanggggttttcgttttnggnggtccnttgccaattaggcaanaaaaagttgtggttcctnaatttttttgccaaaccg

SEQ ID NO: 2540 - DNA, 613 bp, Fusarium venenatum
  misc_feature (1)...(613): n = A,T,C or G
atttccaggagctgtttctctcatcttcgtacgtacaaagaaaggtagcacgctgggcgtggtaacaccatggatttcgaccaatctcctgaccgtcgagcctcacaggcaagcttcttatctctacaacagcttgacccttccccgatagattctccgccagcagatcccactattgaccgccgtgatcttgggcgactacctcgaggaagcgatgatgggtacgagatggtgaacgctgaggaaatggagaacagcacctcatccatcagggccccttcgaccggtgctccaggtttgagtgcaagcgcgaacctcaaccagtctggagctggtcctggtcctatcttctaccttatgcggattcagaagttctcaagttacgcaatgggtatcttcacatcccttcatcttgccaacgtttccctcatcccgctatcactcgctcggttcccggctccgaaacctaccttcttatgactcgtgaaatttaccaaacctactnaccgaacccatactggtcgctctactatcatcggccatatcggatcangaattgccttcgattactgaggangtcgcaagaacatgcagcggtaccgtgcaacggann

SEQ ID NO: 2541 - DNA, 530 bp, Fusarium venenatum
  misc_feature (1)...(530): n = A,T,C or G
cagagaaacgcccagaccctctctcggctcttctagcgaagactgcaagacagacaagctcttggtcaacagcttggcctggctagcactgccgccttcatcgtatttttcctttcggtgaccaactaggaaatgtgtcgtgcttcaccctcttagtcgcccctgttattcccttcgagtgtcgcgtgctccatatcctcaaacggtcatcgatcaacccaccgtcgctcccttgtgccactgagaacagcccaacagaaaacgtgatcgacagcccccgagttacagagctgcgacgcttagtctatgtggctctagccgtggagaacggaaacaaggttaacttgacttaggtttttaggcggagcaataacaagcttaatccgttttctggtatccgcttgtgaacgacgttttcgccgaggcgagacatggcgagaacgcatcgagatgatagtaaacaagctttaccgacaattagaacaacatcaagacngccatgatttatcctatactctataanaaaaaaa

SEQ ID NO: 2542 - DNA, 230 bp, Fusarium venenatum
  misc_feature (1)...(230): n = A,T,C or G
gactcagacatttgtcgcattggccaaagagcagcgacccgaactgggtgagaagctgacagttttctgcgctctcgctccagcagcctacgctggtcctctcattggcaagatgtacttcaagttcatgcgcatcatatcaccgggtctgnttcggcttatgtttggnattcatgcattcattccttcatgaangcanatgcacccaatntgggcgcacgttatccggt

SEQ ID NO: 2543 - DNA, 113 bp, Fusarium venenatum
  misc_feature (1)...(113): n = A,T,C or G
ncgcttgangatncggataccaggatggaacncctattaagaagtganactcagcngggnggggaatatttcaaggnaanaacgtcacttttgnaacncggatgtgagccgaa

SEQ ID NO: 2544 - DNA, 249 bp, Fusarium venenatum
  misc_feature (1)...(249): n = A,T,C or G
ntatacacggagcattcatcgttatcgccaactcanaacactcgctgccgnaccacataacattaaaacttaaactttattcacgatgccttcaattctcaaccttgttacccgatccgatatgcctgcggattccaatggctcaaangacagcatgacaacctgatgcttggccttcttggccttgtcttcctcggcttattctggggggcattctggtncttttncgncgcgctcgtnttaaaaaca

SEQ ID NO: 2545 - DNA, 587 bp, Fusarium venenatum
  misc_feature (1)...(587): n = A,T,C or G
aacaaaagcccttttggcgacgtttgttcatcgacgcatactctacattgtattaactcattgtcccacgcttcaccgctattcttggagaccgtttttgctctgtctcagccctcccggtcgattgcgcaaatcagctccgtcgcatatttccttggcttgaaacccgtctctgccattgtcgataagagctacactactactgctctgcgatcatctgtctatttacaatcgagcattgtacccacgtgccgcgtcgcctgtctctgttaggattacctttgttgagaaaaacaaccgagggctatttattgtttgcgggcctgagttcctattcagtactgtaccctgctgctgcacgagatacttttccgcgtgcacacttctgcaggtccgatctttggggggttttgccgataacttttttttctccttatcctgtttaaaagattcttggttgcccctcctcctccggcccctctctttccatcatgtctacaaagcgagacactcccgctctacaacccatcggccactgaaccngangtaccaacatggcgccaacacgaaaaaaaaagttgccgaat

SEQ ID NO: 2546 - DNA, 222 bp, Fusarium venenatum
  misc_feature (1)...(222): n = A,T,C or G
nttgcacctcgaaaaggctatnantcttgcntatacncccactatcccncatgaccaacctgtcgccatggattntttgcgtcactgggaaattatgacaattaaaaactgcctggggaaaaaaaaaaanaaaaaaaattcttgcggccgatctaacctncttgtagagggcccaattcgacctnttggngagtgatanncaatttattggcccggggttta

SEQ ID NO: 2547 - DNA, 634 bp, Fusarium venenatum
  misc_feature (1)...(634): n = A,T,C or G
cttggaggccgcacgnggtctttgcaccaggcgattgtgccaaggtcacacagaagctcacccacgtcgtcgacaacatccttcttggcgacgacaaggaagagaagaagcaactcaagattgcttttggtctcctcggncttcgagatgatgatttcgccacggccatctctcaaggtatcggagccctacagagcaacaactgggatcctgcatccgactcttccagcttcggtctgtactgcggnagtgtctcttccgacgacattctcttcgcgagcactcgacacctcgcgccttatgtcaaaaagtggctcatctccgctggntacaagaaacagctcaagnatatgacaaatcgnttnctcaactacattggctacataagggncaacggtgagagtgacaagtctggggcgctgnaacggaagaacgctagaacaagngctactctatccgnggggcaatggacgaaataagcttgacccaaaacatgntgcgccagggggaatataaanttgcnacaatgggggaactggggaaatnggaantgggngccaaggacaacttccaaggggctcgcnatgggggcgaaacaaaacattcctgcggganaaataaaatnctacccncc

SEQ ID NO: 2548 - DNA, 571 bp, Fusarium venenatum
  misc_feature (1)...(571): n = A,T,C or G
gcagatagcaatgaagctgtctagagttacgctctacatgctcttgacagctggctgtcgaggtgcatacgttcagttccaagactgctctgagggtcatgactcttcttcactcattcctgagagtttccgcgcatcggttgagaggggaagggataccttcgactggaagttcgatctcattgctggactgatggatcgtaactcctgcgaagttaacctttctaatattattcctcgattctcaattgtcgattatggaaacgccactccttacgtctccggtcagattgtcaataactcctgcttcacaacccaaaggattggctcaaggtcgaaattcaccattattacttcatttaaccggtcaaagctactcgacacgtacaagactacctttgagttaaccagccccgacaacaccacactatcttgcgtcaganctgttttaactcccgcagttcccggagcgatacgcctcccttggtctctgggtttccaatcgttgtttttcgccttgggcttgtttcacagccatgttggccagtccgacnaaancacgaaggcccaa

SEQ ID NO: 2549 - DNA, 590 bp, Fusarium venenatum
taggactagacatttttctactattttgcgtctgcggaaattacgactggatttgatcaatcatgctccatggccggctacctctacgccatccactcattacctccttacttttttttaacaatacgccttgatcgaagcgactggagaagatgggaataatgccgcaagtgccctactagaagtcatacttccctctgtccatatcatggacgtcgtcttggcataagggcattttagcggcactcatacccgcgtgtaattcgcacgtttgttttcttttcttcacgactgggagttttgtctcctgtgtacaaattctcttcgtccttttagaagacggggataaacccaaaaagaggaggacgataggtccttttgggacatggtggatagtgtgatacagagcaaggtgtcacaggtgcactcggacgcggggacggacgtcaacccctgagagatattacgaattcagtgggttgactggaagtacgggatgttctctcgtcgctttatttatttttcaacttggttgttatcttcgcctactatcatggttgtggtccccctgtatgttaggaattcgcata

SEQ ID NO: 2550 - DNA, 560 bp, Fusarium venenatum
  misc_feature (1)...(560): n = A,T,C or G
cgcttgctgtgctatcggtactttcatcgtcttgttttcaccgaaccttgcagccgccatcattggatttatcatttcgattttaggatacgtcatgcctgtctctttgcggtcgttccttgcttcacaattagagaaggacttttctggacgactattcgccggcattgccataatggagacnatcggtggtctcgtcggacagccccttatgacagtcacctactacactgagagtgtaccttttgtcatatcgctggtgacgtatttgatcatgcttttcttgcttatcgggctagcaatcagactttgatgtggcgaggaacagtatacgaacacgaaatctcagtgaccggcatccaagtcttgcatccgggtcgagacttgtcctaatatcttaatcttgggttaatttatcaagcnaaaggaatggtttantttcccttgtcatctttcatatcgtctgctcaacgaagtcaacccatcgtcactaataattgaaaatcttggctctacntcaatcttccacagaacatgaatataagatcaatgcatattct

SEQ ID NO: 2551 - DNA, 832 bp, Fusarium venenatum
  misc_feature (1)...(832): n = A,T,C or G
gaagacgaagagcctgttggccttttcagcctcagccaccgccgcgccaactaccgcacaacaaaaatggcacctgctgcccaaggaatggaacgctccccccgaagagctcttgaggcattccccgactttggatttacccatctctggaacatggctcctctctgggactccaaggctaacgctgctgctgtcaagctgcagcgtgaaatcgattcactggtcttggagggcctattcagcctgaatcatcgccgcaacaccttccgcactacctccgcaagccccgcagcgcttgacacacggcccaagcaacgcatctcgcagcaatctctgccggtgctcacctcagatagcctctggtccgtgcacacgtcgtgcaaggatgttagcgaagtcaactggctcgctctcttcacagtcaggccgagagcaacctcggttgcatccttctctgatgacgaatatatcatgtctgtacctgctcttaccagaacctctttcatcaaagtccgagaggtcccaccctgccgcgactcctgcaagagtggctcgctgctcttcgacgagggcatcaagctgggatctggcaagaccttggaaatcgataccgaaggcttctaccagctctggtcaaagcctgaggctgatgacgagcctgttatcgcctcggatgaactcttggaacccatgaacaaccgcttccttgaattgacccctacaaaagaggcgaatttcgnncaagtgtattccgagtctggnactttccaagcgtggccgcacccanaaagggcccgtcccccccatgcctatgtaccctggctttttctng

SEQ ID NO: 2552 - DNA, 301 bp, Fusarium venenatum
  misc_feature (1)...(301): n = A,T,C or G
ttatcaacctcattattcatgcgattnaccaagagaccaatatcattcccacgtttaccttcatcgncaatatcctgccagattaggatggcatgatctaagtaagctccanaagcccggacccaaaatgcctactcaaatccgtttgaagtccgggatctaactacatatccctgcatcttggcgaaaggcattttcacatgtnaacatgagagcttgttctntnattccggagcgccgattatcgattgctgtgcagccatccncctcatcattttccgtggcancatagagttgctgt

SEQ ID NO: 2553 - DNA, 292 bp, Fusarium venenatum
gctgctagcatcaccagcaacgacgccagcgagcttgccggccagatccgagccatgcgcgacaaggtcgagcgtctcgccatctaagatacccaacgaaccgaggaggaaagcaaaagatggaaacctttttcgtctgtgggcagccggcttcaaaagtctgtttgttgctgctgagatctgtcgccgaactttgatgattcggtcccaatcatatggtgcaataattggtgtatgaaattaggcccttgggtagaatagtaatatcatcaactgtcttgacgaaagccca

SEQ ID NO: 2554 - DNA, 590 bp, Fusarium venenatum
  misc_feature (1)...(590): n = A,T,C or G
cccgattgcaatacactactgtcaacaacgcttggattcatgaacaccactacatcgcccatttctcgacatttgcttgcaattctgggcatcaaaaacgctctacgaaaccccggctctgggcttaccccgaaccctttcgttcgcctttgggggctcacccagccgcccctcccgttgccgctccacttcatcgccgtcatctccccactcgaacaccatcgctctaaggtaccgactgcactgtactcaatcangacctcggctctatagtacttcgcaaagtaaaagcacaatcatggcagctcctgcgaatgtnaaggtctcggggccccaaatagtanctttctcgtgggctatcctggtatttcagcgactctgccgcgcatcgaagggaaagtcnaaatacntctggccaggcttttctatgcccgtacccgtctctctcgtccgaatatgtctacagcgccgaaaaacaatacatcctgatgccgacagcattgcgaaacgacatttaagcgctcctcgccgcgaaacaacggactggtcggcaaggaacactcctctttcnangttcttctggaaaanaa

SEQ ID NO: 2555 - DNA, 150 bp, Fusarium venenatum
  misc_feature (1)...(150): n = A,T,C or G
ngccantggttnccccccnggggggggggngggccttnaacaaggtggcccttggtgggggcccnngggggcgggngtgcnccccctcggnggcttggangggtttaanatgggggangggggttnaggggtaangggtttgttaagttg

SEQ ID NO: 2556 - DNA, 565 bp, Fusarium venenatum
  misc_feature (1)...(565): n = A,T,C or G
gtcggctattttgaattctgtggccgacagctgcatcctccctaccatcttcacctgtttgtctccccagggggttagaaaatgcccaatgagggtgagttgccatatcgccacggctgcactggtttagtcggcgttattgtggtgcaactttgtacactgcagagcatgatgacgacggttgtctatggaatcctggcattatgcctgcgctcacgctcgatgttctgggcatttacggaaacccacattgccttgacggcgctaccgataccttcgattttcagaacaatcacgtcgttgtgttgtgattctgagttgagggaaccgcaaggcaggtggcgggagtggcccagattgcatctctgacagttaagacagatcanggtaaagttccggtatctgttccgtgatgtctgccaagtcagcaaatttgagcccgctttgaccttgtcaagttacctcttgggcacgtttngntgaagtccctcgngtcttcggtgcggggttctgtagtaaatgccgttancgatgggggcttgaacgtcttgncctgaaactttgc

SEQ ID NO: 2557 - DNA, 162 bp, Fusarium venenatum
  misc_feature (1)...(162): n = A,T,C or G
ntaacanaacctcactgagggctgncnacatgaagntagatcnttcaggctaaaaaagcatctagntattgnacaatgagaaccanttaacccatggtaaagctttgcaggngntaaacggnatcatggaaatatcttcttgcggtngttngagcatgcatc

SEQ ID NO: 2558 - DNA, 627 bp, Fusarium venenatum
  misc_feature (1)...(627): n = A,T,C or G
atctngcccacaaggtagcatagcactcttcaggacaccttctcccgagtcacatccgttcttcaactttgcaactcatcgacggtactttcgcaagcgcaccacttctttacgtacgaaatctttacgccagatcttcgaaatggccgattcttcccttgccgncaacggcaactctcttcttgagaccaccaagaccaacgccgcgntgcgtaccaatcggttgccaacgggcccgttgctcaaaatgtctatggccacactcagaaagcttccaccgagctctctaaccttgctgnttntcgacgcactcctgcgactccggctggcactggccagcctcttactcactatcactccttcttttcggagctcctgtcatggaacaaccctngcgcatctgntatcgnttatgccaccattggttctggcatcttcgctgnacganacttaaatggtctccgatggggncttaaganatnctggatggnccttggngggaacattctncgctgagggtcttggnaagggtaatcttaacaatgggctgggntactnaagggtcgncttcgacgaaactacacaagttcctngngagaaccttggacgccggtatttggngaacgt

SEQ ID NO: 2559 - DNA, 337 bp, Fusarium venenatum
  misc_feature (1)...(337): n = A,T,C or G
cttgattatatcttctcttcccccagccctgtcaaggcatctaancagaagaaggtntttgaggccgatgctaacgccaacattgtccacatcgagcctgcatctgcttctcacgctgcggcttaagccgacgccttgatttgcattgcacatgcttgacaggggggcgggccggtcactccctttttagtttctataacagcttgagttcaaattggttgatggagtatgttancacattatgacgagattgcgcgctcanatgttgggtcctaatactacattctttgnggataataatacaatctcaatacttgcctttcnnaaaaaaaaaann

SEQ ID NO: 2560 - DNA, 751 bp, Fusarium venenatum
  misc_feature (1)...(751): n = A,T,C or G
gcgggtcacgaaaccacccacgtgtcggccaccggcggagcctcacgcttnccttccccgcctccgtcctcatcgcctgctgctgctaccggtcctgcttatgccgatgatgcaaagaagctcgtctatgggcatcttgacgcgaagggactnttggtcccttaggtcacgctttcgcgggtcccggctcagtttcacatacccccactgctcagcaaccatcccccgcatccgacgatttccaaatatccaacccagcttatccttctctggcgcaccctcgcaaccgccagagcagacagttatacatatacgtgacttggcacatattcagagtctggccagcgccgacctgctatntggcaatggcggatccggcattctaaacgaccccctcttcacaaatgaagtatgaaatcagtggcatgccataggggacattatcgagatggtgggtgcgctattaacaaagatcactaccacaaatgatctacagcacgatgcgatgcagcgtaatggtgntnaccaacagcagggcaaccaatntggggatgcgagcgggggntngaactcgntttgaatnatctggtcttgcctttntggnaagaatgtnctggcattaccatccttaagtatttggcgaggaacacaaaactggcctaccacttacnaagattccttancctttggatantttgacnctgaaaaacgagtaacnatttggnacnaaaacaaaaaaattnaagggnaa

SEQ ID NO: 2561 - DNA, 632 bp, Fusarium venenatum
  misc_feature (1)...(632): n = A,T,C or G
accagctcctgacttacaccagagccgcaggcaaaaaattaacttgacgggatccataggtttgcgtttgcgccaanaaaaaaaaagcatcccagccttcttgacttcatcttgcattctagcctctgcacttccactttacaacccacgatattcatactaagtttctctatatctcgcacctgcgtgccccagctntttccccatagtcttttgaaaatcaatgacgctgaggtagcaatnggggaagctctagagatagtgagaggatctctaggagcaagcaatgctcgttacaaaacacgctgcagagctttgtgctctcctagtcaatgacctccatggtgaacttccttcgcgaatcttgaatgcgctactgaccaaaggccgctcgacgattgcgcaactgatccaatatacctntcttactccacgatatctgcgaaatggcctcgctgtcttaatccagcaaaaccttatttaccaccacacagatcccaataccaacatcacgagctaccaagcaaattccgatgcctgctacaatcttggtcgggcgggcaaaattctggtgtgataaaaacacaatatggcactggcgaacgggaacttacccaaacttttgatccagn

SEQ ID NO: 2562 - DNA, 337 bp, Fusarium venenatum
  misc_feature (1)...(337): n = A,T,C or G
cctcggtcatacttaattaaatcagttacaatgggctctatctggaacgctttcactggcggcaacaagtccggccaccagcagcaacagcagcagtcgcagtcataccagcccacaacacaagaacccgcgcactactcctcctacgaccccacggaaggccagggcgtcgagtccttcctccagagctctacctttgccgacccctcgcaattacatcctctcgccggcctcaacaganatacgctcgaatatatttccctcgaggactcaccttgtccgagttgcctggnggcaatcagtcctgcctntcgtggcttcaaaatgattgtgttac

SEQ ID NO: 2563 - DNA, 120 bp, Fusarium venenatum
  misc_feature (1)...(120): n = A,T,C or G
nccactnaccctttttttangggggtatngcccagaagaccggtccttgtcttttctaaagacggacccctngtcaacttgggtttcacgatcaccccgtggnagaaaaaacccgttttt

SEQ ID NO: 2564 - DNA, 154 bp, Fusarium venenatum
  misc_feature (1)...(154): n = A,T,C or G
nttaaaaaaggnangggttttttcnctngggaaaaaggacccnaaccgnacttaacantgtcccaaanaaatgggcttaaaaggcaacaaanaagganaaaggggaagcngaaaaaantgnaataattnccaatcantttttgtacttttggac

SEQ ID NO: 2565 - DNA, 571 bp, Fusarium venenatum
  misc_feature (1)...(571): n = A,T,C or G
aaacaaccaatcctgggaccttggcgagcccgaattaaacgatcgcggccaacccgtaatccacaacatcgcccaaaagctcggatgtatccgccccaacagcgacatcgatcttcccgtgcactcggtattccctgaggacgaggccggcatggctgagctggctcgacagctcgaggatcagcagaaggaacacgagcctgcgaaggaagccatcaaggacacagactcttcagtgtgtaaccgaaccgagagagcgtcatcatcggaactcgatcattccgacgtcgacatcgaatatgactaccgaaaagctgcatttggcaacaccaacgccatgacctttcaccgaagagcttaactggctctcccgacttcgactttgccctccaccacccgaaatcgatgcttcaacactgtccctcacaatctccttcaatgaacaattcccgcctggcatgataagctcaatcacgatttatatgcaattctacacagcaacacaacgnagatgcacatganagtgatcnggttctggatcgatcgacataacctcctcttcttctaccga

SEQ ID NO: 2566 - DNA, 447 bp, Fusarium venenatum
  misc_feature (1)...(447): n = A,T,C or G
ttcaccgttggtgagattattggccgattcaagcttgtcggctaccgcggcgaggtctcttctcaccactaaacgtacctcttgtattggagcaagagttgtaaggatcaatcggtgctggactatgataagcaaataaggacgaatggactatagacatggaccttcctggctgaggacgtctgggaaggtctggttggagactggttgtttcggggggagttgaaaactgggagacttgggaataccgatcttaccggacctcgatgtttgtcctgagcatctttcttttgtagaactgtacatcaatcaagctgcggcgggtgatccccaccgtggagggctttcgacaatgatatctaataacgaaacgacccttatggatggagagaaacttgtaaagnattgnactatcttatctttggtgcatccaatccattattgacc

SEQ ID NO: 2567 - DNA, 198 bp, Fusarium venenatum
  misc_feature (1)...(198): n = A,T,C or G
ntacccaattcancctggacaacgaaaattaaactncccctttttgcttnacaagcttggaccatgccaacgnccctttcncnaatattaacttattnnagcctttgcgcattaaaaatccngaccggntttctttntaaaaagatgctttntgccctctttttgctatcagtggnnggctttggtaagggcaaccca

SEQ ID NO: 2568 - DNA, 621 bp, Fusarium venenatum
  misc_feature (1)...(621): n = A,T,C or G
ctcttcttttaccatcctcagtcactacactcatactctttcgctttaaggttcgtgtcttctctcagaccaacctttaatatataacatcctcttctccctatatcatccctattatataccagtccttcatcacaacttgctcccttcacttcagcaagcaccaccatgtccttcgccgctcgcaacgccctccgtctgactcgggctgctgcccctgttctccccagaaacgctgcccgatgtttctcagccactcgtgtgcagcgtgtcaatgacacaaacatgaagaagaacgtggttcgtgagaaggagattcccgtcactgtctatgctgctggacagggtaccggcgataagcacacagtcaatgtatccgaagctgctgctcgcattcccaacgaaactcctggtcctactcctgacagcgatgtggttaagcctctcacttcgcaagacctttgagcaacttcctcaaacaatgcgcaacatgaggggctacggaaagattacttgctcactggggcttgccggggtctccgaaatacatggttcgncntgctaaggttggngcaanaaantggccttttgacccaccagaacttggggacaaantttgtg

SEQ ID NO: 2569 - DNA, 534 bp, Fusarium venenatum
  misc_feature (1)...(534): n = A,T,C or G
tttttttttttttttttttttgagagagagagacggaaattttctaagagtgaacccaaaaccctgacccgttgatttgaaccatatatactctagttgcaaaggcaagcaaaacgtgaaagcaaagcaaagcaaggatccaagctgtacatagtactgtactgtgcgtgccacttgcaacggagaatttaaccaaaagagggtgctcattcgcacatggcatagcatagcccgtgtcctgtccgtcctgtcgtatcctgtctgtgtctgccctatccccgacccaaatcgccttgtgcccctgtagcctcgcgaaaccattttatcatctaggtggtcataaatganaagcatggcgaagggtatcggcatgtactcataaaaatggagggcaatttctaccatgggtttcgctcatgtgacaggggttgcgtgggggatccgtgggagtttgagggttttaaaacctcggaatcatttgcatcaaggtcaatgtttgcccgccgtcaaaacgagataattgctcngggaaat

SEQ ID NO: 2570 - DNA, 493 bp, Fusarium venenatum
  misc_feature (1)...(493): n = A,T,C or G
gccgacctattgaggaagtcgagcaagaagccttgagcaatgtcttggaaaccatggccaagtctcaagacaagctatgaaaggaaactgtgcccattatatcatcttgatacacacgacctctaccaatactcatcgacctaccacacaacaaccacacacagcacatccgcccaccattaacattatgtgaaaattatcattgagcagggagtcacagcgttatatggctatttgcattatggatttaggagtttaatatttgttcatacctctatctttacacggcgttaaaaatcttgcatttgccttggtactcatcttcggacagctccccggcgcagcgcgataaagacaaggtcgggcagggcaaggataagcaactcaaccagttgtcttgggcaagcttggnctttgggtcatgccccatcgttggccctcccccgcaaatgtcananttgcaatcgctgggtnccgaaacgcgggggtgagg

SEQ ID NO: 2571 - DNA, 416 bp, Fusarium venenatum
  misc_feature (1)...(416): n = A,T,C or G
aggaaggatgagcccacgtgggagcccaagtctcttgctgacattggcggcaccaatgtagccaagcccttcttcgaatacgactcggccaaggagctcgagctcttcaccgaccatacttacaacgagtacccttaccaggggctcggtgtgcctacagagaaggagattgaaaaggttctttcaaagggcacttgcactcgggaagagctaaccaacaagattgttgcatcgcgcaacggtcgccaaggcatctntgaagttgttacggagatcatngaccggaagacagtgatggacgacaagggcaaggctgtgtgggtganggatgaggttgcgcccggaagcaaactgnattctacatatgctgcaattctttttgaataatctgtaaaatagaagtnactacgagatgt

SEQ ID NO: 2572 - DNA, 594 bp, Fusarium venenatum
  misc_feature (1)...(594): n = A,T,C or G
gtggtagcgctgcttcgagcggccaagtgacacccgccgataacacgcaaggccaaatccctctgcgggctactcactctcggggtctctctggaaaatgttcctatgcttcagggcaatgttattcctcccagtggtcccatgcccactatgcgacaaaacgtgtctgtctatcctcctaaccagtcatgaatggacaggccccttctactggcgcacctgttcaacaacccagtatggacatgccccaggcaactttacccccaaccctgcttccaacggcgctgctaanggtagcgccnggcctacgantcctgccaacggcagcacgggcaacgccggggaanctcagtgggtttagacttacaagtcttgcaattgaccgcttgtatagtgacttcatnacngtttccgtggcaccgccgtattgacaccgctacaatcacaatttctttgatctgtctcanaacttggccaaaaggggcaggccgatccatcgaatganacaanactccanactggtctgtttcntatcatcaaaaggcctacagganaccnctatcctggggtctnggtcaatttcttcttgggaaa

SEQ ID NO: 2573 - DNA, 406 bp, Fusarium venenatum
  misc_feature (1)...(406): n = A,T,C or G
taattctggcttctacttggaaacaagtctgaatagcttcacttgtatcgnggggtatagacccacttacaccaggacatacctatacaacgaacctcatcctcgctcccanaagagtatcaatccnccactgccgaaaggaanaaggaagcggngggattcnaatacatacaaaacaccttgaagtcgccatcgattcaaaataaccatacgatatcgaacgacgatgcatcgctccgctgttctacttgcccttggggttctcagctcaccagccgcgcggttggctcaagtcanaccaagaagtgtcatgggaacctctcgccagacaggcntctacggcctgaagctggcgaacaagctaatatcgccttgggatggagtnctgtccaacagagccccccag

SEQ ID NO: 2574 - DNA, 558 bp, Fusarium venenatum
  misc_feature (1)...(558): n = A,T,C or G
acgacgaagaacaggcgaagaaactgaagggaagactgagaatgccgcccaccacaaagtggagggagtggtatagcatcctgttcaatgtcaaacccgattcccctgaaattccttcaccatattatgattcttctcgtcctggcgccaaaaccccctgcattaaacttgatgaagtagaacactggcgcgaatactgggaccaagcaaaaccggcagtccgtcaccacgtcaccaaaacggtagatgaggcattcggtgactttgtacctcaaatcaagggcgaggtgatgcagcgtctacaagagttacctcgcatacttgcagagctgctccctttcccaggtcttaactccgaggaaacctcttcagcaaccgataccattgggctcttcgactgtttcaactctttttgaccccaatgtctatgatggggaaaatttcgacttcagcgtacttgataacgaaattggcatccagaatcacttcactggggtcactgagtcttaaaatcttnagatcatatntggttggcgacagtnaggccctntgnggaga

SEQ ID NO: 2575 - DNA, 563 bp, Fusarium venenatum
  misc_feature (1)...(563): n = A,T,C or G
ctaaaacaagcgcttcaacttgctacatatcacaggcatatgatctaggtacaattaataatgtgctcagcctgttttgatgccctggctgctatattcttggctcactactattctgcaggttattatgacttcctacccagaagcgacaccccaagacccttgcacatggtgatgattcncagggttatcatcgcagggggcacggtccctttcgaacangaccatgagatgcatattctaatgangtgctcgtcaaacatgcanctatctccatattggtgactggatcaaagtatttcatcttggcatgcatctacacactacctatctacagccgcaccagacgaccaatctccagaatccaagaacnacacgggctgggcccgtctctactatttggggtttctctatctcaaaaacctcggcctacttggtgagatatatccctggctcaaaggattcggttcgcagtcctactccngctagtggtgacacatnnataaatctnggtgggttgaacgtgaattacaacctcccctgcggccctatcactttggggc

SEQ ID NO: 2576 - DNA, 359 bp, Fusarium venenatum
  misc_feature (1)...(359): n = A,T,C or G
natataaggcctgagagggttgtctgcaaacagttggnacaggatcttgatcatttatnaaaacatgcgccagttccaagaacaaanctgtgggctctgcaatatataccanaaacgaacttactcccaatcaactctgtgctggnccngtgttaccaagtcctngacttacgaattgntgactnggaaacnactaaaanctcnacaaagcnagcggacagctatgtcgattntggatttgganacaaccnactgcttcggtggtgtaacaggttcnctgttgngaaaacaaaacaaactgtacagnanaaggcaaaanggttaaatacnttccaaaacatnnctgtgatccacngcaa

SEQ ID NO: 2577 - DNA, 490 bp, Fusarium venenatum
  misc_feature (1)...(490): n = A,T,C or G
ctttcattttttttacccaacctgtataggcaactacctacaaacgatctatacacttgacctgatcacaagacctgtcgctatctctgttcgacccgaagcgcttacatccgtacatcccgtcttctatgcgccggccatgtcagcaacaatggtcatgacaatggcaccgccgactctctctgccgattccacgccgtgctgcccaggatgcggctactccttacctctcgatcacagtcaagttcaactgctagaagcacaagcccgtatcgaagactcgaaaaccaggtccgactactcaacgaaaagctacagccgccgtggatcgatgggccgactacnaaaacaaatctctattctaaggggncagcttcttcttcgacaacacacaaaaactcaaccccagcaactcctacaaatgtcccatgtnntttttcaaaacggaccagccggtctctcttctctcncacgcaaactcnnacttctc

SEQ ID NO: 2578 - DNA, 509 bp, Fusarium venenatum
  misc_feature (1)...(509): n = A,T,C or G
ctctagttctaatttatctagtcctggcgatcggacatcgtgggattaagcttattcttggttattttccctcattcgttcattcatttcgttgttattcgttttgttcttatttccattcattctttatcagccaataatctcggatacgcgtgctagagtttgattcattaatcttcaggacgacatagtattcgagtcaccaaggtttcagtttatcacagccctgttcgttgtcaattgaaaccaggatcatgcgtacttttactattctcgcttctcttactataggagcttctgctggcacagtctctgctcctttcgtgaacatggctttcacatggcgcctccatcgacaagcgcaatactctaaatctagaagctctgaataacatcacgggaggaggatactatgcagaattccagatggaacgccnctcnaaacatcagcttccttcttganactggtatatganacttggtcactcaacaacaccgatctctgccta

SEQ ID NO: 2579 - DNA, 541 bp, Fusarium venenatum
  misc_feature (1)...(541): n = A,T,C or G
ttcttgagatcgaatctgaggaagaagagagcccaacatctcccgtttccccatcgcaagagcttgccaatgtccaggacgctagaagcgttaatctgggcagaggtcatgtacgcaacttcagcgctgggagcgcaaaactactcgatatcactccccgagcatctgttgatgccagagggagctcagaaaggcgaggaagccacgtcctaccagctatttgaaagccgagctaaggtttaaccgttccagaagaaaagtccccgcagcattaatcaccgtcaattcgacacatcacactcctttcatttccttattgnctcaactgactcagtcactccttacccattttcttatcacttgncaagcaaaaccaagaaactcttaagcatggggaaacacaaaaaagcgatgcggactttttttttgttaacgaaaacatttaaaactgtttctatatggntgggttnggcgtncgactcgttttgttnattacacgaccttgtgacccggggcattccgngtcttactaggatttttt

SEQ ID NO: 2580 - DNA, 262 bp, Fusarium venenatum
agaagtactccaaggtgggatatgtgcagcgagaccctgactggctggagaaggagaagcccaagaagctttgcgaccaggcccagaagagtaggaagaccagaaagattcctcaaagcaagcagtaaattacggcactatcacaacaatatggacaatttttttccatttttttttttaaaaaaaagatttgattagcatgtatcgtagtgttgcaggattcaagggcataccttctgtcctggcacgaattgaaataaat

SEQ ID NO: 2581 - DNA, 165 bp, Fusarium venenatum
  misc_feature (1)...(165): n = A,T,C or G
nacnaaaaagttgggtntccggaaacggatcttacccttaaccttggcgccggtgccggcggnccaaaaccagggnttggggatttggnggacaacnccggggtcgtcgggggnaaaaangaancggtnttttnaaacccttgacctangggacttgtggganct

SEQ ID NO: 2582 - DNA, 190 bp, Fusarium venenatum
  misc_feature (1)...(190): n = A,T,C or G
nccccctggcngngcacttatactgtcaaaaaaggganacccnacttttacccggngggnttttttnggaanaaaaacccgctntttgaanaccccnaattggccaaaaggcccgnctcctttttttggaaaaantggtttttnttatccccccggaaattnaagnttaaaccccnttaacccgaagttt

SEQ ID NO: 2583 - DNA, 116 bp, Fusarium venenatum
  misc_feature (1)...(116): n = A,T,C or G
nttaatacncttggacngagaaaactttgcgagctnncttattcgaatagggcnnatccgatnttcttaccaagagttntcaagactataccnccgcgattacnttcacattttaa

SEQ ID NO: 2584 - DNA, 258 bp, Fusarium venenatum
  misc_feature (1)...(258): n = A,T,C or G
ngctctcgcaatcaacaggacagtnatcaaccaagtacctaaccaaattcancaagttgctttgctggtgtgnggacaaccagactgaatctgcaaagagggctttggaaaggggcgcggaaagtccctggaagccataaaactggcgttccaagcggntcatgcaananatgattgcatacccagtttcctaacaaagcgcaccgatccacnaatagttgacgcgangcccttcatcgggttctttttatccatgan

SEQ ID NO: 2585 - DNA, 131 bp, Fusarium venenatum
  misc_feature (1)...(131): n = A,T,C or G
naaanacaaatgccgntgaccaagatgatggcccnctgaatgntattgatgcccggtggnacacaacnattttggtgtttcantggaccccaaaaaaccctggtggggcnagtgctggggaaaaaaaatan

SEQ ID NO: 2586 - DNA, 364 bp, Fusarium venenatum
  misc_feature (1)...(364): n = A,T,C or G
cgcaattgggagcatggctggtcagagaatcaagcaggcctttgattcatgaaactggcgccagggcaggtgcgaagggaaaccatgtctggaagcagaatgaaaaggaataagcgggcatgcattcaacaggttgggagaggtgtttggtttttgtacgtataggattggaagctggcagncaaaaggcgcaatgagaataccaagtcaattgacagcatattgaaaaatgacgacttgctaggattaagaatgttatatgcgatattttagatttaaatgggaaactgcttggaatcccgttttggctgggtttatcccgcctccatggttccgagggctgttttgcgtagggngtgcttcc

SEQ ID NO: 2587 - DNA, 323 bp, Fusarium venenatum
  misc_feature (1)...(323): n = A,T,C or G
cgcgaatcgtcaacgaaccaacaaccaggctctgggtaagcgactntttaggacacagcacatattatcccttgacgggaagatcgagctatagtatacagtacggccgatgcntattcaaactacgagcnggggcctcagccatctccgatggcttgcatacaaccaatatatgtcccgaaatccaaaactctgggaaccggagggacgacnaccaaccgccgggatactgtgttacatttaggatgctttcgttctcgctcactcaanaaaaaagcaatgaatagttaaaatgtattacgtttgtttcctcctgtctcttt

SEQ ID NO: 2588 - DNA, 120 bp, Fusarium venenatum
  misc_feature (1)...(120): n = A,T,C or G
natttaanatagcctctanntccgaaggnatnggttanacatntaaaagacagagcncattngacactnaggggtggtcngaaagggntttttgctancggtntacatgattggggatta

SEQ ID NO: 2589 - DNA, 259 bp, Fusarium venenatum
  misc_feature (1)...(259): n = A,T,C or G
ctggcgatgaagtatcgnnccggtaaggagtggacccgatataatgaagatgcggaagtgagggcgtcagagcgatttggcaaggtcttggaacaggttgatgaaatggttgaaggactgaanaaagacaagagtatcgatagaatgggnccccgagaatttgagatgttgagaaactaaaacgaggatatagagcncgcacagtataatgagactgtanactacgaattgcttgaattaaaataaaagcttagatgtt

SEQ ID NO: 2590 - DNA, 413 bp, Fusarium venenatum
  misc_feature (1)...(413): n = A,T,C or G
natgcgcaatggtgacggccagatgacgatgatcctgagagganggaaacactttgcaaagcgagacggcagacagcggaggaagaaagaaggctaaggagacggngganggataggacagcgacaaaccagtcggaagaaaatgcngaggagcanaaagaaaacctaaccaaagtccaagggcggagaaaaaaagcagttaaaaanccgtnatgangctgaagcgcctccagaanatgatgtaccacaccaaggcaaatccccaagtgatggtgcggtaaaggaanaacaaggaaaaaagcttgaggttaaattggccgaccggggttggaattcatgcctaccaanggggtgggaactggtttaggaaaaanaaggaaggaaaanccccgnttgcatntattnaaccccct

SEQ ID NO: 2591 - DNA, 358 bp, Fusarium venenatum
  misc_feature (1)...(358): n = A,T,C or G
ttttttttttttttttttttttngattgatacactctatacaaattcttatacacaatttatcatacaaccatccccaatgccggaattcatttatggcttcttctgtccgagaatcctggcatgttgctttccagccggctttccagtctgactggcccgtgaccgtagagtatatctctccttcttccaggcaaacaccatctggtccacactgcccatgtcgtgcttgggtttgcgcatgtatgtgagacgagcacgtcgtgccctcttgggtcgtcgccagataatatcgatacccgtcactgntgggctgtagatcttgaaccacatctnacgcccaccttcatcatctgaat

SEQ ID NO: 2592 - DNA, 583 bp, Fusarium venenatum
  misc_feature (1)...(583): n = A,T,C or G
aagggcatggcatatcttcatcttgcgcatacgttggcagatgctttcaacgcccttgctgatgaagttcagaccttgacagatcgaaagactgtcttggagcacaagttacgctttgctcatgaacagttccaatatctggctgacaaatatgctccggccgcgcctgaaatagccgataccctggctaagctccagatacctccaaatacacctcttgataattcattgcctgttcctctacctttgccaagctcgtacagctccggctcccaacatcagcttgccctcgtcatccgtgacggacgtcgagtagctaatcagcttgcctcgctgggcgaagcgagtaaaaccactgcctctagccgcgagactgagtcgcaactttcccacgtagccacctccatgtcgaccgcgctagaacaagacttcacggtccaaggaaagaanggccatcttcaatgcccgttctccaagcccgccacggncagcggctctggggcccacgatgatgatgcgcagganaccactccgcaccactcgggggacccatctgcgcagccatgttcgaanaatctacatc

SEQ ID NO: 2593 - DNA, 597 bp, Fusarium venenatum
  misc_feature (1)...(597): n = A,T,C or G
tgaagaccgtgtgcttgctgcctacggcgcaatcaagcgaggccaagactcgaagctcattgggaaatggaagcaactggctctagaggctgaagagagccagagagttgaaaagagtgatggtgatcaaccagttgctaccgcgcccaaagacgacctcagatcggtgtcacgagaagacttgaagccttatatggctgaaagtgactttgcaaccgctaccaacctttctgcaaagcagatcacatggctggcttctcggccgttgatcctgcgcataaagttaccaagggaagctacagagtcgccgtggaatgctggtactctcatcgttgcgcacggcggcttggtccctcaagtccctctcgaagaacaagatccatgggcagtcatgaacatgcgcagccttgtttaccctgatgcccgaaggcagtacatccgaagcccgtcaaggctgatatgatcaagggggccaagaacccgcgtgcgacgattcgcagctttncaagangcttcagacgaagaggttcaagtcgagctggccaagttcgctgatatcgtcaagaacnggaaaaggtttcagcgaagaacaaaaaa

SEQ ID NO: 2594 - DNA, 451 bp, Fusarium venenatum
  misc_feature (1)...(451): n = A,T,C or G
gtaactttcatgagcggtattttcataatgcatggtgcggctatggacttggcccatcaacgatgagacgatacaagaccacagacatggacatatccgatccaaacacattttttctttcctttgttcgcccgttctatatatcaacttcttttttggtaccaacggttagcagatacacaacgacaacaaatctggcattcgaggcctctctggtagggctgaaggtcctggttctagtcaggcttgaggataacggcgtttttcttttgtaacctcttccttttttcttgacaatatccggatatcttgatacatgggggagggatttgcatcacaagggatcgagcagtgggctggtactcccgagacagcgtacaactctttttttctttgcatatttaatgaactcggctgaatatattggctcttttgaattanaaaaaaaaaa

SEQ ID NO: 2595 - DNA, 124 bp, Fusarium venenatum
  misc_feature (1)...(124): n = A,T,C or G
ncccggagacanccgtgaaagacngggccntttataatcttnggtgctcaccaaaccnnttagcgttatttntactgggtaccntancgatggganaaataccgcntatntaacaanggggatt

SEQ ID NO: 2596 - DNA, 189 bp, Fusarium venenatum
  misc_feature (1)...(189): n = A,T,C or G
gaaagacctctgagtcattgatgtatatgcaagataagaaaaaaagagagagatacgaatgacgcattttgggttgattagaggacggcatctaagttagggagggggacctggtgcaatcggcagtgcagtatctatcatgactagacgaaacaagattaacnaaaaaataacgggttacctagtttc

SEQ ID NO: 2597 - DNA, 596 bp, Fusarium venenatum
  misc_feature (1)...(596): n = A,T,C or G
agctagagttgcaccaaacaaatccgaaggcgcaggaaaggctgtagctgttgacccaaaaagcaatgccaatgttatgacaagttcatctacagcgcctgccaattcgcctccgcggccagattccaactagcaaaacgaacggaaccagctgtcgggaactgatgaggatggaatcggattgcagcaggtagacggttgccaagaccacatgaccggacctcctgaaagtgaccggttacgagatttcgattctcctgagcatagtcctaaatcggacagagatttcatggaatcggagacggcgaatggtgtgataaaggacgacaacaacgttaaagataagctcgcagatggatcttccggtcaggataccaacacaacgaacaacttactgggaagtgagaatcgtcttccagcgttccgccggcacgggacaaagtctagcatctatttggaagcgcaagatcaacctggccgcgacctagaagtggaattgagtgactagaacaatgacacaatgcccatggcaatgcanatgctgcatttgaagacctancagcatgcaccgcaatttcttcngaatctaatcaatt

SEQ ID NO: 2598 - DNA, 138 bp, Fusarium venenatum
  misc_feature (1)...(138): n = A,T,C or G
nccaccacaanccgagacgcnccncacgancacaagaagccggangcgacgaacccaagccagcgggannacccgacgagnccgancacgaagacnacaccacaccccacgnccccaaggngaccaacnccaccacga

SEQ ID NO: 2599 - DNA, 945 bp, Fusarium venenatum
  misc_feature (1)...(945): n = A,T,C or G
caagcaaccagaatactcgttcattattcacaacagtcatcacatcacacaacagacagacattccttgacatcttttagattgcaccaggagtgccttgactcgacttaacttgacttaaactacctcgaaggcctattatacaaacgatacccaaaccacaaatactcttcttaatcaactctacaaactccaatcttcaaaatggttttcggatctcgcaacaacagagcctctgaggaggagcagcgtggtcgcagccgtgagccagtcccgcttatggagagcaagcaacgtaccaactcatacgcaagcgaactctctacctccaccacaaaatcttcggcttcttccacagccaaggcgtcacgctcttggttcaaacccgcaccacaacccgccaacgtcaacgttcacacctactgnggaaggcactcaagccagttcctatttggnggaccatccctgggtgacctcgctcganccatgttgggcaaggattaatttccagcatgagcataatgagcataaacaacaaacaaaggctgnaacatcatcaccagattattagcagaccgctaatcacccgacccacccaaacgacctttacttttattattcttggatcaccttnattcatccacaactttnaacgtnactggntggtaccgggacgggcactntcattggcaagcgtggcgtcttttgtatggtaaagaaaagaagacatttcaaccattcattcgaaagagaccaactacacgcaatagataccctttttttggggggggggagagtgggggatacganagatcagtgggaagactgtaccacgagagacgacttgtatgattacattctgtgtagcaatattccgtaacgaaccccatgaatccgaaccgatacatccaaatgcattagtatacatagaacaactttnttatt

SEQ ID NO: 2600 - DNA, 737 bp, Fusarium venenatum
  misc_feature (1)...(737): n = A,T,C or G
gttcgggaanatggtcaagnttgnccttgccaaangcccaaaanagtcggggacccntgtgcttgggtgganaagttgntgtaaacggggncnatgcccttgcaatgaagnacnccagtttggaanaagtcanccgcgacgtatgttgttgacganagaagctttttgaagctttttcgtttgaaagtaatgtggtnaaccattttgagtgttgtctggttggtattgatctgcgagggatcggcagaggttgattcaatagtatagattctacactacactactcaattctactttgaatcaaactactctcagtcatcctctcttcacctcgatcatcgttcgatcttcccagttattcaagatgcccgctgccatggaacccacccagcaagcccctatgacctctgacaacggagatattgtcacgcagcaacccaccgctgagcctcagcctgatatgtccatgcgaggtggtgaagaagctggatgcgagatctgctgtggtctctgcgcctgtgacgagggatgctgctaagctttttgtctccaacttcgaacatcttgtctatgaaacaggatatagactaaattgaaccgggaaggagttttggcagccttgatattgtaacttagtaactttggtgtggattggatgttggtcaatttaagctataaagtatatcaactaaaaaaaaacttgcatatcaaanaaaaaaaaanaaaaaaaattcttg

SEQ ID NO: 2601 - DNA, 530 bp, Fusarium venenatum
  misc_feature (1)...(530): n = A,T,C or G
gcgcattgtttcaatttgtgtcggagcggccttacgtgaagatgactttgaaaccgcttactcctatgtagtcagccgtctaggcgttgacgagactgagcgtaggaaacaacatatcagtatttctgacgaatggtcatggaaggcagcactggatgccggcaaatatgtgcgtacagagaggtctcagaaaccaacacatttaggcacggcgagtggaaacccagagattcgtcatctcgaacagcgtattgagtgcctggcaacttctctgcgcattgcaccgncttctcaacttcaggaagtattgaagactttccgtcgctgcgaagaacaattagacgctgcagtcaaggaggaaacttgccgcgaggccgcttgggatgcttgcaagcganctctccggacttcctggctcggtcgatgcaccaaatccagacaaggnatattcaccacgcaacattactgntagtgcaaccgctcgccaaacttgaagaagaccgatgtntttgttgacctgtncagggcac

SEQ ID NO: 2602 - DNA, 636 bp, Fusarium venenatum
  misc_feature (1)...(636): n = A,T,C or G
cacttttccatctacgaggaggtcgtttctctcattgatgagattgatcctgccgtggtagtgatcgatactctgttcagaccaggacttgatgcaacaagagacaagaatcgacagcatgcgttcatcactcccaaccaggctattgacaactttctcggagaacagccgtatggaagcatgttttggaaatatccatcgatgagttcgggttttccatttccagtgccatggaacaagattcccgagaatatttacctcaatatccggtttatctacagtgttttgagaatgccagatcttgctgccaaacgaaaggcactccgcgagagaggactcaaagatcctctcaacttcttcggcatgtnccgagatgatgtgccgtggattactgtcacagccgatggcgcttccatcccagtagaatacattccgtcgaacgtatctaccacaaacccgattggtctttctgttgccccggctgctgaacaagatcctgtgcttgttgactggttgaagaaaaaaccaacagtcttggataacctcggnagcaccgcgagctattctgaatctcaagttnaattatgaacagcatggcaacgcttggnaaggtggnattaagtctttggaagtcaa

SEQ ID NO: 2603 - DNA, 168 bp, Fusarium venenatum
  misc_feature (1)...(168): n = A,T,C or G
ntggcntttgtncaacacaatgggactgttttagtttagtaatgagcaaatnntcgctggagcgccgantgaaatgaaatgatttgananttaatctgcnaaaaaanccccttttcccanttggcgnaanaacaaaaaggccccaccgatcgcctttccaaaaagttg

SEQ ID NO: 2604 - DNA, 158 bp, Fusarium venenatum
  misc_feature (1)...(158): n = A,T,C or G
gccgcgtcctcgcctccaagagcaagctcgccaaggagggcgatatcgtcgctgctacccccggctggaccgagttcgccatcgttcccgagggccgttttgagcctgcctcttactaccctggtgtcaagaccccaagggcatgctntttgccttgg

SEQ ID NO: 2605 - DNA, 489 bp, Fusarium venenatum
  misc_feature (1)...(489): n = A,T,C or G
cccttcgaaggctagtaagtcggctctcaaggctcatgcgaaaggctcagctcgacactaccatgcgaggtaagcctctggcctccaaggtcgatgctcctgtcgaaggactttgcaagcaantacgacgatctccacctatatggacctgttcgctggaacgaaaccggatggtctccgaaaagctcacccccgaagaagctgtcaaagaaactatgacnaccttcacctgtatggtgctgttagatggaacgagcctaacggcctaaggcgtcccaccgccgangaaaatccaagactacaaggatacagagctctatgcaattcgggacttatctcccccaatctcacgcgttcatcccgaagaagcttccaaggcgtncaaggatctcccangataccgtcctattcnaatgctgacactgctccccgcatccacccnaagaancctcnaaacaatacccgaattgaatgcttatgctcttttga

SEQ ID NO: 2606 - DNA, 468 bp, Fusarium venenatum
  misc_feature (1)...(468): n = A,T,C or G
gtcacgtcctagaatagaaccaagaatgaccccgagaaaatggctgagaattcaatcattaaatacagagcccgttggtntcgtgccgaccacggattctgccggccaacggcaatcccagcagcgaagggccaccattgcaccagatctatgcccttccggcaccgatccgcacgtttcctctgccggccttttacccgaacaaccccatatccttcttccatgttgcgtatgcgtggttaggccaactgtggtctccaccaaaggcggaacctcagttgtgcacattggaacctggtctgccgctacatcgtctgttcacattacggatgangtntctaccnaaccctgttggacnaggctctatggaaaaggtatctaatcgtatnaagccaattggttaagcttaacangtcnaacaagantgctgatccattntncaaatctgaccgtgccgaaacttaaaac

SEQ ID NO: 2607 - DNA, 616 bp, Fusarium venenatum
  misc_feature (1)...(616): n = A,T,C or G
gcttctggtgtattacgaagtgttagttcaaaaaggtcggtctaacattgtcgatggtcatctcaagggtgcaatgactatcatgagcaacaacgggactgccaccgacccgacgggcgtctttttggagcgtgcattccgcttctatgatgtgatcgcagcgctgtcttttggtactgctcctctttctagtgctccaggcaccaactacctggcaccatttcctcccctcgactctggtggtgcgacatctccgctcaatagtgttgatactctgcttggcatggcaacttctctatggcccataattcaccggctctctaaccttttagccttgaaagaccagcttgacgttgcagttgcgaacgaagaggtttccaaggtggcagtcctcagaacggaatttgaaacctcggcaacagccatcgaagccgctctggaggattggcaccctgtgctccctgaaaactcgatcctgaaccagaatcccgaggaactgagccctgaacaatcgactgaaaggagcccgactncaaagtattctgagtaacgccttgtcctaccgncattctgcattcgnctatctttaccgnaccatttatagctacccacgccg

SEQ ID NO: 2608 - DNA, 360 bp, Fusarium venenatum
  misc_feature (1)...(360): n = A,T,C or G
ncaacatnaccgacacaattggtgtgtcgaaatgctatcaacccnagtngtccggcgccttcnaaaccgnggatactggtgagatcggnaccancctccanganattggacnaaaatgggaaacatccactggcccccacacangtacngatggctcgacctcgttatcccnaanatagggcttccatcttttttctcatcgtgacctcacaaaactcgatgtntggtccttttgagacaataaagattgcattcctcaagggcgcggngaagaactnnacactacccggtggcttnacttctggaccccncnaaatatgtntacnaaatgctgggtgggaaaacccacactggggcaaa

SEQ ID NO: 2609 - DNA, 678 bp, Fusarium venenatum
  misc_feature (1)...(678): n = A,T,C or G
attaatttcatcattaaatcttcttcgattcattttcttattctgtttgtcgtggtgcgacacagaagttgtctggtcttgagcgagttgatgagctagtatcacgtgatcgaagacccacatatcgtgtcttcacggtcattctctcttcccagccttgtattatcatcatcaccctcattcaatcaccgacacggcgccgcatcacgagaagcgatctgattgctcttgcagagttctggagtgcaaaaaggccatttctcctgattcaagcgtgcgatcgaagacaccggccgactcgcgctacagccatttaaaattccgacctgtacccatcgaacgagagcgcgcgcgccgccttccccttcgttggaacattcggggcttgtagaagggatccccttggtttcgcagcgtgctggaaatcattggagtagtcttgcagcgtgctgganactactanattgcctgtcagcgaacctggtgttntttgtacgtgccgtaccgtgtcnacaactaccggccatacccgaacgatacaggcccatcacatacgcgctcaaatatccggatnctcgncggtgggggcgttataattgccgacttctacccaacaaaacgangccttgttgccttttttgttggaaggaccgggttttcaaaaaggaatntacttga

SEQ ID NO: 2610 - DNA, 549 bp, Fusarium venenatum
  misc_feature (1)...(549): n = A,T,C or G
gcacccccgcaagagccgcaggtcatccagctgaacggctttcccaactctgcgaacccgaacaacaactcgagagcaccccctgggcctcaggctgcctcttctaatgggagcaatcggccttctagaataatcaccgaactccctccccccacacaacttgacattgaatggtcgcctgtgttgactaagaacaacgagcgcattctcaagctaggtgacctcatggtggtctcgacgcctttgcatcaagcccccacggaaaggaaccaggagaaggacataagaagttgtctcgtttcttcattggaagcacaacaaagaagcgccagcgcctggtcatgattacctcaagcggtcgaattgtgcttgcttcaccggtggtgaggagaaacggcaaagcaagagctggccttctaggtcagattgttcttgaagactcaggtcgatgcaaaagggcaaaccgatngtgcgtaataccggtggncaccattatcatttgagaggccaatnctatcaactccccggaaggggttaaccccnttattg

SEQ ID NO: 2611 - DNA, 104 bp, Fusarium venenatum
  misc_feature (1)...(104): n = A,T,C or G
nngatcaattcgtcnttatgcgncaacttgcaaatngcatacccctgantttngttcgatngcctttattcaaagtnnatgtggctcnncccgtgcaggantga

SEQ ID NO: 2612 - DNA, 600 bp, Fusarium venenatum
  misc_feature (1)...(600): n = A,T,C or G
ccaaggctctcgatcgcctgtcaagaccacatttgccgacagtaatgagtctctacccgccaacctggcccctacgaccgacccaaacgagtaccctctcgagccgcctacccaggagtctgagcagctggatcatatttatggctcctacatctcgcctctgtgcattacctctttccttcacctcatgtcgtcgttccctctaccccaagacgccgaggagcctcactcctctcacaggtgcttggacaaccaggagcaaccgcgcatcgnggagctaacgctctcacccacaccatctcctgactatcttagcctgaatgatctgagaaagcatgagatgatttaccgctttgagcangaatggaatgtggacgtggtcctccananagacagtgtttggagacnccccctcgactggtggtctttgacatggacagcactntnattactcaggaagtaattgaccttttggctgatcatgtcaaggatcccccaaatctggctgccnggttgcccaaaacacacattgtgcgangatgggtgagctaaantttgaggccttttttccgngaagcgaagtcgctcttcttaangggt

SEQ ID NO: 2613 - DNA, 265 bp, Fusarium venenatum
atccactatggcgtaggcccacatgcttgtcttggaagagacatcagccaggttgcgctgacggagttgttcagggctctgttcaggaagaagggccttaggagggtggcgggtgcgcagggagagctcaagaaggtgccccgacctggtggtttctttgtctacatgacagaagattggggcagcatttggccgttccccacaagtatgaaggtgacttgggatgaataggatgaagtatgaatgatatcatggatggaattat

SEQ ID NO: 2614 - DNA, 443 bp, Fusarium venenatum
  misc_feature (1)...(443): n = A,T,C or G
cttnttcgccatgtcctctccctacgacctgcatcncgactatcgaggctcctcttccttaatttgnacatatncatgaancgaccttnagatgccnttttaccctcctnacnagccgaaccgcctcctccnaaacgcgtcccaagagcagtcggngaatcgcgctacaggccatcataaattccgtttcgcacccttcaaacgagcgtnttttggcgacctactcctttgctggaacgagcggggtctgtagaggggactgttcgagtcttgcagctcaattctggagctcnaatagtngcccggcagagaaactgacttctcttgnccaaaacctgntggtctttcggccgtaaaaaaanaaaacctcactctcagtcttgcagctnaattcttggagacggagggtaaggttntttgcangaatcnttaattcngcggtt

SEQ ID NO: 2615 - DNA, 423 bp, Fusarium venenatum
cagaacggatgttgagctcatgtacagaaggctgagcgcagtagaagccaagtggtttacaaggttgattctcaaaagctatcaaccactagtattagacccgcatctcatataccgtctttgcgaccctcttcttccttgcgttctcaaggttcaagacgactttgctactgcgatcactactgcacaaactttgcgaaggggattactcccaaattctggacagcagacgccgcgtgagcaaatcatgagcacggtaaaacctcaactgggtatcaagattgggcgacagccttggattaaaggccgcagtattaagcattgcttggatatgggacacgggcgtatgaatgtggaagaaaagatcgatggcgaatactgccaaatccatatagacccaagttaaaggagatcgatgcatcc

SEQ ID NO: 2616 - DNA, 614 bp, Fusarium venenatum
  misc_feature (1)...(614): n = A,T,C or G
cactattggtgataggacgcttcacaatgtcctcgacgaagccgaactttccatcgtaataacgctcgacaaactacatatgcgatttgcgtcctttattttgccttgacgattccttctctcccgacagtttcgcgtccgataacctcctgaaggccatgtccggagacttcatgccatcggcaccaacacccctcaccagcttcacaacagataccggcctgaataccgccagcgcgcacgtttcgtggtacaaccctacggcctggagttttaatgtgacacgctatgcacctaaattagaggaccttgtgcgggctggtccacgacttgtcaagaaacttggatcttttgcatccatcttcgacttcctcgatacgactttcaataattcngattatctaccngcnggagctggtgcnagtnctatacttgccgaaggctggtccacgatcaaacatatggaactgggctgggacattgaganacccgtactgtcagccgcatatccgatggacgtgtgtggtcgaagtnccgtacttggtanatcttggnttgctcaagcaagtggcattgggttnattgtatgccgnattttaaccgacgcaatttct

SEQ ID NO: 2617 - DNA, 130 bp, Fusarium venenatum
  misc_feature (1)...(130): n = A,T,C or G
ncatgaaattcgcttgatgggggactcatgattgctcttcgatnnggcaacattgaaatactngccagaatggcgagaccacccttctgtttggaatttgctgnggacgttgagacctccncacaatcac

SEQ ID NO: 2618 - DNA, 842 bp, Fusarium venenatum
  misc_feature (1)...(842): n = A,T,C or G
ctgaactacactctttgcaactgcaattctttgagaagaataaataaacagtcttgttgtcggtctgatccagaacttgactactcagtccactatatcacggcccactctcactcactcaaagacaaccacaactccaagtggtcatctcaactttctctctcacatatccaataaacatcacttccaacaaaatgcttgcctctcacggtcgcggcggcgctggcaacatggccgactcagccaccacagaaaagacagaccccagcaagctccacactcctgtcctgaagagctccgtcgtcactaccggccgaggtggtacaggcaatatggccaagaacgacgatcctcgcgagactcgcaagcgtcaagacgttgaagctgtgccccgacgtccttcttatggtactcagcactctggtcgcggtggcgctggcaatgtcttcaaggacaaggacgtgcaactgacacgcaaggccagcaacgaaggcgccatcaccgacgacgaaggaacccagcttctgccacttnttctaatgccggcgaagtcattggctcaaaaaggcaagaactggctttttcggtaagaaagcttaacgagcgagagcgtnttccgatcttttattattcggtctaagtcttcagagcgaaacaaaaagtttcatggtctactatnattggggtnngggtttcttttacagcttggnggtttnggcnccttgaattggattanaaaaaggggtctngcttntaagtatggagaccatncncaacaaaaatggggtaccggccggcctnggataggcgattntattnctaaaaggngggacncgagatct

SEQ ID NO: 2619 - DNA, 534 bp, Fusarium venenatum
  misc_feature (1)...(534): n = A,T,C or G
caaagacaaagtccaagaagcgcaagcaaaacgctcaagcgcagactcaatcagaaagccctcgaaagatcgcaaagacaacatctcccttgataccgacacctcctcccgatggcagcaccacacccttcgagccaaagaacctccacactgtcgtttctgaggaagaacttgagatcactatcgacactctcacatcgntggcccaatatcctggtttgatcaagtcaaagctctgcaaggaccttagagttgccgtatacgactttcggcaagcttgcacgaccggtgtcaacaatgctgntggcgcgaaccttacagcgcaggtcactgctgcctcgccgatcggaaatacactgaagcaagaatttttcttgctgagatgaanattcggggcgaacagcccaacttggtgcctgtgccgatgggtgcganatctcgatgtcatnacggnctgtcnctgtgccanaccacagggtctcgtgaagcgctccgaanggaagaaccctgacaaggcatcgattccgtnttaaa

SEQ ID NO: 2620 - DNA, 142 bp, Fusarium venenatum
  misc_feature (1)...(142): n = A,T,C or G
naaaacctgacctgncgntggttgcattgncgaccgaagntanacctcccaagggaaaaaanggaaaaaaaaggtnganagccccaaaaggggtntggaaaagagaagaanttggacttnaggggaggggntaaggaaaaaa

SEQ ID NO: 2621 - DNA, 467 bp, Fusarium venenatum
  misc_feature (1)...(467): n = A,T,C or G
cgagaagcgagccagtgctcatgatctgctaaggcacgaattcatgaagggctgcgttgatcttatccaactctcccccttggtacgagctgctcgagaacaaagggcgcaagaaaaggctcgcaaggggcagtaggtacaccccgagcgaaccgttcctcccccgtacatgcctatcgcggtgaaacgggagagcatattctaccgattcccagcgtattttaaacgacggngattgatgtattgataccgtcaatactgttccgtcgtctcgtgacgacttggaacaaatnaagcggaccttgatgtgtcctgatcacgattttgattcccaactattttaatgacatttttttgcacaaatcattcaactttttatagcagggtttttgcantattgaaatttgaaagttnntaaccattgctttngcaaaagggctngggggggntcggaattttnttattgc

SEQ ID NO: 2622 - DNA, 197 bp, Fusarium venenatum
  misc_feature (1)...(197): n = A,T,C or G
nggcgggttctctcagggtgggccatgtctctccttgccggcctcacctggacaaagcaagctgggtggaatccttggcctctcctcgggggtgntcctgnccangacctttggccgacatgggtaagcctacagatgccaaccggcagactnccgttatgaagttcccangggggaaaaaaccttatngccccttg

SEQ ID NO: 2623 - DNA, 579 bp, Fusarium venenatum
  misc_feature (1)...(579): n = A,T,C or G
cgctttcatatacgtccgtcactatctatccatcactaccaacaaactcttaacaatggatgccccttcaacctccaactcttcggctcagcagtctccttctgttcagatggtccctcagccagctcccacccaaggcagcaacccatcaaccgctcctttcctccaggactttacactcattgccgaggctgccaagcgagcccagatggccatcatgattcgcgattttgaagactgtggcctgtaaattcacaacaggctatgcaatccaacaagagaaagaaagggaaaagatgatcaaacccatacctatctcgaccaaaagtcaactcgacgaatcacttgaganaccttgattggggggggggaaaatgtgcancantggcatntttggcttatcccacctcaccaatcacgacgtccatgggccatattcacattctttgtctctctcatatcactcacctccaaccaccactttcttatgcatcatcatcattgctatcatggttatggtaggaaanggcccntccanaaaaaaaaaaatggatatgggcatcttttctcggctctatt

SEQ ID NO: 2624 - DNA, 517 bp, Fusarium venenatum
gatttgttcctcacttgtcttgagaaacaagaacaaacccttggcataatatcatccaatatgcaacctatcctaagagccatgcctgtcgaaaagattgtccctcttctcttgacagttggcagcgccacagtcgttgttggtggtgttcgcacaacgctcaagccacagacacaatcacggtcttttgatagaagacttgcttcatacagcacagcacaaagtgaaaagactatgacgacaatgatttacagcacttggctagaagattagacaaagccattggtacagaaatgcaggcgtttcagaccaccacatcgaaatcacgacacttaatgcacattcacgaacaaacacatacacatatctaaagtacttgctggcaagatcaacttcttaagcaagaccagtacactacaactattacactacggcctggattagaaaaagttacataaactagcgaatgatagaattatgggcaaggatcccacttgaacctttcaaaaaaaaaaaa

SEQ ID NO: 2625 - DNA, 614 bp, Fusarium venenatum
  misc_feature (1)...(614): n = A,T,C or G
aacaaacgcttcgtgtacaaaggctacgcgagtcctaaagtttacctacatctcaggtgtaaggttagacttgccctgctacttacacaactaaattttatttcttccgtttcaaatgccagctttgtagcgaaccaacaatattttgttttcatcatgaccttctcttcgccttccaaggtcttatcttcgcccgccaaaaggaatcaattgctctntagtccanaacnaaacatcgccgcatnctttnttctcgatacccgaaataatgagcttagtcaccgagatgctctggcggcagcgcaactagaacacgagcgcgtgcgtcaagcagcgatacgagtctacgagctccatgagctgcaagaagagcacaagcgcatcttgctgaanagcgcaaggnggaggagagattaaaagctgaggccgctgtggttgcggaanaaaaacggctttgggaactcaangnaaaaacggttccaagttccccggaccgcgccccaccagcattncaggcaagcaagancctgngaaaacaaatgggggngcaacttctgtnacaactnaaaanaacctggagctttcccacnccncccccnaacaaaaaaacccct

SEQ ID NO: 2626 - DNA, 190 bp, Fusarium venenatum
tattgagcatggttgggtagtgttagaataggttatggaaggataggcgttatggtggataaacaactttcttcttcatttttctttctgtacatttccatttattgttacgacgaaatacttttcaagaaccacactattttttaggtttaacaaatagtgtggttcttgaaaagtatttgttaaacct

SEQ ID NO: 2627 - DNA, 293 bp, Fusarium venenatum
cgaaataggcatgccagtggatgaatttatcgataagatgtatgaagatttggtcaagggtagcgatcagttcgcggtcggctttggaacggagctatttaaagaagggggttgggaattccagcgcggaaaaatgtgtgatgaagtaagaagtgttttaaacgttgcattagtggattatttacgggactaagtataagatattgcagataaggaagatattgcacttttcccctttgtatttgtaattttactttattaaaattatcaataatctactattttctttttct

SEQ ID NO: 2628 - DNA, 634 bp, Fusarium venenatum
  misc_feature (1)...(634): n = A,T,C or G
cagttcatgatcgatagccaggtctcacccatggctttctcaatctccaaattcatcgcttcatcgtctgctattcttctcaagttgcccattgagactgtccttcgacgtggacaggtctcactcctgtcaagtcaggaatacgtgcaggcactcagccccgggcaaccattcaccactattatccctcccggacgctacgaaggcactttcggtaccatgttccatattgtcaacgaagagggaacccacgaggcttcgctacggcacatgctgcagcaaagaagggcaaggcaaagaataagggtgttgccgcaaccgtctacaagggccagggccgtgaggggctgtggagaggctggaaggtcaactggtggggtcttgttggtctctggactgcgaatgtggtangccatggtggagagggccaattttaagacggctcaatcatcaatatttgaggctgcattgtactgaggngcattttctggcacngcgttgcgggtgggatgtatntnttatctaccagcttgacnaaaaaaccgcattatatccncccccattttntgaaaatgaaatggnganaaaacnaaaaanggggctggtttcttantanttcaaaattttatttcnt

SEQ ID NO: 2629 - DNA, 621 bp, Fusarium venenatum
  misc_feature (1)...(621): n = A,T,C or G
tttttttttgcattaattgaacctcttcattcatgaataagatttgatcttttggcaaacctataagtatacaaaaaaacaatgcgccgaaaggtggctgcagaaagtttcatcccaagccaacgccttggttttctcacttggatttcacaagcttcgcgtcttcttcgtcactgtcatcatcgtctgagaacttgtctccatcctccccaacagcaaagatggtctcattctctagcgattcacgaggaccggtgcgtgtgttcgttggctgttgaggggcactccgagatgcgcttganaacgacagaccgttggcgtgttgtgagttgttttgaggcttaacgatttcggcctcctcatcatctgaatcttctcctggaacaccaatatcgccaaggtcaaagttgccatcatcgtcttgggcaatttcgtcactcatggcaaaaccgacggttgttggacgtagggcgccaaagatcgcgatccatgcaacgtcagcaaagtagaccacgttcagcccccatcgangatgaaccatcgtgtcttccagtggaacngaaccaaatcaggatcctggcagangcaaacgtgaaacttgttgaaaaaaaaaaacccaaa

SEQ ID NO: 2630 - DNA, 382 bp, Fusarium venenatum
  misc_feature (1)...(382): n = A,T,C or G
gtagcanatttggccaaggacatgtttctagcaacagctggtgtcatggttcaagatatgcctcttctagggacagcaagccaagggggggacgagcgaccacagcctacatcgagtgcgatacggatcaggtcatcccaaacattggatggtgatatcccttcttcgcctcccagcacgacatcgaatatcaccagcgatgcagcaatcaggcgattgcagcttctcgcgccctcgttacagttggacaagatggaaactgccaaacagtcaagtgttttgtcacgctggccaaccgagcgtggtgtcaccacagatgactacatttctancgttgctattgccagcgatanaaagtttgaggatgcaangttaccactgc

SEQ ID NO: 2631 - DNA, 558 bp, Fusarium venenatum
  misc_feature (1)...(558): n = A,T,C or G
gttgttcatctcgcgccggttgacggagcttcanaacggagcgattggtgttttgagtcaacctggcgtgggttcgacttttgcattctacattgaggcatatgttccgagcgaacctccaggaacgaaaccactggctgctgccgctgcggccaggctaatcacgggtggcagtgatgccgactcggctgatggcaagcaaaactgccgcgacattcgcctacaaaaacatcagaatccgggaggaaacgtncgacnagatgggatccttgttgtcgaagacaatctcatcnatcagcagatcacaagacggggattgacagatcggggcttcntggccgatgtcgcgaatcatggaatcnaaactcncgacatactgagaagcgccagagtactgttccaggacttggtctcaatggggtcctgntcgttcagggaaggaccatgcccnttcgctgcccactgccattaatcttgtgttgatggatatccagatgcctgttccaggacggcttngacgtgcacccnaataaattccgtgaattannatcggaagga

SEQ ID NO: 2632 - DNA, 354 bp, Fusarium venenatum
  misc_feature (1)...(354): n = A,T,C or G
gagcgcaaggcccaggagtctaacccntaccacgagggcaaggagaactcccacgacaacctcgantttaaggatgagcgatccnttgccaaccgactcgctgctgaggagcanaagtcagagtctggtgacnatactganactgcccaattaaagaaggaccttaccttgcttgttcnttttacggtaacnaaccttccaagggcnccaaggtcnntgcaaagttgcaagctgaggaggaaaaggacttgaaccccaagggcaaggnttattggtaacaatacttanatcacgggccgtttnnttgcagggcaaatgatgcggaagggatgaattaatgaacaataattgaag

SEQ ID NO: 2633 - DNA, 285 bp, Fusarium venenatum
agcccatcgagactcctcagcctgttgagactccccacacaactgcttccgagaagccagctgctccttactaccctcctcctccttactaagggcatgaaaattagcattccatgagtctgggaccaggatgctaccttgcatacatttagaatgacatcttatcacgatcttcacgacttgttttgtatttagatttctgttatattttgtacatgagaagcatttagcttagatagcaatagcgtcaatacgacatacatctttccttattaaaaaaaaaaa

SEQ ID NO: 2634 - DNA, 495 bp, Fusarium venenatum
  misc_feature (1)...(495): n = A,T,C or G
tgaaactagacgcgcagacgtgagggcatgtgagtctagatccctgccgagctcttgacatcgctgaagcttgccaactcaaccccggtcctgtcaacccggctgaactcgctgaagcaactcgtcgttcaagctcgacaactcggcacactgtgctatgaagatcgtggccaaggcacatgcttcaacttctctcccggagaaaaaataccgcctgtcaacaccttactcttacgatcgtacgactggcagcacacagctgatgacgtcgcaaagcattgggacttctctgggatacaatcactcgaattgatttcggtgcccattttcaattttctgaagtcggtatgcctccganacttttcacagctccatactctacatgcggaggattacagtgcccatctatcggataagaaaaaaaacccngcattgctttgaacgtnttgataangacacatcaaggcctcgaaggtgttaatattacttgtctac

SEQ ID NO: 2635 - DNA, 343 bp, Fusarium venenatum
  misc_feature (1)...(343): n = A,T,C or G
nggggatgcttcccangtctccgaagggagaagagcctacagctacngcanccgatgatgatgacgacaacaaggccccaacggcagctgagggaacggcgactgcagatgctactgctaccgacgacnatgccacngctnctgcgaccgaaacngacgacgacgatgcgactgacacagccccctgacgggcaccgagagcgcagctcccacaagcaccggtgccgtngttgaagtcgatctccagaacgcgactatcggcgaaaatgcngaactgattaaagtcnacggaaagactgcntnaaactcagcgctccgccnacgggcaggcaacgttttacgt

SEQ ID NO: 2636 - DNA, 492 bp, Fusarium venenatum
  misc_feature (1)...(492): n = A,T,C or G
aaactccagctacaaacccaggggaatggaaattgaccattatgaaggtcacaggcccggtggatattcggcgttataattttttttttcgctcctgtctttcctttgtggcaagggctttttttcttcatgatatcccataagcaagtgggtactacggatcacaaggcggcaccgggcggctacggacggatcaggaatggcaaaggcaaaggtatatggggtcaattgatttttnagcgactacggcgactctacggtattggcaaagccatggaaagaacggatcaaagaanaaaggaacaagggcacaaacggcaaatggcgacaggaccggatcttcaaggcgttattgnatttcgttggacataaaagggcagcggtnggatcacgacgtacanatgccggacccggactgaaatnnagacatgttggaaaaaacccaacacaaaaaaccatgnttaagaaaacaataatactancgttttnctc

SEQ ID NO: 2637 - DNA, 596 bp, Fusarium venenatum
  misc_feature (1)...(596): n = A,T,C or G
ggggtctttcatggggcaatggaccggtgaaatctcgatgacggatctatccttccagttctgtttgctagatctggtttccatcttcttgatctatggggaaaccattatcatgccacagggatttgattgcgactttccatcttggtctacggtcatgcttccaatttcacccaagcttcgacggttgaaccccgccaacggcccggttagcctttggaaacccttaactacatccatgacatgcataaacagaccacaccaacagccgaccctcatttaagccaacgaatcagtgggcaatatttacttggcaatgctacagtccggtctcccgaactggcgtcactcataggtgatgctgaatcacatctcatagctgtggcaagantgaggctctgcttcgaaagattggcgcccacaacttcaccggattcggtgtctcagaacgttattcaccatactcgccataagacttttacttgtcggtccctcagtggtggaatgtttatccaagtagggcagctgancaaagatctcatactgcattgactccctgtgcccgccattgagcaagatcagaactatagaaggga

SEQ ID NO: 2638 - DNA, 381 bp, Fusarium venenatum
  misc_feature (1)...(381): n = A,T,C or G
cctgccctttcggagttcgatctcgatattttcaacgactcacgatcgctcgtagtcctgcgatatcttgaaaagtcttactccaacactcccaaaacgcatgccacggcatcacgcaggcatctcacattgctgcgatgcttgacccatcacacaaacacgcaacacaccacaaccccgccacaacactatattccccccagtacggtttttaagatggatagatagagattcctaaggacagaggtttnttgaggtgaactgttcgagtttagcctcgaggcggatcagtggatggatggacggatggttagttagcatcataggaacatcagatcacatagcaccctttnttaaagaagtaaaagaaaaaaatttcat

SEQ ID NO: 2639 - DNA, 455 bp, Fusarium venenatum
cggggttctttccgtgtctcaggttttcatgagatcacttagtcaataacccggtcatgtcgcgacatgaatacgtccgccgagcgttacgaaaagtatactccgctgtatcgtcagatatcgggatacgtccctttttggcgcttttacaagcatcacgccgttgcaagtattgcatatgacccattaacgccacacgttcgtcttgtatggagttctcaaggtcgcgacgaccattttgtatcagcacagtggatttgagttttgattcgcttgcgattgcaaattacaagacccgacaaggtctacaggttctgtttggcgataccggttttttgacaacttcattgcgtgatctgcttgcactggctctgtttattcattgctttcacataggctttcaggccctgcagctataccccccttcatgttgtttcattttctctggcgtttcc

SEQ ID NO: 2640 - DNA, 676 bp, Fusarium venenatum
  misc_feature (1)...(676): n = A,T,C or G
gctgttactgtttgtatctagtgcacctctctctataaatcaatactctaacctatatcagtatttcatcactgagtcaattcgtgttcggcggtcaacaattccaacatcaattggagcccctcgcgccgctcggccagttcttagattgtccgtatcctctgacccatcgggcacattggtcacgaccgaccatatcggcgaccgcacttcctacgcactgcatttatccctcctcgcgttttaactcatcgccactttcttttctgtcggcttctccggcttctgtcttgtttattaaaccagaagtccacatcggtgcgttgtctgtcacaattacacaccaactgtcatagtcaggtctgcggagcctcaaccaagcggcacatgtgacaaccacttgacacctgcttcacactaagctaccttcgcctcttgcctgcgttttgccgaattgcttgagctccacgatttgggtcttcttgggtctcaagaagttgtctcgttgtgcactccctgtcaatcccacacccttgaccggtgctcttcaacgcctgttacacgcccatcatcancaccaagttgtgatgagcgctgttgcacatcgnccggccaaagtcaccttgcaggtacattaaatgccgttacgtcgccccatnatgagaaacccgactgt

SEQ ID NO: 2641 - DNA, 463 bp, Fusarium venenatum
cttctcaaacaccttaattaccattcctacataaatccctcatccaatacaatggctaccgtcatcattcagtaccccagcggtcacgacttcgatctcgactactacctcaagacacacatgcctcttgccgataagacatggaaggacaagggtctgaagagcgctaaagttatcaagctgggtggtgacagcccttaccaaatctacaccgtccttcgatgggagagcctggctgctttccaagctgccgccactgccgaggacgccaaggctgttcatgaggatgtgaagaactttactacagccaaggccgacgtccgcgttggcgagaccattgctgagtctaagctttgaattattgtcaatcccaatacccaatactgttgataccaattaatatatcacaactccatatctgactacaatattatccctttcatcgtcaagaagttatatcttc

SEQ ID NO: 2642 - DNA, 512 bp, Fusarium venenatum
  misc_feature (1)...(512): n = A,T,C or G
cttcgcgatccagaggttgctgcactggtctccgaccctcgacggttgggcgaaacattgccgccgaattcttgcttgaatggagttgctggaccagaatcgcgaaatgacgacgatgtatccgaaaagcccgatgagctagcagagcctcgtctcatactgggaacattgtttccctgaaagcctcccacgcccgtagaatcccgtcggaatggtgattggggttgggagtcattttttcctgacatgttgcccgtgctcattcttcttggcagctcgggtctgttaccgtacgaactgagccgaacattttgtctcttttgctgagaggctctctcgttcatctcgacggtacctgtcaacttcgactggttatacccacttgacggtctaccactgcagatactctgtgctcgcttgtattgtttgtggtaatcgtgcaacgaaatggtancgttgctcattgaccgangnccaagggcgggtctcatgcctttgggtaaatcntttgc

SEQ ID NO: 2643 - DNA, 1013 bp, Fusarium venenatum
  misc_feature (1)...(1013): n = A,T,C or G
cacggttgtctactgcgccgcggaccgatacggcctcgaggagctaaagcgtctggccttgcgcaagcagggactgcaatccggcatcgatgtcgggaccattattcggtcagctcagtacgcctacgcccatacccccgactcagacagccgtctgcgcgctcactacctcgccctgatcatccgctgccgcaaaacctttaagcgcagcgggactatgcaggccgagatggaggcgggcggcagcaagctgttctttgacctgtttgtggctatgtgcaatcacctcgacgacgtcattgatgtgagcaacgctcgcacgcccaagactgtctgaggcgattcaagccaagctcaacacacacatatacccactaagcaggcctccagatgcctcgtgtgtttgatcatagctggaggacatgtactaaaaggaatatcgccaaagccgcgaaaaagaacaaaaaccacaaaaaaaaagtgatgcttacaagaacagttggaattcggcgttcggttgcttttcgtgctccatcatcagattgacgtcctaaggagctttgttttattacatgactccccttctgcgaggttggccgaccgagttttgatgatacacgagctgagaggatataatccgacgcctacgaagtccttcacatcctctgctcatttattgtgcgttctacttgatcgcgagtttcctgttatttgtcttgtcattttacaactctgctttgataccacacacccaacagcactgggacattttctttcctctacactctactctggcgttttgttatcatccaaaaaagaccaggttgtctttgattcaacaccagagttttggaaggagagattgggaaggattggaatccttgactgnttttccgcacccgtgagcaaatgcccccgaaattggcaatatgctgcatttgaccatcttggaattttttttacggaaaaagaagaaaaaaaggntccctggtttgggntggtttttttggctt

SEQ ID NO: 2644 - DNA, 634 bp, Fusarium venenatum
  misc_feature (1)...(634): n = A,T,C or G
agaaaaccaaggtggtttcagaagcggcaacgcaaaggacgtcgagatgcgcccaagagcgaacatgcccatcgtgaagacgctgaatagcctcagcgagaagatcatggccaatgtggcaccgtctgacgttaacacggacgaccctgatggcggatacaatgcctacgttcaactggcattgcgtgatctcaagggcgatgctcaagagcatcgtatcatgctcaacgtgaatgaacagaacaagttcttctcgaaacacgactcagccccctcgaagcaagctgccatcttcgaaaaacaagtacccagcgatgtgcttttcgatattatggcaagatctagatacactcgagagtgatggagctggcggcatcaacatccaggcagcaatgggattcgacgaacaaagcgacagcgacgacgacacccctaaaagaccacatgttggttctcgctctgccctcctggctgctgataaggncatcatgaagggaatacgccagcaacgtgtccagaagtacgggcatgacacggncactgctgagcctatgggtcnactgttgaganttcccgcaagtgcagcctcactcatgcgaacaccantgagttcttacaccaaattctgggacgc

SEQ ID NO: 2645 - DNA, 552 bp, Fusarium venenatum
  misc_feature (1)...(552): n = A,T,C or G
gacaactagtgtcatgagcttggaagtgtctgacaaatattcaccgacgtcgcggaattgatagtcanaaaccaccatgacagcgtcgcancanaacaagctatcggaatccaatctcgacccgatctcanacgatggcaaagcttgagttgaanacctnatgcatcacagaccggatgtccatacgtgccttggccgcgtcttgccgagcctggacttcctctancacttgcgccgngatgcgtgcattacccgcgaccttctccattctganaatctgtgttttgatccaagccttttcgctagcgtcttgctcttctacacccaacatcaaaagaggccatacatattgatgggaagtgtgtcatcagtatccaaggnggccacaatntgccgagcgagctttcggatttggtccaaaacttntgacccctnttttnttaaaagcangctnttgtaggccaccccgannaaaaagccctttgctggcgtaataattttgaaaagtnttttccggaangctngtgtganaaaaaaaagccaaggtgtttc

SEQ ID NO: 2646 - DNA, 597 bp, Fusarium venenatum
  misc_feature (1)...(597): n = A,T,C or G
tttgactactactttccataagcttagcttagctgccaaatataaaaaaaagaaagaacaagaacatcttcctttgtccgcttgcgcatgatcccgagtcacctccgtacaacgatatatcgctcccttccgccaccccaaccaggtattgcatcagacacatcgacctgatattcacaggaaaccccaaagaatctcctggagtttgattctgctgcttctgtgctctgatatttccatctacaacaacaaattactgtgcccctctctcctgactactgctacgtcgacactcccttttaactcaaccatcttgataccaaagagaaccagccatgacattctctcagcaagacatgcactcacaagatgagcttgctgctctcctggctcgcaacttgacctttaacccgattcccgagcctgcacctgtgcctcangaggcacctaaagcagaatttgctgagcctatcatataccctccgttcattacacacactctgcccatattgcacaagcngntcagcaccaggaaattnctcgtcgatcttcggganccnccccgantccagcaccaagtgtngaanccatcctgat

SEQ ID NO: 2647 - DNA, 609 bp, Fusarium venenatum
  misc_feature (1)...(609): n = A,T,C or G
tgaaaacgagagggcgcgctgttattagacagcccccgagtgccgtgccgaagactcttgcgacagagacgttgcaggaatatcaagattatcagacgtatggattcaatcaggaactattccgcgggaatcttggaaactctagcaaggccatcgtgtcaacaccttgagcaaacccagccaacggtattgtatcatacaatagtacgcattgggcttaaattagacagcatgtgtgtgcaggtggatcaagagttttcttgcgggcacatcggttttctaaacattcgctggtgccaaagagttttcaacggatgcaagggcccttcgcataagcacgacgtcgtttacacacaggacatatgcccagattgnatcaggaaggatacctttctaaaccattgggtcccaaaattaccgaaagagtttaagaggagacaagatnctgggaagcgccaaagaagcatccccatggtcatgattggagctagattatggcggctngaaancatcgaanccggtttntggaaacatacttggttggaataancctgncttgaaaatgggtcccgaacatntttgttntgaaaaccncttggctgnaantgt

SEQ ID NO: 2648 - DNA, 222 bp, Fusarium venenatum
  misc_feature (1)...(222): n = A,T,C or G
ntccaatcaagcgtnacattngggacgagngcgtncgtgatctcatggacnatgccgggnccccatcaganaancaaaacgacgatgaanctgnggcgttgacctacctgttaagtcttgacattgacttggttgatactggnactgaaccacanagagtnatgagagcaaaagcagtnggtgngctattcaaggcaaaagcaaggggagtctttggacaga

SEQ ID NO: 2649 - DNA, 389 bp, Fusarium venenatum
aggtgcactggggaaattcaaggttgattcagcaagtggcgatacgaccagtcacaaactgcttttttaaacacaagcctgggaaaggctttgatgacgttgcggcctgtggatagcttttattgcgttttgtgtttctttgttattttttcactttccacccggaagtcttggccacgagaagccaacccccctcgttcacctttgccatctgctttgatgggcaacagaccatacagatgtgtgatgtatcaaggctctgactttccactttcctttgggctttgacgtcgtgtacagcatactaagaaatctgataatgtcactggggatgggaaccgataagcattagcaacctagaatgaagtcagtttgattacgtgacgtgc

SEQ ID NO: 2650 - DNA, 593 bp, Fusarium venenatum
caacaggcgcgactccttcgtagtggagtcgagtcgacccaacccttggctaacacagtctcttttttaccaccctaacaactttatctttgaagtttagcttgtgcgaggtcccgcgccgggtccaggctcggcgtacgaagcataagcagtgaccactatgatcatcacttagaaaccaacgacaaagcggcattgccgacttgcaatggcaactcgactttggtttattggggcgatcgtcccaagaacttgtctggcgaacaaatgtgaagatattgggcacctctttgacgttgtcgatgacctggggatgtgattaccacgacgtttattctcgtgaggatccgtcttttgacccgtcgcgaccattgaagcccattattgttcaatcaacatccagacaggaaggctctaacttatccccaactttcccctcccattttcaatagaccacttttgttgaaatgggcaaccacccgaactcttccctttcgataccccgactctttttcgcaggccactagtgcttatgaagcagccagtccgtcagcatccagcgtgtgcaatcaaacaacctcacaatccacaac

SEQ ID NO: 2651 - DNA, 739 bp, Fusarium venenatum
  misc_feature (1)...(739): n = A,T,C or G
tcgtttttaaactacaaagtcaagactatttaatgtcgcacagttcccagatactcacgcatctccactacaataccaacaaaacaaaaatcatctcgcaacaatgaacacaaaaactttcttcactgccctactcggcttggcatctactgcctctgccttcgaattcacgggtcccaaagcagaagagctcgacttgtccaaaaacatcaccatcacctggaaaacaggcaacgcatcagagctgaagcgttggcccgagttcgatcttgagtggtatacaagacccgatgatctccatagcttcagctgggacatcaaacagagagtcaatgtatctgatggcgaatacatattttcgcctagcgacaatacccgctacactctcaaccaatttgccgacgctctcgcctccaataagagcttttcattcgtagctgtcttcacagacggtgatagaaaggaccctgaaacagcgaattatacgaatattggtagccagaagtacaaggttactgggctcgacaagacaagtgctgganctgcggtgggcacctatgtggggagctttcatcggtggacttgtggcagctggatttatgactctgtaaagacatggtattggaaccgaagtcggtcggaagtgtcttatttatgttgatgtcccgacatggtantcatgggggggnctangggttatatataaangatacntgncccatattgncacttctgagct

SEQ ID NO: 2652 - DNA, 331 bp, Fusarium venenatum
  misc_feature (1)...(331): n = A,T,C or G
agtctctcagcatcaactttgacactcctggctctatcgcctctgtcaacacatctttctctagtcagcctgacgactctctgtctgcatctctacttgcatctcctgccaattttgccactcacatctntggctctccccactcacgtcgtgcttccagtcttgatgccaccgcaatcgaccgctatggttacccaacctaccgtcagaagccctcgttcgcctntgnggccccaagcagnaatccgactatggctttgcttcctaatagctacagccctagagcccagccccttaaagcctaatggtactgngganccaattccaaaaa

SEQ ID NO: 2653 - DNA, 416 bp, Fusarium venenatum
  misc_feature (1)...(416): n = A,T,C or G
ctctacctcctatcttctctggtgtaagagccgggaaaaggttgattgacaagttcgatcgcctatatccattgnctattccctggccagattaaccatcgcccatcgcttagcgtactacgcattgttagaacaaaaagaagagaattgcttagttccaaggcttcctccgtttctccctcgctcccttgacgccatcatctttcacaatgacgacaaaagatggccctaagctgccaaagcaacagctggcgattctggccattgccagaatcgccgagcctatggcctacacatnagtcttcccataccttccaaccatggttanggagctttcggngttccaaccnaataaaagtcggaagcttggnnggggggtcanatcgggtgttttttttntttnaaaancaataaca

SEQ ID NO: 2654 - DNA, 135 bp, Fusarium venenatum
  misc_feature (1)...(135): n = A,T,C or G
ntcaangtcagngtgtcnggngatgaaaattcttnttaaaaacggaggcaagcangccganctaaggaaaanngagtctggttggatnnggaaaacangaaggggatttngggataaggaaaaaagngnagcggg

SEQ ID NO: 2655 - DNA, 422 bp, Fusarium venenatum
  misc_feature (1)...(422): n = A,T,C or G
tcgtgaacaacgagactctgctcaatatcacatcacgactggttgacgtccccctaacgatcaccgatggcgatgtattcagcgaagttatgcaaaagctactatttggtggcggtgatatcacactcgacatcaaggccgaagtcgatgtcaaggttaaaactgtcctcggcatcttgacggtaaagaaagttcccgccganggcaagattccagtaaacggtccgtcatcgctgtggtaatctcttgcactccccacgaagacgaataatccttgtttacactttgaaatattttcataacacgcctcacanccgtatcganaattattgctgacttaacttaangatcccccggttacgcncctgggttaacttaaacctgaaggtcggtganatcaaantcctggaaacnacgaatca

SEQ ID NO: 2656 - DNA, 529 bp, Fusarium venenatum
  misc_feature (1)...(529): n = A,T,C or G
ggaatcttcgtggtctcccggatgtctgttacccgtacctcggtctcggggtactcaattactggctgtttacttgcagataaatgtttccaaattcacatttcaggcataattggatgatgtgatctgggtggcggcaatgcattttccgtgtctcaacgaatctacgatgcctcggttacctatctacattgtgctactcgtgaggtcgtggataaatatcccaacttcccccatgatattatcatttatctaaatccagttttattcgacaacattcccagttatcactacgtcttcaacatgtctgtacaaatcccctcacatcaacgcgcagcagtcgtcaaggatctggcccanatgcaaaggcttctgcaagaccgtccccgtacctaaaccaggccagccaaattttcggttaagtaaattggacccggncttgnggttaaacaatctcttntcacgatgaatggagtgatttcggcgtcanattgaaaggacntactgncggatngcnggcacnaggaac

SEQ ID NO: 2657 - DNA, 614 bp, Fusarium venenatum
  misc_feature (1)...(614): n = A,T,C or G
gggcaaggcaaaacaatttacgactctgaacgggaagagtgtggtaatcaaggatgcgttcatatacagcaacaaaggctttaaaacgcttgcgcaagcacagctccttaacgacattgttttctacccagacgtctttgagccgcgacaatggctcctctactacatctcaagacctctcgtgggtatttgggaagaaatcaagatcgttcctgcggtcctcgttcctggcgtacggaagcgcaggattcccgaccagaaacagataccaaacgccgagtcgactgaaactgctgcgcctcggaagaaggatattaggagctttcacgacctcttgaataactttcccatgatcgcgcgccaaatgcagcctgcctcgagaaactcttcatcgagttcaacaatgtcttncgaagccgttccttcttcgcctcagccgacacattcctgaccccccggcgatgggccaccaccaatgctgcagacgagcttcgncaaatagtnatcgccacatgctgatgaagtagcttgccggtgaccganacttttcnccgggncatgaaattnatgaggcgtccttgaaccgtntcaagtgnnttgactttcanggngaa

SEQ ID NO: 2658 - DNA, 380 bp, Fusarium venenatum
  misc_feature (1)...(380): n = A,T,C or G
caggaatttttttttttttttttttaggataataattcattaattgatcacataacctcgatctcttcatcctagccctaaactttgaagtcaaatcatgctgcagccttcttcttcttggccttcgccttcttcttgctcctgtctcttggcttcagggctgtcatgcctgcccttgccgtttgttgccttgatgatgaggggtagcggtttgcaggattgatgtctggtgatggttcttcttctgagggcttgggaatatcttgacccgtangtgagtcgcttttggctcangtagatggaccatggtcctacccttgcgatgattgaagagncacccacttgcgaaaaactatatggtnatatgtgagtcggcatgt

SEQ ID NO: 2659 - DNA, 576 bp, Fusarium venenatum
  misc_feature (1)...(576): n = A,T,C or G
gtgaaactagcacaggcagatctggcgaaagtcaagcgagactcgtgtgagatctgtgacgtctcaatggacgaatgccaccaagcttctcaggacttcaaaaagctcacgttcgatctctacaagggcttactggccatccctataggacgaaggatgttctcccaacatcgtcttgtggtgtttaactgggacggcatccgttcagtcggtnttcttctggcagacggaattagtaataagggtaccgtcggaagatccaacactccacatatgcgccatcaagtcccttcgggaccgacgcgatgccaccgaccagcttccattcgttcctgcattccgaaaatacttccacgagctcccgaagagcaagaagcgggtacagacaaaaacccttcatgtcccgctgagcgacgtagaatgccttacaagatgggtaacaaagggcatcgnccctganattttccaggggnggagatggctaccatcaaacgaaggatcgcttgcaanaactatgtggctcatngggatgataaattaanaagagctggacttgtttngaattcaagcaatttc

SEQ ID NO: 2660 - DNA, 503 bp, Fusarium venenatum
  misc_feature (1)...(503): n = A,T,C or G
caggaattttttttttttttttttttcagaccaagatcttcgagattttttatttgagataatctacatccttaaggaccaccgcaatgcaagcctgtaaggtacatgagctgttgagggtggaacaactctagagcggaatattctagcgcagattttatgctagaagctgaatagagatattttttagaatcagtttaaccctcgaaggtgaagctggcaccgagcttgtgggtagcctggtcgagcttctgggctgctgaacagagccgaccgaggctcagggtgtctaccctcaaggaggaggccggctgtaggcaagggcaccaatactgccgtcgtatcacaaaaacgtcttggtcaaagggagaaagatttttaagaccagccgaccactgacgatagggcccgcgaaggccagtggtcacggccgcccacgacgtcggggaagatatgatttgcccgttcaagagccgtgatgaacgaggctgaanaaaggttca

SEQ ID NO: 2661 - DNA, 286 bp, Fusarium venenatum
tgcagagaaggactgaacaagtggagagaaagatatggaacatgcatgaaacattcccagtttgcgacagtggaaaggtcggtgctctttgtcgcgagggattagaggtttgattcgcgggctgcagcagggacggcgtgctgctcccaagagcatggatcacaaggccaatgcagggggatggattatcaagatcaggaacttggatgccgtcgtggccgcgggtcctatccagtgtgtcactagccgtcctaaccatgtgcaatagaaatgatgaatctcttct

SEQ ID NO: 2662 - DNA, 866 bp, Fusarium venenatum
  misc_feature (1)...(866): n = A,T,C or G
tgaacaaccgcttccagagttcatccgaggcgataacaggctcgtcatcagcctcaggctttgaccagagctggtaggagccttcggtatcgatttccagggtcttgccagatcccagcttgatggcctcgtcgagagcagcgaagccactctgcaggagtcgcggcagggtggggacctctcggacttgatggaagaagttctggtaagagcaggtacagacatgatatattcagaccctgcggtcacgctccgattcccaagcatcgtcaatggttgcggcacaatagaacatttctgcattgccttagtcctggcgtttttggtgcacgctggcggcatggccgatactctcgaccgcttagaaaggctggtctacnacacgggggcgtttacattctatgancatttacatgancgaagcatccgccctttcnggacataaccatggatgatcgggctgccgcgtttttttttccttccatattttcttcaaatgttttganattaaactggttggtttggtcgtttgtttattactttttgggagtttcacagcttggcgtatgggaatcacgacaaggagcatattttgttttatcaaggatcatgtacaaaggcgtttgaactcgggtatgcttggaagacagaactagcatgagggcgtctcacgacaggagaatccntggtcagggttcaagggttcaagggtctcggctaggaagccgggatgaccacacattacactgcatcgattgtgcgaccgaangtcagtgtggtagtattaagtatcatctcgtattttagcagaacatnacacaacgtttgagtcttgtnnaaaaatcatngtctcanacncattcttc

SEQ ID NO: 2663 - DNA, 612 bp, Fusarium venenatum
  misc_feature (1)...(612): n = A,T,C or G
cttaaggagtgcttcaagtccggagatgcttgtccgttgttttcgatggcagactcttggcaaggtctcaagaagaagttcgtctctttcgtcggcgatctcaaggagcagccaatgaacgtgtatgtcaacaacagcgtgtacggcctactagactatcaaaagatctggtacggagcgctgttcccagtgctgtacaagcctgagaggtggtacatgttcgccgagaagatggaacagcttctccgcggtaacgcgacgccagctctaatggaatatggacttgacggtgaaggcaatagtgacgcgctctacactgtttcgctgaatgatggactagcgggtcctgagcactggccgcaggatctggactctcttctggagattgtcacgcctacctttaaccgcagcgtttttgccccagacgatctcgtttatctcttcgccaagcagcaatggcgcattcccaaagacacacaactacgttccacgtaacggtgtagagactggccatcctctcctcatcttgacaacatcttacgaacctgtctgtccctcgtctcaactcgaagcgcccttgccgcgttcaaaagattccgccttgtcgaggtn

SEQ ID NO: 2664 - DNA, 592 bp, Fusarium venenatum
  misc_feature (1)...(592): n = A,T,C or G
ctagtatctagtatctagtatctaactacaagacatctctttccatttcttccttttcttccatttcttccttctctctaactagactttctgcttctgtcttcagcctctcagttcttgcctcagttccaggcaagcctcgcggatagtccgagcaacaaataccagtcaaagattcgactacaaaactcaaaactccagtcggtgctgtcatttactgaaccactctacggagaagaccgctgtcaatagccaccccgccaaagccaattcacaatcaccactcatcattgaccattgatcacctacaagtactattcctattcagaagtgtcaatcttgggaggcaataagagactggagctcttgatctacaaaaagaaagcttaaggctattctctactcaactcaactcaactctacaaagaccaacctctcattcttttaccagcaacgaccaagccggcactatgatgcgaggcgagatccctttcangcaccggcaggcatttgctcagcgacgacttgccaaagaacccaaggtcttcaacgcaagctggaacaaatggctctaccactggcggcctttggt

SEQ ID NO: 2665 - DNA, 119 bp, Fusarium venenatum
  misc_feature (1)...(119): n = A,T,C or G
ngaggatatgggtttgggcccaanggggatggaattactnttttnacccgttttaaacctccttngtnttggggattatcaaaggcttacttcgaatacncaaacaaccctaatttcct

SEQ ID NO: 2666 - DNA, 226 bp, Fusarium venenatum
  misc_feature (1)...(226): n = A,T,C or G
ngggtgctccttaccaagttcaagctacacttgaatgggagagtgtcgaggtctttgacaaggctgctgcnaacgaggttgccaaggagatctttggggacatcaagaacttttaccagggagagccattgcttctcaagggtcctgttgttgctcatgaaagcgtttcgtcttcgtaagaacatacactaatcntgtggngaaattaatacatcgaatctgactc

SEQ ID NO: 2667 - DNA, 393 bp, Fusarium venenatum
cgaaacaggtcaagggtactggcaatttactgtcatcaaccctggccgagctatgctcaatgttcgtgatgctcgtcacccggagcgtcatttgacaatcccccttattgataatgtcgagtggagactaagtgacgtctctgttgattccttggaaacagatggtatccaagccttcgactttgtgtcgttcttggaagccgtcgagacaaggtggggtgctgagtgggctgggtgggtggaagaaggtgcctttatgacgaggtggcatgtgcaagataacagcaagcgatggagatatgagagaaatccaaaggcaaagaaagaaaaggccagtaattagatcaaatttttattcaaatagcgtgtcaattaaacatgttaaagttcata

SEQ ID NO: 2668 - DNA, 596 bp, Fusarium venenatum
  misc_feature (1)...(596): n = A,T,C or G
ggaacttcctctgaccctcggctctactacctattcagctcgccgccgccgtcggttgcagacaatattatgctatcccaccgggaaaaggcagcaaccccgcaaagcgctgtggctcgtggcatgggtgcacaatacggcatcggtcccgccgttcaggaacgtctcactccttttgttctccgtcgctgggaggtgcttagtgagccaactcccaatgtcggcgagaatgatacaagtcttagcttgggtctctttgaagctatcaagcttcaataagattgtcaagaaggcaccttactactattatcaccttattattgatgccaagatcccttggcacaccactttacatcgtggacactatacgaactattccttacaccatcatacttctaactctgtctgagttcttttctttaaatctcatggctatacccctgttacggaactcangctgtttgcatcagcgataatgtgcactgcaagacggatctttctttttatcaatgttcaatcnggttacacanggcatcgtacaacnaatggtctctttgttctcctttgttttcggtatttggggcagtttattatcn

SEQ ID NO: 2669 - DNA, 924 bp, Fusarium venenatum
  misc_feature (1)...(924): n = A,T,C or G
ctctccctcaagccaaaattttgttgcacacgctcttctactaaattccttgaaacttttctcggcctcagagtgaggccggctctcaactctgcaacaatgttgttcacaatgtgccaagcattatggttcgcccgccctgtccctgtctgccccgtggctggcagattccacctggcaatgggccttggataaccctttctcaatgcccgcggagacacatgaaaatacccgtggaggatgtctcgcgggctcagaaggggaatcaggaatgggagggattttgcaggcatcatttcttgtcaatctgtcacccaagctcacagatgatgccgcatcgtatcccccaatatggaatcccgccgcttttgtcgaagggagtcaggatatacaaacaatttctcattctgatcagcctaatgagtcattttgcccgagtttagtgcctaacgtcctcccttccgtctcacctctcgtcgaacagggcctgtcttttgacggtttcacctccaatttaaatcctagagaacctacacccacttcatcttcgtcaaagccctcaaaatctgcaaaactcctcgaaagccatgtaagaaaacccgatgaaacatcaagagcgcttattcacaaacgtcaaccgtaacacggttgcggcaaggaaatatcgtcagaaagaagatggaccgaattgcggaattggagcaggctttggaaagcggttaaagaggaaaagaatgatttggagttacagcttgcgaagaaggatgcccgaagttaattttttgaggggaatgctgagaaagtagtgtatttaagggtaagccagccctgagattcaagangaaacaaagccatgactaaaggtcgatggaatattctagtattcgtacactaatttgagaaaactttgagttttggaaaaaa

SEQ ID NO: 2670 - DNA, 624 bp, Fusarium venenatum
  misc_feature (1)...(624): n = A,T,C or G
cagtcaccagtgaatcaatcctcgcaatcgcgtcgacgtctctcgctactcttccatttccatcagctcgcgactcctttttgncggattcgattttcgcatacgccttatctatcaagtcaacaactcatttccggggcagcacccgcgtgagctgctgtgccttaatttggacatacnaccgccccgaattaaatcgccgcgtcgctatcgcatctgactgaaagtctcttgttctcatcaaccatcgtccgtcgaacgttatcgacgagcgttttcatttcttcttcgacttatctcgccgtgactccggggccggagtctcttccatgtctgtcatgactactcgattggactctcgcaaatcgcttctaggggcggacaacggctacggatacggccactcgtacaacaactnatacgacaacagctacgccccatctnctgttccatcgccgnagcccatccctnaacctccgnattccaggccgcggtgaccaacatacaaccaaggtttccctaccgggaaggactcacttcttntgttcctncacaaagtatgaaaaacngcaagatccatttcatgaanaccgatggccggcttgcttcatggntgttctctca

SEQ ID NO: 2671 - DNA, 624 bp, Fusarium venenatum
  misc_feature (1)...(624): n = A,T,C or G
caaacacaatttagctggctctttgcacaccgaacacgggaaggacttgtaaatcgattttggagatattaatcgcaacagaanggtggccactttctgcagctattttcatcctttgtgtttgcnacacccggcctgtgtgcccaggatacaagctacaacatcaccaaatacgatntttntttgcgaactttcaagtatcgaccgatcgaacttcccaccatggcgccagaaacaccgagagcagtctcttcgagattgctcaccatgaaattcatgcaacgagccgtggcctcgganaactcatctcccgcttcagaaacacattcatccaagaagagaaaaacggatcactcgtcaccggcgggtcgcctcgatctgaacatcgatcaggctgcgattcangccgcgctagatgcccaanaaacaaaacgtcaagaggctctgganaaacatgtcgggctgatacacgttgggtgctgaataactcattcgctgggncaaaagctaccaccaagcaaaaacacccatgaatgtcgtttatgtgggtatggggacattgctnttctaacgattcaggcgacaatgaaaatgcgtttgactggggggcgtcctnganaaata

SEQ ID NO: 2672 - DNA, 178 bp, Fusarium venenatum
  misc_feature (1)...(178): n = A,T,C or G
ntttattcttggataggctgnactgaagaatgganatcttgatgangaatcaanatatcggacgtcnnagttttcnaagtcaatnccgntgtacggaattgagataccacttaatatgaggatatgtcgtcgagcggantcctaaacaggaggttccgacnataccaacatgaggcct

SEQ ID NO: 2673 - DNA, 593 bp, Fusarium venenatum
  misc_feature (1)...(593): n = A,T,C or G
gatccttcctcacctatcaacgacactttacttcatcattcaagcactcattaggcgccacatcaaccaacctcaggcgctactgctcatcaatctgcagacctcaaaagggtctgatgaccacgcgcatcagacaatcaagagagaaaagaccaaacaaaaagagagaacaaaaaccacatcaggcacgggagggagtcttgctattattacttttattactggcgtgcttttatattttctattcaacctgggcgggacatgcatggaaggaaatacgggaaaccggggcattcaatgggaaaggaatatcatttgggatggaaagggaaacggcaaacaaaccacactttttttttttcctttttcttttctttttctactatacatcacctactctactatctctgtactcgggcatcgggggcgtttattttaccatcagtcttttcttcatcgcgcaaggaggacaatggttgnactacaacttgggacacaatcagacacaggactattaccccaaagattggaaaggataggttgcatattgtttggcgccaagggaatgaaatacaagatcaatttggccggtt

SEQ ID NO: 2674 - DNA, 589 bp, Fusarium venenatum
  misc_feature (1)...(589): n = A,T,C or G
caacgcagtgtcaagttcacaaacaagaaagatgtttagtcatttctccgagataatagcctcacacatggttgtcctcgactcaaacagcaatggatacagggatgtcatcctaccactagcataccacgacgacaacctcgcacaagctgtgtctgtcgtgtcagcgtttcacctcggtcagaaagaccctaggttacaacacgtcgccgaaacaggccatcaagcaatcgtccagaaactacggcgtgattctctacaactcagcccggagcagcttttcaatccgtatatcctggccactatcttggtacttcttgttggggagacgatcacagggagcggataattacacatatcttctcgagatgtngaattgtctcacgtcgtatccgggattggataacaatgctgccgccgagtttgaaagacttctttcttcagcaaatcaagatgtttcaactctttggtgttccgctagccaacgaatccaaaggtctacaagtactcaccggcccagaagcatacctagacttcatgttcctatcccgaactccccccagactcagagcacttacccaatattgaa

SEQ ID NO: 2675 - DNA, 232 bp, Fusarium venenatum
  misc_feature (1)...(232): n = A,T,C or G
ntttacnganctcatccnaaatgnagagtggtggtggtactggnnataatggcctcagggnaaatnaacccttgctatantttgttgtggaaaggntatnaattgatagnaggattccaaancctncagtangtcnatgatgccatacacgcgananaaaaaaactatgtctaggtcnggaaggantngaagaggnccgnagganaccttgtcccatgtcactaaagccatg

SEQ ID NO: 2676 - DNA, 620 bp, Fusarium venenatum
  misc_feature (1)...(620): n = A,T,C or G
ctccaatcttggtactctcgtctgccaagcttgtggtcgtcgtgtaggcgaacagcccgtgggaacttcaccttgcctcgctatctgcggcaaatacgtctcgcgcgtcactggcaccgtcgtcagcggtgaatgcggcgtctgcagcgaagcaaaggagcacaggacccaactcaccacgaggctcaaccgtgcttttagcaagtgacgcattgcggcattatcccaattcattagaccataccctcccaagccatctatctgcaaggtatctcactttgctacgacatacaatgcaagggtgacatcaaggctctatgaactagaattgaggtaaatggtctggcttgggacgcggcttccacgatatttatatccgttcgaaagccgacactcatacaaagagaccataccgcacactagttttttcttatctggttccctttcacgctttacgactcatgctcttacgatatgcacggcggcgttcatggcatatgcttactttggccttttggtttgcaactttggatggagtatggagganaagtctgcgaacccaacngtgggaacaagtgtacaacactggctcacaatttttaaaattttctttacnatac

SEQ ID NO: 2677 - DNA, 187 bp, Fusarium venenatum
  misc_feature (1)...(187): n = A,T,C or G
ccagcaaaaccgagtagctcgacgggccccaattgatgctgtttaagagacgagtggctntttcaataatgggactcccntttggaccccccccaacaaatncnttcgctacaacagntggacatatcccgncagcaacgggccatatcccacctttatggctttgacaactccatcctcccatcat

SEQ ID NO: 2678 - DNA, 115 bp, Fusarium venenatum
  misc_feature (1)...(115): n = A,T,C or G
ngacattnangaaatgcgtnntttgtctcttccattgacaangnggattccgangnggcgaagnaaattaaattctgngccgttctgcnntccgtcgagagngcctanatagccc

SEQ ID NO: 2679 - DNA, 267 bp, Fusarium venenatum
  misc_feature (1)...(267): n = A,T,C or G
nnacatcccgctgcaccttttcgcctgtagngtctntgttgatctcggcagcctttatgccgccagccgngagccacaanaagtgatttgtcttgaactggtcgatctggttaaanaacatgtggaacgagttgccttctcctccacactaaanattcgggngtanatctgcttgtccttgaaagcctggatcttgtcatcatacttggcaaagacaattccgtcctttccaagagactcggaacctttcggtgnagttggggaaaa

SEQ ID NO: 2680 - DNA, 590 bp, Fusarium venenatum
  misc_feature (1)...(590): n = A,T,C or G
aaaggaacaagcgacgctcccaggtaatgagtgctatgttggatggcggcagaaaatcacaggttctggatgctcctgttccagagcgggatacaactagagactcctggctgcccgatcctcttgctggccaccgagcatcattcattgccctgacatctgatgagctcagggaactaggtcaacagccagatccagctcgttctttgcattcggatcaggatgtcgcccctgttgtgcaacctgaagccactgccgattcgtcagttgagacactgaggcgtcctcaaaagctgtctcgcaagaaccaagacgagcgaaagtcgagaatgtcaaatttgccaccgcaactgagagcaagtgctttctttgatctccctgacaacacgcagccggatatcgaagtcaaggacggatcggcgatggccactctggaaagtatcctggaccttccgccaatgcccctgtcagtgcattcaccgatcatgaacgtgccggcaggctcggaaaanaagtctacggcaaanaaaaaaaacgcacgtcggttgctgcgtctaccgctcttcaacctgagcctgacaagaaacatg

SEQ ID NO: 2681 - DNA, 434 bp, Fusarium venenatum
  misc_feature (1)...(434): n = A,T,C or G
ccaatgagcaaatctccagcgctggtctggctattggtgactcttggaacagtgttattgagcaaatcagtggccaggtctatggcgagccaacacaaattgcctggtacgancacgtctggggtgatgctggttcctacgcttccaaggctaccgacgctgcttctgataaggcttctcttgcctctgaagcagctgcggcatcagccatcaccgcctccgccgaggccatgaagcagtacgaagcagtaagcggtcttgtctctgagctcatcagtggcaaggaccttctttcactgacagcgttctgtctcgattccaagcagcttacgctaccgccgctgccaatgccgaaagcctcaggaccaagccaacgaaactgcctcatctgttggcgaacgggttngcagcgcaactacggtgctaccgaagcc

SEQ ID NO: 2682 - DNA, 565 bp, Fusarium venenatum
  misc_feature (1)...(565): n = A,T,C or G
caaatatgtgagtagttttctcattaggtcaatgccgtccggctcatattctatggaaacccctcgccccgaatattttacaagccatgtccctctccacctttcaaaaagacatattcaatatacaacgcccaacgaataaaatgatcgaccatcactcagccgaaggacaatcaaagagaagaagcaacagcttcttttatggcttgacagaccataagtctcgggaccaacccaactctcgtaccttcttgctactggtaccagtcactcttctctcaccagtagtgctaatagccagtgccttgctgcacgccgcaaatacctccaccaattccttcattcgtctagcttccacgaatgctgtggagagatccgagtcacgctctgcaataatggaggcgagctccatgcattccaaaagggtgtccctagacaagccagtacctgcgaagtgcagcgtacccgatgtatgccagaactgtctcggagagatacgcctggcgaagatctcgtagttcttgatcgccttnctcaatgcccactaaaagccagccctttgagc

SEQ ID NO: 2683 - DNA, 556 bp, Fusarium venenatum
  misc_feature (1)...(556): n = A,T,C or G
nctccagacataaccagtttaccgaaggaaattcaacaaaattatcaaagctcaccacaatgataactggactagagccttagcacttantcccgacacccttcgccgttcgtaacccactatgaggatctattttgggaaaacacgaccaagctggacnacgttgaccgtgagataattgnagtcgtaagtcagccatgccaacggtgcggtttttgtnaaacacatnacacgcatggtctntcggttgcgctaggcaaaggataccgcggcaaaggtgaaaagccaagaagattgcactggattggcaccttcgtggcgagacttgagcgataaagcacaagacttttggcggcattttcggaacttctggctttcaagcccagggaagtagggaaggcagcagttgaatgaattaaaggatgtcggatacgaggaggaacangattngtggagattatagaggnagctggggtggttgcacatncgaataggctcatgatccgtcaggtggttgagatnagatgataagantctcngaattagaagagtgtca

SEQ ID NO: 2684 - DNA, 609 bp, Fusarium venenatum
  misc_feature (1)...(609): n = A,T,C or G
gcttctgatagttgattctggcttgaaacaccaccaacctggacgcagctggtaacgtcaagtctttgaggtaataatctgagcctactgcagcaacatgtttcttcgattcggatcctccagtgtcgtggccgcctcgtaaggctcttcttatccgctatctgctggatgatcctgaccatcctgaccacaagaccccaacatatacaacgtcgatgttgaacataccattcaagccaaatactggaacacatgaaataagagcgcccggttcttaccttttggtcactatccagctccctgaagttagggctgcatgggcaatgtttgtatgaacattggcttatatgtcatcttcgtatggctacaatgtctccttggccaagatgacccgagctgccatttgtttgccaattttctctctgaggacaggtgtttgttcttgggaattgcctctgttcaacccaccaacgactggtataggcatgtctgtcaatatggagcccgatcttattcgtcaccaggaattctttaccagtncaatcccgcaccatggaggntgatctgaacatatgctttttcgaatcccaatgcttaaccctntcgctt

SEQ ID NO: 2685 - DNA, 665 bp, Fusarium venenatum
  misc_feature (1)...(665): n = A,T,C or G
gacgcatctatgttccggtacggcatcagatgggctggttgatgtggcttcgtctcggaacttgggagaagactccagaaggaagactagcacaactgaaaaagataaaggacgggttcaaaaatgcgtggatgacggccacagctacagaccctgaatccgctgctggatatcgtgctcgattctcatccgctaatctgggtttccctttactggtggttccaaatcctgaaaaccttatccgtcgattaaattggcagacgggccaggtgtacacactctttcagagccttgttgacaaaatcaacaatgaaacgtctcaagatcccgcagggatggaagtcatgaaaacacgtccagggcgggatgatactcgctacgtcgagatgggagagaatccatttggcctgttcaccacttacatttcatgtgaagacttcaacaagtacatgaaaagccttgaagtcctgaggggatatgaagatcagagtctnacgangcangacgcgcaccgngctattnaaacngcccccagccaggnaatgctaccttgctgaacttgacccanccatggagcccgtttattntgnagggcnaaaaaanttacccccaggnccaaacggccttttttgtgtntttggaaaaatnggaaacccaaaaaggga

SEQ ID NO: 2686 - DNA, 400 bp, Fusarium venenatum
ttgttcagcatcttccgtaagatgtctatcgttgtctacaaggatgatggtgagcaggaccgtctctactcgatccccgagctcttccgagatgaagcatctgagccccgcgactcgatgtcttctgaagtttaatgatctaaaacaaaagggaaacataaaagaggacaaggactcattactgttttccaacctgcttcgggcaatggcaaagcccaccgtaaaggccagaaggcaggataaatctaagcacaactgatctgagtatggttttgagaacttcactatccttgggaatgattatagtgcagtgtataagaagcttaagcttggcggtcatccggaccccctgagatagctatttgatatagctaacatgagataagaatcgaaacctgaa

SEQ ID NO: 2687 - DNA, 635 bp, Fusarium venenatum
  misc_feature (1)...(635): n = A,T,C or G
gagctgtctcgctcttggttcctaatctcttgtccgctctgtctctgtcctcgcaataatggccgaaaccgcaacttctcctgcccctgcggcagaaaacaagcaggctcatgtccgtcctactaaacctgacgaggagatctttaagaaggagctcgcaaaggctgagaaggagcacaaggcttcaatggaccgcctggctgctgtgaaagctaagattgatattgctatgcccaacaagaacaaggaccagcccaaccctacccagcaacgacgacaagagctcattgctcaggccaacgagattcgacagaagcaggccggcggaaagaacgcccgcactggaaagctcgatcagatcaagcgccttgatgagcaggtccgaagccgaattgccgagcagaagacagcaaagccaaggttccctacaagagccttgaggatgtcgaccgccagattgcactcttgacaagcaggtcaactccggtncatgaacttncgacgagaagaaggcccttcagacatctntagcctccgaagatcgcaagacttnggcagtcaggatctngaagcagatgatgacctccggccagacaagngataaggatgcatggcnanccgacacgtgccttttn

SEQ ID NO: 2688 - DNA, 634 bp, Fusarium venenatum
  misc_feature (1)...(634): n = A,T,C or G
cgcatgtgttgatcccgtgggttgatcaacgtgtcgggcacgtgtcctttatgtcgttatgatttacgaccaggcaagggcgctgcgcctgaagaaggggctgctgacgattccagttcattgccaccacccttggtgttggaagagggtgcaaanaatgatgcacctcagtcatcgcatcgtaaccgactatctcgcttatttgatatcaaccgccttcgagangggaccgtggaagaacaaatggatgcgttgaggcgcatgcggacggtagctaatgagaatgatcaccaagaaagggcangcgtggctgaagccgctgatggagattcccgaggccaaagtgcacgatttgcggcaaggctgagggataagtttcgaattcncactcnagcacaagccatggagaacgaanatgaccacgcggacactagggagcccgaatgaaggctnatggcgcanattgcgctgggagatctatatcactggcgatcgcttttaaggctgagaccgcagatcggctgatcgaagcttcaaatgatgangggngcatntactcaagtttnctttgccaaccgtgggatggaagataaaatgttccaacctcgcctttggaattgangaatgatgggnt

SEQ ID NO: 2689 - DNA, 593 bp, Fusarium venenatum
  misc_feature (1)...(593): n = A,T,C or G
cgccaaaagcggacacacaatgacaaaggataaactcaaagtcaactaatccacctggcgagaggtaaataagggcctcagtctcaaacnaanaaattcatgggctggatgatgctaaacgatcatgatacactctcaagtctgaagcacaaataacataatgacttctcccaccaaaaaagccgctcanccccagcacgctgcaacctctgacccgtggaactcatcttcaaccggccatcaacggtccgagtcacgtcctggcactggctggcgtgagtcccgcaaccggaagctcaacagccagtttcgcagcggttcatcaggcggngaacgtctcagtgacacatatggcgctgggtcggaggactatggtgaggagcgcaaggtgcttgtcccaaaggtagaaaaagagagagcgcagcggagcgtgaggnatatgcttgtcccgccgggcaacatgcgggaagagtttgggcttgaaggatgttattcagggacgaggtgaggaggctctcatggaagcaagacggaaggaagacnaagcgcgggangcagngcttccaaanaaggcatntttgacggagcttgtc

SEQ ID NO: 2690 - DNA, 377 bp, Fusarium venenatum
  misc_feature (1)...(377): n = A,T,C or G
gcaggagcagcagtgttgccagcaacctcaggggcaggggcgacaaagtagtcagccatctctgaatcgagttcctcttgagtcttctttgcaggacgactgctacgaccgcggcgcttcttgttggcagcgcccttcgcggctcccttggcggcaccggcggtgtgcttgtcagcagcagcggacttgggttgagccttggcctgggacttgggctgactattgcgttgttagaggtattcgcgtatgaagatacaataacttacgaagtacgctcagcgagggtcttggcagcaggaatgactttgtcagcctgagcagccccgacgacgatctcaatctagttctgttagctatcgaaaagttcagacgccnan

SEQ ID NO: 2691 - DNA, 620 bp, Fusarium venenatum
  misc_feature (1)...(620): n = A,T,C or G
actcaagattccacatgctcttcgccaacaacccatctnggtaaccctngatggcaaaaacatatttttatcttccgcactcttgtcttacttattcattttcttgacgcataccatgcccaagctctcgtcgctctcgttcccgttgtcttactgattcataacgattatgtgaacttcctcaacttaggccctggtggtacaccttcaacctttgctggctaccttcgtatatcatggtttcgcattngggctctcagaaacccatacgatgcaccagaacctgatcctctgcgcctcccaacgtnaggcatcctccgccgcaacgactcccataccgcgcaggtccacgccctactgttgntggaatcgctcctcaacgacaactcgaccagnatggatctccgaatgctatcgatctgtccgatggccatggcaaagctggcaagtcataacccaaaaaagttccgcactganaagncctgcgttgaaaaacatggcttaacattggtcgctanacattctgtacaaacaagctgggagggngagatctgcccattnatgaatnaaacactntntgccatgtgtctgcccctgatgatatcaaaaagggctaaaaa

SEQ ID NO: 2692 - DNA, 589 bp, Fusarium venenatum
  misc_feature (1)...(589): n = A,T,C or G
aagagacgacattagactcagtactgatactcacaatcaactccgcgaaagaagcacatattcaactgaaactcatcatggctgaagcctaacaagttaatctcgccttcaccacctagcgaaanagccgggtactctgcttgtggaaaaccgaacgtcttatcgtacgacgataccatctctcagatgcacatgtactagcgagtgcggccaacaataaagccattgctgccaacttacgcaacacattcccatcaccgtatactctcgaaaatgctcagaactttcttgtcaacatggcctgcaagcctgacggaacatcttatccgtaccacaacggcatctttctcaaacccaacacagccgaaaacccatcgacggagcccctcttcatcggcgctataggcgcaatgcccaaaaacgatatgtacttccgtacgtggganatangctactggctggctgaaccggcttggggcaaaggctatatgccagaagctgcaaaggcattcatacggtggtgctttcagacntggccgacttgaacagaattgaagcagtggtcaaaagctcaaatgctgcggggtct

SEQ ID NO: 2693 - DNA, 133 bp, Fusarium venenatum
  misc_feature (1)...(133): n = A,T,C or G
naatgnctcttnttanaacaanaattttgngaagttnttgnttttccgngaggccaagngggctncacttgntacggatttttcaatggnggaaacaangncttgtttgtgttanggaaaaaagnaggctttt

SEQ ID NO: 2694 - DNA, 105 bp, Fusarium venenatum
  misc_feature (1)...(105): n = A,T,C or G
nccnacgacaagccctaccttcactctcttatggaaaangtggctcgtntncatcgcctttatgatcnagctcgactccatcgctgtttctcgaaagcnctaaat

SEQ ID NO: 2695 - DNA, 363 bp, Fusarium venenatum
  misc_feature (1)...(363): n = A,T,C or G
cgcggatctttgcgatgagctgtataactctgatgtttacgattctaccacgaaaacactccatgcggagcttttggcaaagttggtggatctttgcgttgtgttgacagacgttttgtcggttgtttctgttctttacaataatccgtcatggatgctttcgggaaggatggaggtggctaaggatgcgagtctgtgtcagattgagttgaagaggtggtataacgcgtggaccgagactaaagcaactcttgaggagagaatgacggaagatgggtcacanaccgagtctattattctgtcaagaatctcatcgagatgtattatcactctgctcggttatcggtctgccactacaatatc

SEQ ID NO: 2696 - DNA, 512 bp, Fusarium venenatum
  misc_feature (1)...(512): n = A,T,C or G
nggaatnggcttcttgactttcctctcccagatccaaaataagacaatatattnccctgtctttgaatctctcgattcattncccgccccatnaaaatngggcccctcggctcttctttgcctccagtataaaactttttttcctcctttgcgcctggctngggatacacatacttccttcaacctataactaaccgccttcctgcaaaactgcaggcatattccaattcctacatcttgatcaaacatcatcagcaaaatagtttcttagctaaaggctcaccacgtcttttgtcacaatggttcacaggcatcacgagtctgcggtgccggcagtgatccctgttccgcacggtcctgtggacagcgactntgancaaatctcaaacgancccattgcttatgctactgntnaagaaccccccatnttcagccatggaacacgtncanatgattcctacnccggaggatggggtttactggggccnaccttgctttggcaaaagcgctnt

SEQ ID NO: 2697 - DNA, 571 bp, Fusarium venenatum
  misc_feature (1)...(571): n = A,T,C or G
gtcatcatcaacgaagaagatcgacacaagttttgggacactactcctaccggcaaccagatcatggtcagccatacctcgatcatggacacccttgacaagatcgtctacggccccaacccaatttctcccaagtacaccattanctctttcgccaagtttttctttgacatcaagatgaactttgtcgaccacccattcttgtccatngcctttgtctttgctgtnggttttggcctctactctnggttccgtaaccgcactcgacgatctcgcggactttcttccgggacgataacatgggtctcaaggatggactcctggggtcanaatagcaacgccaagtccgattaaaagaatcgattcttgtaagagcggagtcgngtcactcactactaaaaagatcaactnttaanggggtttctggggacnggtcgcattangatgtttnggcaagtgttgttgaattgcggagttctggttngataactattgctttgaaattggtggccnttgtatagtaaaacaagttacagngagaatgtanttgcatttgngnggaaaaaaaaaa

SEQ ID NO: 2698 - DNA, 611 bp, Fusarium venenatum
  misc_feature (1)...(611): n = A,T,C or G
tgaaaagatcgacgatattcgtgtccgatatttcgaacacatggagaacagagcaggcacctccaagcccaaggaagatgaagtagatgaacttgcagagttgtcccagtccattttcagcgtgagcaatgtgcggcgcaacacccaaaacaatgcgttcccaacaatggaaagcacaagatcgcaagtcccgtctcatcctgcacacccactgaatcgaccccgccgaacaaacagtgctggttctcgtcactcagtcaacagtctgcctcggagtgggcgcacccatcgtgcttcatggagttcaaaggactttgcagagtgggatgctgatatgaatagaggcgacacctcccgaattagtcgcatgcgaagcagctccctgcgcttgcaagcatccaaatactctgtaaagtcggccgccaatgacaccgactcgagaatctgcagagtttcctcgcatgagtacgaatactgnggataaggacccgattgtccaaaacaaaatcgangagagtgtnctcttccaaaaagaaggaanaaaccgtaanctgggcaaaccaaactngatntgcgaaaagcccttccaaaangctttnaaaaatgaccaa

SEQ ID NO: 2699 - DNA, 574 bp, Fusarium venenatum
  misc_feature (1)...(574): n = A,T,C or G
cgcaggaattttttttttttttttttttttttngcgtgtctcatgcggatagatgtgttgtgaagggtttgctgagactatgaatgcattaaaaaacgaacccaaaggaattgatcaagtgtctggtagagttgagtgccgctttttttcgcgctgtgctgcgaccgccccaagcatatgtcgtcgtcgtcgtcgtcgtcgtcgtccttatctccccccaccaccacgggattgccatactgtctgtctcatgaccaatactcttggctccgagattagcctcaccgaatgcatcaagtcgctgtcacgaacaatcctcgctctgcctcaaggtctcctagtgttcctcctcctgcanggtcttggcagcaatatgtatgaccagcaaatactgatcatgctgcgtanacggctctctctaataaagcgctcgaacaatttgtatctcgagcttattcaactttcttgaaanctggggatggggtagggggctcattaagcgantcngtctcctcagggaacngggggaagggtgctttctggcttggaancaccaaaattcttctcgaaatcc

SEQ ID NO: 2700 - DNA, 777 bp, Fusarium venenatum
  misc_feature (1)...(777): n = A,T,C or G
tttggtaggtaggaagagcttttaaaccaaacactgctatttctttctgatgaggcttattccaataaagacagtgtttcacgatcaaagggacctatagtaacaagaaacacgcagatatcgatactcataccctcttcacaataataaccgcgattgcaaatctttctgccaggcttgacaaatccagtgaccctgcattctcttcggctgcctctcgcagcttattcatcaaaatcctaacaatgtcgtctttcgttccaatcaactcaggattggcttgttgccaacgattgaccgcccaaaactattgactagtttgtcgaacctttgaagtgcctcgtctagtggaatatcactaggtttactgccatcatgtaggtcttaagaaaatcccatncttggcactgagttcgtggcgggtagaccattgacnggcatacaatgaaacaatggccgggtcgtccaagcatgacgaggtggcatattcgcgngcgtaagttgctgcctntgagtggaccgagcaagcacattttntttaagttttaataagaaccgtactttgtgcccaacgtntcggatttctgaaactggcatatggnacggncccccggtttaanaacttggcagtgnttccaaaatttgnatttaaacaatgaacccaanggctgtggataaatccncnaaaaagatcaaacatnatnttgaaattttaacatactatntttntacaattgananccggtttggagacccccaattggttaaccttttgaa

SEQ ID NO: 2701 - DNA, 122 bp, Fusarium venenatum
  misc_feature (1)...(122): n = A,T,C or G
ntncaatgcacggngcantcttganttctaactacacaatctttagagttcgggcgaggtcagttcttttcnatggcccaaaaatngcaagggtgcttccagtncnttaaatgaaacccgga

SEQ ID NO: 2702 - DNA, 332 bp, Fusarium venenatum
  misc_feature (1)...(332): n = A,T,C or G
natacacaaggacgatacacgaagaaagcaacacgggcgaaaatcccaacgaaccggngggcccctggngaaacgactgcgggatccaaactctggccaacaggaatgaacgctncgcgaagcactttctagacgaaataaagaatcaatttagaggaaagccgccgactttcgggcgacaagactagaaaggaaaatgatgcgacacgacgaaganggatngaatggattacganggtatgataccccctcgaataccgaacgaanactccggtctcgatataaaatacgaaacagaatacaagggggaaagatgggcacnggccttttac

SEQ ID NO: 2703 - DNA, 572 bp, Fusarium venenatum
  misc_feature (1)...(572): n = A,T,C or G
gtgcgaggcgctggtggggctggcatccaatctatacctcagaagcccttttctcaattctgggttctcgccctggcgaactgaattatggtgccgaatcctttggtgctagaactcgaantggtcgccgaatttgaattccttccctccaggcctggaagatgccgaaatcctgccattgaccccacgggtttcactcaatcgcctacaaaagtggaagaagcgcagcatgtctcatttccaccaaatgatcttctaccttctctcatgtacctcaggtagcccaagaccgcgacttcctgatggctctagtaacggcctaccttctggcggtcttttcgacactgaacctcatatcacgtcggaactgaatgccatctcnaaaaatatccagagatcctggatctcaggcgccaatatgtctcactttctaaccagggcccngacgataaccgaganatgatcaaaattgggaaatctatcccccccacctgaacccgcgtggggacatcttcaaaacaggcaacaagcnccccgaacatgtgccggccnggaaaatctggtncaatgga

SEQ ID NO: 2704 - DNA, 597 bp, Fusarium venenatum
  misc_feature (1)...(597): n = A,T,C or G
accgaggtggacatttctcgcacaactcgcactcgatcacagagccaggagcgacgatctgacttccgcgacgatgagcttgtggttcgacgagaatccgattcccgtcgccgagcgcattctgctgctcctctgcccacacctagtgctgttgatgaagagggcgactaccttaccggaaagattgactctcgaggcaaaatgggtgaggcctggggtggtgccaccaaggactggactctcgtggatgttcctccaggcactgagcgcatccgtatggatggaatcggcggtggcagcactgagacacagtggacgaggtacagcggaccaggaagagcaagttcatccccgagagagatggccagccttttcacttctgtgcattcccaaacctgctttanggaacctttcttcccaaccgtgacgtgacacacaatgacgtgtaatcncgaccgtagcggaaatcgcattggagactcacggttttgacctgtctcaccaccaaggntttggcccgnatcctaggactgtttccggaggtnttgnacttggtccaattagggccaggatttcttttcangctttaattgaaga

SEQ ID NO: 2705 - DNA, 727 bp, Fusarium venenatum
  misc_feature (1)...(727): n = A,T,C or G
cctgataccctttttgtgtatttattttcatttgctcttctcaagcttggcatactctttggtctggtccggcatctaccgttttgtaccttgtatttacgagacagacctcaccaacaccaaggtggccagacacttgaactcatataacgccagagagaagcttaatttaaccgcccgccgccgctaaccctctccatcatgggagtcggttcatttcttgaacctctcgtcgtggtgacccttctctttggaggcgcctacttcaaccgcagtaaggactacaacttctggaccaacaagtcaggcttcgccagcctcaagagctataagcgttccgatgacctaccgaaacgagactcgaccgagagttttgatgagtggatggagtggttcgcgttcgccgaatttggcttccagaagaatacccagccgagtctgcgttgtcgcaggttgcaagtggtaaggttcaagcgcattggttntacgccaaacacacaagtntttgagaatggctctaagtgacttttgaagaacttcccttttggtcgagggtgggactgggtcctcattactttggataccaggtgggcggccattaatgcttgattttgaagaaggcaccgtgattaacttggcacatgctttttaaatggtnattttgaaaaggcctttttttttttggaggggattttaaaanggtcttggncaacaacnatttttatgg

SEQ ID NO: 2706 - DNA, 781 bp, Fusarium venenatum
  misc_feature (1)...(781): n = A,T,C or G
tctgagtaatcctcagcatctggacccttgtactcaggattactcanaagccgaggcggcatgcaaggccaacttgtgaagacgacaaacgcaatcagattgcacatggccatggttcgtcgacgagcttcatacaaagcaggaccagcagtcacattatcggagccgacgcgaccagcagcaagcgaccggtggcnagtggttgtgaagtagtacagcaccacgaggaacatgatagtccaggaatatnggatgaaagaataaatgccggttgatccagtgaanaatcgttggtcgtgcaaggaaccattttngaaaatcgacctcccagaagatatgaaggcgctggtcgagatgaacgatttgaaaagcatgtcgacgagctacatcaacggtgcccttatcnanagtcaaggcagtgatgggcgcgggcaactggtatacaaaagtanatgagggacnatccaacctcgaccaaaaaaggggaacttttttaaaagtcgcttaaggaacnattctcaaagacttgtgtgtttggcgtaaaaacaatggcgcttggngcctaacctttgcaacttgngacgacccaaanttcggttgggtattttttttgggagttaaaaattnggggaaaggcgaaccattccatccacttattaaacttttgggtcgagtttngtttgggtaggtattnggacccttattgcttttgaggtngcaaacctggattgntggcccaaaanttgagccttatggggttgaatnaggccctccaanagga

SEQ ID NO: 2707 - DNA, 702 bp, Fusarium venenatum
  misc_feature (1)...(702): n = A,T,C or G
cttttcacgggtcatgggcacgaacctgggtttaaaacacgcaaaaagcaaaaaacccatnttcggtntntttaaagggagaaagttttntaatnttaangaggctctcaaccaaagctttcaccaattaagcataaaccttttttacttcaacttccggtaacccaaacacaacctttacaacattcatcatgggctggttcagnggtttgtcatatcgtttatgcttatcagttggtttcttatcccttcagaggcctcaaaccaagctcaagggtaggagacagtgactcaacgtcctcattaggcagagtggtcccccnaactttataggnggagttgcagcctacgaggctgccaaggcctattaaaaccatgttgctcggaatggagagcctgatagccacgctcaagcaaaggagatcttggcaggttttgttggngcctttgttgatcgagagattgacacgaagggattgnattacgtcgacgcananaaggccaagcgtnatggaaggcaacatgcaaaagagcagttgagctacaacaacaaccagggntggaactaaaaccatgctgagaaaataaaacttaactttgttattcttccacnaggcttttaagggggaatnttcctgggggccgttngagcctgcatctatagggtcttnttcccctntttgagttgtttaccttcactgc

SEQ ID NO: 2708 - DNA, 650 bp, Fusarium venenatum
  misc_feature (1)...(650): n = A,T,C or G
caagccctcgtcacgccgccgcctgtcgaatcagaggatgagcctatgactcctccaatgatgcgaacgagtggatatgactcggatgcacagcccggagattttgacgataatgatttcttcgaggactagtgtaaacaaggtttctctactttggtccaggagacgcatatcatgacttattataatctatatttcttttgtcagaacaccaaaaaacggctgatgcataaatatttgcgctgcacattattataacaagtttcaccgagactgcgaacctagaaagatacccccttttggattcatgtttatgccacagattgggatttgtttgtcttttatttccatcaagtcttctttgcttttcattctttcactccgttaggaagcctgtgtttcagagggtcatctcatgaaagagcccgtgaaagcatataagaaaaaggataaaacacagaaaaaaaaacgattgcggaacaataagttttgatatttcagtactttcctcactggcggttggatagcggngtgggtaaatgtcatttcgacgtgagaaaacattcaagaacgatggctcgtggacataatcataaatttactctcaaaagnaaccatagaatgaagtanaatgagttatttttttttaa

SEQ ID NO: 2709 - DNA, 317 bp, Fusarium venenatum
  misc_feature (1)...(317): n = A,T,C or G
caagggagaaattgtngatatgcccgatggggaactcaagacatggtggctggatcacggnttgcccactgatttttttggngacttctccaanttgcctatgaagctttgtatcggtgatctcttgtgctgtggagagatggttgcaagggggttcatggcgaagacgactgacagtgttgagaagttgacgggaaggaagccgaagccgtataaagaggctttgttgcantncaaggacttgttttcgaaagcctaattanagagtctacttgagtatcacagagcctattaaatatagaaagttggattgcttg

SEQ ID NO: 2710 - DNA, 616 bp, Fusarium venenatum
  misc_feature (1)...(616): n = A,T,C or G
gagcctcatgatcttcaatcgagggtcaaggctcttgagcgacattggtcagcgctggaaaaatgccacaccaagcttagagaatgggagcccaaatacgccacccaagcacaaccgccattgttagaagggcaggaagaatatgcgctcgacttgaacgacgaacaagccacacatgcggaaattgagtaccgcgaatggcgctctgatcgagatagaaaggtttcatacctaaaagtcaacccacccgagccatctgcctttgtacccgtcgaacgtcgcgacatccaaaccgacgaaacatggaacatccttcctacatcaaatggtcactacgggaagcgcctgttaccagtctggacacccattctcttccaagaagtaccgctcgaatgggagagtcccaaggacggttattgctacaagagcggaaaggagacggagagatgagtttcgcagaagagagaacaacagaagagagaagaagtncgagtttcaaaaacaacttctgaagcagacgaancgaggcatgatacacattagcgatttggacatttaatgattgggatattggggttttacatatacaggagaattggcgatttatagcttggat

SEQ ID NO: 2711 - DNA, 234 bp, Fusarium venenatum
  misc_feature (1)...(234): n = A,T,C or G
naaccccnagntgggtaaaanttacccagcctnggatttattanttgntaaccnaanaacttgnggggcgggggggaanaacaaatgccacccgtttgcccggtttcancacccgagttgggtatatggtctggtggttttggttgggagtgggctttttattcttggcttatttcgtaaattangccatggtaagttttctgggagtttggaatatatctacatcatgccaat

SEQ ID NO: 2712 - DNA, 321 bp, Fusarium venenatum
  misc_feature (1)...(321): n = A,T,C or G
caaggancaagtcnagatgcctccccgcgcccactccaagacctctcgtggtcccccgccgacccttcgaagtctgcccgactgtcagtatcaccggccactgaaacatgaagcttgactctgtttaggttcgaattgtgaaattaagactgaccgataataaatnttgactccgaagcnttngctcgttgggcgaagtatnggcctgcncaaataagcgtgaaggtctgggcgaantcnggtctgactctngtccaagatccgtcttgccggccgncngctccttaccctnccacaagaaggaccccaagcgtctctttc

SEQ ID NO: 2713 - DNA, 447 bp, Fusarium venenatum
  misc_feature (1)...(447): n = A,T,C or G
ggaaaaatacgagttcaaattgagcttgtctcccaccttgtcatgagggacaatgatctacagtcttgactgagacattgggaactatctcagcaaacaagacttatacttctggtgtctgttcggtctttgttactactcaacaccatcaagcttgagtcgatatctcgacttgactcaacttaacaatgaattctctggtcttgtctccggcctcagccttggtcttttgactgctgtatctgccagcccagctgcctttcccgctccagcctcgatcctgacctgtacctgctgcacctgtctcgcctgtttcgccagctgttgaaaaacaancagccaaggtcaccgttgctgttccttccngcacaattgnttggatccanctctggaaaggttgaatcttcanaaccatccctttccccgatccacctactggttctctac

SEQ ID NO: 2714 - DNA, 601 bp, Fusarium venenatum
cttggcccattctaccatacatccattgatcagttagtatttcgtcaatatgtcctcctctcctctccgtataggcttcgtgccagagcatttctcaactcccctcttcttcgcccagaagcactttggtctcgatgcaactctcattccctttccttccggcacaggccacatggtcaccgccattcgatctggagagattgatgtagctgttggactgactgaaggttggattgcgggtctgggaaaggagggcgtggaaggagatggtgggatatcgtcttgtgggaacttatgtcgagactcccctatgctgggctatctccacaggcgcaaagcgtcctgaaatcacatctgtcgactctctcaagggtggcaagattggcgtttcacgaattggctcaagcagctacgtgatgggcttcgtcctggccgaccagcaaggctggctgactcctggtgccgcagaaaagcccttcagcgatactgtagtcctcaacacctttgaaaacctgcgttacgccgtcaacagcggtgaggccgacttcttcatgtgggaacattcacgtccaaaaagtctacgactctggtgagatccgcc

SEQ ID NO: 2715 - DNA, 632 bp, Fusarium venenatum
  misc_feature (1)...(632): n = A,T,C or G
atctgtagagttacgagttgactcttaccgccgctcattcgacatcactgcacgatctcccattgccaacaacaacgacttccctacgcgtnaaagtcttgattctgctcgccttccccgtatgcccagatctgcggtcgagcgatcgtttgagcancccccaacagctgaggaacgttttgaagatgttggactggatgaccacaagtaccaatatcaacaacagccggcacaacaggcacagccccagaagcgaggcttcttctccaaattttccgactctcgcgacaaggacccctcaagcaacccctctgtttcccgattcctcatgcatggccgcaaaagagctcagagcggccaagggtcanaacttacacctatggacaatgtaccgcccaaggtcactgtttcacctgaaggtcaaganatgcattgaaatgcatgaaagatttagtttttacccttctacgttgtattaaaaatcctggagttttcgttttatattacccggcgttatcggntacaggggccaagataatgctanaaacccnttcctacgacactaacattgctangtacaacttgggccgnaaatccggcttttgtnttggatgggttatgcaaaanaagct

SEQ ID NO: 2716 - DNA, 164 bp, Fusarium venenatum
  misc_feature (1)...(164): n = A,T,C or G
nggtgatagtcttcttaccctgnntaacagtaacatccnaancaccagngtatccgntgaccctactgatcccgctgncancatgataaccaccactantgatgtannaaccatagcatgnanggtcttgnaacaacacatcagtgttgcatantgaaggatca

SEQ ID NO: 2717 - DNA, 603 bp, Fusarium venenatum
  misc_feature (1)...(603): n = A,T,C or G
caatgcttccattacaggtgttgtgctgaggctataagcatatttcgagctcaaaacatctcctcaacagcttttattcaccaccgatcttcaaagaagcacacaaacaaccgacgtccattttcaccttgaaaacatgcagttccaacaaagaattccatccagcctcacccgaatccttctagctcctcattcgacaatatcagccacccccgaagatcgcagctctcacctccatttctattcgagttttcccctgtggcgccaaatcggaagagctctcaacgcccctcctccactcaactgttgagagctggcgtccctgtctgcatggagattttgtcggcgttatctctcaccgagactttactttacctacattacttgacctacctatgagtgaacaactctcctcgtattttatgatacaggggtttctatcctattactgagcaaaacagagtttatgcttggaatanttaataaggagcaagcatatcctgttgggtgagttgtatactatagangctgaggcaggtacagtactttttttttcgtggggggtcaaccaaccgattcaatgaggctttagaacaaaccgtc

SEQ ID NO: 2718 - DNA, 560 bp, Fusarium venenatum
  misc_feature (1)...(560): n = A,T,C or G
tcgtcttataattcacaatggctggtatcgcttactacaccattgccggcaagcaggtcggcggccactacttggccatggcctggttgggaaccctcttcgccggtgtcaagtacgccacctctggcagttctgctaagcctaccgctaccgntactncccccatnaacgcctcaagcttccaacgaggccaacttcatccaagacttccttacccagcanggacaagaagaactnagacggttggatcaaggacaatggtcatgccggttatttggatgtgggggaccgttggtaagccatggaagcataagctgtcatcgagccggacagtcaaattaagataccaacaaaagcctgtttcgccaatcgtggcatgacgatcctaaggaacgatttcttcatatgtgaaaaaccgaacatgcgaccgaccagctcgagccaatttcgntattaccgaccagctgaatttgatggtgcgaatgcttgcatgcttacttcgcacangctgnaatcgncattggttttctcgagctcgaaatggcgcaagagaaaaattg

SEQ ID NO: 2719 - DNA, 393 bp, Fusarium venenatum
  misc_feature (1)...(393): n = A,T,C or G
gccgttctcgaaggtctggccaagtacgcccatcttatcaaccaggatttctttggtgatcttcttgaggcgctgaaggatctcatccgccacagtgaagaggatgccgagaagggccccgatgatgaagaggaagaagtagaggaggaagatgaagatgatgtccctgtgcgcaacctgacccgtgaggctctgctctgcaccgcacaaccttcgctttgcttgaagggcaaaacgctcacaactcacgcaacgatcttcacctngatttatcgttcttcactacacacctttttaaganactcctcacactttctacaaaccctgatgtcgagttgacacgtnccgtaactnaaccagcgcagttctaanataatgtcaaacaacaacggt

SEQ ID NO: 2720 - DNA, 518 bp, Fusarium venenatum
  misc_feature (1)...(518): n = A,T,C or G
tttttgtccaatagactgttttctaagcgaatgtgctggcttccaaagttgaaaatggacatcagacggaccttggaagccacaaacttctattccaatttagccgctgcgctttcagccttttctcaagacaaactcgacaatccgacgttgaatttacaaatcgttatccaagaggggaatagtgctgatggtgacagatcggatactttcgaagccaatgaacaacctattatgcaatcaggacaccttctcctctcacataaaatccctctccgcattgacactgcacgtgcagcatcgaacctgctggtcctagctttgctcgagagaagcatcttcggagcaccgtatccaaccaatcggaggcagattgaagttcaaagacgtacccagagttatcagacacataagagacaaggcggttgaggttgctgcgtgaaccgggaatgtccgtggaagnggcgtnaaacnaagcccagacagatcagtcggcaaaaacttcaaaagagcaggta

SEQ ID NO: 2721 - DNA, 596 bp, Fusarium venenatum
  misc_feature (1)...(596): n = A,T,C or G
caaggaagtcggccctacagtagaagtcggatctaaagcgccatggtctcaatatctccgtttaccagatggaaaacctacattagtagtattcctccgccactgtggatgcccttttgctgagaaaaccttcaggtctcttaccgacctctcagacaaggtcccaaatgtccactgtattgctgtctcccactcatcagaagaagccacagacaaatggctgcctcaagtcggtggtacttggaacgttgacatggtaatcgatgaggagcgagatctgtatgccaaatggggtttgggtatctcatcgacatggcatgctgtgaaccccttcacaatgtggaatgtattcagtctcggtaagaatgagggcatatggaacagaccgacagaaancggctcgcgatggcagacangcggggcttttgctgttgaccgtgatngaactgtccgttgggtgcaggtggcaagaacagcagacnatatgcctgatctcaaggcggccatgaacgcacttggattccccctccagaaganaaacccgttctagacacaaattctaanatactctcgtcatgtttactggggaagcccgg

SEQ ID NO: 2722 - DNA, 253 bp, Fusarium venenatum
  misc_feature (1)...(253): n = A,T,C or G
ngttaaggttacgcagtcattgtgggnggacaagctttcgctttttaccgtnggcaacgttcgggctggtnccggacagtggaataaagtcaagctttgggatctggcngnaagtggaaggttntgtggaagcggtggtnggaagtgggaancggnggtaaggncggtaatggnagcggtagcggaagcggttnaagcacntccacagttgacggancaatgcangcganaattgggggattccgggtaacgt

SEQ ID NO: 2723 - DNA, 480 bp, Fusarium venenatum
  misc_feature (1)...(480): n = A,T,C or G
ctttttcagcttgacattctgcttcctgctcatcactgctggtttctgggccctcgctgaggactttactggcaatgctctgcttgcacaaaagcttctcaaggctggcggtgcatttggattcgtcacatgcatgtcgggctggtacatcctcgtcgctgttctcttcgccatcgtcgacttccctatccaaattcctgtcggcgacttgtccactgtcattaagggacacagtgagaaggcccgccgcgcataatttgatgcgcatctgagatgtatgatggaaataatgtggaaaatgggataaagggatgatacagacacttgagaacctccttcccggcgttggtcatggcgttgagttactcaacaattgattatgggtggtctccagtctgatgttctacccacggagttgaactttattagctattaagtttactagtctgatgaatctttcanatccatggactgaaaaac

SEQ ID NO: 2724 - DNA, 364 bp, Fusarium venenatum
  misc_feature (1)...(364): n = A,T,C or G
aacngnttcactcgggnataagcactcgntaaacggggatctatctaatncaatatgcgtggacttgttattttcagcgcggncgttgccgtcgccaacgctgntgctgtcgagaagaagcactaccccgttcctggacaagaggagcatgtnccttccgtgccngacaacaactacacttctccagcaacgagtatactnctnccgatnacgagtatactccccccgacaacgantacacttcttctgacaacgngnattcttcttccagcaacgagtacccttcttctngacctaccaaagnnggttcttctctcaagagaacaaacctggggttaaccctctnntggacccaccgaggagg

SEQ ID NO: 2725 - DNA, 362 bp, Fusarium venenatum
  misc_feature (1)...(362): n = A,T,C or G
tgggtctctccccttctgttcgctcacctttcttttcgtcttacttctcgtatccgagatcaacctctactaataaacaacatcgtttttgtttttacttgaacagtcctcagggacttgtccccaaacaaaagctatccgctggtggttggaagtagacttgaattcggctatagctcaacgaacgagtctcacaaaagcgaacaacctgngacgaaggaacagcctntgacttacacatngaccacaacgtacgagccgacccangatcctttaaatcaaccaatacactaaatcgttatcaactgggcctgaatttactggttccaatggaccggattggggaatnaaaggtcaaaacc

SEQ ID NO: 2726 - DNA, 473 bp, Fusarium venenatum
  misc_feature (1)...(473): n = A,T,C or G
tttcgtctgtcgtagcaaccactcccaagaaaatactcacaaattcatcaaacccaataaattcaacgcaggcgatcaaagcctgaagcttttaaaaatgttgtcatgtttcggctgcggtaaagaccgtgaagaggcagagcgtgagcctctgctgccgcgttacaatgacgacactaacttgcagacgcgactgcatgagaagttacatacatatcagatgctgcgtgccatatcaaagggttatatgccaagcaatgagcagctcatcatccatctgcgaactcttctctccgcccaaatcttgaacccagagcgacaggaattgagcccttcaggacgagctctcatcagaagcatcaagctgnggatcacccagttcatccaagtactacagcacaaaaacagcaggaccagatccaggattttntctggtcctcccangcacgtttaaatgtcgatgtccccatatc

SEQ ID NO: 2727 - DNA, 117 bp, Fusarium venenatum
  misc_feature (1)...(117): n = A,T,C or G
nggtggnataaagggccaaaangagcnctattnggacttgattncnagggcatgcgacgccnattacgantattcattgtgaangcccgagttgctgacnaantggccttactctaa

SEQ ID NO: 2728 - DNA, 610 bp, Fusarium venenatum
  misc_feature (1)...(610): n = A,T,C or G
gaggaggggggccaggagagcggttccaagagccatgctcagtcgactgcggatcaagccactataaacgagcagctcgacactataaaggacaaatacgccaaataccttgcaagtcgacggtcccttctgtcctctgttggcgaaaagtttgattcctcagcagctccaatcctggctccgtccacagccaaacaacaggcagatgaaccagaacctacctcaagtacctatcttctcactccatacatcgagactcttctcaagttatcaaagaagcaaagagcaatgatagcgcagaaagcacacgtaaacacgactctcggcaaggaaactaaggacaactgccagtcactcggtcatctggaagaagaaagccagctactcccgtctcactctacggcaccagaatctcgacgtagatccgttttgggagagtttcttacctctggtgaacggtcaggcttggctgggaaagtccaaccttgggttctcgctgccgactcggccaaaattgcgacgcttgagaacgtggcagaacaggttgaaggcggacagcttgccttggnaaactctatgcaaacattgcaagcagatcgaccaacttttg

SEQ ID NO: 2729 - DNA, 599 bp, Fusarium venenatum
  misc_feature (1)...(599): n = A,T,C or G
caatattagaagacgaaaacacgaggctgccgggcatatcaagtcagaccaaggtctgtgaatacagggtcataaaaaactgggaattggcataaaagaattgaacaatttttttctctggggtatctcattgttacccctatctcgaaaccccaactccccaaaaacgcccgccctagaaatcagttcacgtctaccctttggcttcagcgtcgggcgaaaaccactcagccctcgactccatataacctctcggtgatgatgcacgcatcgaagatgtaggtgaactgagcgctgtcacgaagctatctggtgaccctctacccaacgtcgctgtactttctggaatccttggttcctccgtcgcctcctctgctctctaatttccaatccaaagcgcccgttcccgtcggttgcgttgtcgtcgctgttagctgatgacnctgaagcagcagcctgaagctcataagatcctccatatttttctgcaanctgttgcatggcgttcgtgtcnaaattggctagcagaccgatacttcttgcacgtcgcggtcaatctgcacttccttctcttgggggtgaacgtcggctctatcnaa

SEQ ID NO: 2730 - DNA, 119 bp, Fusarium venenatum
  misc_feature (1)...(119): n = A,T,C or G
naggntcacaccaacnaccnattcggngtggccacntgggctngttcctggnatnccgactcgactgntaatcgagtgatttacantagaataggcnatgtgacattntgaatgtgcca

SEQ ID NO: 2731 - DNA, 658 bp, Fusarium venenatum
  misc_feature (1)...(658): n = A,T,C or G
ctcaataataatcttagttttcactcagtcccaagctttatcaacatgagctcctctatccagacactttgccgtggcgttcgcgctgctccccagactctccgtctcggtctcacccagacccgacgattgagcaccacagatcctagccgaagcgttgcaaacggcagagatactgctgttcacgaccccatcatggacagattctggggatcaactcgtgtcaacatttccgagtcttctcccattgttaccgagacccccagcatgactatgtctagccgagaccctcctctgggcacaaacgcctttgagccttcatctgcacctcgctggtctggaatcaacctcccctcaggccgcaataaatcttgcgtggctgctattcaccaccaccattaaatgcttcgccgcaaacccgacggntaagcaacacgacaaattggttggggatttatcccaccaataacgacatgaaatgaataaccacgccccaacattacatatcacaccacaaagttactgggtcccttcattgcgcagcgcattcgagaactttttttttatcaaagtggtaccaaagtactggcagaagatggaagttggagtaatcgcacaaanggnggaggaaagtcccctttaagcgtggaggnttgan

SEQ ID NO: 2732 - DNA, 143 bp, Fusarium venenatum
gacttcggcccggccagggtccagggtgggccgcagggtaggcttctagataagaggtctggggaaggcgtggttttcattcctgtaggagttttggatgagtctgcgccggatgggaatctgtccgtccggctcggtgtctg

SEQ ID NO: 2733 - DNA, 543 bp, Fusarium venenatum
  misc_feature (1)...(543): n = A,T,C or G
ggatcctccttcgtctatcgtcaatcctctctgtctctcttttttcttttctgttataatagttacttcttcttattaccgtatgcgactgttgcttggatctgaagcttgactttgtatagtcaagaatcatgggtgttccgaatagaggccctgagcttcaggcagtgtgttacacactgcttgtctcttctgttatagcagttggactaagaatctatgttcgtacgcggatggtcaagaactttggtatggatgattggacaatgtgtgctgctcttgtcacattcctattgttttgcacaagttcccttagtggtgtcacgcacggaaccggtcgtcaccgaagtgacctcgatccagcagattatatcaaagcgagaaattggtggtggtggtgctatctgtggtactgcctaaccatgattacttcaaagatatcatcggcatcacccttcttcgaatcaccaaccgaaagatggacatctggatcctttacngnacaatggccataacactctgaccggaatcgctttttctttg

SEQ ID NO: 2734 - DNA, 570 bp, Fusarium venenatum
  misc_feature (1)...(570): n = A,T,C or G
ggggatatgaggtcgaatataaggcccgtgatagtaattgccgcttacttctctttgtgcttctcactcatcaatatactgtctctcacatatcgcttacagtacgacctgcttgacttanacattcacaacgcctacaatggatacgctccccacagaaattgtcatccagatcctggacaaccttccaaccccagccatcaagcaagcccgtcttacatcccgaacattcaactcgattctcgcaaaacgcacatttgaggttctcgtctcgtttctagacccgaaagtggcgcaagacacaatcgtcgctgtcgcacaagatcctgtgcgacggcatcgacgaccctcgatttggtcgccaagatgcagcgtacctcggaatttacccgtcgacgactcattcctcatggccctctggatcggtttgcgcgganattcatgggtcgcaggtgttgaaggagacaagttggacgttggcaagtggaagaatggggtgggaaangacntgagtgaagatganttngagaagatctggtttcgatatgcnctttatctgaattatatgaa

SEQ ID NO: 2735 - DNA, 590 bp, Fusarium venenatum
  misc_feature (1)...(590): n = A,T,C or G
ccgtctcttactccacaacagcactcttggcgttgttggaacaacaagaattccccttcccagtgctcgagcctagctcttgatactttctgccctacaagtcgtcaacgtcatatctcgcgtggcatgacgctagattgtccctggctgatatgccatcttccgccaccaattgcagtccatgctgagaagcttgaagcgggagacatggagttctccaacgatcggggtaaatgctatgacgcaaactgaggtagccaggaaggtgagaatcccaagagtttgtgtttggctttgtgtgtcaggtcctctgcccagtttgtgacttgttgatgatgaagccatcgagatgcaagccgccaggatgactattctcaactatataagaatcagggcatccctcctcggaattatcttttcctcattatcataaacaacaacaactcttaggatacccaaaagcatctgaacttcagctcaatcacaactcatctacaagatactcaaacacttttaacaactacaccacaaacaacaatcatcatgtctggtctcatcaacaaggttaaggaactattcactccgatnag

SEQ ID NO: 2736 - DNA, 592 bp, Fusarium venenatum
  misc_feature (1)...(592): n = A,T,C or G
cacatcacctatccaagagcaatatatgtactccagaaacagtcttgctgtcaaacagtccaaccagccctcgacgttgaagccttctccttcaatggatattgcctctcgtcgaaacaagcgcccccctcaactcgcaatcaacgcccctcgcagtttttcggcaagcggacccagaactgggatcgatgttgggagaagagctgaggtgggacattcgatgcgccgtgttgcctccgcaactggagttggacgcatcggtaagcctatgactggtcctcgaagcccttactttgaaagaaacccagacgttttattgcagctgaatcgttcccccaacttccaaaagtcgactaccattgcaccacctactcctaacactcctgctgttggaaatcaccagggcctatgtnaagctaccccggccagcacgtgggatacgaaaaaaaataccgatggatcttgcaatccatgaccaacactccgaacccacctaccactcctggantcatggaacacttgtncacaatgatctaatatcaattgcntccccnataaccttggtganacaagaacngcacctttctctgac

SEQ ID NO: 2737 - DNA, 292 bp, Fusarium venenatum
  misc_feature (1)...(292): n = A,T,C or G
nacaagaaccaagaaaagccttnttcgagggttgttcnacaattngggggcaaagcgaactaaaacntggcaacccggtcgcaagggggaaaggaaaaaccgntctttggtcgaatctttccaagccctttttcccttgaacccgttttttgggggaatanggttgaancaccaatngggtggaaacccnaaacttggncccttggccccattcccaaaaaaaagncaaaccgttntgccttgcttggccgggggggttgncctttggganttaaaancccaaactttattc

SEQ ID NO: 2738 - DNA, 112 bp, Fusarium venenatum
  misc_feature (1)...(112): n = A,T,C or G
cgcggccgnaagaatttttttttttttttttttttnggagttatcaaaatgatanattttattctttataaatatatgnaaaaaagtaatatctaaaaacagttgtttaaac

SEQ ID NO: 2739 - DNA, 482 bp, Fusarium venenatum
  misc_feature (1)...(482): n = A,T,C or G
ggaccaagcatgactggcagcgacatgaaaagtcattgcacttgnccctcgagcggngggtgtgtactccccacagcccaaaggccgtcaaccccgatactggtatcttgtcttgcgtcttctgnggngacgctaacccagacgatgcccatatcgaaagccacaaccattcagcctgccaagagcgcacacctgccgaacgaactttttaccggaaagatcaccttaaccaacacttgcgttnggttcataacattaagtttcaggactggtctatgaagtcgtggaaggtggctacgccananattcggtcgcggtgcggtttctgtggtatcgtgatggatacatggactattcgtgtcnaccatttggcggagcatttcaagacgggttattccatggctgactggaagggtgactggggttttgataatccagtactcgaaatgggcganaactntatgccttcatgtatgaaacct

SEQ ID NO: 2740 - DNA, 227 bp, Fusarium venenatum
  misc_feature (1)...(227): n = A,T,C or G
naagacgagcgcggttgttggaaaaatgacnncccacgacgtnaaaaanaaanacctgggctacgatgtcncatcncccccaantaaagatgtcggcctcggcnaatatcagcacattcgaggcctcnagacgagcgctganacgtcttccacagaggcctcaaggcccacacattactatgattgcattggnggtgctatcggaactggtcttattatcngactgg

SEQ ID NO: 2741 - DNA, 308 bp, Fusarium venenatum
  misc_feature (1)...(308): n = A,T,C or G
cgccgaacgagacgagctgaacaagaagctcgagaccgctgagcgtgaggctgtgattctcancgcactgaggaccgagaacaacaatctnatgaagaagcttgacgatgccaagaaaggctcagaatgctgctgcatccaaggtgaactctctcgatactcaganngccgcactggtggctcanatcaacaacggtggcggtgctcccagagcgagctccangggaaggaatctatcaaggatcccaagcgggcacaaaagcnngtcgcgtaagggatcctcnggaaaaaggactgaactctctcgt

SEQ ID NO: 2742 - DNA, 593 bp, Fusarium venenatum
  misc_feature (1)...(593): n = A,T,C or G
ctcatccgatacccccgttcattgccttgtgggggttgtgttttgtcttgtttcatcttcctcgttcaaaacactcgccattcatccgactcatcccgctatcgcaagggccccccagttgagtttttggccaccttaacattcgccatattcgtcgcaccttgaaaccttcgcttctcgacttttaaaaacaaacattcacgccttcgaaacaattggaaacacttctaccatcatgtctttctccagccttgttcaagacttgagcctccgcgacgccaatggtgctcgccgccctcagatttccggtcccgctcgtccgcttctactcttgacganagancttcgcacgtctcgaaggccatgtcctatgccagtaccgctgccacagcgtcagtatctccggcganatttcganccagctccatggtggatacttccacctctggcccgctcatggcaagctgacgtcagcttaccaagtctatgcttatctacccctcttcntcacgacggggaaggtgatagatctcgtccctctctccctggtcagcacagtcactgcaaaactgatccctcctcnaacnctctca

SEQ ID NO: 2743 - DNA, 972 bp, Fusarium venenatum
  misc_feature (1)...(972): n = A,T,C or G
ngccagccagggcgccagatagcaagtgcngttcagtgtatctgaacagacgaacggtggaagccgcatgaactttggngctagcaacttcgncattgccgaagacgatagcctttcggatgattggaacaaacggtacggatattagtgngaggacgaggaactatggggacaatggggtggtcaaaagttcatggacgccatatcgaaagcacgagattcggctggacgattaatcgagtctactctcggtcttgagaaggaggtaaccgaacaacaacgacacgacttctacttccccaagaacccgccagtcaacgaataccaccctcctgtcgtcagtagcaaggccccttcacgaaacgcccaccaatggatgctgcaacccccgccgtcagccaaggtcatggaaggcaaggtgcctgttagccgagctgcaagttcgggaagcaagtcgagtgctaggacactagttggagatgacactcagctcagccgtcttgttcacgagaagcttgttatggagaagttgagaaaggagtacggtaaccctacagaaaccgaactcatcgaatctcttttctcgaaccgaacgaaccaatctctctctatccatcgcactcgaagcctgtctttcgacacttccgacgactcacttgacagtggctttgcgaagcgaaagtcaagacttcgaccagttgccgnaccaccaggatacgantcttcanatgatgattccgattntgacgtgcccgctcttttttacaaagggccatgcnctcgggcccttgccgaaaggattttggcgttcaacggtcctaagttggagactatccagagcacgaagtcngccacaaggatgtcctcgaagcgatccaagcgacaaagatccactcgatcaagaggctttcaggcgccgcctccctgttggcgacaacctgattaactcaaaactgggtgaaacaaaatctc

SEQ ID NO: 2744 - DNA, 358 bp, Fusarium venenatum
  misc_feature (1)...(358): n = A,T,C or G
cgaggaccacagaacgtgctttcttttttttcttcttggaggaaaagtcngntgatgatgggtggcgtcttatagggaacccnggggtatttgtacagtcgtcaaatcgggtgtcgctcgttctttgaaaaacatgcattctttgcagatttnacaccaatactctngcaaaccgtggcgcactgnacatctatcatngtgctgtgaatttccatttcttctcatatacgattcagggaacatgaccatgatgatcaactcgagtaacgaggagtagaaacgaggcatgaattcgggccactacgaagattgggtcgttgnagagattctatctgtttattccatccttatatctata

SEQ ID NO: 2745 - DNA, 237 bp, Fusarium venenatum
  misc_feature (1)...(237): n = A,T,C or G
ctttctcaacgatgctgcatctactgctgctgttgagagatcaagtgttgctgagcgcggtgcatcactcgttaccttctcttctgacccacaacatatggcacgctgggaactatcagcaggaatcaaggttctacagtcggagcaaccaggtgtcccaggaaaagtcgaagcgaacttgcaaagcttgacccgngactttggggcctgcatgtccatccntctnatctacggcaa

SEQ ID NO: 2746 - DNA, 150 bp, Fusarium venenatum
  misc_feature (1)...(150): n = A,T,C or G
ncgccggaggccaaggncgaggcccgcagaaggcaagaagtccccnttgaggcggatgatccccgtcatgnacacaacctngngttatcggntattgtatnagnaaagcaactaccntgttccaagaagccttttgggttggncccccca

SEQ ID NO: 2747 - DNA, 315 bp, Fusarium venenatum
  misc_feature (1)...(315): n = A,T,C or G
gaataaacaccattcgccatgtctttctcatttggattcgcaggcgacgacatttctgacgatgagcagaactcttcaactgtcaagccaacagtcccagctcctgcagccaccagcagtgcatttcctgtcgcaggaaaacctcagcttccaccaactctccatcaactgtctgatcttctcgcccagcaaccgtccaagatcgcttacggtcttctagatgttgagcttgacgatggaactaacgttcagttaccacggagaganttgtgggatgtganggtgcnctgatggctgaagaagaagattcctgga

SEQ ID NO: 2748 - DNA, 581 bp, Fusarium venenatum
  misc_feature (1)...(581): n = A,T,C or G
gtgtgtcgagactatccccagacgttctcgtgtctcgtcatcataatttggccgctcatactcggaatcatattcatccagctcaattcctttatcctcgaatgtactatacaactccttttctttgatgagtggcaattgtcaactatcatccatctccatcttgctcggcacaaatgggttttctccatctccatacagaaaatcgtcgatgtctgagtcaagcttcagtgtcttaccgtacgcccagccgtcatcggcaagctgaatggtgacctttggccgcaatgaccggctccgccattcagttcccctcagctcattgaagaagttgtgtggattcaacgaacagtacatcgtagggaagctaagggggccacgaacgtgataacaatatctggtattcagggttgatttttgtatggcgaagtcttgaangctttcggccacgcatcttggaaatcagaaggatttacttaaatcttgacncccaatcttgttaacatttgttcgctctgggctcccaaaaaaaccaacttcggttgaatagtgaaggantcttccaattgganatgcnaaag

SEQ ID NO: 2749 - DNA, 587 bp, Fusarium venenatum
  misc_feature (1)...(587): n = A,T,C or G
ccaaagctgcatactccatacatactgatacagaacaaacaatctgtttgcgcatcaattgtatcaatcgcatctattcttattacacctcatcgcatcgcgcatcgcatcgcatcacatctcatcaaaaccttcgtcttgaaaaagagcgcaattacactataacttataaagcaaaaagtcgactccgactggaatcaaagaaactatttcggtagcccggcgctctgtgcttgcgctgtgtgagtttcggaccaataggttccaatcgacaactgaacgaccgacgacaattcaattccggactccccttgcgataaaatgcagtccaatctatcaggaggacttcatgctcgacaaaagcagcatcggcgtcaaaactcgacaccgactgcttttgaaggtgctaagatccccaatctgccaaccgcacaacgacaaancgcacaccgacgcggcctcagtctcgatattcgaagacaacacattgcggnatctccagcaactacaacaacaccaacaaggcagaaccaaatggtaggtacaaatnctaacaacacaggactatcccattatccgcagcataa

SEQ ID NO: 2750 - DNA, 531 bp, Fusarium venenatum
  misc_feature (1)...(531): n = A,T,C or G
caaacacgttaccaagaagtttgcttattttgaatatataatagataagaaatataaagaattagnggcattttatttagctaaaggtctaaaagctaactttcagtatttcagtgcatatgaacataatcgttcagataaagctggacttaagtttaaggacttattggataaagccaggtctgaaacagaatctgctattaaagaagataaaaaattaaatcattcattacgaaatataactggngagaaattaagtgatttaatagatctagctgaaaagcaatgagatagaatttatagtaataatgaatatccggataatgataactattattttaaaactcgcgngattatcctataaccgtgtnttattaactagaaatcgtagtcatatgacttatttcatatgtataaagagggagttgnggaaggtataaaaatagacagcaaatgctgggnggataaatgctncctaaattatttaaaattntntaatctagagaagagttataaaaaaatactgtcttt

SEQ ID NO: 2751 - DNA, 344 bp, Fusarium venenatum
  misc_feature (1)...(344): n = A,T,C or G
aacacacaaagacaaactaccaaaatgactggcaccgaccaacagaaggacggcggagaagcaattctccatccaccccatcaaggatgaagctaaggacaaggtctctgcctttaacgctcaccccggacccgccatgcccaaggatatgcctcaagaagagggtaccaaggaggagcgcaaggctaagatggaggctctcaacaagaaataagcaggtgacttctgcaacagaagctatttcgccgacatgattgtatgactagatatgggagcggattgctttacgacttattacaacacagctagacagctatttataattcgcataaannaaaaaaaaa

SEQ ID NO: 2752 - DNA, 380 bp, Fusarium venenatum
  misc_feature (1)...(380): n = A,T,C or G
nccagaatgaccgaaccggattaaacggcagggtcggatcgaacctgtgtaaaggaatggtggtatttgtgaaagaagaaagacaaaagggatatttgaatgctcgatgacattctgagattgttggtgcttacaccaggagtacagcggcagcgacaaaggctgtcaaggcaaccataccgacttgtctgtcgttggtgctgcccagagactcatctgatgagacctcctnacggtcggtagcgtcagagacaccgttcatcttgtctgtcgcagcaaggacctggcccttctcgaagaaatcgacaaggacaaattgggggcagcncccactnctgtcggcactcctggaggtgcttgccaactcgccgttgtggtag

SEQ ID NO: 2753 - DNA, 189 bp, Fusarium venenatum
  misc_feature (1)...(189): n = A,T,C or G
ngcgactctctccccccgaagtcttngtcgaaccccaaagtttgacgcaccttctantccagctcccgagcctnntaaatttcaccgccgagccgctnncttggttttgaacccagganaaccgtcccncccgntgactatttaccggaaagccctcccactgtnttaggacttgccccgttcgctcag

SEQ ID NO: 2754 - DNA, 438 bp, Fusarium venenatum
  misc_feature (1)...(438): n = A,T,C or G
ctcccatttatgaggtaatgaaagccagcgatgaggagagtgttatttgggccattccaaagctgctgaaacgcatctaaatgggctgatgaagttcttggatatttattgccctctagacttggccaacccaacagaaccaagcaacactacagagctttccattcgatacatcatgcttacatattcttttatatctatctgcaaaagccgtgtccgggtcnaattantagacgtcggtgatggcgcnaccccanaantcatggcagcaatgcacgaccgatataagttcgaggccggngggatggacctaaaattganaagtatggagatgcttcttacttntttgctccgntgcctccatgagaggtttcccgcgatatcgatncttcatcaatgattgaatgtctcctgtctttgacagaggtntttaattga

SEQ ID NO: 2755 - DNA, 828 bp, Fusarium venenatum
  misc_feature (1)...(828): n = A,T,C or G
ttttccttgcctttccctctccctctcctcttttctcttctgttctcctcagttttcatatccatctcttttcttctttcttacggtgcagctcgactatcgttcatctactctcttctcattcatttgtgacctgtttatcttgactgttcttcatttttgatactcaccgctttccaagatggcctgcatattcttccccacgccgcgtgggttatccgttccattatcgcgttaatcttgtctttgaaccaccttcgcctgccacctacctgcatgaattatcaagaagacttggaccgggcactcggcccgctatcctttacatattcacctccaaattgcactctatcaacaccaattgttcgcgcctatcttacacttgaccgcccggccttcattcaaacgaactcgtctcgggtttcagcatggatcttaaatactcgtacccccttaatgtgacggctatcaacaaaacaactatttcaacacaaaaccacaagtaagtagccactgtagctaacacacgcagacttccttgtccaattttcctgtaaagtagccctagatcaaccctacatcatcgggcgtcaagatcgcgccagcagtccctacgcgtaggatttcgccatgcttggctgcctgncaagatgtatatttgaagaagcaccgccgccggctagactggtcactttcgaacgagcttcatatagcagcatgaccgacatgtgcttaanaaaaggnggccggagggatgantgattggacttgactgggagataatgngacatgggangnttaatattgtatattaaaagaaagtcctnt

SEQ ID NO: 2756 - DNA, 782 bp, Fusarium venenatum
  misc_feature (1)...(782): n = A,T,C or G
caagaaggaattgtggatgtcgttccgaacgattatgcccgaattttcaaacttgccaatacctataatttcgcggctgcatgtcaagattaccacgcatctgcacgtggtatcttccagtgaggttgttagggagcccgaagtcgttgttcgatccactaccgacaaacactgtcagcgttagagagcacgctctagtccaccacagatcttggaaggtcacaatggcggcaagacaatttatgtccangcgccaaattcaaaggagtgggaaccggcatgattgagtcagacacatgggtgggggtttaactctnatgaacttctgctgggcaacccccggagctacttttcctagcatctnctatattatgccatctttgcatgtaagaatgcatggttatcgatagcctgtcacttaactattttaccgagtgggcacgaggggacaaatgtaagtggcagaacactcaggtccaattttccggagatgcacaatccttatttgatatcgaacaccgcattntacacatacggtcgtacatacgacaaaggcagcaagactacccgctttacgtnttntttgcaacttttataaaccaagtgnggtggttacttttatntgagctacggagcgacgggtcggtnaaanttgtggngacaagaattaagcgcaagggctacaattgatccaaccaacggacgattcgtccaatanttttccggtnaaaaaggcctccaacgaattttctggattttggaaccagnacggaaaaatntcg

SEQ ID NO: 2757 - DNA, 560 bp, Fusarium venenatum
  misc_feature (1)...(560): n = A,T,C or G
atgctcaggctgggcacaacttaaaatattccttcgctttcgttgattgaagctaccctgtatttttacaacacggcgatcatgacatcgcaaccgctcgttctcgcaccagcaactccttcagagcttttatcacacattgcatcctaccacagatatcccacaacactaataatcggctcctccnaaagctgagttccacacatctctcgttgaggatgtcactcgtcatctcactctccaagaaagttgacacagagggactcagcnacagaaccctctcatgtnctcttaaagccatcgctttaccaaatcgccatttctcgccatataaggattctatttgcaccaacagtcacacatctgcgtgcttatctttccgncttcacacccaaaaactccttgatatcagcaccgncaaactatacccctgactctnatacgcctcttcttctggnctatggctcctcgctcttcatagagatgcaagcgaatggnctgcgcaagggatcgggaactctgcggtttgctaggtgatggccgcgtcacnggatggggtc

SEQ ID NO: 2758 - DNA, 511 bp, Fusarium venenatum
  misc_feature (1)...(511): n = A,T,C or G
cggctgtgttgactttgacgattccatccgacgaggaccatcacaacgacgatcaacgacaaaaccgtcgcacgcgccgcaaactccgaaaaacagaggtcgaattggtcaagcaccgtctttcaatctggagccgttgactttaagtcgaattaaaataatatccttatctcgatctcgaccaaggacgcgcttaattaatcacatcattcatcatcaccatatcgtcgaataatagcaatcatggtcgacttcaagagcgaaaccattcacaaggtttcggaaaaggtggcagataaggtgcatgataccaccgaaagggttggcggcctgcttgatcaggccgaagctggcaagatcccggcaccaagggtcaccatcctgtctctgctgtcatcggcacagcgttgactggtggtatgggcaatgctggcaccaagggctacctggcggcctacatcnagganctcgaaaanaaccccttactaagtgaccaatctcactgtcatcc

SEQ ID NO: 2759 - DNA, 496 bp, Fusarium venenatum
  misc_feature (1)...(496): n = A,T,C or G
gaaaatattttcttctttactctattttacttttntcctaagaaattcatgctggaatatattctcggattcatcatcgcctacatcaccatggctcaaagtatcccccagaatgtgatcgagggactacaaagtatgctcccatcaaccgacagatcagacgacaagggaaaagaaccagaagttctagaagatgagattactcccgtcgacatagtcattgcacgaatcatgctctcaaagggaaagaagctacctccagatgttgtcgatattatcctcgatttcgcagagtactgggctcattcaagcaatgaagttgactttaaacttcaacatcagaatcctctgactgtcaacggtgggaagtcctactcagaacaaatttgttcttcggtcttaccctgtgggtctaactggtcttcaaggcagacaagcgctcgctgagatcctggcgtatgacatgactgaagcgaacctcaaaagttgggagaaa

SEQ ID NO: 2760 - DNA, 588 bp, Fusarium venenatum
  misc_feature (1)...(588): n = A,T,C or G
atcctcttccgcctctcgggaaacatcactaccgtcaggcattggattgcggtcccaagacctcgtggaatctgctgtcatctcccgttgagacatacattcactcactcgctcttggcttgtagcaatcggtcatcgccggtcttttacaatcgggacaggggtacgcgcgactggacaagaaangacagggcaggatctcgacgactcggactaatcatttgaccatttccttttcactccgtcttggtcttgggttatttcccgtgccaaatgcttgcccgcagaancatctttgaaaactctcaaccacacgcatttggcaccatcgccgctgaacgtatttgcccatctgcggctctttgcgtctcaacatacatggccgacgacagctaccgaaaagantatccccagcacagccgccccgacgacagtcatcctcgaactcagtcacactatcctccaccaccggatactgcccagcgtcttccgacgctcctccangcaccatggctacctcagtcactttgcctctatccatgactctcgcngttacnggccgccgcctgcactccnggtcttgttatc

SEQ ID NO: 2761 - DNA, 623 bp, Fusarium venenatum
  misc_feature (1)...(623): n = A,T,C or G
cttaggttcgtatcatccatacctattaatttgtttgaggcattgccactgtgacaggcacatttatcttggccgccaatctgatatcacggatgccgacctgccaaacacgtttatgaaagactacttgcacgcggacagtgatattaagagatcaaggaagcgaccgaaaatgactagtaatgcgcctcccaagctgtccagttcaaatatccaagttaacgacaacacatcacaatgcttcaatagagtatcgagcataccgacgccgttgagcctgcgagtctccgattcccacacgaatagagataataaaccaagcccnttagccccaaaaccgcagatgcctgcaaagaagancaacccgatatccgttggttcgacggtgcatggccttgccaaagtccacaccaggtatggtcgctagatggagcgttgttacagaaggaagagtcatntcaaccccgggatcctcactcaaatatatgtcaggnaccacgattgggagtgaatatccttcgaatcctgaccccttttttttgaaatattcgacaatattcgggtggncccaatcagatagcanaacatgctttctttttnaaccccaataaaanggccgccaa

SEQ ID NO: 2762 - DNA, 618 bp, Fusarium venenatum
  misc_feature (1)...(618): n = A,T,C or G
ctcagtctcgacattggttttcctcaaggggtggtgttgcattgacctgtcgtcatcccgccgcctcctccttctggctctcctcacatcaatacagtacttaccacctaaaccttcgtcatcctgcacctcacttcacctcaccctcatttcgcatcatcctacatcaattcctcaccctgacttcacacctcgcatcctatcatacatggtcgatctgccgtgatgccgctatagtgatttctagactatcgcagctcgccagcagtggtacagacacccctgctcatcattcgattctcgccgcgtcgaaccatcatagtatcaactgcaagacagtttaccactccaaacctaatctttctcacttgatcggccgcacctctgcactgtctttaatcactaactcagcgcatcaaaccttaccatgtcgcccaaaacgccggttaccatcacttacagcaagcctggaatcgtacctccgttttnctcgcangctctttctcggatccacaatggcactncaagagatggaatgtatttctgaccaaaatggagagcatacgttccaatctgaagntatgcttgagcctgaacaggataccaattcaagcttnn

SEQ ID NO: 2763 - DNA, 629 bp, Fusarium venenatum
  misc_feature (1)...(629): n = A,T,C or G
ggccgcaggaatttttttttttttttttttaatcgtaaagtaccatccgtatgcgtntatcagccttgttccaccctcctcgcaggcgtgtcaacgacgccaagtagacacaagccgccaaatgaataaaatatcttcaacttnatctntgcgcaataaatgtgaatanaaaagcgcgggcacctgattctaccactgcacttccgtaccagttganaatcagccatacctccaaaacataacaaatcgtctcaaatgcagataaaccacgccgaacctccaggaccgtcccttgaccgacaacctgatgctcataaatagaaatcggtaactccccaaaccacntnttgtcaaagagcgtgtatgcgtaaactccaaaaccaaaaccaagaaacaaagcgatccancgactgaacggatatgccgaaaccctatcggaaggnacagtgccgaccgaaggggctgncattgtcaaaatagagaggtaattaccggatcaaggaatcgcatggngacgttccatgatcccaaaaatccaccgggtnntccaaaaccagngttaaagtttgnnttggtgcaaanancaacgaccccccgggtgttccnatatantacaggggggtttttnn

SEQ ID NO: 2764 - DNA, 269 bp, Fusarium venenatum
ttttggttcatcatgacatcgtcttggtatctgtaccacaacagtcggctaccgccagatgatacatggatggtgccgttcagcgttgtggacacaattggtatggacacagcccagaaagtgctgcttgccagtggcttggtcttgaggtttgcagttggcattgaggtgtaaccatcttgccgggggtaaagcgagcctaaatttgcattcaagataaatactctacatagatatctcaagtaatgcagacgataatttgtctccat

SEQ ID NO: 2765 - DNA, 593 bp, Fusarium venenatum
  misc_feature (1)...(593): n = A,T,C or G
gcgcccactttccgttgtgggcggtagatctaacttgcaaagaaaagtcccacgccttagaaaagcttgaaatgatcctcatttacaaaagaatgcatagtgtctacttctcacgtgagaaaataccacatggctcatggattctctaactcgtgtgatatctgatgttgcggacctgccacttaggagcaagcgccttagaaaccttgcagtattctatcaagatatgccgagattggcagggaatcgcctacgtgctgcagggtcacggtatgaattgatcagcctacacgacgcattcaacgaagactctctgcgggactgccgactaagcaatgaaggacgcgactcaggtnagcatctccgaaggtgttgaacttcatccagattataattttatcctgcacccatcgcaaacggacctgaattttacgtctataatttaacggcaacgatccatttccagggcacagggggattatgaancagggcggctgaatgggtttctcctgaccattcaaaacatcgactcatcgtcacacgagactggcggatgcttacacggcattcatgtttcaggtggcacaaataaa

SEQ ID NO: 2766 - DNA, 341 bp, Fusarium venenatum
  misc_feature (1)...(341): n = A,T,C or G
gagaaagagaaataatcttggttgtggcaaattgacgatgcattgctctctcttacaaggcaaggcggggtcccactatctatctggccctgcattaaactggttgttgagtctggaacctgagctgaacaaattcgcctatttacacttggacccttttgcatgtttgactttggctttggctctgacaatatcaagtcattctaatgcgtgacattgtcttgtcttggaatgggctgcatggacntttatanaattcgtggcacttctagcgggacngcacatgcgggcgatcatactaaaaagcgtttaggaatggctactaaaaggacgtttgttgt

SEQ ID NO: 2767 - DNA, 159 bp, Fusarium venenatum
  misc_feature (1)...(159): n = A,T,C or G
nccctgttnacntgtggcttcaacactggccctgggcggtanattggctgtgcggncctcaagtgtgtnttgaaaaggaaaaccgncccggaaatcaaggtaggaaccccaaccttgcangggacttccatncacgcaacanacagtggctggggaaat

SEQ ID NO: 2768 - DNA, 517 bp, Fusarium venenatum
  misc_feature (1)...(517): n = A,T,C or G
ggctctgagatctggaagtatctagcacgagctttctacggcttgagaacagcgacccgccgaactatctggggtgatcgcctcttcctacagttccacggacctacaaaaattctcatgtctagccgaggtgtgcgtgcttcagatgtactcaccaacaagcaagtgaatgagatcgccgactctgaacccggcgtgctctcccaggctgtcgagctgagcgacaagcccaagctgacagatggtgccggacagggactggatgataaatcccgtgactggaattcacgttgccaaagtttganaaagatggcaanggcaatttccaaaataacaaggaccttaaggagtttattccgatgaaacgatgcatgtaaagaaaggaaaaagccaatgagccgatttacatatatgaaaaaaggagagggaagatganccagaagttttttccaccgttgtttatgtntgaatntcctcatagantggacctttttgtttaattttcagagttgaaaaa

SEQ ID NO: 2769 - DNA, 955 bp, Fusarium venenatum
  misc_feature (1)...(955): n = A,T,C or G
gtcaaaggttggacctgctgctaacaaccaccgctctgctttgttaggcatgtttcgtaaggatgaccaaaaccaacctcctgctcagtcgcctcacgctaccggacaagctgctccaggtagtatgatgagcgaacttatgcgatctgtcgggggagacaatgtgaggacccaagcttctccacaaaccagcgcaggcatcaacccgtccatatctttggagggcttgtcccttcatccacgggctgctcagtctagcacgcccggggctcccaaggaaaaagccgaattatgcgcattatgggcgctcangtacaaggaacagccgcttcgcaacctactcaacccattcgaattcttcagcgaagacaaacagaacagtttcttggtgttggtggancatcngcatctcctcaaacttcttttgcttcacccagtggattatccgcccacctacagcccgcacgtnctaatgtcagtcccagcattgcgcaagcatccctgcgttcaacacacgtcgcgaatctggcccggctcaaaagcgagagctactttcactctttgggaaaacagccatcgcctgctagtttggaagcagccaagggcaaagaagtcattgctggaacgcccgggtctcgccttgcttcattagcctctggcacagaagaactgctggtccaccttctcgtcgtgacagccagacacctatctcacccgctgaacntacatttttgcttgactacttgcagtctgttacgaanaatgccaatcattgacgggttttggaaacgtgaattatttgtncgaattgccatcattgggattgaagaacatcccaacngaccttgtctgggacctacnggtttccangtttctagcaagcaattaattgctaagcaaaattacgtaattggtatcttgaaaatgcattcattctgtcaatattntcaatccg

SEQ ID NO: 2770 - DNA, 154 bp, Fusarium venenatum
  misc_feature (1)...(154): n = A,T,C or G
ncctcactgcacngcngagtaggaanaaagacccctntacctntcttacacatgctaacgcttgcaagccttaccgtttgtgacntgggcagggacacattattgngaggggctagtttgtgcgagcccgaaatnccctttgacaaaggacgct

SEQ ID NO: 2771 - DNA, 107 bp, Fusarium venenatum
  misc_feature (1)...(107): n = A,T,C or G
ncntacgacgcgggaaaggaagcatcacgccgtgtnaaaacagaaagacgggggcaanttatttttcactatntgccaaagntaattgcttatttttacttggattc

SEQ ID NO: 2772 - DNA, 335 bp, Fusarium venenatum
  misc_feature (1)...(335): n = A,T,C or G
ctgaaagccattcttttataggaagttgtggttgtagatagtcggcacggcgccgcttctgccatgggtctttgcggggcgcacttatcattatttccattgcacttggctgcaaaagtctgcgatcacgacagcgagactccactctttcctttcttccttgtccctcgacatgctattatttccttttaaggcttcttgtcttttttgctattccttttcttcatcttcatcttttttctttctctcttcttaataacactcgggtnggtctcatctcatactaaagactcaatcgccgttatgagtccgcaaaagaccaanttcccccccgg

SEQ ID NO: 2773 - DNA, 204 bp, Fusarium venenatum
  misc_feature (1)...(204): n = A,T,C or G
ntatcacaaggactnaactggaagaccgagcttacatggaggaggttgcaatgacctctggagatggttgagacanccnaaggttacgccaggatnncctgcgagcttatggagctncaagttttcaagctaagtatacanattggtaccggttgagncaatgncctcatgntggaataggtaccgattaaatgtgtggttttn

SEQ ID NO: 2774 - DNA, 766 bp, Fusarium venenatum
  misc_feature (1)...(766): n = A,T,C or G
gaacaatccattctcaacgtcaacgtccacacccccccccccccctgcgtcttttctggccttatcagaaacctggttcctctttttactcttgtcctctcttctttcttcctctttcttcaccgttcgtcttttcttcattacagctaccatagttttttttatcatcccaagcgacgtcgcgtgccgcttcgggttttggttctgcttcttgtgtccttgtaggcacttttcattccctctgaatatctcaaagtacgcgcgtcggaaaatantcgcttgcccacaatgttcggtcaagtgcgtacgaaccggtcgacggtccttatggccggcaccgtcatcttcttggtcgcttttgttagcctggcctacaaccatctcgacacctgggancctcctactgatgtcgctaccgataccganacgttcatcatcggcgangcccatgataaacctcnccacganaaacctgcaaagantgagcctcaacagantgantntaaccacggngccatgttcaaagcccgaacaagcttccaacgcttccaccgagcttggcgactactacttaactacttattgaagtccaaggttaagcctaccgttaagaagtacgcgcctttggggggtttcccatggagctnccggtgaggccaattggaccacatggtggcnaggacttgnattttcganttggcaaccgncctttaacgagcccggcaaatttttttgaggnttgatgaactgggaccgcntacaagtn

SEQ ID NO: 2775 - DNA, 258 bp, Fusarium venenatum
  misc_feature (1)...(258): n = A,T,C or G
tgacttgaagcctctccctggtccctttctcatgacccttttttgtttcatttnccctgctctgtcttttttcctngggacctgaagtattattcattcggctcctntggttctacaacaagttctactaattaacatctcatttccagtcgtctntttttttcctctnggcattttgacacgatttctgtattctgctctcgcagcaagtggggatagnagggaacccaccaacnccgggctttaanatgtttgcca

SEQ ID NO: 2776 - DNA, 168 bp, Fusarium venenatum
  misc_feature (1)...(168): n = A,T,C or G
ngataaaanctgncgggcngactccccnttcaactccagagantcagncaacatagacnatttggcccnanagctacaccaatttgaaccccccgnttgcgggtgcctatgttgggaaaatantttcttnacaanaagatatggcctngggtgtanttggagtctatg

SEQ ID NO: 2777 - DNA, 168 bp, Fusarium venenatum
  misc_feature (1)...(168): n = A,T,C or G
ntgttnaattattccaagagttggagacnattgcaaanaatgctggtcacttgcaaanctnttataatctnntcttgatcaagagaatggaggtgntaacagttttttcgaagaaaactatgtttgtatancccnaccgctangggggttgcagatntggacnacccg

SEQ ID NO: 2778 - DNA, 768 bp, Fusarium venenatum
  misc_feature (1)...(768): n = A,T,C or G
ctcccaaacatgattctcggttccagcattggcgcatggcagggctctcgaatcctcccccgcgaagccaaggaaacgtgccgcaatgacatgcagtcagatacctgcgagaaacccgccatgtcaacaggcgaactattagtcgttcttctcatcgccagttctattgtcgtctgcggtattgttgcccttttgtgcgtctttcaccgtcgcaaacaacgcctcgataaactcgaagacatcaaaggtgttcaagaactcgatgactacggcctcgcccccatcaaaccaaggcctgtacaactaccccaagcaccaccaccgacgtatgacaaaacgcacgagggaaaacccaacgtgacgacagatgaaaattgggatcggacaaatcgaaactctacagactcgttaacaccgtcacttcgccaaagccatgggtgtcactgcccgcgatacactgtccaatagctagaaactactgcgcattggaacgttttagcgctggtagtcgagctactgcagnctgtcgatcacttatgcataatcgctaaaaaggcgaaacgcatcaagaaactgggtcgttttgagacaggcgctacgaatctttgnggncattgcaccccgcactttgacaagtagacggngattacgaggatngggataggatttggtatgggttactatggggttaaaangccatnggtnttggtagggtcctggtttgggnaaaggataacgattntgccgcggtttgaacggttnctatta

SEQ ID NO: 2779 - DNA, 826 bp, Fusarium venenatum
  misc_feature (1)...(826): n = A,T,C or G
cnngtctcccgttcctcatttgatctttggttaagttaaaacgtaatcatcatgccaaaagcactttaagcgtttggactgaagtacccgcttatacacccttagacttcaggcccgaacaggagttagaaaaccagacgtcaggtggcccaaactttttaccttccnttctngagatcagtctacntgttccagcacgttcatcgactcgctgtagttttatctgtccaaattatacaatcgtccactcccaatcgtatcagtgttcaaggtatgtacaagctcagttatttccaaagccgcgtctgcctttgtttcaccaccaaaagctctctggaaaacacaagctgggcattgatcaagctgcaaaagagaagcaagacgccttccaagcaaacattggacatttgagcactttttgggggccaatgctaaactattgtgaccccaattgggatcttggaaaggctgtctgtctgaccggaccaacgccggtattttcggtctcttctcgcctttgttcattctgctttgtttccccctgcgcttcctgtttacaatggtcactgttgcccacgggtcaatggactgggtaagacttgaggtgggaaggggccatgcaatgtcaaagaaccactggcgtgggcatgccccttgccccntcaatgggcgtgatcctgagcaaaattgtgnacttnaacatcggccatgntcgttcatnggtctgntgtntggtnacggcttgaaataaccaagagtnacggctggcccggcaacctcatagttaatngggcccatgaacttggnaaccancttgntccaacca

SEQ ID NO: 2780 - DNA, 443 bp, Fusarium venenatum
  misc_feature (1)...(443): n = A,T,C or G
ccgattcaaaaacagcaaatttctggcatcccttttacatcgccattttaacagcaaatcgtttgttcttacaaactaatgcgattcgaacaaagataatacgaagccgcaacaaacggcgtacgcctcttccaagacgccctacctacgggctactatctcctggaaagaagacaccttcgctcttcgctaatctttaacgaacaaaaaccgctttcaaccccaacgcttgacgtacgattgatatttcgtactttacgactctcaccacacctagcgacctcagaacaataataaaattcgatgcccagcgcaacngcttccgganctgatacnggtggttcgctcgatctcgcgatcacaagcagggttaccagggacgaacctttacccngaccaggaagcaccagttttccgtntcnaaaatgcaacccntgcctttt

SEQ ID NO: 2781 - DNA, 130 bp, Fusarium venenatum
  misc_feature (1)...(130): n = A,T,C or G
nngtgggacctcttgcngatggttatctcgncttttgnacagnacgattccctncgttgttgttggtatgctggaatgttgtctggagcatncgctgggataagaccgatcgcttccgtgaatactacga

SEQ ID NO: 2782 - DNA, 632 bp, Fusarium venenatum
  misc_feature (1)...(632): n = A,T,C or G
gcgatggtctgagcaagtacggcagtcccatcggaaccagccccagccgatggggtcccatgttccagcgacaaaaggaggaggaagaaaccgctcgatcactccggggtgtctcggcttttggccatgtgggtagcccactccgaaactctgttctctcgcaagagatgggaggcacaaacggcttcaaccgcccatcgtctttgcgatcgggaagcgacggcatgtctatgctttcccaacaacttcagcgaactcgtctcgatgacactaccagcaactccagccctcttcttcacccctcaaccgccgggctggtaccaccgctagcgccattaaccccattagcccgatcggcanggaacgtgagcgcattgacgtatgtgtccactgggagcataagtcnttcatgaacggcgattcactattccatcacganggccacgagatgttcacatggagggtatggaagacacggcgattttgcaatcaagtacctaanaggaccgaacttggcttgccggatgaacgtntgggcagtttgcctncgtngttggaaagtccagtccaacggaaccaaggtgtcctgtangnggccgttaacgactaggcttgnatgcggaggganctnt

SEQ ID NO: 2783 - DNA, 504 bp, Fusarium venenatum
  misc_feature (1)...(504): n = A,T,C or G
aaaggattccacagtcggccgcctcagctcttggtctcgtcaagagagacccgaggttctggtcgatcagttggttgacgtatcattagtgatataggcgagcatgcgctcgcagcaccattccaccgtcacaatccccattccgcgccatattccaccccaggttgttctcgactacatacagacatatgaacctatccttcggcacaaccctggcatggtatcatggtcgccatcagccataaactatgacactgtcattcatgacacctttttcgacgcttcggaccctaaccagagccttcgctcctacnaagcctatgagatcgttaggcttggtccgggggtgggaagggattgcagatggcccatcatcttcagagagtacctaatggaatcgtgtcgaggactgatgcncctgcaaaggtcatcagctggactcagtggtatgtgagaaccccacaaaatgaacaggaagcttccagtgtttgggacccctagtac

SEQ ID NO: 2784 - DNA, 461 bp, Fusarium venenatum
  misc_feature (1)...(461): n = A,T,C or G
gtccgaatggaccaatgtctgcacatctgggatgttagtcgactgtcttcaatagacaaaaacacgaaaggattcccttcagacgcaagcaatattgcanacccgaagacccgtctagaacctagcgtctctgtgtcgagtatnaaattcttcgaggacagccctcaaactcttgttgtcggcatcaaggcacaaggcctccggatacacgatcttcgcgatcctggaagcattgtgactttccagactaaatgtaacaacaacctcacaatcgactacgccgatcaaaactactttgcttcatctgcccttgaccatcctggtgtaatgatatgggataggcgggctacatcacggcccgtggcatctcccacatacatgcaagccatcgaaaaanacaagcttccgnggggnggggcattgcgtcttgatcaagtgataaaaaccgattctgacccttt

SEQ ID NO: 2785 - DNA, 352 bp, Fusarium venenatum
tcaccattccgcccgctgaggtagagaaggaagattgcatgaaggaggcccctgaggaggccgttgctgaagtctaggagactgagcccctcctccctggcggaccgttggtaatgaagaagtcgccggaatttctcagactcaattaggcgccacccaaatgggtcatttccaagccactcctggcgaatggctgaaacaagaacatgaagaactggatcaggatagacaaaaaagacttggtgcaagacacaaaatgccaggatatagaaggcatgcacgtaataggtgagtaaccgcaagcctagataattgaaggctcgtctagagaataatacacaaacgtacagat

SEQ ID NO: 2786 - DNA, 194 bp, Fusarium venenatum
  misc_feature (1)...(194): n = A,T,C or G
ntngcaggganttgggggancaagcntgagtgtttnttatatcanggatgcaaatactatgggggcgcactttatagacatttagtggcttcataattgtacagacgagggcgtgccagtctagatatcttggaatattcatctcaactttagttaataggnaggcatagttattcaggtcttgggaactaaac

SEQ ID NO: 2787 - DNA, 590 bp, Fusarium venenatum
  misc_feature (1)...(590): n = A,T,C or G
catattngagcttataagtggntgcatatgcccacttttgaatccctgctngaatatngncatacttagcggatacctaatctctcaacatnatccccatccctcataatcaaaagataatcaacgccatgtgtttcggaagtaagaaagaagagaacgatgagccancgccccgtcggtgcagaggccancgtcatctcaaagtcaaggcgatgtgaagaagagnagatacaacccttaaaacgatcccaaccaattcgcgggagagtctagctattcagcgcctccaggaccgctcctgatagaaaacaggcctcagactttgngccacctccaggaccaccacccggtnagtcttnatcgcagcaatactctgnttctnctgggccgncgccaagtaaggtgggagcacagtacgatgctccctaggatctccctaggacatggatcatcgtnacaacaatcngatgcttcttnggggccttcttcaggtnaangggcggnaccagaatatgcgccttcnttttgggacctccaccaaacatgactgggaggnagnagtccagatacataatatttccacacctctg

SEQ ID NO: 2788 - DNA, 124 bp, Fusarium venenatum
  misc_feature (1)...(124): n = A,T,C or G
caacgccgnattntactaatacncttggnggccnatctcttcactgcanggatcacanttctactatncantaaccntgcgagnttacttctacgagggttttncaggagaccantgcntcccc

SEQ ID NO: 2789 - DNA, 554 bp, Fusarium venenatum
  misc_feature (1)...(554): n = A,T,C or G
cgtctcttggccgaaaccttctctgctgccgacatccccgtcttcacttacctctggaacgtttacgtcaacggcctccctcctattctcggagccactcacttccaggaggttgctttcgttttcaacaacgtcaagggtgttggctatggtgctaacccctttgagggcaagcctgaaacttttgttcagctcgctgacctcatgagcaagatgtgggttgcctttatgcacgacattacccccaacactgttgagactgcccctgcgcatgtcgcctgcctcagtactcactcgaggaccctctcaacattgtctttgacgttaacaagactgggctacctacactgccgtgacgacacacataagaaggagatttctttcctcctcgaggatgttttcgcttaaacaaaagtcgtaagcgctatagcatattgaccagatataatgtgtaatgggccttgttcttgctttcacccagagacatgtttttaaaatagactanggtaatctggcacccttgtattcataaatagactctgaaaaaacctttt

SEQ ID NO: 2790 - DNA, 472 bp, Fusarium venenatum
  misc_feature (1)...(472): n = A,T,C or G
ncncagggttttcttttccagtntagtnttgtttttggatttttgtttnggggtcaatcccgncaaaaaagaccanagaaggcagggacttgtttgaagcatggaacattctggaggcggnaaaagagcactccaagcctacggcacgtatccaggaccttctgaggcaggtgatgaaaaaacacaaggtgcctttgtcaatgttgaaagcaagggaacggcatctccctagaccagngggtagaaatcttccacctacgcctaattcgtcaacggcaatgatgtcaacggaaacaacgcccagtgacgttggagtttcttctcatgagttgagtgatatcggattgaacatgaatttggactcgatggattgggaaaatcttntntggggcttggaggctcctatgttctgatcaatttatggatagnaaattctaggnaggcattatagatgtgcatcggagaaccaaaa

SEQ ID NO: 2791 - DNA, 406 bp, Fusarium venenatum
  misc_feature (1)...(406): n = A,T,C or G
cgcaaagaccctcagaagacttttgaggaagaggagcaacgacgtgcccaacgacacgaggatgtcatggctgtgggcagtcttataggagccggggcaaagtcgggatcttacaaacctacacagagctcaccagtgagtaagtcgtatctagcggatcgcatgtctaaggattcgattgcccacaagctcaacaagcaggcctcgacgcctgggaacggagaagaggtcggggaaagcagtggtcaacgccaggaagaacagggaaggtcctacgggactctgtcgtctgtcattcccggntttttcgttttcaagtctcttgggccaaacnagcgtcttatcancatttccngaaggcntggtngcgcccgcaccaatgggnncaagaacatngntgtaactt

SEQ ID NO: 2792 - DNA, 605 bp, Fusarium venenatum
  misc_feature (1)...(605): n = A,T,C or G
gcctgaagacaatttgagacgaggagaattatcatcgactctcccatccactcacccaaccacccccaagggcttctttcgctcaacatctctccctcctgcggtttccaccctattaaatctaggccaggaaacaagaaacccttcgaggctgtgagacgaaccgatctagaaaaggaacagggaaaaaagtgaatcaaaaacacctttactggtatttcgcttttcgactatattctttttctcaactgccaattccttccctccagcttgcttgactgtaaaattcctcggttgcgtctcaaacccaccaggaattccaatctcaactgaattcactccctctttcgctcccgctttcgctcccgccgccgacgaaaagcctcccatcgaagtgcccgctcccttgattcacttcatcgaagcaacgaanaactagttcgccaaccaaattccccagtgacccttcggaccctaggaaaggagaactatncgacaagagagttatccaacttttcagccatacgcacaatcgcaatcaacccgactgtcgactttatcactgnaatttcgggcggactgtttgggtgaanccanaaagttac

SEQ ID NO: 2793 - DNA, 314 bp, Fusarium venenatum
  misc_feature (1)...(314): n = A,T,C or G
gacttaaagatgagctgccgagttgagatgcaaggacatcaattgattgaggctggattgtcttggttgagggtgancctggtggtgataatggcgaatgggtcgatgtcgctttttcggacatggttgtgtctgtgatggaagtggacgcagtgatatcttgttgtggtgttgcctctgtatctctctggtgacgtgctgtgtgaggctcgcacatggctcgagctaaaggctggagatgacctgccccatcaaggttgaaagagatagagatagagtggttgaatgattgattgaagaaaaaaaanaaaaca

SEQ ID NO: 2794 - DNA, 556 bp, Fusarium venenatum
  misc_feature (1)...(556): n = A,T,C or G
gaagttgttgttgcggcgaggtaatcaacacgattcagtgataacaatctcaagacccaggcgacctcatcccacgcctggngacgaaactcgccaatgggattttacgattttaatgcccgaacccttttaattttcgaccttatacttttttttctgataacaactttggcattcatcggcacagcgaaatggcgcaatgcgatgctttacaacggcagatactggattctgacgcagggccgtcagggccaggcggcaacctttaataatgggttcaaggggccatcgatgtccctttctaatgtatacctgcggaaggacaaaaccggacctgaatagagtaatgtatacaaacaagaggaggttaatatgtgcatggatatgcgatcacgccatgtcatgcaccgattcgctcgttagagagcttggatgactcgagagggacaggctttacaagctcccctactcatgatgaggaggaaacaatgaacgaaagggaaaagcggctcgcttgccgaaacctggtcgatcctgganaaaaaaaacccaggcg

SEQ ID NO: 2795 - DNA, 267 bp, Fusarium venenatum
  misc_feature (1)...(267): n = A,T,C or G
ntgtcatcngctacctatgttcttgggatctgatactgccaatgttcgataccgggcttggtttctgattggcancacttggatnggtctnggtaccatgaccaacgcttacattaatgccnacgttggcaagtgatacccggtcgaacantgcnatttggctnaacgtcatgtttggcacattngngggcttatcgctactttggncnttaccttgaaaaaggataacccaactaccccattgggaacaagattaantgggccgcc

SEQ ID NO: 2796 - DNA, 574 bp, Fusarium venenatum
  misc_feature (1)...(574): n = A,T,C or G
gcttgatgtttncagcttgtccttcaacgacaccgacaacttcatcaaggtccgcaacttcacccttcacaacactggtaaggaggaggttgctctcagcgtctctcacattcctaccaagagtatttacaccctcgacaaggacagtatttatgcttcttccttcctcaacgaggctgtcnatgctcatgctgagctcgagttcagcngaggccaagctttccattgctgcgggtgagaangtcaccattgaggttatcccttctgctccagaangtcttgacagcaagcgtcttcgctctttggtctggntacgtcgccataaacggtaccgnaagtatctctgtctcttcctttaccagggctttgacaggttctctgcaacgattctgttgtntttagggaactgacgatcatggatcgncaagttcaacgacaanggacaactttactccctgtccccgnncaacacgactttttnattcttcccggttaaaggcccanaacgccactgatgnttnagcctggntcccgcttctngntttggatgctttgcgcttcggttnaagccaaa

SEQ ID NO: 2797 - DNA, 157 bp, Fusarium venenatum
  misc_feature (1)...(157): n = A,T,C or G
ncaaagtccggcccanggttccccgctttnttanaatacnctccccnggggaaanantttttctacaaccnccnatcttgggggtcttttnttnataaaattgccattnttgnttttanaattcagcaccggtttccnccccaaaccntttgggtnt

SEQ ID NO: 2798 - DNA, 603 bp, Fusarium venenatum
  misc_feature (1)...(603): n = A,T,C or G
acggcagaagccaaactcatttgacgacgacgagacgaccaaagctgcttataccagtcacgcctcgtcgctganacgattctcgcctcgacctttcgctattaaacattttttacttctttctttgtctcttctttcgccttattccgttcgtaattcgccaatttccgtggtctcactcgcttgccatcaaaccaaaagtctattcaaagaataacctcacgcactctaaaagccaacggctaccgctttcgccgactgttagttgattaaccgccttcggattcgcatagtttcgactgtttaagaactggntggttcgcacaaacaacgacaaccatcttccgaccgaacgttccgactcgatcgctggccataataatcgcaactcctggaaatagtggcgncacgatgtggtcttgcatcatgaagccattggcggcatcgcctcggnggctgctctggcatcgcccgtctcgggtganaagattctntactccaactcctcaacaggtgccaaaanggacaacggattcaaagccncacnttttcaacgttgtttttgacaccaaacaacgggntccgctacgttaanggcggggg

SEQ ID NO: 2799 - DNA, 559 bp, Fusarium venenatum
  misc_feature (1)...(559): n = A,T,C or G
cggcttgatcctcatgggcagtccttatcgcgacatcgtggttcgcactccatggtcgtttctcgcagccaanaaagtcgtcgtagttccattgtgaccccagcagtcagcgtcagcgacgcatctgaatcagcagatttgcacgagcggcgaagttcacagagtcccccacttctcatgccaccacccaccacagcagctgacgcattgaggcgaagagcgaccatatttattctccatttcatgaatcttgcaggctcgcactctccattactaagttacatcatccgcctgggcctatttggtatcaaagngacaaccctcgtccgtccttgctggcccctcatggcagagctgaacgtggntattcctctcatcggcgtagcggctctggaccttggtctaccgcaagtaacaagctattcccaatgatgatacaaggccacggggactatttttcaaagtggaccacccncatggggactcggtatgancctaanttctccttgngtttcacttcacngggctgnggggttgcctctgggngggaaactttttt

SEQ ID NO: 2800 - DNA, 582 bp, Fusarium venenatum
  misc_feature (1)...(582): n = A,T,C or G
gccattgagtccaacaagcctgtccctcaacacgccatgcctcttctcgtccgaattcttacccaatggccctattcagaccgtctagctggcctcgatctcctccgctgcgtggcaaagtatcctcttgcgcacaggtctctgatccacagngggctctnttctngaacttggttttgnataatttntgcccaaaggcnaactccnaangagaacgcagncatgangggccttngtactttcgnaaacatnttntccaccgccaanggccgctcgattgngagcgctnaatcgggatgaagcaatctnattcttggagcgcgcgttggngtatnatccganctatgggacccttgaaccgaacgttttattgnggcaccaaagaagaataacctttagttttgnacaccgggagcgtttttnatccgaacaacggggcgctactatnttttggacaatcttttttggganggnagaggattaaaagtntaaccggcccttggggggtngganatggttttagataaanatgancagcaatttggntaangggggaccaggngtgagaccantaaaaaangt

SEQ ID NO: 2801 - DNA, 193 bp, Fusarium venenatum
  misc_feature (1)...(193): n = A,T,C or G
ngccangatttnttcngttttccaagccagtttnaaatngggnacaaagggantaaaanccgggnaaccagcnatgttntacttgagtttgcaanagaaaaagggtttggagaaancttntaaagtngaaaaccccaaanacttcaaggaanccgcangtttttttaaaaaggccggtcggcaggattnggac

SEQ ID NO: 2802 - DNA, 353 bp, Fusarium venenatum
  misc_feature (1)...(353): n = A,T,C or G
gggtcagcgaagatagccagaatgacagcttcaagtcggggngggcgggccgttcaggctgtgctatccacttctcccaacgtctgcgctcgatgcgcttcttcatcctcctccgccctgcctagaatccctgcacgactctactcatccgtcgctgcagccgtancnaaaactcccaccgatgcctcgcctccctnaaacgcacccaactcgccgccttacnatgttcgttctggagtgattcttactcgaccaccactggtgacacggaaacttcacccctttgagaactccttnttnttttaccanaagcgtctcgaggaacgtctcaacactcccttnatcacgggcat

SEQ ID NO: 2803 - DNA, 537 bp, Fusarium venenatum
  misc_feature (1)...(537): n = A,T,C or G
tgggggcatggggaggtggaggttccgtctgatcgtaggacggcggtggtagctcttgatggggatcgtctgcatgaggggcgggcaatgtgacnattttggcgcccgtgccgctaaacatgctgacaagatcatnttgaacaacgagcgagacaccgctgccgacagcatcgcanacgggttggagttgcgccgttaatgtgcctgagtctttgatatanattgaaagtacggtaatgtttgcaagttcgtggatcgcgtctaggactgtccctgattgtgcgcgcagaggagccagcggctcgtgagcttctgctgaaacgaggacttcggggtgtctattgaggcggaagtcgaaacaaagggtactggagtggaatttgtcccncacaccactaggaattgtaggatttggtatgatttcaaatgaaaaaatgaatgaaggagatnttcttgaggatcaaaagtcgggccggtctttattccttgattctgatgggtatatttaactgaaanaatntttctnttctttccaac

SEQ ID NO: 2804 - DNA, 563 bp, Fusarium venenatum
  misc_feature (1)...(563): n = A,T,C or G
cgcaaaacacggcttatctagggaacgtcacgcgttaacgttcttctactttacactcacacacagaatctgactcactaaatcaaatgtcgcataccagcttaaattgcatttacattcaagcttggtctttgactgtttgatacaacccattaccgcgtctgcaacctataccagagcttgcgcccctngagaactccgggtttctttnntttcgcagcgcatctctcgttgcatcgcgaactatttttttacatttctnaaattttcgtcctttatctcgacctgcctgcctaagtgaaagtgttttgaggcacccaagcactcgccaaaaaaacatgacggagatcgaaatggatctcgatatggccaagtcggncttagacggccgaaacgaaaacgagatgatcnattttgacaccgaaatggcagactcgaatcaagactttgagaagttggatgttaatctcgaaggtgcggatagagagatggaaaaagacgagnatgttgtggaccacccntcttacaaacnaaacggnattataggcnaaaacctcnaattt

SEQ ID NO: 2805 - DNA, 427 bp, Fusarium venenatum
agaacggccagctccgaaatcgcatggaaggtttcgagatgatggtaatgtctcgagatcagggaccaccagcaggcgtctgggcatagactgtgtttacttgattatcttgtgcacttgccctagacttgtttttttagaatatttgttttctttttcttttgtgcgatattatcttttggatcgacaaactggaaacgcaacgcaacgcttcaagcttgtgtgattgacgaatcatgatatccccggtgtttatcgtttttacaaactcggcgtttatgaggatatgggaaaggcattctgatgatatcttatggcgtcacaaaagcgagctctgtgtgatgagctgcttgaacaaaaatatgggcattccgaatggaatagtataaacaatatccaatacacatttaatggtttgcaaaaaaaa

SEQ ID NO: 2806 - DNA, 554 bp, Fusarium venenatum
  misc_feature (1)...(554): n = A,T,C or G
ttccctgagaaattcaattttattgctgttcagtttataatggagatagaaaagattcccgtttcgtggagtgatcagccaaatccgataccgaacctccgtacacgaaccttcttcatcacggaccatccacttgacgagaaagaactgaagaatgggcttgaaactttgattagaaagtattggcgaaagttgggtgctcgtttggtctcatccgaaaagcaaggtttagagtatcacctcccgcatgtgttcctagatggttatgagcttttcaatggtcgtcagtcagtgctgggttttcctacngcgaaacatacnaaatgtcgaagatcattcntccgggagacaatatcgcgttcctaccagccgtggataagattgacaagctggntcgggctccagactgggcttttgagcgccaagatgatccaccccactctccgctgttgtttattcncttgaccaatttccacnacggagcanttttggggatcagtgttcctcacgttcttgncgatcagggggggattgggccatattgtcaaggttgg

SEQ ID NO: 2807 - DNA, 751 bp, Fusarium venenatum
  misc_feature (1)...(751): n = A,T,C or G
caaaatctacgcacgtcaagctttatatcgactcattccctctagctgccctcttatcaccaacgtctcataacatcttccattttgcgcctgcaaacaaacaacaacctgcgatttcactacagcaggataaccatctnagaattgcgacatcactacaacagttgaataacgatatgcagatcactttgaacaatccaaccataccacagctaaaatgaattcacgacctgtgaagcacattgatcgcgaggatctctacaccaatctagaagctcgtgttcaatatttacactcattcctcgacttttctagccgagacatcgaagctctcatcactggcgcaaaatacgtcaaggctcttatccccgccgtcgtcaacatcgtctacaagaaacttctccaatacgatatcacagcccgtgctttcacaacacgcagtacctncttcgaaggccctcttgacgaagtgcccgacgagaacagtcctcagattatgcacaaaaagatgtttttgcgggcttatctgatgaagctgtgttcgggatcccaaaaaaaaatggagttctggggagtatctgggacaangggcggaatgatgcaccgtgggtctttgggcgcangcaccctctttacatggnggtacgtccattcttgggcgtntgccttggcttnattccaggatatcatggaccggaagnccatcctctcgcattctcggngtacacatttcagcgccangaacagcccc

SEQ ID NO: 2808 - DNA, 382 bp, Fusarium venenatum
ctgacgacaaatgcccagagaagcgtcgagattgcatatctgcttaacaatatgaattatccacttgcttaatcttcgactcaactggaaatagagtcagagctccactgtaaacagtcagtaaggccaaaacagtcatgggtccgctgctggcttattggaggcgtgccgacaagggaagaaagggtcactgcggatgggattttggggtttgagctcgcgctattgttattgcaggcataccaaaacgacatggaattatatgtggcggagacaaattgcgttgagtaattcaagatgaaataaatcatcttttcaagggagaagacatcgatacaaaggggtttatttcaagcctcttgaacaaagttttctcgatctg

SEQ ID NO: 2809 - DNA, 361 bp, Fusarium venenatum
  misc_feature (1)...(361): n = A,T,C or G
aacgaagtcctcgacaccaacctnaagactcagcagctacatgtcnctgtcgaggctgtccnagccagccttgaggatgaccagcacccccgtccctttatccgcgaactggttgccctccgtgagatcgcttntgatgatcccgttgtcaacgctgctatcngtctcagttaaccctgcgggcttaccaagcgcggcatctctacctcttcccagctgattgaccgtttncgccgtgtcnntaacgaggtacagaaaggcttcgctacttgcccgacgaggccngtgttgcagccacncctccagctgggtctcagccacatcatggtcaaagaagcaggnacttgctgatggtaacgac

SEQ ID NO: 2810 - DNA, 310 bp, Fusarium venenatum
  misc_feature (1)...(310): n = A,T,C or G
ttttttttttttttttttttttttttttttnnaccgagtattaacaatatgttttgtacatgcatccgtgatctaacttatccanacaaccncccgtcagcattatacgtanccaaactatnaaaccccgnggcatcctgcaatccactcaacttntccttnaaatactccctntgattctgatgaatcctatcaaaactcaacaaaaacgtaacaagaaacaaaaaatcctccaccctcgcctcnacatcntgntgttccccagcgccggnaggcaaagccaatacatccnccacagnggtcgtgatct

SEQ ID NO: 2811 - DNA, 222 bp, Fusarium venenatum
  misc_feature (1)...(222): n = A,T,C or G
natanttttgggaagntcacatcaatttatttaaaatggctcctattgccatggccnagttcggttatccnaaaaacaccngtgcttctttattaaagtagcacagcaatattacatggaagcacatnactttttttggttttaagttgccacatttgnacggctcactcgcatttagatcaggcgcacatatttgagctcatataccggatattctttctg

SEQ ID NO: 2812 - DNA, 202 bp, Fusarium venenatum
cacttctcgcggtgtctacgagctcaagttcttcaacgtcgtcaacgacgaggctgacgaggacgacgagtaaacgaaacaaattgcaatgcattgcaacggcgcaggaatggattggtgaattgggaaacgggatcgaacaaaagttttaaggacttggccaatagacccagccatttgtgtggcactctttgtggtgttc

SEQ ID NO: 2813 - DNA, 605 bp, Fusarium venenatum
  misc_feature (1)...(605): n = A,T,C or G
tccacttggccaangcacccctgttggccaaggaaacaaaaaaggcccgttatgggcgtttangaaccctgtggttcaaacacacacgatgcctcancaaccacaggcttgaggcacgtcagccctgccggttcatcattacttaaaccagcaccccttgaacggcattccacaggccaactgttggtgattggagaggaaggttgaacgattaccgtgggggtacgcccgtttcgcatttaacttatttggaaatctgctcggtgacaaaaataacaaatgtcgccagacactcagcatatgctagcaggggaggaaagattattggagtgcattcaggcgcatggagtaccgggttattgatnaaaccctggtgatttgggacaagacttcttctaacgttttatgtcatgtaatatttgtcaaaatccaggggcttgctttgtttatacatggttcaagtgactcttgtcttttgatatctatatctctatttgtnggngcgggccgagaggcttgtgaaagtgnacaagcaaccgatcatnccggnggggcaacatnatcatccataggctggggagttttgggaatctttttttacctgg

SEQ ID NO: 2814 - DNA, 123 bp, Fusarium venenatum
  misc_feature (1)...(123): n = A,T,C or G
ntgcntgctttcntgttattggggcgatngacncaccctttgntaanctatatggcccnanaacacaaaggaattgttaactgttctattggngcngtgttttggncactancaaccantcat

SEQ ID NO: 2815 - DNA, 606 bp, Fusarium venenatum
  misc_feature (1)...(606): n = A,T,C or G
ggagcccagctctgctatcgtcttttgagcatccattagcgcacttgtacttcccataccatcgggtccgagagtcgggttcanaaaacgatggaagccgaagatggtaccgtgcctctggacnaaacctttactgagatagtcgagcattgngggcgttcttaccaacattactccttgaaaaacgatacttattttgcgcctatcgatgaggtaggagtgaagacgcttcaatgtcatgttcttcaacanaaaataatatatctcgttaggacaaantttcgcgtcttgagatgatgcatggagtcctcagcggctttttgacaggcgtttatattccctcctatcaggctccncaaaaagtgcttgattgcggtgtggtctggaactggccatggaatcctaccaaaccctgatcggaggtnttggctcatgtagcccaccatgatccaaaaaccctctgcaatatgggcttaggtgtgacttgacccganatcacatnaatccaccctttgnntggtcatatcaaangngccgggggatcctgcaattgtggaaacttttccaaaatttcngtttnaaccnggggtgnggaaatgcaaaaan

SEQ ID NO: 2816 - DNA, 312 bp, Fusarium venenatum
  misc_feature (1)...(312): n = A,T,C or G
nttnttttataacactccattcccttctgttaattcagcccctngacggaaaaagacgagcaattgtncgactttcggcctgtgcctcgcgattcanacccccgacgaataatcaagaagcaccgatncaatcgcaatcgagttacctattggaactatntcccgtacgataccatacccgctggcgtcgtgcctctcgataaatttcgcgtcgtgcctntactngagctacctttcatcaaccttgttctacaagagcttnacatcctcgncaggttgagcccatcacaaagactcaatcgcccataatgt

SEQ ID NO: 2817 - DNA, 311 bp, Fusarium venenatum
cgattttcatatcacttggccaacatatactaccaaacaccctgttaacatggttttcgaaactactcaaagtcatgtacaggctgatgattggcgagctgaagcaatcggcctgatgtctcttattccggatacctgtctagctgcagttgacaaaaatcatgaggtcaagctcatgtcggctggtcccctcagttcatcatagttagattcatccttttcagtccgtctttcactcaagttacatgaaaccattcatgcaagcgtgcttgctttgagatttcgaatagatactccaccacaaaaccatg

SEQ ID NO: 2818 - DNA, 367 bp, Fusarium venenatum
cgaaaccaaccatcggagcctcccagaactctcattaaccgacttcaagatgcctctcgtcgacgccaagaaccccgttcctcagtaccagcgttactaccagaacgcttacaagaaccacacccgtctttggaagattggccctcgcagccgtatgctgatgaccccctacctcatcctcctttgtggcaccctcggcgcttctttctacggcgctggccgcaaggtccttggatacaactcttacttcggaaactaagatacgtgggctgcctagcttattatatagctcgacaacgatggagggctagtgtgatcaagtatggagtgaatagaaggagatgaatccaatctgatatcctcgcgg

SEQ ID NO: 2819 - DNA, 233 bp, Fusarium venenatum
  misc_feature (1)...(233): n = A,T,C or G
gaacgctgtatgacagacagggagcgatccagagcggtggcaaaaccgactggtactcactcaagcccccactgctgcggttagtacnttttgccgatgacttaaaatagacgaacgaagcgcaaaaagaacgtgggtttgtagacagtcatattgnaatcgtgggcgcagggcggacctgtcacgttgaccattatactagacggcttnttaagaacaaagacttgccttgg

SEQ ID NO: 2820 - DNA, 285 bp, Fusarium venenatum
ttcccaagggctgtgcacccattcgccttgtgccccagtgcgacgagctggagtctctccccaagggatcgtactcgagccacaagtacgccctcgactccaagtgctaccaggacgtctccaagattgagtggaagaagtacagcccctaggctgagacttttaaattaataggaaacaacgagatggaattaataatgatgaatgggtaatgattgcttttggatagcctctataattagcattggcattaatagctttaatattgtacaacacattatctgt

SEQ ID NO: 2821 - DNA, 296 bp, Fusarium venenatum
aggtcctcactgccccgttcgtcattcgagcactgtccctctccaagcacggcctcctaccgaccaatctctcatcgcgcctcgaaaaagaaaccccaaacttttacaagtgggcgcaggccattagtaaccatgccagtgtgctagagatctacaatgaggacgagattgtccagggaaccaagaacaagagggcccagctccgagcccaaggctaggctaagcgtggctgtgcttgactctagatattataggacagggttttgtttttatgaattgtccccattttcttgctt

SEQ ID NO: 2822 - DNA, 133 bp, Fusarium venenatum
  misc_feature (1)...(133): n = A,T,C or G
ngnaggaaaaccanaaacggngntgtttcttnacanaaaaaanagggncccttttttggntntacaaaaaaaangggtgtttttctggnacccccaccnccctnttgttacggccgccttggctaaaaacngt

SEQ ID NO: 2823 - DNA, 495 bp, Fusarium venenatum
  misc_feature (1)...(495): n = A,T,C or G
caaatttctaaactccttcatcatgggctgtaacaattctcgccatgttctcgagatggaatctcgtcctgttcgtcccgtcaccctctcaagtcattcagctggttctgcaatgacatcctccaccatttttcaagactaccccggactacgccgacaacaaatcatcgacgccttccaaaagatggccgaatatttgaacgagtacggtgtaagcatagattgtgtcgctgtcgatggcgctgtcaacaccctctaccttcgctcaagagactcgacccacgacgtcgaacttcttctcaacgatccttcttcaaaagaaagcatccttctcaccaacgctgctagcttcgccaacagtcaagcccaaggtcgtcttggtgagacttggctcacagctcgatgcaactgttctgccgcgaaatgttcanactctcttgtcgaagaagcaaaacccgaaaganatgtcttgaacatcaggaacaatggtggtct

SEQ ID NO: 2824 - DNA, 537 bp, Fusarium venenatum
  misc_feature (1)...(537): n = A,T,C or G
cttgacacctctcttaagtccttccgctttcccaccctcatattcaaccccagcacctcctccttctcccgaaagagattcgagcttctcccgtagttcctggtccagctcttcacttgtctttttacgtgcggtctttttgattgcgtcttctgttggcgtagcttcctcctgtgttggctgagattgattcatgggttgagattttgcagtgtcggatacagcacgcagagaagttgtttggattcttctgagggggacagttgccctcaaacttgatgcgaagatacagcgcctcatttttattgtcggattgatgttgacggaatgaggaaatgaaatgaagaaataaatggccactgctggttgacgttaacgccagaatttatgctgactaagtcttgtacgtcattggaagatggcatcgtgacagcataatttagtcatttatttacattgngatgttggtcacctatttgaaggngcgatgttttgttatgaaaaaattcaattgnaataatactttatatcttcatt

SEQ ID NO: 2825 - DNA, 746 bp, Fusarium venenatum
  misc_feature (1)...(746): n = A,T,C or G
caagaagaagggtgaactggagaccctcgccgagtctgtgggactatcagcgagtgagtacctccgctcgtctcatcatcaccaatcaccatcatactgcgcgtcttctgtcgcacaccaacaacattacgacacgtacatatacatcaagctgaaatctacattttggagtaccttttttattttatttttaattccaattacacacactcttcacgactcctcaacatgtctactcatagatacaactcatggttaaagaccaagaagaagggtgaactggagaccctcgccgagtctgtgggactatcaggcctcgacggtttcaagaaagacgacctcggtgtagctcttgacagctatctcacagagaactcgtcgcgctttatcgccgatccagacctcgctggctacttcaacagtcgttccaaggctcaaggatccccgatcaagaaggaagtcttccgcgaagacagcgtcaaggtagttcgacgaaggccctcaaagcctgtggaagaagaatcacttgattcgagtgacagaagtgacattgcttcttcttccctagctacatctactgngcttgncgagacttctggccgtacactggcgcangtcgcgtngagcattacgcttcatgcgctacctgngacttctggccgatgtaacttttggctggtgaaccgctcaaccagcattgtgcgccagcgcgtntngtcaatgtccaaggaaggnggatcactgaa

SEQ ID NO: 2826 - DNA, 590 bp, Fusarium venenatum
  misc_feature (1)...(590): n = A,T,C or G
aagaatcaatgacagaggagttcgaggctttggatgaatggggctggaataccaagggcgagatccatgccaacagttatatacgagctcgcttcttaaagtcctatctcttgggacgaagtgatagagattgcactttgtaatgacactcacgtcacgcttgattatcttgaaaacaccaaggctcgagtaaaccagtttttcttcgagatgccatcgcatttgatttttgcctaccaaaatcttgatgacccggatcttgatataaaagttctttacttgagaatcttgctctatttgagccataagaaggatatcttcgtggtcgaacgactgttgatccagcatggggcgatcgatgatggctctttgctgacaaccagttttgatttaatcaaggtcacagttgtnctttgggatacacaagaacaaattcgctcctatgaagcgaaattttgaatggctactaattgcgtttgctgctcctgggggcggcattctgtgtcnagaattacttcggccaactttctttggtgttcaccctctgaatcctgctctttcaagatcaatttcntgcngcaactcacatg

SEQ ID NO: 2827 - DNA, 596 bp, Fusarium venenatum
  misc_feature (1)...(596): n = A,T,C or G
gctcgcatactgacccgcatactacaatactgccgtgctccatcctcgtgcatcgtccagacattggacccaagtctcggccggttgttgtacgactgggccgactcaaaaagaagcccaccccagtcaagtcaatgtctcattgctgtttataccgaaagaagatgcgcggttttttggcaaagggaggtgtgggctgactctgctgcaagatggaacacgggatgggttgtacagcaaaatgccatgcccatggacgacatgagtgagaactgagaaatgagtgaactcaactcaactcaaccccatctcgtttctccccatcccatccatcctagtcagttccattaatccagccatgagccggtcgaccgccggatggtatcaaagaccaaaaaagccacgtttacaaattagaggaaacaagcatcctacgacatgcaagatatgctgctatgacggtcaagaacgggtttcctagtccatttgctcgtctgtccattcacgttgtcgtcaaaattgccgatcagggattggggctttgatgtgccctnctagaatcttttgncaagagatttgattttctncgagaggcc

SEQ ID NO: 2828 - DNA, 496 bp, Fusarium venenatum
  misc_feature (1)...(496): n = A,T,C or G
atctgtatttattcccgtgtgtccgtcacaaccanatccttttttngtncttttcctcnaaaccctcttttcaacctgnatctactgtaaacaancacatntcaccatggacgccatacaaaaacagtttacccttctctcccttggtcttttcaccattggggtganaatggttgtnaggacgcaacaatttgggtttgcaggatggcanttggacaattacctgatgccaattactggtctcatcttcactgccgaaacggtagcagcatacctcgtcggagcnaaattccaaggccttacaaatanttacatgacggatgaggaacgnccaacatcnacatgggcgganaaaaacactacaatcgtgtctggggatccaaaatcaagtcataggctggtccttttatgctgtattctttggtgtcncaantttgcgtcactgcttctaccccgactcacatcgggcttgtccatctaagaatcgtgtcatgtc

SEQ ID NO: 2829 - DNA, 591 bp, Fusarium venenatum
  misc_feature (1)...(591): n = A,T,C or G
cattatcattacaatcaatacgcccaaaaggtgaacctgcaacatggtcggtgtcggaaaaccgcgactggacaaatatgacaagatactctcacggctctttgagaacctcgccctctttcacattctcaaacgagtagatggccctcacgctgccaatgcttatgttcccgccactcttcaagatgctaggcgtaggttcttgaanaacttgagctttatctgcgattacagaaaagggggagataccacgacttccatggctctcgaggacaagcanaaaagtgtcgtgttctggattgcagcaaacttaactccgaatgataaagttatatcgtttcttaccgaagtnctcaaattgctaagagaggaacctaaagagaccgagggagagcaaaaagttttgaaaaataaactcgcaaagatatgtgccgagtttgctgcnccaagactaaaaaaagagtgcaagctgntcacagagcttccaaacctgngagaaagtcctcaagttagatactgacacagttcaacagcctggaaaaaacncattgttgaagnggntgtctaattttnattttcccanaactggat

SEQ ID NO: 2830 - DNA, 302 bp, Fusarium venenatum
  misc_feature (1)...(302): n = A,T,C or G
tctgacttgtgggatacagcttntgggcaggggcctcgtcgccaacgcgatctttccgaggacgagcgtttggagaggtggacagttatgctcatgacaactgctggtattcttgccttcagaaacgatgccgtaggattctttgcgggtatgctttgtcatggagcgtatcgcctctcggaacaattgacagagaggtactcatatcgcacttctctagtcgagcgtgaggccctgcttcgttaggtattcaccgtnctatcggtgtgcattgagttaatagaattngcttattcgcgacg

SEQ ID NO: 2831 - DNA, 436 bp, Fusarium venenatum
  misc_feature (1)...(436): n = A,T,C or G
ctgatgtttcgtggctcgaggttttcgcatactcgggagtcagcgctgccttatgcgcaaccatctgggtcgcggcaaaagcatgttgaagatccaatgtcagctttccaacagacgcagaccaatatctcaacccaagccaactgaagagaatgcctgtcattaattccggcatttttgcacttcgggtccacgaacaaatcatactccagccgggtttcgttccgaacgatctttacaaggaactgcaatatcttttcctactcaaaatcaacactccttcattatgatcaacatcgtgtgtcgcgcggaccggacaagtcaaatcatgtaagaatatggaggaacacagcacccgattgacaaccatgattncagactacttttggtcaattgattggatatatatncttagataagggtggcttatnatcga

SEQ ID NO: 2832 - DNA, 479 bp, Fusarium venenatum
  misc_feature (1)...(479): n = A,T,C or G
caccatcatccagcaatcacaagcatctctcataatcgcaactctattacagcttcagctcgatcaataccttacacaacttcaaccaatcacatcaatttatttaaaatggctcctattcccatggtcaagtccgctgttgctcccaaggttcttccagtccttatcgcagtaggaagcatctccatcgttggcggctacgtccgctctcaactcaccaatcaatcacgcacattcgatcgtcaatttagccagtacaacaccaacaagagcgaatccgtgagagcaaagacattcaacggcgctgtgcctgatcctcgaacaagtcttttcaacgtccttggctggtgaactcaagatgaaactgtcatggcgtttatgggttgggtaatctggatttggatttgaggcgttttaaatctgccttgagaaaataaagttacataattaatttaaagactntcgggaaaaaaaaaaaa

SEQ ID NO: 2833 - DNA, 486 bp, Fusarium venenatum
  misc_feature (1)...(486): n = A,T,C or G
agttagcagagcagacttgttcgaaacactaagtcaatatcatgaacaagacgcaaatctgtctcagttttggcaagaaacgcatcatgttccgtcctgggttgactgggaacaaatcgctaggggtcagcacttcttctaccgatacgctctcgcaaacctgattggcttcgcctttcaaggctttgtaggcgagaattccgcttcaacaagtgtggttgaagtacttgcgcgtacaggcggattcagcacccgtgtactcaggagacgcctcctcgagacctttcagatggtcctccaagtcacacactcccttgagtacatcaaaccggggggctcgggtcacagctcgatcatcagagttcgtctactgcactccatggtcagacagcanatcctcaaggntgccgcatncaagtgccggttctttgatcaanaatccacggaataccaattaacacttttngattccatccacgccatacc

SEQ ID NO: 2834 - DNA, 578 bp, Fusarium venenatum
  misc_feature (1)...(578): n = A,T,C or G
aactaagtcaaacgttgacgacaacaaacccccaatgtcccttcctgcggcgcttctccttttagcagaaccagccaagttcttcccattcgttacatcgctcgagaaacgaggctatgaggtggtttcaggcggtcgccagatgctcgttttccgtgaagtacgaccacagtcggaggaaactagatttgatccccttgatgagctgttccgtcgcggcggagtctttcctaccacagatggagagacgttccagagctccagacgtcgaagaaactctgacgaacgcaaaaagaagatgggattcggccgcaaggttctggtgggaactgttgggatcgcaggaagacctttgcaacgaccacgttggtggagtatttgagtaccaaggggataagaacggagactaagcagaccnacaggtctagttccccgacaatagtattatttatgtgcagcttcaaggacgttgtttccngggttttactcaaccaaacgtctacgggttatcantttttgttttggaattggcacaattgggacaaatctncnctcaacatgtcttttggttataggag

SEQ ID NO: 2835 - DNA, 589 bp, Fusarium venenatum
  misc_feature (1)...(589): n = A,T,C or G
cttcccttgtggccttcgccaattcatacgctgcttgctggtgatggccttgtacttcgtacgattgagccagcatgccgtctgcgacactctgccacaaaacgttcccactgcgttgtgcctgctttgctgctgccatggcagatttaagcgcttgctcgccgataacgttctcaaacagtcgactgcgcatgatagcgagcgtgacggcagcccccaaaacattgttagtggatttggatccggccatggcagcctgtatatgctgtttctggtggttgagctgttgaagaagctccgtaacgacagcggccatgacattgtgccacgctgtccgcaaatcgacnttgtgatggttggcgcacagcgggtgcagtcgatctatcaaatcgagtgtttccgcgtcgtttctctctgaatgatgctgcatgatccaaagtctgttgangccagctagcatagctaattcgcgatgcgcagctttaacgccagttccacgctggtcgaagtcnaactggggtctttggaaaactccatagccgaacgtaagtctcctatagcctgctgatagacccggatagataganaa

SEQ ID NO: 2836 - DNA, 135 bp, Fusarium venenatum
  misc_feature (1)...(135): n = A,T,C or G
nctatccgcancgtganatccgatcgnaaagaggtcgcacgttccttcnaaacgtcgtttnnctacaaagctatgacttnctattacctanccttaggnntgccttccngtcggtccganaaggaggcaaggccc

SEQ ID NO: 2837 - DNA, 321 bp, Fusarium venenatum
  misc_feature (1)...(321): n = A,T,C or G
ctgcgacaaatgcgaccagacatgacccagcagcagtatcaaatgatgcgaatgcaaaacggtggcatggctatgaacatgaagcagggcaaccttgcccgcgctgccatggccaacaaccaaaacaaccctcaaatgatgctacagcaggccaagcagaaccagatgcagcgagatccttccggcatggacggncaaaacagaccttcataccggnttctggggagaacgntcctnccgaagcgacaacgcattgacgggcgcttttaaccataaccagcctgttggatgatgccaanggccgccaaatgcctaacaaat

SEQ ID NO: 2838 - DNA, 559 bp, Fusarium venenatum
  misc_feature (1)...(559): n = A,T,C or G
cgatgatccggaagaagccagcgttatgggctctgaggacttgagtccggattacaatatcgatcttttaattccatcagacgcttcgaaccgatctatcgaggatcaccaacctgatccagttcacatctttagactctggcagttattcgttgaccgcgtcaatcctctgaccaagatcatccatgtcccgtccgtccagccatttgctttggagatggctaccgatgtgaacaagattccactcaactaccaggccctaatgtttgccatcttcaccatggcgacagtatctctaaccgaaaccgaatgtcttcagatgctggggactacccgcgaccaagctttacgaaagtatactattgggaccaagctggcactgacaaagttcaactttttgaaaaactacgatatggtggcgctgaagcgctgctgctggatttgctgctcttcaaaaccgntacgaccgccatgctgcgtggatctgagcggcattggttggaaaaatgnttaaaagatggctaccatcgggacggggatatttangactaacgctttc

SEQ ID NO: 2839 - DNA, 615 bp, Fusarium venenatum
  misc_feature (1)...(615): n = A,T,C or G
gtacctttttatgacttgcattccccatttcttctttctttcctctaatctgaactgacctgacctacattcaatcaacatcaccacatatacacttacaagttacaccacaaaataccgccattatgccgactatgcttggtctcaccaacgaccgctctactaacggtctcaatgccaacgagagcaagttcgggggtccctctagccaaaggggaatggaactcacccctagtcaacaaaatggcagcatcgtttctggcattcaaggatccgatttcttcaacggaggcggcaagcagcaagagcacgacccggatgaagaatcagacgaggagaacctcaagacaatcaagggtcgcaacctnttcgctgtcaangagatggagactctctntggcgcgcgctctgcgacaagcccaagacggcctnaagtacatnggcaaggacgccgtatgtccaaccnttctntttggggacccacgctttgaacggcgactctgncctntttggagaaaagtcagcctggaaaagggtnnctacaaaagccgacttanccntcaaaagggttatggttccctttgatcaagganccttttcgcagttntcagggac

SEQ ID NO: 2840 - DNA, 628 bp, Fusarium venenatum
  misc_feature (1)...(628): n = A,T,C or G
ctggtttctagatctcgtcgagctggcaccgaagagccggatgacggtagaacatcatcgcttctcctaagaactagacgtgcaggcacggaagagcctgatgaaggccgaagaacctctttgtttgtccgtaaccgtagaaacacggtcggtgaagatagtgaagacgaatcaaaattccgaggaccttctcgcatccgtactgatctcaacacgatccgagttgtaccgcaagagcaaacgccacagccagcagagaatacatcagccatcccacgacggcggtacgtttcctcgactatcgggacctccgcctggcaacaccttccgtcaacacagcaacccctccacggagatatatggagaggtctacgcancangaccaangtccaccgcggncgatagggttggcgaagagcgtgcacaacgttacacgtntntagggcagacgacatggtcaacagaactggcaggatgattagaagacctaacgggagagtttgngtaagcaatccttntcaagttgcggcaacttccggngatggtattaaaatattcattgnttacgatggacaacccctnttatgtttnggcncagccggnttattggccnattttgttcgacgga

SEQ ID NO: 2841 - DNA, 232 bp, Fusarium venenatum
  misc_feature (1)...(232): n = A,T,C or G
ctcgacgttcatgaaacaacagcttatcggcccttaatcagaggtttgccgccacgacgactctacatccatcctgacgaccagattgctgctttggaacgtgagaagactacaggcgagcccttggatcagactccagagcttgaatgggtgctagcagtgcaccctgaggagaaatgggccatcaaaagcattttccaaaggcttcgnattttttcgngcnccaagggcc

SEQ ID NO: 2842 - DNA, 504 bp, Fusarium venenatum
  misc_feature (1)...(504): n = A,T,C or G
ctacccgaaacctgccatacagcctgataccgatccagcgcattcacatattgtgcatttctaccacttacactaggggatgtaagctgtaggtttccgcaccggtccggatggccgcattacaccgagccggaggactaccatggcggcagatcaaaatggatctagaagtggatttcacgattgaccgaagagggtctcggtatggagtttcgaccgcaacaacaccaacaataaccttgacgatgagctggctagagacagagacatgatgctggtctagtcaatgcaccagggaataganttgangacagggccgtttgtggtcttgtcttgtctcacttcgctcgcggancaactgccgtcgatctcgaatggacttgacagcaataaccttgacgatgaattggccaaagtcnaatcnaatgttgatttataaaaatcctctgcagggatactcgttgttgtctcntatcanaacaattgattganttgaatggagaa

SEQ ID NO: 2843 - DNA, 1116 bp, Fusarium venenatum
  misc_feature (1)...(1116): n = A,T,C or G
gcaaactcggagatttgtcgctggatactccattggcaagaagacaacaagagcttgaggatatggctcgtgattctgatgctgcgcgcgctctgcaagagcttcagaaactacaacgcctcggccctagaaatggcacaaagcgaaaccgaactgcctctatggacaactgtctccagganaatgttcgcgagatgctcggtggtcgttactctattcagagacctacctggcctaatacgttggttcgtactcgaagtattacctccgagtccaaccttcaggtcccgtccgaactancctgccaggcactggcaagcgaatgtgttgttctgctgaagccgcacagggctacgaattttcgtctgtccatcctgccctcggcattcggggaactggtatgtnggaaggtatcttgaactaagcccatcgtacctcgttggtcgccttaattttcttgatcaactcgataccccgtcgactancgacaaactaacatccttaccacaatgttgaagaattaatgttgaatcaataacattttctatgtcaaatattgaactggggttgctggcaagcaaggaatcttttgctaaaaggccttggataccacccatcttgatgacttgacaaagtgcccggaaagcactttgtaggtgttgagattcggccaaaaagcgtgttcatttacgtgcatctctaggatcgatcacgagggagagggagacggcggtgaacgtcttgttttatcagaggaagtgaagagatgacgattgcaacttttgtatgactaggatgtcactgcatttttgttttgcttgtacattgtgcttttatatagcgttgtttactcgtttcgtcactgcagtctttcgcgagagatgagggacgatccagagagttatggaggagaaacggatagtacaaggggagcaatgggtttaatttgctgccaaaacctacagatgaacaccacgaanggacacaacttggccgtcgagtgttgcttctgtgagggaatgggttttgcatcaaatggagtcccgatctgccctttctacaatcaagataccaaagccccncatnatgtcttgaganacacacccaaacttgaat

SEQ ID NO: 2844 - DNA, 413 bp, Fusarium venenatum
  misc_feature (1)...(413): n = A,T,C or G
ntatcacatcttttctttntnacgacttgagacgattctnacggaatattcgaacaacattcaagggcatggaacgatgcagctacaaacacgagctgctttgaatnttgatataacgattcaacaatcccgatgtatttttcagctcttgaaagctgtntttaggtagctggtttttgtgtactttgtgcgcaaataaaaaaaggtgttaagaagcatttntcattgctcttgngcatgcaatgggttggacaaagatgatttgcatgaaaggtggatttgtaacatanntgaggtaggtgctaagcagaacacgagctgaagcgggatccnaatcagtgacttgctctattttctnctgcaagaagttcntgcttacagttttactcaancaaaagaatnacnttgcccac

SEQ ID NO: 2845 - DNA, 816 bp, Fusarium venenatum
  misc_feature (1)...(816): n = A,T,C or G
gccttaatgggggaaacattgcctcttgccatggatttataatctttcaatgcctttgttcttcctgaatgtttaaaagttaattgtgcctccctcctaatgcaatgtctcttcgcaaaggaagtgtataggcatctccttatcttcgtcagatggatacagaaacaagggttcagctttggctaaacgcacattttgagcagcaacatggagctgcaataataaaaaatgctgtgcctgctgtcaaaacacaagcaagattcacctgtgggttggagtcagcacctgagcagcaaccagtttcccacaacgtcgttgataaacctggcgacgttgtcgaccatgattgtccaacagaagaagagctcttggagatagtcattcatcacatctttccacattccattcttcgacccggtcggaggcttctaatacgctaccttcgggaacagaccggccataaagccaattcgttcaaacccttcacttcgaggtcattacccgacttgccctttatgctcttcagcacttttaccactggtaaatttcgatttggactttggaccagctattgctgggattccacttctggnggctaatgatatgggaaccgcacggggtctgatgtcatataccgattcctatgccgagatcttgaanggactcgaatggatnggcgggtcttatgnaaaggagtatccacatcctcccccgatgaataattccccgttntgtnacaggacttcggcgaagtattgccgggggcnaccggcaaatnaatgaccaaggaacnctnggggatnttttnttttctta

SEQ ID NO: 2846 - DNA, 102 bp, Fusarium venenatum
  misc_feature (1)...(102): n = A,T,C or G
ntgttctaaggaangccctggatacantttgagnctcagaatccattgaanctntgcaaggcaccngaggccctanatcatganatcgcgtggattgatgtg

SEQ ID NO: 2847 - DNA, 284 bp, Fusarium venenatum
  misc_feature (1)...(284): n = A,T,C or G
ncnccgaagnggtttttttgaancattttggccttntgaanattttaggccccaanaaatccggaggnggcgagcaaccatggagtgtggctataaggtcatacccgaagtggcaaaaggagatggctccttaggaatgcttntaggatccatcttntttggtcaacgacagcgaaccgttggggggagcccttgaccaactgatcgtatccaaaagttgattnttnccaccacttttttatcggngngctgtgaatcccccgatagtgatcttaaaatcaccg

SEQ ID NO: 2848 - DNA, 295 bp, Fusarium venenatum
  misc_feature (1)...(295): n = A,T,C or G
tcttgacaggaatttacaaaagaattttctcttattcctataccccagccattatacacaagggctcaattgctgcatttgtcaaggcgcatttgtgtgagtgggtttcccatttgtaaccgaagcctctgacttttttgttaaagccgcaagggaanaaaaaaaggcaccgaccgaggatctggaaaaccgctaaaatgcttctttgaaaaccttgatttagtggcccctnttctagttaccgcacagaaaaagaaaacccacaacgacgaggcacagtttcnatgttgcgcac

SEQ ID NO: 2849 - DNA, 136 bp, Fusarium venenatum
  misc_feature (1)...(136): n = A,T,C or G
nnacacagaagaaggggagaccaccggaccccgcgagncgcanggggacgcggaaggacnngcgaaaagncccnaggccanagggggcacggngggggcaaaaggggnnccccaccacccaancgcngggggggcc

SEQ ID NO: 2850 - DNA, 212 bp, Fusarium venenatum
ccaacgttgggggcattgataccattttacaaagatatcctgttttgatgacccggattacgagaacagtcctgattcccaaacctcccatggaatttcacggcatctcaacaattgacgacgaattacgatttgtttctgtttttgctggaatcatttgaacaccttttcaagactcacgatcttcatgcaattttatctaaatttcaacg

SEQ ID NO: 2851 - DNA, 628 bp, Fusarium venenatum
  misc_feature (1)...(628): n = A,T,C or G
tgccaccacatgcgccggcgcatttccgtctcgaaagcgttgagtacagagatctggtagacactctggagcaaaatctattggacgtggaggctcnctatatcgacccaactgctggaaacgtacacattgctgccctcagtgttcgcccaatgatttgcagcaagaatgagggagatattggtgcctatgagagaacagcccgagtgggcaaactggggagattcgcgacaaaaaggacaacctcttcaagatcgtcttgatgaacaacgaacacagtacccgatgcgtatggtatcatggacgagacgggattcctttggttcatgaagttccatttccaggtcgacatcttttccgtcatgacaaagcagctttgccaccgaccgagaggttcctttgccgcccgtgcttggaacatggtcgagaagatctaccattatcaccctgaactcctggatatgacccaaaaaaccaactttttacaagctcaagcagttttgaaggcttggcacaacccgtgaacaagcacacagagaagacggccagatnctanaaacaccaaactttatttattcgcatacganacgttttagcgagcgacgtccgaactactgaatntttggcg

SEQ ID NO: 2852 - DNA, 216 bp, Fusarium venenatum
  misc_feature (1)...(216): n = A,T,C or G
nactcngagnggaactcnttcgaggtgcgtggacatcgctgtatctcgantcaagcagcttntgatctggacggcaacnacccgcctccggatggtgtcatcgctttgatctcagacctcctcggtcggtgcatcgacngcttgttggcgcctggaggatggttgctnaacgacaccatctcaggcgacaaatnctgaggctggcgatctactgac

SEQ ID NO: 2853 - DNA, 138 bp, Fusarium venenatum
  misc_feature (1)...(138): n = A,T,C or G
ntgcttnattaattggtttattnttcnggaggaaataataatngacncctttgnttggggctnnccgggttaannaactaattaaangcctttnggnacttgngantttacgnttcncacccttcnggacatgaatga

SEQ ID NO: 2854 - DNA, 478 bp, Fusarium venenatum
  misc_feature (1)...(478): n = A,T,C or G
ctttttcattttcaaccggcatcctttcatttctgtcgctacctccttcgttaaagcttcctgctgggcctttgcatatcgtattccctaacaacatgaaatattcgtgtgttcgtatctgaaatcgttcacgaccagcgttcatcaccgtgaccatcaaagccactgctgttgctcaaaagtaaatacacatacatacataatggccgacacagaagagccccagttcaacaccttggccgagcgcattgctgctctcaacaaacaaaagagctttgccaacgctcaaagcccaagcccaggtcctggaccagttcgcaagcgaccgcaccaccttcttctccgttcgtncaactattgaagggcggagtcaaacagtccagtaatatcgactacttcaagncgcgcagaataatccatcaatccttctngnccctcgagaaagngtaacaccacaactcacagggaaaantggcaa

SEQ ID NO: 2855 - DNA, 581 bp, Fusarium venenatum
  misc_feature (1)...(581): n = A,T,C or G
aaaaccaccacttgtgatcaaaacatttatttgtaattctaaaaaggtggtaaattcattaagatgtgtgtcgtgttagagaaaacaagccaggggcaactttgaggaggcttggctgtccatgtcatcggtatcccgctcttcagcgccgcgctcccgagagactgacgcctttgaagcgcaacaagacactaaagcaatcatccatcaatccaacacgtacgacgatcctgcttcttggtcatggcaggcttttcttggcaaacaccaagattctaccatctcctcgggtctcttcaacgctacacgacgtttcatggcaacagcctttcgcgcctcgccctctttccccaaactgggtagggagtttcataaaaganagatccgttaaccaactattggcataccaaaagtagcttcgcaccactatgacatctaacccgcgtcaagtcgggcagtactaacaagcccaaactccgaaacttgttaaatccgtcgtcgacactggaattctcgagacatccaccggaacttgatgaaacccgctggtcgtagctttgctgctaattgtccctgcngcg

SEQ ID NO: 2856 - DNA, 548 bp, Fusarium venenatum
gctgatgctctatatcgtgctcgatggtactacccctctgacgacctgtcttttgttcgactcggctatgtatcgccatctgaggcgaggttcgtcattcgcgagcctgaccagcttcaaatgcccgtcatattcgaatatcacgttaaggatgctgagtcgacttacgaccccaagatatggctcactgcaggctttatcacctctactgacaacaccaccgacttcaccacgactatgacagtgcctctggaccccgcaaaacagatggcatatgcatggaggacttccaacaaccacactggcgagtttcgctccgctcccaaggcaggagagatgcctgaccacaaggatggcctcttcactttcctctccacctcgtgcattcttccccgattcccttacaacccactcgatcatgctttggccatccctggcttgaaaaatcttgccaacctgttgcctacgctgggatgcccaattcatgctgttccttggtgattttatttatgtcgatgttcccgaacgatttggaaagacgcagaaga

SEQ ID NO: 2857 - DNA, 213 bp, Fusarium venenatum
  misc_feature (1)...(213): n = A,T,C or G
gttnaatgcccacagcatctnttgctatgggagccatgatgggtggtgctgctattttcgttaatatgtaatatcgcncccgattgagttgtgagcatctagaagtaatacanaccaataatgttgtggnccgngcctcatttctcaattgcgtgtgatgtagagacaacgggtaaagacaatgacaagttgaatggatagctttgtgagtcg

SEQ ID NO: 2858 - DNA, 113 bp, Fusarium venenatum
  misc_feature (1)...(113): n = A,T,C or G
nggcattccaattgcggttttcaaataacaacanaacacgcgcgnatganacggtcttaganataccttcantcatattatctggggagncgggaagagactgctngattgga

SEQ ID NO: 2859 - DNA, 471 bp, Fusarium venenatum
cgtgatagcagtctcttggaagcgtactagatcgagttgaagaagaagaagaaaggaaaatcataactgagggcggggacaaaatttatgaggtgctcattactgtttggaaaggaaggaaagcacgctggtcaaggaaggaaagcattgtggtcgaaggaaggaaagcattgtggtcgaaggaaggaaggaaagaaagcgcgctggtcggatgaaggactgaaagctgcgcgtttcagcggctcaaatgtaagtggcagtctcgaaatgatgttcgatggtgatggtaactggtcgtttgaacctcatggtagctgcatacagtggtacactgcgatcaaatgggccaacggttgttatgagacgcaacgtaactcaataaccaaatcacgacattaagtgccaactattgggaacagacatttattagcaagaaaacaaagaataaaagattggacgagtttttttttt

SEQ ID NO: 2860 - DNA, 634 bp, Fusarium venenatum
  misc_feature (1)...(634): n = A,T,C or G
cgaacgtttcctttcaagctcgccggaacctatggcatcatctgccccaagatacgtcacttcggcaggcggtanaanaagatcgtcgatacttgagtcgtcgggaatgtcgggtgccgaactcgcgtcacattccgatctttccgacagcgaagctttccgtcctcacgattcttcctttgacagtcttactgccaagtcacccggtaacattcctaccgccgcgcgaccaggccagggaatccgctcgacaagccaaataagtgtatccaatgttgaacaggaccctgatcgtgtaatttggcaaggtcggctctaccttttgcgtcatcgcagaggtatgcgccaatggaaggacatgtgggccgttcttcgaccacgcaaccttattctctacaaggacgaagtctgaatatacagccagatggatactgccaatgtctgccgttgtcaatgtcgccaccttgatcctnttancaagagcaanaaacattgcttcaggttattaccgaggagaaaactntcgnttttgcgcacaccaaaaaaaaaacttttggtcgctgtattggngccttnaaaagcntgctcgccaaacgttcnnaacttgangctcgcgctgccgncacanatcana

SEQ ID NO: 2861 - DNA, 573 bp, Fusarium venenatum
  misc_feature (1)...(573): n = A,T,C or G
gtcacgcccaaagcgacaactcggcgtcgacagcttcaatccactcaatgagctgctaaagcctgcgaatcccttctataaatccccgcagctcatttttcgccatgcagaaagctcgccaagcgggtcgcccaggcccagcgccaggccggcaaacgagccgaaaaggcgccnaaagcgaacagaccaactataaacttcgaaaccgacaggccattcgagcggctgtctctgangtccgacagaatcttcaggatgcgcgccgtgctccacangangattgggaattgggtcctatcgcccccaaacgtgatctgggattcaatggttatggcatgttcactgaaggcgtncgaacggattggtccaactacgggctctacagccctcgacctgagatattgatnaaacgatgtncctgggctggtggtgtgaaacaacttaaccttgctgtttctgaacnaatggttatcatggatggtccncacaagggaaanattgatcgcntcnagtctatcnacctccacgccgggngtgttnctctttaaaacacaaccnggctatctctgcngg

SEQ ID NO: 2862 - DNA, 578 bp, Fusarium venenatum
  misc_feature (1)...(578): n = A,T,C or G
aaaatncagtcgaatgagaaagaatatcngcaagagatgtgagctcttgtttgttcacttcaatgccgctgcatccccctgttataggtgtnaccgggatatgacgntaggtgacgtaaatcggggttgacagcgctgatgcaacacgcgacaggttcaggaacgacttcggctccactgaatcgagaaaatatcaaggaaatagtggcatctcctgctatttttatttccttgacttgattctttcatacaaatgaaacacgtacgcgtgcttggngtgccgaacgccnatatttcgaatctcgtcgtcntcggtcagccttctacnanatgatcgcaannggagagctaccngaanttaatggtttaataatccggccctgganttatatggattgcagtagatatacnngagaatattctttgaaaggaacatgcagtaagtactctgcctgtcctcagctcagagtaatagagatgaaattagtgggtcagtttatgctattccanaacatangtgcggttcacttttgtgccccaaaagttnggctcacttnacccacancacagggnaaaan

SEQ ID NO: 2863 - DNA, 114 bp, Fusarium venenatum
  misc_feature (1)...(114): n = A,T,C or G
ncagaanttgctgcaggaagacatttagacactggcaaaaagagctnatctttcctggggggcntgaaaggcanagacngatangttgtttttttccccctggnacagaaaaaa

SEQ ID NO: 2864 - DNA, 629 bp, Fusarium venenatum
  misc_feature (1)...(629): n = A,T,C or G
atcatctttgaatcaagatcgcgtgcaacatctgaaatgtggnggggaaagtcaaaagatcccaagccggaanacaagagcgaggcagctcanatcaaagacgctgtagctganaagctcccctcaaaagagcaaatctccaacaaagtacaggaatctgtcaaccaaaccggcaagaacggaaatgtcttgaacgacatggctgagggctacggccctgattcaaccgattccaatattcgatatgcagcctatgccactcgaatccgaacgattcttctctcggcgcatcgatatgtcgcttacacctccgatataggcgagtcgtttaggccggtggctcacccgaacctcgtccgtggtgcctacggtgtatcttggttgnccttattggtgatgtctcgtacgaaggctacaagtcatactggcacaatcagngggtgtttgaaccccaagctgcaactcaaccccccgtcaaaaaaaagncactggtctgcctgcccttgaaacacgtgcggnccaacccgggacgggggcaccacttcnatgattaccccncccgttatggtcaancgcgcaatntttcanaagtgncgcaagtttgggaccaccccgtttttacnaattna

SEQ ID NO: 2865 - DNA, 122 bp, Fusarium venenatum
  misc_feature (1)...(122): n = A,T,C or G
nttcagtggactgtttgaccgngncgacatagaggtgccaccancgtnctttggtnaacacaaaaattancccattggtanggntgacgcttgacacaacgnccnccttgggatcanggccc

SEQ ID NO: 2866 - DNA, 136 bp, Fusarium venenatum
  misc_feature (1)...(136): n = A,T,C or G
nacgnagcaatnaccggggggtgnaccntctcaggcggtctgggtcggnancgttacagantttggtatttggacccttcaagcccggangacccggctggtttcatggattccaacaataaggaggcaanctttc

SEQ ID NO: 2867 - DNA, 121 bp, Fusarium venenatum
  misc_feature (1)...(121): n = A,T,C or G
ngggggaannaaaaaagncccccggggancnaacccgggggggcaaaaagggggaaaaaaaccgggcccaaaaacccccnaaaggccnggggncggcccccgnaangggggaanaaggggg

SEQ ID NO: 2868 - DNA, 108 bp, Fusarium venenatum
  misc_feature (1)...(108): n = A,T,C or G
nacacccccacgaccanacccnaggaccacgagcacacaacnacgnggagacgacaacncaggangcgacgagaaagaggagacnacacgacacaccacnccacgaga

SEQ ID NO: 2869 - DNA, 442 bp, Fusarium venenatum
  misc_feature (1)...(442): n = A,T,C or G
caacatccggaaaccatccaagatcctcaactgtgcggttttgccaatctgcatagcaggcgcacactcgcaatgccctaaanaacaaaagtctattcgtgcctnggcggggtttatatatgacgagattcggtttgcgtctgttcatgcggtaatcgcggtgttggaagatgtttggaagcgancgcctaatgaggagatgacttggaatgagatgtttgtgaacttgaatgaccagncacttgtgctatgagattgggttgtgtgtatgcatttgttaatgaactggatggagtttggatttttgtcttcgattgggcgtcagtatggtaacggngaaatgagaggtctttttttagctgnagcaaggactttntgtattgaaggcacttcaatcatagtctcaactatgaattactcataatccnaatatcctcacaat

SEQ ID NO: 2870 - DNA, 444 bp, Fusarium venenatum
  misc_feature (1)...(444): n = A,T,C or G
ggtcttcaccccgtcacaagtctacttccagtgtcaaacattgcattgccacgaatcgatatctttccctctacgaacacaacccaccctcaaccttggccgagtctttccanacaatgctattagcaaccgtgcgagcacctacaagaacattgccagcggntatttcagccgggaattcaccattccanaagaccgtttagacgcttttaggggtattacggaccactatgctcacttagatgatcctctggacagtcttcttggccttccgctctatcataccaaggacttcaagaacctgccaaattctaaccggacagaccgtttgccgttggctcggntggttctaccatcctncaaganatgctgatttatcgncgcatctntgcagcgccaaggccattccctnattganctggctcggtggaaaattccaccttg

SEQ ID NO: 2871 - DNA, 118 bp, Fusarium venenatum
  misc_feature (1)...(118): n = A,T,C or G
ncccaaccaggggcccnggccggggaccaagggggnccggaagaacccaanctccgggggacgaggacacccggnggagggggggaaacgggcncngggggccaaacnggggaagccc

SEQ ID NO: 2872 - DNA, 586 bp, Fusarium venenatum
  misc_feature (1)...(586): n = A,T,C or G
cgctcgcattgtttcgctcagcccgctgtctgccgctgaaactcctgcttcaaccggatcgatctgctgtagaacggctgagctcagtttcaatgccgacgatgccccaggctcatcaccaactgctgccgccgtgcttccttccacatccacttcgacaccactgatattcgaaatgcggcatcttatacttatgcatcacctcgacaccgttgtgctgaaggacccgttcttggcgcctgagtcggatgaccgcgggccaattaacatctccaaggccatcgtggaatcagccgagacagtcccttacttggtgatagangcccttgcaatatcatcggctcatcttagcactacccaaactgatcctgctgaacggatgaagtacttccaggcgggcgaagaacttcaaactcaagcactgagtcttttcaatcaatcccaggtccaagttaccaagganaactgcgttaccaatatttcttttctcatccttgctgggtatgcacgccctgtttaatgtcagcaatgccggaacgaatcaattcattgccaaattcgttcaatatctgcaggtccatcgaag

SEQ ID NO: 2873 - DNA, 126 bp, Fusarium venenatum
  misc_feature (1)...(126): n = A,T,C or G
ccgatttggagaggcagaccaaacaagttaaggccgattgtgatgcctggaagaagcgtgccggtgagctggangcanaggtcaaggagcttaaggatcgcccacntgctgagccagtccaagata

SEQ ID NO: 2874 - DNA, 458 bp, Fusarium venenatum
  misc_feature (1)...(458): n = A,T,C or G
ctcgaccgactgcgatactcgctccataccgaattttctgtctacaacctgctatgggaacctgcttttttgttacgccataatgggagcttgcgcatcatgtttgggacgggctgatggcaacagctacgatgaggaggaagagagtcgcctactttacgatgaggcaaatggaatgcaatacggcagctttggagaccaagccataaatggcgagaacgataccctcgaagcccaacgcgagaacgaggcattacaacgagtaatagccaaaacatcagataacatggtagacatcttcgatatcgcgcctcaagagaatggaaatcgtggaaccacaacccccttcgcctatgctggccaaggngcaccgtnttgcccgataccagcatnttgnggcaaagctcggtaaccagggcgacaacactnctgttaacggcgtcaagggtgactggctg

SEQ ID NO: 2875 - DNA, 588 bp, Fusarium venenatum
  misc_feature (1)...(588): n = A,T,C or G
gaaaaacctcagccgtacgacccttactggtacaatagttcagcaaactactgggagcttgcgcgtgtgacgtgtgaccctaacgctccgtcgcgcaatgtccaacaagtctcagactttaaagctcctgtcgagtacccatcgaactggagccccgaatatgcgtacagagggtatatcaagaattggaccgcctcccaagatccttgccaacagccacatctgcgtcagatgcacgggagttttgttgcaccccttagcttgtcaacttctaccgaattgatcccattgttcggcggatccaagctcccaatgaacaacgagattttgattcctggtgccatgtatctcacggctgatgagttttactctggaggagacaagatgggcccagcatggcatgccaagaagacaggtatcgtgtggaagggcgatgcgtctggtggtgagccgaaggctgacgtttggcaccgcttccatcgtcaccgtcttatgcagatgctaaacggttcatatgtcgacagtgtcgancatgaaggcgtgaaaccgaaaactttccactaccagaccagaacactacaacagcac

SEQ ID NO: 2876 - DNA, 579 bp, Fusarium venenatum
  misc_feature (1)...(579): n = A,T,C or G
tgaaattcttgaccttgaattgtccgtctgtgacaagactatcctaaaagcatatgtatataaactcacgaaaccaactaccacttccaaatagcacaaaaacccagtttcaaccaactctattagaacatatataatccgaattcaacaataagtcctcccaataccgctacaatgggaagaattgatatggaactcgaactcaccggcctagccactctggcttctaagctcaacctcgactgtccggagtctttcgagaatccaagaagcattgctcgctatcaagaatacccttttgctcgctttaaccacgacgaggatcagcctgatgtcattgacaagaacagtgtcgagtatcgtgtacgcctcgctaaggnnattcgcctctcgacaatgcctacgaaaagacttcacgaagtnccaagcccgcanggntgcttcantggaaaactggaggaaacaacagcnatgtggacccgtttntntcgaccaacctacaagagtcnccatcgnggnacaaaaaaaccggttttgaccgataanntttatgancatttggaaggaacccccactcag

SEQ ID NO: 2877 - DNA, 156 bp, Fusarium venenatum
  misc_feature (1)...(156): n = A,T,C or G
ntgacccaatggatncctttcctatttangttggggcnttaaaaaagaatatgaaaccttgggttggtggtgntggtaaaaattgggccgttnaggcacttggttaacttgatanccgtgactttnggtttntgaaagnttgaaaccnatttttat

SEQ ID NO: 2878 - DNA, 1112 bp, Fusarium venenatum
  misc_feature (1)...(1112): n = A,T,C or G
catgcctcgggcagctatcggccgaaatgatttcgaaaccgatcacccctctcttttttttgggattcttactagtggcgaccgatactgacgatacaaacccaacatcgacatccggatgcaagtttattgaaaagctggatgattctgctggccatcattctgcccattgatcgctgtcgactgttggggcggggttcgatcacggctatttcctacatcatttgctctatctcgttcttcgacgtatgttctgggggttcacgacatttggctcgggttgctcttgatggcgagggtgttatactatggataaaccgtcccggttttctatgaataacctcagcgccttcaggagactttcctgaacggcatgtccggtactcctccttgctaggtgtactagacctgtgggttcttggctgcattattcgatagtagcctcgcacctcggatgccggatattatcgccgattatacaatactcgtccctgggctgaatttgggttcgtagtacgatacgactctattccgtcgatgcggtacagctttgatcccgcccagcaggcatttctttcatgtattatttttcttttactttctattacaatgctcagacggttgctttggactttgaagtttgcttccttcgggggcggcttctggggaggcgacaggggacgtcttggaggtgttgagttgatcaaggagttgtcatcgacactcgggcgatgatggtaatagggtcagaaggtactttctgatggcagagagaatagtgaggtttaccggtccgagtcaaggctagccctggtctcgcactcccttagccttgatgaatggaatcagacaagtggaagctcaataaccttgcagttagtacatctctctattcaggtgttacttggccagagaacagcatcatacggcatggcttggcaggtgctgttacccatggttggcgagtcaaaacatcccactgtgggcagaaatattctacgtttgcttaaactcattgcatttgcttccattcacgggtcgcttttggggcagcataaatagtttacatcttgcgtcgcnttttgaattgatcaaggaatttcatcgacctc

SEQ ID NO: 2879 - DNA, 273 bp, Fusarium venenatum
  misc_feature (1)...(273): n = A,T,C or G
nngccggcgggnctggcttacagtaatagtcaatatatcntnagggtacctaatagaacggattggaggcgcnctgtggnggccccctttttactctnaatcaggacatcattggtgtgggggagaaataaagccaccaaccgnttccaatcttcaattcaaattgccacaagatgccatcaccgaacgaatagaaccacatgatgggntctggaatttaatccnggtagaagaaaatggaaaaatcatggatcattatagtccgttaaaaaa

SEQ ID NO: 2880 - DNA, 116 bp, Fusarium venenatum
  misc_feature (1)...(116): n = A,T,C or G
natntaaaccnccntggcctattgnacgattaaagtcggaanaagnttccnccgaatttgcccgggggcncnattcgggtntgaaagatgaagcgtgttgnctacccattgggcaa

SEQ ID NO: 2881 - DNA, 189 bp, Fusarium venenatum
  misc_feature (1)...(189): n = A,T,C or G
naaancggtggacncggaattggattttcgaccaacggttgnaggcgagggactgaatccntgtcattanccgggtccaaattagaagagatttaganggcaggatttcacccacaacgttcccccatctccttggctcgaggtccagacagtttgatcctttgagttagcacctacctactgcgttgc

SEQ ID NO: 2882 - DNA, 437 bp, Fusarium venenatum
  misc_feature (1)...(437): n = A,T,C or G
aatttcacagcgacaaccgccgccatgggtacgtgaagatattgaagttcagcctctgtatgcgagtagaggaggtgtgcgcttctgtgcctccttttctgcgaccaatgcaccatcttgttcgcgaaagcgcaagacagagttgctattttttgagcatgcttgaacaaaaaggctgacgatggcttcaccctacaggtatcgatctcgaccgccaccacgttnaaggcacttcacccggactgccccaangagcgacaatggtctaccttcaagctcttgggngaagcttttaccggtttnctggcttcggccgaaaccgatgccttnttttcaaacaangggtngtttctttcgaccggtctggttttactttccnaagaatcaaacccgaaccttcccggtnttccnttggtncccggtnattnggtcggccc

SEQ ID NO: 2883 - DNA, 361 bp, Fusarium venenatum
  misc_feature (1)...(361): n = A,T,C or G
catcaccaccgcgagctccgtacacgaggtagagcaaacgtgtggctgtctttaagtttcaaccgttattatctctccgcgaccggattcacaaggctgcgccgcgcctcttctcttggctgcgaaatctccttgactttgatcccgccctttgcgatagcatattccactttaactcttccacgcgcacacgcgattcttcgctacctacttcctttaacctcagtcacgcacgcctatcgtgcttntttccacaaacccgagacggccgagcaaaacatcaatcgttaaccgcttaccacgaatgacgtttgcgcaatctcgtgcggaattgttaataaatcacaaatttactctccag

SEQ ID NO: 2884 - DNA, 868 bp, Fusarium venenatum
  misc_feature (1)...(868): n = A,T,C or G
ncaagaaaacacggcanttgcttaaacctacaggttncccaaatttaaaccaggaaattaatccgtgcctacttctgcccctggtctcccgaaccgaacaggaagcggganaattgccaggttggtttaatatcggactatctcatagcctggaaagctatgaaccttgaaaaccactggttgaaaaaacttggctgggaaagcctgatgatgttccgtgagctatgtncaacagcaaagcgtgagacctgtgttttacggttccacacttactgcaatatctatgtctggacagcgaagaagcctggccagccacagtaaaaccgtggctttggttcagaagaaattgccaacacagggcacaaatacagggcatatctccatgaagctcatgaacaccgtatgaaatccatcaaggcaggggttagacatggccttgttcttcaattctttgccagggtagttgtaagcccaaaccggccccgggcaagatggcgtggttacaggcgcggtgagcaaccacaccctggcgattcctaaatgataccacgattttccaagcattttacagtgcttctctcttctcatccgttggcggtccctcgagtttcaagagacgcttctccttaaaatgagtgtggcactgacggctagcgacaaagatcctagttggtatcaccaacagcggggttttgatcacatcaacatgtcaaccattatgaaaaagcctgtcgatcgggcgaatttatctgaacgctagacactagtcaccaggtcaaaatcgtttgccaangggaacaatttcaaaacgcgtttattggcaacgctccattatggttaccgcgcgggttgaaaaaaaaacactgtt

SEQ ID NO: 2885 - DNA, 529 bp, Fusarium venenatum
  misc_feature (1)...(529): n = A,T,C or G
gttatcttgactgggagttggtgaagatgctgatgttatcaccgtgtcgcccatgttcaatcctatcaacagcaattgggttatcgccaaccaggtttggggctacaacgattcaacccataagtctcaggatattccccgacgtaccaccatcgtcacacagtctcgtgtatcaaagagctactaaacatcatgcatgttgagaatgtccgtggcaatcatgttgcttcagaaatgacaccgcaaacagtggcccttctgcatggcctcaaggcagtatatgctcctcatcctgttttcatggaccgtgactgggatggaaaattcctgaacaaatggttcaccctggcgaanaacggtgaatgtggtggccgcggtaccccatgggctggggccgaaacgcaaaacattggtcaacctgttactaccggcaataccccaccgactttcacactggaatggctgcaanaacagggcattggtggcctaattggaaaaaaacatgaacttcatgctgctccggtttctc

SEQ ID NO: 2886 - DNA, 479 bp, Fusarium venenatum
  misc_feature (1)...(479): n = A,T,C or G
agaggaagcttcgtcggtggcgccgctctgagagaccctgacaccaatcacagtgccacaagtctcgacaaccgggcaacaagcatgcgagacgttgcacttgccggccgtggcacaaatggcgagtcgagcgaccgtgacatactacatgattcacgtggtgtgagtcctgtaagtagtgactcggatgatgacgaacaagttcctgccattactcctcccccagcgattaaggaccctgttgcacgacaaagccacagtcccttaagagactccaggtttagagagaacttggacaattgagtagacaatacgccaagacaaggtnacggacaatgaattgggttgggcaagttggcangatantgtttggcgtataaattgggtttcctggtttcctgtttctttgaacgttgcagcggttattaacaaaacgttacngtttatgattggccactactagggttatgttttgccta

SEQ ID NO: 2887 - DNA, 542 bp, Fusarium venenatum
  misc_feature (1)...(542): n = A,T,C or G
cgtgcaatcgcatcaatggctcaaccgtcgcctttcctcgagccaggttccaccacttcttctggtgacctggcgatcgttcttctctcacgcgacaaccttgaacccgttaccctcgaggagtcnactggcgcagttgatggctacctcgaagcgcaaccctcaacacacgattcggatcttttcctcactcgacgttactcaatatcccttggggatctcaagtccgcgcatcaaatgttgatnctggatcaagaagacgaaagcgccgccgtgaagtgactgacgacgacacaccaacaacgactggcctgatgaaaagttactagtgtcnaatctaagcctgcgaaaaagggtgtcgtagcacaagtggctttattcatattcttcgaccgaccccgaactttggangacanctccccntcgaaccagttgttatactccgattacagctacatcctacagaagatacaacaatnccggtatcncntatcaaacagggccggtgtggtngttttaacacnctctgcncactgtttcaa

SEQ ID NO: 2888 - DNA, 499 bp, Fusarium venenatum
  misc_feature (1)...(499): n = A,T,C or G
nggccgccagngtgctgganttnagcacatacaaaccaactaaacgaacaaacacacttcaattgttttacacaaacaaatcaataacttcacaatgacaacaaattcattcggatcagctcttccccgctttgacttccaccagcccccagctcccagactcacagcgagactggcccgctcattacccactgcagcgctcgtcacaacagcagcagctgcatacgggctcacatattatgtcctcagacagcaatacacaatggccaaggctcaacacaatcgagctgtggaaacattaaacgaaatgaaagagcgtgggaataaaacggacgagtgggtgaaaaacgatgcattatggtggacggcattttgaacaggacacgagaacgggcatggactagcgatttgaaacatttttatgcatttttggaatagcatatgagcagagacagtatttaagcataagaatgaaattaatttatgaccatcntaaaaa

SEQ ID NO: 2889 - DNA, 324 bp, Fusarium venenatum
  misc_feature (1)...(324): n = A,T,C or G
cgccattcttgcgcttccaaagcaaagtaattgatncanagcttcattgaacttttcctntcacactattcaccatgaccaactccgaggttcaaacgcctaccaatagntgntgcacagcctgttgcaaagccagngatcttggaacacatgactactgcgtgtanaatcgacagaaggacaaaccggacggnacgcccaaacaggntcattcaaaagggtgtgatgggaggagtccgtggttccnaaagtccccctggaanctgnacaaacttttgcanantgcaggttggggccntccntgtccgcccgttcnggggaaaa

SEQ ID NO: 2890 - DNA, 628 bp, Fusarium venenatum
  misc_feature (1)...(628): n = A,T,C or G
ttccagtcactcgtttaacaatctcggtgttgatcacctgctggtccgttacactcctttgaatcactcacaatcgacttgtgtgtttattctctacagcaaacggctctcgtcactattttccctcctcggtgaaaacacttgcgcaaatcactatcacaaccaaaaagaaagaaggaaaaaagcaacatccatgaaaaatgcgtttcgtcaattttatcaccgtctttatcggcctcgctgccgctgcgcctgctgttgcacctgctgctacacctaccaaagatgaaatgatagccgtcgcgacttcaagctcccaccgnttctggggatcccttcacctattggacccgntacctatgaatcggcaaggcctgcgatgaggacacctactttggggcgcgaggccctnaaggacaccaagcgggcaaaaaccggaatggngctgccctctggcaactttcggaacccaacggactttntcgncccgngcttgtgaaacncagcgagtttgcttcgaacggccncttgatgnggcaagctggtcctggcgtttccnccggccaccanggattgatggcggngccaaaaattggggacatgcaaaggccgttttgnaaccctgagg

SEQ ID NO: 2891 - DNA, 626 bp, Fusarium venenatum
  misc_feature (1)...(626): n = A,T,C or G
caaaccgccatatcgaatcttcagtaccctagtgtcattcaatccgatgctgatcccagatcatcgacttcgagttccaaatcaggacctccatcggttctttctggagtcgaaacagcgcacgagacactgacaccagaagcacgacatgtaccgatcgaacgaagcgcatctgctgagcccaatggtaacgcctttgccgctattcgggatggcatcgtaggtcttaatctaggcaaagggatgctcgggcaacttactagcaccggcgagactgcctcgtcttcaaatccagctcccgcacccactcgtaacgatcaggagctaagtgagatgacatagaaggtcatgtttccggagtcagatcctggcccatacttgatcgtcgaaacacatgattctgtcaggtattgctgttcctggtcacacacactggcagccccgccgcttttggatacagacttcgctatgtcttcaagttggggtagtattcgcagtgtacccggcaacttgagtggaagaatgggagtacatcagacggtgcgactgtgaacttctagagccttgccttnatgtcacccccaacgctttcttgcaccaaaagaaaagcctgggacgcctcgtca

SEQ ID NO: 2892 - DNA, 213 bp, Fusarium venenatum
  misc_feature (1)...(213): n = A,T,C or G
nccacnagctntttatgttcnagggacnttgttggccatactnattgctnacacccacataatactntgaccggangactactgttggacattcttntgaatgacaaggataacntctgctggtcctcgacaaagctattntttcaagtgaaacatgctaanggtgctaaccncaccaacctttgtnaccgggantattaatacttcaagatt

SEQ ID NO: 2893 - DNA, 786 bp, Fusarium venenatum
  misc_feature (1)...(786): n = A,T,C or G
attcctcttccaaaggctttcaaaatctagctccacttacagtagaccgaggtcctaagctcatactgccgatcgcgatagctatctctcaacaagactcacaccccattgccgagtatcctcacttggacttttttagttcgatttttaacccgaaactatcgcaatggctcctctcactccccactggcagcaaccctcccacccagacatccaagaagttgtcgtcgtaaacgcccaagaattcaccaccaagagtatctctcgggtctctcttccaccctttgcagtatatgcaaagttcgatttcccgccttgcacacctgccagcgaacctacctacgctactgtccagaccggccgcgatacccacctcagcctgaacagtgatctgctgtacatcaaccattcttgngaacctactcttctcttcgatgtgggaaacttgaacattcttgtcggccccaagggtctcaacgtcggcgacgaagctgacattnttctacccttccaccgaatgggacatggcccaaccttttgactgtntttgcgggacacgttcttgccgnggtcgcattttgggcgctcgaaanatganccaagcccagcttgatggnatgnggcttaatggccatattatacagntccggccgancanatggntcnttccaaaacccccacaaccaatgccctttgggatgttgttgtttattcttaaaagggttttggaatcacttgtttgcccttcggtcggacaccaacaataccccccccaaaaaggacccc

SEQ ID NO: 2894 - DNA, 190 bp, Fusarium venenatum
  misc_feature (1)...(190): n = A,T,C or G
natatgaacagcccnagganaatccatcttccnggcccnagggtcggtctttaagacactcttttaagatttgggngcatgttttagaanggatccccctccaaaaccgacaccagaggncttgtcctacaacacaacttgggaatnanggttgcccaagcaantaaagtttttcgnggatttcncccac

SEQ ID NO: 2895 - DNA, 156 bp, Fusarium venenatum
  misc_feature (1)...(156): n = A,T,C or G
nccgcngggnatttntcatntaagaggccntttcancttcagantcacttanttccatgggatttcnctaattggggaactttntcaacagttnctgngaacctntttcnttgaaanctgcccagnttgctttangncagcttggcctgggtnaan

SEQ ID NO: 2896 - DNA, 568 bp, Fusarium venenatum
  misc_feature (1)...(568): n = A,T,C or G
gcgatgccttactgagactctatcatcgccaaatgccatctggacattgacatcgntcatgctgcccaagacacccgagtccgatttcaagcgtgattctgccaacccnctggttgaggctatcatgaactatgagctcgttcacgtcgaggcttacattgttcacgtcgacatggttttgcgaaacgaggtagcctacaagctcacaaaagataccattgatgctcttgttgagtaccacaaggagatccactgngtcgatgctaaggccaacacatacgactggaccgacaaggagcaacagtgcaagaagcttcacgaggattttgtccaggacatnacaagttggtttccgaccacgtttaagcccttgagggtcttgaggagaaggtgccggnaactgttttgcggaagaagtnaggaggtnaagaacaacatnagggctttnatgaagcccctattacccctcntcttcctggggtaattgaagtnggccggaaaccaaaatggtgccaantttccggntnaaaaatangggcanaactggntccanggaaccnggttgccg

SEQ ID NO: 2897 - DNA, 136 bp, Fusarium venenatum
  misc_feature (1)...(136): n = A,T,C or G
nagnatctagntgggntctcttgcgtacacctngntgaacaagatgggacangacggacttgangccaacaggnatngcataccgattgacccangtctacaggaagatgatgcgaatcatagccatcatgacctg

SEQ ID NO: 2898 - DNA, 581 bp, Fusarium venenatum
  misc_feature (1)...(581): n = A,T,C or G
tgatgtccgtagtcggggatgttgactcacacgacgccggataccgcctcagcaacccttcaatgcagcccgtttccccccacacttacatggctcagcagcagcagcccgcctggaacatgtatcccgtctactacccccaggctcagtcctcggttcactgaaggaccaaaatcagccgggtgcctgctggccggtacccgtcctgaccaccccgccggcctgccgcttcgatcagcttttggtcggtttcctccaagactgccgtcgtatggccactgcagantcactcgcccatacactgggtccgactcgaatagacgtgcggtccgtatttcgcagtcacganagccagcttgcctgctcgcctcatccgatcacggatttgatccggagtctcatagacacngcangcatgaccggctcatggancgcattgcaatctttgcgccccttcaaacaatgatatgttngcttgcacaacctacgccagaaanactncgcgactgtgcgangactacgcaccgcgtnagtgccaactgacactcctcaccccaatggcttgactaattcattggggc

SEQ ID NO: 2899 - DNA, 415 bp, Fusarium venenatum
  misc_feature (1)...(415): n = A,T,C or G
ctctttgctacagatacagtgccaagagggatgattatgccagaacttgaaccaacaaatctattgtttctcatatggggtttggtctttcggagattaacgctattgnnggtggattcacttccactatccccggtccangaattcgggaggatgttgtcttaataaccggggtttcgggtcaatacatacaatggaccaacaganacaagtttagtgatggttgtgtgatggctcattactgtcgtctttttgaatgtgagttgagcgaaattggtcttctgnggaggccaagtttggtgtcgctatgccattggtgggcatcagtcaattcttatgcttcgatcactcgtcgcactctcgaacaatataagatcagtgatatgatttttcgtatcacgtatccaaaaaaaaa

SEQ ID NO: 2900 - DNA, 223 bp, Fusarium venenatum
  misc_feature (1)...(223): n = A,T,C or G
cccaagagcggnatcagcactgttggtcttgccatcggtgctctgctcttctcctccttcgctgctggtgctttccagctgtaagactcgtcaattaagtttgcgtcttttctctgcggtttccatcattctacatcttgtcaataattaggagggggttctataattatctatgtattcgcagttggcgataaaacaattgaacatttatttaataccgtnc

SEQ ID NO: 2901 - DNA, 145 bp, Fusarium venenatum
  misc_feature (1)...(145): n = A,T,C or G
ntcgatatnaaaccangtgcnagaaganacatacgcngctctnatagatacatccatncgaacaagaagaacgatatcatccaacgtgatgcttgagntgtctattagncaccttacctttaattnattccnaggcttggccccg

SEQ ID NO: 2902 - DNA, 119 bp, Fusarium venenatum
  misc_feature (1)...(119): n = A,T,C or G
ncnaaagcgacanaaccggggcgggaccnccccggcgcaangacaaaaanaggagnagggcnccnggggggagagnncacggggccaaccagcgcnggggcgaanaagaagnccccgaa

SEQ ID NO: 2903 - DNA, 185 bp, Fusarium venenatum
  misc_feature (1)...(185): n = A,T,C or G
nngtgaaaaaataatatgcatcatatgctggcgagcatggcgntccggtgactgcanacagagangttggagccttttgccgaagcatccttggatgaacaagaatctcagatttgatctttatagattcttaccactcggtgcattgatcaacatatttatcttctttttacttgttaaaaaaa

SEQ ID NO: 2904 - DNA, 271 bp, Fusarium venenatum
cgggaatagatgtacacagagccctccaattcctgcacctcaagaaaccagaatgtcaggtctaacggctggtagacccaaccattaaaattgaaggatagcggcggcacggcgactagaggattgtgaaggccagcatgggcaagtcaacgcccggcctgaatatcgttagtatttgaggagaatcggtatgggatggctgcaaggcttcttatatagtcatgagcaggcacgacatgtcgagtcaacaaaatacaagtcgcttgcatgg

SEQ ID NO: 2905 - DNA, 686 bp, Fusarium venenatum
  misc_feature (1)...(686): n = A,T,C or G
catacatcctcatatttcccttgcacagagctactctgtgacaaaaaaaaacctacaagcactacttatctacaagacgtcaccccatcactcatcgctagtcgcatcattaccgtcgagtgtacgtcatcccttggctaagccaagccatttcaacgccgcaaacgagcaacaagttatctcttgggttaaaagcaaattttgtttaattcaagcatttcccaaacgttgcttactcaaccatctttctcgtgttgctgcgacaaataaacacaattcgcgcatcttcatcttcaatcgcaacgaccatcacaacaatggcgcccactgacgatctcatctttgcgcgcgacttcagatgtggctctggctacagttacagctacagtagaaacagatgttatcgaaacagctggtcctactggggacgctgggtagtcgcgggcattgtcatctttttctccttctctttcttatgtgctgcctcatctcccgtcgtcgtaagantcgtggcgttaancccgtctacngcactggctggatggcnggcaagccctggggacttaacacaacacacaccaggcctacaattaccgcaaccaangtggctataaccagaattccacaccaaggagntacacacagaacaacgnggtacaatgcnccctcgctatggtcacagaaca

SEQ ID NO: 2906 - DNA, 648 bp, Fusarium venenatum
  misc_feature (1)...(648): n = A,T,C or G
gaaggacagcagcagcggccggttatgtctgcgtggtatgctggtgcaccccatcaagtttgagcatccttcagagaagccttaagttgagggatgcagaataacagtccttcaaccttgtcgccgtcatgagcaaggcgacgctatttgtccaccctcgaccagcgcacacgacagacatcaccacgcacatatgcatttgcaggagcatttgtacaaatatacccacgactattactgaatggcaagacatccgattcccaacactacgatgagaagggtgatgacgcgaattctatgcatctatttttatcagttccttcgccctgcttgcattccgtttacggaaccagcgaactcgtcctagacttacctagacactttattatttgaaccttaccttctatttctcttccaccgtctcggtattctctgcaatcaagggtttccagaacgccgtcctaatcaattcttctcattcagactgggaatggtatgagggtgtctgcatcattcaacactaaaaatttgngttttaactcgctgttattctctggtctcaatttatcaatcggngtggcatgtcgtttntgggtaccagacattcaggactangcgccgggaatggncttccgctatgctacangg

SEQ ID NO: 2907 - DNA, 676 bp, Fusarium venenatum
  misc_feature (1)...(676): n = A,T,C or G
attctccctcgctcgtctcgctggtgggattctaaccatcctccttcggtccgaccctactagccttggcctcatcatcgcaactaccgtgctgctcaatgtaggcctcattccattgatgatctccatggttgggttcatccgtttgattatgaaatcaagccttgatgagaacaaacgagctttcttcctgttgaagatcattcgcttcgcattcatcgccgctatcattcttctctgtgttgctggagcttttagtggttccagtatacacctttcacgacatttgacacaggctggctatgtcactctggctgtcgtcattgctttgatgactgttgagctactacacctctatactcagaagcaccgcatttctcccgagaagcacatttttatagagctcactctagcaagtgttccgacactcgtcctacgaacagtctatggactactttgcgctttcacggttgacaacttgacgaccattggaattcgctggttggatctgctgtagcgttgctttgatgtgcctgcttacggagtacatacacttctggtttncttttctcgggattcgcattggcangcgttgcgctgaaagcttgggaagtatcgagatgaaatcttgaacacatgaagaanccttganaagaaaaantaggaagtcggtcta

SEQ ID NO: 2908 - DNA, 117 bp, Fusarium venenatum
  misc_feature (1)...(117): n = A,T,C or G
naccacaccgcncacaccncgacaacncccgcacnacacgccncncgaacgancccaccgccaaacgacacccgcaacncgncgagccgncacaccccccacacaggncgaccaaca

SEQ ID NO: 2909 - DNA, 112 bp, Fusarium venenatum
  misc_feature (1)...(112): n = A,T,C or G
nggggngggagttttngggaaacccggnggattttaaaaancccgacangcncaaaggggggttactacaacnacnggggtttttttccgaaangggggnatccanaaagct

SEQ ID NO: 2910 - DNA, 613 bp, Fusarium venenatum
  misc_feature (1)...(613): n = A,T,C or G
gaccaaggtagtgagagacgtcccccgcgtccgcgtacactgggactctgggcgtacaacntcatgcttgcaaggcagttggggcctatccaaactctgaacaaacagtggggtcaagagggcatctctgaagattatgtcatgcaacgcgtcgcggatctagcacaaggcttacggctttgggaagcgagactccctgacggaaagaaagcgacagaggagaaccttcgagcacatagtgccaaangccttggaggaccattcctcgccatacatacaggctaccaccagcatttcgtacttttgctttttagattcttagatctcaatcggacccagacaccggagactatcgagtacgccgagctttgcaagcatcacgcaagttcgataagtcatctcgtcaagctctctcgccaagttcccaattgtgaattggtttttggaggaatgggtnacatgacanctgcctcttctgcagtcctactgcatacgcttgtgtttggtcagcaagatgaccngctggtatccgagccccantttagantctactangaagccatccatgagcttcaaaaatnctgggccttccaattgaaactcagtgagtaga

SEQ ID NO: 2911 - DNA, 387 bp, Fusarium venenatum
  misc_feature (1)...(387): n = A,T,C or G
tcgtcaacaaagatgctggtcactattatttatttgagtcgagacttacaacgagctaggcgtctcaattaccacggtactcttcaactcagttacaatggtcaaaaaacttttgattgctgccactatggcatcgatgattccctcggccaatgccttcaatcccgctnaagatcggtggctttgcaacaaaangatgctatctgcatcactcgttggatgggctcaacattggtgaagatcagcgaangnttgttatattctgngacacctggcagagntccaacactttggaagacccancctggttttggggatacatttccatagctggaagggacgatanactttccnctttntgaggggcttttngaanaacggtcgcca

SEQ ID NO: 2912 - DNA, 694 bp, Fusarium venenatum
  misc_feature (1)...(694): n = A,T,C or G
attcttacacagaaactaaagagtttctcgctgtctcttgcgctcgagttgctggtaaaccagacaatgctggcagcgccaaggaacttcttgcgcgcgagtggccacatgcgttaaccactgggaactctgactctccatttcttctgtcaatgctaaaagtgtacgtgggaagccataaagaagacgcggacaggtcaaattttatccatcaagtcacgcaaaatgtcgagaagttactcaccagcgaccgatcacttccaaaaatgacacataagtattcttctatcgatcttgtgacgtttttcttcctcaactatgctttcgagatctacgacgattgctttgaccaggcaaatcccccagacttcgtgacagagcacctcttgcacgagttcatcaagaaacaacctttcataaagacactcagcctcaaccgccctctcctctacgccattgggttgaatggtgccaggaacaactccgacttaaccaccctgtggctttacaggactcccccgggaagcccagcgcaaacatgcgatcctgggggcacaatattcaagttttttgcaccctttggggggtcatggtcaactggtacggcaaattgngcccccatggacaatcaggcgaatccgctttgnataactcttcggactctgggatntntttggatgattgngatgaacnt

SEQ ID NO: 2913 - DNA, 164 bp, Fusarium venenatum
  misc_feature (1)...(164): n = A,T,C or G
ggaaacccctcttcccaggcaagcagcgaaacaacttctaagcaggatcacgccaaggtgaatgtccacctcgagggtcatcttctgatgccctcaagcgcacaacgaacccttaacttttttttgggcaggcactattggcaagcganggccctgaaaaacga

SEQ ID NO: 2914 - DNA, 556 bp, Fusarium venenatum
  misc_feature (1)...(556): n = A,T,C or G
ctttcaacatgatttccatatttcccatgtatccatgtcgcatttttgtcatggaattcttcgctggcgtactcggcatcagcatatcgctttgtgctcggtccccagatcaacaaattcctccatcggcatttccgacgttcaatcttcacccaggcataggataagctaggcatatacgttttgcagtttcctaacaatctgaagggcttgagacatgctatgttgaaggttgacatcacctgccattggtaccaattctcaactaaacagggtgttatcccatcagtctagagccaaccgtctcgaaaagaaatcctatgtggccttgtactggtgcttgggctttccacatacgtactatggaccacggaattaattggtcaagctctggcttatcaatgtgcaatagattcactcgattgaatgcatctgatgctcattctcacaagcacaacacaccatcctgcacctcaaacatgctcaacgtactcggtacattgtctctcttccattgcnccgcctaatgcgcaacacncgtattcanactattact

SEQ ID NO: 2915 - DNA, 622 bp, Fusarium venenatum
  misc_feature (1)...(622): n = A,T,C or G
gacacaacgagaactcaatctaccgggcggtgctggtgcanatccacagcacgttgtaacgagatctctagaagatttacagattcaggtcaggcgattaaccgagtcgcgataagttttggaaagacaactataccctcaaagggggcactccgccttgatcccgatcgaaaagcgtatgccagaactcgatgccaacgcccgttagtttccgaaatggcatggatgagggacctcgaataatacgtaacctgtcaagtttgaggcgccagttctcggcagctacctccctggatactcggaagagcctcaatggcttttgccaatgtgatttgacagggaggaagtgaggctaggtaggagattccatgccgtactatctactggcagagccaccctcagcgcccggcttaaagcgattttgttttcggcctagacgatgtgctgtgctgcgctgcgcgggttgtgttgcgttgccgtccgctacagactatgatccaagctgctgggctcgaaacaagtgtgtatcacatcacaacaaagaagaacaaagccgagttccgcgcaaatgccggaaaggattccancgtgcaatcgggaatccggncgggcgttttacttc

SEQ ID NO: 2916 - DNA, 488 bp, Fusarium venenatum
  misc_feature (1)...(488): n = A,T,C or G
gagaatggcggtattgagcttcaagctgaagcaggagatgtctttgtcattccagcaggggtagctcacaaaacgtacaacaccaaacccgaagcagagttcaagctcatgtcacccggtgttggacacggcatcgaagctgatgatccacgacaggctttgtcagagattgagttgtcgggctataccatgatgggagcttacaatggcggaaattgggattttgtcaagagtggtggtgactatggcaagtcgtggagggttcgaaagcccaagtgtgaccctgtatttggggaggtggatggccttgtgaanagttggcctggggacnacaaggatcctgatttggaaattgttcaagtaganaacagggagcgtcanaacagggggtccaaactttagatgtaagcattgaaacaatcttaccaatatcataacccacaacttggtgngggggttgactgtttcattttgtttgggcatagtca

SEQ ID NO: 2917 - DNA, 577 bp, Fusarium venenatum
  misc_feature (1)...(577): n = A,T,C or G
gaagaattctcggccgcaggaatttttttttttttttttttncttgtggatgtctttattgaatgtttctatatacggatactaaactgatcattatcccgtactgattgctccctcggcacatgtgatttcctacgtgcggcgaatgcacggcacatacgcagtcttattcaaccggctggtccccttctctaatgaacgactccaggttgatcctagctgtgtggatcacagaagccccaagagtatcgattcggttgatcttccgaccaagatatctccccacaccatccatacggttgttganatgggcgtattggtcatcgactcggcgctgcgcgaccgagctctggaattcagccgggttaagaattggcatgagacgatgagtngggtagaatcgacctctaatcgactgctccttgaacacaacgttctccttgactattgcataacaccatcgttgcgccccgactgagcgacccattggctctcgctgcgcaacgcaaggggaaggtatcatcccngacaattttgggtgatcttcnggcacaactggttaatntaacccggaaaa

SEQ ID NO: 2918 - DNA, 473 bp, Fusarium venenatum
  misc_feature (1)...(473): n = A,T,C or G
cagtcaagcacgattgagggtggtctgacaccagcgcaggaggatattctttaccgagagggtaccattccttcggctgagaaggccgaagctctcgttgcacaagcanagaaggctgagttggactcncccgacagcactgagatgcaaaaccccggacacaagtttggtctaccaaagcgaccttggccggaaggtttcaacatgaagaagcgttaccatcctgtgctggagcaaattgctcgactcctcatgaaggatggtaagctcagtgttgctcaacnaaatctagctatcgtcatgagctacctccgaaccgcccacctncgatctacagtccgaaattccccctnctgcccggtactccccggccacacatttcctttnaacccgattntatacattaccgcgctattgactcggtagctcctctcctnaaaaccgcaacgtggcgggtgccggtggtggtggtc

SEQ ID NO: 2919 - DNA, 455 bp, Fusarium venenatum
  misc_feature (1)...(455): n = A,T,C or G
atagatgctactcgtttctgccctggacatctccgccatggagatctcatgggaaagcatggcatgagcggtcaccgagcaaacctttctgagtctatagcacagatggttcgacgacaaaacacaccagcacccaccgacacacaggattctaccgccgaccctactgatgccgctgtcgacgaagcttctaatgaagcttcggcaccaacagccccaacggttccactgnacccacgggtctacagcttcaactggccaactgngcccactgccctacggttcttcagacaccgnagtgccgcctnngatactgntgaggcgcctacggacaagcttccgcaccaagaagaagcatttgaggaaccaaccgatcttgcncaaatgaagattagagcacagaaccaagcnttagtacccacggcnatttgacgagcgactttgcatgtggccaa

SEQ ID NO: 2920 - DNA, 344 bp, Fusarium venenatum
agttgaaatcgctgcccgagactggctcacccaagctaccaaccaatacgatgccaggtttaagggaactcccagacatcaagactggaccagccgtatattcaacgacaatgggtatatcagtaaaaagacgctgaagtttaatggagcgcgcggccatggcgcccgtaatgatgaaaacccaagaatctgggcgcagagtaatttcgaaaagttgtggaagcctagtcttggtgcggctggacctttttgaggctctgagcctcggcagggtatcagaaactttggccgcttgaagtataagagacgaaattagttagttaatttatgctcggttcgacgtg

SEQ ID NO: 2921 - DNA, 465 bp, Fusarium venenatum
  misc_feature (1)...(465): n = A,T,C or G
tctcgacatccttgctcacaccgttagcgactgggtgatcgtctgtcttgtcgtcgccattaactgatgtggattcaggcgcgtcgtttgacttatcaggagtcgcatgcctggtagcaacaaagtcagctaatgctggggaaagatgagactgcatcgcgacaatgcggtaacacattgcgcgccagcacgacttgggaacaacttacccattaacttccgacttttgttccttctctgtggtgacatcacgcgatggagaatcggcggcgggaggatcggggttgggtgaagccataatggctggtcgcgataaatgcgcgtcaatattaagtgtatcctagttgacccgatgcgacatgaaatagcgatgcgtttacgtatcaatgtgagtcgtatgttatcgaaaggtaagcgacgtgattttgatgcgcgatgganatggttggggtggggaccctggaa

SEQ ID NO: 2922 - DNA, 158 bp, Fusarium venenatum
  misc_feature (1)...(158): n = A,T,C or G
ntcgcgatgccnacacgcnaaaaattgctgtcaanggtggaacttctgctantcctgaatgctggattgncggcanggtgtgactatgatgtgaataagccaatactngtccngagttctactggacncgaataaccatgctcggagncattccatgt

SEQ ID NO: 2923 - DNA, 394 bp, Fusarium venenatum
  misc_feature (1)...(394): n = A,T,C or G
tcttttctcatccacccggcaattgagcgcacaatggcttcacggantggtgttctcaaggcgctctctggcgcctttggcgantatggcccttggtggcctggcactgacgccagccactgttttcgctgaaggacccagcgacctcaagcgaaaacccatttacgatnacttcganatcccagcatcnaagcccgcacccgtganaccaccacccgctgccacgacgcccgtcgctgagcccattgaagatgangaggagaggcactattagcctaccccnacngatcgantggctgtttacntcggaaaagggcgtctgtctctgttcaagtacctgtcgctgccgaaaccaaagtccacgangtcatggattcggntttcaacctccaac

SEQ ID NO: 2924 - DNA, 650 bp, Fusarium venenatum
  misc_feature (1)...(650): n = A,T,C or G
cccagacctagaagtctcatcctgtgtccgtacatcatgaacactccacaatcgtcaagtttcgccgcctctgagtttatcaccgaaaaccctggaaagccagttgcccagaagtacgtccgaagacgaggcctgaatgaccagataaaatgggttaggtcatggatggccaaactaccccaaggagatgaggactgggacaacaacaggccttcgactccggaggacattttacgtttgcatagtcggctaaccatctcccacatcggatcacgccgaaacatggactggtacactctcctcgatacttacgctgccgcctccaaggactttgaacctggaagagagactcaaacacattgcatggtcatggtcgcattgtgtcatgtggctcatagtcaaggccttacgacggacgangtaatgacnggcatggcaaaatgcgtcagtggaggaagcgatacactaaagattcaaagcgaatcgcactaacaaagtgtgttgcaanattgggngatgaacttgaaaaaagttattgggggccncgggcatatgaactccccgttnaanaattgagccgcctaanttacctttggncaacantttancaaccgaatggcttcaaaatccaacccaaaagagtccatatc

SEQ ID NO: 2925 - DNA, 256 bp, Fusarium venenatum
gagacaggcagttccgaaaccgatgccacttcaacaggaagcagtgcttctgcgactgctgagagtgatgagaacggtgcttctggaaacatgcccaagatgtggctgagtcttggtgctctttgcgctgccatgcttacgatgtaaatcttcactacggtatagaaagaacgtctctcttctagattcagttttggttgcttatagattggttgcctttgtttatagatcgtttgaatagacatcattgactggg

SEQ ID NO: 2926 - DNA, 501 bp, Fusarium venenatum
  misc_feature (1)...(501): n = A,T,C or G
cccccgatgtgcaaacactgcttgttcacatgtgtgctcttcgcctaatgtactaaggtatatctgnacccaggtatgtatgtatgtacgtacctacatatagcgtatccccgatgctaaacccacacacaatgcatgtcagccccagatacagcgaatagagcaagagagatttcctcgaaatcggattcgggtcagagatgggcgatctaaatgacaagcatcggatcttgacattcgttttgcttgccagctgcatgagtttggcctgatcttgtgcgcaaacnanaattactcggcttgactgagctgttgcaccggtccaaaggacatgtacatggagctagatatgaagtatcctctcttctcatctcatctcatctcatctcatgtgatgtgacaagtgatgactttgtacttccgctgtgctgtgttgtctgtagtgtacgaagctgtcatcagtagtcgtctcctcgtttattaagcagttgcataaccccc

SEQ ID NO: 2927 - DNA, 136 bp, Fusarium venenatum
  misc_feature (1)...(136): n = A,T,C or G
nccagcaccacggccagctcctggatgtcangtccctctgctgganganaacaaacgggatcgatcatttgatacttcnctaaacacagtctttgagtatngctttccgctctncgntcagcatggtntacaggnc

SEQ ID NO: 2928 - DNA, 412 bp, Fusarium venenatum
  misc_feature (1)...(412): n = A,T,C or G
aacattatagcattatcaacaccataccatagcatttacaacatggccgaaactctcctcgaagctcgatacgtctcccgagcgaaactgacgaacctcctcacaacactgtntggggatgcaaagaattacgatgtgactaccgaaaatgacatgattcaagtcactgcaccgcgtcaacttactccgaaattgagtcaattacggataactgagaacactcatgaaagaaatacttntcagatacagaactctagctccaggtcaagaaataaaccgcgatgatgaattacaatcaagtcctagattcataaccctctaaggttggctcggaagcgtaaggctcaanaggtcaaatcacgtttttatgtcatcttanatccgccccaattgaattancctccttttttgg

SEQ ID NO: 2929 - DNA, 411 bp, Fusarium venenatum
  misc_feature (1)...(411): n = A,T,C or G
gcctatttctctgattacgatgaggtaattggcaacgagcccaaagaacaacaactgttcactgccgaaacgccgatngtcattgtcgactctgacgcacgacgcgcagtctcagacaaccaacgcgccattccgcagcatcccaaccccgcaactgagtatcccgtacgtggatttggcgatgcattgttttttaatgtctttgattgtcagcaaatcgacctgggatttttagaatccaaaaataagacagtcgaagatcctttgccagataaattatttcaaccaatacatcgtcgagctgagcgactggaaagatcagtacgcaatgctgaaaaaggtcgagctcaacatgaaaaagaccacattatccggcttctcgagggcctgccaaaaggggggcccccccaa

SEQ ID NO: 2930 - DNA, 649 bp, Fusarium venenatum
  misc_feature (1)...(649): n = A,T,C or G
tttttttttttgcatgttggacgaaacacggaacgaattgctccatatggtatctgcagcgtctatccatcaccagatggaaatcactcagtccatgtaccaaacatagtatatcgnaaactctatctggtcattctatctctttcatctaagcaattcttacacgaaagcatcagccctttgggctcctnagaagtcatccaggaccgngggtatcaacctctttctctcgatccccattttctatccagaatactgntcttcatcatgctttgcttctcaccaactcatgacttccctgccgcgatcaaatcgcctngtagctgacgctcaggcttgacgaccttgcctntgagcacagtatatcggatcaaggtctnacagtcttnaggcatgacacgagcaaagccagatgccctgcgctgnaccaacgctattctnttctgaaccattggcgctgcaccggtcttntcaccattggccatgccgtctgntgntcgaccgtatcattcaagccaaacgcattgggccgcngnagatcattacattagcagaatacttgngtcctccacatggntgatgnagtaaaaacccacttcaccggggcttttattgngtanatccgatacaaggccgacnggctnagtgg

SEQ ID NO: 2931 - DNA, 122 bp, Fusarium venenatum
  misc_feature (1)...(122): n = A,T,C or G
ncactggngggcttaagggaagcaaggncctctttaagttnggtatcaacttcnacnaggatattatctgntacaacatcactntgtatgggttcngtgnagactaccantatgcngccaac

SEQ ID NO: 2932 - DNA, 256 bp, Fusarium venenatum
  misc_feature (1)...(256): n = A,T,C or G
tttcttttctctctctctctccttttctaacggcgggcttagatgagaacgatgtcgtcgcacaacatggctggtgcgacgatctcgacttgattcttgaaaccctccagaaaagccatcaaaacttacggnacctgattggcttgttggaagatacatgcaatgcaatgcgcctattcttctggcgtacacgatagggtntgacacgcaccgttggatgaggttcagtgctggtcccttgtaattaattttgtaa

SEQ ID NO: 2933 - DNA, 165 bp, Fusarium venenatum
  misc_feature (1)...(165): n = A,T,C or G
ntantcgaanaggnccttgaaaatccntggnacctggngagggnaaaggtggtcgtaantaccntttctttcccgganattccaccatnccaaanggcccntgagctttntatgcnaaagcttcccttttccttgntcgtccgttntactccccagggacttcta

SEQ ID NO: 2934 - DNA, 243 bp, Fusarium venenatum
  misc_feature (1)...(243): n = A,T,C or G
ntttcgcttggattgaccaanaacatggtgtttanaaatcctccaangggccagactgacccgataattatgtggagagacgatggtgcangggatatgaanatcgatggtgtttgggananaagaggcacgagagttactcnacctgctgattaccatttatganaaagccaccggcgctgatttgataaatttnttttggattatgttttgcagacagttaacttagatcactatncctgg

SEQ ID NO: 2935 - DNA, 558 bp, Fusarium venenatum
  misc_feature (1)...(558): n = A,T,C or G
ctgacaaagtttatgctcaaatccaacatctccccctactcggactctcctgttgtgcaacgctgctacggtatctgggctaagggactacttcctctgatgttgaacttgcttacagctttgggcgctaccatcgctccanaagttgcctacgtgttgaaccagttcccacacctattggaggcaagcgtggaccgttttgaggcaccaggggcaagccgtacgcagtctcgagcgtcgcctcactacttgacgcttgtggctatttctgaagtccattctctggctctcctcacaagagtgcttgctgctcttcgcgtaaacaacaaccgggatattccggacgtcgaatgggattcagcaaaccttcttgaaaacgtcgagttttggttgagcacaaagaagctgctaaaggaacgacttatgcctttgggacaacnnagaaatggattgggcggggtatngaagcccgtccccggagcatacgatagtnttttggaggagaaagctgnggctcaactggacgccattccnggatgtgtttggcgatgaancaga

SEQ ID NO: 2936 - DNA, 179 bp, Fusarium venenatum
  misc_feature (1)...(179): n = A,T,C or G
ntcttcaagcangncgtcactcgtnccatcaccacattttgtcaggccctcgaanntcctccatncggaaaggtnaagcgtntgccaaaatccntgaaggaantcacgangancaaccatgcgataagntccaacaggaanccaanccacaagttcnagcaataagtgcgctcatcgat

SEQ ID NO: 2937 - DNA, 191 bp, Fusarium venenatum
  misc_feature (1)...(191): n = A,T,C or G
ntgtgntcagacagcantanacaatgnccnaggcttaaaacaattagctgnggnacattaacgnaattgaaaancntgggattatgcgacgngtgggcgananctatgcatttggaggnccggcgttaagaacngnacacgagaaccngcatggactagcgatntgaaccattttatgntntttggaatag

SEQ ID NO: 2938 - DNA, 117 bp, Fusarium venenatum
  misc_feature (1)...(117): n = A,T,C or G
nggngactantattggaattttgcggtacnaaatnggggccgngagcaccgggtgnttaaaaaanatggacgggattagganggggnacgctaanatcnttccttttttggccccaa

SEQ ID NO: 2939 - DNA, 166 bp, Fusarium venenatum
ggacagctatgaaggggcagccggtgccgatttggtaaaggttgtatagatctgggatattagtacggcataatctcaacaaacgacctagacatgacctttatagaatagcggcgaagctttccatatacggaagttgtactataaattgaatcaattccactct

SEQ ID NO: 2940 - DNA, 637 bp, Fusarium venenatum
  misc_feature (1)...(637): n = A,T,C or G
gggggaaactcagtcatctgcccagcgcttgacatcgcgccaggtaacgcaccacctgatctgtttgcttcanaactttccttctttgcttcgcatccttggactgcttctctactgtccgcgccggagacaatcccgttcctcccgtcgtgtaggaatcctcagtcacctgcgcatgatcagctttttggaaactcgcttaacaatgctcgnggcttgacacattttatcagctacttccgtgcgccaagtgttgaggttgccaagaatccagcacataacatcactgagattgttgtgctggtatcagtgggtgaaggcgtaagcggatatcctggtattgttcacggnggcatcgttacagctctctnggatgaatccatggggactatcttcgatctgaacggcacgttgggcaaagaggccagagcgttcaagacgtccaatgtaacaggcggaatagacgtaaagtttctgaagcctgtcccaacagacaagtgttctctgtatcagagctattgctgaaaacatcgatggtcgaaagactacantcaggggtgaaatgaaggatgaaccangggcaattgctggcgaattgcttcaaccagtgggtaagcacttgaagcccanccttttg

SEQ ID NO: 2941 - DNA, 584 bp, Fusarium venenatum
  misc_feature (1)...(584): n = A,T,C or G
gcgagtctgcaaacaggtacatgatgaagctacgttcgccttctacagcacacgaaacttttcgtctatttcctacctatcctggcaaatacttcaaaagtaagaacctctgttggcaaggttaaagccacagcagcgacgatgcgttacatctctcganttgcgccttggccctggatggaatgcgccacctcgtggatgggttgttaacccagcgcttggtctctcggaatgcgtagatgttgancgcctcaatgtctttgtcgaatgcgacctantgacaatatcttccaangatggcgccgatcagaaggttctatgaaggttcagtcggaacctctcactgatgtnttggaagcattgccttccctcaggttgttcattcgatggttggactacntcagaaatccggaaactgagcaaggtctctggacattgtcaacacaaggcnccgcatgaatggggtctgaaaaagatgacgacccnatacataagtnaaaggggganccgggggtntctaagatcccnccngatataaaccaggttntggcttggctatntgtcaaccgactattcctggtcga

SEQ ID NO: 2942 - DNA, 354 bp, Fusarium venenatum
cggaaaccttggcgaattgaccacacaccgcgacgagcttggccaatgcttcaagttcagtgacaaggtcaaatctgtcagccagactgaacacgtcaagggctgcaagcttttggtattccaagatacgcattgcaggcatggagagaagagccctaaggattttcaatgtctcaaggccccgacctttttcaatagctacaagactgtatgcaagtaaagggaactggaaggaagattgtcgcttatgagcgtgaattaacatggtgaatggtatagatctttgcctcaagaaggtcatttaataggttaatggttttagcaatagtttttattttgaatgaatattcaggt

SEQ ID NO: 2943 - DNA, 589 bp, Fusarium venenatum
  misc_feature (1)...(589): n = A,T,C or G
gggtggtttagatcgtagcaccagcgggcgtatgatatcaagagaaccgaaccttacgcctatcacagagcgatccgaatactctaacagaaactcgttcatgagtctgggtatgcctggctttggaggaacaacgcccctgcaaagccctggcctggctcaacttgctcttcttggcgatcgcggcgacgagatgactttatctgctcttctccggcttaggtcccgggcttgggggggttctcaagcaagccttgtgtccagccaaaacgggtcccacgatcagaaagaagcgatatgtccacctcaccttggggtcagagctttatgagcccaacgactttccacacccggaagaactcggttctttctaccatcagccacgactcngatagcgtangcgcctcaggaacccgacgttgacaggtggcatcctggctttacgctgtcccaccacctgtccaacgttggctaagctgaaactgattttanaatgatctcaatcccccctcacntagcagactgctcaaatctacaacaacctattcncatgtcgatcaaaaaaatagccnctcacctgtanccctta

SEQ ID NO: 2944 - DNA, 589 bp, Fusarium venenatum
  misc_feature (1)...(589): n = A,T,C or G
ctaccagtcctaagatatctcgttaatgctacacgagatccatctcgtctcaaacacaaactttgaatcctggacaggtgcaacgcttattatctagctcaccccgtttttatttaccattccaaggaacgagagcttattatcttcagatcgatgtgatccggctgtctctccctctattacccgtagcggcaacacgaccgtccgtatcgtggcatggctttcgacccaggtacttgtatctccgggcggtttccttcaccggggagctccttggctttggccgggggttacatttcggcctcttactgcatcaaatagcagaaagcgctcaagcaagcgggtgatcctcttctgtccactgttcaaaagaaccgacgctagaatcatgatggagaaaaagaaaaacacatctcatcgccaaactcttgattgtcgaactcgcttgctattctcttacaccggccccggaagtgatgacaacgggggatcncaccggatctaggaccccgaacggactgcgccaaacagcacaagattcctgcccgtngggccgaaaccgaaaaacataattccccgagcctgttcg

SEQ ID NO: 2945 - DNA, 588 bp, Fusarium venenatum
  misc_feature (1)...(588): n = A,T,C or G
tgaaataaaagccgcgtttcgatggaaccacaactgtcttgccgacgccctatcttcccagaaaggatcatatccgagtccttgatatcggctggttgggccatgatcgggatcaaaatgccttcccagtctctaactttccaaatctacacaccatgaccatatgcatagcatataaacatccgaatgaagaagcatgtcggaattggttgactccctctttgcaaacacttattctcaatctgcataccagtggccaatgcggtccttcttctcataattgcatgagcaaagctaattctcatgccattgctgagtgggcgaagatggcgaagagatgggtagacaaaacaccaacctggggctgaganaaatctgcatacgtgcatatagtagcgganatgatgcttggcaaaatgaagatgaagtaanttgtatgcaccggagttatgccgaaganatgaagganaacctcgtcagtgcctgaaatacttgatgaacaagggttaatcatctggattggtatattggaagaaattactttgaacangagcatntttatntgagaaaacctanccgaactaatct

SEQ ID NO: 2946 - DNA, 587 bp, Fusarium venenatum
  misc_feature (1)...(587): n = A,T,C or G
gagctttcttgcggttacaagaaggagattctcaaaaggtcgccagatcagtccattctcgtatggagatggcccttggcccgcaagcctgaaacgaaaaacgcaacggatgcactttttagctgatagcccggccaacttcaacttacgcacttacgccggacaggaggattctgagaaattcggggtcaggttaacagatcaaggactcgttgttcgtgtctggaagtgtccttgcaaattaacgcgctggaaccatgacaagacggagcttatanacnctggggacangtggttggctgttctcgactgcagcttatcgccagatactctatcgcggccagcaataattctcggggagantccttatgctgaaggcgtttttcgacnanatcctacgaatgttatcatggtgatagaacacgatcgcntgaagtcnggatacttggataccgcngggatcgacacncgatacctccatcgaatacaacctgaattccaganagaaanaanccgcttgattngatacatcaaacanaaatccnttacaagaaacttcctccaattgaaatnanctcaaaacctga

SEQ ID NO: 2947 - DNA, 134 bp, Fusarium venenatum
  misc_feature (1)...(134): n = A,T,C or G
cttctggcaattgacaaacaagatgacccttcttaacgataccgtcaaggagcttcctctccgcattgatctcaacaacctgtctagctggcagttcctaatcatggntacccttgatcatctcgatttctgtg

SEQ ID NO: 2948 - DNA, 593 bp, Fusarium venenatum
ctgggcgacatggtcgagtctatgggcaaggtgtgtacagtggttccgagatcgtccaccagacatggtccctctgctggaaagctccgaggtagacgcacacacagctaccaccacctctccattcacagcggatgtctattcaagtgccatcgcagtacaagcaaatctcacaatgcactattcctccctacttctactttcctacaaacctcgactggtcaagctctcatcgacaccacatcgtctaacatccaagagctggcacgcccagaagcttgcgaagttggctttatggaacaacttccccgatcaatgggatcctgtcgtggtagcaaccgtagttcggattgcgagagacatgacgtatccttcccaacaagaagctctactatcttgcttccaacggattggtgatgcgactaaaattccactccaaagggagattacagatctgcagcagttctggtcttcctcgcgacatccaatgcccctaccaacctccatcctaacactagctggaatagatcaccgaggtaatttcaatcggtattgagtttgatttgcaaggtacttagtctctattcgtctct

SEQ ID NO: 2949 - DNA, 327 bp, Fusarium venenatum
  misc_feature (1)...(327): n = A,T,C or G
nttcctggactttctctcttcnaaaccgaggccgccgaggctcagagtntcgacaacaatgaagagccctgtgaggagtcanctgtncataactacaacttccaggctgngccttnacttantgggctgantcctcctgtttacgagcccgcccccaanacagtaaagcagatcttcttgtcgtnttggaaccccccttcaccccatatacaacagggnggccatctgntctaccttgttgtgccaccantgaaggcgacaggaccangtcactttccacgtttngggcttctcgtnaanaatcgtctaatgccaaattanatcctt

SEQ ID NO: 2950 - DNA, 590 bp, Fusarium venenatum
  misc_feature (1)...(590): n = A,T,C or G
atccaaaccgctgctcatacatacgtacgtacctcttggttggttataaacctcaatggtctccgtcaaactatcttctctggaggctgcatcctccgttcgtcatggtaaacatgtcctcgttttcagtatacgactctgaaaccatgccttattgggacctatcaacttcatccacaaccagcttcacttctttgcctcccgaacttcgcctgaagatatggtcgcgggccaacgagcctcgcatcgttttatacggtgatctagcccaagggaatgggtcttgtccgttaccaactgttacacaagtcaataccgaagcgcgagatgaaactcgactaaggtatgagccaataggccgcggatctttcttggatttttctaaggatatcttgtttgcgaccataagatctcagaccaagcaacagaccagtatttagatgaactggcgccccgggtcaaacggatggctttctgggattgtttcccgatganggncgggtacagatgcctcatcactactccgtctanctatctatgtgcttcaatcgacggggaaantttggganaatcnaatttgaacgatgctg

SEQ ID NO: 2951 - DNA, 584 bp, Fusarium venenatum
  misc_feature (1)...(584): n = A,T,C or G
gaacaacagtttaacgtatacccacgatatctcgccgttgccaaatgcatatagcaaagcctgccgtccttcgtacttctttcttccgataccagatgcgtgtcgtgaacttctacggtaccgagcctcacttcgaatcacagccccgcgcagatccggagcgccgacgaggatttccttgaatattacgattctctgcacttgtccacagcttgatttggacgagtgctgcgtggtgtagctgccagagtataaccgtgccgttctttaccctcgaacccatagactcccacttataccggccgccatgataagccacgcacctgccgcggtcaacaccgtccgcggctttcagactacacctgctacctcgggcgacgaggactcagaccctggacacagcgaggtccctaccccccgacgaaagactgccggacgaacgtcatcaacgatgttgttagcgccaactgcagccctattattcgagcatcttctcccgctgtttcgggcatcgcaaagctgcgcatgcagatggaanctcttantctggacggaagatccccttatccatganccgttctgga

SEQ ID NO: 2952 - DNA, 394 bp, Fusarium venenatum
aattatcaagactctagatgatgtatgtcctaatacgtacctcaatcaggtctggaacatttgtcaaaaactttattgcaaagctcaacattccaggcgaccatcaacaattgtgtcagtcgagcctacaaatccgaataacccggcatctgccgtgtatcctaacatagctcggtccggacacgccccggtgctagaggatggagaaatgagtgattacctccagttagatccagtcatcttggaccaattactaccatacagggctcccgtgctctgggacttggagactttcctgtaaagcactgttttcaaagttcaacttggttcatttccgtttgctattcattctatgtcgctgttctcggactcttttgaagcttggtacttccct

SEQ ID NO: 2953 - DNA, 579 bp, Fusarium venenatum
  misc_feature (1)...(579): n = A,T,C or G
aattacgacagacttgcatccttgtttcaagtcaacccaccaacacgcctattgccagccccagtaagccctgtaaccgctgaaccttgacctgggcagaagctgtttcagtcaaattccaaagccgactggttatccaaggttcggctcatctactttacataccttgatcgcttaaccaaataccatgtccagggttgcatttgaccggagatggcctccgacatgaacaaganantcatgttccctgccaagacgagcaattcacaagtcatgtcatgatttattaacactcaggcaaagaatcattgatgggatgtgcaaagaaaatactcagtcattcattttagccaccaactggctctaaactcaaaatccattataaggcttgctangcttattcagtccaggaagaangaaaagaaaaaaatatcccgagtccttggccacggacattcttttgcatccacgttccagcgctactgccctgttctgcaatgtnctcctgttntaaaaaaaaagtctcagctccaatctgtgcgtcncgttggtcanacctcaaaccngttataaataata

SEQ ID NO: 2954 - DNA, 610 bp, Fusarium venenatum
  misc_feature (1)...(610): n = A,T,C or G
gagacgcgcggcatttccctggccggctgtacgtgatgtgattgatatggacaaaatggaatatgaattaccccgcgctgcccagaatctcttcaggaatctatcatcgcagtcctgcgacattcttacatatctcgacagtcctccagcatacactgatccagggaaattattattcaaaacagatctgttcagtgaggtcaagaagcacgacagcttcatcaatgaatctcatcaacgactatggatacgctctcccgctttgcatggatcattgggtcgtgcgggtggggagtatctagactttcacttgcgagagcctaatgctgttgaggaggatatgttggaaagtttgcttttggcgtccaactattttggaaaacacatcggctatttcctangcagtacaaagctttctggtggagattaaaaggaccaagcagaacccactcaangntgatttgaaataatttgggccgggaagatagccctcgatccgccatgctgtgctgnggnctggaacnattcagacaagngtagaattnttnaccatatggcttgccaatttcatgcagtgggccccgnacggtanaacactttntatttttcc

SEQ ID NO: 2955 - DNA, 596 bp, Fusarium venenatum
  misc_feature (1)...(596): n = A,T,C or G
accgaggttgaagaccgtttcgaactccgcgatgagtggatcaacatggaatccggatatcgcacgctcgatcgcatgaagaaagctggccttaccatgccctctggccgtgaaacagccgtctacaagaacctcaccgaaaaccgtgagtacgcaggtcgacctctcgcgggtgttgagcgcccaattcatagccgacctttccgccaagagctcgcaaatgccgaggaactctttgcaagctctaggaaagatcgccatccgagcgtctcaaagcgttgcgcttccgtcaaaagtacgacctcgcggactcagcactctacctcgaacttttgcaagancgcgatcgcatcatgaagatgggctctaaatccccgtctaagctcccgccgccgaaaaggctttcgatcagcgtctcgataacatcaagaanaacacacggaaagaatgggcaatggttcgtgataactaccanctttggaaacaaaaaaaaccactctgttctnggatntcgccccttcgaaacgctcgccacgcgccccgaggaaatctcccccaaaatgcccgngccttctcgattttccaccccaaagcct

SEQ ID NO: 2956 - DNA, 166 bp, Fusarium venenatum
  misc_feature (1)...(166): n = A,T,C or G
nttctgtntnctcaccccgtatggcngccatccntncaatgtcctatgatgccncgcgggggaagctgcttaactaaaagganacncccccgcccatattttacttgggaanaangtggggtggtggtcgaaccaaaaagnttttagtcgnggacnaaaaaaacat

SEQ ID NO: 2957 - DNA, 628 bp, Fusarium venenatum
  misc_feature (1)...(628): n = A,T,C or G
aattgccgaaacatcgtttaagcatggcttggatgtttttaaaaccgttctaacagtcgatcctacagccaataccaggcgaacattaacgagaaaaagccgtcctaccatttttattggtagagacatagcggtattcacagacataacttgtcatgggatctcaaacgagactcattttagcacaaccaaacaacattttaccttatttgtatgaattctaatgtcatcctcatgatcaaaccagacaggtgggcgaccaacaggagttgtggtcgagcatactgcagcaacgcgagacgcgaatggccgaacccataccgaaaatagggtgtctactagcaacactataccattgaaacatggtggtcaggaacaaatggtcaaagctttgaanaaagaagcatgtttctcttttgggcgtcagggacaaaataaaaaaaancagttctgatggaaggaattgatctaccaaaacagaaccaatagaccaacttgggcagggattggtgaggctgccnatatggattatggtgggcaattgttcggtncccggacattaaacaaactttttncacaaccccgnttggggccgggnggcccanctttcnaccttggaacaaacatn

SEQ ID NO: 2958 - DNA, 469 bp, Fusarium venenatum
  misc_feature (1)...(469): n = A,T,C or G
acgtgctgctgtcggatttacctgaagaactcctttgtcctctgggaacggaaatatcaggttccccacgtgagaaatctgcttcccctgattgcgtggaggctgaactgcctgcccccatgtccctgttagtgtgagccctcaaagccagcggggcctctgggctcttcttcgctatacaagttgacgctgaactgccgcatctggataaatcctctcttattgcctgtcgtgagcgggtacgaagcaacggtgctatgtgatcaggcccggcattatcgcagcgttgctggagactcgcgtttctcaaagggatcaaaggaatgtatccgtcatccaaaggcgtctgtactcccgcccttgtcgcctcactttctggctggtttttggttagccgatgccttcatttgaacggacatagcttacagtanccatccgcctcaacactccctcgcgttcgtggcaccta

SEQ ID NO: 2959 - DNA, 588 bp, Fusarium venenatum
  misc_feature (1)...(588): n = A,T,C or G
gcgcaaactctccatccaccgcggatacgacttgatgaaggaggtatcacagcactcgtcagtcagaagcggaaaggagaacgatggccagggcaaccgccacggggaaattgatggaggcgaagaacaaaagagctgggcgagtcaggcttgcagagggttgtaacggtccagtattgtggaatcggttatgtataaggttttgtttttaaggaagtgtcggtttgagtcgccctaatgttgcagtatatacttgtacaatacctgaggatggacggggcttagtgaanaagcttgtctgacttgcagttcagangaccccggtcgggggtttgaaagaggatgaaacaaagaacatatccagccagaagcatctgagaatggaactgcgattagggccggaaccgggaaagctactggcgttggcgcangttgggatgggatgggctggaattccgacgggacgggacnatacaaaggaaatgtttcnaaatcnaccatnccggaaaggcccgaaaggattcttatctcttggttnggcatatatttacagataatnatggacttgtgttgtttnatgatcatacc

SEQ ID NO: 2960 - DNA, 106 bp, Fusarium venenatum
  misc_feature (1)...(106): n = A,T,C or G
ncggacaagggcttgattgtcttccttatcgaccgcggngagggtgtccnnaccaagcangatcangacctcttctctaccactgatggtacagcttttgtgacgt

SEQ ID NO: 2961 - DNA, 284 bp, Fusarium venenatum
  misc_feature (1)...(284): n = A,T,C or G
nccaatggcaaganggacccctantccttatataagcgggtgggngtnttctccatttacccgttcnatactttctttntttatttngtttnccttcgcatttccatgttncccgnttgctntttcccatgaatgtnaaangaaatccnnccaggggacanatgacanttatnaatgttgcggacggacaatntaaccttgataacccctccaanaaaagtaaagacagaantntgaaatagtgaagagtttgtganaaaattgggacnaatnaaaaaacgagg

SEQ ID NO: 2962 - DNA, 455 bp, Fusarium venenatum
  misc_feature (1)...(455): n = A,T,C or G
ntggtccccgtcgcccgtcgccagctggtcctccgtnttttctcattctcactgagctccatctcccgaccgacgcaatccccgatcagatttcctgttgacggcatctgtttcgacgattganacnaatcgnctgttcattcatccattcattttcgngaccgtttttggcggtctacaagtttcgattctgcttgnacgattcttggccaggccgacttntagcctccctgcttggcccaaacgcgccttaatttcccgccgctcgccttttactttntgngccgacaaaactccatcaactggttatacttgccatatccattggcttcgtttttgnctcacgctctangccttgaaaggccctacttgaaaaagtaggggngatataccnccccgattttgtttgttgngggccacgttttacaaaatcaaaaagcaaaaatggccaccca

SEQ ID NO: 2963 - DNA, 442 bp, Fusarium venenatum
  misc_feature (1)...(442): n = A,T,C or G
caacaacatccaacaataacatcacttctaaccggttaatttggtgggtcgcatctcacatctcatcacaggccacatcttatcgcaacacaccacatcatcaatcatatcatggctgccaaatggtctttcaaagcccaaccaggcatcttcatcgaactcaccgacatcgctcataactaccctgganaaaaagtcacaacccaaccaaacttgggcctcatccccggccagtcatacccttccgacgatccagatgcttccgatcagcgggattgggcccgtctcgcacgttatgtnacatggctcaataagaacagctcaaacaatgtcgcatacaaaatcctatacttgacgccacacngtcttggtgtgcataacaagangcacgcncaagtttgttcagaaacatngaatacanaattttcttccaaaacgggga

SEQ ID NO: 2964 - DNA, 623 bp, Fusarium venenatum
  misc_feature (1)...(623): n = A,T,C or G
ccctcgtcgttcttatctcgtcacgcctctccgattatcatctgacaaccttttcatgaaccggaaccatcacccgaaccgcgtccaaagaggcggtaaatcgcgctacagaccattaaaattccgacttgtacccttcaaacgagcgcgtttgcctnctttgctggaacaaccggggtctgtagaagggacctgnttantctcgcagcgcgctgganactgacgggttgcctggcagcnaagctgttcctnctttggccgcggntggggctaggtagcaggcaggtaagtcacgcagattgtcgtcacacctaatcgttgcaggaatgtcgtcttcaccatgcctcgatctcgatattcaacactccaccaaggccgtgatacaatggcagtccgataccacgacgcatattctggctaagccagaccctnaagtcagctccgggacactcaacttccgctttnataaaanatgtgctttnttcaaactgagcgttcctgtcaaaaacaaagggattagacccactacgggcggtaaattacgcgcatgcgcctaatcattgnttttttgggcgggggnaaaaccccgacggggttataaaataaaaaagagttgaattgcc

SEQ ID NO: 2965 - DNA, 488 bp, Fusarium venenatum
  misc_feature (1)...(488): n = A,T,C or G
cggataacgagcagcatcctattttggatagctactctactttgtctcaggatattcttactgcagttatttttacaagcgaatatagtacgggcggtgtttagtaaagtccgcaaagtccgccgtggtagtattttttaatcttgcatttttaacgcattgatgctgttcaataatacaggtccccgaaggtatatgagcttgtgttggctttggtttatgatcgacagctacagttaaccggtcaaactttagtttgcaaataaganaccttaccggtatgttaatgctctgaagcttgagcttgagcttangccangaagggcatttgcggtggatgtgttaggtacccctagtcacagtcacagtcccagtgatctggctcagaatcagggcgcagcggccgactctgaactcaaggcttgtgcatgtcctgtcatgcaaagggcggcggaagaactgtcngtcaaaattgtcagaaggcgttt

SEQ ID NO: 2966 - DNA, 164 bp, Fusarium venenatum
  misc_feature (1)...(164): n = A,T,C or G
nngaaatacgtgnattgataagctcgatnggctntgggcatttattttataacgcctgcatcncggtgtcctggaatctgagagttgtngtgagancnagccctntctatgggggcctatantcgcggttacagatgnttttgctttnttatatacnggagaca

SEQ ID NO: 2967 - DNA, 107 bp, Fusarium venenatum
  misc_feature (1)...(107): n = A,T,C or G
ncnatactggcaccatgancactggccngaaagacgacncggnggaccntaggtcctgtaagatngctgccgtcaccgtcatccaantccactgncngagggataaa

SEQ ID NO: 2968 - DNA, 434 bp, Fusarium venenatum
cgcgctatcaaaagaggcgccctcacgcctgaagagaaatctactgctgcagggaaagtcatcggcgttattcctctgctcgatcaaatcgtgcaactccttcccgctacttcagcagcacatctctactttgatctcgcccgcttcttcgcgtgtcaaattgactcgttgatgggtgcacccgatttgcaggagatgcaagagactattgatacaggaatgtttacggacgactggttcaaggccatggatacaggaatgccagatgcctatacgcttttggatatgggatatcttgggatggatcaaccgatgatggatactgattacttcatgaagttggatgatgtgaatagtgttggttaggaatgtttgttttgaccttgaaacggtcgagaataactcgagtaaggtaaattcaagactggactttt

SEQ ID NO: 2969 - DNA, 249 bp, Fusarium venenatum
  misc_feature (1)...(249): n = A,T,C or G
gcaaggtggtttgcgaggaactctgcgcccagaggttcgcgccaggtcggtcggaggcagagagcgtcatcttctactgttgcttggatttggatatttccctgtgtcgcatgccctattagtctatgcctaaatggctaagaggaagaattcttacccagttcacttgaaatgtcacccgtcttcggtgatttgattgacctctntaaccattttaaacgtcaantccanaaaaataaaaactgccgg

SEQ ID NO: 2970 - DNA, 601 bp, Fusarium venenatum
  misc_feature (1)...(601): n = A,T,C or G
ctcganagaagtcccgacaggttcatgagtgaggacatcgcaggccgtatggagatctgaagcgtcactggaggcataagggacgaaatcattaggtcagcttatgcgacttagccaagactggaggttctttattttcataccctaagacttcgggcgtcttctgctatccactagttgcggtcttgtcaaacccagctttcaccacgttccttcgaaattactttcgttacgctttttcgacattcaacactgtcacctcaaatcggttactcgatcgcagcaaatcgagacgaaagangctaagcaacacaccacttttcttttaactctctgttttatggacgctcttgcattatgttttctctttcagcacattgggtttgttcataacgaaagcgtgggggcccgggtaaggcttcttggtcaagtgagaagcgggtganatccgcgacatgaagcgtttcccggtatccatttccgcctgcttttttttttcctggcgataaagcnccnttaatgacttttttggggcttttccttttcntatcctgtttatcnatacccttgtttccggtttnggcatacgctgtttgcttgg

SEQ ID NO: 2971 - DNA, 625 bp, Fusarium venenatum
  misc_feature (1)...(625): n = A,T,C or G
caagattcttcaatcaggcggcaataccaaaacagatgtacagacattacctcttgttttccagcttgatctacgacgactcgacgagacctttagttggtttggnggtttaagcagtttccttaacatgagtgcttcgatcgcctcaagtcctgccccaacaccaaaaccggtcactgttgcacataaaccccgaggagttcgatttgacactccagtcgacccagacgacaaatccgcggcatcagagaacaagatcaatctgcgtattggaggctcgtgggtggaactcattggaaaagactgcagcatgatcgccgaaacaagtgctatcaagctcataagtcgagacgaagtcattggcgtggcttgtagtatgatacgggtatctggacctcacctgaagaactcgacggccgaccccctatcaatgccgaaattggnggtgttcgggtggagttcttgacaactcccaaaaacagcgatcttgaaaaactcctcgagctgattatccttcgaaacatcagtttgatggggagaaccaccaaattatggtaaaccccttctacccaccaaaaaaaacggttcggntttgaggggtaacgnggacacaatcagtgntcga

SEQ ID NO: 2972 - DNA, 113 bp, Fusarium venenatum
  misc_feature (1)...(113): n = A,T,C or G
nccacatcgactntttnatcggangncgaaatgttttgctctttgcacacacgatgaagaggctccccttcncctttttagggggggctgtcnaggaaacnactttgaacaca

SEQ ID NO: 2973 - DNA, 360 bp, Fusarium venenatum
  misc_feature (1)...(360): n = A,T,C or G
ggcgagcacggggttattgacgcctaccgtgttacataaaatctccgtcacaaccgggagaacttcagataagaaagacttagcattgcatatggggtctagcggacctccgggcgcggcacagggcacaggagttagggatttggtcaccccgcgtaaagtttcgaccgccacggtggaaanggaacgaaatacgactgaatgatgcatcaagaggcgcagatatctggtgattttatgatctcttcttcctcatttaggcacagcgatgaagtgattcgatcctgtgcctgtttaaaccacacatctatttagcgccacaatttataataattcaacacttcccananaaaaaaaaaa

SEQ ID NO: 2974 - DNA, 860 bp, Fusarium venenatum
  misc_feature (1)...(860): n = A,T,C or G
ctcagcacactcagacacaacccgaccaaagacggacgagagcaatcgccgaccacaaaatcacctaaatggtctacctaatctctacgaacactacgagcaaatgtcattccgctcaatcattgacgatgagttggacgaagccgatgaggaggagcgggttctggagaagtccaagtccagggattcacaccaaccaaagcccagcagaattcttcgacacagcaagtctgaacagcgcataccacccgggccaccatgcccgagcatattggtttcccaataccgcaaaaacgcaaccttacctccaaccaccacctctaatctaantatggggccaaagaagtctggacccaaatcctcaatttacttggactggcgcttgcaaggtggttttctagcaagacattaccccggcaacggtccaaaggcttttcgaaaacnggtacngaagtagggaagtttcaggatgcggatctgcagggcaagagcgtgctttcactatcctcggactccgaagacgacgcatacaccgaatcctcttccaagggtcaaccttcgatacctgagtacgccacatcggatactagttcttctatcgacttncgtccaggcaccggttcgaacttccgagagcgctgatacagcttgaagcggttgagcagatcgagcagaaagacgacgggatcgagcaactaccttgacattcccaacgggcatnacagaagcccccgttgnggnccccaggtcaagctncctatntggaagttcccaaacacaattcaagaaggactggttggaccaacaccgtcgcgcacgtnaagcctttcaacttattagtaaacactttaaaaacgggt

SEQ ID NO: 2975 - DNA, 366 bp, Fusarium venenatum
attgaggctgtttcataccttgctctcgtcataggcgcttgggttgtggctatcgacacttgatctaggtcaacgcttggacacaattatgtcagtcttcactgaccacctatttttatatgttatccgttggaattcccacgagagatgacgcctcacgatatgaagcgcgtcttgaaggaatgcaaataacatcggcgacacaaaacatttacatcattgggaggagttcaggaaacattattttgaaggggaactacggtccctcgtcctttggaatagcaatactttgataccctttgcattacacatatcttttctttataggcagcttaaccctgcaaaagcccttatttttccaagctc

SEQ ID NO: 2976 - DNA, 190 bp, Fusarium venenatum
  misc_feature (1)...(190): n = A,T,C or G
nggttgccctctataaaacaaaaaaccncnatgctttggacgtggatgtnataagagatnttantgacaccccgggctaaaggaggagatccccttgcttgcgcacctttgcanttanataaactgnggcntaaaattacccgtggggataatttgngataaaaattggctcaggaaacaaagtttggcc

SEQ ID NO: 2977 - DNA, 141 bp, Fusarium venenatum
  misc_feature (1)...(141): n = A,T,C or G
nttantttgctaagaatgaatgctntttctccatctggcgtatacaangatgaccncacngaacgccttttaacacatgccntgacaatgcgtacngaggatnaangtgacnctattgaacagagacccggnattctcngt

SEQ ID NO: 2978 - DNA, 360 bp, Fusarium venenatum
  misc_feature (1)...(360): n = A,T,C or G
ctcggcaccaagcctcccagtctggatggaaagagcatcacatcaggcacaacatttgcgcttgacgagaaagaatcgctaagacctgacgatagcgcgagtgttaaagccgccgcanaagatgatgatgctttttctattcgtggttcacttgttgctggctctcgcatcgggtccgaggtagctgctcgcgcccgaggcattcccctgggcgatattccagagcgcaggttaccacaacaaactccaggtgttgcagctcaaggggtcttaactcccaaagttcttcgtccgaacaacccgntagtgcccctctaggngcaactggttcctcagatgcgcttggtgtcatttataggc

SEQ ID NO: 2979 - DNA, 150 bp, Fusarium venenatum
  misc_feature (1)...(150): n = A,T,C or G
naagatgggtgaaggcaagngnagcttatgantcattgattntngtttagcaagcttnaaaanaagcanaggaggatcggtctantnggcttttccacanttgctctcctatacnacnggagtttaanggttnctgcggtcnacaaaaat

SEQ ID NO: 2980 - DNA, 112 bp, Fusarium venenatum
  misc_feature (1)...(112): n = A,T,C or G
ngggcccactgtcccnttgntggagncttgaanaaaagtgtgttntgaataccatgttacctctntacccttgnaaaatcccncatntaccgactttcttgttntnaaataa

SEQ ID NO: 2981 - DNA, 528 bp, Fusarium venenatum
  misc_feature (1)...(528): n = A,T,C or G
cgaactctttaatagggaggcatggaagaagtcggccttcgctatggttctcgctatatacatctggatgtcccctgctgtagtcatttttacttcggcaacactcagtgtagtgacagatacgagagccgaacatggaaattgcccatctgtccgaaccctcaactttagcaatgacgccaagaaaagctgggacgacgataaaagagcagcgaacgagacaatgcgtggaatttccctatcaatgttcaatcaagtcatagcagacagggactctccttatcatttcgactactggctccagtccgcgccgccacttgattccatcgcgtcaagggtcttanccggaggacagccgatccaaaaagatgaagtggctgatganatctgtgganaaactgggactgtctccactattcactttnttggacccggatacaaatgcgagcactcgccaaggcccactcacaatgaaaagttcaaaaattacaaaccctttatnctaccaaaatgtgccgcggaaancct

SEQ ID NO: 2982 - DNA, 176 bp, Fusarium venenatum
  misc_feature (1)...(176): n = A,T,C or G
nctantttgtgacaaagacgnnccttctgcgattgggcttgagaagtagctataggaagntaaagctatctctgagcgttctggacgaaccgacatccgaactngtntactctctgangaagacttntacntaagagggacnnggtgctattggatncgagnttagatttatcttc

SEQ ID NO: 2983 - DNA, 231 bp, Fusarium venenatum
  misc_feature (1)...(231): n = A,T,C or G
nangcttcagnnaagacatgagnacactgaggantgctcacgcttantgccaggaagactacaggacttaaatnncatactcaatgggagacttaagganttnatccccnactgagaaaaaaaganaaggcaacgaagtttgattcttggatgaaattccanttacattaaaanccggtctcgtanaggaaaggccccaaaattcctgntttanaagaggccgaaccagcc

SEQ ID NO: 2984 - DNA, 492 bp, Fusarium venenatum
  misc_feature (1)...(492): n = A,T,C or G
gggcacctgaaccgggtgctcctcatgcatccccttggcttctttggtagccattgcaacagaagcaagcttggcctgactttgtttanatacgaacggcaagaggtttgctaaagagctggtctatgggtgaaagaggaggcaanaacggataatgggaacctgagcgaaattccaagagggcttcccatcatttatagctcatggtgcaccccatcgccaagccagcttgaacagacgggagggaaacncttgaggcttggcctggctgagaanagaaggtgagcgttacgaaattctctcttcagtgccnagaggacaagcatcaactccttggtattgataacctggggtgcccnggtagaccgatgggggaatcactcgttggctgacattgtggagaaaacccaaganccctgttggattgangattgggatttgcccgacgaagcgacaatccaacctgggaatgcangcaggcgantctttgga

SEQ ID NO: 2985 - DNA, 535 bp, Fusarium venenatum
  misc_feature (1)...(535): n = A,T,C or G
gcataaagtgggcgcgttaagtgctgccatcgcattgtgcctgcgacctcgatcctttgttctacatattcttacagttaatcacaaacacaactacatacataccttgtggcgcgctttataaaacataaagcacaagctccaaacttgctaccattcttattcagtgcaggctaacaagcaactctgcgtcaacatgaanaaactgcctttcaagcccactgcgatgcgcaaggctgctcccaagccaactcagccagaagaagcaaacgatagtgacgatgatggactggctctgtttaaccgccgaaaggagatggtgtntgtcatgcaagcccgacatcgaccggcgctcaagaaacgtcgcgcatntgactctgangaagagcgtcncaactcgagntnctgaagaaaaccacgcncacaagcccgaanatgttcangactctggggttttagtcagtatgacacaacgatgtccaggaanaccttcatccgtcaaccaagcaaaaaactctgttganaagaggcttcg

SEQ ID NO: 2986 - DNA, 349 bp, Fusarium venenatum
  misc_feature (1)...(349): n = A,T,C or G
nggccgganaacanttttggaacaacctggtgatcnanttttggcccctatccactgggtntgctcagaaccaagtcgtnaaaaacttcacgaggnttttaaggnggaatcacaaaagccttttttgagccaacaccctgggtttttttaaaaactttttgactgttcccctgcccacctttaaaagtttggttttgagttttaccaagngttggcanaacggtttgccanatccacttgcnccccnaaaggtacactntccttttggaaaaanccgccccnccctgggcgtttgnaaaaccggggcgttcctgatgggantttganaaggncctgggacaattgatgg

SEQ ID NO: 2987 - DNA, 184 bp, Fusarium venenatum
  misc_feature (1)...(184): n = A,T,C or G
naaaccccngggcaaaggttgngggncccttgaccatgcatttanaggngccaaataaacntttcngaacntaancagtggcttgttccggggattaaaactgggncattgngaanacccttgtggnaccgactcaatctcnttttcggaaaaaaatttttaanttggccaaatgnaaaaagcc

SEQ ID NO: 2988 - DNA, 157 bp, Fusarium venenatum
  misc_feature (1)...(157): n = A,T,C or G
nggccnattccccctatcggganaagnaataacaaaaactngccaccttttacaacggggnaaatggnaaaaccccgccgatcccaattnatcccttggaaaaatccctnttccccagcgggggtatagtaaaaaggccnnaccgttccctttccaa

SEQ ID NO: 2989 - DNA, 174 bp, Fusarium venenatum
agcgccattgccatggccgttagagcacacccattaccagctctcggcctgtcaagatatgcacggatcaatccctgagcagcaatcaaacagaacgagtctagcggcccaaagaacaatactaagcatcaaagccacaaaatgcaagaacaatactaaggccagcctctcccc

SEQ ID NO: 2990 - DNA, 160 bp, Fusarium venenatum
  misc_feature (1)...(160): n = A,T,C or G
naaaanaaagaagnacttatcaagtttnctctcgccgncaatacttcngaaacaagtcttccaaanaaatgtcgacaanantttcttgngacggtngancatcctttaaaggggccaaattgccctntngggagtcggnttaaanacatggccgattttt

SEQ ID NO: 2991 - DNA, 102 bp, Fusarium venenatum
  misc_feature (1)...(102): n = A,T,C or G
nacgggttncaaaancttgnccctttttnnaaaaaccggattggganaccctggatnacccaaattattttcttggcccccattncccttttngggaatann

SEQ ID NO: 2992 - DNA, 243 bp, Fusarium venenatum
  misc_feature (1)...(243): n = A,T,C or G
nttcaagctccttgcggatcatgncgtaaagactttggggttgtcgaggtagagannctcttcacctcnatcatcggtcgngcttgccagntatttagangcccgctgcnatggnaccnacccgcaagcncctatganctctgacaacngngatattgtcacgcaaaaaacanaccgctgacctcaacctgatatgtcatgncagggggtgaaanaagctggatgcgaaanctgntggggtct

SEQ ID NO: 2993 - DNA, 102 bp, Fusarium venenatum
  misc_feature (1)...(102): n = A,T,C or G
nttttgggggaanaangggtattttcagccccnctnaaagacctcgggaccccctttgccnatccccttggnaatanaaatgtgtggcnganaaggtanccc

SEQ ID NO: 2994 - DNA, 280 bp, Fusarium venenatum
  misc_feature (1)...(280): n = A,T,C or G
gtcgacttcatcgacaaggaagtcgttcctctctacaaccgcttcgatgactcagctgccggccgtgtcaaattcgacnatctctgggccctattccgcactggcgatctcatctacatgcctgcctctggcgagaccgggggacgataccacgaagtgtggcgtgtgtacagaacccgcacccagagcctgaaactcttatcccacatctggctgggacttcttcccgatgagcagcnaatgatgagaactccaagttcaagatttccgcttactacat

SEQ ID NO: 2995 - DNA, 129 bp, Fusarium venenatum
  misc_feature (1)...(129): n = A,T,C or G
naccgttttnactggtaaaaccttggcctaaccanattattcncctcncgggccaaccgcttttaacnccttggccaaataancnaaaaggtcccaaaaaaaggncctttcnaaattttccccggggtt

SEQ ID NO: 2996 - DNA, 205 bp, Fusarium venenatum
  misc_feature (1)...(205): n = A,T,C or G
nntatcttaacttggcaatcataagggnataaangccattgnaagnggctnccctgatcaaataatgaatntcangctgnccggcgaaagccgtggatgaccttaatgtctgcggaaagctcaccacancntgataggggannatgacgctaacaaagctgccatcgnanttgaaagccntgtggatgcnaangtagaggctggt

SEQ ID NO: 2997 - DNA, 159 bp, Fusarium venenatum
  misc_feature (1)...(159): n = A,T,C or G
ngcgggcnctatancctgcgcactggacagagttgntttttttcatacgacactntgatgaatgccctcaaangggagtttcnccggagggagaaattgggtcaattcaaaaggttttgataaaaaaaaaaagtccccccatggggtgggntngagttc

SEQ ID NO: 2998 - DNA, 111 bp, Fusarium venenatum
  misc_feature (1)...(111): n = A,T,C or G
nactgatttanagaccatngcaagctgnggaatgttnntccacgaggagcaggatttatatntggctcccgcgggggacaaaaanaattggtgaagaatagtcgaagtcta

SEQ ID NO: 2999 - DNA, 440 bp, Fusarium venenatum
  misc_feature (1)...(440): n = A,T,C or G
ccaacttctcaacttcatatgctgaaggtcccgatggcaaccagacagagttcctcaacactatcttcgaaaacaccggcgccaaattagaagccggcttcccagtgtctgtcggtgatacctttggccagttctggggaacatggctccctgaggaccaactttttagtaactactccgacgttgctagcaatggcacagcctttgctatgggcgaagctcctatgcccatcatgtgctttgcagaagtcgtacctggcaagtcacccgagatcggaaagctcatgtttccaactcgcaacacttccaatctcttcaacttgaccgcctatgaaatcacaccatacaatttggtttttgggctggtngccgtnttcaactttcataccaaccaattntctccgcacntccatntttgaaggcaaaccacaaaanaaaac

SEQ ID NO: 3000 - DNA, 602 bp, Fusarium venenatum
  misc_feature (1)...(602): n = A,T,C or G
cctcggatcacctgcgccgtcgtaaaaaggggtatcgccaaaaagagaagtatagtaaaaccagtttgttcaagaagcagagttactgaaatgaacatgtattgtttccgcgtcgccgacgtcgtccccgctcttcggtcgtccactctctttgcggcagcagagttgagtgaagagatgttgagtgataacaatgttaaaaaggtcttcagccagtgggatgcaccagcaaagaaagaagcaaaattttggaacctgtgtgctttgtcaaagacaggcgcgatgaacgaaaaaacaatcaacttctgtaaaggcaaatccttaactcctccaatgttaaccagcacagtgtcaccctgcaaatggtatccttgcgtttcctccataaaaattagccgcnctttgccaggtttaaaaggttaaatgaacaaccatgaagacatngatgttttcgcaattttntttaccacatcncgaaacctcagattcctttccntacaccccccttacgaaaaacgcacgaaagcnccacacnccacccatgggaanttgcccacaataagnactccgcgtttctcaggaaccgaaaagccccaaaaacc

SEQ ID NO: 3001 - DNA, 469 bp, Fusarium venenatum
  misc_feature (1)...(469): n = A,T,C or G
tcgagaggggtttcgctttcttcctcccgagacgcttgtccttgagatggttcttgaaacaacgaaattagcatgggattctcccacccatcgacgccgtctnacgaacgccaagcgcgatctcgatcgaaacctcgccgcttcggctggtggcaatggctcaagcctngaaaacgagcgtcgtgctgaagctntgttcgaatacctgcngagacagtactggcctactgagggtgacgaagcttacaagtcaaaattattcaaagaggcggcggcgcagatgggagtgtacnatttgttgaaaaagagtgtaaaacagtaaaataggggagcattataacggcgcttagggaatcacgaaccatctcctgacgatattggaacatgtatattagcatacaaagggccatgtcatgcctgtggaacgagatacaaagtcatcttaaggaatactggtngaggatgaaaa

SEQ ID NO: 3002 - DNA, 407 bp, Fusarium venenatum
  misc_feature (1)...(407): n = A,T,C or G
tatgctcggacttttgtgatacccttgggaaaattctcggttcaggtactgatggatcgatctactttttttttctttttttggcttgaacttgggaggcgaatagagcttgcgctcgcttgcatcaaataccattattgttgacctanagtggttggaggagaggcatcggctttacagcggacagtgccctctgtttgaggaggttattgtacaatgaccccatgtgcttatacacactgcacaaactagttggccagcatgtttgcacatagggcgatcggagttttggttagcgtttttgcgccacaagcttccatgaattacgaagcctgcctgtttgcttacccatataacttgcccccatttaaatatccataaatcccacgccttgttttgatncgttt

SEQ ID NO: 3003 - DNA, 521 bp, Fusarium venenatum
  misc_feature (1)...(521): n = A,T,C or G
gtcggaggaacgcaaatggaacatgacgaggtgccgttgacgagagacgatgacttccagcacggttacaattctggtctgggacgtatcagcgaagaagaaccacgaccaggaatggctatcagcacgccaggccatgtaagcagtcctattcaaccatatcccggacctcgccgcgacggaggggggccattatggcaacagaatcgtggacctggatggttttaattgtgtataatacgacggaggaaaaaagaggagacagcacatatataggttgtggtgatgaccacgattatggtttcgcttgggaattattacggcgtttgttggtccagcatggggagttggtatccggggctgttttatcataaagaagggctgtaatgagcgattcaagtccagtgaatagatggacttgcggatgggtgataacgaaatacgatggcccacngncatgaaatattaggttcattggtagatagttaccgtacaaaagaaacccgancgttnttaacgaa

SEQ ID NO: 3004 - DNA, 206 bp, Fusarium venenatum
  misc_feature (1)...(206): n = A,T,C or G
ngctgacaccgacttgaanggcgcgcgcnanacaacattgaccgngccaaacgcancaggcatcgattgcgatcgananatttctatcaacctgcattcttatctcatctaatctnatctcatctcaccgnntcccatctgaactccccgngccganacgcgtnttgcgcaatgtttatgtattcgcatcgcccatggggggtggt

SEQ ID NO: 3005 - DNA, 250 bp, Fusarium venenatum
  misc_feature (1)...(250): n = A,T,C or G
ngcgggggtatggaagaagtagacgccatgatggacaagatgncttgcgaactanactcaacgcgnatcagtagtcangccgaagccgacgtgcttacatgangaaccaccgtcagccaggatagaacnaatctttnaacntgttctgangactcgggaatctttcattgaggganaacagaggcttttttcagaacctaacccgcgggntgcangacgaaacccaantgganacctgttaacgattcta

SEQ ID NO: 3006 - DNA, 144 bp, Fusarium venenatum
  misc_feature (1)...(144): n = A,T,C or G
nctgggcgncatttanancgcttggaatgnaaaaanccttncggtaccnancttaatagccttgggggcgatcccatttncctgcttccgtaatnccaaaaagcnctcncggggtttantttttaacctttnaaaaaaaaaccg

SEQ ID NO: 3007 - DNA, 357 bp, Fusarium venenatum
  misc_feature (1)...(357): n = A,T,C or G
nggggtttttttnnttttgggtaaacccaccttagacgactcatattttgacttctgctcgcatcaatacaaatttccacagaaacaaaggcaggataacgatcaagtccatcccctcagcagcgcagggctttccctctccatcctttccagtgagaaaaggaggcgagtatctttccctcattagcaccgccaagttttgaaaacaaaaacctttcatccccatgcaaagttcgtagtaagaaaaggtcagcaagttattgtgttttgtcgtaaaatggtgagggggatagtagaagaaacaggacatgtttgtcgaatagtttgattgaaccacaacatccacacatccttcaa

SEQ ID NO: 3008 - DNA, 104 bp, Fusarium venenatum
  misc_feature (1)...(104): n = A,T,C or G
naaattngatcntgggacttttggnataaccngctgatataagaatcttgatatcaattagcatacattgaacgtatacaccngcactacggattgaggcggac

SEQ ID NO: 3009 - DNA, 112 bp, Fusarium venenatum
  misc_feature (1)...(112): n = A,T,C or G
ngngtgtaatacaatgccggtaaaaacactttntgaantatctttccccgtgtctggttttgcnaaaaaaatctccttaatgtggncaaccagagnggcttctaanaaaatt

SEQ ID NO: 3010 - DNA, 574 bp, Fusarium venenatum
  misc_feature (1)...(574): n = A,T,C or G
cattcagttttatcaaagctaattgtcatatcaacaccaagataccgcaaaatgtcagccccaacgcattcaaatatgcaaacaccaccgaaagatgagagcgactcttgcagtcggccaacgcatcatttacaagagatcaaagtcggagataacagcgttcagctcttgttgtcgacaaaagatcacctctatgacgccaaagacgtcggagctggagtcaactgttatcaagttatcggttcttgggaagaagctcagttcaggaacttgccaaggttttaagccaacgccaagtcatcgaaaatcggcagtcatctacgtacgctgaggcatctcgctttgagagacatggggcaggaaagtctctagcngaagccaagcgaacaacataatanggctgtgaacgggccgcaaagganaaaatgaaactatcttgttgatcgcatataccctccactcacgcaaactcgtctaccgtactttcattgcgcccatactgccccggttctggatntcancacccgttgaaactacctctgaaacngacccaagaattgaacgatcgtcccng

SEQ ID NO: 3011 - DNA, 116 bp, Fusarium venenatum
  misc_feature (1)...(116): n = A,T,C or G
nagagatanactttctntctctccctgtggtaacaangtttagaactcttgcctgcaggaatcgngaatgagtttataggccctaaaaggncttatcntgangtcggaacactgtt

SEQ ID NO: 3012 - DNA, 278 bp, Fusarium venenatum
  misc_feature (1)...(278): n = A,T,C or G
gttactaggacatctgcgggtttctgatttttttactcttctcttctttggttctgcttattaggggttacttctcctctnataccccagaaaaagctcctcccagggtgcagggaggggcaaaaaaaactttgctttttcacaaaaatggcggtgggcttttttgctaatcatgaatccccccttcgagatataaaaacngatgatgaatggaatgaatatggatggatatgaccaagacgagacctcccccacanggatggaangaatggtacctc

SEQ ID NO: 3013 - DNA, 601 bp, Fusarium venenatum
  misc_feature (1)...(601): n = A,T,C or G
naaaaagctncaactggngganaatacttcccangcttgnaaaaaccaccngcttaaaaatacgaaaccttttntttagtacctggagccagcgggcgtccccaacgcgggagcttttttgcttaaggncagcaacaacagcaacccccattcaaagcacgaacttcaacgcactttaaagtggcccacccnctattgggtggngggcggganctggcgggaagaaccggccccaagaacctttcggtgggaccttaaggaaggaccttaaangggggtcctttttggtncaccaaaggacttgggaagcgcttcccccgtcacaagnttcaagaagacccgacaacaaagccgagttcaacccccagtgctcaaaccatgcccccaaaacctggtaaagcagggtccaacgacatttgaagatatgggtatttcacaangaaaagcggaccgngattgcgtttgtcatgtagacctggggagtagatgaacaagatcacaatgggnggnggaagcattgaataattgatnaaaaacacataaagctttggacangggtttttttttggagttaagcttaanaaccggaaacattggtatt

SEQ ID NO: 3014 - DNA, 209 bp, Fusarium venenatum
  misc_feature (1)...(209): n = A,T,C or G
nccaacttaatcgtttacaccacatgcctgttaaacccttgcgtacccaaaaaaagcccgtgcngatcntccttctttcngtggtggagctatacgacaggagttaacgttacnctttnaaaagaganccgtttaactgntggggntgncgtacnatttttgcccccgcgcaacggtggtatcccttcccaggacttttggtccccagg

SEQ ID NO: 3015 - DNA, 613 bp, Fusarium venenatum
  misc_feature (1)...(613): n = A,T,C or G
gatactccagtcatggttcctactagcttatcgtacgccaatactggactcattcccaccgtaacatccatagcagcaggtggaaacaacactttntttaccgtagacgcaaagacttccaccattcctggcagcaaaaaggctctggccccggcgagaaggctcccgcctataaccaccgacttgtgggcttgcggccaaggagtctacggaacattgggcaccggccgttggtcacatgtgtcccccaagccaactaaggngaagggcctgtcgtctctcttcgaatttgacgaaaataccaacacgatgtgccctatcaagctcaagtctntttcagtcngcgctacncattggtcaactattatggataacgtgacaganctctcggtgtctaacaagggaacgganaatgaaaccactgggngctgatgtctattctggggnggcaacnaacacttccacttggcctggaaaaaaacaaatttaacgccctgctatttccactntgatatccacaaatctccaaggaaggcanaggttcatcantgggtgtactctccanaaatccctggcggggaaggggnaaaaatnttgacnaaggtaattggaa

SEQ ID NO: 3016 - DNA, 145 bp, Fusarium venenatum
  misc_feature (1)...(145): n = A,T,C or G
naaangagtcgtattgaattactggccgtngttttacaaatcgtgattgngaaaacctgggggacccaattaaatcccttggagacaaccccttntaaaggtggcggaanaacgaaangcctnccaaatggcccttaccaatagt

SEQ ID NO: 3017 - DNA, 628 bp, Fusarium venenatum
  misc_feature (1)...(628): n = A,T,C or G
gaaaccagaacacgtggcattgaagtggtgtagcttgacgaggggccagatgcctgtaccaacttatgatgaaggcgccttcacttgatgaacaacgaaccgccaccgacatttgtccctggcggcagcanaacagaccaatgctcatggttggtggttaaagaaaggctgaatgatggttctaatataatagggacccgttcgtccttttaatccgcaagcgccacgaaacagggcgacacgtatctcggcgagtctattcaggcgatgctggccgaatatgttggagcaacccaagaggggggctggaaaaaactcancgccaagggcgtattcaatggattggaagtcgggattctgaaaagtccaatttgcaatttcgaggcgaatangatcgtatnatcagttccatgatggagtctgnganatttttacgacttctttcgtttacatggcgganctgctcgggaacggcccaagattaacggggttcttttggcggnggctcttttttaaccttttcgtcttgtcntttggggataaatnangggcgggtggcnctcagaatttacttgncaaattttaatcncgggngaacnaaccngccgagncttttaccggtggaatt

SEQ ID NO: 3018 - DNA, 119 bp, Fusarium venenatum
  misc_feature (1)...(119): n = A,T,C or G
nattaaagagaacctttggtttttcnnactttgcctttgnccatgaaancagactcatgantaaaactccaattatanaagntcttttgcttttttgggaaggtaanaacnattcttaa

SEQ ID NO: 3019 - DNA, 175 bp, Fusarium venenatum
  misc_feature (1)...(175): n = A,T,C or G
nccgccntggcttaannaatgacctttgttcattttnatggaagnttnttcgctctcccaaacgggaagatctggcgaattgngggttnccgagganctttngggcacaaactgtttgaaaaatggcaaaatgaatcntggggccggtttttggaatgcaatgnaaaaggtgtct

SEQ ID NO: 3020 - DNA, 590 bp, Fusarium venenatum
  misc_feature (1)...(590): n = A,T,C or G
catgatcaatctgtttatccatcgtgggcataaatcgtcaataccttccgatacacgtatatcgaacactgttgttacttgaattacccaaaaaataactcatttactattaccatatgtctaaaagcaccacatcgtgacaacgttggtttcacaaagcgttgccaagactcaacgtccgcatcccgacggacattaccttcatcaagaccatgagatactctcctgaacaggtcaacattgaccatcatcaagtactcactcatctgaggcctcttaatcttggcatacagtctacttcattgaaatcatcctactactcacaacgctcaccactaaccactcacaatcaatcttatttagctgcctatccaagctacgtcaacaaacgaaagccacgatgcatcactaaccaagaaatctgtagttgcctagtgacttgtatctagatagatcaaggttgctgccttattctgcggctgaaatcctttgaagcatggaatggatgaaatngcattgaattgggttatgttcatacaccttttacataagcttacttttgttatcgtctgtatataattataatctag

SEQ ID NO: 3021 - DNA, 104 bp, Fusarium venenatum
  misc_feature (1)...(104): n = A,T,C or G
nngttttacagggcttaaaagtnctttngggaaattcttacctttgccttgnccgnatttttaaaacnnttgctgggnaaaaccctggggaacccacttaaatg

SEQ ID NO: 3022 - DNA, 142 bp, Fusarium venenatum
  misc_feature (1)...(142): n = A,T,C or G
ntctttttgggcgaggaatgtacttggtttttaatcgacttcgaaaccaaggggngnaaaccatcaatgcttgaacttttgatgagggccccgnaganggactntgaaacctgctnttaaaatnnccaacttaaacaggacc

SEQ ID NO: 3023 - DNA, 624 bp, Fusarium venenatum
  misc_feature (1)...(624): n = A,T,C or G
gtttactctttaaatcgcaaagtaaccatggagtcttgttctacgtgtgcaactatcctctcgtcaacgccggcttacacaaaaaacgaatcgtctctaccgcaagaccgtcgagtcgcatgttgttcganaatcatttgtggcaaatgcattcatgttcgtcatctatctctacctccttctcgcgtgaccgcaacgtgggttgtagctgatgctcttttatggnacctaagaaaacgagcgggttgcagattattgccttactgcagggttcaacagtgcctacttcacttggcccagggcctganagacccccggcttattcgtcattctanctcgcagcccatatttaaggagcccccccccatattaacancttcaacgacncangatgtcgatacaagaaggcacattggcacaggatgctttgaaggaggatgccccaaatattctgcattttctcancatcgcatganagatcacttttattttccaaacgggggccggttttgttttccaaaaacacaatatnaaagcnacacttgtttttgganaaaaaatctgatcctgggagactanaaggggggnaaccttttcncgccncaagggaaaaaaaaaanaaaa

SEQ ID NO: 3024 - DNA, 180 bp, Fusarium venenatum
  misc_feature (1)...(180): n = A,T,C or G
nccagccgangngtaaaaagcctgtgcatgcggccagnaacattcnccgnccgcctttttcnangacttgnctgtaaaaaaccccgntctgtcnagaccgntggtccatacttgtcccgtgannaaaatttccnccgncaaaccctacggttgttaaccncgaacttcngncccgatgtc

SEQ ID NO: 3025 - DNA, 123 bp, Fusarium venenatum
  misc_feature (1)...(123): n = A,T,C or G
ntggtnagctccantatggtccnctttattgcacttccaccggcggaggctacgntatccggaanggaggngaataaaatctgnattcctggcnaaaactntcgcganatatatgggctgtta

SEQ ID NO: 3026 - DNA, 127 bp, Fusarium venenatum
  misc_feature (1)...(127): n = A,T,C or G
cgacatctcgtntcaccccccttcgtntnaacaagtcttttccacatnanactgccancaggactnatgtcaaaatgacttccnccggtcctatcnacaacnacgccatcgnccgtcagggctngta

SEQ ID NO: 3027 - DNA, 242 bp, Fusarium venenatum
  misc_feature (1)...(242): n = A,T,C or G
ngcttggtttgaagaggaatncacgctcnttcaatcnatnattctacggcgaancaacgccccncaggttncaaaccttctnggagaagtctcatgggnaccccaacacntgtggccagacacatgaacanttttactcggccccanggtatagaagctttnacagaccaaancttaaactattatngctgacanttggcccnantttaccnaaagaacacccttagaccttggntgagggc

SEQ ID NO: 3028 - DNA, 230 bp, Fusarium venenatum
  misc_feature (1)...(230): n = A,T,C or G
tgaggatggcacctgcgttggaggagctgtttaatgaagtcttgctttggatgggagggcgacgttaatttcttttgtactggtttgcaacatgtttattgtttaacaattccccctttagataccaaacctggatgaaaaccactctagacggatgatcttcagcaggctgtgcctactgatgtgaaccaatattactagttacagaanaaaaatgaaaananaaccaa

SEQ ID NO: 3029 - DNA, 149 bp, Fusarium venenatum
  misc_feature (1)...(149): n = A,T,C or G
ncaataccaaacgtattnctgcagtcaaatcnttctcttaggcgattcngtggggccacctgcccngcatnggtctancancaccaacacggccttttgatacattctcttcaaaagcgatgattttnggctncatnggagnttatcag

SEQ ID NO: 3030 - DNA, 247 bp, Fusarium venenatum
  misc_feature (1)...(247): n = A,T,C or G
gtcggcgatttattgagtagtttattctctgttttccatttcatgttcgatacaaaaaaggatacgcgatagaagcctaccaagttgtcaaaggtggtccatgcatgatggatgactgctgacataatgacgttcgccttaccctacaccgtactcccctttacgactggaaaccttgaagattgtaggttatagtctgcattataatacacgcaattaatcaaaaggtttcgaaataatgatnaan

SEQ ID NO: 3031 - DNA, 358 bp, Fusarium venenatum
  misc_feature (1)...(358): n = A,T,C or G
ctcaacagaagcaggctccggcaccttgacaggctcagccttctctgttgcttccgaggccacactggtcacgtcgctgacgctgctcatagagctaccgattgacgagatagagctcgacacaacgctaccagcatcggatctcagggccatgttctcggacctcaagcccgagacctccacagataatctcagcacttgcgctgactgatcatcctgggtgtgtatcatgcctctcatctggtctctcaatccatctntctcaanaanaccacgggccggcagctccggctcaggtcgtgcanaatgtctttaagccatganaacattnttctttntggcaaaaactccgtatgac

SEQ ID NO: 3032 - DNA, 244 bp, Fusarium venenatum
  misc_feature (1)...(244): n = A,T,C or G
gatgaattgtgccgagtaaagagctggaagttgagataatacatggtacaatttgaaaaggtgacatggccgcatcgattagaagagaactgcgagcgatattgtcggcaagcagacatggacgttaaggaggctggacgatagatgaccattcaaacatgaatggctgtatgcgatgcctattaacatcacgcgagacaatgataccctanaaaaaaaaaaaacaaaaaaaaantaaaaatan

SEQ ID NO: 3033 - DNA, 586 bp, Fusarium venenatum
  misc_feature (1)...(586): n = A,T,C or G
aggtgatgctacggacgcacagcgaggagcgcaagagtgcacgattctggaagaacctancaggcaaggttggcctgcgaaagtaactttctttctttcttcaacctttaatgacctacgataccatgacgactagacaaaaaaaaaaactagaagtctttgggatggatatagccagctctcatggggtttgcttggcgttttatttttcattttttgccatttttgcagagataccccgactcatgtcattccttcattttacgtctgggacattggacccgatatagcctcgacggcacacaacatatctggtcgcatcagacctgcacatattgtttattgtttagaaaaatnttcataattggaaaaagccctggggcataacgaaaaaagcgaaaaatttaaaagggggggaaccaggttcacaatgcganaaaaacaactctctttgactccctgattttgatttggttttgccccaatgcccnacattttttgttcnctgcttgnacacncacacacacacacacacacacctttatctcccggtntgacccaatgatngtgaanttaggaaanggac

SEQ ID NO: 3034 - DNA, 445 bp, Fusarium venenatum
cgcatcataaccaatggccatcgtatcatagtatagcaatcttcgacttcggagacttttgtagttgtcctgaacaggtaggagagtatttctaggcctcaagaccaccgaaagttcccttgtagcccctggctggcatgtactcagtgtcttgcgacattttgtgtcggtgtggtgaaatcgaagcaaagcaaatatcttgtcctgtcaaggtctgtgattcgactgttgagacgcggaacatatgcaacgggcgtctccatgcaactagaaggttttgacagcaagttaatcacttgttgatcagaattttcatgcctaactagttgatgcttcaattccatgcgcgtggtgttttggttgagcttggatagggtgtggtgttaaagttgatgagatgctgaattgcaagatgaacaggtagacagggtgagtgagtaccaaa

SEQ ID NO: 3035 - DNA, 210 bp, Fusarium venenatum
  misc_feature (1)...(210): n = A,T,C or G
cgatcttatattgtggagatgttttgatcggctttagattgataaaggctgcgtttttaaggcttcctttgatcaatcgacggaactcggctcgcttggatggattaccccggcggatataaccaagatgagtggtagtatcgtataaacccagttagcgtatcatttgcaaaaaaaaaaanaaanaaaanaaataattnaataaaataa

SEQ ID NO: 3036 - DNA, 543 bp, Fusarium venenatum
  misc_feature (1)...(543): n = A,T,C or G
gagcgtgatgaggcaaatcgcaaggcgaaacgggagaaggtcgagcgcactgaacctatcaccgtaacttcgacagcgataccagctgccgaggcgcagaccacggaatctgctcaagctgcaccagcaaagccaaaaagcggaagcttcaaaaacttcttttaaatgtaaatggttccaacctcatggctgggtagtcgtatacagatctatggactaagaaagcatatccttgaagatgccggggtttgcgatcgaagcttgcagtgaggccttttctggctcctctgcaggtgccacatcattgcgcagggcagacaggagagcaggaagaagatcgtccgtcgacaaagcgacccttacgccctgctcgccttgttgattggggtccatacccgcaaaaaacttatcctcgctctgataccgccatgctgatgatggcaatgggcatgccccgatcctgagctcgctttggcaagtcgcaagcagaaataagtggcaagtgangtgcccagcacgaagtagcttttccgcattatcgat

SEQ ID NO: 3037 - DNA, 246 bp, Fusarium venenatum
  misc_feature (1)...(246): n = A,T,C or G
ntcgcaacaaacntgntgatcctccatnttcnctggcgcttacatggggcactggcangtcagaantgntcaganaacctcaagagactgacgaagagtggtggaagcgacanatctgcgctgagcatgacgagatgagggaagctggcagacattagnatcccgattggagaanantccgagcgtgaaagaagatctggacactaaaagttcccnggtgaggatcatggaagtgtggcggagaca

SEQ ID NO: 3038 - DNA, 625 bp, Fusarium venenatum
  misc_feature (1)...(625): n = A,T,C or G
cagagacggcaatttaattcccacatttggcgcgtggtatcagagagtccttttacagtacgccagcaaagactcggccttgcatgtcctagaacaagcacttcttggatcttgagaagatgtcgaccaacgcaacgaaaaggaaattcaacactttactacaaggcctaggaccaccgagcccgaacaatgtcgacgacacaccagcgcacgaccccggcacgactgcctctcctggctcaatagctcgcgcatccggtgtcgatttagagctgctgcagaaacgccgacgacttggttttccagactcgactgctcctaagctgggaaagagggccaacctatcggcgaccatatcttcaattatctctcgacgcccgcaaagccaagactcgtctaaaagttccaatgcaccaccccgcacgatatgcgccaaccgatcgaggagacttgttgaagcgactcggtacttttcaaagagataacagactggacttccgaagcccggaagagtgaatgangtggaatgggcgaaaccgtggatnggtatgtcatggcaanggagaaaagttcgatgccttnttntgtcattcgcgaattgggtggtnaagcttnaaccgtaang

SEQ ID NO: 3039 - DNA, 192 bp, Fusarium venenatum
tgcactggaggcctcaagggaaacccatgtgattcgattttgatatctcggctatgatttgaggcagctgggtgcatcatgtgttgggcgagacaacgtactttcttgattactttcttggctgcattttcaactgccttcttgcttgtgacttagtttcttatctaataaagaaataagaaagattatggc

SEQ ID NO: 3040 - DNA, 813 bp, Fusarium venenatum
  misc_feature (1)...(813): n = A,T,C or G
gggaagcgaaaagtccgctgttctcgccatactcctttatgcgaacgatgttctcactttgctttgacatgtgaatcgttcgcatacaaggaccatggggcgtccgaggagaggacagccgctaggatatagatcgactggtgttgcgagtaccagtgttgcatcaatgtcgccaaaggatatggaggctggcaattttactggcatcatggatcagttcctcgatgacttgggaacgccgtcgccttccttcaatatggacttctcgatggaccaagaacctataccaggacgtgtatcattaccacccgatcttttcactgacgtttctacacaacacgatcgctacaattattatcctggcactgaaagcaggggtgcagcgataacaccacaaagtatggaaagcgcgacgaatccaagaccacctgttcagaagtgttcttgtatcgagttagtgaaccagcatttctcagagatagaaagctcccttgagacattccaaacgctcaaagtcctcaaaaagtctctggtgtcagcgaagacaatcctggagtgtacagtctgttttcagtcaatcaagagtncacgcacatcgcgaaacgtctaccttttgggttctcttctatccagcattggctcttcttatggngactttttctatatccagaagcaacgaacttccgatccatcagtctccagcacacctgngagccttttattggacaacaagctgattcgcgagacatgggtgagggtgctntcgagggacccaatacatggctttntacaacaagtctnaaaaaagagttg

SEQ ID NO: 3041 - DNA, 563 bp, Fusarium venenatum
  misc_feature (1)...(563): n = A,T,C or G
cttggcagtcattctcatcttggaaactaattagtgactacagatcgagtcatacacattcaagacaactctcattgtcgtgacactcccccattttgcttggcaaccgctcggaagacaatacacccgctaaaatctccaaatttatagcagccccagtggagtcgacaaggcctgagtggtctgggagcataagagatgaaattagcaggtcaacttatgctattcaaatcaggcttcttaggctctttatttcgtaccacaaaacactacctagatacggcatacttgacgtgcattaagtgcaacaatgtcttaggtgagctgacatgcttgagtcaccacgtctctttcaacaacccggcttcaatctctatcctcaatcatgagattcctgccttcacattagctgngatcacaactctcctnacaggccaagaatgggaacaatgtacccgggccaccacaaaaccaacacgacgtaccaccgntgnttggacccagaatctnnaactcacttttcggactcnaagngataggcngcccaggagctgccgatacac

SEQ ID NO: 3042 - DNA, 305 bp, Fusarium venenatum
  misc_feature (1)...(305): n = A,T,C or G
gttcttcccttatgtctctcttcttccacaaccttacaaacctccacattctaactccagccgcaggccccgcagaaacaggttctggtctcgccctccgcacaagaaaccactgggctgtcattagcaccatagcactattccacacaaacgccgcaatcatccccagtgaaactgcccacgctgtagaaatctggatatagcacagccccataactgagagatcatcgaagccatctgtgagcacaagcccagataacataagaatcacttgacacacaaacatgtcgaagtagtgaactaan

SEQ ID NO: 3043 - DNA, 224 bp, Fusarium venenatum
  misc_feature (1)...(224): n = A,T,C or G
tgcggcatgtttggctggatgagcatgggtaaataaaacgggatctcgcttgataatttaatgatgccgaacgattcagtccggtagcacatttgtgcttctttgcagcaatttgaaggaatggtatttccgggcgttggatggagtatacttgacacaagcagccagatggctgtgctatctatttctttataaatttacaatgtttaacgtanaaaaaaaaa

SEQ ID NO: 3044 - DNA, 254 bp, Fusarium venenatum
  misc_feature (1)...(254): n = A,T,C or G
nggtctatctaanaagaaaaaacttnattgccggttntgaaacccccnaganttggaanancccgccgggccacgaaagggattccatggataccctttttnangtggganaaagctaaaanggccttacccagggggtttttaaagggtgaaacttttcctgnggacttcangttgcccctttnaaaaanacccntttggganaaatnggggtttcaacccctttaatggaccnccgngccccgttaggtatc

SEQ ID NO: 3045 - DNA, 569 bp, Fusarium venenatum
  misc_feature (1)...(569): n = A,T,C or G
ctcagggctgaagcactaatgtggcgtggcagtgctgtcggaagggagggacaacactaccttggcatgtcccccgttgcatcggcaaagtttatagcactgtttgatctctcaagcgacatgaaacccaacaatctttcagcttggcgccacacttggcactcgacgcgattactatgtatagtgttgggctcatttcaaccctcccccggcccgacatgcgagaatgaatttgacgatgaaatataaaaaatcaaggtagcgacacacaatttgaccagacgcatcgcctggggccatgcattctgtggaggcgctactttctcactgggcttgacatccctgccgggaaaccaagctacacgactgccggaatttggcaaaaggagtcatacaggagaangaatatttattggcagaaggaaaaaaaagcctggcgatgttctttatgggttaagccaatttgtgctatcccttgncaaaatgaggagganaggacaaagggtttcacttcgtatactacatattaagcttgacacangcttgatgctgaatgncctcgcttgcat

SEQ ID NO: 3046 - DNA, 651 bp, Fusarium venenatum
  misc_feature (1)...(651): n = A,T,C or G
ctcactcagccttaccaggctcttctatccaaagtcactttcgttaaaaatatcatgtcatggaagctcataaacattccttctccggggtgaaccgccttcactctctttgcggtcatcccaaccgttcacgctacctactatgacatcccctataatatgactgccggtgaaaccttcaacgtcacaatcaagcagaacattgatccaaactctgaaaatgggaagagcaaccgactcttatcgtgtctatctcgccctgacaccaccaggatggggcacaggacctgtttgttggctccagtatctaattcctcgagatcaaacacaagtcaacatcaccattcctcccgacgtggctcctaagggcacacgtatcaggctttcaacatgtcttaccaactcaaaaaatggcaggcgaatcaccggttttgattacagcggaaagacagatatgtcggggttaaacggaacttggagccaagccgaattggaccgtccgaatacaggcgaacaanataaaggttcctgctcgcgttatgggtgtggtangggatgctatgatctgttctacaaaggngacaaagatgatgaanagtccagcccggaagtcgtattgcttgcttgaangnttgggcaagaaaatttgaa

SEQ ID NO: 3047 - DNA, 412 bp, Fusarium venenatum
  misc_feature (1)...(412): n = A,T,C or G
cgaggctgttatctgggacaagatcatcacgaatcccagcgccgaccatctccagaacattggacctgttgctatgaagaagctcaagcgcagcgctgaaggaaagacaatcgaccccgaccgtggcttccttggcctcaagaaccagaaaccaaagtatcaaatcacccaccctactggtaaggttgcancgacagaggatgtgaacttaagctgcctatatggtcaancctgggttggattcttacttgggatcagacccgcnacttggcactggaaggctttggtatggcgagtcaccaagttcatcttccancatcaagatcaagaagaagaagatctccaagaagactctagatngctggttatcagtttaatatgtgttgaagtgaaaaataagttaatgtgcggt

SEQ ID NO: 3048 - DNA, 254 bp, Fusarium venenatum
  misc_feature (1)...(254): n = A,T,C or G
ntaaatgcntatgccntgtnttatgatgtggtaccntcatcatgactagtgcggacatggtgganaacagnacantgtgttaaccngcctcttagccagaataaancgcgtaagaagttcccaattgccttgcgacnaagattcggtnngcttcattngtcgcctttttntagncctaactnttgacgnacccaagctagtttgacaccgtaacttcanccnataccaccnaccaggagttgccttacacttag

SEQ ID NO: 3049 - DNA, 626 bp, Fusarium venenatum
  misc_feature (1)...(626): n = A,T,C or G
ccctgtttcaggaaccaccacgaccaggggttccgcgcttaaacgtcataatactaattcctttgtgtcccagtcattctttgaacccttgatttgacttcttctgccttttggtgatgccttccgtccattctctgcatataccagacgttcattaaatctgtttttgttttcatcatggcgttgtttgaagaggccaactgcgatcgaaacgcgaccgctcccatagccagcgacgcgggcgtcgcaagtgctggtattctatggtccttcatgattacggcgctgcttgccgtcattttatcgagtagcgtcatcttcgcggagatgcgaggcaaggagtctgttcatccgacggaagctactcaacggctacagcgactctcaaattatgcaaggaattggtatcaagagtgttgggcttcgccaaaaaaaaaaatcttcgggcccgtataatttctttctaaaatggatgctggcgcttcttttcatggggacccacaacacaacactgntagcccttaagcaagaatacccnccgcgattgggtgattcgatnggatgccacaagttnctcatgttcgtcaaanctggggctggcttgggnctctgggggctttggtctc

SEQ ID NO: 3050 - DNA, 582 bp, Fusarium venenatum
  misc_feature (1)...(582): n = A,T,C or G
ttccaaccaggttccatggcccaagcctccatctgttaacgacgcaaaactataccctgctcgtcaacagaagcacaacaatcgcaatgccaactatcaacccccgtgactcggtcaaatccacctggcctctcagcgacaaatctcaatggggcatgagccagcgcatcatcgatacattgaatgcgtacccaataacccccgggaaagaagtaccgagacatcccaaaactgagatgatgccctactttgttgaatggcagggacatgtctgggttttgttccatgcttttgctccaatcgcactccatcaaacatggctgtcttgtactggccacgaaagtctccatcctgtcatcatctttgtcctctacttctcgatgttcagttggaccgtggtccgcgaatcaagcttctcggaaactgggtcaccagcatgggttcttggatggagatactcacgaacgtgatggcatacctgactcggtgtcacaaagtggtgttctcctatggaaaacactggtctcggatcccatgttactgcatcggatacaatacaccaatcnccacntcgttatcaaa

SEQ ID NO: 3051 - DNA, 224 bp, Fusarium venenatum
  misc_feature (1)...(224): n = A,T,C or G
nctngatgttggtgccganggcatacnnctggatgctttgnctgantatatcgacaagcncattgacnggcctttcgaggacttnattgacnancatttccagggcactcccttcatcaccgagattcttaagactgcccaccgcttctacgtcaaggagaagatgcccgttatccgcaagtcantcaagcttgtccttgnctataacctnantatgcacanaa

SEQ ID NO: 3052 - DNA, 148 bp, Fusarium venenatum
  misc_feature (1)...(148): n = A,T,C or G
naaagtattgggctcatantcnttataaagnacaaaggcnggtttnttcgagcaganttggnaatgacaaactcaagtnttctttcnaaaaaggtagaaaaagaagttattaagaagcgttaaactttnttnctgaaattcaataaag

SEQ ID NO: 3053 - DNA, 226 bp, Fusarium venenatum
  misc_feature (1)...(226): n = A,T,C or G
nggttggaagaaaatctggatgctttacagtaaaagngagagttcncttaccaactatanncatgggcgattngtnactcatctgcttatcgaagaccaantctngaataacttccngccgtccaatagagnttacgtttacaaggaccaaattggcctantgngaattttatnaaattcaattgtcttgncatacaacccaggaccaangaaaaccttgttttcc

SEQ ID NO: 3054 - DNA, 137 bp, Fusarium venenatum
  misc_feature (1)...(137): n = A,T,C or G
ngccagtacantgaggaggagnaatccggttctgangatttcaaaagtacataggtnaatgttgntntggccaggttaagggcccaangcaaaattttngtcaatcgacantgggtttttggnngggttcccttgaa

SEQ ID NO: 3055 - DNA, 272 bp, Fusarium venenatum
  misc_feature (1)...(272): n = A,T,C or G
cctctatttgattatctggcgggcgcaatgtggaaagggctttttttgttttttggttgtatcattatgtatctgtcagnggaattgagaacacgcagagagaccacggcctggagcctggcaaacgccgattggacagtattttatttattcatgataattcatnaaaaaaccaaacaggatgctgaacaattngggacaacatgttgcnaccaaaccggtccaagtcaacgcaccaaaaacacaaccagtttttgggtgtttntaacaaa

SEQ ID NO: 3056 - DNA, 1775 bp, Fusarium venenatum
  misc_feature (1)...(1775): n = A,T,C or G
cgttcacataccgtgatgttgagctaatctatcctgatatctgcttcatgaatacggctaaatatttatttcggcggcaaacgtttactcgattgtcgttgggattaactttaccatgatgaccttcacgcacgccaagcaatctgctattggctgcctcaccccgcttcatcaagtcgattatctctcacatgctcacaatgcatccattcccatcttactcttttacaccaactcactccgtgtatccacatccggaaaacagattgtctctattcgtccacgtacaggacgaagctacttgatatccgtactgggaagtgcccatttttcacgcagggtcttggagtgtgatatctcccacttgatattggatactcctcctcctcatactcaccggtgtgggtgagagaacggaacccatgttttatcggtccccggcttgccgaaaccactaccgttcccgttctccatcaaccggcctaatcgagcccccacattaacttctgttccgacattagtcgccgaattccatgaaagcatgacctgcttcgaacgtcgccttgtccctggcagctagactggaacccagcccaagctaaaggaagagataatcggcatgtatctagaaacacaccatcgcattgaatcggatggcattacgtggcgaatcccacccacctcgatccctccacaagctctgcggcaggcctcaacatgtcaatcatgctggttatgggaaacgccttcgacttccacacgttgctgttgaataaccctaagtcaggaaccattggacttggtacgggacgtgttactgtactacaccatcattcgctggccggcaacctgccatgatctcgccatccagtactttgggcagtggttgcatgtccggcacggcgcgaatcgaaactcacggagcttgaggtcggggagagctttgctacagtggagagctcgttctgcaccgtaaattcggcgcaaccactttgcatgatatggaccaatggcagagacatgatatcccgcattgcacattggcatgcggggtgagggtctggtagggttactttgaagagaagacccttggatgaatgatggaattgctcccccaagtcgggcagcatgtaatacatggagtggagttattgtctttacacacccatacccacaccatgccagacgataatcaggcaactgatgtctgataaaggacgtgaaacgcttatgagtgggatcaatgctggcctcgatcgagtataagaaggacgcttgatctccctcaaactcgacttttttttcttcatccaacaagctattcactcttcaacacaaactcaacacacttttacaacctttcaacacaaactcaacacacttttacaacctttcgaagtctttcttcaccaataccttcaacatgtctccctgctcttgctgtaaccacgccgacgcttcttgcaccagcgcttgctcttgctgcaagcactaaattccttcttattattaatgcctgacaacacttggcttacaaccacggtcgcgacaatgtctccttgacacattgaggaacatccaggaacaagcctttgctaagcaagtcggacagatatgagaatggaaacaatgaatagaaatggcacaaacatgcgagagtagctgtgacggccaattttcgatggtagcgcagtgttagatacaaattgaagcttgcatgccttgaaaaaaaaaaaaaaaaaaaaataaaanaaanaaataaaaanaaaaatttt

SEQ ID NO: 3057 - DNA, 104 bp, Fusarium venenatum
  misc_feature (1)...(104): n = A,T,C or G
ngcnttgacatgaccagagccaatcatngccgaccncacctattgttgctatcatctgcacaaagaccaactgtccaagatntagcccaagaagcncatngaga

SEQ ID NO: 3058 - DNA, 321 bp, Fusarium venenatum
  misc_feature (1)...(321): n = A,T,C or G
ngtaagatactgcnactttcgctgagcanggtantgagcttgcntttacancactgcagagaccagcacgatagctncactgaccgatcantantgggctataggcttccagtnnctgactctggancctacggcgaactcagagccaatgntggaggtttagagtctggaaacntcgtttgagnaaccgataccttntttntgggctgccccgnccgaaggnagcgaaattgngcggttggnatctacnggcatcnacctgttgtntggagggggcttagttaacgccccttgngagcttngaacctgtagtgccttctt

SEQ ID NO: 3059 - DNA, 644 bp, Fusarium venenatum
  misc_feature (1)...(644): n = A,T,C or G
tgcctcatcatctccagatgacatcgcatgggcagtagtcggatcaatataattctcacactcaatcccacactgatgactttcttatcaacttttcatcatgaaatggcgttttgggaactgattcaaacgcgccgcaagagatcatggaagcgtgccaaagtatggtagtgcgtttcaagacgcctcgccaaccaagatgtacttgacggataacgcaacaatacccctttgcgcacggattgcgcacatttggatatgaccaggatggatggatggatggcgcatcgcaccgcaccattatgtcgagtacaggtatcttgaggttggttctagcctacccagtgtcttctcgacttgttacaatgtaccatcagcagtgacgtacagcaaaagaatacccccttggggtgcaaaccccaattcgaacacatgcgattgnatatacattcatgtatgtattttcctttaggccttgccancatttgctttgattttgcttatagagaggccatctggtatttggtttgattatttacaaagaattgcattgcatgggtacttggtattggcaaatgggtttcttgacatcatgggatctcgattttnctttttaacgtgggaggggattcgggaggagaatn

SEQ ID NO: 3060 - DNA, 361 bp, Fusarium venenatum
  misc_feature (1)...(361): n = A,T,C or G
cattcgaaacttgttcatagatgctcatcaacgataactcacattatactctcccagttcgctagacaatcgactagctaaactgtgtatcctcccatctacgtaactctggacttgatatcatggctgctggccngtcccgtccccgttgcctcccacagtgttactcaacctggcgatgcagaattcatgtccaacaagatcaattttgcactcattctcagggactcaatacacttcccggaacaagtaaaggaaaagatttagcttctatggctcaacgtctctccccaaaaatatggggccacaactccaagnttatgcccttttaacctcctcaaagaaaccagtagttgcccca

SEQ ID NO: 3061 - DNA, 373 bp, Fusarium venenatum
  misc_feature (1)...(373): n = A,T,C or G
nagcgggganatactactgtcgctgnccgcanaaatcaaccaactnggctgtntaatcctggctcttcattcgcacaactatcgccgttnctttcgccagtacccgagacacaaatgtccgacnggtggctttcatagttcccccaattggcattncagtgcaggcgacttgcacatgacccttgcttaagcaaatttccaatgtctcttaacgcggctattncacttggctcacaaaaagncgggctgctccctattgactttgggcatctctcanatcctgggggaaatccacanggaggattgtcaccanggtttgncttttgggcatcgccccaaggatgagtctntnttttttacganggntttaagg

SEQ ID NO: 3062 - DNA, 654 bp, Fusarium venenatum
  misc_feature (1)...(654): n = A,T,C or G
cttcttctancccactgcttgtctctccattcctgcacgcaattnggtgattcatcatggccgacaaagacatctctcccagtcgttcatacgatgacaagaacgcaagcttccctcctgaaaagggcaatgcagaggttctagagcacgctggtcaaggccgccgtggttctaaagctgncaacatcgttgtgaatcctctacngggtaaaacgaaagagcaaacaattaccgacgcacgcacctttgccganaccaatggcatgtctgagcatgccgaccttttcggcagagccgntnttattgcccgtgatcctgacaacttcgaatcggncgaccttctcgatgatgagcgagaagctctcatctacgaaaganaccacaagtggcatggatcaaagatgttgtggtactcaattggcctctgtgctgttggtgctgcnacacagggttgggatcagacaggtgccaatggtgctaacctgtcattccccaaggaatttggtattgatggtacggnacgcgatgaagtggattggtggcattatcaactccatcatcttcctgactgntgggntgatcggggctttnattggcgatctttnaaccacttantttgggcgacgggggaaaagatctttatttacagccgtt

SEQ ID NO: 3063 - DNA, 121 bp, Fusarium venenatum
  misc_feature (1)...(121): n = A,T,C or G
nttgtcactcaggctccccgcccctcagtctcgggtgctgttgaagancttgcaagggtgcgagcagaaaatgaaggatnccattncttatgggcagnncagccctgaatacacttattat

SEQ ID NO: 3064 - DNA, 101 bp, Fusarium venenatum
  misc_feature (1)...(101): n = A,T,C or G
ngggnaagaaacggggggcccttgggcccggacnggggggaaaggggggccncccgaaaaaaaccaagnngggggaangggggnaatggggaccngaaagg

SEQ ID NO: 3065 - DNA, 158 bp, Fusarium venenatum
  misc_feature (1)...(158): n = A,T,C or G
tnatttgncgggggggggggnggtanagtagccncaagaaaatcggacgncaccgnaggaagaaanctangcaagacgcccaatngcgaagggccntcccgggngcgagangagcggcagccaacacngaaagccagccgacggacacacagaaggng

SEQ ID NO: 3066 - DNA, 496 bp, Fusarium venenatum
  misc_feature (1)...(496): n = A,T,C or G
gcgagtcgagcgcgaatcttctatccttggagatgcagacnaatactcttgtttccctgcagacttcatcatcccccacnaaaataactactcgacacctcctccgttgattagcgttacttttcgatcactggaactcatatcatccgagtcgaccaaggttttccccgcgagggcagctaacaaggatcctgaattactatcgttaccagccactgtcaattttgctgtggccattgacggattcacggctganaacttctcgttctctctggcctacnacattagtttcgtaacggcgcacccgtgttcaccttctcaccgagttcgtttcattaaatcgccatcaagcccaacaatccaacaaattgacgtgactgggtctgacacgttcgggcaaggctctcggcctgccaatcgcacaggccatccattacacaaatggtataattacgctgcatccacatctcggagcttntgaagcgcagcacacttc

SEQ ID NO: 3067 - DNA, 471 bp, Fusarium venenatum
ttcaatccatcacacctaccaactctcacaagtccaacactacattacaactatcatcatgactaccaactctttcggcggagctcttcctcgcttcgacttccctgctcaaccacaacctgccatgtctcgcattgcacgcgtcaacaaagctcttccagtagtcttgctcgcagccacagtagccgcactcgctgtcaagacaagacaaaactttgatgcacccatcactacatcaatgttatttgcacgcccgcagaacttggtgcctcaagggcagataagcattgacaagaggaatggcgatgtgggattgaagccaaaacaataagattagacattgtgatgggtggtaggattgggaagcataaggaagcgatttacagacccgttttaaacatgagagtagggctggtcccaatacatggcattttaattattcactcgctgggtttattccaaaaaaaaaaa

SEQ ID NO: 3068 - DNA, 635 bp, Fusarium venenatum
  misc_feature (1)...(635): n = A,T,C or G
tgcaagatgtcctaatggcactgagaaagcttcgagaaggattggtggcgaccaagcgagctgatctcttttccatacaagcctacatcttctccattcgcctgtctatccttgccaagcatcctgagtcatatcacccagcgattctgcaccttcttcgatacatggctgtgtggactccgatggtccaaagcgaaattgaagaaattgctggctacttcatgctagatgccgcgtgtcggcgtagggacttgacggaggcgtacttcatcaggcaagacttcaacatcagaaacacgaagctggatcacatacttaaagcactggcgcatgacaactacgtctcgtggcaagctgtaaagcaacaagtcgaccgccattgcctcaagttgatggagtgggcagatgatgacatgaggcttcacactctgaaatgctttgggaaatcgtatcttcacgtcgacttgccttacttggnattttncgccggtcgcaagtggnatgagttgnaaaaaaaagacaatgtcnggtgggnactggaagacnagaaggcactntttaaagactaanancgagatganggtcgtttgtnatgccggggtncccgaacgagttttnaaacaagaagggttatt

SEQ ID NO: 3069 - DNA, 169 bp, Fusarium venenatum
  misc_feature (1)...(169): n = A,T,C or G
ncnccgcaaaggaaccccttttttgggggggggggaaaagngggggaaaccagaaaacaggggggaaggcctggcccccggggggacgncctggaagaatacnatcngggggagccaanaatncggaaccgggnccaaaggaaaccggaaccgnaacaanccaaaagcc

SEQ ID NO: 3070 - DNA, 127 bp, Fusarium venenatum
  misc_feature (1)...(127): n = A,T,C or G
ntgactnataaggggcttgnttccttaaagactgcngtctcnctcatctggnagtcgtcatggccttcntcttgatctttgagggncaggcttcctggacaaaaccggcttnggccctaattcggac

SEQ ID NO: 3071 - DNA, 597 bp, Fusarium venenatum
  misc_feature (1)...(597): n = A,T,C or G
cgtggcacgatatcacaagcaatggatgattgatgcagggtttgaagacgttcaagaacgagtctaccgaatacccattggtccttgggcaaaggacccggcgtngaaagaactgggtaaattcgaactcacgcacatgcagatgtctgttgaatcacatacacctgcactattcacgcgagtatggaactattcccaggatcaggtcatggtgttgatggagggtgtaaagagagaattccgaagccgagacttgagattgatcacgacctatcgattcctcacaggacnaaaaccagttngagcgtagcatctggatgtttctttactcaagttgcacttggtagctgcaaccacttgtttcttttcgtttttctcaagatagccagttttattcttttcttcttgtcactctagccaccgntgaaagggttattcgctcgtggctcgtggctcgnggcataaatacatcaatatgggcatgttttaatggcacatcggttcaatttggacctggggncacaacgagaaaccacacggatgacgattctnttacgataatggccccgaaaattgatttaaaaaacattnttttca

SEQ ID NO: 3072 - DNA, 232 bp, Fusarium venenatum
  misc_feature (1)...(232): n = A,T,C or G
ctttggtttngcttagtgtgcaaactcatganagaggcgaataaaggtaaagaaaatcaaggacngcanggtgagctgcggaactgatgaaatgccttgttcgacacagtacgtatattgtaacttgatactcgcgagctccttgtcgcatttggccgccttgacnagtcgcaaaagcaggacctggtaaagacagaaagacaganagangtgggangtggatatcgttggt

SEQ ID NO: 3073 - DNA, 203 bp, Fusarium venenatum
  misc_feature (1)...(203): n = A,T,C or G
ncaaggacctcttgngggattnggatnatggctttggtgttcattaaagcanaaaanggactgaatgnatgaacattgggacganggnagaatggatgntctttgtntttaagantgctctatcttntcgngaattgaananaaaagaaattaagttntttgngcgttnaccttnatttaaagggccaatngccttttttttg

SEQ ID NO: 3074 - DNA, 316 bp, Fusarium venenatum
  misc_feature (1)...(316): n = A,T,C or G
aaagctgttttgaccatgcggatttaggagtagaagcctgaatgatgctaacttgctaaggaagatgactttaggaggctgaaaactagaacttctaccgcagtcttagtccagccctgtaacgttttgcaacagccacaattgctcgcccgtggcttttgcaaggggttatactgcagctcattctgtaggaaggaaggtcatgttcgctatgatcctggctttgctagangcgaagtcntggtttcaaccaccatcatagttaagnctgnactttggtnatcaaggaatagtnttcaacttttgggggaaaaaa

SEQ ID NO: 3075 - DNA, 118 bp, Fusarium venenatum
  misc_feature (1)...(118): n = A,T,C or G
nttgctnaagggnttaagggtttgnctttnggtggaaggnntaaaatggctttgttacggcgaanggtggacagngggatattaataaagaccntgtcttacatggnanccatctgga

SEQ ID NO: 3076 - DNA, 216 bp, Fusarium venenatum
caaggacaccagcagcttcaaccgtactcttggtaccgtcaaggacaagattcgcggacgtgctgcttaccgcgagcgtgactctgagaagctcaaggagtggctcagcgcccatggatatgcttgactgtgtaaactataaatattatgaaatgagcggtgactatatcacaagaatttctgtttaaataaaagttaaattcctaaggaaaaaaa

SEQ ID NO: 3077 - DNA, 596 bp, Fusarium venenatum
  misc_feature (1)...(596): n = A,T,C or G
cagcttgatgttgaagaaagaacacttatctgctatatccccttttcttactggtttggcctcccaaaatggcngtcccgtcctatctttactgccacgcacccccgtgcatgctctacggcctttgagcgagtcttcatggcccgccgcgatatcctagagagtgtccacgagccttttgggagatgccttttactacggtcctgaaattctcagcgatcgctttagaaatgacacaaccactcgcgaacagagtggtttctctcacaagacctataaggacgtccttagcgaagtcatggatgcgggcaaagatggcaagcgaatcttcatcaaggacatggcttactacctcatggcccagacagcaagcctaccaaggttgcgccgtctctgggcgaagaaaaaccnggtaacccncgtgttnccattagaagtcttgaancaatccnattcatttccttatccgccacctcgacaactatccctcgtnctatcgatgccantgccnctctggatgaantccnggttctntaattctgccnatgaggtggntacaaaaaccnncctcttganttctgatcaaaaaaaatgtc

SEQ ID NO: 3078 - DNA, 273 bp, Fusarium venenatum
  misc_feature (1)...(273): n = A,T,C or G
tactcactggaagagagagaaagacaccgggaagggagttgatgtaagtataggcaaagcagtgcaatgctatactgatcatcccttcccaacgacctcgcgagagacacaacccacccgatcttttcctcgtttggttcgtgttgccgcggaggatgaatatttcaangattaaagcacggttttacaggttcctttatatccatattttcatacatgtaattntctcttttttttttttttttttgctctttctttttcaatcttggcatt

SEQ ID NO: 3079 - DNA, 446 bp, Fusarium venenatum
  misc_feature (1)...(446): n = A,T,C or G
ntggtctatcggtggatcagaaaacaccaagccgcacgcnggtttggccaaagccgtccggccaagccgtcnaacangaagcagatatagtgagcaattgctaagacgtttcgacagagataaggatattcatcaagtccgtggactataagcgagtagagcttggctacggccnaactnaagagccggggggcgccacgngactttcacaagtncgatggcgctagcaatggcttcanaagtgnatggtnttttgncgacaaccgaccaatcaagaatggaatcgtggtcgggnttnttaagctgacaaagtcantctggtggcaagaaccttggtgngcgtacttttannccaagtccanggcaanggttaaaccaagtncgtggtggtggnaanaaaaccccccgggccccnaaggaacccnaangggcttncanaaaaaaaa

SEQ ID NO: 3080 - DNA, 132 bp, Fusarium venenatum
  misc_feature (1)...(132): n = A,T,C or G
ngctanatggaaatgtngctgagctgctngatccctgaactattaaaaatcntntattgagngaaaagggggggtttntttaaggcaangggctaaaaancaggtaanaaagctggagaagaaaacnaaaat

SEQ ID NO: 3081 - DNA, 159 bp, Fusarium venenatum
  misc_feature (1)...(159): n = A,T,C or G
cgtctagcaaggtcatgtagaccgtctcgtcctctaaacttactcacttattcgtcaatcatcatgctcaaggcttacaagaatctntcgccaaaacccgnctcggcgtctggtgttgcngtcattggcatggggtgctggagggactcatggttgact

SEQ ID NO: 3082 - DNA, 114 bp, Fusarium venenatum
  misc_feature (1)...(114): n = A,T,C or G
natgccccaagcagattncaccggcggcggccattttttgcntcctngcatgcntnaggttcaaggnttggtctccnttggntcatgggggttnganttcgcgnccgctttttt

SEQ ID NO: 3083 - DNA, 183 bp, Fusarium venenatum
  misc_feature (1)...(183): n = A,T,C or G
naagagagggcggcggaagaatctntnggagcatcaacgatatcaagtggttgacgccgttgggtcctgaaatagangccgctcttagagtttagctngtctatgtaatgtcttnggatnggataagtgtattgcgtntttttgatttgggtaatagaaatcttntcttgcctttaaaaaaaa

SEQ ID NO: 3084 - DNA, 238 bp, Fusarium venenatum
  misc_feature (1)...(238): n = A,T,C or G
ngacatccncanaggccctccgntattttctgcacaaggtngctttttgattaccantttaaacccnaggaaagcttntttgacngaaanggactgggtacccgaccggtttctttgnatcctttaaccncttcaagtcggtccctttgggnatgaattggncagcccntttccttttggtcnaaaagaaactttcgnctttccanacnaaaaacgccttnttagaangcanaccccg

SEQ ID NO: 3085 - DNA, 369 bp, Fusarium venenatum
  misc_feature (1)...(369): n = A,T,C or G
cgcggcgggctacactgcccccggtaagcagactgggtggctatgatctgcctacccaggttcaccctacccangattatcctnaacctactgggcgattctcacaagcctagtggtgactctttccaagcctagtggtgacttccncnaagcccangcccaaccctttttgaggagcttnncacctacctncccacaaacgtttacccttcagatcccctcaaagcaacactgttggcgacagtttgtcaaggcccacaagggcaccaccacaaagccgggtggacctttnttgagcccgcaggcacttcccccttgngggtcaattnaaccggggggcaatcaaggcttgggaaccnttgccttggt

SEQ ID NO: 3086 - DNA, 344 bp, Fusarium venenatum
  misc_feature (1)...(344): n = A,T,C or G
cgagtgagcccgacgccaaggtccccgagtttatacctcaacaacaagcgggctgaactttcaacagcttagtccactaatatgcaccgtattaaactgctttcagagtttctttttcttttctttttcacgtctatctccatttcattcgctgagagttcgcttaagcttttggggttcatgtatttgggagcgatgtgtgtgtaaaagaactaacgaatggtgatgatcgtctttattaatcagatgggaagtttnggactaccttggcaggcgctgggggtaaaagggattntatcacaaggcgcattcctngaccatgccncnttaagataaaccatact

SEQ ID NO: 3087 - DNA, 622 bp, Fusarium venenatum
  misc_feature (1)...(622): n = A,T,C or G
ccaaaacattcatctggacagtctacaaaactcggcttgattgcattcgggcactatgtcataacacctacaggtttccttgtcactctctatggcctgaacgttgtagcctggggcggcatgctcttcttattgctctgcaacgcttcaccagcaatgtgtgttccaacttgcaatgatatcaactcgcccagacgaaaatggatagaggggggattctcagatccttaatgctctctttggtgtcacaggctttggactcgccccttggcgctttcgcgattaatatttcctccttcaatatcgcgtccaaaaaaaaggaagttgcccttagacccttggcaggcatccatcgaggatggttccgtcttccaggatctgatcagcttgacctcagatagggccccataatatcttctcgtcgnccgatctcaactcgtcactcgcctgcccgtttccccaaaaaaaatcccgagcttccttgacangagtccgagcttcancaactaccattacaagaattggatgctgcatatggtgatggnatgggaacaccttctgcaatgcgtctgtctngggttatgtgggggtgaaccgtaccacgtcccattgggccnaggcc

SEQ ID NO: 3088 - DNA, 433 bp, Fusarium venenatum
  misc_feature (1)...(433): n = A,T,C or G
acaatgcttagaacgcgaaacggatacaaaaacatctcctactctggattttgcattacgaagggggcctcgagaacgaaaggctttaatgactgactctaccttgatcacatactatgtgtgtgtcctcgcctttactagtactgagggtccccctgtttgcttttggttcgcctcttgagattgatacctcgaaccttgtcctctttttttgagctgctttccatgctatttttttgtttgctggaggagatgggaatttttggagatccttcctgcatggtttattgggagcggcgaaacgccgatgagaacgaagttacgaatcttgatgattattaacaacttgggatcgttgaacggtcctccctggcgctttgcaccgtcagggtcgaggtaatgagaaattcggccacctcanaaaaaaaaaaaa

SEQ ID NO: 3089 - DNA, 617 bp, Fusarium venenatum
  misc_feature (1)...(617): n = A,T,C or G
gtaacgttctcgtcgtttagttatcgcatcgaagcagccacgatccttggtcgagttttgttgctgaatcagttgaanaacagcggtcatgaccattcgcaatccatcgagaatgctctacttagctggtcgaatcatttacctcccggnaaactggaaattgttgactcgtatgggaatatcgacgagatgatgtttcaggcacacatgatcattgcactcgccagcatgctgttacatctcccccgaagcaatctgcactntnttttagcagacgtnaaagatcnatttctaccagtcgcacagaaccaccctctttcatcatccacgacattaatccagggcataaaagcaacggatgcatcaagacgtatctcagattgnatatcgntatgccccaacgtcccnaaacacacacccttcgtcatcccagctttggcactctgcggnttcatccagctcgccacaacccaaggccatcccgacgaatgttttgaacaccactacaaccgcgtcactttagtactaggntggtnaaaaagtgcaaaacnggatatggcgccatgggggaactccgantatgaccgtnttcggtgntgggcctgngaacttaatcc

SEQ ID NO: 3090 - DNA, 246 bp, Fusarium venenatum
  misc_feature (1)...(246): n = A,T,C or G
aactctacgaagccgacatctctgacatgggattngagggtcgggattcatggtactactccgtctacgatgcttgctgctttgagaatgancaataagcatatcacctcttactggttagtaggtatatatggtaactaggtacatactggngggcataaaaagcgacaagctccatgttgnaaaggtgttgcgtcnagagaaggtctcaaaagacattaatttataatttcataactttatttc

SEQ ID NO: 3091 - DNA, 112 bp, Fusarium venenatum
  misc_feature (1)...(112): n = A,T,C or G
ncacacgacnccagcacacnancacaccacgncacgagancantaacaccacgacacgcagcccnanaccaacaccacaccagcaccacgacccacgaccangngcgacanc

SEQ ID NO: 3092 - DNA, 705 bp, Fusarium venenatum
  misc_feature (1)...(705): n = A,T,C or G
cttggcctacctggactaccactgccgtatccattcccagttgttttgttcccctttttgtttgacctttgtcctgtcctgtcttgccataactatttatataaatgccgagccaggccctccacttgctcgtcctcttggataacttcaatccaaaaaaaatacctgagcttgaacttacatgttacggtgccactgccacgtctactaccagccgttgctcaagtgatcgcagatccaagaagattccttgctgaactttacttctgatctgctcgtttaaacctttcggctacctttttatttgttattggtgctcttcttcttctctgttctggctataaattacttgccttgtggtttcacaacgacttaactggcatctatcatatctttctcatcccagtcttgccaaagaacaaaagcacaacatgactgctcgagtcgcacctggctcctcatcctacacagaggcatctaccaccatgtccccagctgccgatcacgatgtcctccgaggccgtaagagagagcgaagcttgacccgcggcagcgtttgcacattccgagccgcaccaacaaacgaagtcgagcaaccttcganggccgtttgtggcgccggtttctgtttanttcattgctttaantacacatttngccccttcttgcctaaaaaantcctttttcaacttcgacgccgttttt

SEQ ID NO: 3093 - DNA, 165 bp, Fusarium venenatum
  misc_feature (1)...(165): n = A,T,C or G
ncagtaccatgggttngggggataatgtntttgtntcaaatnccanggatcaaaggcgtcaacganccatgaggagtnccttcaggttggagggagcgtaccggggctcgaatattagacggagaatctcaatcctgactccatttcgcctttcnaaaaaaaaaa

SEQ ID NO: 3094 - DNA, 453 bp, Fusarium venenatum
  misc_feature (1)...(453): n = A,T,C or G
catgacgacaccgntataatacgggagtcgactattttattcaagcatacataagaacaggttctccgccagagttgtgaacagtagtatcagctttgctcaaacctggagttgaatcaaaatgactacgacctccgaaatgcaaacagtgcgacgcctaggtctattagaggctggctcggctgcttttcacctcatgggtttatatcgctcagtggtagtatctgcgacgtacagtattccctnacgcgagcagtctaaagaagccatgctcgcagctctggggggtttgatcaatgataaccctatgctgngtgttggcattaaagatgagggggagcactatcgcctacttttactnacatttccgagatgaaacttaaggnctttgtcnagttccgnanttctgcttctganttgactttagtaaaagaatttgaaacattctgcctg

SEQ ID NO: 3095 - DNA, 688 bp, Fusarium venenatum
  misc_feature (1)...(688): n = A,T,C or G
cggtggtctcgttgtcatgcgacagcctgccgagggtatcattcacggttccttctctgccgatcaggctgccgacacccctcagcttcttgcttcttgctcccctgacaaggttgccgatgctgtcaacaaggggtatncaggtcgagatcgtcaagctgaacggnaacaaaaatcgacctcaagggcgtccncagcttggaaggtcagcccttgacgacgttgcttaacactcctcctggctggctganggacgaccctnccccaccttacnggcaaggtccaatcaaccnaagcctgcccaaggccggttggcnttaccaaacgccaagaacccggnncaagccccttaacggtttggnaacaaggggaactttcctttcttttcaaagccttcctggccttaaaataccccaaatttggatagggacacgttggnctggttttttttctttccatttttggtcacatcttggtcttttggccaagcttnttaatgctcaacttggnccgggancttaatttaccaaggggattcactangcaaaacccgccacnaaaattcggttttatggtaaattttaaattcccttgggcaagacttaangggagtcaccgaattggtatttttttccgcccagaactattggtctattaagttggcccaatagcnggtcctttttggtcc

SEQ ID NO: 3096 - DNA, 948 bp, Fusarium venenatum
  misc_feature (1)...(948): n = A,T,C or G
ncccccaccctttattcntggttcaggcnttcattttgaaacccctnantctcgctgcgcctntaccttacaaatgttcagcancaacctgtgatggatttcggccatgagggttctgnatttaccacagagctacctgctgaggccaggatgcttttggacggtgttggcatgaatgatttcagccctgcgctgtacggcgagcaccaaaactggggtgcccaacagtnattccactacggngacgataccaagtnctttaaagaagaggaggctgagcttggtgctggtggcaaaaagtaccccgatgtccttgatacaatgaactggggcaacggagactacgcgacgccaaccaagaactgcaccgaggactgggacacctatatcaacgacccatgggtcactgaccaacagcaataagacgctggtcagactgttgcacagctttttcctgatgatttgatgatactttttttctgcgacctattagcagtcgttcaattatcacaacgacactgcttcccgctcaattcgttaaagagcaaggtggtttaatgtccgaggcgtttgggcgatttgacattcttggacatatccaagaaaaaacaggacttggaggcactttatctgcatttattagaatcacgagaaggcttccgccaggagtttggggcatacaactgtatttattgagtgcacatctttgatatgtgcaggagcggcaggacgataatatccacgacatcgcagagagaaccgaaacaccctatatttcttctcggtggtgatgaagttgnttattttgngtttncaatcaagntgattgggttcttctctttggatgggtgagaatatgacttgcaantgagaaattctangcgggcacaattcttgcncncaaagaacgccaggaatcanactaaaagtcttccggctattttaaaa

SEQ ID NO: 3097 - DNA, 158 bp, Fusarium venenatum
  misc_feature (1)...(158): n = A,T,C or G
gcaagctacgcaggaagcnngggaccgagcncgganccacnagaaacnggccagccagtgngcaggaacccngcaganaaaccgncgggggnagacgagaggagagngcnaacccccananacccccggacacncaaaccgacaacacgggaaacgcc

SEQ ID NO: 3098 - DNA, 214 bp, Fusarium venenatum
  misc_feature (1)...(214): n = A,T,C or G
nccacaagtccttcgtcagcccgngatggtctcncactgaaactactccatcgttggaccatcgtctatgtatntttccgtcttgatgaatagttcgagtccaatagatgagtncgganagctgacttcnctttcttccgnganactggtctttaagagcagganaaaaaaaggnggttcattggggatttttggaatgctggttnaccggttg

SEQ ID NO: 3099 - DNA, 499 bp, Fusarium venenatum
  misc_feature (1)...(499): n = A,T,C or G
ngtcatcagcccaggcagagccttnttctatctttcaaacgcgccgtcgactacgtacagcattaccacagctggaatatgtaccagcaggtagcgatgatgaggctgatacaagcaacgaagtctctactccggacacacaagtgttgaccagacgcgaaagacgacaaaaggctactgctgcacatcaactagcgaacatgagcgccggtgaccgcactgctctcatgcatctatcttcagctgaacagcgcgcgcttatcactacaaatcataaatttacagaaaaggtcaagaaggaggaagctcgaagtcagcgaagacttgatagaaaaggaaacaagaacctgtatgcttattggaacactgaaacaccagtgtatcagtgtggttagagaaggtggattgttagtctattgncagtgattataggggaaatttgaaaaactagcgatagagcatagttacgcagctttaatctatgtctttggcttctgaa

SEQ ID NO: 3100 - DNA, 441 bp, Fusarium venenatum
  misc_feature (1)...(441): n = A,T,C or G
gttcggtgagcctgactcagtattggccaacttggcaacttgcatctggagatctcgagaagatgcaaagaagggcggcactggtccagctcatcgaaaagctgcaggggcaacgcggtccatgtatgcattctggcagattgatcagcaccgactcatcattcgagacaatgttgaagactgggaaattatcccatggaaggattcagcataatgttaagagaaaactctccagtcgtttgctcatctcttatgaggcgtttgggattatcttcaaaaagtttanaaaagggttatgctttaggatgcgggcactgggtatggaaatatgggacggagcgagtaaaaggcaaacggcgttattagaaaggaacattgattggatattggtagaaatctanatagtagacgacttaagaaatataaagaaggcgcttccat

SEQ ID NO: 3101 - DNA, 626 bp, Fusarium venenatum
  misc_feature (1)...(626): n = A,T,C or G
cgggatgccaaaaacgatcattgtctccacgacaggctcctgttttgactcgtgcctgtgctatgcttttttctttccgtggcgccggctttgctgtctcccgagctgctaattgcacgccagacatgcactggctaccgtccgccccgccgccatgtctgtctagtcagtgcaatctattgtccaattgcctgtcttgtcactgagttactccggacgcaccggccgagacgattgctgagtctgcacagacacagaggggctctgctctgtgctagctgtatgtattgactgcactcgacctcaacccactgacatcacagggaccagttgttctcaactcgtggtgacagggcaagagccgcggaattaattccttgctgctatttcctcaaaagantgtgttgattgccaccaggagtcggncttggcggcgcattgaatggtcccccaaatgccggggaaaatgggtatgtccgcttcctcantcagggtaaactcatgaanatccaagtttacttttnaagtgctggtagaagtactgcacaagggttgtaatgtgtaccccaacaaaatcgggtcatgggaacaattggtttttgaaaaancaaccggttgcacccggt

SEQ ID NO: 3102 - DNA, 173 bp, Fusarium venenatum
gccgttgcttggttgcaaaagggcaacaagatgattgccaagctgtaaagcagccacgccatttacatataagataccttgttatttagtcattattttgtgatctatacgtagattaggagccggtcaacactgaaactttgcatataaaactcattgttataacatatccg

SEQ ID NO: 3103 - DNA, 495 bp, Fusarium venenatum
  misc_feature (1)...(495): n = A,T,C or G
tcactctgcggtcagtatccattacaatttcacttcctgctggggacctttccaccgacaattctcacagtctagccaaccacagagccaattttctttccccctgcactccctgaccctgcaggagtatgtatatacactgttcgagggccgggtaaagctacctagatcgacaaagcctgaggcacgctatttctatactagatatactagcaagcatcatcacaatcagctccctcagagataagctaatgagatgcttgcaaatacgaatctggtcatatttatgtctgactgcgcgactgtcagatgtttaaaagaaaatctttccctttaattgagcgagccaaatcatcatatcgattgcatgtggtgtatctgcgagtcgcgttgacggacaagcgagagcctgacatgatgcctcgcctcattgnctattttggtctgaggtggangggaaggagacaatctgtagcncacaatttngggtagtca

SEQ ID NO: 3104 - DNA, 162 bp, Fusarium venenatum
  misc_feature (1)...(162): n = A,T,C or G
naccatntttgggttacttttnaaaagcaccganccgaatncatgagggtttcacttacatgcntnccaatgtttactactgnattatacgtaccctcccccccnccccnttttccgggatacacccagtttttgcccgaagcataaagatttntgaatgaa

SEQ ID NO: 3105 - DNA, 442 bp, Fusarium venenatum
  misc_feature (1)...(442): n = A,T,C or G
tcaatctacanctaatgtctctgtcttaaagtgttcatacccgccacagncttgcacaacttcttcaaatcacatgccttctctcaagactntgntcgcttcggctactatggcttacctggccacccggcaagancatcaagaacactggcaccagtgaccacaaggttcgaccctgangaantccgangcttganaagggntgaatgtcctcgaattncactttgancccaaaaaccacaagtggttggtgcttggngactaccgctantcttgctntcccccttgatcttggnnagtggtttncttctntggtttccttnccactngattntgggatctggccgacaaaggnttttccnaagtnacagagcaacgnaccccgacccctanntcctttttttctcttntcaagggccagggaattgggctttctnggcat

SEQ ID NO: 3106 - DNA, 617 bp, Fusarium venenatum
  misc_feature (1)...(617): n = A,T,C or G
gggactctgtaaaggcgaaggcagccctctatgtaaaaactgacgttgaaggacgaaggcacagagaacaaacaggattagatacccaagtagtctttgcagtaaatgatgaatgccataggttagatatacataatccctatataataaaaagtattgaatatatctggtctataaatgaaagtgtaagcatttcacctcaagagtaatgtggcaacgcaggaactgaaatcactagaccgtttctgacaccagtagtgaaagtatgttgtttaattcgatgatccacgaaaaaccttaccacaatttgaataattttattacaggagttgcaccggctgtttccagttaatgtggagaaactggggtttccatgaaattaacggaatccctggctttattttttttatttacgataaagcattctttcctggaaatttggaaagaaaaaggggacaaagacaagtcatcatggccttgatattgtgggctatagacgtgccacatattnctaaacaaagagatgcaaaaatgtgaatttaagctaatctcaaaaaatangatataaatttttaaggattgntagtctgnaattcgacttntntgaataagtaatt

SEQ ID NO: 3107 - DNA, 103 bp, Fusarium venenatum
  misc_feature (1)...(103): n = A,T,C or G
ncggccatgcttcttgnaaaatcgatncaatctcaagaaccaagcccccttaanattattcttnctggggannggtcctattttttcnaaaaaaatggnttcc

SEQ ID NO: 3108 - DNA, 121 bp, Fusarium venenatum
  misc_feature (1)...(121): n = A,T,C or G
ncgaaccacacaacacttgaataantgacagccgncaaaggatacgtataaccgacaatgggcgtnttagacagccttgatncggncatcancaatatgcttggtcantggaacgtatact

SEQ ID NO: 3109 - DNA, 436 bp, Fusarium venenatum
  misc_feature (1)...(436): n = A,T,C or G
caaaccaactaaacgaacaaacacacttcaattgttttacacaaacaaatcaataacttcacaaatgacancaaattcattcggatnngctctttccccgcttttgactttcacaaccccccagcttccaagacttcacaagcggagacttgggcccgcntcatttacccactggagccgcttgtcacaacagccagcagctgnattccgggcctcacattattattggtcttcangacaagcaattccncnatgggccaggggttnaccacaatncgagctggtgggaaacattttaaccgaaaatggaaagganccggtgggggaattaaaaccnggccgaagtggggtggaaaaaaacgaatgncatttttgggngggaccggncattttttggaaacaagggaccacngaagaaaccgggccattggggact

SEQ ID NO: 3110 - DNA, 121 bp, Fusarium venenatum
  misc_feature (1)...(121): n = A,T,C or G
nccgtttacnanttaagaatacaanctggcctctgnggatggtatgctgaaacaagangaccttcattgcctgctgcctgangatgctgngntacagcccangatgatttacgnttcttca

SEQ ID NO: 3111 - DNA, 966 bp, Fusarium venenatum
  misc_feature (1)...(966): n = A,T,C or G
cccgcccaagaaggacaagtacccatacggttatcctggagatgaattcggtcctaacagtgtgccacactaccaatgcaaggaatgcaagacaatattcccaactggcgccgaaaatggaacaccatgcacaaagtgcggctgcgagaaaacagacgaatcgcctcgtgttaaacctcgcaaggtcgaacctgaaccagaccctgaggtattgaagagtttacaggcacgactggagaatttaaaagtgacatagccggcataagcgaacaggcgccctctttgccgggcgtcaggggttgaagagtgggggtcattttcctatcatttcatacacatacacacaacaacacatacgacgacattccgaagcgagcgagggacgattactgggagatttatcacctattttgcatgcgccaaaagatcgcccactatttcttcccgccagcagtctatttacctatacctcgatcatatgttgcacggttcatccattcttggccacggcacacaacaacatccgacacgagccctcttggtttttttacgagatagaggtggcagtttcatatcagccgacgcatacgacatcacgatctggatcttttaagcgtactccatgattttgcattctcagccatcagtcatttacatgcatttacgaacaaagagttatgattcaggggaagtagggtgatgtacaagagttggggganatgcgggtttgatttctagagaagtgttgaaggaaaaaaattgtgtctccttaaaccaaatacgcattccctctgtgggaacgtggctctgccaaggatggataccgcaacggataggctacacagtcaatgttttctggcggcagcgaagaatcgttgttctttccattctcttggttaactcaagttcttggggcctgtttgcgattttttcactcnctcntatatatcaatgaaaaaaaattca

SEQ ID NO: 3112 - DNA, 852 bp, Fusarium venenatum
  misc_feature (1)...(852): n = A,T,C or G
natttacnttgaaaactcctcaacgtcgctganatcagtcttgcacaccattcggtcgatatgccgggaccttgagtcgtggtttcagagcctcccgcccgaactgaagcaccgagcgacaacgattccgagttcgtgatgcagcaagaccaagatcccctgacaagcaatactgtgaggatatttagactgcaggccatggctttacagctcgcctacgataacatacaaattctacttcatcggccattattgcaacttccccttgggctatgttccccatcgcatgttgttcatggtatgcgcagcacggatgcatcgaatgtcaagggcaagacagcgaacaagccaaacccgtgtgccgtagacagtgcaacattggcactgagcaaaactcagtgctacaagtctgcagttcggacagcttgcctgaacgcttcaattgttaaggaggcgaggcacactcacgcagcatcctatatcggtatacagttgttcacagctggcatggttctcagcattgtggcgctttcagcaccgctctcgtcagaggctcagcaggcgaaaagggctattggccgcattgtctctacaacggcctcgatcggaaacaaaacactcctgtcgacccagagccagaaaatcctaagggaattggttcgcctcattctagagaaggaaatgaattccatcttcgcggaaccagtagcccagtctgatactctaaaccatgaaaagccgactctccagaatccgaatcagtcggtgccaagcaaaatgtcccgttccaactcaaggcgaaggctataacttcngatctgcttcccaaacagggatggctacttacaacca

SEQ ID NO: 3113 - DNA, 199 bp, Fusarium venenatum
  misc_feature (1)...(199): n = A,T,C or G
ngcgatnaccangaaaagannaccgaccctnggncgcaaccatggacnaaaagcnaactggcaaccaagggccaccccaaagatnttcaactaagggaaagnaatnacttgnaatgagattnaatggatgggatgctttttaaaagccgattaaagagcttagtatgaattaaatttgacnttaattnttggttccccc

SEQ ID NO: 3114 - DNA, 158 bp, Fusarium venenatum
  misc_feature (1)...(158): n = A,T,C or G
nnccccaaatctgngaanggcccttgggngaaaaaangcnggcgggcttanaagnaaccatgaaggaatgggacgnaaacccaaggggaaaaaggnccccnccgtcaaaaaccccaaatcaantcanaaaacgngaaacccccatntgggggggggaa

SEQ ID NO: 3115 - DNA, 318 bp, Fusarium venenatum
  misc_feature (1)...(318): n = A,T,C or G
nctngggagnaacaaaangtncaggganctgaactnntccgccgtcagcgacctatcgggactgattnctggcgcaagccataccgttgagcagcccgaatcgcaggagtggntttctaagacagtcattgaatttttgaagacagtttaaataagatgatacgtttccaggtagtacaaanggcggacagcagatntcttggacaatcgggagcagcttgattatnaatacatgtgtatgtaggagccatagtctaaggagcataaagngacctactaatttcgtctcttatgctcccagcgatcaatttttctgat

SEQ ID NO: 3116 - DNA, 105 bp, Fusarium venenatum
  misc_feature (1)...(105): n = A,T,C or G
nggaaaagggccaaacnacnaagggcaaangnaaacccctgggggtaaancnaaatcccnaaaaangctaaagttccccnaaaanaaccaaaanncgcgcaaccc

SEQ ID NO: 3117 - DNA, 149 bp, Fusarium venenatum
  misc_feature (1)...(149): n = A,T,C or G
ntggccgttnaggcnttaattttnaggagggatttattaaaggggtatataccatnattggcttatggatgtaacnaactatttacgttctattcatatttaataatgactnttcccacgggttttttggttttggtnaaaanaaaaat

SEQ ID NO: 3118 - DNA, 308 bp, Fusarium venenatum
  misc_feature (1)...(308): n = A,T,C or G
agaaacaatacttgatccaaattctttgatagtacgatatatgaagggcattatcgttcttaataatttattattaatatccaactgcttctgctggctaaataatcaccgaatnggcttccgtcagtngatcgattntccaataaaaaaaagttcccctccttcttcaattccatcccccgntgacgctgccgcttccgttncgcctccgaacccgntctcttngtgcntcccgttcgcnaccgtcgcattcgcaattatnacaagccgaggtcgaacagccaagtttttnttcaacttttaatcac

SEQ ID NO: 3119 - DNA, 162 bp, Fusarium venenatum
  misc_feature (1)...(162): n = A,T,C or G
ngggcaaccgntgtgtagctgnggcaataaatcgaaatggnngggtatcatgtgngacancganccaantactnaccggaatncaanaacggganantaggggccttaggggaagngaggngaattgaagatnagaggctggantngggagtnaacggttaa

SEQ ID NO: 3120 - DNA, 326 bp, Fusarium venenatum
  misc_feature (1)...(326): n = A,T,C or G
ngacggttatgacagcatccgacatanccttctatctgtttaagttgcgccaatggctaggcctcggcggaggaatggaggatgagatgganaanaggatgaaggatgttgcatcggactttggcattgaacttcngcacgatgtatttgatggctganctttctcgatgggggtncggtgatgaatcccactatctcgtgtccactattgcnacaaaagaaactncccatgtaagactgtaatctanatagatagatgatgaggttctagttttgcgtttgccanccacgggcacctagaggaactanataaaatctctttttgg

SEQ ID NO: 3121 - DNA, 635 bp, Fusarium venenatum
  misc_feature (1)...(635): n = A,T,C or G
cagacaattgtaacgccgtcaaatcgtgcgtaccgactgaccatgtgatgactcttctgccctgtcttgtctcatggaccgtcattagttacggttcatctgcagctgcagggggcttcttttatccccagccatctgcatcaggtggcctagcaccatcacttgttgagcacgaatctggaagccgggcttgtatgagtctagaaactaggtgcttaattggagcgcacacaaacgcgggttgtgtttgcagtaattggctgttgtttgcgcttgcgcctgttccctcgtcatcgctcccgtcaccttgcttgcatcttgtgcgcctctctctccccatctctcccttttcctctcacaaacacttagccccaaggaccatgcgtgatagcttcacccaccaccttgacttgccatctagacgctntgntcaaccatgggcgagttcaatctgctncagtggaccattatcctcatctgacgccggtgcctgtcctcantgnccttggccaaaacatttccaatttacggntgnatacccaacggngccgntcgaancgcaanctttgntgaacaagccacttttntgtncaggaaaacgagagctttgaacgcgatgtaccaaaagtgcancg

SEQ ID NO: 3122 - DNA, 437 bp, Fusarium venenatum
  misc_feature (1)...(437): n = A,T,C or G
ngtgcgtncaaaacagngcaatnganattgacattgaacaccccccccccgacttgggtngggcttggcctncccctccatccccntccaaccaggctggatggactccacttacctcacctcacctcatctcatntcactggagctttnttatccnaatncattccacgctgttaacttngaaccagcccacaactccccggttggctacgggatcaagtgtccatgttgctgcgtntgtgtccnattttcggagganaaagttttaattttnaaaaagcatacagtacagcnctccagtcaaggnctacccagttnaggcctaccaggcgggccaagctatnaaagtcgtgtgctcaggnntgtctgtatatggcaataanctacccgtttggaactgcaaaacaccggnggaacatccaccggaagancaagaa

SEQ ID NO: 3123 - DNA, 214 bp, Fusarium venenatum
  misc_feature (1)...(214): n = A,T,C or G
naaggcggggccanaacccaattcatttcccncgaaagcacttggntgnatcattgaanattggttnccgggaaaccaaggncggcanaaattaaggttttttttantngggttgnaaccagggaaantttcggggaaggcannaacccccaccaagggtccgangccatngggnccccttacattttttagnccgngtttttttggccnggaa

SEQ ID NO: 3124 - DNA, 111 bp, Fusarium venenatum
  misc_feature (1)...(111): n = A,T,C or G
nggcaaaaaccccnagcccganganaggggaaaaaggggnanggcaagaaggcagcccnaagaaccnagggccggcccnggggggacangaaaaaaccccgancccccccg

SEQ ID NO: 3125 - DNA, 261 bp, Fusarium venenatum
  misc_feature (1)...(261): n = A,T,C or G
ngggggtccccttaacngggccaagccttcccccttaaangggtaattaacccccaaccgaangnattcaaggaaggaaaccggtggggtggccngccggccggacnggactcaagaancgggtccttctaagcctggggcctcgncnatggccnggtggcnggattnggaaatggcctttttntaagccntcaaaatcnggacccaaatanctcgaaaancaacccgcccngccgaaaaaaccgggaacctaacaaaaat

SEQ ID NO: 3126 - DNA, 238 bp, Fusarium venenatum
  misc_feature (1)...(238): n = A,T,C or G
nttagtcaaagcaaatnaanatgaacccttgatatttaaccgtgcttcgnttaggtggaagcttgnaagcctacngangcctgnccaanggccctattgangaaccatgttgctncggaaatnggagaagccttgnttacccacncttcaaagcaaaagganaatctttggccagggattttggttgggtgcccctttggttggatcccgagaagatttggangaccgaaagggaatt

SEQ ID NO: 3127 - DNA, 120 bp, Fusarium venenatum
  misc_feature (1)...(120): n = A,T,C or G
gttctcaactctacaggccatnctgcagnccacaattactctaaaacactatnntcacccccaccggatttcacttgtaacgctgnngtgccatcgacngaccactctggncgccnactg

SEQ ID NO: 3128 - DNA, 174 bp, Fusarium venenatum
  misc_feature (1)...(174): n = A,T,C or G
ccggggttnaaagaaacaatgcgctctctanatgagggtagtgattgggttaaagtcactgctgtggtggaggagggcggacgtcgtcttgggtggtctacgcaagacctaggagcgtgtggttatgatattatgagcgacgtaaaaacnaaataatgcatcatccatggatcc

SEQ ID NO: 3129 - DNA, 484 bp, Fusarium venenatum
  misc_feature (1)...(484): n = A,T,C or G
caatgctcagagatatacacatcagcgtcgaattgagctatgaatcgtcttatacctccagtcttggcccggagccaggcattcttcagccactgtaacaagctgcccaccaccagccttgctattaactcatggaccatgacgcgcctttgctttgttgtcgctaactcgaacgttgctatacgaaaaccatttctcgaactacccaccgaaactgaatacctatataccacgtaaacattggctatgtttattgctcgtggctgctgcgcatttgcgacaagcgcagccttgcctttgcattgccagcgcccaacactgctacagctgcaagcactaagacaattgctttttctttttctctaccagaaagttgntggctgncactgctacgccactgnatacagagcaaacatcaatggtgcggctggttcccgctggctggctttctttgncctctcatcgcatgcatttgcaatcggtg

SEQ ID NO: 3130 - DNA, 148 bp, Fusarium venenatum
  misc_feature (1)...(148): n = A,T,C or G
nttggggattagcccgttgganttatangtgccncgtccgtntgangataaanaanccctttnttaactgnaaatctgaaataggcgttggccaaccattaaaaggngcnaccccggccgtttttgctgcctgacttgtntnaaaaaa

SEQ ID NO: 3131 - DNA, 113 bp, Fusarium venenatum
  misc_feature (1)...(113): n = A,T,C or G
ngttanaggaggnttttacggcgaggaacgctcattgctcggataatgttcttcgaaaangatcgggtggcgatgacaaggacttggtgacgagggcttacaggagacantgg

SEQ ID NO: 3132 - DNA, 135 bp, Fusarium venenatum
  misc_feature (1)...(135): n = A,T,C or G
nctgggctgtatcganatctcgcttgggcacaagancattctttggacgccgctnggctcttnccattttatagngantggattcnncgctataatggctnttacctgttatanctaactggggcncggganggt

SEQ ID NO: 3133 - DNA, 111 bp, Fusarium venenatum
  misc_feature (1)...(111): n = A,T,C or G
naacgganatttttgacncccccanggccnacgnatggaaatcccctttggccangcncctttggttgaaaaaaaaaatttnccaggnaacnttacccgggggggtatttt

SEQ ID NO: 3134 - DNA, 174 bp, Fusarium venenatum
  misc_feature (1)...(174): n = A,T,C or G
nttatcatnggtacttggaanttngggaccgatttgaaaaagcacangtacctggatataancatttggnaagnggttggggngattttnaatgggatgatgcttaaagcttcttnccaccncttcctttggaaaaattcttaaaaaaccataaatccatntgntccacccctt

SEQ ID NO: 3135 - DNA, 257 bp, Fusarium venenatum
  misc_feature (1)...(257): n = A,T,C or G
ngactttgtaggtttaaaggggttaatgntttatgcntgaattggaaccaatggccccaggncaacnaattttttgtcccaccttnatttccggttacaaggcgangnttattttaaaaattcccccnccgcaaaacacccatttanccgcgttttttaaggactgggaatttccttggataccacntttcttttggccgggattaaccgtttanaaagtttttaagttctcaacnttncccctgnaaaaaaggtaa

SEQ ID NO: 3136 - DNA, 281 bp, Fusarium venenatum
  misc_feature (1)...(281): n = A,T,C or G
cttcccgcaatcattcanggacatttccgatctcctgatccccgagctacgaaagtagaggactcttctggaatgactacgctgtgcctgaaggcacttacccgcgagaacttctacggcattccggggcagaagtacccattaaaagagcatgttgcttcgtcncacttgtggtctgcttctgaagataaataggtataacacgcttaaatatattatttaaagccagnagaaataatagtatatcttatttaagntaattattttacttaattaattct

SEQ ID NO: 3137 - DNA, 120 bp, Fusarium venenatum
  misc_feature (1)...(120): n = A,T,C or G
nttntatgtgcccgtccgntgangataaacanatcttttctcaactgnaaatctgaatagncgtttggcccaccatttanagngccaccncgggcgttttgctgccctgactgnctgaaa

SEQ ID NO: 3138 - DNA, 441 bp, Fusarium venenatum
  misc_feature (1)...(441): n = A,T,C or G
cgcctgccgcctctctaaacttatcctagttgttcgcaacttttttctctctctcccctgctacgttnggatgtcaaatctttagtgagactgacacggngggcgtcttatcagaacaagaccctcttttctacttttgtcgcaatcctgactccaccanacgccgcgccgtttgatctgctctgntttgcgctatcgaccctcgcctcccattgcatggaagttccattttcctatccttgcttaacctgatcctcgnaggttttggcttttcntgatctcgnanccccactcaagttttttagaggntgtaccgtntccacaacgtcccgtcgactcgtgagnggttngggntgctgcaactcgtcactcatgcacttgacttggtcgngaatctaaataaaacgtccatctcctccaattaattctntngcccttcca

SEQ ID NO: 3139 - DNA, 440 bp, Fusarium venenatum
  misc_feature (1)...(440): n = A,T,C or G
cagacacaaaatgaatttggcgtgaagcaacacgtctcacgcagcattcgaagtctgtttttgctttcacgagcgtcaggtatcgatcgccacgagtttgagaaccttgttagagctgagctcgatattctcggcatggttgaggatcaggaacaagtgtaatgttgtgttgaacacgcaatcaatgcatctttctttggtttatcttttgacccatgggatgaaattgggaaaaccttttggggtaatgcattttggtagtctcggcatgcatgcaaggcgtttgtcattaagcatctggttagaggtcggtcaagcgactactttgtttcgagtctacttaaggaaattagataggacatggtcatatgtnctgaacaaggatgtnaatagcatctcatgagagaatgaaacaatactacattataaatgttttgatg

SEQ ID NO: 3140 - DNA, 306 bp, Fusarium venenatum
  misc_feature (1)...(306): n = A,T,C or G
nccaaccaaattcnggtctttcnntcactttnaccanccagaacttacggaaccggntttcataangccnttaanatggtaccttgnatattngaccgatttgaaaaatgcnaanttatttgatataacactggnaaggcgttgggggngcatttccaangggattattttaaaccttcnnccacgaanactttgaaaaatttcttaacctnccttaattcaaaaggtccnccactaaanaaaanaaaaaaaaattctnggggcaatcngcttctntttaaaggcccnattccccctntacggatc

SEQ ID NO: 3141 - DNA, 348 bp, Fusarium venenatum
  misc_feature (1)...(348): n = A,T,C or G
catttacagtccgaaatgttatactcanggcgaggggtgctatgtanccccgatcaggagggaacgtctgattagatggtctcgaagaccccagaccactcgacaagcaaggagtgacttggttaccagctttgtcgggggcatttggtgcctatatatcgcattctacaactaccccccggtagtcagatgggcgtaacatcacgattcaaggaatctttatctctataagagataacacaatatttatagacgctgataccgagtgcagtggatgggaatagtccaaacagatttggaacagtgtacattaacgaattacgaaagcattcctacnanaaaaaaaaa

SEQ ID NO: 3142 - DNA, 566 bp, Fusarium venenatum
  misc_feature (1)...(566): n = A,T,C or G
gacccgagccagcccgtgacaccacccaattcgttggacaccacgacatctctctgcgaggacgaccaaaacgaagaaaggtggccaatagcgatatggagtgacgcaaatcgttgcttcgattggatggcctttccaacttccgtcgtcttgactacggacctatccaaactctcataatggaaggtggttgaacttcaaaaaccctgcttggtcgttgaaacagctggctacagccgataatatgatatatcgctgggctttataagtcagancttgatgtttggctcattttgaaacactatggtgcgatgcgaagccttgggaaaagcactgactggacttgttcttgcttagtggtggaatatcagctactggcatgaattcaccagctgttaataacccaaggtacgaaacatgtgaccggatctgcggcgtgacttatgaaagttgtttatcagaatgtacctgcctgctctgtgcaacttattagccacccangcctatatcaanacagcagcgttgcantcagcttggttacacaaaaaaactcagcagtcccttcc

SEQ ID NO: 3143 - DNA, 297 bp, Fusarium venenatum
  misc_feature (1)...(297): n = A,T,C or G
cgggagcttagcgcgcatatcgatataaagataggctttctcaaactcgactcattgtggtttcaaaaagcaagggccttcggggtgcggggtacnattgcggaatggcatgatggaccgtgggactttgggtggatncacgtggggggtgatctactagagacccaaanaagggattgtggaatgggttccaacgttgataaccagtttcatatgtttaagaaggaagaacaagatgtatagtatagatagtatnggtagggatcgaaggagaactgctgcatagaatctcatctc

SEQ ID NO: 3144 - DNA, 143 bp, Fusarium venenatum
  misc_feature (1)...(143): n = A,T,C or G
nganggcttgngcttacncatctaatccggagtgnggagcgntaaggtgaaantcctctgntacaagctttggaacaagttatnaaganactaccctgggganatgcctggttatttnaccaacaaccggctatgcngttgca

SEQ ID NO: 3145 - DNA, 780 bp, Fusarium venenatum
  misc_feature (1)...(780): n = A,T,C or G
tgactgcccacttgaaatcatcctcgctccgcgtcctcggattgctgcaacttgctacactattgcctgcaacatgaaacgcttgtcgctctggctctgcacaaattcgttcccgcttccattctggattaatgctgctttaagtcctctgggatagtcaacttcttcaaatctggaattttgctacaccctgctggccacttggtcatcgtgacaactcggcattttggaatacacaaagcttgcggaaacctttcctccggaaccatatctcagcatgccatcaactatggacaatcccacttcgtctacaggcgacactgngnttttcaaaccatcctgctcctgaatttctccatgagaactagaccatatcgacaccggaattggaacttcatcaaccctatgggttgacaatgcctgtacagcactatggatggtgcaggaggaagaatgggcaaggttaaagggggggattctgcggcttaatttcaaatctttgaacttggatccatggacttaatctctttggctgttttgctgnactgtcatttattgtctcttacgtcgttcancgaaaattttgcttttgattggagatncacggagtttaagaggttgcctatatcttccgttcgattcgattgtttgaaagaggattatgaaactattnttattgcaaangtttgattggaatacaagagntggtcatgtctttgaatgaatgaaaagatttgttcgccatcgagtganatgaanaaataanaattcctttgagcc

SEQ ID NO: 3146 - DNA, 120 bp, Fusarium venenatum
  misc_feature (1)...(120): n = A,T,C or G
ngcatcnctgctgctctaaatgttnntggtgggctgnaagattttcacnattnatgcgacaattttttncgccntggaatgcccgatttacnnctttaaaatnattggncgttctgantn

SEQ ID NO: 3147 - DNA, 388 bp, Fusarium venenatum
cccaaaagaaatgttctaaatgaaaagtccccaaccacgatcgtcgattgttcctttttgcacttaccatctgagaccagaagaacctaaagcacaggggtccgacaattcaacatgatttccatgagaataaccgagactcttgtgtggatacctcttcgaactttgggttttgtgatgaggcttttgatgatgtggaggagggatatttcattagtgaacgtttgatggaggttggagattgccattgatcccgtgtttacccaaggacgccagagttcggcggacgggttttatgagtgatggcaatgggaggtgatcttgttacgcttccttgaacgggacagggtctcgcattttgcacaataggagtagaaaaggaaaggct

SEQ ID NO: 3148 - DNA, 651 bp, Fusarium venenatum
  misc_feature (1)...(651): n = A,T,C or G
aaggtttcacgttcatcgaagggagcgaggtccctgccggatacaagaacgactatgacctccatttcaagtcgtctgtcgaactccatccgcatttcgagcaagcttccaacacatcccatctcccaacggcaaccgccaaagaagcggcccgccgcatgtacggccaacgattgctgtatgacaggactcctgcacacgaactcgtattgaacgctagaatcgtaggcgtttcgtggccgccaaagtacttgggcgagtgggcaatgggatttcatgacggcatccaagccagtgttccaaccgagatcttgagactggatccgccgcacccgaacaagtcaaggtcgatggaacaagtccggtgcaagctactgcaaagtggaagttcaaccacaaggacaaggtcaagggtgactggcttaagttcgagaaagacgaaatcattaccaacatcggctggccttatcaagaatttttggtgctggtcaggcacaaatgccaaangcaagacaggaattttccccagcgtttattgacgcagcaacgctacgcgactttggcaagtccggctcggatagggcgaagtatcgtgagtaatgaacgaaacaagnccttggctggtttggcttcgggttacatctcgcaagn

SEQ ID NO: 3149 - DNA, 125 bp, Fusarium venenatum
  misc_feature (1)...(125): n = A,T,C or G
naaaaggcccgaacngatngccctttcaanagtggcccagcttttacntnccgggaagttaaaggttncacttntaaaaanaaaaacccgttattcgcctgnttngtgggatgacncaagcgatt

SEQ ID NO: 3150 - DNA, 176 bp, Fusarium venenatum
  misc_feature (1)...(176): n = A,T,C or G
aagacaaagttcatgattctcattgaattgttttgataaaaggaagcaagcaaaaaatagattgtcatacatccagaaagaatagtggtaagcctatccaaagggagcccttctttactagaatgcctacccaagaaagtaaccaagtggngattnatgtnctggcaagactttct

SEQ ID NO: 3151 - DNA, 396 bp, Fusarium venenatum
attttttttttttttttttttttattggattcgattgcgagcgctagcatttagtttcatgtttgggagataaactttgttaaactgaagaagaaaattattgatttcacatataaagactgcatgacatcacactgtgatatttccgacatgtgattcaagcacctataactggcatctcaccatccaacatcatatccccatcaacaagggagatactgaagatatcgacaccctcggcaaacccaccaaagccagtaaagtcaaacatatctccagaaagtgcccaatcttcctgactcgtattgtgtgctgccgacgttggacttccaggtcttgtcggggttgacaacgacgtgtagtcgacgctctgccacagcgccttgacatctccag

SEQ ID NO: 3152 - DNA, 210 bp, Fusarium venenatum
  misc_feature (1)...(210): n = A,T,C or G
ncgattttccgagcngaaggcttcangaacttcatctccttagatctgcgncntgatgtgcncaaggacnacataacctngcctttacccaccaagctcaacttcctggacctcatncctctcaagangaagtccatgtgaagcttganctctgngcgatatcgaccccgngagagcangataancaccttncaanaacgttgaaattaa

SEQ ID NO: 3153 - DNA, 565 bp, Fusarium venenatum
gtttcaacaaaattacagaagtaatcttctttaaattaaatctttggataaataactatagcggtctcacttgaaactcgctcccccagttcccatcaaactttcttaccttgtagagttcaatttctgctgtcaggtttccccaactgcacgaacaagaatcccttttcattcttcataagtcagagctttttttcaacgcgtccgatgataaacaaggtcggtgtgtcgaacgcttatttcatggtaccaacctctcctcgccccgaaaccacttaagctgccccgaaaggtagagggtttcgaggtccggagaggaggcactacatagaccgtcaagtggttcaagtctcgcttcgatggtattgtccgataaacggttgaaaaggaaaatggttatttgaatttacggactggtcacggcgaacattagggggaaaactcacatggggcttgtattttctggtgccattgctgcatcagctcgactcttttagtcgagccacggcctgagagaccgacccggcactctgccggctttccgatattcactcactcttgaatg

SEQ ID NO: 3154 - DNA, 204 bp, Fusarium venenatum
ggctgcgccaccggtgtccgagaacaccaagcctgctgaggctgagaaagatgttgcaccaaagacggataacaagggaccacaagagctcaaggaagtcaaagagggtccctgcggcctgcccgccaagtgtgttgttcaatagatgaattcaacgataatgcaatgcgatgcttagaatcaatacaaacatgttaatcattc

SEQ ID NO: 3155 - DNA, 546 bp, Fusarium venenatum
  misc_feature (1)...(546): n = A,T,C or G
caccttttctcattgcgtaccagccaagacttaggtatagttactctcattgacaaaacacaccctcttggtttcatagnactcattctcattcttcttagtcgactgaatattaacaatcactaagcaatattacttctggggactctatcgtccatnatgccttttcgccntnaaagtcgtcggcccggaccccggccccgaggccctttatccgtttaatatggaaggcaaggtcattttggtttcgggacgcggttccaaaagagcttgggaatccntaccgccaactttcccgtcnatnaaactntgacccttnggatctnaaantgggattanggcggtttactttggnttttgccttttttcgccttcctttttgagcatcccaaangctcttttatnagngtaatccaacgctgttccccaaaanggcccanaggaccctnttnttttanttgggactcccgtaaccccccattccanaatttccccangggttatggntattgggtacaatcccttttacaaaaacaanggnccgta

SEQ ID NO: 3156 - DNA, 246 bp, Fusarium venenatum
cgcgtgctaaatagcactgcgccgaacagaactggagtacaggagtatctgggaaaacgcaagccgtgctcgaatcgcgaaagaacccttgttgtcgcgcataagacaggatatcaagcatagcgtgcagattttagtgcgggagcttgtatagtacaaccaggactacgagcctacgatcgttatataagacactttaatgccttggttcgactggctttgaggctggtcaatcatttcgcttct

SEQ ID NO: 3157 - DNA, 200 bp, Fusarium venenatum
gaagactttgctagagtcgcggcccgtcaactgattcatccaccccacgcacgtcgaagcacctcgtccaagcgaatttctttcctgttatgataccatattctttccatagaagagtggccagccgcctgcccatgcccagcgcgacgccctagtctaaatcggcacccccttggaagttccaagtgggagaattaaag

SEQ ID NO: 3158 - DNA, 117 bp, Fusarium venenatum
  misc_feature (1)...(117): n = A,T,C or G
ngaacggntataacatgcttccccntcagttnccctttggnggggtacaaaaaanaccggaatttgnacaaaaacttcgggnaaggcagccttcgccatcttacnccanaacaaggt

SEQ ID NO: 3159 - DNA, 461 bp, Fusarium venenatum
  misc_feature (1)...(461): n = A,T,C or G
caaccccctcgctgtgtccaacccgcaaaactcagccttcagcactgcaatgtcacctatgagccccgccaacatgaccgccttttctcatnacgggcacacaccgaccttcttcccgcccgaattactggctatgaactttggctcgggctcaaatggcaacattgaccctcttgatcgtcaacttgtttttggtggatattcggtggatgttggtaccggtctaggcagtggtcacgatatgatgactggtatgagctgggatgcagttgccccaagtactcaaccagaggaagacttgcaaggccggngatctaatatcaaancangcatgaatggcacacgagcttggcatggccgatngagcaggactatttngacctgaagcatcatctgctggntcatgccattcaacatggagnccccggagatgggccagatncttggnttaacatgggcgg

SEQ ID NO: 3160 - DNA, 248 bp, Fusarium venenatum
  misc_feature (1)...(248): n = A,T,C or G
ngggcaattttaaanaaagtttggaaaaacccggttttttcttaccaagaaaaggccaccgagctnantaaatttggatgttaaagganaaaaaccttgcaaggaaaaagattcnttggaaacccagtcaaagnttttggaanggnttaagttcatgggggagcttgaaccanantttggggggccttattccgtttaaacggttggggtanaacaagaaaccaacaacagggctttaaagaagcaaa

SEQ ID NO: 3161 - DNA, 423 bp, Fusarium venenatum
aacacattctactttttgtatcacataaatctcttgatatcaacgccaagatggagccttttgtcaactacaaccacaacacttgccccaagtgcagcgccaccatcgagggtgacggcaaaacctgcggtagctgcggtgctcactgccccgtctaaatttccaacggagaaattcaacaatatgatgagacaagacgagacgagttgagatatttggtgttagggatgcatacaatggagtgtggttggcgatgttgtgcgaggccgctttttgaaagcgtcactcttttttatttgggcggcggttgatggtttaacctatttgcgttgggtggtattgtgtaacaaagattaaactcgctcttttattcgattgcttatcatgaggaaacaagactgattctcgcctaaaaaaaaaaaa

SEQ ID NO: 3162 - DNA, 347 bp, Fusarium venenatum
  misc_feature (1)...(347): n = A,T,C or G
atccttnttgggatggaggtttatgatagggggctttttactnatcacaaaggtatggtngattattgaaacaataccagctcggaatccttagtaacatcggccaattcaagtgtcaactactcggccagcaactacaacttatctggcggtctacctattggtaccaatggtcatatgtnacgcgcctgagtcnacctaccctgccgctccctcgttggtgcccgnccaccttcangatcgtatggcaagcagttggacatgcctcatacaangcaccaactntttnaattngtgggagaaccgngagcgatactngcctacccatttctgtggacgacatcttc

SEQ ID NO: 3163 - DNA, 155 bp, Fusarium venenatum
cgaatctttgaacgcacattgcgcccgccagtattctggcgggcatgcctgttcgagcgtcatttcaaccctcaagcccagcttggtgttgggagctgttttagttaacactccccaaattgattggcggtcacgtcgagcttccatagcgtagt

SEQ ID NO: 3164 - DNA, 113 bp, Fusarium venenatum
  misc_feature (1)...(113): n = A,T,C or G
nggatttagggaaaatccccgctnaanggaattttgttnctccgggatncattgttnatggngaancccagcttaagnttgaacctggnttttaanagggcccaattncaccc

SEQ ID NO: 3165 - DNA, 440 bp, Fusarium venenatum
  misc_feature (1)...(440): n = A,T,C or G
gcggttctgtcctgcgatagcttttctgaagttgacctttcttcgccgatgttcgggatggattcgcatctcaacgacatcgattcagttcagtttgcgttctcaaatcctccggtaccgtttcttgatcttcccaccgtctcggatgatgtctccaagatggcatcgctcactggttcaccagtcaccgtagccgctctatagagccgtaggttcagcgtgcgaccagacgaacgataccattcttgactcatcatctgcggcgttgggaaacgacngaatatcagctgcatttgttgatgtcgttgcttnagatttcaagttcatctctgccgacaactccgccggcaacaactcagcttcgatataacccagcattcagacgttcaaagaaatnctgccnttcgtctgaaaaacaacnagtttnttgagcatggaaa

SEQ ID NO: 3166 - DNA, 636 bp, Fusarium venenatum
  misc_feature (1)...(636): n = A,T,C or G
nccacccccagtgccncttcaacnntgaacccaatgganatgatgacccntnagtctttnacngacgancaaatccttnatccttcttatatcagncnagaggaggacatgtcaacnccatcatcatntctgccctgagaagagacaacnaagaagcgaagtcgngggacaagtcttccgacccaagacnatttctctngaaaacgacaaagactggatgactaaaaagagngcgccgtttgagcgcttctttnaatngccgcgctgtttagncttntcgtgaaccaagaaacaagaggcgangctntcggaaagagaatgagggaacttggaacaagccggaatggcgggcgaacaagccacgcttaactcatgatggacttgngccatccgacggtntggagncggtttatacttccccttnggtttgggacttttttcgagtcaatctttaatattacaggagctttttancttccagacacgcncgaaactatngacgcattagnggnttcaaacaacaacggggatcccnaagaattttcctgttttgcaccaagggttgatgntntgaaaaattgcccccaaaaccattnaatgaggccaanccggactgatgnaagacttttcgactga

SEQ ID NO: 3167 - DNA, 175 bp, Fusarium venenatum
  misc_feature (1)...(175): n = A,T,C or G
ntggtnaatnaataactaccaacactggatttccccttgntaaaagcgctgngcatataaaaaatgnctgattttattggcntttattggcactacccccgaattcatactctggggctttacangttttttggagctntnatacggctaaaccaatacaccaccatttatcacc

SEQ ID NO: 3168 - DNA, 222 bp, Fusarium venenatum
aacgaaactggcgagtccagtggtaatgcctttagcgggcagcaagactttggaggtcaggacccaggtttccaacaggccatgaacgcccgcgtcgtggagaacatctagatgctctcccctcgtgccttccaatcttgaggtgatggtcggctaacgcttgagggtttcccgtttcgggatttagcctggtctacttgatttcgaaagcaacttcgactg

SEQ ID NO: 3169 - DNA, 153 bp, Fusarium venenatum
  misc_feature (1)...(153): n = A,T,C or G
ncnttgaccgatantggggacgggaancaaggtttccttgtttttancagtanaacttttattttcgttcncnaccttttntngttcggccnagctttttnggattnttttctaaaaaacnnggccttaacttgcggtnaaatgaagggattc

SEQ ID NO: 3170 - DNA, 404 bp, Fusarium venenatum
tttccgcttgtcatgcttgttctgttcgttgatatgaccgcagccgtcatacgcatatctgcgggagaatggacaacagctgcaaagatttctttacttgccacccatctggctctgatatcccaagtcttgacgacagatacaaacaggatgaggctgtaggacgctcaaagcacaaccatcgcactttttacgaccgacaggagattctaccctacacttggacaatgcacgatgacaatcagagacaatgtcggtgaaatgcctagtgatggatggtcgggtgtcttgattggctacgtatgcttagttatttatgaggcggcttagttgccgctattccgcttcgtcatgagtggaacaagtcgaagccatgttaatcaatctagctcgatctagagact

SEQ ID NO: 3171 - DNA, 339 bp, Fusarium venenatum
ctgtaagcaaactttgttagtcgtcgatttctgacaaacacttctaaatttttcttttcttttgaatgcatgcgaatgcgaatgtccacaagggctgagcgcttgcccaaaccttagtaaccgttgaactcgtatgcaagggatatgtaagtcatcgtggctgaagctgaaaaggagtgcgatctaccgagaaagctggtcatgtcatatggccagatccaatcttgaaaggatcgtgaggcgttcagtcacctcatcccgtctcacacatccctccctagatttagaaaccccgcaagagcattttagatccaacatgtctcatggtttgatctatcg

SEQ ID NO: 3172 - DNA, 288 bp, Fusarium venenatum
  misc_feature (1)...(288): n = A,T,C or G
ccacaagattacgaagaaaagcggtttaggatttggacagttataggcgccacgcagtcgtacaatgcatggagcgagcaattgcgtttgataccgattctgtttttaggaagttgcaatttggcgattcgcatcgngggcgttgtcactatgaccaaaactggggcttcgctggcatcagctgggaaggatacggtctttggagttggaagtccaagacgagtgtatgatggcaagagctaatagtacatagaaatagacgagtgatatctcactaaanaaaaaaaa

SEQ ID NO: 3173 - DNA, 338 bp, Fusarium venenatum
  misc_feature (1)...(338): n = A,T,C or G
ncacagtgtnttcantcaacacacctacgcttactacacagggacaaacgccananggccagcaagnggncatggatgaggaccttncaggnatgcctatgggtggtnacacgaacgatattggcnatatgggatttggcggaaaccanaccaataatgatnctaacttttgcataaacgacctggaaagnaccttttgagcttgacggcttcctcaaacgtgtatccaggcgcattgcnacactgggtatttannaatcttaattaaagatccnagaccacaaggcattaatgcancgttacaaggatgatgatcttgagannacaagccttcagtg

SEQ ID NO: 3174 - DNA, 186 bp, Fusarium venenatum
ttcattggtgttggggaagggaaacgaaaatcagaatgatgatggtgttcttttttatttgcaacctgcttgcacttgacggcagtgaatgggcgattcctggtggcacagcaaggtagctcttagacggtagataaaaatgcgaattaaaaggtcttcggtctaatatcaagtctgattatccct

SEQ ID NO: 3175 - DNA, 407 bp, Fusarium venenatum
  misc_feature (1)...(407): n = A,T,C or G
ngagggcttcctcaagtcactctggcatactctgaccaaccaccccgctcaccaaaagccgaatgaagatggaagtcagaatgacggctctaccaagaagcctgacgacaacgataagaaataaaagatatttcgctcatgaattgtatcatatgcttgggagaattatcaacatagaggaacggaagaagcgcatttgttggtgttcaaaaggttggtattatttgttgtatggcgtcggtggagggttacgatagcccaactactactcacgtcgatctgccacagcgtcagatctgttgtatctaatnctgnagtatagaaagaangggctangaaaccccangaggncactttctcataggtttggnaggtaaaaatcactatacggacatacacatggaaaa

SEQ ID NO: 3176 - DNA, 224 bp, Fusarium venenatum
aagtcccgcttcaagcgtggaggcttgatccaccaggtccgcgtcggggtttaaaagtagccccgagttgacttcagccatgaatgagatgatgtcccagggaaagatgcgatcccttttttgtaaataagcaggagtttctgggttgctagtcactaaacaaagtatgtaaatttttattgcatttatgtcaggtgaccaatttggtcacggcaatatttgac

SEQ ID NO: 3177 - DNA, 240 bp, Fusarium venenatum
gcgaatgctggcggagttctgaagactgaggaggtcagggttcaacacgagcgcctgagcaccttcagcgacgaaaactcgatagagttgaggaacttgccgcaagctcaggtcaaaggtggttatcaaagccatgatcgagcaccttctttctaaaacaaaaatccttttttctcccattcatattatttactatgtatttatgataccctcttacaacagacaacatccatttgcttg

SEQ ID NO: 3178 - DNA, 174 bp, Fusarium venenatum
tgcactgcgttgtataaggacggagatgtcaaacaggggaacctggtttatacaattctgaacaaatcagtagttgttttctagtgcatcaaacgcagcagatacaatatcaagtatggagttggtttccgatttgaaataaggaagccagcgggccactcgttgagaatctcg

SEQ ID NO: 3179 - DNA, 534 bp, Fusarium venenatum
  misc_feature (1)...(534): n = A,T,C or G
tgttgatattccaaccgnnatctcgtctgttttcccatccattaggacaattttcggtttctctctctacttttcttggctcttattacttgaccctctcgcaaccaatcccaacgttgcatttacccactggacctgaacgaagcgacgatccatccagtcacccatgcagctgcagagaactgagaccaacaggctattccatcacctgcagttcttcgactctccctctttgatcaacttgattatttggttcattcttcatttttgctataacctttgctttggttggtcttcatctattggcgcgtgaaattcgctcttttgcgagtttattcttcaaatactgnttcgtatcggcaatttttggcgggccctaaatacgtgacacacacccattttgcgggcnggtttgcatcaatcaaccatttcccaacgaatttgaggttcgctatatttggcttggttggncattggaaataaaagctttctgancatttaatntcaatcatcccttggtngggntttcgacca

SEQ ID NO: 3180 - DNA, 256 bp, Fusarium venenatum
  misc_feature (1)...(256): n = A,T,C or G
ntggggtggatactttcaagctgtgatgtaccagatctatcaattcaacccctatgancacaaacaaggaactttcatcggcctcatnttatactttaatcngaacgcttggncattactnttcctcgcggggacaagtttgannctcggaggatanttaagggtataatgggtcctgcangntggctcaaagannttaaaggttttcaaccaagnnctggggtcttaaagaacatgcctcttgggttataacggt

SEQ ID NO: 3181 - DNA, 322 bp, Fusarium venenatum
cctatcttgtcttctaaacgttgtccaatcggcgtcgagccagctacaggtcgatggtatcagattatattgactatgatgatcgtccaggtcgtcacgtaaaaccggcgttaggatttttttcgttcatatattgcaagccccgcgatttgtgagaggttagaacctcactattgcgtgcagaaactgcctggcatggcatcttccattttgttgtctgtgggtttgggttacggaccatgtttagataaataacttgcgtctcgtttggagtttcgggctggtagatgttttaaaagatatgaattgatctttcttcacg

SEQ ID NO: 3182 - DNA, 402 bp, Fusarium venenatum
  misc_feature (1)...(402): n = A,T,C or G
ngngcctcgatntcgccgggctcccaagggtattatcggctccacctatgacgctcttacctcttctgagaacgccgctgtcgtccgcagcatcgctatctttggttttgcagtgacattcctgtccagcttttgggggcgagatccttctgcttccccagtnaaatgacgctgtaacgatacccgacccaaagaaactgcgtggggaatgggaagaaaatcagttcaaggggtangaatgcgccnatatccgcctccctntgtgcattatttaatcgaatacttggacattagttggagtcagtggaccgtttaaacaaggaagggatttcaaaagctagnctgtgnctgtncaanggcattatgataccngctgnatagaaatcgacatgatcaattctt

SEQ ID NO: 3183 - DNA, 139 bp, Fusarium venenatum
  misc_feature (1)...(139): n = A,T,C or G
ntggggggccgttngagccatngcattaagaagggccaaattnggccttatagggangncgtattacaattcantgggccgncgattnaacnacggnatggactggggnaaacccttggcggttcccaanntaattggc

SEQ ID NO: 3184 - DNA, 203 bp, Fusarium venenatum
tgttctttatgcctgacttagcgcgagactggcaagttgcagaaatgctccttgaatctggaaccgatggcggtgggccaatgttatggacagggatgtcacaaatggggggatatccatgagaaatgcctcaataaagtccaaggtttgcataggaatagttcaaagtcatagataactataaaaagcaccaaactgactac

SEQ ID NO: 3185 - DNA, 168 bp, Fusarium venenatum
  misc_feature (1)...(168): n = A,T,C or G
nacctttactncggagttaaaggttaccctattaaaaaaaaacccntttcgnttgtttggggtntncaaagggtntnttgcccccccgggccaccggangggatccctnggcaggcncctttggtntaaaaaaaaanttccggaatttacccggggggcttttgggga

SEQ ID NO: 3186 - DNA, 127 bp, Fusarium venenatum
  misc_feature (1)...(127): n = A,T,C or G
naagccgaacttgtantgggttgtgnagggtntttaaagaagganggcaaacaganccnagtaaacancgtnttgaanggacccggtttttccatggngganatttcaaagatttnacnacacatgg

SEQ ID NO: 3187 - DNA, 538 bp, Fusarium venenatum
  misc_feature (1)...(538): n = A,T,C or G
ngctcttgttgcattgactcttttcctcccactccctgccaaatttggcgaggatgatcatacaacacctgccgaagccgtgtcttatagtttctatgtagtcgctgttgtcgcactggttgtgtctttgtttgtagcaatcgggctgcgaaacatcaagggtgaagaaggcaagggttttagggttctctttgggcttaaagatgagaacgaatcgactagatcagacggaaatggtcaccaacggaaactggcaccttatctacatnttatgaaggattcagcttccttggctttgtcgattctcgaatcggtctcggatatgttggtggctttgncgctagagcttcnagcgttgccatttacttttcatccctctctttggcaacacatattacattagcaacggnttctgcaaaggctacctcacgactctttgctgagctnaaaggaggagtgcaaaaacgnttacattctctcgtcatcttgactgggggttgcgcaagttnatgggnctttatcttgngccgcctatctt

SEQ ID NO: 3188 - DNA, 599 bp, Fusarium venenatum
  misc_feature (1)...(599): n = A,T,C or G
aattttttttttttttttttaattgtacatgtaggtgtgaattggtgatggtgcggtagtttacagtggtataatacaatatgtataacaaatggcccttctttatgaagtcttttccgtgtccgttgcctcgtccataattttgagttgtccaagaaaccactcgttcttgaatctgaccaaaccatttatttctttttgttcaacatggcctgaatatcatccacgcccttacccttctcccggcaccaccctcaggcgcgaagctcgttgtgaccgtcatcttctgggcaccctgcgctctnaattcatcaagcgtcgcttnttctggatatcggctactcccactgcttgaagtacttgacccaagcagcagcgcaatccgttcaaagtctaccgctctgcggaccaagggtggaagcgacggaccactcttncacttanacnaacgaagccatcgtattggttggtggnggtaacaaaatcaaagagtgnggggattganaatcaggggctttataggccctgactaacatggtacnatactgcatcgggtttggctgnaaactgaanaacctgnctaacanatcgtaattctg

SEQ ID NO: 3189 - DNA, 622 bp, Fusarium venenatum
  misc_feature (1)...(622): n = A,T,C or G
ntccaacacgaccatcatcaacgtcgacaccaccccccaactgggccgtcttcattcctattgtgactgtcgctgtcttttgcgctaccgctcaatataataatacttcttcaccagcgtcgcggttctttctcatcgtacaacccgtctactgctccaattcgcttctcgcttgcgtgctatcacttatcatattctcgctttcgcctgtctttcccctcacaaattaaactctcgactcgagcgcttgcttgctcgcgcgcacttaatactccagtcggaaaataatgcgcgactcctcataatttaatcaacatggcttcccctcgccgggcacaaccctcgctttctgtcgcatgccttccaaccaacctaccgatcgtcctcccatcgatgccctctttctcattcacttcgacgtcaaggntggatacacaattctttggaaacaaaatgcaccaagcatttgacctagaaggtcttggtgagtacaagtncctttcttntggactacacaccgncttttgaagacctcatctactttgtncacgatagtgnacatggccgggacttangcgcttttcgtcaacatggcttgnggacganggaanaaggcaccnaa

SEQ ID NO: 3190 - DNA, 718 bp, Fusarium venenatum
  misc_feature (1)...(718): n = A,T,C or G
agccagtggaagcgataccaaggtgcctgctgagcaacctggccgacaaactggaaactgctgaantggttgactgctcaacaacaacaatctcacaatcgatatcaaccccgcgatcccagccaccgacgaccattgccttaaagctgcgcgcattcattgcgactcttttattggcactgcgaaaacttgtgtgcgcatgtgtattgttacttgatgacgccaccaccagtcattaccacttcaccatggggaccgactatataatacccacacccatggttcactacgaatttaaaaccgaatactcgatgaaanttcacgggcatcaaaccacacgaactctccatgataccatcctttcgatgatcttacggccacaaaccaaatattcccttcatgtctaatactatacatctttgacagccatagcatagactccggcgttgaaccattttccaagggcggcagcccgcatcatctaccatatcaaatcaatctgtctttttttttttactttcttttgtttattctctttgtatagggggcgcataacggtggccagcagggacgggttggtccttttgctccggggcgtttggatgtgttttctttaaaggctttcatgagcgagtatgaggccaggcaaaagagatggttcagatcagtggatgaataagataggataaatcaatgccacaggcagtnctttctttnc

SEQ ID NO: 3191 - DNA, 198 bp, Fusarium venenatum
  misc_feature (1)...(198): n = A,T,C or G
ataaaggagaatcgtgaccggctgcttgatatggtgaaggaacatattggcaacgtcaggcggggcggcctcggggtatcagaaacattaaccgctggaagcataagagacaagattaataggtcagtttatgctgcttagactaaagttcttagactacttatttttatccccaagaaaaaaaatannatataaaaa

SEQ ID NO: 3192 - DNA, 268 bp, Fusarium venenatum
  misc_feature (1)...(268): n = A,T,C or G
ctctgcagtnctatcgagcagctggaaggtcctatggcccagatgaccattggtggacaagagggccaggaggtcatgcacaaggttgatatcaagaatcccgatggtaccgagtcgagcatgtacctccagattgataccatgtctggggaattcctncccttccggcctccccctctgccacaagcccaggctgctggcgagccagagagtgctgttgcggaagcggaagccgtggaggacgttncccagcaccgtgtctacaagg

SEQ ID NO: 3193 - DNA, 242 bp, Fusarium venenatum
  misc_feature (1)...(242): n = A,T,C or G
ngtaagcgtgtncaantgaggctgaattcgggcagacgntngcaatgtacntataccaangtttaattgaatgaagggaaaggctaccacttttaccttaactgtngaagcggttctggctanctctaatcttacntgtgcaatgtaaggtntaatacngggaccttttttgttaacacngtncgagttttgtttgnctcccangnggataaangatattggcttaaaanaaaaacccggag

SEQ ID NO: 3194 - DNA, 685 bp, Fusarium venenatum
  misc_feature (1)...(685): n = A,T,C or G
gagacttacaccgttcccttttactttgtccttcccactaccctcggtacagaggcttgctcacataacgtcatatggcaagaaacacgcgaaatgcactcgcatcttccacccagtgtcaccggctgggaaagtgatgcgatgatcccaaggggtgtgcgcgttgactacggcgttattgcccaggtctgggactcggccaaccctgagtatgctaagatggaggccaaagagaccgttcagttcttgccaggtcatatccaacactcacatctgaagatccctacaaaaaatagaaattttaaagttcgggtcgtctaaaacatctcaaatccggtgtctttggtcgctcttggggtgaaatcacgttaaacgccgaccaacccactgcaatcgttctcgactccagtggaaagagttttcatcctacaacggtggtaacgtctctcagattgaagttgtgcaatcataagactagcctgccgcaaatatgcagtgtatctgcaaagatcgagtcagaaacatggtcacaggacgagcccatgcaacagctgcctcacatcgtcaacgcgagagactgntacaatagctccgagactctgctgaagaagacggaaattggattgagctgggagaaaaactcaccaaagcagacagacaatgttgtcactgagactcccgagac

SEQ ID NO: 3195 - DNA, 253 bp, Fusarium venenatum
  misc_feature (1)...(253): n = A,T,C or G
attgagtngacacccancaanatgctnaacaggtcagtcatgccggccttcagnccntttgcnaattngcgagtgtcccttgcaaaccctgcgcnncaataccgacgcttcagngcaactcctacccgatgcttgagtgccnacttcgcaganaccnatgaacccngagttgaacaaaattcttatcgatgntcaggataagatcatccttccagcatacctgcccgngacacagaggaagattgtntatgac

SEQ ID NO: 3196 - DNA, 182 bp, Fusarium venenatum
tcaatccacctttacctcaactgcctaacagagatcttacaacctcaacactaaattattgatcgcgagccgtccatgtgcgtcgcgttccgcagtcgatgtcaagccctggataactacacctaaactgcaataaacgaaacgccatggaccagtccatcattcgcatctccaaggaactt

SEQ ID NO: 3197 - DNA, 225 bp, Fusarium venenatum
  misc_feature (1)...(225): n = A,T,C or G
nataatctngcgcaccatatgnatgctacaagaagacaaaagcacttaacgctcgcacttgattgaaaggcaatctcgccgcgactgactngttgattcttctgcgggatgtgcgatagatatatnccatcgcatccgaattggacaacaggcncttaggccgagnttcaacatattatcatacagcgtacagacacgctgcagatgcttganaagntatgatcc

SEQ ID NO: 3198 - DNA, 188 bp, Fusarium venenatum
  misc_feature (1)...(188): n = A,T,C or G
cctggtaacncggcctntactggtagcagcagtggtgtggataanggcggtncnttgccanactcgtggcggactcgtggccgaggtcagcgactangctgaaacaagtncttantcaatactctattanncacttgcagcatgtgtacaataagatagaagaataattatcgctatatacccttgaa

SEQ ID NO: 3199 - DNA, 159 bp, Fusarium venenatum
  misc_feature (1)...(159): n = A,T,C or G
aacaaancacatcttgggcctttcggtttcaaaggcaatagaacttttggtctccaaaaatccgccgaaatggcgattcggatgtcgagtatgagacattgctcatcggatatgaactcaagcttgcgctattccaggcctccatcgattacggcaaga

SEQ ID NO: 3200 - DNA, 262 bp, Fusarium venenatum
  misc_feature (1)...(262): n = A,T,C or G
aaagacataggaggtggagaagagctgggaagattgagcaaagaacgatccttgaaggacacggaacggtatgccaacgtcgatttgtccactaaagcatgggtcaggttgctctcagtatgctctgtagcttggagcatcatcgtctaagagttcaggcatgtatgtaaatggcgtttttggtgcgttggagttggactgaactgcattcggggcgttgngagcgtccaggaagtccccgagaacgttagcttatgaaaaa

SEQ ID NO: 3201 - DNA, 350 bp, Fusarium venenatum
catctcggtgctaagccctgaatggcttagatgcgcccgtggatttggacttgcatcttagatagttaattggcaatcacggtgaagcgtcctttttcgaactgccagaccgcttctcttgggtcccgttccccatcgaccccgtcttggattgacaactgttaagttgaccatgagacggtaatagtctagatagtcttgactccccgatctacaggggagaagggccattgaacaacaatcaactcaaatggaataccagggacccttggaggaattctaactgttatatcggcatggaatagggtagccgagacagttgttgaatggatatacggagttacggttta

SEQ ID NO: 3202 - DNA, 119 bp, Fusarium venenatum
  misc_feature (1)...(119): n = A,T,C or G
naaatcgntgtttataccanggtntttacaagcntncccacttaggaccccgctgggtntaacntcccactagnccgaaactggggcgntnctttttcattttttgcgttttgggggat

SEQ ID NO: 3203 - DNA, 162 bp, Fusarium venenatum
  misc_feature (1)...(162): n = A,T,C or G
ncacggngagagggaattngtacatgaatggntccggctgcttggtgnttttttaccaaanccnggcgccggntgaacggtttcccnaacacttaaaccttgtntcgganacaagctatttggcaccaaattacccattngctggangttnggactntccgc

SEQ ID NO: 3204 - DNA, 232 bp, Fusarium venenatum
  misc_feature (1)...(232): n = A,T,C or G
cattcctaggatcgtgtctatcaacgctgaaatgctcgatgtcgagattgaagtacgacgagctcgaaaacgtcgtgccaaagcagagatggcagagagaaagtcaggtcaagccacaacggacactcagttacaaagtccagcacttgaggcatcatgatggtactgttatttctctnagaaatggaaacagataaaattctcgaaaaatagaatcattctagatgtcccc

SEQ ID NO: 3205 - DNA, 482 bp, Fusarium venenatum
  misc_feature (1)...(482): n = A,T,C or G
acctactcttctctcctcataatcatcacacacctttcatccatcaacatgaagttcagcatcctcgctaccttcgctgctcttgtcagcagctctgctgctgctaaccaggctgttgtcatcaacaactgtcccaccacgatctatgttcaatctttcccttataatggcgcggctccaggcgctctgactgccctgaagccaggacagaagttcgccgagaacatgcgtgcatccggctcgactgtcaagattgctactagtaggactctactnaggcctntntttttnggatacttttnaacctccaagcccaactntgtntactntgagtttancncttgaangggggaacccttttngccaaaaagcaaaanattcttaaccctggttnnggttngaaaaaaatttnactggccgtgcnttgaanaggctggtgcttanaaanccccctntaaaagnaaaaaanttttttgggggcc

SEQ ID NO: 3206 - DNA, 275 bp, Fusarium venenatum
  misc_feature (1)...(275): n = A,T,C or G
naaggntgggacacaagaggatgaatttgttgaaatgagaaggaaacgtgattcaacgttggcggcgccaaactgatccatccttcgttgcaggtgaatattaggggngacagttgcctgctccggatacttaaggatcgcgcatggtttaaccttccttnggtcaccccgacatgggaaaatgatctttaattatcgaagtcgttgctttcgtggtccaatggtanctagctatttattaaattactactctttattcttcanaaaaaaaaaaa

SEQ ID NO: 3207 - DNA, 565 bp, Fusarium venenatum
  misc_feature (1)...(565): n = A,T,C or G
aggnngaacagagnagtcaacagtatcagaatcgngccgtagcttggcagtccactggcctgaccggcaggcttccttccttccttcctttccattatcgcggtgtttctgaacaaggtacctcttatctcaagtcgtgacttacaccgtgtacggaccacgcttggttcatccttctccttattagggggcgttaacatgcatatctgggcccgatatttgattagacgtgagcgcgaccagtaaagcgcgatctatggtcgcgatgcttcaccagtatncgaaagcccccaatgctgcgatgaaccaaaggaggggcactngcgagatcaacccagacagcgntcttnatgcgtctgacgtcttcatnacctcacgtcctcgtgatatacatctgcgatggtggaggtaagccgtgacccgctgtagtnaaaacccggggggggggggntgattgatgttaactnaccttgccgacacgcccaaaagggngatccananaacgaanaaaataaagtccctancggaacaaaaaaccggngattncccggaaaanggacgaatt

SEQ ID NO: 3208 - DNA, 489 bp, Fusarium venenatum
  misc_feature (1)...(489): n = A,T,C or G
caaancggctggggntgcttgcaggnntgtccgggnagttgagcctgaggatgtttacgacgaccgtccaccaacagctcgatccaactccaaccactctcagtacagctacccaagcaacagttctcatttaagcagtcacccaagcttnagcgaagagagcttccaagatccatacgcaaccatccgctcacaaggctaccgtcccgctgcccccctgcgcgacacatctcgggtgaatcaatggnctctaccaatatctcgggatctgagaactgggagacctatgatgatgacaacagcgagcccgaagttgatgtgtccgatgnctactatgcangctaagagctactcgaagcaaagcagttcttacctgantcaanggcgggnctatgagtagncaatctaagcgtatacccgggggggcaccgacggggtttattgctgnaccggtatgatcgaccaggatggaaaccgatnatttttgca

SEQ ID NO: 3209 - DNA, 280 bp, Fusarium venenatum
caagcatgtcagacacctctttgtccatgctgaggtcacaagtgtacaagtcagcgttgatggtatcttggctgtagcagaggaataccacgctacaattatgggtatttcaatgacattcttgaagaagcacggtcctaggcacctgctgcatcgcgaacggtttttgttagaagtcctggggacttatctcgtggaacacaagaagagggaggaggtgacagttgagaaataaattaagaagcacgttaatcaaataataccaattcatttacacaac

SEQ ID NO: 3210 - DNA, 385 bp, Fusarium venenatum
  misc_feature (1)...(385): n = A,T,C or G
ggaatttttttttttttttttttatcgtgatgaatagtattttgtattcctttatcggaatcacaatgtgaagcgctactttctgaaacccaatatcgctgtcgaaaaccaataattcaacgtgatgcttccatcctcacctgccttgaatgcaaaggccgaggaaacgccttacgctcaaatgttaaagcaagaatcatgtngtgtcgagagacagcggcgatacctatcgtcagcccatgctgcatttcaacaaaccaaaccacaaaatgcaaccatttgcgccccttttgctacgtctcaaagcaccacctcaggatgtctcgngctttcatctgacatatccatgtcaatgctatcagattggccgactccttttttcaga

SEQ ID NO: 3211 - DNA, 356 bp, Fusarium venenatum
aattatacatgttccagtgatgaaataaatctcgaatacaggaaaggataagactagaggaaggcatttttacgacgggcgtttgggcatctgtttttcaggaaagggatactggcagtgcctttatcgattggacggcctggtcatgctgtcaaaggagtatatcggcgtggatacccaacccaacctcctgcctgagatgggaacatattatattatacagcgggggtaattggaaactctggcattttctgctctatcatttaatcgtcagtcatcttgaatttcggctagatcgaattacttcaacttaaaccagaaggaaagttgagcccggactggcttctggttcattc

SEQ ID NO: 3212 - DNA, 747 bp, Fusarium venenatum
tttttttttttgtaactcattaaagacaaaactatcaagttaatgcgttaatctttgctggggtctcaatattcatgaaaattgcaagcaaaccaccaaacacaaaagggagaaaaaggaaatagggagtcctgtctctgaacatgtagaaagaagaacaatagcaagcgtggtatgtaattttcgccgtaagcttagggtacaccagataaataattcgacactttacacggatggatgttcgctccaagtattctccacctcatcttaaataacatctcccggctcaccaggaatttccaccgtgcacccgtgataataatacccgaaagcaatagatagcgaactgtaaaaacaacaaaatgataggagagaaagagacgtgtgagaccgtggggagttccgaagaaaaagccaagtcgtagtatgtgggtgtgcgtgtcaaaccagcttcagtcaaacaccacatccagcgtcggtaacataaaccaaaacaaatagtgctcttttcccctgaaaccaccacataggagggaaattgcctcctggaccagatcgccaattgaccatgatatagtttccactcagaacgcccgtgacaaatgatgcctgattaagtcttgaccccaagctcgtgtgtaatgccaacccagcctttcagaagactgctagtctgctccaatctcatcacccattgggaaagcttccgtaaagttaaaggccgaggtgtcaccatcctggtcgtgc

SEQ ID NO: 3213 - DNA, 241 bp, Fusarium venenatum
  misc_feature (1)...(241): n = A,T,C or G
aggttgggtggggatgacaaccctgctcgtcacataggtgcatccatctgatccgcctgggctattgggttgtccgagggccgctccccttttgtctggaggtactcatgttgtagttacacttgaggtgagcgtggcaaaaggtggaagttcggatagaatagataagattgttctgttacgaatacaggcgacttctcgattccatacttctaaaaanaaaacttaaaaanttncataa

SEQ ID NO: 3214 - DNA, 249 bp, Fusarium venenatum
  misc_feature (1)...(249): n = A,T,C or G
gacgaaatnatcattcaacttctncagatgagataactccgaggaatctacagacaggtccactgaatntttctagaaaactgccacattcgcttctattaatgacgatcgcatctttccataaacacagccactgagaaggattcgaaagtttccactgatagtctcgcccaaggcattctactttgagggatggccgtcatatggtaaagcgatgtcggcatcaaagcaaaaaaggtgtagggtagt

SEQ ID NO: 3215 - DNA, 167 bp, Fusarium venenatum
  misc_feature (1)...(167): n = A,T,C or G
nactgataaacactaatgantgctgtcgtattgcatttgtagcattcactatctgcagcctttactattcngtggcganaccactgntttaaanggcncatttgagctacatanttgggnacaatnaatgctgtganttatnaatgaattggaaancttttccaaaa

SEQ ID NO: 3216 - DNA, 484 bp, Fusarium venenatum
tgcgcggctccgatcccgagggcaaaaatggtccacagatagacactccatgaacaataatgataccacccaaacgagccaataggaggagcaggctgttcaacagcccgtcagaatatagtatctacgtgtcgtccaagccacagatccagagcaggtcaggctgttcaggacgcccgagcttcttcaggacgagggtggtcaggaggtccaggctctcgagtcaataggatgtcgtcaaaatcaccaggctgggaaaagccaccaaaaccttacgaaggaagatgggagacccgtgggatgagggacggaggtctactcaggcgtcaattgttcatttgcatctgctaagggcacggaaggtttcattcttgcttgtaatggtaggcaaagcataaaagagaaaaatgagacccaaagattaccaccacacgtcatatggccgggtcttctgtctaccaaaaaaaaaaaaaaaaaattcctg

SEQ ID NO: 3217 - DNA, 65 bp, Fusarium venenatum
  misc_feature (1)...(65): n = A,T,C or G
ctcacctnaactgnaataaacaaaacgcnatggcccagtccatcattcgcatatacaaggaactt

SEQ ID NO: 3218 - DNA, 302 bp, Fusarium venenatum
  misc_feature (1)...(302): n = A,T,C or G
gaaggttctgcgccgngatgganagcgcagnggttgacgtgatgcggagggtcctttacgtcatgttcgtggntccaaacagcttaccaacgtacgatttgcgagcgaattttttnnagtctggaaaggaagagccatacntgaagttagcagnttgcataagcttgaatatccaacgtntaacgacatantngaaggttatttcgagatgagagttatcgggagttaaagaagccntgttncatagtaattaaatactgtgcatccaaaanaaanaaaaaaanattctgnggcgctcgagc

SEQ ID NO: 3219 - DNA, 116 bp, Fusarium venenatum
  misc_feature (1)...(116): n = A,T,C or G
ngtccaagttanagttgtggtggtttcanaaaggtgaggacttgcnggatccttttgaagggncttnttctggccgggtaggaacccntttaatgttcaccggtnaagttgtagcc

SEQ ID NO: 3220 - DNA, 260 bp, Fusarium venenatum
  misc_feature (1)...(260): n = A,T,C or G
cgacatgaatcacaacgggatgacctctaacgccatgtcctattaaggccacatagaatgagttgaaaggatttactgctggatgcagttgaggctactatgttgttgttattagaccagccaactcttattcgttgggctgacgcagcgttgagatgaagcaggatggcggactgaatttagccaccttctctcnctgtagtattgnaggctgttagataccaaagacagaaaaaagttcccattgtctaaaaaaaaaa

SEQ ID NO: 3221 - DNA, 211 bp, Fusarium venenatum
  misc_feature (1)...(211): n = A,T,C or G
caacatattgatttgtttgatggatccttgagtttgctttgttgtaatacccaagctctggtctgtcgacactacggttatttccccaggctacttactacctactacgaaaccgcttaattcaaacaaaacaaaacaaaacaaaacaaaacaatctnaaccactccacgatcgagacgattncgattaaccccgcgaacgagcgattagg

SEQ ID NO: 3222 - DNA, 324 bp, Fusarium venenatum
  misc_feature (1)...(324): n = A,T,C or G
caaaaggtacacgataagtgtaagtcccagtgaatgaatgaatgatgaacatgaactaggtaaatctagcgtgaatgcaaaccaacggggaggggttaccctatgaggtttacgtattccgaggtgtggagggggtgtttgggaatgggattcgaggagtgaaagtgaggagtaaggagtgaanaacaggtatgtaagaanaaagctgatgtactgtatgcacttgcactcatacgaatagatcatatgattcatatgtatgtaagtntatgatttgatggcctgcgttgctcctgggctgggtctgggcttactgacttacat

SEQ ID NO: 3223 - DNA, 154 bp, Fusarium venenatum
  misc_feature (1)...(154): n = A,T,C or G
ntgcctttntgnttacagngnacattacttggganaatccttgcnttaccccaantttagggacattgccgnaggntcccccttttggntgnttgacngaatancccatttgtccgcaaccnggcngtttttcngnaaggtggtgaaccntatc

SEQ ID NO: 3224 - DNA, 349 bp, Fusarium venenatum
  misc_feature (1)...(349): n = A,T,C or G
cgaggccaagtcgcaacagcaagaagatcaaacaatggtgccaatcggagactgagtttgacgtttatctganccaactgggcttcatgcctgtaatggacccaaacatcaacaccgccggcngtgantctaatgctgcattttcggataactcgnaggtggcgcaaatggcagactggatgtttggaagccgcancttgctgggattgttggaacaggatatatctnaaataggcngtccccagtggccaccaatggtgaanggtgaagggcatgggccaatagatagaagatgtatnattgnaaccgtttaaaaaaanaaaaanaanaatttcntgctgccgctcga

SEQ ID NO: 3225 - DNA, 177 bp, Fusarium venenatum
  misc_feature (1)...(177): n = A,T,C or G
naacttaaatcgccttggaaggncattccccttttcggcaagtggcgtaataancnaaaaagccccggccggatcgncctttccaacaaggggcgcancttntacgtncggcggtttaangggttacnccttnttanaggagaaacccgttttcntntggttggggttgttcaaaag

SEQ ID NO: 3226 - DNA, 238 bp, Fusarium venenatum
  misc_feature (1)...(238): n = A,T,C or G
ncncaagacttccacaataatggacnaattgtgggaatggtttnnttttgaggatnggngcaatctacangcggggcgantgncacacatgaaatttnacttggagtcannggcattgccattctttctatcnttgcggcnttatcntgggngataccttttttctggctnggatgtttcgggggttcttgggacattttcggacattttttntacttgttgcantaggtaaggcttg

SEQ ID NO: 3227 - DNA, 155 bp, Fusarium venenatum
  misc_feature (1)...(155): n = A,T,C or G
gatttttgatctcggcccaaatgaaaaccttgctggtgtatactggagcccgcctttccagaaccaataccagaacgtctctgtcgatatgcgactgnggctggagccagcgaaactgttcgatcgactgatcaaagaccctgatnccntgtcca

SEQ ID NO: 3228 - DNA, 156 bp, Fusarium venenatum
  misc_feature (1)...(156): n = A,T,C or G
nataggcnanagattgtnaccaagtggcctgaggattgtttctaacgagatgggccccanantcaaccantactgcanaangcattatggcttagccaccnnaaactttngcatcngaaattgctggcnggattngggaancattaaggaccttnt

SEQ ID NO: 3229 - DNA, 221 bp, Fusarium venenatum
gacagacacaagcagataacacaagttgtgaggagagaataccagactactccataacggcttgtgttgaatgtagttgttgctttgacgcgggtctgatggatgaggagtgaggctgcagtggtgtggtggttagtgacagacgcgcagatgcagtgagaagagttgtaaatgatttgatacgcacccataaccccccaaatgaagcgaagtggcatcag

SEQ ID NO: 3230 - DNA, 270 bp, Fusarium venenatum
  misc_feature (1)...(270): n = A,T,C or G
ccaagaagtacaggagcaagaanctcaccaaggagganaangagaancgngtccangagcgcatccagnanatcatgcngcaggattaaaaagttgctttatctcattgggtnacgggcatattgangattgctaacctttgnattgggtttggagtttcgaggaaaggcaaggtctatnaaaaggaccatatnaatgaattaacaaaaagataccttccagcctaattncatanttttggtgaaacggtnntctcattactccataaaa

SEQ ID NO: 3231 - DNA, 351 bp, Fusarium venenatum
  misc_feature (1)...(351): n = A,T,C or G
cttacctcgagctgctggcaggagcgtgagcggaaagcaagatctagccgctgctggtgcaacggctgctatgagtcgacgatcatagtttctatttcagagaatgccttttcatgacgattggagtcaggttgngtcgagcatttcttttttccgttttcaaacttgtgtgccattgggtaaaccatacactgcgctgcggcgctacctgtgacgacaaaaacttttccttcacaacatgattgcatcactacaactacggttatggaaggggcncanaaagaaaaanactcattttggggcatnggggattcatcttatttattttttcaaaactcggancaaacaccc

SEQ ID NO: 3232 - DNA, 350 bp, Fusarium venenatum
  misc_feature (1)...(350): n = A,T,C or G
ttttttttttttgaacataacgatattaagaatgttttatactgcggnactaactcatactactactactgtgcctgctcttgcttctcaaaatacatnatctgttgnccaattggattgtttggtagttcnaagaacgctcaatttgtttaatattgttgtacncaataacaacntcagaatctnataattatcttatgnttgcatncatctcttcagttnttggtccaaataccacntattatgttacttgttaaggnnttgacattgggctcntcacngccgatatgctccttnaactngagganctcantggnaaacttgantcctccttcnggaagtcttgagct

SEQ ID NO: 3233 - DNA, 236 bp, Fusarium venenatum
  misc_feature (1)...(236): n = A,T,C or G
nacaatancttctanggctanagccgtaagacaacaacttttttgnaaanggcacataatattgnnttgtatagtgggaacaatntaacttcganctttgttataacnacnaggttctttngnacagaganacccantctacgctgatnatttccncaacgangaaaacattttggctgnntggtcaatntcatggcacgngntggaggaaanggnccacggntcactngatccgg

SEQ ID NO: 3234 - DNA, 121 bp, Fusarium venenatum
  misc_feature (1)...(121): n = A,T,C or G
natcgggaactccttangagaaaagcgtccccctttaagcnatgnttcaaaaaaagntaaagaccnatttctaaccnacctttgcnagnattttnccgagtacnccccaccgntaatttga

SEQ ID NO: 3235 - DNA, 223 bp, Fusarium venenatum
  misc_feature (1)...(223): n = A,T,C or G
nggattaaaaacttttatnttgggcccctccaacnttcatttaaaagattccttgcggccgttaagcaatccttttaaaagggcccagtccgcctattaagaagtcnantaccaggaaaacgcccggcgtttnacaacntaatggacttggnaaaanctggccnttncccacttaatggaattgcnaaaaagtccccntttgacagcttgtctaaaaagtgaa

SEQ ID NO: 3236 - DNA, 166 bp, Fusarium venenatum
  misc_feature (1)...(166): n = A,T,C or G
ngaacaccgccncnttaatgatgacacttnnaccctagagngcacacggcaaccgctgttnctctttaaattnacgatctgccctncctcaatcctcatggttggggacgangatttaccatgaccagntggtattgtgntgaaancggaagaccctntaaacttc

SEQ ID NO: 3237 - DNA, 170 bp, Fusarium venenatum
  misc_feature (1)...(170): n = A,T,C or G
ncgcgaccggatatcagctantgctatatnctctngcaacgagggcatagnggncggttataccggngntattccncacctggcttcttgatgctcgctggctagcttttcagaaaaccccctttaaanncttgatcanagccttgaagcttcctngagcntgcggccct

SEQ ID NO: 3238 - DNA, 228 bp, Fusarium venenatum
  misc_feature (1)...(228): n = A,T,C or G
ccttgttgagagccagacgcacgagacaacacccgacgcataatcccattacagtacagtagtggcctttttagctgcagcctttggctcccctgacagtgatcctgggcgtgacgacacccaattcccaggctccatcacaacaaattaatccctactacttattttttttttgggcgacagngcattcaacaactgagttttccgggnttgaaaccnccaagtttc

SEQ ID NO: 3239 - DNA, 126 bp, Fusarium venenatum
  misc_feature (1)...(126): n = A,T,C or G
nnagggcggagccaagaacgtgcattggntctgcnctgtctgcnacgctcccatgnaggtgctcggngtcactgcgaacaacaccgactcgcatctgccacacatgatcatccaacgcncttatga

SEQ ID NO: 3240 - DNA, 114 bp, Fusarium venenatum
  misc_feature (1)...(114): n = A,T,C or G
ncgattgatctgaccacggattggattaattcgacatggaaaanggccngtcanattggaaggttccatgcggaaaaanggacancttatacggccntntaaggtctggacctt

SEQ ID NO: 3241 - DNA, 153 bp, Fusarium venenatum
  misc_feature (1)...(153): n = A,T,C or G
nttttantttttngaaaagggngggggttcnataaaggccaaatttttttacaggcgtccngganggactggaacctttnncaacttttttaaancanagtttggcactttntgnacccccncacnccctnttttaancaagangaacccgat

SEQ ID NO: 3242 - DNA, 178 bp, Fusarium venenatum
  misc_feature (1)...(178): n = A,T,C or G
ggtatcttgaagaatcgcctcgaggttcgctacattaaacggtgcatcctgacgcaattgctttgaaacggcgcattattgaagatttgtttggttatataaaaanggcccttgcgcctgctggcattgggnggctatttccttccacctancaatngcgacagcgcgccggtttaaa

SEQ ID NO: 3243 - DNA, 374 bp, Fusarium venenatum
  misc_feature (1)...(374): n = A,T,C or G
tgatgagttgcgcgtcaaagccacaactaatgtatgggcagttggagacatcgtatccaagcctcgtgcctctttcttgattacggaggcacaggccgctggtgtttacaaaaacatcgatcttgtactcaagagtaaggaagcccagcctgtgagtggccctcgngtggatgcttttctgtgcgcaaccggtcgaagtcgcggagctggaaggttaggcaaagttccngtgccatcgctagctgtgtggacggtcaagggtcgaacgttgggtattgagcgcacaaaaaagtaccgccactgggagtatgtggtgataagaagtactaggtangtggtgtaacgcctgatatcctattcaagaaagcgccaaa

SEQ ID NO: 3244 - DNA, 154 bp, Fusarium venenatum
  misc_feature (1)...(154): n = A,T,C or G
caaataagtcacctatggaaatgacaccgaacgaacatgccctatggaacgcgcacatgcaaacgcccgtcctcttcaaccaccacaagcctctcaaagtngatcccccttgattnaacatatcgatctgnaccccaatacctttaacccccaa

SEQ ID NO: 3245 - DNA, 232 bp, Fusarium venenatum
  misc_feature (1)...(232): n = A,T,C or G
atgatatgcaaaaaagcattgctntgagggtttcgaaaatggtgaagtgtgtatctcgancatgaagtgctcgttgttgngatctgcacttgcggatgatacgcgtacttttagtgacttcatgccacacatcaagttcggtggccatcggtnctctcttgagcgagccttttntttantaggctntttgtccttnataatcttgttntgaccgcgttaacggctatttaat

SEQ ID NO: 3246 - DNA, 225 bp, Fusarium venenatum
  misc_feature (1)...(225): n = A,T,C or G
ctcatcttctgttgcttcagaagatagaagaagcatgaaaccttggcgttggcctgttgttggaggtattggcgcggagcanagagttggtttcttgattgagctgctggagctaggaagaactcgggtttagacttgttatggcatgttattatttccagcggttcaggatatggattatgatattcaataagcgggtaccgtaaatgagaactgcaatcacat

SEQ ID NO: 3247 - DNA, 191 bp, Fusarium venenatum
  misc_feature (1)...(191): n = A,T,C or G
aaaaggtgtttggccaggcgaactgtttttgtgcctggggggcgttttgagcatccggatcgatcctaggagatgaacgtctttggtgttattggttttgcgcttttttgttaagtagctacaggcaacaagaagttacttggtttaaatggacgatagttgaactatgaaatacgataagtacacactan

SEQ ID NO: 3248 - DNA, 148 bp, Fusarium venenatum
  misc_feature (1)...(148): n = A,T,C or G
nttggcggacaanaaggacgngtcgacagcatggntnttgacctngaatgttgggatcanatntgtaggactaatttataanaagattagtccnatctgttanacaaaaaaaaaanaaatnaaaanaaaaanaattanaaaaaaaaaa

SEQ ID NO: 3249 - DNA, 123 bp, Fusarium venenatum
  misc_feature (1)...(123): n = A,T,C or G
nttttttnaancccganccttccgncggaanaanaccgaantnatccagggggggggttaaagggnggattttacccanttacctcnaanttattcccgnggtatnggccgnaaaatgaaaaa

SEQ ID NO: 3250 - DNA, 154 bp, Fusarium venenatum
  misc_feature (1)...(154): n = A,T,C or G
agctcgacagacagtagcatgtcgtcatcggtgttctctcgacatagtattgagacaatttcaacgcctttacaaagtagtncagctttggaccgcagtcccctttctatggactcaaaaaangggcctacntngggccaatggccccaaaaga

SEQ ID NO: 3251 - DNA, 310 bp, Fusarium venenatum
  misc_feature (1)...(310): n = A,T,C or G
naaaaaaaaaaaatnggcgccanntttttggacnaaaggnggggcccaaaaatanaattttttccccaacacgattntttcaacncttagggattnaagcaggngtaaaaagggttttcnttttccttctcccggccaagaagcncccgcccacaanggggcgttctgcaacagganaaaaaccccganacgcanttgncccgccgtattatttntgggantaaaccaancttgaccagtantgccnccggnggtataaccangccggcctttaaacaacggccttttacattggcccggancccccang

SEQ ID NO: 3252 - DNA, 187 bp, Fusarium venenatum
  misc_feature (1)...(187): n = A,T,C or G
tctacaaagtccttcaccacccggatagtgtgacacaggaagatgccgaaggtgcggccgaatgtctcaaagcgtcactcaaatggnccatcgcctatcgccacctgnaccaacaagcgaattatccaangactttttttggncccaaaacctttttgggaggtctnggggctggggnaattttttg

SEQ ID NO: 3253 - DNA, 465 bp, Fusarium venenatum
  misc_feature (1)...(465): n = A,T,C or G
ttttttttttttttgccatagataatgcctgaataataataactgcttattgaacgactgttatgagtatccagatctacttctcctccatatcagttgtggtgccaatctcacgagttgcatcaagatcgtgatgaagaaatttaagtttgttaccgagacgtgtgaagcagtcttcgcccagtggtaatctcaagatcttgcccttaagatggcctgcctttccttcccccgtagcaacttcgtagatgatatccactcccttgttgggatcgccgcgctgtttcnctgaagcgttcgcaaacttggtaagtgtttccgatagcaaggtaccctcatatgcctttcactgatcgttgtnttaacgctagcgcnaggaagtaagtgcgaaatgctcaagctcgcattagaacattggtaccgactcttgacttttngatagatttaagttaaccctcaaggcga

SEQ ID NO: 3254 - DNA, 368 bp, Fusarium venenatum
  misc_feature (1)...(368): n = A,T,C or G
agccaaaggcatgacttaggggaaagacattatttgggcacgcactgcacagcaggaaacaagactatgaactgatagcatgaagggtgtggaggggcctcttggggcagaagcaaattcaacactggcggttacgatgcgtaccaaacgaagggaacacaagtgcaccatgtgtttctcgagggctgtggttctggcacgaggccatcactacctacctagtcaactcgctgaagccatgtgttaaccagaggggcagcttctggtcggnaaaggggaagagagaaaagtcgagggagaaatcagagatgacaagaattaaaaccctttggacttgaagttagcttcaattcaactcaaatttagag

SEQ ID NO: 3255 - DNA, 124 bp, Fusarium venenatum
  misc_feature (1)...(124): n = A,T,C or G
nntatgagcattgcaacgngagaccaggggggtcntgggggcctcgtcatgantctaaaganantaaggacacttgggnaacttttgtattcagtaatttnaangcctctgangacntaaaggg

SEQ ID NO: 3256 - DNA, 337 bp, Fusarium venenatum
  misc_feature (1)...(337): n = A,T,C or G
gccaactttgtgggtcgacagacagcctggagtcctggcggcgagtggtgtgttgtggtgggcagttcaaatcaagcgctgattctccagcgatgggctagcaagggctcaacttctagagcatctgcttccgcttccgcttccgtttctgcgtccgtgcctccttctgcaccgacacaaagcactgccgtttagagctgtgctcaaggctaaagccctcttattggaaggctagaatatagtgatagtgaagtatctccttcagaatcatcagagggattcaaaactcttaatgcagcattgtcaagttcgcctncaaaaaaaaaaattnattatt

SEQ ID NO: 3257 - DNA, 155 bp, Fusarium venenatum
  misc_feature (1)...(155): n = A,T,C or G
cagaggtctccttatcatcatcccccttccaacgctttgttgactttgcttttgntggtggtgaatcacgtcacaatattctcatctatccttcngnaaactttccaaggaactgatattggcnaagnacctgggccatggcttttgnttttcta

SEQ ID NO: 3258 - DNA, 605 bp, Fusarium venenatum
  misc_feature (1)...(605): n = A,T,C or G
cacgcgcctgggagtgccgtatcatacctcacactctttgcaatgcccatcgccaaaagaaacgacgctccttcaaatcatgataccccatagacactcctttttgacgactttacgacgattcgattggttatagaattgactccttgcggacccccctttaccatttgtgggaaaaccgtacctggagagcatagcgactgttttatttatttttactgcgcccgggaaaaagtttggcgtttaccggagtttgagttagcatttgtttagcgctttcgaccttgttatgtttgcttctttttggaatgatcatgcttatcgcttccagctcttcacagagcttgggatggcgatggaacaacacgggacggaagcacgattgggttttgggatattttatctggctctatgagagagactgtaggcggatatatgttttggattggcatgacacatatgaaggatatcatgtgaagatagacgctatatttgttgcttatcacggctgtatttcatgatttgtaggtagagaagattgatgttttgacggcagttgcatatactgcctggaggttaattcttaatctacgctgntgcatttt

SEQ ID NO: 3259 - DNA, 417 bp, Fusarium venenatum
  misc_feature (1)...(417): n = A,T,C or G
gtacgcacccattcctacaccaacatggcccgaagataaggcgcatgttcccacttccatcgagtgagagcaactatggctttgtttttgagggaatgtatagcaacgctgttgcacaaccacattcacgaaatgattcacctgcgttttacgaatctccttgatatcacaggatatacctatacgtcttttccccttataatttctgtctgatcgtcgacagttttctttcgcagcatgataccaggtcccgacggccacggaaagcggatgacttcctcattcgtttccgtggactttatctttccttttctttccttttnctctccttttctttctcggagttgtaggcatntgtcaaaagnatgactctatcatcataaccgcgtgcttttcgctctattttnaataggggca

SEQ ID NO: 3260 - DNA, 476 bp, Fusarium venenatum
  misc_feature (1)...(476): n = A,T,C or G
gttagcttggtgggtcaggaattctgccatccagcatcattcgcatggcgccccgctttctggtactactggggccaatctccggtggtactgccctgtacttacagtgttgtccatgtctatgcgacctgtctgtgtctaccctgtcgcctcctagtatacagggctgcagaacacaatagagtggcgtttccaaggagtgtcttcgtcttccttccattccttctcgaccaagccttgactcatgtagataaatctacgtcgcatcgtctcaaactcttgatgacgatgcgggtcatgccggtcttttggactgtttccaacaattgccctgtgttcgtcggtaactttgttcttgactcgttacccnttgngagcggaggctaatggctttactcttcgtttnatatntttnccaactttggcatgacttttttttntggntaactttttttaaaaaaanaancgttttgggt

SEQ ID NO: 3261 - DNA, 179 bp, Fusarium venenatum
  misc_feature (1)...(179): n = A,T,C or G
caacttcggcgtgcccgtttcggcagtcatgagaacctnagttgtgtctatgcctgttcacggactcactttgggtgaagtccagcgtcttcttcgccgacgatcganatcaaggcttncccttagtcgaagataagcacaccaaggntnttatcggctacatnggctgtataagagtt

SEQ ID NO: 3262 - DNA, 274 bp, Fusarium venenatum
  misc_feature (1)...(274): n = A,T,C or G
nggggggantcaanaaacttggggnaaaatccccccaaaatgnggnggaatttcggnanattttttngtcctgcnaaagangggctccaanaccgaagatncctngccacaaatccgggnggggggatttttatgntcagggcccnccntgcaggaatccgaatttcaccttttttgcatnggccagaccggtcctttggggggnctnttaccancagtttangnggggttttttattccaacctgccccaggnggggtaaaacatgctggccn

SEQ ID NO: 3263 - DNA, 211 bp, Fusarium venenatum
aaaaaacgcgccgatgaacgacaaggacactggcatcaaccgcttaaacagcaaatctctcggagtctagaggggcatgagaaatgcatcgcctctactccaaaccgatgagggcgctaaggaggggttacgtgaaaagccttgtgtattatgtacgaggctatgaaaaataaacaaaacccctttgagggccccatctgaatgatgtgct

SEQ ID NO: 3264 - DNA, 402 bp, Fusarium venenatum
  misc_feature (1)...(402): n = A,T,C or G
agcgcgatgaaaagactggtgacatttttcagaacaaaatcgagaaagacgcggcggacgcacacgaggctggaaacgcgatagttgctcaggccagcgatgccatggctaagtggctcgaaaaatatgaggatgacactcagagatggacaaaccaaactggcctcgaaggttggngtgatgcgacaaaagccaacaaggaaaagggcgccgtttgaaactggttagtgacgattggagaacaaaacatggggatgggggttaaggcgcctggtgtatcctattcgagatcaagaaggtgaagccaggttaaatgccgngtgctaagtgcaaggattaggagtaattggttttctctttattaataatcttttttttttttgnggaacaatattttnttta

SEQ ID NO: 3265 - DNA, 203 bp, Fusarium venenatum
  misc_feature (1)...(203): n = A,T,C or G
ncnccggacaaacggacaaccggaaacgggaattttaatcttaancaattatcaggggggcccactaccgcgggntttctggtnaanggtttttgggacgacaanggntggggaaatggaaagcttgggtggcaataacattttaaggnttgggnaagaatcttcaattcggttacaagaaaccttcaacaaacaggaaaaat

SEQ ID NO: 3266 - DNA, 184 bp, Fusarium venenatum
  misc_feature (1)...(184): n = A,T,C or G
ncttttattannaaacggggccnggantgggaaacggcgggcttctnaagggnaaaaancccggaatttggccgggccgacgtaaaaaanggatttngggttaaaaaaaaccttttggntaaaaaaaaaaatcaaggcgtgntccccnattgcaatttttttttcnaaaagtcngggttcccaa

SEQ ID NO: 3267 - DNA, 461 bp, Fusarium venenatum
  misc_feature (1)...(461): n = A,T,C or G
ntcaaacaattggnnaacgggtaaaaaaacggaacaaaggcttgatttcaaataacaaagcccaaataatggggggaggtnttnaattccttnaaacttttcctnttcaaggccctcttttnggggtgggggntttaactttcnttcggctttgggagcgnggtctttttctaaccctcaagnccttggnttcaactgggcggtcgggcgctccacaacccggaaccacttgncngatttccccttgaatcaacgtnctcgggttcgctgnatacttttagctcaaatgnaggctttctactacttcaccaagagaaacgtgcccaggatggcggcaganacaanggggcttngaatctactggacagnttaaacgacattacatttggncttncatgncctggtcctctccaacatcacaacctcacaggaatttttanctgntttgnggggggttggtt

SEQ ID NO: 3268 - DNA, 577 bp, Fusarium venenatum
  misc_feature (1)...(577): n = A,T,C or G
atcgaatacacaagggttcccatctggccaattctaggtctacgggaacgacttggtaaggctttgggtcaagagattgttggttctttcaacccagatgagatagagacttgggaaaaggatcccgagagacctggcggtgaaaagcgcaagcgggaggcctgtgtcaacagcagctttgaagaagagacaacggaggaaatgaccccaccaaagaagcgatgtctgaaagaaggcaagccggtgggcatggtgatgtgagagatgattacaagcgacgcatgatatgaatcggtattagatcccatttttggtgtttgggagcaacaggacacgcatacactatgatacattggtcgggcggcctatggaatttcatcaagactccatctngctccgaggcatacatggtagctggcaacggcgcaaaagggtactgggtaatgggcgaancattgggcttncctttgatgacgggntttatttgggggttgtaaganagcgngtagttatnatatggtgggatttggnctggaagggaatggttgaaacttgacaaatgccaaaatatncttgg

SEQ ID NO: 3269 - DNA, 335 bp, Fusarium venenatum
  misc_feature (1)...(335): n = A,T,C or G
atttgacagaaaatgacaagcgcagtctgcgtgctcttcttactcagatggacgccatgggaagccatattcgacagctccttggggaacctaatggcgtttccgctaccatgctaaatgaggacgccataccaagcatcctctcccctcaggactccgccattgctgagccactcgacaaggctacggcacttccagttactgaacctactcctcctncacctttgaccacgccgaagctccatggaccttgactgaacaacaggcatcantttggagaccaactntgcgctccgnaaganaaaatnggggntttaaaaattctgccanatggg

SEQ ID NO: 3270 - DNA, 133 bp, Fusarium venenatum
  misc_feature (1)...(133): n = A,T,C or G
naactggntanaagagactggaaccatagntttcctgntgtacgacattccaataaaacnatnaacggaatgctaggcttctncaagggtcattgggaacatgcagaggatgcccacngggataagcgaaacc

SEQ ID NO: 3271 - DNA, 269 bp, Fusarium venenatum
  misc_feature (1)...(269): n = A,T,C or G
ntaatgaanataacctnacaanagtcgcacttacgatgccaattgaaaaaaacgtcttngaaactgcacatggtgcttgataaggcaccagccttggatattaaccagtagtcaatctaatatccttcatgggtgggtgggtgantgattgcccatgtccgagcgctctatgacaaantggtgggctttnttgaccangtctgtgtgatttcatgggatcatagtggatatgcatgggtgatttggttattgnagtctattctgnatta

SEQ ID NO: 3272 - DNA, 402 bp, Fusarium venenatum
  misc_feature (1)...(402): n = A,T,C or G
tgctgagcagaaaacgagcgagcggtacatctcctgaagtccagtggagggagatttggaacattgttttcccagatgatgatgacggtgaagtccgaccttatgaatacactcctgttatcgaacactttgaagtagcagccaactaccagatggnctttgatcaacttcaaacttttccttgtngacaagatcttccaccctgccacgctcgaaaccctngtttacgaaattttaccaatgcttnggtngaactctggatcaattgcatangccaacgcgcaaagcatgccctaccaaacccgaagtaacaaaaagaacgaaatcnttagatccaagctncacaaaaacgtattgcagcgaaagagcagaaanatatgcccagaacctgatntgggggga

SEQ ID NO: 3273 - DNA, 195 bp, Fusarium venenatum
tccaacagaagatgacagacaagttcgctgctgtcatggacgagtaagacctgagcaagctgctggttatttctgtcttgaagctatagatgagtcatgttgtgggataggccggaacatggctggtattccattactgtttgcgccgccccgtagtctagtgtatgcatccaatatcaatttgttcgaaattcg

SEQ ID NO: 3274 - DNA, 588 bp, Fusarium venenatum
  misc_feature (1)...(588): n = A,T,C or G
ttacgcgacaaccggtgcgtggcaggatgaccagagcagttccaagctgcgaggtctgaagctcaccgattttcccagtgctgtagaacgccctagcttgccagttactccggccccggtccaccgaaattccttctttgcagatgacgacgccgaaaatgaagacgaaacaacgaaaaagcttcctgaagccgaaggcgttccgacgcagtccgactgggatccgatcgaacaactccagaaattggccaagcagcaatcggatgtattgcttaagagattgggtagtgatcaagaagtaggaggagtgtgttaagcccacagccgatgaaaggcgaaagatcagcaggcattttgcgcgatatgagcagtggccgtctcgaccccgagtcaactttaacctcgcaaccgtcaacgataccccaacccagttactccggaccggcgccgcatggganaaaggcgaanatacccgcagtacgaaacgcccttaccgcctaaggaagatgaattggatgccttaacgcctaggaaacaaccggacttcctcacaactctcccaatggtcaaaggtgtcggatctttatc

SEQ ID NO: 3275 - DNA, 966 bp, Fusarium venenatum
  misc_feature (1)...(966): n = A,T,C or G
cgcctgcaacataccctgagagctatcccagtttgacatcacaaacagctcagccagtgtacggggcaacaagctatggcgaactgcacccagagcatgaaaggctgtggcgctttgtcgcccaggtcatatctgatgaccactggatggatgctcgtgttgtgtttagaggttgtattgggcagcctcgtgaacattgtgaaganggtcgtggggaagaatcaggtgttgtggcgcataccaatgacagacgccggccaggcaccatgttctctcgaagcagccctttcagctccatgtttgcttcaatgctcccgttgatgatggcgccattggacgtgcagctgcgatgatgctcgaagcgctgcaccctgtgtcgtctagcttccggcgatatctgcgaaaggatcaacgggtcgggcccttttccttcggggattatcgcaactctttgactcactctttttctagcgtgtgggcaagaatggtcatgcggacagaatacggggactctacagtatcatttcaccacccctccccatggtcaattggagctagctgtctagggcccaaccatgacttggcgggtagatccgtcgagcgcaaagcagggatcacctgtcggcctatccaatcacgcgacaccaccaccaacagccatacgccacctacactacactatctcgagcttgtgcacgacgtttctaggcgtccttctactgcagcttctttgatgcttgagcttttctggtattgntggttacccatgacactttttgtcaccaagatgctactcccggtcacgtacggtatggtatagacttgcacctattttctatgncttctcttatctctacngncatgcgtttgntactgggtctacaacgaatagaagacttttggtttttttttttttttggtcaatgtttacagggatagaatggggattgaccttgacatgggttn

SEQ ID NO: 3276 - DNA, 228 bp, Fusarium venenatum
  misc_feature (1)...(228): n = A,T,C or G
gtgaacaacccagtatacgatgttgagaccgctaaagctctcttcacgcagctacctgaggaagaagccgctgntcttctagccacatacganttcactcatgctaacaagctcttttgcttcaacctgggcacganggnagcagaacaggcgccgagcagnctatnggcagntacctttttttangtnaaaccttttcaggacgcctaccttttaacnaaaggtact

SEQ ID NO: 3277 - DNA, 381 bp, Fusarium venenatum
  misc_feature (1)...(381): n = A,T,C or G
gaacgaaacccnactgttacnagtatcatcaatccttgcttcaacttnaacatcaggacattctcgactttnttttgtcctttgtcgctgtcaaccaaatccattaccccngaatcccttgacagnctctattttcgaccgccatcgtttcgccatggctggtcattgggcccttcgacaccctcaatcggagcaccatcntcgccttggtctntttgtcatcttctntatgggttccggacagcctctancgtcaaaacacggcgccaagcatagaatgatatccacgttgaactcgggatgacgatgtgagtngtggtggctacatgaacatgaaatgttcttgctcgaaaatcctcctgaatgaanaaaatattacgt

SEQ ID NO: 3278 - DNA, 435 bp, Fusarium venenatum
  misc_feature (1)...(435): n = A,T,C or G
ngtagcgcctccaacagcnaagatgatagggggtgctcgttgaccgtctacaaaaacatatccaggccnacctttcttaaaaaatcggcaaacgccaccccgctgattccaaaaggccaatctcgtgaactntntattgctttanacccgcatgcagntgntccganattgcacttactcctctgtcanatgggagacatgcgngatatgcgctgccgngtctcgctcaaacaacttgccangaggggatttcgngtgtacccggtgacgagtttgcatngtccgaggccgtttganctgctttatacctgggnncaggacccangaatgcttttgncttggatgaccagtntactggtnggttggatgtccaaaatgntgatcccacctgggancttgcttgttttggccttttggggcccaagcaaggttttt

SEQ ID NO: 3279 - DNA, 152 bp, Fusarium venenatum
  misc_feature (1)...(152): n = A,T,C or G
ncanggggaaggggaaggaatgggcatacaantctgacgacaaanttgaaacggccggcantttgtttnaaaaaggggggttctttgtaaaaaaangggaacanggcntgtgtaggcgtcaaggcagaanttttgtgatccggccatccaat

SEQ ID NO: 3280 - DNA, 175 bp, Fusarium venenatum
  misc_feature (1)...(175): n = A,T,C or G
ngcggaacccanatncttcttaaaanggttctcngctcgnttncaggggangaagagccccncgataacnatggaacanngcgggcgcggagcaaaaattgacnattnttgaggctngaaaaatngntggattgaanaaanaattgagttnaacaaantggaattcnatcgggaa

SEQ ID NO: 3281 - DNA, 464 bp, Fusarium venenatum
  misc_feature (1)...(464): n = A,T,C or G
cccaaaacccatagtggatctatttcgcttcatgtcgagaagacgagacgtctgagtagcgtcgcgtctgcgttggcggcattggaacctttcccgaatctagacgacccgtttgacgaagatccaactggcaggcaggctcgtcttataattactttagtgatattgagacagcggatgagtnccatcgaattgcgaccaggttggccaacaacgacaaacgccagtcgctacgtgggacctctccccttacacggtctcgcagttcactcagtcggcggctgaatgtgtcagcgcggtcactgtttacacnaanaaaggattctggtctgtctgctagctctagtcgacgtccctgaccgccaccaaccatcctacaaaggggcctactcgccttccattcctccctcaactgacgatgcaagcatggtatctccgcttcgcagcatgtttgaaattgaaga

SEQ ID NO: 3282 - DNA, 394 bp, Fusarium venenatum
  misc_feature (1)...(394): n = A,T,C or G
cgagtaatgagcgctgagcgccgattcaatcccgcggcaaagacgagctgtacgaatattcgatggttgggatcttcgagacatgactatgatcgtatggatataggacgaaacggcctgtgaaatggttgatcgatttgtacagtgtgaaggatttcgacagacgaaatcggcagcacttctcttgttattactttgatgttgtttgtactactttggaggggtttatttcttcttcatctctcttttctttttatttatttattacgttatggacggacctcatcatcttgaggccgaaagtaaatgcattgnattggaaggagtcnggggtcattacnggtggccagcgctgaaatacgattgtacatanaaaaaagcctgggcnggcaat

SEQ ID NO: 3283 - DNA, 238 bp, Fusarium venenatum
ggcttgttcgtgggtctgtggcatgtcaggggtaggttcttggcaaagagccgccccggggcctctccccacgttggctcacacaagatggtgatgggtgggattcccatatgtggaattggggaaaatgaccgagtctgctgctgctactgtatgatagaaaagccgtcgacgacgttgaagacacgcacatgctcaatcaaatccaaggacaaataataaagccaattttttttat

SEQ ID NO: 3284 - DNA, 364 bp, Fusarium venenatum
  misc_feature (1)...(364): n = A,T,C or G
aactactcgagtctcttggccacggtcgaggcggtgcaccacctcgcgtctaaggaaagaaatggatacctagtcttttaagatgtcgttgtttttagcaagctacatgcatatctggtttgatacctttggcgttttggaaaggtgtacgggactgttttcggaccatagagggtcccttgctattttcggaaagggggatcacacactgatatccctgtttgagcatttggactttgcctttttaggccgaggacgtattgntcaagtggcttcagcttggacactattacccccacttcggctnggaccctgcaganggcatncccaancttncgaaacccgggtttccccaaaaccnggg

SEQ ID NO: 3285 - DNA, 109 bp, Fusarium venenatum
  misc_feature (1)...(109): n = A,T,C or G
nnaactacaggctgttctcaangtcttgatnaccatttatggcanggnttacgagacantgattgtncttgttgccaccgcgaggatcagttctccgacgtaccattag

SEQ ID NO: 3286 - DNA, 566 bp, Fusarium venenatum
aaaaaaatggaaaatatctattttggcgatactttgcccatgccttgccagaccctgatctgtacaaggcctgaactcggtagtttggggcataagctatttcgttcctgacgtctctcaatgctgtcttgaatcttcccctcttcgtagtcaattactgttttttctttcgccagggtcaattcattttgttcattgaactcaaatctgccatcctccacatcgacatccttctcccttccacgcctctcttggtcttctctgtagaacggattagttgaaaactcagaagcaactacccataaatgccagcttggttctgggtcaagcattttgtaaatatccttataatcgcaggcaattgctgcagctgcgacttgccgtttcatctccggcacacgcttagcgagctcataaagaagattccaatccgggcgcaaaggccaccagatgatgtacggcatggggactccagtcggccagccattctcaaaaagcggagagatcgttgatcatgatgcgacgaagccattatggctcgctggatgtcccatgtgtatggggca

SEQ ID NO: 3287 - DNA, 134 bp, Fusarium venenatum
  misc_feature (1)...(134): n = A,T,C or G
ncatgtgcttgcacaagngggttccancacctngaangagccttgtgagcgngagatnggtaagaatgccnacgaactggtcatgcttttgatgactantgaccttgggtacctcgggatcnttncatcgtgaa

SEQ ID NO: 3288 - DNA, 502 bp, Fusarium venenatum
  misc_feature (1)...(502): n = A,T,C or G
actggttgtgccgtaatgaattatctttgttccgcagtttgggttcgaaatagcggcttctgacgcgagatccctcgcattgcccgtcattgtccaacattgtgttagtagcccgtcgacaccatcaactagctagcccagtcgctagagcctgacatcaccgagtcatctgctcaagacgaatatctctagatatcttgtccttcttcccccttgcatcgccgtacttcatcactcttatctcaggcgttgtttgctcaacttcaatcaccatggccgaagaaccgatgctcatgcgaatccccccagagatccgtatgctgatatacgaccatcttcttgacaatggcggaacaaaggacatttcaatccgtaaccaatcgagatccgagtatgatgcatgccgntcgaaacacaacggtcaacatncacataatggagccgaagtatcgtaagagggcgtncgaaacacgtntgngccatcccgaacacaccgngcatg

SEQ ID NO: 3289 - DNA, 380 bp, Fusarium venenatum
attcggtgcctgccactcaacactacagaggaaagcctgaggctcatggccgttttctcgccagaactcgctgatgtggaagtactccctgtggaacaatcagaagacagcgggtttcgctccgctcacatgcgattccgatcaatggaggcagcacagcaggccagaactatgctggatggccgtcccaacatttccaacagcgcccagatgattgtcgagatcaagtccgatacctctccattcgcgcagcgatattccactgatcctttaccggcgaacaactcgagttcaccggcttcggctgcgtcagcatcatctgcaattggaccaggtcaggcttcaagattcaacggtgggttccactcactcgagagcct

SEQ ID NO: 3290 - DNA, 220 bp, Fusarium venenatum
  misc_feature (1)...(220): n = A,T,C or G
actcaggcaagtagtacgcgcggtatggaacgaggctcgtctcccccgccgcccatgccggcacctcgtctacaaacaagcgtggaaaacatacctctcaacaccatgtcgaacggccgnncatctatgtcancagaccggcagcgccgtgagcgangcttatttantgaccanccaaggggccaaaaagncnaaaggccgcttggatgancnagaaggg

SEQ ID NO: 3291 - DNA, 302 bp, Fusarium venenatum
  misc_feature (1)...(302): n = A,T,C or G
gctccattcccgagtcgacacatactgtgcattttactacaccaagcactcttaattttcccattccacgctactgccaatcatttatcataaagtgtcatctgccgacaggctcttgacctctcacttggcccttacaaatccgtttctaaggttgttctgtcacttgggactttcccacgaacagatagtgatgggcctcattgtggcacacatcggcttctcttgcatgagcaccatcttgataaagacatactgnactaccattaatacaattataaaggctgcncgcctcccccant

SEQ ID NO: 3292 - DNA, 442 bp, Fusarium venenatum
ccaacgtgttcacgacagcctccactggtcttgctattgccctcaatgttagtcttggtggcggaatcggtcagatccctggtgtgtggatttaccagacgtcagaacgacaaggcgggtttacaacagggcattgggtcaatgctgcattgctcctctttgtagctgtgatggccttaggcctaagactgttttatggttggaagaaccggcagttgagggagtacgctgaagcgcacggggtgccttatcgttgttacaagttgtaggaagcgagtgtttgcatattttgtttgttgcgatgtcgtttaatgagttcgatatccatacacattagcgctatggggctgtgctagcaagacgcatagcggaaaccccagtacttcaagagctgtgtttcagacatacatacagttgtgtatatacgccgatgttacttgtc

SEQ ID NO: 3293 - DNA, 1014 bp, Fusarium venenatum
  misc_feature (1)...(1014): n = A,T,C or G
gtcgcattcttttcccgctcttccatccgacgctgcatctttctgcttattgcatggcaactaggtacagtgagtgaagtgataagcaagctcctgtttccaacccctcctcctcggccgcctcgctttgacttccccggaagcaatctatcctatcacggctttgggacatgtcgacgtttctcatccgagagcggcatccataggctctatctttatgtgtgtagcacattcggtacttcaagtcgtcaactactatagtagtcgctcacctctttggcccttttgtttcttctttttatttctcttattcttcatcatccatcttctgtaaccactaattccatcatcaacgactgccatcatcactctggacaaacatccatgggattcttgtagtcatgcactactagtctcgtctctgtaaaatcaccatcaatcaaaaatggccttcttcaatcccgtctacgctttcgttgngcccttccttttcgtcgncaccgttcctcttgctgtcttcgctggcatcacaactaccattgccttctctgttcttgttctcagggtgctgtctgtctatctcgacgtagctttatccattgnaccgcattattngggtggacgaaaaattcggccttaccgtcctaataatcattacattcgtcaaccacacctngaaactccaggttcttctgcactttacaccaacccatcagcttcatcggccgggtcaacggccttcgaatcatccttacnaagacgtcgtcatcgtaggagctccagtgctctatctacagctggttctaccaccccaattagcgaaaaggcattcggcttgctccctaacattggccctgagcgaaaatttttgaaggtnttggcgggtnggccactaagggggtgatgacnagacatggaccacaatcaactcaaggctcgaatggcccganaaacaacacccatnggacgtaatcatcaccggtccccgggaggcccacaacacccctggagagg

SEQ ID NO: 3294 - DNA, 603 bp, Fusarium venenatum
  misc_feature (1)...(603): n = A,T,C or G
cgggtagcacattcgtctcttcttagtacactcttttaccataactgtatcaccttctcttttcattcctttttttttctaattatccctgtgcttgccacgaggatatatcctttcgcttatataccgtttcttagtatcgagttgcaggaaacaactcgacgactcgactccgtcctgtcttttcgaggcctacagtccgggccaccatcgcttacttgcgcgctcttttatccgagagagccccatcctaagcgcccttggagaagcagtcgccatcaatatgagattgccttgggccagtcaggccgcaatctatggcctcttgtctggtgctgtcgcggacgtgttaccggtggacgacatcccgttgatgtgtgtgaccatctgcggccaaatcgtcgaattgacatcaaaatgtgatattcatggtcaacgcatgtcgaaccgacaagtagattcggagtgggttcctaagctggccgtggaacctncttcgctgggcaagagaagcttttcaatcatcagagctgcgcctacatcattcccttccgagttcactcctgaagagagtccaccacatcgctatcgagttggactacg

SEQ ID NO: 3295 - DNA, 290 bp, Fusarium venenatum
  misc_feature (1)...(290): n = A,T,C or G
tacatattgcccaaggagcggtaaggtcgactaggatcacattgtttcgcacgcccccacgacatatgataacgtttcgactatttacagctacgtattgggcatctaccacgagccgaacatatgcgcaggacaactagacagggtcgtccatacagaagatttttgcaagtgcaaaatttgngcttttgctcatgaatttcccaccggggcaaaatagcttccctatatcgaanaggggcctgcggctgaaaaaaaccntggancaaaaacatttaggccggccaagt

SEQ ID NO: 3296 - DNA, 506 bp, Fusarium venenatum
  misc_feature (1)...(506): n = A,T,C or G
ccgggagaagtcataccatgacacgatatggaacttgactgcgaggcccaagaagagcatcaggcccgactgagcctatgtcagaacaggtgtttttgacgtctccgataatactggaattcgataggggtagcgaagggataagaggcccatgatgagatatctatgacttgacgctttcacgattatgatttggtgtgccatgttagggacgtacgagttgctaactgagtggcaaataccacatgggagtctggagcttgtccaacatttctgagggagttgaagtgctaatcaggcgacagacccaacaaaagacaattgcttgaccaggtttggccatggcaaggatatttatggttggtttgcgtangggtcaaagcatatggaagatgtatagtacggaaaaaggagtccaccaaanggaatnttcaaccaacctaccggtagctgancacctacttaaatattggttgagatatcaaattcctgatgaagcaaacgtc

SEQ ID NO: 3297 - DNA, 254 bp, Fusarium venenatum
aagaaaataaaattgcggctgttgtcgccgtcttccatctcttgatgaggttgtgctttcggccgctggtctcaatcgctcagcgagtgataactgaccacgcgataccaggacttggccgactgtgcgttgttggtacatgttccgggaaggtttcgattctgccattgttcccggatgtcttttgattatatagaaaaaagtgtttgaatatgaattagtcatcccttttgggatgttttccaaaaaaaaaa

SEQ ID NO: 3298 - DNA, 149 bp, Fusarium venenatum
  misc_feature (1)...(149): n = A,T,C or G
ntcaagcatntaanggtttctngaaggcntttgaaaccaaaataaaaaganccccntgtgttggnagaatttagggcagcataaggctttggaaaantcanccccccttggnaaaggtnttncctggntaaaatgggaaananaggcgt

SEQ ID NO: 3299 - DNA, 408 bp, Fusarium venenatum
  misc_feature (1)...(408): n = A,T,C or G
acccgctgaacttaagcatatcaataagcggaggaaaagaaaccaacagggcaatncaaggccagtggcggncgtngacgaaaggctngaacgagttgagagcaatggcaacatatatctgcgcatagtctancgtccattntccnagtattcgggtaccaacgcctgctttgatcttnttttgcccagtcctggtccccnggtttatgcatcagttggtcaatattcgccatgatttcacttgctgaagaagaaacgtaagtgacaataaaagccttgctgaacctagctaggctcncagtcactgtgtgcttacagctgatctttggagcttacgtnaagtcttttggcaangtacggagtgtacgatgggtnttgctntcgcattctctggtttgncntttgcat

SEQ ID NO: 3300 - DNA, 144 bp, Fusarium venenatum
  misc_feature (1)...(144): n = A,T,C or G
naggtagnctgtcatgccacttcncacagggcaaaatggnaatctttccgganganatgagngcagaggccctagnccttttangaaanaagnggctccctaattnggaagtaatgtgctanttncttgcaaanctgtttaann

SEQ ID NO: 3301 - DNA, 606 bp, Fusarium venenatum
  misc_feature (1)...(606): n = A,T,C or G
ccgncttgccacaatctcaaatgaagtctgcattgacccaccagggaacttcaccggatgagaccgagatagtaacgacgacaggtgggctaaaagtgaacctttacaatgctcagatgcagctatctagcatccgaggctcgatctatcgagagatcaatccaaacaagccatcaccaactggcaccacgaaatccatctcgagtctgatagagaagctcgaaagctggcagaccgagtttgcaccggcacttgatggtaaatctacacaaacctacgaacatcatggnttaatccgtttgnatcttgcatactgncacactctcatcatcgtaatcgtcgcatagcttcaaatattgggcatacccgaactcatgaacacatcggcctggcttcaaccatacatcttncatcgagaattgnatacgccctnacgttgcattattgagttgccaaagcttgttcagataagnggaagagattcattgggacctattcaccctcttgagtcttgtgggnatatcataatgnatcacaatntgggttagggtccaacgntgttttgtngggnagggccaatntagattnagaggtgccatcgncnca

SEQ ID NO: 3302 - DNA, 605 bp, Fusarium venenatum
  misc_feature (1)...(605): n = A,T,C or G
nccaatttttgcgncgcgnacgtacgttccgaggagctggaaagcgttgatcaaaagctgntacagtggtatgaacagatccccgaagaggtaaaagttcgtaactgggacaaagggaagcacatcacgtcaacaccgtcgtataacctccaacggttgcgaatctggacatatctgccttggatcaaaatgcgaatttggtttacacgcctgttctttatagccgccacaagcattgngggacaccctgcacaagtcagagcgtggtgtcgacattggccaaagatctatccctatctcagccattttgaacaacacaacaaacctatacangcgtgtgcaggtcttctaccatcagttncttacatcaactatcggccgtcgtcttnctcgctttcgttcacgccccaatnccggttcaatgctaattgccgcgangaagttctatatggnttttggagcttggtgaaggatctnttccgntaagagttgggncttacaacgggtgnggcggacaattagatcggttaaaagacgtnggcaccccgatttggattgaaccttgaggaccaatccgaagtcaacaacttnatttgggaatgata

SEQ ID NO: 3303 - DNA, 171 bp, Fusarium venenatum
  misc_feature (1)...(171): n = A,T,C or G
ntctnctgatgggtaacaacnttgatgagggcactgtctactgaaagaagggcataaacactacagancagtnacaaanttgganctatancctctgcctcnataangatgctgtgggtactgctancgagctctaccccgactaccctganaaaggnattccnacctatt

SEQ ID NO: 3304 - DNA, 573 bp, Fusarium venenatum
  misc_feature (1)...(573): n = A,T,C or G
cttactttggtgccaccacaaaccttttcccctcttccatatcataagtacctatcttcgggggagcaacctaccgtcttgcgtcgtataaacaaccagtatttcttctctcttccacactcccgccagccatattctgcgtctctacatgcttggtcgatcgcttcgtctttcaaatattacaaacgaattaacgacaagcatcattttatcgcttggtacaatctgtctagtcaaataaactaaacaccatggctcgaatcaaaccatcaacgcgttngcaaataattcgtcaaattggccntctacatacttgaactttaacnggctgtttaccccnttttnccaccccccttaccctaaaatgcctaaaaaaattttttgaaccccccnacctgggtgggccccagncccaaacctgcgccccgccgaaaaaantgagcgaancccttaaaaaaaatcnaaaaggaaacttncctcnctgnccccaaaaaaaaangaaccaaacctttgaaccccgnttttctttccncccaaaaagggcccngaaaattccttaaaaaaccaaaccgg

SEQ ID NO: 3305 - DNA, 641 bp, Fusarium venenatum
  misc_feature (1)...(641): n = A,T,C or G
gaaagcatcaactgatcaatgcttgccagctcttacaagccccaaacatatgtagacgtggccgtcgcattttcctctttgagcgtgcagtgctacaaatatctcttgacacctctcttaacgtcagggtttcttcttgtctcaggtcagacccattctcagggcaagaagcatcaatccaccaaagacaatattctatgtcgtattgcattactttccccacaacacttacagaacgatgagacagcaatatgaatcgatatcaatggaaaactggccctctagcaaccgtaggtcacgaccctcagctattagttgcaagtatcctgaaatggcctataagctggaggctgcgtctatcaaatatacctcggcttggttcgagggctgggcgggtactatcctcagctgggccttgatcgtactgntcgctctntttcaaggtgggcattttcgncatangaatgggtatgatctacacgagccatgcttggtatcgatgagaagcaagttaanatttnggccnttacaaaaactcccggtttccgggaatgnggccaatacctcaacctggacaaggnggaaatgnaccttactacangggaaaaggcgcttnaacgggtattcgaccccccgnntca

SEQ ID NO: 3306 - DNA, 541 bp, Fusarium venenatum
  misc_feature (1)...(541): n = A,T,C or G
ggacacgatgaaattccatacttgtacctgtttttggatgtgaagcttactgagatctaatagattttgagtacctccagtccacataatgagccaacagcagtcctcacagtctctttcgggagctgatcgcatcagggctctcaaggatgacgatgcaatattcactgcttttgatacatatccatggaccaaggacaaaagcttcatgtcaggcctttgctccatccttggtgaacctggtcagcaagaccccgaagcctctctctcagatatggctatccacgctcgcatattctattatgcacagcgcattggtgtcaacatcgactttggtcctataaaagctggttgacaatcaaaacaaactaccagcccccatatgtcttgccagaggaataccgcaacgtacagangccaatggcacctaagcttaagccttgactgcagaaggctgaccaaagntgaccttatnngccgaaagccgtgaagttattactagaagacagctaatatccatgggttgccaatgacaacttca

SEQ ID NO: 3307 - DNA, 957 bp, Fusarium venenatum
  misc_feature (1)...(957): n = A,T,C or G
gtcgaagtcttccaagagctctaggaggtctaagaagatgccgaagcatgttgcctatggtagtattgatgaggacctgcgacccatttaccccccttcaacagcgacgagaacgacaacgtataatcagcacagccagaatggtagcgactcaactaattatacggcgcaccgtatttcgctagatgtacccatgcaagctcgccttcgattgaccgtgcccggncttcgtacgatcgaatgagggcctcgatggaccgtgtcagacccagcttcgaggctagcaatgacttcacatcagcagcgcggctatcacgaatcgagtcgagtcaatcacaggcagggacgcttccatcctcgcctcagagggctttcactgaccaagagtgccaacatataagagatggatgatgattcacacaactacttggtccttcctgtatactcctcaaccatggctgatgacacggatctccttttcagtttctgagctttgtttctcttcgccttttattgcttttgatatcccaggcctttacggggccagtgatgcacgtacgatctgcatgagcgatctgtcagctgctccccccggtctttgtccgtttgttcatgcgctgaagcacgcaacgaaggcaacgaggtcgaaattagttcttttttcttgatcctcccacgctttacgctgggaggtttgctttacatacgcagggcgttataaaggggaaacgcaaaangagggttttgcttttttttgtatgaaactgttttttggtggctttccagtactnatcacttttagtcnttatttcctccgccgaaaaattttttttccacccttttccttttttttttagcantctttagaactnggagaagcngggnaaacatttccttgacgaaaaattattttattattgcntggaaaggngttgaaaangggaaaaaaaacgggcc

SEQ ID NO: 3308 - DNA, 174 bp, Fusarium venenatum
  misc_feature (1)...(174): n = A,T,C or G
naccntgtttnaccaagtnaacggggacgggagccccgttnagtctttgnttttatccagatntcttcactatcntttataagcgacggcgtcacactttaagtcaacgaactcggcagcgttcattaganttagtgacgccgctacaaactttgntggtccgtcgttcctatt

SEQ ID NO: 3309 - DNA, 628 bp, Fusarium venenatum
  misc_feature (1)...(628): n = A,T,C or G
aatggctccaggatgccccacaaggtaaaacgcatgcatctcacgaggacgaaatagagtctcgatcagagtctgagtatggcgacgacattaactctggctcagaatcagaagcagaagcagaacccatgtttttgaagcatttcaagagcttggagcatgagccagtgacaaatgcaagtgggtgtgaagaagaagagcacagcagcagcggcagcggcgatgtgaacgatgacaaagccaatcaacggacaagtctccgcacacaagttgagcacgacattgaacaaactggagattggactataaaagccgatactagcgcagttacccccactacaacaccgacaatgacgcctacggattttgatctccgagagggaaaaactcgaattagggtcccagaccgtcggcagccgcagcagattgcatcaataagcatgcctgtgccgcagatggttactgnttattgatggacatggccaagcttcactgcgcancaatcagagtcctaattcttctcatgcggttgaagagccttnnttgcagggagtcaagtccgtgggnttcaaggcanggnacccttanggctgggctttggtccgttttggggggtccattcaattnn

SEQ ID NO: 3310 - DNA, 552 bp, Fusarium venenatum
  misc_feature (1)...(552): n = A,T,C or G
nattgtgatgcagcnacatggcgctttggtagtcggtnattgaccaccttcgtttggggccttnatnattcttntctnttggtggagntctgnattccnttnggatggttcttttngggtattcantgttgataagtaagtcttgccaaggttagacctttattaagaaggaccattngtgggcttgtaaggtggtgtcccggcgggaaaagaacgaaggttcttgcttacgacaaantttggtnttaaaaggctttntggaatgaaggaaaattttccaattggacnaccccaacgaaccaanaagggtngcaagtcaacgtcccccgttttctancctcgatgtccccttaacctggccacaacgggnaanaagcttttcttgccacattttatttttgattancgcaccccatacataattaactaccttttgggggactntnaaaccacataacttagatttccgtaaaatgccgnnaaaacactacacaggccgcnatataanttcttttttaccccctttnccaanttacaagggaaacnacactt

SEQ ID NO: 3311 - DNA, 328 bp, Fusarium venenatum
cgaagaacttttgaactcgggtcactttgcgaaagtacctttactcattggttcgacaagaaatgaaggaacatccctattacagcaaatgttggggatgacgggcgcatttgacactgaggagcacttgagatcgtttatccagacttcttggtcaagaggcccaattaatgctacagtcgcccaacattgggcacaattgtacgctcaagaaattgagaccccttcgacagcaggtccaggtaccgtgaaggtaaatcccggtccagagtacggtagctattatgggccggcaactttggtggctgggcgattttgatattcactg

SEQ ID NO: 3312 - DNA, 538 bp, Fusarium venenatum
  misc_feature (1)...(538): n = A,T,C or G
ntcagtaactatgtcggttgaagtntttacggacgtggtggggtngcactttcaaccaaaagaaccccgattntgtgaccggcgaaggccgtcccacttgcantggttggaagcatggngatggccatancatgcaagtcgtggaaggtgcttgcaatttttggaaaacgtanggcccncttctaccgagagnaaaggaccaggacattattccaaaaattggcgatccgaccgaanccaaaacggccgagantaccattctggccggggaggcgcttggcatgcttaaggtcggaacccanagaggaatccgaaangaaaaaaacccctggccaaaattctgtggtntggctgacaagcttaagtcaactttttggtacaagaagtanaacctngatccgaactgangaaaacaaatttggagtccactgaggaggaatgtattttgtttgattccagcanggcggtgtgatttnggtttttcaaaaatncccaactntntcgttattctttgcaaataatagatgggttttntttg

SEQ ID NO: 3313 - DNA, 633 bp, Fusarium venenatum
  misc_feature (1)...(633): n = A,T,C or G
gcgcatgtcgcaatcgcgcaccgctctcgatgacagtgaatactctacaaggttcaatcgactcaatggtgccatcaacaacctctctttcaacattcgtaaagattggcggtgtgtgccccagtggcttgacaagtatgttagcgcagaggcactcaagaccggaaaggctgagatgacggctgtcggacgagcagtaatctcacggtggttaatggaggaggtgttcaacaagtgctttcatccgggtctggacacgcactaagtcagtcgctcaaagagattgagcttggcattcgaacaactcatacaccctgctagccaggaagaatttgatgcattgacnagcaaaatcgtgagctggcgaatgacgttctttgacggttttnattgtaaattaacttgcccaaaagcgattganaaccgtaaaagtttttttgccaaaanaacaattaatttgacggcttgttttaccaattttttaaannaaccacacccgcccgggggnggacgggacccattnaataatccgngggacnttggttggggcatttgnaanttaacctttcccttaaaaagggcggaanggggtttnttttttancccctgccttggaaaaattngncccccctt

SEQ ID NO: 3314 - DNA, 205 bp, Fusarium venenatum
  misc_feature (1)...(205): n = A,T,C or G
ncncgctttccttcaganctctnaaggcngggngggtggcncccctatggttgntggatatgatgggcgttgctggtgtcgcaaggtgtccttgctggtatggggtctttaattgactgtctnggagcatgtaccatgatcttagccgagangccgtttaccncaacccccttcaattctatataataaaacttttttgnctttt

SEQ ID NO: 3315 - DNA, 612 bp, Fusarium venenatum
  misc_feature (1)...(612): n = A,T,C or G
gtgaatattcaacttcgaattcaccattctttcacttccgtgaaagactatattccacttcttctctctcgtttcgtgtttctcacatacgcttctttttgtggaagcttataatctgtcctgtttgtaaaggacagatatagctacctagcttagtagctaccatggcgctcactcgcaagagcgtcgtttgctcggctttctgtcttgctcttcttgtcggtctcgtatacgccggccatggccatgatcaccaccatgcagaggctattgccggtgtcaacaccgataacatgagcctcgacgaacttgatactcaactccagacttgcctattgccagcagctcaactcaccaagcatgcccatcatgccgccgttcttcgtcgttaccgnacgtgccttcgctgnccttttcctaagttttctgccgcaacgctntcttgcgacctttacatctnggcccttccaacttctcttggcctttggccgacaacattgacctgnttctctatcngnatggtgnattgctggtggaggcttnncggggaacttngtcattggntcttgaattttgtggngaaaacnttacccggttncaagtttggctctt

SEQ ID NO: 3316 - DNA, 520 bp, Fusarium venenatum
  misc_feature (1)...(520): n = A,T,C or G
ggtctaacttgagtgtcttctccaccaaaacttcaagcttccatcccattcattacaattaactgagctcatggcttaaatgcagctttgtcatcatcagaaacaattcattgttcaatcgaccgaaatacaaccttacaaaccccgctcatcataaacccaatatctcgaataacgcgctgtatacccgaacaaaactttaaaaacattcaatacccctcgactcccgctcccctgacacgtctagcttcagcatcatgcgacacacatgatataacccacaatgtggttaccgacgccgtcgtcgagagcataacacggccacggttagctgtggccgtagtctctgcagtggctgcgctctcagcaggatactatgcataccaaagtccgatcgcagagctttngaaacactggcaggtggtggtctgcataggagcaatgcnntacgacgtcacnacgganccgcgaaacnaggatggatcaaagttatcggctgaacttgcagtgatgaaaatgt

SEQ ID NO: 3317 - DNA, 124 bp, Fusarium venenatum
  misc_feature (1)...(124): n = A,T,C or G
naaaacgaaagtgntttggtgcgggggaatcantttgaaaggtttttccaanaaaaaaaccccaatngaaatgttgggacntnaacccttggattttcgtcaaanaaaaggaaattttttcctg

SEQ ID NO: 3318 - DNA, 591 bp, Fusarium venenatum
  misc_feature (1)...(591): n = A,T,C or G
ctggaagccaatcggttttgttccacactgtcctcgatgctcggctttcatcgtcacttcagactgatgttctcgcggctggcgtgggtgagaatctcatggtgcgaataaagcccgtgaaacggacaacctgatacctggcatcaaatcccgggccaggctcatggggtacaaangaagcatcggagacgtcacagcagtatctgtcatagagtatgatgaggtaccaggcgttgttgtcnggaganccaatggagatatccagatactatctggcaaggataactttacatctgtttcacgacaactgaagggaacagatgggtcactaagagatagtctttctgacatgaagaagtcgccgggccaaacttcagtctcatccttgcagtggcaaccagaagcgaatcgtctcgcaagcggaaaangctctaccctcatgctctacgatctctcggcatcggacgaccaggattgactcccatagagtctacgacttctcaaagacaatcccgatgatgaagcatcgttcctacnaacaccaaattcatgancaaanattcttgcttgcgcttgggtgcaacanaaacc

SEQ ID NO: 3319 - DNA, 182 bp, Fusarium venenatum
  misc_feature (1)...(182): n = A,T,C or G
naaaactcccggnaactttaccccgggggggcatttttggggaanaaanctgggcccanaanaccccccaanttggccagggggcccggcttccttttttgggggaaaaaagggtttttttccccccccccaaaatannttcaaaaaccccctttacctgtgttttgggggaaataaaattt

SEQ ID NO: 3320 - DNA, 668 bp, Fusarium venenatum
  misc_feature (1)...(668): n = A,T,C or G
aatcaaactattctaacattccatcaatttgaatccgtgcaacccattttcccttcgtccttccaaccataagcaatactacatcacgtctagtcgacccaaccatcaaataacagataccttcaacttccctcaataacaacatcaacatgcccgtccgcgttcccagacttcctgctgccaagccctcagagatcttctgcatgggtgcggccggtgttggcgttttgacacctttgtacctcgtcatgcctggcgccgaggaacgcctatctaaccagaccaacaagtgggctccacgatgggagaggaatctcagctacttcatccctcccatggagaagggtgttcagcgcatcgagcctccggtatccaagatggtccagcgtgttgaggaccgcctcccccttgagaagatggcaaagtccgttgataagggtatccgaagtggcatcgcccgattcaatggcgagaacaagccataagaacatatttctactgtcaatttcgtcatgcctgtggctttgaccatgaccctgccaacaacttactgctaggcatgcgtctttcttttgtaaatatcatagcataccctgggtacggatagataacttattgtcgcatcggnccatatatggatggaatgaatttttatttcttttccttgg

SEQ ID NO: 3321 - DNA, 558 bp, Fusarium venenatum
  misc_feature (1)...(558): n = A,T,C or G
gaattttttttttttttttttggccganggggaangtnatttttgggatcatagganccaaaagcctttttgggatctaacatgaatgacgatgcaaaataactttgatgtccaagataaccaaaatctgggccaagtcttcattcccatgactttatccacatcaattgcgcctgacttctaaacattgtcgcttatgtatattcaatcattccacccgccttctgtagatagggaatccttacaccccttgaacccccgnggtgccntttttagtcaangaggatgggtgncgatattttaaaactcatattttggtggaattgaataacctgatctnggcattaacttgagaagtaaaancttggtcgnggcngggctgtaccaccgngagaaccggcatagggaggatcctttgtcgntgaccgtgaaaaggggctaatgtttnggcaaaacctttnggcttgggcntancaccacgttacgggggaagttaaggggaggttnanctgaggttaatgacggcattgggttcactaagcaaaattttgtggatcc

SEQ ID NO: 3322 - DNA, 189 bp, Fusarium venenatum
  misc_feature (1)...(189): n = A,T,C or G
ncttcataacaaggggccaaggggggaattgntaaccccaaaatccaagaaaaaaaagttgggcnaagggggggnggaattcccaactnttgangggattttttttngggtgggggattaatgantttnccaaattnttttnagggttaataaaaaanattttcattttggantccccnggggggaagg

SEQ ID NO: 3323 - DNA, 238 bp, Fusarium venenatum
  misc_feature (1)...(238): n = A,T,C or G
nttgacaagaaggcacccttttccaaaatgggaaggcgtaaccaacttgccaagganaaggtccgttcgttggngtnttcaacttnaaccagganaagcttgacnaatattaaggncttggggtancccccncattaaccaaaatgagcggtancctttgttttcttaaacccnaactttttaaagtncctccagganaaaggggntcctttttactgcctaattccgntttngggaa

SEQ ID NO: 3324 - DNA, 522 bp, Fusarium venenatum
  misc_feature (1)...(522): n = A,T,C or G
gtgcttcttggcgatgatccctgtccagctgggtatggagactcgaattaggttctgatgcgacgtcatttgcaggccagccatagacgactgtcgttggcctcctatctcccttgatcatcatgaaccctgaaaggagggacccagttcaagatggagaacatcccaatagacgcaataccaagagccgctgaaatgtcgtcgttgtagcatgattcgtctactttaacgcggacacgccgatacttcaagatggattgtcacagaatgtcttgctgcactacgacaaccgggtccgctactgcagtgcagatagagtgtggccagttagtatcgctcccgatggtttcgtcaaagttcngatcgatgcgtatagctggtacgcattttaattggtttgcaggtttcaaaatcatctgcgggttcaacgacacaaatgcagtactggttggtgatcgattcgatgctnacttcaaaacccatatttgcaacaaatcggttgcatcgatgaattggtattcg

SEQ ID NO: 3325 - DNA, 132 bp, Fusarium venenatum
  misc_feature (1)...(132): n = A,T,C or G
ntaaancttaaacnaaacaaattgtttttgggagnattttggcccnccccgaatttnttttttttttaaacccaaanaagaagggttttnggcttaaaaaaaaaaggncttgggcaaaggggnttttttttt

SEQ ID NO: 3326 - DNA, 103 bp, Fusarium venenatum
  misc_feature (1)...(103): n = A,T,C or G
nactantgggtagcatcactactgtggngctcatgattacnctacctanacgggttnaccntcctncaatgacactcctggatgatcannctttcgcctaata

SEQ ID NO: 3327 - DNA, 295 bp, Fusarium venenatum
  misc_feature (1)...(295): n = A,T,C or G
gattngccattgagcaaaagaaaggaacttatncaacagagcagcttgagcccntnaaactcgacaccatntcttcaacgcctcantggtagtagcaacttnaacagcttnaacacttcanaggcgctcttgaactctcatcaaccccaacgcgtgtcgaccctccccacttgtgctgcccgngagaatgcacttgncaacttgcgacagtcagttcaacangagttacgcgcgggcacgcccgttattagtacctncggtcngggagaaccccattactcngcatgtctttttg

SEQ ID NO: 3328 - DNA, 134 bp, Fusarium venenatum
  misc_feature (1)...(134): n = A,T,C or G
ntgaaagnaatgttacncangcggacccnaaaagancggttanttgagganatcnaggacnatgnggctaaacctggttctntaccgaacattgcggangcntgatgangcttgggcaaggcntgtttttgaaa

SEQ ID NO: 3329 - DNA, 122 bp, Fusarium venenatum
  misc_feature (1)...(122): n = A,T,C or G
nacattctgggncngttttatctggtccctttnanccagctanaaaaactttattttacgggatttcntggccaagcccttacaaanccaaacttggcccaaaatcccacaataacaaatac

SEQ ID NO: 3330 - DNA, 591 bp, Fusarium venenatum
cgcggccacggctacatataggagattatattttttatctggcggcttgcacgttgacaatcaggcggttgcagtatcaacaacttatatcttcgcgttccacgactctgaaccagaaccccacaaacctcactcttgtaacattcctgtagccatatttctacttcactttaccagtgaacagtctgggatatagcttgcattgatcctaatgccaaggcaggaataacaacattacagtggaccgggaatcatgtgctaccagacgattcatacgccaaaacctggttggtcaagacgatacagatgcccagagagtcaattttctgagtcttgacgtggtttcacagttcaatgatcaaccaagccgcaacccatctatcaagtaatctacagagaagaacaggtcgagtctgtttgttagcaagtcggattggccagccgcaagttaatcaagcacacaatatgatacatctctgtctacaggcacggtctctcaaagccaagcggggagcatcgttaaagatgcgggaatttatcttcgtccaacagttatcaagaacattgggacttttgatccatccattatcg

SEQ ID NO: 3331 - DNA, 104 bp, Fusarium venenatum
  misc_feature (1)...(104): n = A,T,C or G
ngccanatcggtnacactatggangtccagaaaggcttggaagtcctcgacggtgctgtctgancccagggcgctgaaggtggnnggccaaaccagacaattac

SEQ ID NO: 3332 - DNA, 154 bp, Fusarium venenatum
  misc_feature (1)...(154): n = A,T,C or G
ctgagtaagattcaaaaacctatgcacgatagccaaaggaaacggccggtaattaggagaaggttggattagcgattggggaggcagggtgctttgtatatacttgaagcaagcgatagatacctgtatcttatgacttttaactgtttttgtn

SEQ ID NO: 3333 - DNA, 316 bp, Fusarium venenatum
  misc_feature (1)...(316): n = A,T,C or G
caacacatctaccacaacggccgtctgatctcggatgatacgcaaacaatggagcagctacagattgccgatggggagatgttggccctgcatgttcgagatatgagaggcagcaccggtgtaccggaacaagctcgacgccctcaaccgaggagacaggccagaaacgaacaggatcctgaactcattcgnctccagatccttggtcagcctgctnttgaggcagcagcttnagtcccaacaccccgagctgggtttcggaagttgatgatcccgcccggtttgcaaanatntttctttgacagccanaattagg

SEQ ID NO: 3334 - DNA, 372 bp, Fusarium venenatum
  misc_feature (1)...(372): n = A,T,C or G
ctaagctgatggtcgtttgggaagtcaagccgagcgaatgactgctaaagctttcaaagatgttggcgtcttgagtgggggttagttcagcccgttgtctacttgagtgagacaactccatcagcaagctcgcgatacagtcaaatgcttcgactgccagcttggatcgcatttatagcaagatacagtattctatctcctcagaatctttattattattggttgatctctcaacccccgcaaaatgacgacactggtagacgctnttncgacagaccctcaggtcgattgnganacccttgtttgcttaangggactaacccaagccctttntttttacaacattgacttggnttgncctggaccacaatc

SEQ ID NO: 3335 - DNA, 347 bp, Fusarium venenatum
  misc_feature (1)...(347): n = A,T,C or G
cggataaggatgctttgcctacacatctcgctgagctcatcgacatacacaaagcatttgtcaagactatcatgatccaacttgcccataacggaaagaactctcctatcgacattcgcgcgctcgctccccacatctcacagtcctgggggaaacgccaggtcactatcgaggacattcgtcgctgtatcgccattcaaagttcagccaagtcaatgctcattcgccattcatgattacagactatgggcggggaaaganctgcgtaaacgctnttntgccgatatggccctatcaacgaaaaacggtttttggggnagtttggcnttaacctacaaacattgggc

SEQ ID NO: 3336 - DNA, 287 bp, Fusarium venenatum
  misc_feature (1)...(287): n = A,T,C or G
cttcaaccaacccagcaggcagagtaatacagccatcaccatgtcaaacgctcagcttttactacatatcgcttaatccgctgggcaactgacctggcaattcacgatatgacaagctgagcttggtataaaagataaaaaagatttagcttcttatattggggtattggngaggtcataattcgggcggataaanaaaccaantgctgtaacgttganctttnaaaaatggccttngnttgaattattttngctggtngggggcntggcccttggttttaaggccc

SEQ ID NO: 3337 - DNA, 278 bp, Fusarium venenatum
  misc_feature (1)...(278): n = A,T,C or G
ctttaacggcctccaccaactcttccatgccaccgaccgatgttgggccactcatgccctctggtggcattggccatcgggggagagggctgacataaanaacaagctacttctgngtcctcataccggagactgnggagccccaagggcaggtttatgaatggcangggtcggagtacaaaaggngtttggnaatattttggaaaagttaaccggtnaactttttgggcccttttttttttatatttatccaccatgttgtcgtaataagcgaaaag

SEQ ID NO: 3338 - DNA, 316 bp, Fusarium venenatum
  misc_feature (1)...(316): n = A,T,C or G
nttaaggacatccggttttttttcgaccttttcttgagnagtttttaaaggccgggcaaccttattacccaagnaaaaaaagtntcgntccgatgcttttttaaggnttntttttgcctatgccaagcgcgccagtgacattgtcgaacgcatttcgtgatcaananaaagaccccgtctggaccccttnaagtcgagggaggacctcccccaggctggnaatgaggtgcatntttccaggaatgatgttcatgcttccnaanggcccnatgggaaagaaccatcttntggnaaaatggtcgtcgtttgcaaaagg

SEQ ID NO: 3339 - DNA, 176 bp, Fusarium venenatum
  misc_feature (1)...(176): n = A,T,C or G
ntgacttnggagcatgagatccaganttggtgtccagagctttcnagnttgganaaatttttcnaaacttattganggggcnggtcantaacnattgggtaacgancgagtccggggcttcttnggggtttcnttcnaccctttttnccttggttttggaaaccgggggtttcnnc

SEQ ID NO: 3340 - DNA, 593 bp, Fusarium venenatum
  misc_feature (1)...(593): n = A,T,C or G
tggtaaccctgataaacagccacttctacaacacccagtcaggctctgaacgataaacctaattcgagagcaaaacaacacatcatggcgcctgctctacactcagatacgtacggcgctgctgtcgaatacgcagccaaaagaaagcatcaatgatttaacaacacgcgatctccagaaatccaaaccacacacagcaagtcactttgggcatcattggtgtttatgtcgttgttattgctattctatggaacgttccttatgtccgcatggtcctctggccattcaagatgttggtcattgccttccacgaattttggccacgccatcaccgttcttctcactggaagccgcgtcaagtctatcagtcttgatcccaacgaaagcggcgtaactcaccacattggtggcgcaaacgctattgttctaccagctggctatctaggctcctccatcatcggcgccctgctcatcttttgcggcttcaacatcgtcgccagcaaaataaccagcattgttcttggcgtctgtttcctcccgactctctggtggggaaancgtgattggtcancatcctcactgttctcttggct

SEQ ID NO: 3341 - DNA, 504 bp, Fusarium venenatum
  misc_feature (1)...(504): n = A,T,C or G
attctcctacgacctaaaatactgtttcgctttgaatcccattgaccaaacaaagtattgttaattaactcctctcttttgcattgcattgctacgccatccccaatctaatacaatacatacgacgatccgagccgatcgctacccacctccggtgcatatcacttcaacaatcgccttatatacgactntacaaccatcatccctacactaccgacacaacacaactgggtacgcaaacatgcgctcataaagtcgttgntcctttggaggnttggcttgttntttggcccaagttgttgccttgnttttccccanttttcnaaaaggnttggaaagggcnaaaattntttncctttaaaaaacggccccggcgggnttgccnaaacccccaaanntttttgggaaaagngggncaaaataaaaaatttgggccntttaanggggggttttttnccnaaaaaaattttttnaaaanggaatnttttttttttttngggcccg

SEQ ID NO: 3342 - DNA, 384 bp, Fusarium venenatum
  misc_feature (1)...(384): n = A,T,C or G
nctngttctattctccaaccttattagcccaaaccttacaacagatcctgaactacctacgagacatnttcatgatccagtcagaaattcgacttcgacacgccaatttgttgtcggctttcaccagcgcgatcccgccgcaaaagacgcaattccactgtgccgagccgtcgctttgactggattcgtagtcaaagaccccggccctnaatgctgggctggcatcatgaacgcacangtatcttttctttgatggggacatacacgctggatcatatncccctnagcctttactngagcctcttcagcctattttttngagtactggtancacaagtcgcaaggggcaaggaaggctggggcgantnaaccgantaccaagtt

SEQ ID NO: 3343 - DNA, 352 bp, Fusarium venenatum
  misc_feature (1)...(352): n = A,T,C or G
cttcaacctctttatatctgatctttacctggggtttatttatcactgttgcctcgcctggctgcgttgcgctgtagactcttatacatcacccaggatctggacactccaccgttttagtccgaggtccccgaatcgcctagctctcattcatcctaccgacgacatctgaacttattcgcgacaccacactcgaggtttccgacgtcacaaaccactttacgatgcctncttctncttcttcggcccttcggcaccggctggnggnatggcggnccttcttctcggctcttcttccccagganggcttctggacgtcatangaggacaggtaaangggggctntttttaa

SEQ ID NO: 3344 - DNA, 571 bp, Fusarium venenatum
  misc_feature (1)...(571): n = A,T,C or G
ctttcagtcagctgccaaacctaccaggcaaggtcgttcctggacatttatgtcacttgacgtccaggcattgacgcgctcaaataaagcaaaaagaaagaacagaattgtgctggtatcatgctgcccaatgcgtctcgactcctgcacctgcatcgtcaatctcgtataacaagcagcagaagcgatagctcgaggtactgacaagtgcactctacttagcggcgcgctcaagagcttcttgagtagaggctacctattccggacccagcattcagcaacatcgaacgagaacggacccgacctgatgtcttttgttttcgcacgggtaggtatgaaccagcacatcattagtggcagatatntcaaaaagatattggatcgnattatnaacaacttactttcactagctcggaatacaatctttacgtgagcaaaactgttaccaaacgctgggtacaatgcgcttnnggtacatgcagcacatggctatggattgncacccgancttttcgcttcatgaatataacaagntgngaccaacctnttanctgcgctnttcttnaaacaa

SEQ ID NO: 3345 - DNA, 144 bp, Fusarium venenatum
  misc_feature (1)...(144): n = A,T,C or G
nttacanggtgcatgagctgtgcgnccttggganancttgctgcttgcatgctctcaatagacactggggagaggncggtcatnatggctctagcatgcnttaaaaggccccaatncggcctataatgnggtnggattacaact

SEQ ID NO: 3346 - DNA, 335 bp, Fusarium venenatum
  misc_feature (1)...(335): n = A,T,C or G
cggtcgggcaatgcgcacaaggactcttattcatacaaaccccaagggttacaaaccagttattcggaagagtgtgatagctcaactctgcctgtttgggagaaacactacgagcctaagtccgaatcaccaaagactgaggtgcccaacgcttcttcatacacgatacttgctttcgatccggcttccaagatgatgaacgtggcgaaactaagtnaaacgttgcgacaacaaaccccaatgtccttctgngggcttntcnttttacaaaaccagcccaagtcttccattcgttacatcgtcggnaaacgagggtttgaggnggttttaggggg

SEQ ID NO: 3347 - DNA, 103 bp, Fusarium venenatum
  misc_feature (1)...(103): n = A,T,C or G
nncctggcgtgtgcatcntgtcgagctatgcattgatgcattagtcaacgacaccaacacagaggaaaagccgaantaccctgatcgccagatggggggttca

SEQ ID NO: 3348 - DNA, 244 bp, Fusarium venenatum
  misc_feature (1)...(244): n = A,T,C or G
ctctcccgccctctgccctcccctagccttcctctgtctctctcctctcttccgttctattcttgttttgctttgcctagctctntgtatctcgtgctataccttgaccaacctttaaaaccctctctcgcccctgagagaaacgccttggtcctttgaacttgtcaatcggaatcttaaaagactncaatacaccacaatcgccatgtcccgtaagagaaagcaagacgaaaagggggagctc

SEQ ID NO: 3349 - DNA, 193 bp, Fusarium venenatum
  misc_feature (1)...(193): n = A,T,C or G
ngncttgagaactggntggtntttatgncgntaacacccncganattggaagcactttgacttntcgctgcttanatcactngccaaatgttacacccggancttgtgcatccctgacattgngggaaagtgtnaccaaacttttggcatngttttaggaacggactntgtttatnacatgatncccacaant

SEQ ID NO: 3350 - DNA, 373 bp, Fusarium venenatum
  misc_feature (1)...(373): n = A,T,C or G
ntngaggagcaccccggggggggcaggccatcctgaaattatgggccgggaccgaccgaggagtttganatgttgcacgacacnaggtcatcccaagtacgcgccccaacaggtcatcgggcgggtnaagggccanganggtactntngagccttaaangntatgtggagaaacttgatgtaacgacggggacgcngnaaaaaaaaaacaaaagccgcatgaactttttgnaggtttggttttttgngcgaataaacatcatgggccgaaaaaaggntttttggnaatttaagcgttangaactttttttggattggattganaggcgggatgcattgcaacttngggtgnaaactaagttatncaattcccc

SEQ ID NO: 3351 - DNA, 641 bp, Fusarium venenatum
  misc_feature (1)...(641): n = A,T,C or G
ccnacttcttctcatgacaagctttacttgtcacaaaaatacctggagggctagggtcttgacggcatttgcaacgatgctacttgtttcgcgatcctgaacaccgacagggaaatgctgatatcaaaaatcagatccaggatgacctatgcacgacgcgtccaaaaacttcagaaatggtgctgtctactggcattcgcacggccgatactgtacacacgataggtcgaaaaggcaacttgttcgcaggtggtggggcgtctacagggataccggaggttgggtgttttggtaacgggtacgcattgttttgcgagctggcaatatcgtgcgcctgcttgctgcttgtacaanggacttgacactagtctttcgacttcccggtgtcgtaacccggnctgtactgtcacacccaaggcacgatgcttnacgccataccaagtcctcaccgcntacctnatcacnactnggcacccagttcncgccgggattcttgacctgcncacgtttctnattaatgaattttccttcgtttggttgnctttgagcaaangaattataattntgccttccggggtagatngcaaaatttttattttttttttgacggttancncttttccgtcattnaccgcntttaa

SEQ ID NO: 3352 - DNA, 135 bp, Fusarium venenatum
  misc_feature (1)...(135): n = A,T,C or G
gtgaatcccgatgacntgntgcagggctgcagccgaatgcngagtctcngagttcaaagtngccatcaacccaagtcagngagacctgcntgccgcggaaggttgacaagatattatcaagatctcggcgcccct

SEQ ID NO: 3353 - DNA, 523 bp, Fusarium venenatum
  misc_feature (1)...(523): n = A,T,C or G
cccgaagttcttaatacgggatccaagtcatggcaataattctacgatccatgccccaggaactttcaagtacctgcttaaagattgcataaatcaatcaaacaaaccttgcctcggtaggttaaccttcaatacacttgatttgcagatccagaaccttccttctcgtcttgttcttacaagaacagcgggggacaccactacgaccgaaacgcaaaccacatcttctgttctcacgtgcaacagtcgaagcactagacctttatagataggcttgcaactgaagctcacgaaacgaccttgttcaatactacagacaaggcggncagangaaactcacaactatagtatggacgaaagtgaaatcgcttggacagctgtcctctacgcagcaagagggcctcaaccagttcctcaagtcaccgnatcaagaagtcaacgaagccatcccacttntgagggggcggagtggacgtcagatcgcaatcgctaagtntttgacgggaaacaagccgntcaatag

SEQ ID NO: 3354 - DNA, 152 bp, Fusarium venenatum
  misc_feature (1)...(152): n = A,T,C or G
ncgcnttatctaatttctgtgcancttgnccaccangatntctgtccttgactacttcncatgggcttnngtcaaacctcgtncttgaantgtncaacgtgccgancaccacaancacgtcgcganacccacaagatgttgtngnccggctt

SEQ ID NO: 3355 - DNA, 245 bp, Fusarium venenatum
  misc_feature (1)...(245): n = A,T,C or G
atttattcaattcaatatgtcgcactctcacgatggacaaactcattcccatgatggtttcaatgcgcaggacatggccactccatgagatccttgatggacctggtagctttctangtcgcgagatgccatcgtttanggaccaaaagtggnaaaacgagcnttacaattggaattggagntcccgtnggttccggaaaaccgttttaatgntgccctttccttggttttccgaaaggaatact

SEQ ID NO: 3356 - DNA, 402 bp, Fusarium venenatum
  misc_feature (1)...(402): n = A,T,C or G
tgcagttcgcaggagggaccatgtcgaagcgagacgcatctcggctatcctgcagccaatctgggacctgttccaagagtttggtgaggtccgggtggcatttgcagttgcgaacgagcgtggcctttgcaaagcagcccctcctcggcctattcttcctatagatgcttcgcatcatgatcgaatccgctcggtgttggcagacatcaataaacacttttagcggccatctcgaaacttaaggcagtgtggggagtctgcgcgctgcactgctctacatcgttgatgaggttgttgcaccgtcggtagttatttttatacttcagaatgaccttttaagcataacgtataaccgttattttaccttatctcaaatcttatcagcataaaanaaagnaaaaa

SEQ ID NO: 3357 - DNA, 287 bp, Fusarium venenatum
cgggcaagtgactgatacagcgctacaattctcgatctacgaaaaagaaacgactaactttacagatcgctcgcctaggatgacgcgagagcaaccgtaccgcaccgcaccgccgcagacggcggcagcgcatcgtcaaggtcaagggtaagggtccaagagagagagcttggacagaaggctagggcaatgtcggttgtttaaaagacccaatatacacaagattactattcattcatcgcctggataaggttatcccgacagcttgaagcatttttgttatcatt

SEQ ID NO: 3358 - DNA, 317 bp, Fusarium venenatum
  misc_feature (1)...(317): n = A,T,C or G
taggaagaagcttttacttattagtcgcatatatgccgacatgtttattttcacagaacctgtcccaagagccttcaatacgcacaactgacatagaccgttgtgtagctatattgcgcagcttacgatgatgtaccctttaaaggagaatctggggacagggacggctgaactcaacaggtggttgacggcaaaagttagctcaagtgaagtttgagcagttatggtttntgatatgtccaacaaaggccaaacctttatgcatagtttatcgcacgctntgaccaagcaaatngggaagaacttccaagcgtttt

SEQ ID NO: 3359 - DNA, 649 bp, Fusarium venenatum
  misc_feature (1)...(649): n = A,T,C or G
gcacgaacgagcgacgagtttcaactttaaattcttcagcttggaagactgcgcagcggccattttaagatgcgattccttgataattcgagtctgggcaagacgaccgaaatccgagacatggacctttctcctcgacgagtcaatcgatctgcgccgactcaactttataggcactcttatggatcgaaactttcctccaaacgcattaatatttcacctcgaagacggtgtttactcgttcgactttcccaataagatatcggaaccgaaacaagcaccgacagtagcgacgtcgtcatataccgcgcttatgaagttggccaacttggagagctctatagaagatgcgatggagacgcaaaatcgacttatggaagagataaataatatgcttgatgattcaccggtcgataagtcagaaacggcgcaagaagctgtttctgtcgcagaaaagtatgtgggcgngcaacaacgcttcaacaacttggcacaaaaagaaacnggatgatctacnggaatcgataagggcccgacgccgaagctatcgcttaanggagagagcttggagctcaaccggaaccggtatnggcaataatcgagagaaggtgancgcttcggaagagcttntcgaanaacccaacaccaa

SEQ ID NO: 3360 - DNA, 637 bp, Fusarium venenatum
  misc_feature (1)...(637): n = A,T,C or G
cagcaaacacatgccctctcgtcacatacatatatgtctgtcgccccctctccattttcatatcgcctcttttgtccgtctacctatattttgtatctactctaagatttgcttgttaataattaatcttgctttacatatttactggatatctatctactgtccactcacctacatctactgggtccacgagcttacccatttgcacgtgaaatccactctcacgatcttcgatttttcgattctgtacgccagaactgatgctcaacaagccgcaatcgcaacatagatagatatatcgtcagccctcccgtatacttcaccatggccaccgnacaacttccccgccagacgcgacacaacttctggcgccattcctttctgctctccaccgnccaccatttctaccgagcctgctattggcattctgcccttctntccccatactacgtcagcgaggcaagctnttgncacctaccagctctgagccatggattcgaatgntgngctacgacaaagaaaaaatatcagaacttgttcagaatgggcaaggnggnagctttgagcccaccccgtgtnccgcgagggtgaggtgactgggagtccatgctgagacacgattngaagggtggcgaaa

SEQ ID NO: 3361 - DNA, 196 bp, Fusarium venenatum
  misc_feature (1)...(196): n = A,T,C or G
ncttctgatagggtaggtgataatggtccgctgagaggaagtcatntgctgttcttcataagatgccaacatagcctcgagctgctcttcctcgtccatcatcatctcatcctcctcagggatnggagggtgttcttggttaaangtcatggcctnttcaatatccgcttcngtacttntggagcatcatgtaata

SEQ ID NO: 3362 - DNA, 289 bp, Fusarium venenatum
  misc_feature (1)...(289): n = A,T,C or G
natcaccatggaacnatccacaacgagacnganagacaatgacnnctgttgctacganaggccaccnnttgttgacgaagagctntaccatcaccatggntgatattggcatcngcgagaaggttacntgatacctggctaccaccgatgggaaattgatccctatgtcantctaatgtttntanccaccgatgcttacnatcccaangncaacaatgccnatgtgtnagccntacttgaaagctgtnaaacgctnanagctgtgcttgccaaagtagcatcggtgnca

SEQ ID NO: 3363 - DNA, 460 bp, Fusarium venenatum
cctttcggcgcccacctctttgatcctcatcagggcggcgactgcctgcctgagaagaagacggttgtcgatcaaacccagtcagcacaagggagatcggaagcttcccatcagtaaaatcataacgcccggatattatttcgaacaaagataggggtctaataagtcgaaaccagaggactgggctctttcaagcccatgggctagccattgatggttcctgtccgacaaagccttcaactcctgggtttgggtaagctaatttgaacacagctgctgtcgaccgatttcgaaatgttggatatactgcttctgccgctttaatggcctcgcgagtaagttggtatgcattatttacaggccgttatgtctctcctgttttggttcaccccggtagataccgtgcagctgctatctacgtagtattccatcaacaaagcctctggtcttcagaaaaaaa

SEQ ID NO: 3364 - DNA, 406 bp, Fusarium venenatum
aatggacgccgggttggttgccatgagcccgttacatttgtgtcatttgtgcttgatttcctagcctcaataggctgtgcgtatttgaagcagatcgagatttgaccggaaattgtacgtctctgcattggaaagagccggacacgccgaaccgccgtactatgctggtttgctgaggactggcaaatgccacacgtgcagacatcaagtcctcgacagggcacgaagtggtctagaacttgacttagcttggaagcgcatggtgtggtggtcagagactggggacgtaccgttttcctagacatctacgccgggacaaatatagaagttgagcgttatacccgcatattataagttattacgatcttaatatatatcgaaatctgggaattgacacttcaagatc

SEQ ID NO: 3365 - DNA, 104 bp, Fusarium venenatum
  misc_feature (1)...(104): n = A,T,C or G
natgtcgagacgatctacatgaagaacntcgaagaacttagttgagngccttnattcccactacaaaggcntatctgncttagaccntcnagcatttgtcggtt

SEQ ID NO: 3366 - DNA, 547 bp, Fusarium venenatum
  misc_feature (1)...(547): n = A,T,C or G
tcanctaatnaacgggccgcangtggggctgggaanttctggcagatctaattttccccttnaatcttctttttttggcttggcgaatatttttcttttttcggcccatcaactttgggggcatactcttccctttcctttggtgggtcttttccttctggttgggcttctctttggtatacttgggcccttcctgcactatctatcttcttgattaaaatgggtgggccttttgggccctgggggggcgaaatcctccgacaccgcttccttcgaaaaaaccctttctacgctttcgactaaagatcaaatgatgctcaaggcctcgctcgacaacttccgcgcaagctctcgccgcgcccgtgtcatttggacactatacctcagctttgcttatctcgnttatgcgancgccttcttcttgtcgcggatatgacaacctcggggccttcgaatgggggggcttacaaggcgggcnggtgctcatntacgtaacggggcacgaacctnggtacggactanaaggtttnggatngagaacctaatg

SEQ ID NO: 3367 - DNA, 380 bp, Fusarium venenatum
  misc_feature (1)...(380): n = A,T,C or G
gggaaattcntgcaagatgcggnaggggtttgagcttcatgngggacggggaacngtcatatgtatacactttagatagaacccgttaaacccctgtcgtagcatgcgattgtctaaaaagatcatgtcagcccatgttattttccccgcaacatcccgtcttcggaaggncgttgtcngcagaatgaagatgaatatcctttgagttctttttatctatctcggctgaagtcccatctttgcatcatcatcatcatcatcatcttgttcttctttnttnagcagcttcaactcggtagcagaatttattgccagaaaactacgtttttcttcagacatccaactagcggccctctttgatcaaattcaccccgctcatt

SEQ ID NO: 3368 - DNA, 164 bp, Fusarium venenatum
  misc_feature (1)...(164): n = A,T,C or G
ntcattatagaaggggatttattttagggggggaaaggntatgagatagttaaaggnggtgattaatnggttgggatactaaggaattatgaaaatttgaggggaattaganangataggtttttaanangtttgttatggaatttntgggaattaagtaaaag

SEQ ID NO: 3369 - DNA, 345 bp, Fusarium venenatum
  misc_feature (1)...(345): n = A,T,C or G
nctgcagcttcagttctgggtcgtcngggttaatgacaggcctagtccggaagttcggcacatggcgtgagttgagtgggggcatcgttcgccgttccgtgtggatatacgacggccgtatctaacgttagtagccatttggctgcactccgtggtgtgtggaacatttgatcctccatgagtggtgtgttatgttgtacttttgagagtcaatatcatnctancgcaagctttgctgagaaaagangaccaaggaggagtgaggtgaangatttccgaagggcaattgcagagattgatgaccagaaaagtcccgttttcagtctagcagtaaaaaaaaaacca

SEQ ID NO: 3370 - DNA, 130 bp, Fusarium venenatum
  misc_feature (1)...(130): n = A,T,C or G
ncccngaaggaagaaagangcctaaacggagagncgcagacttcagangaaggggnggggaggcctttttnatggccgccctgngagacnaaaaggaaanngaaggaagggagggcnggggaagggaaga

SEQ ID NO: 3371 - DNA, 106 bp, Fusarium venenatum
  misc_feature (1)...(106): n = A,T,C or G
ntggccacgngaagagacaanaanggggggaggagaacanggnggacttntccgcacccccaccacagaagggganggggnggccaccgaanggaagccgcgnggc

SEQ ID NO: 3372 - DNA, 183 bp, Fusarium venenatum
gctatgtgagagtgaaggtttacgcgtccatcaccagtagaaacttggtgtctctataaacactacgatgttgtggaagactgagtagcggctgcagctgcgattgttttcaaatacacatgtaatactcgaaacaatgactcgtcactttctttgttgcaacagatgctggggaaaaaaaaa

SEQ ID NO: 3373 - DNA, 465 bp, Fusarium venenatum
  misc_feature (1)...(465): n = A,T,C or G
caaaagaaaaaactcgggggtaaatacaagcaaatccaagcttggccctcttcgatcccgtgaaacttgggaccttcctctttcttcaaaaggggggttgtgtaacaaatcangacataatcctcatccacttgctcatcttttttatctatccactatccccatccccctcttctttccctctctcttattctctcaacctctcaccataacatcaaactctcgataacaaaccatggagaggccaaacgatatggaggctgttgagaagcagcctgactccgactataagcacatcgaccaagcccccagcaaggtcagctccgatatcgatgccgaccatggnttcacccacgaggagcagcgcagcatcatcaagcgcattgatcgcgctgggtattactgcggngccatgtactgngctcgctcatggatcgcaccacatgagtgctgcaacattggcgg

SEQ ID NO: 3374 - DNA, 572 bp, Fusarium venenatum
  misc_feature (1)...(572): n = A,T,C or G
cgggtcaacaaagatccttacaggggagacacatttcggcgcaacttcaacttctcaactctgatttgcggcgtctgtcgtatggtatcaaccggtagtcaatcgctcgtcccttgggccatgttacgcccccggaaaagaccgttatcaatagctcgagatttgatacaacgttgctcgaactgaggccctgccgattgccggccgggtgttcctggctaattcgagaaccattgccatgtctctgtgcaatgccattcgcccttcattcttcaacaaccttttctgttttacgcctccgtccagagacctaaacatgcgaatcctccaatggcaatctgaattgggcacgggaagttccagacctagcgcggagctgctcactgggcactgaagctctgcacgtctccttggaaacgggtcgggaatactcatgatcagcatgagatggatgttctagacccttagagaccaagggcctgcgtgtcctcgtgccctgagccacaatgtctcttggcagaacagaattattgatcttcgcngtctaaaacgggctgtggcgcccttccngc

SEQ ID NO: 3375 - DNA, 338 bp, Fusarium venenatum
  misc_feature (1)...(338): n = A,T,C or G
ntttaanaaactgggnntgggaaaaaccnggggtnacncaaataaancctttgaaaaaattccttttttnncaggggggtaaannttaaaaagccnnccaaaccccntttccaaaagngggccgcctattcanccggggggttaaagggttaccccttaaaaaaaaanaaccccnttttttttttttggggggnttcacaaaggaanttttttccncccccggggcaaaggangggaaccccctggccangcccctttgtttnaaaaaaaanttcccggnaaattttcccgggggggnattttggggaaaaaaccggccctnaaaaccccnaattggc

SEQ ID NO: 3376 - DNA, 631 bp, Fusarium venenatum
  misc_feature (1)...(631): n = A,T,C or G
ctccaagcattccgttctcgcttgggaatttataagtcttttgtactcgagttgtgtgcaatgatgtctgggagaacccgctgttagtatctgtctctctcgatgcccatgagtttcttacttcactgatcttagcgccaatttgtgttctgtatcctcaagaggtcgctgcttgcaaataccaggcctcaaagcgaacggcaacgttgattgatattgccacccaaagagctgctggaacttatctctttatatcaagtctcaacaaacggaaggaactcatctctcataaacttggcgacgttcgcgcagtatcaggacgagcgattggccgacaacacatatacgaatacttgtgttaaggaatcatcgtacctcagaaatgttctggatgccggtgggggcgtactgagggtaggaaacgtagcgaaaagggggatgacccgtctgaatgtcatctncatacatttctggtttcttcagcctcgagaaacgtcgcgatacgtatcgcacgcagcttcggtatctggtccaatggagcattccctacaccagcatcattgctgtcgacatacaagttcgctagcaagtgctcgatgaaacctcgtgtacctatgttcagtaaanggcg

SEQ ID NO: 3377 - DNA, 619 bp, Fusarium venenatum
  misc_feature (1)...(619): n = A,T,C or G
ccggcagcgagctcccagccgttgatcccgagaagactccttccgacctcgttactttctggcagaccaagcccggtgaggctgaagagatggtgcgcttcagtcaggccaacatcgtctcagccatttcagctcagctcgcagctatcccaaccaaggagcgtattaacccgtccgatttgtttctaccagccgattctcttaccaacgtttacacccttgtggtcacattgggcgctctctactccaacgcttctatcgctctgaactccgtcgccggcaagtcaccagacttggttctcgcaactcaaggtgttgctcccacagttctagtggctagtcccgagacacttctcaagactcacgaacagtccacattcagacttggcttcgcttggcaacggctctcaggtatggctactcgaactttggcctgganggnggccactntcatcaacttntntcgggtttttagggcatcccatnattgggacaattctggcaacttgccnggattggtggccaaccggctggtctggnactctttccngctgcaaagtctggctggactggcattttacggggcaanattgggntgctttaccgggccaaggtgtgg

SEQ ID NO: 3378 - DNA, 291 bp, Fusarium venenatum
  misc_feature (1)...(291): n = A,T,C or G
gctttaaagtgtctctcacccccgccaaccaaccatgatggcgtngcgacgactcgacctatccctctccggcctcgcccgtcgacctctaacatgtttattttgcgaatctcgacggtccttcaccacctncgctcttnggctagcgaggactggaaaaccaggtgctggcgcattcttagatncttagcnaatggtggccaagccgtcgnagcttccgnaactnttggaaggganacaagggcnttttgnctaaaccnttctttggccgatnggttgccttaccgccca

SEQ ID NO: 3379 - DNA, 609 bp, Fusarium venenatum
  misc_feature (1)...(609): n = A,T,C or G
cgatcaagatgcccgttttattcttgttgatccactcgtttttaactatttcgttatagtagaacaattttcatcgtcatgatggcgagaaaccggacatagtgaaccgacaacggcgagggtctcgcatcaattcaggtattatacatcatcagagcagctttttcagcttttaatcacattagtgagtagacaaatttcggcgccatgtctatctaggtacatgatccgagttgagtttcttatccatgtctgccagtgacaaagtttgagatttattgntacccttgattacagagcagacacagacacagacacagacacaaccctgcttttctgntcccgataatctttgatgctnaaacagcaacaatctgcaacgcacgacaagggcctttcttggggccagaaaaacccacgctttgctgnttcatgatatcggccgtaatggcgtgtgccaacgaaccccaggtnttaagggggaagaattnncgtttaattccggctttttnttcgaggaggattcctatttttntcccaggtntttggaccaggattgaagnttaggtttatgccacctttgttgncctgagnccaaaaanaagcccc

SEQ ID NO: 3380 - DNA, 156 bp, Fusarium venenatum
  misc_feature (1)...(156): n = A,T,C or G
ngagaccgnatgcaatgacaaatggaccgagatgacccttcttnacaagaaagctgatnactggattgcttnggtactgacgnccttttacttaggancccntggaaccaacgccnctggcncctggggngtgtttattgggntggttggcagagt

SEQ ID NO: 3381 - DNA, 623 bp, Fusarium venenatum
  misc_feature (1)...(623): n = A,T,C or G
aatcacggctcattcttcatttggtaaagagtatcttgaatcgtaccagtgattcgtctacttttgccttgtatttgttgtatccctatacgaagaacactacaacaaatctggcgacaagctcggtatttcaaggctttgcctatttccccatctcatgctccatcccgagtggcctcgaaacaccataacctttgtttattctagctcaacaaacacaaattgctgcagcgacgcaagttaccataactttgccatttcaccttggtacttgccgacaagtaatcgccccacgtgagaagcgcgactccgcaccgttttccaagattctgtccttcaagccaataacggaacttcaaagcttgcaatggcgactaattcgaacactctccctcaagggttctctggtttcaacccgtcttggcgctcagctncagttctttcctgccatcggaacccgggagctcgacgagctggtgaatgcttacatcctggcctgttccacgcaggagaaacgtgccaccgtcttttcgatactttgagttgcgcacctgntggacagacattaagtctatccgntancacttccgttctgtgaattcctntggtntagccttcaggan

SEQ ID NO: 3382 - DNA, 628 bp, Fusarium venenatum
  misc_feature (1)...(628): n = A,T,C or G
cnncacacatgctnttccttgntnatcggtgacacgttaagcgactgcagntctacctcatcaatcattggtttnatcactctccagccaaaccgaatncgttctaacacccncacaaacaggtttctttgntataccgtcccaagcctnttggttcccctcaccaaaaatcccttccctggtgtnggtttgagcccattttcgactcttttcaccaacaaacttgagctgatcctcccgagtacagttcgtgcttactgtgactganaaattctgttattcataccaagacgatgtccgaccagcctgcgactgtngctgttcccacngaccggtncgacctancntctgccgntgagtcagcttcagcgccgcagacagagttagnccngctgctgatccacacgatggtgacgagagtgaaactgantctgctggtngtgatgacccgtcagctgcactggttncatcacatcgagcattttttnagtattgtnctatncaagggcgaacttttaacagggatatgacaccctatgagtacttactctaacgatgagcaacaatgtgcatcgnttgcatcaaccattaagcttgacctactttnggcgggaagnttttcttgcnc

SEQ ID NO: 3383 - DNA, 704 bp, Fusarium venenatum
  misc_feature (1)...(704): n = A,T,C or G
ttttttttttttttttgaatgagacatactctattatacaccttgataccctacatcgctgtgagtttctaatccaaagataacattagctggccacctcatagcttcttcccattcctccccaagaacctccatgatatatcctaacagcccgcttggccaatctntaaggcaccagtgctccttatagaaactnattaaaacagtaaaatgaccaaaatggngagtgccacgggatgtccgctgaacataaatctagaaagacacgatctatctcgagtccccaccccaaataccttgcccggttanggtctncgacgttgtccganagcattgaatgcggcggaacagtcttgaacggcgtgaaggcatgatgtcttctgttcccccacacaccaacggctatgcattcccagagagatgcaagctgtggataccttacttcgagatccctttgagtattttggtgattggcacaaattttgtaagaagcccgattgtgagacactataggggcgaagttntgttgtacaaacatcaaggtagaacggntaaattgaagtgcctttaatagcttctcgacagggtcgaatgngccaaanaccggacttccgggggggcgaaacataggttccgttccgnattcantggaagtgaaacttgaaaatcccacagggcttggtggngcgtttgatctggggact

SEQ ID NO: 3384 - DNA, 358 bp, Fusarium venenatum
  misc_feature (1)...(358): n = A,T,C or G
tttttttttttttttttttcaatatgtttcgacttatatatactctaaactaccaactntccgtnttttaaactntcatgatttaactgcaatcattcggcaacagggcaaanatcatagttgccattgacattgttccccccccagnttgggaaaggatggccagaaccccggcccgaagacagcaaaggagaggatgaaaagaacagtgagacttgcgccatcaaaagcaccagtcaccaggtncgagtagtctntaaanaccgcggcggtantttcggaggtaganctgaacgaaaaaagccagagagcaactgnctgaanatnaccaagtttgnctntggttgtaagggatggt

SEQ ID NO: 3385 - DNA, 270 bp, Fusarium venenatum
cttcagaattgggtcattgtgaactttcgtaaagccaagataaatcttggtaatttagacgaggcgacgttggctgagattagccagcttgtgcccatgtatgaggatctaacatcatcacacaaggtttattctggcttcaatctattgtatccaggatattagtcgaaatggtgtttgacgcctacttcgtcggcttaacagcaagagcagacacacatttccgacaactggaaaactgttgttttatacccagccactttgagaagc

SEQ ID NO: 3386 - DNA, 534 bp, Fusarium venenatum
  misc_feature (1)...(534): n = A,T,C or G
gaggacatgcatgctgcatcgcgaacaagaacccactagacctcatgggtaaaattcgatggtactatgtactcaacattcccttgtcgacaaatgtgctgtctgatcactcagccttatcccccatctcgttcgatctcgaccggacccagtggcgaacgttttgctcgacggcgaatactctcgcgttacatctctgcatcgagacgagtcttaccgaccgttttgaaatctccccgcgccgtttctttccatcttacaaacatttgccttggcgtctgattcactcatccttgcccgtttatgtacagtacattttcacgaactcgccgactactaagccgcttggacgcttcagcgaatcttgattctgggccaangntattctttggtcaatagannttccctgncctcttatccagccctgccattcgtcgaattcgcactcgtggtcctancccgttgtcaggtttgtcagcttagatcacgatngcatngtccatacagntactaccatggtttttccaactttgt

SEQ ID NO: 3387 - DNA, 655 bp, Fusarium venenatum
  misc_feature (1)...(655): n = A,T,C or G
aaaactttcccccgccgattaccaagtaaacctattcaangggcgggcgggtgggcccaacctggtggtgcttggcccagttggtccgcccagcttgaagtggttcaatcccttttttgaaagccctctggtgctgaaaataatgggacacgtcgatggggtgaaagcaagaagatcatgtttgcctgacagggttatcttacattgcggggcaagacgtctatcaacatttctgtcttttttgcaagccatgggacgctttagtcgattacaagcacattgcacaaccacagttcacctttcagttctactcaaggcagacngntctatagaagccgcaagacgaaccgacatcctgtttcttcgataaccacaacattgaccaagttacatcgtcagtgcgccaacgtactggcttttcgctccgctattcgttccaaaaggacaccagaaagacctttcngtgttattgnaaacatttcaagaacttctttatgcacagatttncatgaccatgtctatgcctttcgtgggngtggatggancnggggcattgggaattttcaagtggactacaacaaggtcaaaaggctcagaatgtttcttttcacttcttcgactttatnggttnaaaccactcaattaccgggtgggg

SEQ ID NO: 3388 - DNA, 220 bp, Fusarium venenatum
  misc_feature (1)...(220): n = A,T,C or G
tggccaagcccatgcctgctatgtccatggtgtttggtcgacgacaagaagctgtgtctaagagctggagtgatatgtgggacgaggatgaggaagaggaggaaatggaacagcagcgacaaatgctacaggagctcaacgccaggacttggagccaggagagcaaggaggagaagaaagaagtnnagaagatcgcattgcgaaccttgacccttaaccg

SEQ ID NO: 3389 - DNA, 509 bp, Fusarium venenatum
  misc_feature (1)...(509): n = A,T,C or G
cagatgcgaactcggcatctggaccacaggcatgtggtcatacctgtaagcagcgaaccctccttacgaaccggcccaggtatatctccaagcgatcaattaccgttcgcctcggccacaacaccggaacattttccgacttctggagacaactataggattttttggacaccagggaatcacacaggatatagaggacttattgctcggcgctcaaggaggaggacttattttttcttttattttcggcacattgcttgtccttcagttgacaggcggctgaggcctagggacaaccaaaactcatagccaccaacattccgttggaacacctaaccgntaccgattaaaaaccggnatttccccggtggttttattacaggggctccaatccaagacccaagaaaagaaattgaatttggcgttttgggatccncttcaaanaaaacggatngccaacgttgtaatttgggccttgcccaccattggcctattttctttggnttgaa

SEQ ID NO: 3390 - DNA, 612 bp, Fusarium venenatum
  misc_feature (1)...(612): n = A,T,C or G
attctttccaagagaccttgcctctaggaaaggcaggcggtgaaaatagcccacctttagcttcataaattctgccaaggtagtcgcaaagcgactagctgccgtcttcggcgtcatctataatcaaattcaatcagcctggacaggcatattttcttctcgatagctatgcagtatcatccatgccatgtctagaaggccatttataagaggcctggcgcccattcatcccagactttatcagcgacccgcgcgttcgttcatttttcgactaccaacctcgacttgcactgcacaaacatgtcgtcttctatcgacaacctctgcccgccgaacctcggaaattcgcagcattgcagaactaacaaatagaataaacccacgatccttcaaagtaccaaaccccggatcatcggttctatccttaactggccaagcttcccaaaccttttatatcacaagctggactcagatcagttgtcgacncgttgcaagtttccacataccttacaanagtntccgaggnaaccttgggtcnacttgtttgccgaacctgaaggacattngtttcaattaagcctnaactttgatcaactggggcaaggtgacgnt

SEQ ID NO: 3391 - DNA, 611 bp, Fusarium venenatum
  misc_feature (1)...(611): n = A,T,C or G
tcgaaaactaacttctgntccntggtttgggtncatcttgtcttggcttgncttgtctttaaatactnttgacctttcctcgagctgtcttgacgtcgacgttacagccgggtatcattcattcatatccatcaagctaacacaacacctcttttaccgccattactacccaacaacttttattcactctaccacttgagtttatatattgaacgacagaatctgaactggattggattggatattctttcgacactctatcatntactcatcttaatcaacgatttactagaatcgagacttttgatccgnttttcacttcacaatgtgcaactacatctataaggagctcagctggcaacaccactaccacttggtggaatcatggtgcccaagtacatcgagactgaacgtcggtgtccgccaccattgtgagcaagcagtctggggtgacgacatttgtgctgcctgccgagaacgccacaaccaagtcaacacccatgggcttagcttatccacgtccgagtnangcatgtctactttcttaactccgagcattatgagaacgacacgacnacgactcggcagtccagatgtgtattgacnccact

SEQ ID NO: 3392 - DNA, 194 bp, Fusarium venenatum
catgatggcttctaatggatgcggaggcggtgcaccagaatggtaaaaatggtatagatataaacaaggagttggagtagattacatggcgtttggggcttgaggttgggtggtttgggatgtttttgttatgatgatgctatctgaatagatatatcgaccttcttcaacaatatagaagaaattcaacgttc

SEQ ID NO: 3393 - DNA, 310 bp, Fusarium venenatum
  misc_feature (1)...(310): n = A,T,C or G
attttacatgttctcatctaaataccgtctcttttatcacatcagacatcatggctgaagcggaacagtgcatcatatgcctggaccctttacctcgaccttcggctccccttcaagctccagctgccctcactatagctgcgagtgatgctgcttctgctggtactgatactggactgggtattgggggngtttctgccgatccgantccgatctgatccacctttacttttgagtcccgcctattcntgccacaaccactacagccacagaagtttttgnggacgtttnaaattttttgaatgttgcc

SEQ ID NO: 3394 - DNA, 220 bp, Fusarium venenatum
  misc_feature (1)...(220): n = A,T,C or G
nattaatggnctctggggntggtggtgataatatcctaatactnaatatctanacggtgggataaatgtatatacaattcatatnatgacaaaacatcaccttgtaaatgaaaagatcaaacgcccctcgcaatttcagtacatgtcatccaccttctgggcggcngtcattntncatataaagggccaanctgcctatcccnantcgaattncaatata

SEQ ID NO: 3395 - DNA, 125 bp, Fusarium venenatum
  misc_feature (1)...(125): n = A,T,C or G
nccccacaacccgcttaggaacaagggggggcttntttttgggatntgcactttattgcacggtattgtcctantagtaccttatctttggttaanttgatacgcnggattcgaccacgaccacc

SEQ ID NO: 3396 - DNA, 485 bp, Fusarium venenatum
  misc_feature (1)...(485): n = A,T,C or G
gtcaactcacagtgttgtctgtactataccataccagtcctatcggtaaagtgggagcaatggaacatccgcaacacgtcaattcgtcaacccacatgccgacatggcaggacagcaaaagcgataagactgccggcatgtcttttcggtcccaattcccatcgtcgtctaagagtctacaacctcttgacgtagacagaatggatctacgatgcctctttgccaacagactcttgcccgtcgcctttgcgctaccatgggttgtgagcatgatcatatcctgtatcccattcacccgaattagtttactcgaggccccagattccttattttggctgcgcttgttantatcgtcaaantctcantatgtcgcagtctttatctacacatccctccgcaccgacactgaaanaaacagcatcttccaaagaaaaatgtctacaaaccctggttcngggttcctttttaataatccctttggttac

SEQ ID NO: 3397 - DNA, 598 bp, Fusarium venenatum
  misc_feature (1)...(598): n = A,T,C or G
ncctttgnggtctgtcactcgctcacttcgaagtcaaataccccgacacaatcggcttcnaagacgacnacgaagataagttcccatgcggnggtttnacccccgacctctccaaagataaactngtcgatttccacgtcggaggcgaagccattgctcttcgttccactcaccaacaaggcaactggcttttccgagttactcttgatgaagaggcctcangcggttgggaacaggtctttcctatcgttcagcagagnggnctcggtgatttctgtcaaccccaggtcacaattccgagaaatacgtcggcaagaagggttgggtgaatgttgngtcttcagcaagttgatggcttctctaccantgcattgctgccaatttcgtcaagggcaanggccgatgcgcccagccagtgcaagaatgcatcttcagtcaaagcatatttcacncgacgacgacaaactttctgccttgtggatggcggatctaaatcggaggagtcttcaactggtacnggcacaaacactggnttaaaaagggtnttttacagaaaccaaagattcnggtgcggggccgcaatcttggtcaagccacg

SEQ ID NO: 3398 - DNA, 1333 bp, Fusarium venenatum
  misc_feature (1)...(1333): n = A,T,C or G
cgcattcggatcttacaagtctccgttaccgacccgagcgaatccttccacttccattcacacacccgctgatcagagatctagttatctctctgatcgactcgactccgactcggtagaaagagtcacatcacagcaagaacccacggaacttcataatggccgatctgccggcaaaacgtggggaagcgagcagagatatcccacgtttatttcctagccccgaaggatccgtcgcattcattcatgctcatttatcgcagtttgacataaagccgcaaattccgtttcattgacgtagttgaagctcaacccgtgctagctttcaatttgtcaggatatcgcatcgataccttcaaaaacaaactcgcggaagcttgatacggacggctcggcacatgccaacccgtcgtccctcaactcaaatagattgatgacgtgaatattcgaatcaagttgaccatgtcatttgtaaaaaagacaaaattacaaaagcagaccacaaaaaacaacaccacagccgtgcgttgncaggcacgcgagttcataacgccacgaaactacgtcgtcgaacccaaaagncatgcgctctcgttttcttcgctggaaagagatcatctatcgatcacatatctcgccttgatacccaagtaatcgcgggccaaaaattcccaactctttctggtatacacacactttcgccatcgagtcttggctttgtgggaatttaccgtcactttangggtatgcatcgatctttccaaatttcccgatccaaccgtctagtctatcactagaacttccgaggcgactttcattcagatcggtaccctcagtgacgcaaaagcgactcaaaaatgcgaaacacatactcaaatggggaaaataaaatttctttgtttaatgggtcaagaagtttggtgatgcatacacatggtgttttcgcagttttacaaaactccgaatgatctaacatcagcgattgggcggctagacgatggatagagcgacaacgttgagcatccagcaatggatgtcactgcgggccggtctatttctaataacatttccaagtgattggtattagatgacgccaaagtttcttctgtcgcatttcttgaacgaacaacagtgcttacctgagaagtcaccacacacacctgacactattgcagtcggcttntcaccaacctcgacagctcgaatcgaagattgatccaatcanggccgattataggggncccttttngtgggggggctagttctntaccttttccttaaactcgnttttggagcctgggtttgggattngaattntagccanacagcggga

SEQ ID NO: 3399 - DNA, 122 bp, Fusarium venenatum
  misc_feature (1)...(122): n = A,T,C or G
nggctgggagagcaccaattatcacactggacnaccgaatgnaacatgcaccacaatgggtgacgcgggcatgctgaactnaaaattcaangantgggccgagtcnaacaaggggggcaaat

SEQ ID NO: 3400 - DNA, 583 bp, Fusarium venenatum
  misc_feature (1)...(583): n = A,T,C or G
cttttatcaaacgatgttcttgaacctgcctttcgccagaatccacttgtcgacaatgattatgtctttggccaagccttcggacgctactggtatatgggccctgcctcatcctgggcattctgtagaagagtcctagctctggttggaaaacatcttccagaagcaaacaacgatcccccgccatggcatctcgacggagtcgcattccgtctccaatggagacccctgatgcctgaagaacatcccgatatctcgaacctacccccatcagactacgcattctttctcgtacagactgcaagattctatctcggcccttagcaagccttatcgatgaaactgaattccttcaacattttaaagagctttaccaggatgcttcaacgaaggcagcatcgtgcaaagctgtggtatgcacaatatttgctcatgatagcggttgggaaggcgttcctcngcnggaagagtgccgatggaagtccancgggttatnaagtacnctggtanggctatgcctnttatgnctgagctggntnggatggcctanaatccaatntttnagcacaggcacttacttttg

SEQ ID NO: 3401 - DNA, 635 bp, Fusarium venenatum
  misc_feature (1)...(635): n = A,T,C or G
ccgacccactgatctttagtgatcggttccacgcttcgagattgttctggaacaaaggctggcaacgtattcagaacaacgtttccacaccctggcgtcctaccaagtggccattggggactcgtattcgacaggtcttcttcaacacagctattactcccgctaaacgtaccattgacgtcgctcctttcccatcacactttacaatctgatggtgtagctcaattcccaaaaaatggncgcccagaagcaaagcttattcaacgatcagttattaaacctgacatggtaattttagcaactggttacgttccacactttccctttctcaacacaaaatacaacaccggccgtcgaccctaccccgtatctcacgatgcggatgtccgccaggtctggtcatctaacgaccctactggtggatttattggcttcgtcgtactggaattggtgccattccttctttggctgagaagcactcttatgctcttngntactcaccttctnaaccgagtccacgaactcttctnaaaggtgatgagnggnattaccgggnaattcatgccccggngcgcgaggtanatatgggggtgagcaccaaaggtacncataccacntggccaaggnattggaca

SEQ ID NO: 3402 - DNA, 640 bp, Fusarium venenatum
  misc_feature (1)...(640): n = A,T,C or G
attgtgacanacaagtacacaaagtcccatattgacttgcttgtggaagaggcctcgcctcactctncgccttgcgttcctccacaacctcaaaatgccatcgatttggctctcgcattcatgcccaatgagattcaggatggtgggcaaactcccggaccttttgangatatgcgtcgnagaatgacgggcctgggtgtgccaagtacgcctggttcgcccatgtctnccgcanggccaaggggtatttcgaagcgaaagaanaagganaagaagcgccgttgggtatggacaatcnggcaagaagatggcnatgatgatgagcatgtgggaggttctatcgctgctttgagggctgaggcggccaaaggcgaatgatgctgatnaaataaagaaacctgtgaccgcatnagatcttcccccttnacttttntacaacgccgacaccgagcaccgataggtttgaaagctttggatagcatcctatcttgagaaccatgatattgnngatgtccgatncnagcaggtngtcttacaataccccgaagaatcttccacatgacttcagagatggatcttggacatcaagaccccgtcgccnacangattgatggggaaagctcaaaatttntcctnctcc

SEQ ID NO: 3403 - DNA, 120 bp, Fusarium venenatum
  misc_feature (1)...(120): n = A,T,C or G
naagtggcntgcanttgacacccgcggtcaaccctataataacacgcaatncgaangggctacgcttatcacaacatttgaccaagctaagcccgttcatgatggnnggctcaaacatgg

SEQ ID NO: 3404 - DNA, 585 bp, Fusarium venenatum
  misc_feature (1)...(585): n = A,T,C or G
cgaagatgaggagatggaggatttcgagtggtctgaagcaattcttactcctgtccccaagacacctgctccagaggctattgcacgatacgccgccaatctcgacctcgagtcggcttccgctgatgatgatgacgatgatgatttggacgagtcacccacgaaggatgctctcctgatgcgaacgtgccccccaaagaagtccatccgtgagatgggcgctggacttctcagccagaccaaggatgatggtgttcttatgcgactcatggctgcacgacgcaagagtctgcagtttgcgcccaagattggtagtcctttagcgaggacctggcagtaatagactggatatggtcaangtggaataattgtacatggacagggtttgatcccgagtttatgggttcatattaaaatttgctgtcacacggcatggctggtacaatcactcatttttgccataggangggatacccacgggaacagacaggaccttcgntgggccgtttggtgggatggnatttgctggatactttgttcacatatttgagagctggtcacttaagaatcancattgttgattgg

SEQ ID NO: 3405 - DNA, 206 bp, Fusarium venenatum
  misc_feature (1)...(206): n = A,T,C or G
ntatcatgggacacaagtatagggcaccttactcttgccgtctttnttggccnctatnccagcgcatancaaaaantcanttactgattttnctagggaaanacaagccaccaaccccantttggcngcttncattgggnactccagnggcngagccataattnaggcagaaancggtcctgttttggtctgnnccttttggccgg

SEQ ID NO: 3406 - DNA, 408 bp, Fusarium venenatum
  misc_feature (1)...(408): n = A,T,C or G
gaatgatcgacgatttttctgttggtaggatacggacgttcaaatcacgaaggccattggtctcggattggttctcagctacattcgctgtaagtattggtccgtaaaggggctttttttttttttttgcacctacactccaagttttcttgagttagaccagccagatccatgaatagatcgggccgctcctaacaggcctctggctggatgttgntctccggtatacaccaaggagtggcagatatttcaatagctacccaaaagatattatgccccgnctcaataacagttacctccggtgtaatgctaatttttggtgccaggcaanacactgcctctgacgtggtaaggtggtgagantttttgatcggcggtagttgcaaaatgntggccggttgcaaaagg

SEQ ID NO: 3407 - DNA, 379 bp, Fusarium venenatum
  misc_feature (1)...(379): n = A,T,C or G
caaagcngctatattcttggtttttctatctttgctttgcctcagccctcgcatcatcctttgactaggcatgttcgggggatgatggcattgtttggtctagtctaatggggttctgtctggactgagattctcccccccttttgggcgatagagtcgtcgagaagcgacggcaatggtgtctgacatggcatggtgaaggaaatgggatttccaagtcgagattggcaggatcgntgagataggatgactcttttnacgagaaacggactggttgctgagcaggggccgtggtgaattganaaggtttgctgtgtcatgttgagttgtgnatatactccttatacttgnatagctctngcgtccaaancgaagacct

SEQ ID NO: 3408 - DNA, 651 bp, Fusarium venenatum
  misc_feature (1)...(651): n = A,T,C or G
gaacttctgcaacattctatacattaccatccatcacagtatcttgaaactgcaatatacttcttggccactcaagccaatcctgccattcatctggcaaaattttctcaatcgctctaatctctctaacacccgaatccccaatccaccaaaactcactcaacatggacaatagagcaaagtaatacgcaagaataacaagcgccctcggacgaagctcctccaccagatccgcaaacttcgggcgcatcatcatagggaaaacaatagttcgtcgtccaatactcttgttgatattttccctatccatgaaattccgtatgcgtcctatgagactcagcgctctcacgtatgcatcttctgtttcttcatcccacggttcttcaacctcgtgaggtttctctcggcttaacaagggttttaaatcgtcgggtagttcattactatcgttgtcctctagaagatccgcggcactttcgatcatctnggnatactaccgactcaggggtatcccgtatgatatccaccccttgcggaagaacgcaagantcgtccctggaanccncaaaagggccaccgggaggggttataaggttccancgagcnacncttgaagncgaatataaccgtaaaacccncacgattccttga

SEQ ID NO: 3409 - DNA, 184 bp, Fusarium venenatum
  misc_feature (1)...(184): n = A,T,C or G
ncgcgcctcgaaggctgggtctgctgnatcaaaaggccgacgcagcgataccatnaantgcaacggtccngttaagggtgccatcctaaagcnttnaaactacacatactacacatacgagagtgtgnctaatggatgcaagagttacctgactttcaatccttacncttcggcctatgttttg

SEQ ID NO: 3410 - DNA, 576 bp, Fusarium venenatum
  misc_feature (1)...(576): n = A,T,C or G
gcatattacaacatggccgacaagatcaaagaccttcttgcagacgacagcgtatctgcgcaagatgctgcgcggaaaattacaagctcttgtataaccgcaattgagaagaacgaagatgcgtccaaaattgaggatgagctgtatgccctctggccgggcatcctcaccgccgccgagcaaacccctcatgatcgacaagataagctagtgcaaattatgcaggcgataaaggaacttgcaccctccggagacaaggccaaaaagattgttgtttgggggaatgagacacgctgggatgcgcttcccctgttcggctctacagcacgagatgaacttgaccgtgcgcaagaagatctgaagactcctgtgtaaacatcaacgcattcttcgcccgtatcacggctgctggaattgatgactttactctctacgccatctggatcttgcgcgatgccattgangacccgccgtgaatgagatcgcacaaaagacttcacccangctattgaaagctgcctcagtttggttcatttacgctggtgattcattggcaaaggcgaccaaagaaggaaa

SEQ ID NO: 3411 - DNA, 624 bp, Fusarium venenatum
  misc_feature (1)...(624): n = A,T,C or G
caaaacaacgccaccagcatgacactcatcaacgttcaatggacctatctgggaatcacgctgctttgcgttgccctcggtctcttcttttattacatgcctcttccggaagtcagcgatcgcgagctggagcaatccgcgacgcatcttcccatggatcctcaaaagaagagcagcgacctgcaactacgcacctggagcctgattttggctgttcttgcgcaatacgcctacgtagcttccaggagtgtttcagtatttatttccgcagtctcatgatctccatacttcccaatcaacctaacagtggcgagaaagccgcacaaggcgctagcgacattcctaatcccgacaagccacctggcatcagcctctctatacccgactacctacttattgcgcataccgcctttacggnatctcgctttatggcagcaggcctacatatctctctgnataccgtcccgcttccccggcctncactattctaccgctgcatcgctggggtttcctcttcgccttctccgtggtgtccgtcacccaacccaacttctggtatccgatggcctctctactcttcanggactataacccctatttcgtattggcttccggcaggncgac

SEQ ID NO: 3412 - DNA, 623 bp, Fusarium venenatum
  misc_feature (1)...(623): n = A,T,C or G
ggttcccgccgttgctcagcctgcgctattacccgctgcgcccatctcctccgcagcaatgactctggacaagtccaagaagcgcaagcggtgagcggcgcctctcccgtgtggttgggttccgattagtagtatgtatatactgggatctcaaagcacacattgccgtgtctttgcggcatttgtacaccacttatgattgttactcaggagggcgtaataacgacggtcagttgaccattacactccttatacggcgtttggaagaaatattgcgaggctaactatcagccccttgcgacagcctcggggatgtatgtggaggagttgtgaagaaacaaggtgcggtatgggaaaggaaaaaggggcgcgcggattggaaaatctcccagaggttagaaggacatcaaagaaaaggcatatggatggtttatcgtgtgcctgaaagcgcacaaagcggaatgggtgatccaaaagagggtccgcctggatgttcangaatctgcccatcaacagcacaaaaggagcggactggtttgacagcgggtattgtttctgattggtttcccctgggctggaacttttctatactttggtacctactcgtttaaatacacatactc

SEQ ID NO: 3413 - DNA, 182 bp, Fusarium venenatum
  misc_feature (1)...(182): n = A,T,C or G
ncngtactgncacgggtgttacaaattgnanaatgcgacgagatgaaccanacttagtacagactgccngacggtagactanttnttaccacagcgttatntacgntgggctgtngcgacccnaatgcanatgaggagaagaagtagctcacgccattcagntgtcnatgaaaaccaataca

SEQ ID NO: 3414 - DNA, 122 bp, Fusarium venenatum
  misc_feature (1)...(122): n = A,T,C or G
ngctgttnactttggncctngatgactacgagcnanccaccgattcnctctaanaaaacccnactangaantcactgtcttcgcacccgcttggatgtcccacnacataatacgctatgaga

SEQ ID NO: 3415 - DNA, 197 bp, Fusarium venenatum
  misc_feature (1)...(197): n = A,T,C or G
ntagaacaagaggcgaacccgatccnagcacctacacctggcgaaagagcaacccttacctattgnngggcttacgggctggagcgcgctaattacccaaagnaaacttgcttttcttggtncaaatgggctttttnacaagcanactatgcngagttgccttgcaanatccttaaantatgggtntncaaaggggt

SEQ ID NO: 3416 - DNA, 114 bp, Fusarium venenatum
  misc_feature (1)...(114): n = A,T,C or G
ngaaacaagcgaaangacnaaaggacnatgantcaggaatggccggcnaaaaacanangacggacgccaggagctggaaatcgcattgggaaccgatcacattgngtncagaga

SEQ ID NO: 3417 - DNA, 485 bp, Fusarium venenatum
  misc_feature (1)...(485): n = A,T,C or G
cccgaagcttggacggttcactacctggctccagctctactttcaaccaagtctaatcaacattcacatccatattctcactgcaacaggacagcatccgtacctggacagatgaatgggctccatagacccggctattgtgtcccgggctcattatccagcgtgacgagcttggttcaaacgctgtgctgtgctggacagagagacctgcagcactgcattacttcacccatgggtctatctggaatcagccaaaacctcccaggtcttgcatctgccaaagtactgtactactcagtgcttttcctatgcaacaccctagcagatttgaccctgcctgcctggttctggnaaaagcgtccccggaccgcaattacacttgaccgattgnagtacatggaactgaccactaccaatatagccatttagactggatcgtnccgtccatgtcccttgcacggaaagtatggcgtttnttnggttgt

SEQ ID NO: 3418 - DNA, 515 bp, Fusarium venenatum
ctggtacgccgggaatatttcgctttcagtgagaacatcatggcaatgcccaccattgaaagtccccttgattgggaagggataggcgacatcggctatcctgattctgagtatgctgactttggcttccatgacctcttgaaagagtggaaggacaggatcttgccctgatacaacttttgcgataatgccggccaaaaggggcgtatgagtgatattgcgtcttttttacgaatatggctctttttcgggctcttgaaggaggttcttggagaaggtcatggctcactgcagcattttgagacagagggcaggatcgataaagccaaggtcaccagtcagatagaagaatggaggaggagagaactggagaatcaacaaggaaccgacgagacgctccggcgacgacaacagctcggacatgacaaaagactcaatcgctaataaccgagatattctcacgtgctctgatggtcctgggcgagatgcttacaagttatacaaattgattgcta

SEQ ID NO: 3419 - DNA, 500 bp, Fusarium venenatum
cgcgaacatactcatcatccttaccctcgtattgtttctttgttccggttcttgtttatttgatcggaagcatgcaattgccagcgtcgtttgactggcctcggctttgcacggcatcttcggtccgtctaaattcatctttgaacctctttcttatcttttacctggacaacagccggactctatgggaacatgcatgatcatggcagcactgctacgacgacgcacgcctattcgtatggaaaacaccggctcttggcagaaaaagacatctaccaacgaatttcctttttccaacattcacctagacttgtttgcatggatccttggttactagggggtcactagacggtttctccgtatctggcacctttccccagacacaactttggatcattcacccaaggactactactacgatttgaacgacagacgctgtcagctagctcttaacgactttcgaaaattctacggcacactgcgaaggatataccccgcga

SEQ ID NO: 3420 - DNA, 338 bp, Fusarium venenatum
  misc_feature (1)...(338): n = A,T,C or G
nngcgtgccaactacacctttgttaacccctacagctagggttaagacaatgaaagcaactcaagccttnaaatattttccatcgacgcngaccctaccacctnttnaattgacnaanacaccgaggncgcataatnctacacaatttaccaccaggagcatacctcantnaacacacngatgggctgggcgncattgcttggtnaataaagaaagnacgtttnggngtggacagangttattggtcacgaccacccctgngatctcccaatnacaagcgagtgntnccagttgnttnaaaggtgganaagncaataccacgttcttggtgacccttt

SEQ ID NO: 3421 - DNA, 1097 bp, Fusarium venenatum
  misc_feature (1)...(1097): n = A,T,C or G
ccaagccacgccaaaaatgtacaagactcgattctcacaatggggattcgtcaanaataacaccgaggacgaagtcaaacgcttgttgtccatgaagtttcaacgtgatgctgaaggaaaggtgtcanaattcgttcgcaacggaaaagttgttaatctgggtacatatctgaaaaggaaaggcgtaactgaatatgatctggtcgatttcgagttaccggctgatctgccggcacatatccgatgtcgaaccccaactccacctcccacgccaggttaccttcagtcaccggatcttatccgcgctcaanaaacaatcgtcaccaatatgaggaaggctttcctacaatgccggcaattcgaggtggaaacagatgctcaagttgggtggcagtcggttatggtttggggagccgggtccagtgatcttcttctcgaagccaactattatttcgaaatgaaggatcacgatcaaggtggtgacttctttgatgaaggcattctcacaactcgagtcggatttgaagaagctttccccacaaggtatcatagagctgcttctaggcatggttcatcgngatccaggcatgatgactgcgctttccaagtatttctcggcttattcgatgaccaacttcgagcgatcgcatcccttgcggcagatctttgcctgcttatatgaggtccagcagaagcatggcccacagacactctcggagctactgtggggaagcataaccactattgctgaggaactggaagctatttatgggcgcaagcatccttatgtggctcgaacatgggtcgatctgccatgttctacaaccacgtcagccaaaaagagattgganaaactggtgggagaactccgacttttgcagcggcaaatggagcaccaacttggtgtcgaaagtgccnacgttctcgtattgcgatatacaattatccagttgatgttgnaagaacgtnctaaatncgacccgacgaacaagcgaccattggatttttggcnttaatttgaaaagggatngggattcctttttcctttgccgaagccagcaaccaantgttttttnttccnccgtcctttttaaggg

SEQ ID NO: 3422 - DNA, 248 bp, Fusarium venenatum
  misc_feature (1)...(248): n = A,T,C or G
nanccgaggacatnganaaagtgccctggccangnttgaggaaaagancatgtatanacatgaattctccgtgagactgaccttaggagancgcngacctgnanttgtcgagggaggatatcgaaaagacgacttncctttatnggacttaactgggatggggagtagcaatgcccttctaggaactnctgggctttcaaaagaaccacccctnatnggggggccaattttccttcccaanggccaag

SEQ ID NO: 3423 - DNA, 134 bp, Fusarium venenatum
  misc_feature (1)...(134): n = A,T,C or G
aaataggcgatgggaatctgatgacaggtagttcagtttctggtctctttatacacaacgacttgaactttataagcatagcttgagaccgcttgacagtttanagactccgctgtcttatatcccaccacttt

SEQ ID NO: 3424 - DNA, 639 bp, Fusarium venenatum
  misc_feature (1)...(639): n = A,T,C or G
ttctggtttaatttgaccaaaaatcttccgacctctctactcattgaagcgaaagtggaatccccttttcccttttcccttttataagaatacacggcttggactcatacaaaatccgtctcttactcgcatcgcactctctttcgtatcagagagagattgcgtgcaaccgctgaggctttgctcttgcgggagacnaaaacggcatcgcgcttacacgttcacaacttaccctatttggcaatcaacctttgagcaagagtcgatgtagttcaagactcggcgaagccttgaaactttgctcgctttttaaactctcttactattcttaaaatatcacattctcgaccaactattgcatgattccacacttgggagtctgctcaccataccgaaacaatgtcgaattccatcgccaactctggctctatcaagcctcgaagagaacccagagacacagggttccctgagcctctcaacaaccttcgcaacacaactctcccacatcccgatgcggatctttcaccaaacgcatgccttacccaagaagatattgaccccgattcgggctcttatgcgaaccccggggatntttctnaggaaaaagcgacaactntgaaccntggccgtttactccgg

SEQ ID NO: 3425 - DNA, 584 bp, Fusarium venenatum
  misc_feature (1)...(584): n = A,T,C or G
aatnacttttttttttttttttttttttngggnccaaaaacgagatcgtaatcaagtgaattattctaaatagtcatnaatgngcctcaaaaacttgcttccaaattatttcatgatcatgtataaacaaccctcaactctgacagcaataccggaaagttgtttgacaaccaactntgcgttcccaagatccaacaaaccgatntcatgagataacatttaacaattgtatgtgcagataaaacattccatcgncaggccacagtacctgtttcataaagagaaccacacaatttacatgcggtaggagagaatgactgctgntccgttcagtgtccanngccgtagtttgactgcgcatttgacaaaagtcgctctcgctcatcatctgntttcatntcaaccttnttctccacaaacatcctacccttaatggcaacgaatacggtaaggatgataccgactaggggtnccaacagcgcccancggggcgttgataggtgttggatttcatgaaaccgggcccgnggggtgancgcgtcnanaaccgactggacaacttgagtgattcccganacncaagg

SEQ ID NO: 3426 - DNA, 524 bp, Fusarium venenatum
  misc_feature (1)...(524): n = A,T,C or G
gaatgaattacacactgatcctatctatcaacggacccttcactctatcaggccccgataactctttgtcccttgacaaaagcggcaatcttgtgtttgaggccgatggatgggaataccctcttcgtcacgtcagcaacgacnacgctttgaaactggatccaggtcatcctggtcggatctgggtcaacacttcctcatccacacacgagcccgtcaaaatatcagtgcctgctgagattactctaatggcagatgtactccatggtacggtggtgttgactggctcaaagttgataggaagatttgaagtttttgtctttggagggcggaacacgcagttcagctggagtcagatggcgtttgttgcgcccctggatgagatcaaaggggaagtgagtggcttaactttgaatgcatctaccatgttctccgcgatcgacgcagatgagaagacgtccaacgttccagganagancagcgctgttcccacgacagatttgccaggcttgattacggtcttg

SEQ ID NO: 3427 - DNA, 263 bp, Fusarium venenatum
  misc_feature (1)...(263): n = A,T,C or G
aattngattttcttaaanaccgtcngacgctagataaggagtaggcagaggacgttatatacaatnaacttggcgagatgaatgcnattagagatgacactntccaagcttataaaggtatagtcggagggaactgggaatagaaacagagtatgatagatagagcgtcagtctgattaggcttgagccaccttgccatggtcattagagcaggcagtactcacgaatccttgtggttcttatcaaaattataatagtttatt

SEQ ID NO: 3428 - DNA, 288 bp, Fusarium venenatum
  misc_feature (1)...(288): n = A,T,C or G
ggaattttgccgatggtgangganaaaaacagttgcctactgnnccgagctcgcccgtacagcagcagtcccagcctnagtgtcaagcacagcctcnancagaacaggactctcgcatgcgcctgcattccctcttggattaattgttcaaccccaacgcgctcaacgacttcgccttgtgccgagctntgtttagaggaaacattggcngncatacaacacatttgattttngacaaangaaaatccncgccttttaatggacaggtaccgagttaggtgccaacat

SEQ ID NO: 3429 - DNA, 523 bp, Fusarium venenatum
  misc_feature (1)...(523): n = A,T,C or G
cgtgcaaccaaccccgatccaacgtcggaaccttgagccgaaagggttttggcaatggatcaatgaaatatgttccacacgagaggacaaaaggccacagctggcccatgaagcacacgaatctcactttctccggctcacattttcacaacctatggggtttttcttgcatttcgagataccaggaaggcgttgacattttatatgggggaatgggaacacatacacaacagcacaagaacgaacactcctcagtgacnaatggggtcacggtatgggtacatgcataagcgggctgagcgactgttgctttgcacagcgctntcagtaatgtcataaggacatganccgactgcttacttttcgattcaatcttatattttactgcattacgacacggcggcctcgactaagcaatctttggttacatggaaatggatggattgtctttgcgattaatcttggtttgaacaagttgtacaancatcagtgttggcttcaaagtctggatataatatgcagg

SEQ ID NO: 3430 - DNA, 591 bp, Fusarium venenatum
  misc_feature (1)...(591): n = A,T,C or G
ccatgtctccaatgcatcaaatcaatttcgaatcgcaatgcttttggtatccaacactggaaactgggaacacttggattgaccaggaaacgcagtaattcccttgatgttttggtgtctttttgaatggacgtggtgatggggctttatttcaactctcaacctttgttcgatgtcatgggaacttcacttgcctttgccttgcgatgatgtggcctggggatgctgataaggctgaggactgtgcttcggcacttggtcttcacgggccagatatcgctcggcaaaagaacccatacggcactcaacgaagcaaagcaaccggagatngattgggccctcaagacccttttgcacccatcttatcagatccaacctggaagcacaaacctttatggaaaatttgtccttatccacggcattttagctctgatccggcgggnccagatcgacggccatgcagctcaattgtccaaatttgacacnccacctcccaatgattggatgactgcactggcggcaataaccggccggggcactccacttgaaggggcggcagccaacgtggaaccccaaaantctgcagaccct

SEQ ID NO: 3431 - DNA, 330 bp, Fusarium venenatum
  misc_feature (1)...(330): n = A,T,C or G
ncgcctgtggagtcgaaaactcctctccattcgncatcaatcatgcacgatggactatagaccgaatgtcatcgnctcaatatcaattactntgccacttgcagcgactgtcctngnacttcgactntttgcgcgacggtcgacgagggccggatatggaattgacgattgcntggcggnagatgcctttatcggagctctnggatactcgatagacaatattgantggctaataggcttnggactcggagtaccactcaaagatggcccagcgcacctnacccacgacgagcgactcgaacgatcatatgacctgacgtggatcagaag

SEQ ID NO: 3432 - DNA, 584 bp, Fusarium venenatum
  misc_feature (1)...(584): n = A,T,C or G
atcaaggattatctataaataaacatggcctcttattggggaagcggcaccactgcccaggtccatattctgggtttgaactgaatgcccgtacagaattcncctttcatatanccccgcaaccagcctctcaaaataaaataaaatttgggtggcattccctgacatcaacaacctgaagacccaatccatccatctttcttcaagacacacatctacaaacatgaacttcaccttgttctcgggtgtttctgancagcctcgtttaccacatgacccgtcaactgagtcttttgaactcagggccgtcgcgggacccgatatctggcggacccttcttgtgctggagggcgagacaatttcaacggtccaatctatgcaactcctcttgcactaaattcgttcaaaaangccaaggtcacngtatcagccaattttcacgccccatactcccanggcggtcttattctgtttatgcccgaatctgatccgactgtcgataccgatgggcagtcgtcgccccttcacttntcnccaagtacatggatnaaagctggaattgaactcctcgatnatcancattt

SEQ ID NO: 3433 - DNA, 313 bp, Fusarium venenatum
  misc_feature (1)...(313): n = A,T,C or G
cgcccacatgcctgctcccgtttnttggggtctgacnaatatcgcgggttcgtggtacggaaagtggtggaagttttcgagctgtgactctcaaggcaaaccacaagaactttatgctctccgtggcttgaaagagtgagttgggggttgtcaatgacttatctagacgtggattctgtgattcagggcgttgatgataagcgaattgataggactatcctttgttagtattaaaaacagagaagtgacaagagccaatttctttgaccttgttgacaatctttacctgatattctatctgccnaaaaaataa

SEQ ID NO: 3434 - DNA, 145 bp, Fusarium venenatum
  misc_feature (1)...(145): n = A,T,C or G
ngacaagattccctattctgataaccnctaggtncccccccccncgaancccggntggggtggttaactaagaanaagatataccccanttgcccaaacctggatggtttttgcaatttcttnnctaggactttcggggnttaac

SEQ ID NO: 3435 - DNA, 307 bp, Fusarium venenatum
  misc_feature (1)...(307): n = A,T,C or G
tctgagctctccatcttctacatcttccccacgaaaaaactctgaccatatatctcgtgtgaaatcactctcgcggcccgacatagctgcgagctacgcttgcgtttccgtcttacactctgctttcttatcgatttcccggctccgccgcccggagataagaaacgactacgcttaagccgnggcgcccggtttnttttttgttaccaccaacctcgtacccatcaacttgntcgagggattatactaanancttgcggctcattgggatangaactgggggantaaataaacttgaccaactttg

SEQ ID NO: 3436 - DNA, 617 bp, Fusarium venenatum
  misc_feature (1)...(617): n = A,T,C or G
accagtagtcatatgcttgtctcaaagattaagccatgcatgtctaagtataagcaattatacagcgaaactgcgaatggctcattatataagttatcgtttatttgatagtaccttactacttggataaccgtggtaattctagagctaatacatgctaaaaatcccgacttcggaagggatgtatttattagattaaaaaccaatgcccttcggggctcactggtgattcatgataactcctcgaatcgcatggccttgtgccggcgatggttcattcaaatttcttccctatcaactttcgatgtttgggtattggccaaacatggttgcaacgggtaacggagggttagggctcgaccccggagaaagagcctgagaaacggctactgcctcaactggttcatncgcgaattcgaaatgcacgggcgaggncccaacattatttncngcatctttggcgtcatncaaactgntctctacattgactttgcatgggtttactacactcgccagcgcgtaagctncgcggnggcggnatcgttgatgcccatgatatgaagccgcaacttggcttttccgccgcattttttgnaagcgcttngctcacgacnagg

SEQ ID NO: 3437 - DNA, 344 bp, Fusarium venenatum
  misc_feature (1)...(344): n = A,T,C or G
cccagaaaaagcaccatcccagacaccagataacgacgagtcgccctaaatcatgacgacggccccgtcttcgggctcttctcggccggcaactctatctgcatcagagtcaacagcaccagcagaaaactcattgtcatcagccggggaagtccctatcgttcctactgtggagatccagcacttggcccgcttcgaattcagtgatgctggcacaaaggttcttatggtggaatggtatcctgatgctgtccaaggccccgctgcatctgccgatccttccgccgattcctccggtgaacgctccgttccaactaccgatcanggtttccgaanngaaccgg

SEQ ID NO: 3438 - DNA, 1013 bp, Fusarium venenatum
  misc_feature (1)...(1013): n = A,T,C or G
ccttgtcggacacggaagtcacactccgcttactaaccgtctcgatctcggctggcacggcgttcggagactcactcactaattgtctaacctctattggtcgaatttcgctgatgatttgggtgttagttgtgctggactgcagctccagctgttaaanaaatgctatgtcaccatcaatctcgttagcatctcgtcctgngggggcgaactaagggtcagcactgactgagctccccattgctcttcctccacgtgcnaaaatgactggttggaccaagactcgatgggtaggcatgcaggaaacaagatcggacggatttgatctcttatgattcaccaacaccgctttgcatttgcattttgccttgcttgaccttgctcctgtaatatccttgctatactaccatatcaatatcaactctatctcactggcaccaaccctgatcggatactctaccgactgcagcacagtagtcgactaacttgatcttgactgtctgacgatcaactgagatcattgcatacagctagcactagcagatgctcttgatgaggcaccttctccgctcctgaggcctctttgttggctttgctttattatatctcgcttaccaccatccagcatttacacaatatcggtattgcacactgacttctcctatacatccacatcgctgtctatatacgacacagtctattgagacatgacgcctgataacagcatccacgccgcccacctgccatctatcgaacccgctcgaagtagctcaaggcactcgaccgcacacaatggctccagcaccgcttttgagcctgccatggccgatgataatgagactatcgctagaaacgtcttcgcacatgaccgatgtcgagagtcagactaccggcaccggacgttggcagcccaatcccattgacaatggatccgtatgaccttttccgnggnttacaaaacaanagtctggacttcgccgatatcaaagccacacgttgcggnagcggggatn

SEQ ID NO: 3439 - DNA, 535 bp, Fusarium venenatum
  misc_feature (1)...(535): n = A,T,C or G
ngctggcgaggcatatatctactaagctttcattttgataccacgtcactcttcaattcgttttgaatatttcatcactatcgagatcccgctttcgtctcattgtaacgctccctggctgtcaagtctcgccctggaagcgtttaatattgattgaggaaatggctcgtctgttgtttctcacgcgcagatgattgacactagttcatttctacaagttcaaggtcactttgatttatcctggttcttttcatgcgcgttctacaacaaatgcgtgtcacgcatgtcttttcgcgggtgcgatcgacactatataagtggatgaagtaaaaaacatagtatcattgctggtgagattcttatcaacaattcgttcgctccctgcctggttcctacatcgactcacgtctgcgccgtgggacaaactcgacgtgtcatccgtgtttacatggtgttgnacagacatcatgacaagcatgtcttgacccgacccancgaatcgggctgttggggatgttgtccgtccaatatcgag

SEQ ID NO: 3440 - DNA, 590 bp, Fusarium venenatum
  misc_feature (1)...(590): n = A,T,C or G
ctttggcgagaggttctctcgaaatgtcaaggctcccgaatctcccccacaaagtccagcttgggtcctccgaggacttgtacttgccagtgttcaagcagcaggccactggatcgcaatcaatactattcagagtacaccaggctatgagagtgttcctacattgcaactgatacttctcttgtgcacaatgccccgtcttggctggctcgcgatagcaccgaaagaaattcattgttccgaatcaaaagatctgaccgcggcatgttcagcgctctacgcggagggtttcctgcagatccccaacttgtattcaatgactacggttttgaattatggatttcgcaatggtttctatttcggtgttttgccttatacagagttgggatactccgcttggatgatgtacggcgggancgctcctgtggctcgttgctgttgctttgattgttgtaattgtcatccgaatcctgcgtccagtattcgccacccatactctcatatacacagtatcagaagaactatccaagtgcganggcaataaatgcacatcaacaaatgaaagaaatgaaactggtcacttgttgatc

SEQ ID NO: 3441 - DNA, 913 bp, Fusarium venenatum
  misc_feature (1)...(913): n = A,T,C or G
ccgacgacgaccgagacgaagacgttaccttacgtttatcaccgtgttagcccatcgccaacacgctctgcgaatatattccaagctgcccatcttcgtgaagagctgctttgattaaccctgctccgccatttactttggccccagacgacgaccgacgaaccaccgtgtccgtcctaaaaaaaccgactccaaattcactgatcgcgcgcccgcttggctgccccaacacaaatacaatacaagacgacgacagtacgacgacgagaacattacttctcatcttcaaaagaaaaagaaaagacgatcgagtggcctgtttgctactcttgacctgtttattgtacaaaggcgacgaagcgtcacatatttgttgacgcatacctattatctcggacgaaggataataacaaaaactcgcgttgacggtgttttgttctattctcctctctggcttgcccccattttctgacgccctgtacctacgtctctttctggtacagttatcaacaaccaaagtcggtggcccactgcggcaaccacgacgacgaactgttcttgtccctgtatttgacgtgatctgattgctttgcaattcaattcaatatcgacaatctgcttgattcgctcctctgctcgattcgctttcagctctcgaaagcttccgcagctacaacaaagcctctcgctgatagaagagacgtgatcccttcacgggttttttgggaagggcatctatccatctgctatcatattccactcgacaagttaccccccgcagtggttctgataagcgatcttgaatgccgccttcttctccccacgcgaacttcctcanttctacgcggggcctcgttcgccagcaatatctcnaaatggcgacaccaagtcaattcaatcatatcaacnctac

SEQ ID NO: 3442 - DNA, 802 bp, Fusarium venenatum
  misc_feature (1)...(802): n = A,T,C or G
gaattttttttttttttttttttcaacgccatcacttcgtattcaagagcctactctacagcttggaactaacccgtatggtgtacgtacccgttagctctatctccgcattcaaccctgcccctgctagtccgttcattgcgcggcacagggggcagtctccccccgtcctgggtctaactacactacggcatgtttcttctgggtacctcgtgctccagtcaagaggtgatgctcgcaaccgggtgcacaaacgagttgaaagcatattccggaagtgttaatgtcggtcaagccaaacaccacgacgcgggggttccttgngggtctttcgtcaacaatcgcggtcaagccgggnccggggtgatgacacttcttctggtcttcnttctcgaccactgngggctggttaattgggggtgtcaaaagtacaactgntttggncagcttgcttgttggcgcttgtaaangtgctttgatgccccggtaccgacgaaatacacgacgatgcgaaccttntgttaactgnttactgganggtaaaatgacgggcagcaaggggaatacccgggatgggcgccaacatccgtcgngtcnatgcttnaanacgactttttatcggttttggttgcattaaaggatgtggatctcattattgggactttgggganaaaacccaatcggggggncggcctccttggcnnaaaacggggtaaannttttggactttgggtgaaantttgtaaccnggaagggggaatttnaaatcgggggtccattggnatttggnaanctccccaag

SEQ ID NO: 3443 - DNA, 300 bp, Fusarium venenatum
  misc_feature (1)...(300): n = A,T,C or G
gggaagcacatcgaaagacatcaagagacatgtcccaagccgtacgactctttgtgaacagagcgaaccgagctttacaaataggggacgtgcatgatgccattttgttgataatacatgtaggtatgttggttgagaagagaagatatgatatgaatagttttggcggcaaaaggggatgtggatggtgagtcanttanaccaaagaggtaaatatgtagtctgaatgcaggcctaaatgcatgcggcgtagacaaccaagatctcaatcgtcaaacctacacaatacacgagatgcan

SEQ ID NO: 3444 - DNA, 152 bp, Fusarium venenatum
  misc_feature (1)...(152): n = A,T,C or G
ngcaagtgtgttngaaaaactnactgccggngaccacgtggggggaattctnaccaagttcctnagcgccacctacanatntattatacacngcctcngccttcgcgcanggcttcgttcngatccaatttcggacccctgggagaggagat

SEQ ID NO: 3445 - DNA, 119 bp, Fusarium venenatum
  misc_feature (1)...(119): n = A,T,C or G
natggggnaacctcccaacgttcaaaaagaagttgnntatagcctttcggggccatatacacagttatccaaaacgcgactcncttgtttttgnngtggctggcccgaaataanaaaag

SEQ ID NO: 3446 - DNA, 170 bp, Fusarium venenatum
  misc_feature (1)...(170): n = A,T,C or G
ngatttatttngacntggaacgtaatgctnnccaggatgaggnacagctatnaggaatcagaggcgtcaaanaagcgcatcgacagatgttctgatcacactatntctgtataacctatactctantgcctgtctaggttgtgcttactngacagtntcaatcaccctgg

SEQ ID NO: 3447 - DNA, 336 bp, Fusarium venenatum
  misc_feature (1)...(336): n = A,T,C or G
tcanaacaggaccctggacaaggcagaagcggccaggcaaaagttgatggatttgcgaagtcttttcaaatgaacgacgaatgggcccggttcatggagcagtaacgactgcatggaacaggagtttttggtgcgatttttttcttattactatttttcttgcggacttctcgactcactggcagcgagtcggttcaggctcaagtggcatcatcctggggcgcgagtgcgcaaacttttacgggttactttattcgttctggggtaaggctatacttcttgactctcacgagatggttttattatttccggcttgcatcattgggtttttttttn

SEQ ID NO: 3448 - DNA, 338 bp, Fusarium venenatum
  misc_feature (1)...(338): n = A,T,C or G
ngggtatcgaaactngagcgtnttntacttggacaccaccancncacattgggtcgttgtgtgctccatgccttcatcaaacttgcggagtgctaccccgagactggnaaggttgggctcggaccataaacntttcatggccccaanaaggctcttgtnaacctttttaccccagctgacctgtaccatggtttagnggagggcgtaaataaatatctcattctnggnccataacggaggctcaccancttcctggcgattttagactctgtgctgatgcgtgctgagtaaggggaagaggancggantggatggcacaaggggnttaacccgaaggg

SEQ ID NO: 3449 - DNA, 462 bp, Fusarium venenatum
  misc_feature (1)...(462): n = A,T,C or G
gtgcttctatctatcgcctgtccttcttctcttggggggcggtccttttgtaaccggcacnctggtctgttctaccataagcaatacgtgaaancggaggcatagaacagccgtgttttcactcgctgaaccttatcagtcatctggaactgttttgagccaactctcntgacatccacaatgancattcccctctggttgtcttcatngatcaccatntgtnatgcntgcgttgcttttcattccggcttattatctcncggaagacgacaacccntctctagaanatgatttactacttgaggttctgtattccgcnatgaggtagagccgtnactggatgctantgatattcttgggccgcgaagtcntcgattcgaaccagtacattaaaaggtggacttacttcgangctcaccatcctcacagtattgcttcgtttgctcttttnaagttcaactt

SEQ ID NO: 3450 - DNA, 621 bp, Fusarium venenatum
  misc_feature (1)...(621): n = A,T,C or G
ccagaatcaaagctaagcggtagatcgctatcccccttttattccttcttcttaatcccttgtatcggtctgtctcctcacttcttctattttcattgccgtaatctcgtctgggaccatcaaactcttgactaaaaagccaagccaggctgtgcatgaggaaggttttccttgcttgtctcacaattcatttcatcccaccgttccattcatcatacgtctctacggtgactttgacattgccatcctttactttacccacttccatcttgtcgatctgtcgatagctacaaaaggtggctcctcaacattggtctggtgtttctgcagcagggatcacaagcagggcgaccatacaccgcagatcacactagatcttgtattgtgtttcacccatactcgattttagcttgccttctatctaattactttttctccgtctttgatctgacctggcctggtcttcttctggatttgnacattcgctttggtcctgtaccacttataccaaacgagggcctgcttcacgaggtggaacccaatcagtgcgcggacctgagctgtgaaagcttgtcatactaaagcgactcgactcctatcgcttggtgacccaatacttta

SEQ ID NO: 3451 - DNA, 495 bp, Fusarium venenatum
  misc_feature (1)...(495): n = A,T,C or G
tctggttcccagatgttcatcatgtaccaggacggaaaagggcaacgtcactctgaagcccaagaaccaggaaacaggccaatgttaatgcccaggttactcgaaaaatggatgggaactcgaagctgtttggaaanggttcngggaattcaaggaataaatgaagaatgaattgnccaacgtttcgaatgcaacgaactggcnagaactttgaaacctccnaggggttctgacttgttggatcgccgcctggctgttctggcgactccctgggcttcgacaagcccctccgaanccatttctcngcacgatgaaaacctacctttgatgtcaacttgccaaancccgatgactccatagcaacccgtnccttcccccacacaatcaaggcagctccnctctggtgggctgcttcgaaaaatccaccgcggtgcaagcaacacggttaactggtcacngtatcatattttattgttttcatccctggatacctct

SEQ ID NO: 3452 - DNA, 565 bp, Fusarium venenatum
  misc_feature (1)...(565): n = A,T,C or G
ttgggagtcggacgaggaaaaccgcacatttccaacgacgtgctcaattggtagcacagcagctgtgtcaccagacgagggacctctgatttcgcggttcgccacgtctacgtttggccgcaacgagatccgaccacagcggaggagcgtcggcgttgcaatgtgaaggaatgattggagtacattgtttggtttataccccgcgttttgcaacgtttttgatgactttatttacattcgatgataccattttaccatatacgatagctaccacctagctagactacgtggtacttctttggatatttgacattgcggtaatggataatgaattgggggaactgggttcggataaaaggatggaaacctgggcggcaggcttgctctaaaatcatgcatgttacacgatggccactttcaataggcgagttttgcataacggtgtgatggaggcattgnctagatagtcacagttatacgcctaaagcggtttnacaaagatggtacatcgtcgaattcttttttttttttttttcaaaagttttntggggtnttagttgaactg

SEQ ID NO: 3453 - DNA, 139 bp, Fusarium venenatum
  misc_feature (1)...(139): n = A,T,C or G
naacttccnnaacccccgccctnttcaaaanaaanatttcacccatnacatgggcttaaaatcttgactagaccttttccttcccattaacaaaaaccccatgtatggttttacagaggcttgccnccgatgaagttgg

SEQ ID NO: 3454 - DNA, 136 bp, Fusarium venenatum
  misc_feature (1)...(136): n = A,T,C or G
nctggcgaaccattagctaangatcttcttggtcaagaacctttttgnatgatcgcaantaagatggccnaactgatatggctttttgttnatctggatgaagtccgtaccttnactaggangacgaggcttttaa

SEQ ID NO: 3455 - DNA, 104 bp, Fusarium venenatum
  misc_feature (1)...(104): n = A,T,C or G
nataccgangcacnactaacaataactgcctcgaccaggtcttgnctgtnggcttactganttnggtgataacgcgaanntcaactangatcaaccatccacaa

SEQ ID NO: 3456 - DNA, 350 bp, Fusarium venenatum
  misc_feature (1)...(350): n = A,T,C or G
nantatgtccattnactgctgcttacnagcgaacggacttgngcccaaatcatgaagatgatggccggcatgctagcnataccnaggganttacgggncnactcgatcgnatatagctcttgcntgatgaaggcaatngcactgctgacgagcttgtngaggtcgtntcaaaacctgcttatntgnagcttttaaacagacctctccaggccaaatcttcgcttactttatggtgnacnattacgtctaaaacanaantggtagcgagtttgacaatttncnggggacntgcattacatntgctcgcgctgcanaatgtgatcttncanggacctnttctgaacttcgnn

SEQ ID NO: 3457 - DNA, 507 bp, Fusarium venenatum
  misc_feature (1)...(507): n = A,T,C or G
ngaggaaaantaaantttngcccaagggatganaccggcccggacttgatttgacatgaggcgttgacatgacgatntatntcaacactgaacaatgaatgactttcaacgcaattgggatctcgaacgaaggatgtganccatgcttatgaanagaccatatcttaagctgngtttacatcgtcatgatacagcatctttagcttnttgaaccctatcaagggctacccgttccaacaataaaagccacgcccggttagctcaatcggtagagcgtgagactcttacgagtacccgatctcaagggtgcgggttcgacccccgcatcgggctgttcctataaagtacgattgcaaacaagcgaggcacttcttttttttctctctnccatttttgggggantgggtttgttggaaaaanaggagggaagttgnggngaaaaattcggtgacctggggaaaaatnggcttgnttttttgatcangaaactttttaanaatggccgcc

SEQ ID NO: 3458 - DNA, 353 bp, Fusarium venenatum
  misc_feature (1)...(353): n = A,T,C or G
ggaaccgnggcagccttgtgtgccgttnatnaccggctggctgtgantgaacatggtctgtttgcgtttacttggcacatttatgatgagaacaccaatcaccacanaacattgaattaaaaggcataagcgggtatttgtttttatggcattatcttgtcttggttgttgcaattttattcaaggcccaagaccagaattncaaattaaatataattaaataacttaactactaagctttgtatatagatatgaaagtaagaggagtgacggtttattacaatattgattaggtagaataaagaagccttcaaatatcaagantgacaagtatcatttatgattagaaaaaa

SEQ ID NO: 3459 - DNA, 176 bp, Fusarium venenatum
ccttcagtgccgtgtatcaaatggcttgagcgggacagaacaacgggttcgagcagcaatgcaatcccttcacagtatcatatgaagctgggttctggcaatatgattattgcaagtataaagataacttataaccaatgctacactgtaatacttggtataccaatttgacaccc

SEQ ID NO: 3460 - DNA, 104 bp, Fusarium venenatum
  misc_feature (1)...(104): n = A,T,C or G
ntttttcntgcggccngancgagcattgcntnatagagggcccaatntcccccnatagtggngtcttatnanaattcanttggcccgtctgttntaanaacttc

SEQ ID NO: 3461 - DNA, 273 bp, Fusarium venenatum
  misc_feature (1)...(273): n = A,T,C or G
ctctcgtaataaatccatcggagcgagaaatgaaactcaaaagcgtctaatgcgaaactgtccgatggagtgaagggaagtgtgactgacccttgaggcngtgtatctttttgggtctcacaaggtaaaagaggatggatgctgcgatgtgatgtgaaagccactgagtccaacaaacatccagatacagcaggtggtggttttgatcagcggattgatacccaacaaccagtattatggacagatgctgctattattatgacagttgtcatt

SEQ ID NO: 3462 - DNA, 239 bp, Fusarium venenatum
  misc_feature (1)...(239): n = A,T,C or G
ctcctccgttcctcaccttcgcctctcctctgcccgtgacgacaacctctgcctcacaacctccaaccacctttggatatatcgacactcgcatctcgtgagcctcaacaaccgacaacccctctttcttcaaccttcccttttccggtccgtgggtggtttgggtnattttttttcctacgagaccccatctttntcctccttatngactccttaaccttttggcgattcctcgccgt

SEQ ID NO: 3463 - DNA, 220 bp, Fusarium venenatum
  misc_feature (1)...(220): n = A,T,C or G
ccaggtcgccgttgaccaagtaagtgacggtgagtatgtctcgagacggaatcccgtccgaatgggtaacgctgcgcccatcgcctacggaggctgcacagcgggccgtagctgtcaacgcttgatgccatacaagaacctctaccatggnaattttnttcggtcttnggncatttccatggtcntgcttnaacggaaaanaaactgtntgnacgtacca

SEQ ID NO: 3464 - DNA, 487 bp, Fusarium venenatum
  misc_feature (1)...(487): n = A,T,C or G
ttttgataaaaacaaaacaaaacaaaagtcagacaaactgtaccacatttccatctcttctctatcacgacttgtacgacgccatcacaacaagaacaaccgctcccgcgtccgctagagtagagctgctaaaccccgcatcgtcttgagtccagccctgttctgtcaagacaaatccgttttgtctttataataatattgcccgcgctttgcgacatactacgccaacaaaagcgcacgttttttacgatcacgactcgcacgactttaagacggaatagctatagactagatcagccagatccgtccttagctgaatcgccgctaaaaccaactacgacgctctcaagacgttttaatccaatccaattctcatcaacaaagttagcccaaggcttctnaacctcttctttcaaaggcgaatcgtcgcgccttagcgacaaccttacaggcatgtctaccatccagcaacttaagaatttcatcc

SEQ ID NO: 3465 - DNA, 206 bp, Fusarium venenatum
  misc_feature (1)...(206): n = A,T,C or G
nccccggcaanaaaaccgccgttttggcnacaggaaaaagcgctccaanacccgcanggagacttactnttttacatntacaagggngagtttaatcgccttttacctatgntcgntaaaacccgtggggcnaattggantcctagncctaaagcnggtccntccgncactggntttcnaaccgcccatgtccntcctgactcctt

SEQ ID NO: 3466 - DNA, 123 bp, Fusarium venenatum
  misc_feature (1)...(123): n = A,T,C or G
ntacaacaaggaactttantgtnagacataccgacacntggacccgctttgngttggatggaccgaananaggccgtcaacaaaggcntgggatatttgtcatttacaaacgggtttaccntt

SEQ ID NO: 3467 - DNA, 105 bp, Fusarium venenatum
  misc_feature (1)...(105): n = A,T,C or G
ntaaaaacctntaatcataccttgtttcgncgaaagancttaangaggccctttataagaaccctccgncaacgatcagcaccgatnctggagttattcctttct

SEQ ID NO: 3468 - DNA, 580 bp, Fusarium venenatum
ttctttgtctcgtccacatcaagcaccccacttacaaacaaacatccccttttttggtgctgaattaaataaagacttcatgagcaatcaatttgatcattgatgaatacaactgactcttcttcttaattgtacttttataccccccatctttaatctcgaccgcttgaaaaacgacatctgcttctacacgacatcgatcctcacagatcctccttcacgaatcttccattgcgatacttctcaaaacatacgctcgagacttgcgcgactcccaatcgttatgcgcctttgctgttagcagctgaaatccgaactcaaacactggtggattatacttgggaagggaaaatatcgattgacccgtcgctaaacaagaagaggaaggacaacgaccagacgaaccaccatggtgccctcttacggtcaaccggggaacacgaagggactcgctcgaactcgcatctttggcaagttcgagccagctcaacgatgaaggggcaacagaaatatcgtccccgcagaatatatcgtcatcgcgaaaaactatctctcgagcttgacgacccattgaacagcg

SEQ ID NO: 3469 - DNA, 280 bp, Fusarium venenatum
  misc_feature (1)...(280): n = A,T,C or G
gttcttgaaggttgcacttccaagactaggaagcacaggacaaggccnaacaacaagaatatggaaggttatgaatcatgggaaatggacgaatgatttggatatgcggtcttcgttgcggaaggcctgaacccggacaggggaagtcaagtccaggaagttatgaacccgacggcttcagtcaatgaaaagggaagaaaggagaggtgaaataacatcgcctgtcgttgacattcagagatataaagacataggaagcagaatagacaaggcgttnttc

SEQ ID NO: 3470 - DNA, 725 bp, Fusarium venenatum
  misc_feature (1)...(725): n = A,T,C or G
gagctgtcgcacactcattgagggagcgtgacacgtcggcactcggcgtgctgagcccaacaccatcgcaagcaagatctgttccgcctgaggccagtgcgtttcttgctcggtttcaggaatggccgctcgagaatgtttcaatgaaacgcattaccgaaaatggaaagactacgtttcaattccaatttgagtggcccctttgcgcaaatcatccgcatgccaccagtgtaagcccccattcaacccgctcggtcgcgacgaanaaaacaaccaagcgagctccagcaagacgggcaaagtattcagacgatgaagataacttccttatacaactgaaggaagaagagcagcttgggtgggcggagattcgtcggcgttttgctcgacgtttccccgaatgaagtggctcgagtctgcaagtgcactactgtacgaaactcaagtgtcgtaggagaacttgatatcatcatgctcttcagggtcgggggactttgaaatgggtgggaaataccttaaacgagctaaggagcgctacaaaatacattgttccttgatattctaggacgtctgcgtgcacgattgcttggagttgttcgtcgggtgatctggagggcgtatgcctcggttctatatatgagaccgcagtccgtacctagatagtagatgctatttcgtttagccgaatangatatcgataggtgttataaacaccctgataaact

SEQ ID NO: 3471 - DNA, 452 bp, Fusarium venenatum
  misc_feature (1)...(452): n = A,T,C or G
naaactgacccgtcngggtcaccttagcttttctcattcttgggcatggttggcgttttctttgtctgactctaactcttcctcttgactctgacgttacatacctgatttgntgtatgtattaacttgatttattcattggattcctgcttttctctgtctcgtctgtcttcattccctcctcaacctagccttcatttcctctcccgtcgtcctgtcgcanactgggttaaactaaacctttaccagcccagcccaaccccagccttgtgtgggtaattattatcatctgtcaccgngttcaagtctcgctctggccggtctcaaaattcaacccaccaacctcggacaaagtgaaccgtgcttaattgactgaacctgaacgaactgccctggacaggtcaaagggtgatacctaacataaaacaatactatttatcattctcttccgg

SEQ ID NO: 3472 - DNA, 139 bp, Fusarium venenatum
  misc_feature (1)...(139): n = A,T,C or G
nngaggagagnccaccaagttacnacgccaactcagagggggggcccttanaatccggcgaggatcnaattcttcncggagganaacttctgttcccccaantcccgcngacagaaaaaaaaagcctttttctaaccct

SEQ ID NO: 3473 - DNA, 479 bp, Fusarium venenatum
  misc_feature (1)...(479): n = A,T,C or G
gcatccattcagttacattcatctcaaagacttggctcattcattcactatcccatcaacatgtcccaaaaagatgtctttgacgacggggagcttcctcccccgtataccgaatcaggtccatcaacatcaacacccatatctgaaccacgacaatcagtaacgaccatcttccattcccatctccaaaatcttcccttgcgtattcattctgttcaagcagctcgcacatcagcgcgcgatcaacgcgacagcgagatactcacccttctcgttccccatgtcgaaaaaatgctttcgtntattgcagccaaagattcaccttccaggttgacagaaacaatnttggttccaggggacccttgtcggaaaanaatggttctttcagcgatgaaaatgagtcccaaacagttgtccgtgtaaganaanatccaagttagtaggcgatcaaaaacgaccgccaagcgagaggncgaacc

SEQ ID NO: 3474 - DNA, 625 bp, Fusarium venenatum
  misc_feature (1)...(625): n = A,T,C or G
gattctccatttcgtctacgaaccgatccgacgtgtcgcgactgctacattcagttcgttacctacaaactgaacagacgccttggtgctcttcataaagatactcgttcgtcaaaggcactcactactcggagacatctggctggcttgtcctttggaccttcgtcaagtgtcctggctcagatactcagccaacaggctcgacatcactctgaaaacaaggcatcttccccatatgaacctgtcatcgttcacattgatacggatttatcacatgctgaaggagaatctcctgcccaaaagctgctcagcgattaccgccgtgcttttcctcacgccacctttgaatgtgttcctcttaaagaggtactgtctgtgaggagtatcgactggtcaactctacccctcgatgctggtaaccctgaanaagatgcgtctgctcgtcttcaacgactatttaatgccttgcctacactcaccgcacgtagcgatgttcttcgtctacttatccgcaccttcttcttcanaaagctcaagactatgcctgcacagcgctctnttgggtcacaagcactacagcgctcgccgngttgacgttatcagangttgctaacngacganggtt

SEQ ID NO: 3475 - DNA, 243 bp, Fusarium venenatum
  misc_feature (1)...(243): n = A,T,C or G
nattttcccaatacagcagggcccatttgttcccccgaaccgnanggccaacacggggccattttcntngaccttgaatacccccnaagcgctacgtgttggganactgctttacctttgtagaacaacttgttcgnatcntatcgcatggaccaccattggaatcgcnntccactgtgtatcttngggactanacnctagcggtntttttgcncggtggacaaataaccatgcgaagactcg

SEQ ID NO: 3476 - DNA, 519 bp, Fusarium venenatum
  misc_feature (1)...(519): n = A,T,C or G
gttttttctttgcaatatctcggtgtaactaacggccagctgcatcatgttttccgcttttagatttgtgccccgtcacaaatcgtcaccaatgaattctgctacatcaccctctcacaatagacttaccaaacggnaactcctatcacatttgttcaaacctaaatgcaaccacagtgaatccggagttacttcaatcgctaaacgtctttctncttttacattggacaacagtgacagcaacagcgacggngtttaccctacactttattcgccgtcgtctgttgatcanaatgggtttgacacggatattgtcacggntgcagctaagttgaccctactaagcaatggccaatacaacactgttgggactagcgaaccctcnagtcaaaagcgccccccagatggttcacaccaccctggtcggaacgggaanaaacancgtccaaacaaaagccccaacaatggagtcggnagggatacnggtgacngaaataccnggggaatagcagagcccct

SEQ ID NO: 3477 - DNA, 624 bp, Fusarium venenatum
  misc_feature (1)...(624): n = A,T,C or G
ctttcttcatcatcgctngccgcgtttatctatttaatcaaagctcaacctacatgaacgtgcaatagttgattctgcaaccgtgtcacctcttgaatgatctgatgatacataaaccgggttgcaaacagnaaaggattcgcctctaactttattcagtcacgactgcatacaactccggatatccaccatgttggcacctttggatcttggcttcggntggccatctgaacaaggcatggccgctatcgcctactcctnttattcaccactggcccttcgcgatatgccccagcctaaaccaaacgatgcgccatccgatatagacccctntattttcaccttcgaagatgcattngaagatctcctcgctgtgtcccaaggacaatcgctcccaaacatcaagtcccgatatgagcaacgaaagctctgcgttccatgttcccaactggngagccgggctcttntggctacncaaatngagatcgcagggtcttttaaaanaatcggccccacccggttgatgaanctgttgctgaaaaaaattgggaccgatttcaccaagagctcgatcgcagtgctcaagcagtatggggagctgtttaggcaaaaacgagggtgcaa

SEQ ID NO: 3478 - DNA, 626 bp, Fusarium venenatum
  misc_feature (1)...(626): n = A,T,C or G
agcaaccatcccaaaagcgatgaatcaatcgaaatgggccaagtaatgctatttgtgtgacgctaggcaattgcacaatatttgtttcctttcctccccctcctctcacgttctcttccctttctccttccccatcatctattatatccgagacnaccttgctgaggaaactgataattaactcagtcctccaactgctacaacaaggttcgccatcatgtcgcagtttgagcagcagactgtgccctcggccggccagcattacagcggccggaaccgcgttcccaatgttaaggagtttatggaccagctggaccagaacaagaagcagcgcgacgctcanattgatcaagaactgaatcagaacaaaattcagggcgagacaaaggatcacagacaaaacagagctgaagctattcgaaatcagaaggatgttcgcaccgtgcgtgatccggttacaggaaangatgttggtatccganacgcaaatttngattacaaggacgctgcganaaccctnagatgtcagttcccaatgagaacctaagaaagctgccctatcgcaacctntttaaaacaattntggagaggagtccgntnccccccaaaatgtcactgccccccnt

SEQ ID NO: 3479 - DNA, 272 bp, Fusarium venenatum
  misc_feature (1)...(272): n = A,T,C or G
ntaancctcnaggatccctgttttacacctaaaggtactgccttgacacttttacaggaggacactggatnactttccattggcncaagggtgatncctggncccaaggacntatgtttttggnggaaactttggtgtcctntcctccctggactgatagccccgtccaacttaaggtnaatgttttaggaagcaagaaactaaggacctcaattgcctaccgacgntgttttgtggnattaccccntatttaccagtngaacttanttcct

SEQ ID NO: 3480 - DNA, 627 bp, Fusarium venenatum
  misc_feature (1)...(627): n = A,T,C or G
cggccagaatggcgcctataacttcgaccaacgaaccaacaccaagacgatcgatcatatcctgcagaacgtatccgaggagactggcaaagaggtcatcagtattatccagaagcctattagtaccatcgaccagcaagagacagcacaagctacatccaccctcagagtttacgtcgactacctatcaaaaaccctcaatgcctcggcttcaactacgtctggaaagatccaacaaaaggtcttctccgctgccctgcaagaactttcccagcttgcatactctcagcctaagaatattccagcagactctctgacagagggtgttcgcgagctttgccgaactcgcctcgagtcttcatttgccaaggtcagccgaagaaccgaagactacggtacgctatgccttgccgtgtctgctatcgaccccgactcggtggcaatgtccgaggagattagcgaggccgtccggaacgctatgtcaagaatgcanaagctgcttaagcgtaaggcggcagatggcaacnanaagagtcttttncaggctcttggcaatgctgcatgctgngtccgtcttncaactgtcaacgaggatcccgatgctntggaagttttcaacgatcttgt

SEQ ID NO: 3481 - DNA, 160 bp, Fusarium venenatum
  misc_feature (1)...(160): n = A,T,C or G
gagacgaatgtttttaatctccccatgttcgggatgggttttcatgaatttgttataccgaggcctcgggcccgtgtgagatagtaataggcacgggacatgtacctataanaaagccaataaggcaaataataccaaacaaatgaaccatacacaagtc

SEQ ID NO: 3482 - DNA, 241 bp, Fusarium venenatum
gtacccctagtcgaggaacgccaagactttgtctttgttcgtcccttgttcctggtctttcgtgcaacgttccacatcctgtcccttgcttttttaggatatttccaagccctgagagatcattagctgcgcactcgagaatattagcatactgacctgccttgttagtggacaggtagctctactctgacacttgacaacactgtacataggtagtttagacctgtgaatagaggcgccc

SEQ ID NO: 3483 - DNA, 479 bp, Fusarium venenatum
  misc_feature (1)...(479): n = A,T,C or G
cttgcccgataggttgagtctctctgtcgtctattcaatcgttcgaggatagcttcgatttcgagacatgaaagaggctgaagctgaagctgaacagagaaggcatcaccaagttggtaaaatgtttcaacttgcggaggaactttgttcacgccttgtccctgtcaatagtcgcatcttgataccctttttcgtgtancaatccgtttcgttgcatgaattggttgacttgtctaccaagaatatcgcaacaccttcaatgtcattacgaacttttgtctctttctcgcattcatgagtctgccttgttgcgacaagttggcaccntnattctcccatctctngggtttgaccgatcaggcatttttattttttaangcacaaagantcatnctctttttttcttgttacaccttgancaaaaggnttttncgccctaaccttttggngggcctacaaaaanngtttacccttccccc

SEQ ID NO: 3484 - DNA, 535 bp, Fusarium venenatum
  misc_feature (1)...(535): n = A,T,C or G
gcatgtctgtcctgacagattcggaggaaagagatcgtttgaaggggggcggtgagagatgagtaacgtaaggctggccatcanagaccgccgaagaggcgaagttgtcatcatcatcgttttcattatcctccacgatatcttcgggaatcatgatcgatggcctctcgctaaggctggatccgggacgagggctatnatctgacaggaagcgccgaagagactcaggtgaaatatntnttgtgcgggtgccctctgatggtgttgtgcaacgatactctgtatcctcgggtgtgtcattgggaactggagatcggccacgctccccctctgaattggtcttgcgaccaaacaagcgcttccatgccgccggggctggtgataatgacctaaaanaaacttgtggttcagtgagggagatgagccaacccgataaggaatgtggttggttggtactgagggtgcnggtcgaggtgtgttgtatttggattcggggttcatgggtttttaaatcggcngtattgtatngatgtaa

SEQ ID NO: 3485 - DNA, 606 bp, Fusarium venenatum
  misc_feature (1)...(606): n = A,T,C or G
ctttcgcatctcatctatggacgcatttgtacttgggcaagaagatgccagagtgaagaaagcgtacagaacggcagtccttcgagtattcgtggccgatcgtatcactcttggtagcacgaccctgcttggcatgatggagcttgtaggaagagcgggcatctcatgggctttagcgtctcttatcactcatggcttctcatgatgagcgtatagttgttggtgaaagtccccggggactcaacacttcataatgggagagaggtgaaacctgtgcttcatcagcactgatacgtattcactctttcatgctttgcctgcaaagaactgcgctttgaccgacgcgagatacgcttgatacgaccataggaacaggctaaactggcgtttcgagatccttcacgtcagccaatcagcatcacgaactttgaagccccagtggtgagctctccactgccccgcgactttcatcatcattttgactaagctctgagagagcttggtcaagcttgtgtctttgtctgaacagaagtcaatggctacactaggaattcctncagtaattgcagaatgggtcttactgnaacccgaacgataccacgacat

SEQ ID NO: 3486 - DNA, 498 bp, Fusarium venenatum
  misc_feature (1)...(498): n = A,T,C or G
nttttcaaagcgtnggcgctgnttaaaggcacattcattttgcttctaagagaccaaggccatggcatacaacatcatggccattgagaacacacgactcgctcactggaataatagagcgcgaaatcgttgcacaacccacgctttccaacaccgaaagcagaaacgccgagcctcaacatcggcacataccccctaaacgccgcttctgcccgtcgttggactggatgagatatatttatatgaagccattttgggctgttgaacagtcgttttacatacctatgccaggacggcattgcatttgcttacaggcgaagattgngactgcacttactcttatacccaccattttgcatttttcgttcgcacctggggatattatttttaaagcggggaaaacagtaccgcaaaatattatcatattggctgcatcttggganganattaantgntctttctacttttggccttgggggttctagggtacaacaaggg

SEQ ID NO: 3487 - DNA, 291 bp, Fusarium venenatum
  misc_feature (1)...(291): n = A,T,C or G
ttcctcggagggtgggagganagcggcccaaagcgccccgaancgaatggcgactctacgacaaccctgtatggattcccaggaatggtgtttgaggttttgaanaatggacatgtcaatactgttacagtattttgattgaggatttgcatcgccgatttgtttatggagttgatggaacttgatgagtanctatggaagctggctctgttttgattgagtttgatacctctgtctaatttagaaaaacatatactcgcttgngcgatgctttttntccccnaaaaacaa

SEQ ID NO: 3488 - DNA, 282 bp, Fusarium venenatum
  misc_feature (1)...(282): n = A,T,C or G
nactctcaagaacggcaggtcgacaccttcaagggctcatactacgccaactgcgcattctacattgacccatctctcgaatgcgcccagcccaccgaagaattctctactgataacttccccnaagtatctgtccctaatgtctgggcgcccnnaaggaatcctcccaagcttttaaccctctgtganatcctgtngccgtctcatcctccacnttaccgttcttgtcgctcntgcatnttaatccttccctccaaaaaganatcccngaaaccccctgga

SEQ ID NO: 3489 - DNA, 389 bp, Fusarium venenatum
  misc_feature (1)...(389): n = A,T,C or G
gaggacgactatgtgttgcggctgacgacatcaataggaacacgctacaccaacacattgttgtgctacgcatttnattcgcgacaccaattgatcctcttcaccaactgcaataactcggccaaacggccaaagaatcatcggaaatagtggaaacaagtacattgtgctccaatacgtacgcagcgtcacggtttgaacaccagatctaccactagtggcatctatctagtcattggaagtgagggcaaaagtgtcagctcggattttgactgccaaaacatgtcgatcacttgacgaagctgtcaacatctgggaggtaatgggcaagccaanacactttgccgttgntaaagagnctgggcgtncccgtttttaaatccgggcag

SEQ ID NO: 3490 - DNA, 114 bp, Fusarium venenatum
  misc_feature (1)...(114): n = A,T,C or G
tgggaacaatgtanaacagtagctgcctagcagcttggcgcatggtgtcatgattagcaatttacatttctttagtttttctattagcataggataatacatcttgtgtctcag

SEQ ID NO: 3491 - DNA, 129 bp, Fusarium venenatum
  misc_feature (1)...(129): n = A,T,C or G
naacactgtcctggagaccctctcaaanaacggnccgaagantaccccancaacnctttttangatattagagagctcattgggggggatttctgacgaaaacaacctccgggnggatatccccacttc

SEQ ID NO: 3492 - DNA, 567 bp, Fusarium venenatum
  misc_feature (1)...(567): n = A,T,C or G
gacaaatcctatactttctacaaccgctaaaactgtaccaacccgttggtatcaacaaaagaaccgtcttcgtttgagcaagtctccccagctgctcaacacctttaccaaaactcgacccgcctttggtctttaaaaggcaccatcttcactacggctcctccggccgtgagtttcgtcagtgacaaagatttcagcctctgcaagccctcacacattatcaacgcgatccctcctcccgctgctattgctgctcgacgataagcttctcgatctctctgtcttgtatcatccaagacccgactatcctcccccgtcgttcttcgacacccatcagctgccgcataggaggtacttagaggttcttctctcgccgaggaagagtcgaggaggcctcgccaaatcaccgagggatcagttcattaccgttcccgaccaccttaacatcatccgaatcatcgggtgattctttttctatactaccacactnacaacaactcaatcagtctccggactcaatcctcgtcaaaaaactccaaaaacaaaccccgcaactgtttgggatat

SEQ ID NO: 3493 - DNA, 113 bp, Fusarium venenatum
  misc_feature (1)...(113): n = A,T,C or G
nagatctcggangattcncaagctactccgattccaaaacgtnncaagtgtaactcanaacccanttctgacntgttgccgcttcctgttttttactcccatatttactctta

SEQ ID NO: 3494 - DNA, 112 bp, Fusarium venenatum
  misc_feature (1)...(112): n = A,T,C or G
tnggaaactgtcttcgggataaatggcntttgggttcgntcccagcaaccgganggggcgggttgggtccnatgatnctgcntctgcctctagagncactgggnggtgcttg

SEQ ID NO: 3495 - DNA, 583 bp, Fusarium venenatum
  misc_feature (1)...(583): n = A,T,C or G
atttataccctcttcatctgctcatgaacttgctagtgaggctccaacctcatcaatactcatacagccgacgccgatatacataacatcatcacacgcatcaagaaagtggaacactcccctccagttcaccgtattctcaatccacattacatcacattatattatatcacagtaactgtgactgcactcagcaaccatacgcactatacacttgacattgagcaagaaagcaacaatggttcaagtactgactgatcccacattctctcccgccgggacaccaacctacgaggccaccgatggtcctctcatgaagcgtcctaaccttggcaggactgactcatcaacatcgatgaccgagaagaacatgccaagcggatgcaggaactcaacaagaagaaaagaatgatgaaggcacccagacaaggctggtcaatgaccgactaccaaggcgaccatgtcgctgcatcacattctgggcgcagccacattgaaagtcaagctcctatcctgaanaacaantctccttctcccccgaaagttaaagaacctgttttccccaaggctccagttgaaaacc

SEQ ID NO: 3496 - DNA, 244 bp, Fusarium venenatum
  misc_feature (1)...(244): n = A,T,C or G
tttgaggcnctgctcttggcatcggatatatagccagacagcgtgagaagagagctgcatagaatgatgtgtcctttttggaccaaacggaggacaacacatcaatatcgtaattgaaaataagctgatatcaaattgtcatccaaggagggtagtgttgcctggaaatggggatgtacgtcttgctataggttaggtactataccaacagaaattagactatctggtttcaaaaaaaaaaaac

SEQ ID NO: 3497 - DNA, 171 bp, Fusarium venenatum
  misc_feature (1)...(171): n = A,T,C or G
cgcataaccaattcagtgtaaccagaaagagtcntgcaacatgggtgacggtggctatctcattctcgnaaacggtacgccgtaccgttggaaacggtcagaccagatgagctatcanatgaagtcttgggatttcccggatgtcattgaanctggaaaggtacccataat

SEQ ID NO: 3498 - DNA, 434 bp, Fusarium venenatum
  misc_feature (1)...(434): n = A,T,C or G
ctgagccgccacaaagactacctcttcttttgcctatactttttgtgccaaatttaagcatttggaccctgtttttcagcatcgccaaatcaccgactccaccggccattaaagatttcccaatctcctgtgcaacgacagataatcagacgactgtctagtttgcagaaacatcttttcagcttcgattcttacttgtagtcgctcagcatctggacctactacgcactatcttgtccatctcaccataccaggtagtcgttgagtgagaaatcgagcccctccacatcatggctgatctcgccgaacgaccagcgcttgagctgcagaccgataatgagaaatctgacctaccgaatgaggacggcataactttagagaaaacagaagacctattcnaagcaatgatgttgacgctagtgctgatgctgggc

SEQ ID NO: 3499 - DNA, 239 bp, Fusarium venenatum
  misc_feature (1)...(239): n = A,T,C or G
gtcaggcagcttgcatgtttgcctcgcagcgaacgaactaacacagaatggcacctgtttgaaatagcattggtgactctctctactgacaggaaaggccaaaccgccactattcttggctanaatgggcaggtaggttggcaggtaanaagcttttactaatacatgcttgataatatgataataaaacctacctatggcaggatcaaattttaaacttcaaaaacaaaaaaaaaaaa

SEQ ID NO: 3500 - DNA, 555 bp, Fusarium venenatum
  misc_feature (1)...(555): n = A,T,C or G
aaacgcttctgttttcacccttgacaatggaaatgttacctttacaaatttcgtcggagacgtanaagttggtactctcacaattccaaacttactccttaagccaggcgacaatgttgtcaacatcaccgccaacatgaaccaaagcttggttctgaacgccgttcaggaggagccctactgcaagacaggcattnttcccttcaagctgttgggcaagtcggtcatgaaccacggcgaaaatctcacatatttcgccgcagcgttgggaagctcaaaccagactgtcgatatcgacattggtgccatcctgaaaaagagcattgggtatgatgtgaagtgcaaaaaggattagttgcaaagcattattgatctttggatcgcgtaccgagtatgctgaggcaggagagaatgatcaaagccgccggtcgattaatataaagctaggtagnggtttgacaagaggcgcantcgattataatgatacctttgatgcgggccccatttataccctgtncctgatgcgaaattcaanattactttattccgncaagg

SEQ ID NO: 3501 - DNA, 241 bp, Fusarium venenatum
  misc_feature (1)...(241): n = A,T,C or G
nggcctgtttagggtttgcccttaacgatgccagcaaccaggagcctatcaaggacgttgtccangaattgggtgaacgcgatgcttcaaaacgagtgttggtttgtcanacagatgagcagctagagatggccaggttgtgcgccgaaaaggaagacatttgggaatgatgcnacaccacagggatggtggttgtggtagtgatgatatatatgacttaatagatagagagtgtgtatac

SEQ ID NO: 3502 - DNA, 308 bp, Fusarium venenatum
  misc_feature (1)...(308): n = A,T,C or G
tccgtcagtctcggtagttggacaatccgaagattacgaaggtcttgaaggaatctaccggttccttgaggaatgtgaccatgccaagggaaaggttggtcgagtaaactgattttgagcgaaacgataccagaatgccatatgaaaattgacaggcattgattgtacttaacgaccgacattctctacaccgaacgaaccacaatagctagatttagtatgagcagtaactagcttccaattgaatttccttgagtatttnttngaaaaaaaaataantattaaaattattaataanatttatatta

SEQ ID NO: 3503 - DNA, 469 bp, Fusarium venenatum
  misc_feature (1)...(469): n = A,T,C or G
gcagagggcatccccaatcttccgatcctgctctccccatacctcgttacttatttcactcccatttctctttttcacttcatgaggtcatgacccaacatcggttaatgtctacctgtctattcttttattttcttcaccgtctgtgcatatatgcctttgtttgtggagacaaggtttcgttgtctcatctcgttgtacattacattactcaaagcggtctacgccctgaagactgctgaggactcgaggccttgtgccaatgatcctctttgatagttcgtttccataaagggattgggagcaagaatccgagtcatttggagggttgtggnggcatatgagcggctctggttgtggtgattcggcgataggtttgtagttagaaaaggctatctaacacaaactgagctgacacgataatcccgtcaccttctgggtagtttaatccgagtagggattgtttctc

SEQ ID NO: 3504 - DNA, 385 bp, Fusarium venenatum
  misc_feature (1)...(385): n = A,T,C or G
tactcggagccatactgctacatgaagtcacccaagaacccacacagatgtggacgccatggaggaaagaagggccaataaacattctagaccaagacaaatcaagaagaaacaggtggaacgatagaacgaaaacaacccagaatgggtatgacgacatgaaaacaacgacgacggcaagagagccgacaaactctggattttttgttacttattaacggttgcgacatcatatgaggaacattcggttattagcatgtgcatgcaatttatttttattcaaacttcgcaagcatagatgataaatgttatttttggcaaatcactcanaagcacantgaggggaagactcaaaacagcgggtgttnttgatcattctcaaaaa

SEQ ID NO: 3505 - DNA, 624 bp, Fusarium venenatum
  misc_feature (1)...(624): n = A,T,C or G
ttcttccccctcgcctcgcaggtacaaaaaaatatctcttggcttcttttttgtccctgctcgaaccgaacttgaacttttctaatcttcttctccccccatcctttcccgccggtcgagggtttgtgatgctttgatatttctctctttcaacatccatcaatcgacctttaaatcgttcgttcgttcatacagataaanaaaaggtttcaaaaagacctcacaaacaaaanggccgtcgctcttcctcggcgattctattcgctgctntgggtcgcaatcctccttgcgctcgtcgtcttcttcgtcttcctccgngaagatacctggtcatccattcctcgacctcccaacgggtggaagattcctttcaccaccgacgatggggcctctcatcttggatgggnaacaacaaaaaggctcccgccaaggaccccaatgagcctctgcgcatcgtcctcacaaagtcctccggactcacaannaaatcgctgctgccttgatgcaccctttcggnggccaagaagggtttaactcgacgtntacttcgccaccagcgctttcaaatgcangacatnatgggcaactttagccttccccgncaacatcncatcacaagnggga

SEQ ID NO: 3506 - DNA, 124 bp, Fusarium venenatum
  misc_feature (1)...(124): n = A,T,C or G
nagctngttgcaacaactggggctnccttaaccgattttttgtccaattttcctgaaaanaaccttagancttcaanatggttgngcgaanttcctccaggagangaaaaattttttttttcac

SEQ ID NO: 3507 - DNA, 617 bp, Fusarium venenatum
  misc_feature (1)...(617): n = A,T,C or G
cgacgaacaagttaacagaacttggtgtattgttggccaagtatacgctgcccgtagtggcaaagaggccttgaatagacaacaaagagacgggatctaccaggcactagcttcacaaacagccatatgcgccaggggattgaaacaatcctccacgacgatggcaactgtcccactattgtgcgcatcactactcgctgtgacagatttacttctggatgatacaggagatcactggcgcacacggatggcttgtataagtgagtctgttggggtcatggttaatgatgacttgcaattggcaccccttgatagggaactgatacggcttttccaattgaatgatgtctcggctctgtgtcccgtcaggagaatccgttaggcccaattttcagaagcgatcttgaagacacgttgacatcgaagagtccagagagctnacgtctgnactttggatgataccgtccttccgcatgtggaaatggnccgtcttgaaaaagaatattcatgggttggcnattttctacacctggggcattccattacgacacnntgtgatattgcagaactgatntggggnaaatcaagcttgactataccagccccnttgaattttt

SEQ ID NO: 3508 - DNA, 243 bp, Fusarium venenatum
  misc_feature (1)...(243): n = A,T,C or G
aggttggagacaaagacagggaaacaaagcntggattcaaacctggggaagccagtntntgaaacgggccaaggcataaaatgacgatagtgagtttgttgttattggtccgtgttggagcgttgcactgggagattgtttgatcacccgttggtgcanaaagttggagttgaccaacagttatccgaggataaaggcacgatgtacgataagacagccgcanataanaaagttccaaatgcg

SEQ ID NO: 3509 - DNA, 426 bp, Fusarium venenatum
  misc_feature (1)...(426): n = A,T,C or G
cgcctgcttcgcttgcaaacccaccttcgttaccttcgccttctttctgtcgctacaaagaccgcctcagttcttgactaactcactgctcagactccgatccaatcaatcaaaatcgtcaagatgaagtcttctctcctcaccgttttcggcctggttgctgccgccgctgcccagagctccggcgacctccctcagtgtggtcaaacttgtgccagcaacatgatcagcgctgcaagtcccaggagcttggatgtgatgctggtgacgttagctgcctttgcaccaaccaggacttcatctacggtctccgtgactgctccgtgctatctgcaacgacgagcaggccgctgctggtatcgnctacgtcttgcctntgccgcaactggtgtcagatactactgggtagtgtgnttccgttcggct

SEQ ID NO: 3510 - DNA, 438 bp, Fusarium venenatum
  misc_feature (1)...(438): n = A,T,C or G
cgacaccctatcaaagtctctgacctcacaactttgcaacttattcgttatttaattcttgattccccaggtttcacaaataattatctaataccactganaaaccacttattttcaacgatcaatatacatacttgagaggtatatgcaagtattagtctctacgacaacccaaaggtccatctatcgccactctgcctaaatcactatcgactctgcccttgcgatggcaactggggactctaacgattccaacgatgccaatgatgacggnttcaacttcggacaanaaccattcgccngggctctcatccccttattcgtcatcctcatccttggattgacagcaactgtcatccaaatcaaacgtcggcgccgccgtcgtggaaaccaatggcccagctcaaatccccaaacacccacatattggggacttcg

SEQ ID NO: 3511 - DNA, 610 bp, Fusarium venenatum
  misc_feature (1)...(610): n = A,T,C or G
gaacattacccgaagctcttctgcccaatccatggntatcggaaaaaccgtggcgacagacttnttttcntgaaaccngccaactggatgagaatacaacggttccccggaattatccccgagatacctcagccgtaaagttgacacnggaggtatgatcctcactgagattcaaaatgaactaagttgattttgaatggccanatcttacagcaattgagccctgataccgtcactgaataccgatcttcagcattaccgggnggntcaggcaacaatacaactctgtnttcagatgccgttccgatcaatcaaatactgggattgaatttgccctccaaagtcgtttcanatgacttgttcaacgcctactttgattccgcgcactggttcatggcttgntcatgaccttnatttcgcaacgatcnatgccattatgttgacagggcaagctacgccagaagatcttccgttttnggttgnttgatgctggtcttgctatngagctngatatttaaccgaaataaattttctttgnggggggaaaacaaacctggaccctnttgaaaacaatttnttgaataacncacntgtgcctttttggatattg

SEQ ID NO: 3512 - DNA, 111 bp, Fusarium venenatum
ccctatttgaaatcttttaatacccagtaagaggcttcccaaaggaggcaaggatactccaggatgcccatagctatggcaatagacatagtaatatgatttatgaccccg

SEQ ID NO: 3513 - DNA, 317 bp, Fusarium venenatum
  misc_feature (1)...(317): n = A,T,C or G
tgatatcattgatttagacgaatgcatcgagatagcggatccagccatggatcccaagatgccctccagagcgggaattacttttgggatagaacggcntgactgcggcgttgaacttttgggaattccatttttagatagagttctgatttggcttgcttgatgcaaagactcaagccaaggaggtgggttggttcctttgatgatgggtatttgatacctggatactacttgatcatgcttcaaccttaacacgttgtgattcttacttatgattgcccagtatataaataaaagagtcactggnnaaaaaaaaa

SEQ ID NO: 3514 - DNA, 398 bp, Fusarium venenatum
  misc_feature (1)...(398): n = A,T,C or G
gatgcaactattttatcttggtcgtcattcgccgtattctcgccgggagtgtgacatactggctctccaaacccttcacttactctgcctggttgcactgctcacttgctgtacctttgagaacctgttcctctatcaccaaggggtttatggtgcttcgctcatggataatattagataagattaaatgggtggttttaccaaggaagtttgtcgagtagcaacttgttgtattttagtcgtacgtttgttgagaataggtggttataatgtctcaacacgcgatactccttagacagtgacgcgttgtctctttggtttgtttcttagctggcttgatcttggtttccttaacattgttttatttgtcttagaaaaaaaanaaaaaaaaaattcat

SEQ ID NO: 3515 - DNA, 152 bp, Fusarium venenatum
  misc_feature (1)...(152): n = A,T,C or G
nntcactcatgntactgnggnaacctgcacncaactttccacaggtggtnatttgtgttaacaagacngacagntcgncctttgcagagtttctgntctattgcttnggaanttangcttcaacggttaaancaaagaancgttttntnctg

SEQ ID NO: 3516 - DNA, 128 bp, Fusarium venenatum
gctcctccaatgactcaacaggcgattgacaagctcaaggaattcaagggcgccgttgtgaatgatctttccgagaaacaaaattagtatcagaacggttttttcccaaaatacacatttgatgcatg

SEQ ID NO: 3517 - DNA, 615 bp, Fusarium venenatum
  misc_feature (1)...(615): n = A,T,C or G
ctcactttctgtgacaaaagcagcgatgaggggcaactttgcanggnggggcaattttgctgagctggaggggagctatgatgaaatgtttctctgccacgtcggaccgctatcagttgaattgcggtgtctacccataacattaatccgctgcaactctgccggtcgactcaatagtgtgtacaagtcatcataaggcagtcattgggctgcaatttgttgatattgagctgtggtagancatcnatcgggatggatgattcctacgagtagatatgcgctantccatttatagattaaagcgggccttcttgaagattccagantgggcaaattctcatcgatgtggntggnaagttgaaaatcaattgcaaatactcaacatcaagactttnattctcttnatattcacaacaagngcatcctaattttctcgattcaagcaaatctaaaaactccgacaacatgggcgatcccanacttaacgagcttnttaaatggagcatcgagcaatctgnggccccaaaaatgaccccaatgccccttcaccaagaacaacttaccccaaacttatngcgcccttatggggggccctccacgcggnctcatgaaacc

SEQ ID NO: 3518 - DNA, 546 bp, Fusarium venenatum
  misc_feature (1)...(546): n = A,T,C or G
cgacgattaatgatgttgcgagtcggatttcacagatggaaaagactattgagtcgtttcgggcacaacaggatactgcttcgccgcagtctacaacaccttctgtcgcgtcaacaaacacccctgtcatttctggaaatgtgactgctagtgatgcattttcaaatcaggctgttccgggacgtcgagagggtcttttgttgaataaaggaaaatacagtcattatgttaatgaagttcttctctcacgggttattgaacaggaagatgatgtacgaacagccttggcaacgccaagagacgaacttccccacgacgtcaactcttctcccttcaaccccatggccctcctatctcccagtttctcaaccgaatcacttgcaagctatcatcctcccagaaaaacagctatccggttatggaaaatctttgtcgaagtgtcaactttgtncaaagtcagtctcttccactcgggaaacatactctcncgtgganaaaaaacctacaaagcctcnantggaaactgacctttgtttgctattttta

SEQ ID NO: 3519 - DNA, 840 bp, Fusarium venenatum
  misc_feature (1)...(840): n = A,T,C or G
tttttttttttttatctaacatgtctattaactcatttgacagtaagccaagattaacggaaaacatatntacaaactcctatccgaaaaactntgaaccgnttttattctaaccagatgcaagggaaaccctcgtcttactctctcccatccttaaactccactccccattccactcctttctccttctaacctcaagctcaacatctttnttgggcgtataaataggggccatgtcacctgtgttcagcgccgggttccttgcccattgacctgaagcagggttcatatcgcaccgcacagaaagaagagccaacacaatcagaatttctgtcganggcaaactgtcgcgcagggacaaaatgttggnggtgcgccccatgccacgaaaactgctcgacacgaccgatttcttgtccggatccctnttttggcatgaaccgatatggatcgaanacatcagccgaatctcccatgtagtttggttggtgtgcacnggttggccaggcattatgacnaattggncagctttaaacanatctttgtcgtcaagagtgnatnttccgtcacctttcgaatgtcgcatgaatatgtcttgtccgtggggtttctgataaananataaaacaaaggcatttggtttcaacgctgnacgtncaccacaaacccagtnttttggttccactaacagctggtcgaataattcgcgtcgcacttngtnaaaaaggtaaggccggaaaaaaanttcgtaaatggnccaaaanatgatggggtctggggttggcaaacttcgacatgcntttaaagggccaattcncctttagggagcgnnttcaaata

SEQ ID NO: 3520 - DNA, 274 bp, Fusarium venenatum
  misc_feature (1)...(274): n = A,T,C or G
cactgatgacaagattgagggacagattgtggtacgaggaccgancgttgcgggaggagaggtcaacgttggcntccccggaaaanttcgacatgataacactgttgcttatgcntaaccaagggttttgacaaaacntgcattgggntggggtcgatagacacatcgatgtcaaattccaaggattcagggatcntttggcccagtttcataagctagtagatacaagaaatgatttaagaccgcaataagaatttcttggtatttttggttt

SEQ ID NO: 3521 - DNA, 186 bp, Fusarium venenatum
  misc_feature (1)...(186): n = A,T,C or G
ngctatgagcgtncaatancccganaagtaaggttttttaatgccaggaggatganttggtgcaaggtatgaagntngaagtcctatccaancgnctcaaggantncccttcatgaacttccaanatgtgttgnagactcgnatacntactggatacatgnnctcagcagacgaanacttgcatca

SEQ ID NO: 3522 - DNA, 192 bp, Fusarium venenatum
  misc_feature (1)...(192): n = A,T,C or G
ggagctnttanaaagctcaataagcctaccgtcatccgtcgccagtcgtcgtnaacaaatcaactccccgggtcgncgataccacaatcaaattaccgncgcaatgagtntatactatggagngggcggcattgggtcatttctgaccatcgntggaggctatatgctntttaccggcagnggtgagtcctt

SEQ ID NO: 3523 - DNA, 203 bp, Fusarium venenatum
  misc_feature (1)...(203): n = A,T,C or G
nttgttnttttattactattatgcattatnaaatggaatnntgacatatggcaaanaaaaaaggggcctggacnctaaaagtgactgtcaacctgtgactnccgtaantgactggncagttggcggaactccgtaaatgcatntgcagtcactggattaatgcacntcggatgaaatttaaantgntaggttttttttttttt

SEQ ID NO: 3524 - DNA, 502 bp, Fusarium venenatum
  misc_feature (1)...(502): n = A,T,C or G
tccgttgtatgattacacccagactcgcatcgacaaaaaaaaaaaccatcagactttaataattccatgctctactggaaacgcctctgaacaactgttatccgcatatccatattcaatcgtcaaacgcctgtcatgaacgccagttcttttaaatctactatgcacgaattccattgttgcagtatgttacttcaacggcagctgctggttttgcccaggggttgatatgttctggacaatgtgcgccagcgcatcaatcactgccttcattagcaactgcgcaatactgccaagccctttggcgaggagtggttcaacatactctgcatgtccatcttgggatcttgtggccaagtaaaagtctcgttgatcctgtctgcctgtgctcgtctggaagatgacatgggcagactcatagctgtgacagcggaggaggttggcgtggcagtcggtgtcaatnggggtcttgatncaatcttacttaaacatctggtaaagc

SEQ ID NO: 3525 - DNA, 290 bp, Fusarium venenatum
  misc_feature (1)...(290): n = A,T,C or G
ccacggcctttctganagcaacttccgactntggatcttttttgancntgatagccaaattgggcntgatacacancatgctanttntggaatgttgctttntgtcancttctttntttggggacntggcgatgaccgttgtacaancntccagggcaacatttccgcntttcccganccagtntggntgctgcnaantgaggcgcccgtattngggtcttttgtagtactccntaacaagcatagcactagggaaatagatattanctaagtgaaaggtcgagggacac

SEQ ID NO: 3526 - DNA, 177 bp, Fusarium venenatum
  misc_feature (1)...(177): n = A,T,C or G
ngcctgtcgcaattatcttttagcattaacgtttgaaagaantcattgactcagtttcttgaaaaaaaaaaaanaaaaaanttctgcgggccgctctagcatgcattntaaaanaaanaaaaanacttctnggngaccgcttatncatgcatattagagggccnatttcaaccttta

SEQ ID NO: 3527 - DNA, 158 bp, Fusarium venenatum
  misc_feature (1)...(158): n = A,T,C or G
ntggaaangganctggtatggacagaaatcnacntgcaatncacgaaggntttggtgccntgaangcaacnaaancaatggggggngtgctntcaccngatcattctctctgacctaggactngatgnccgactncttctcatgcaattgntggcttg

SEQ ID NO: 3528 - DNA, 380 bp, Fusarium venenatum
  misc_feature (1)...(380): n = A,T,C or G
ncgaatcgtcaccatcctccaaaccccacccagtttcntgcggcggagtntatngaacntttacgggtaaanttgaangatttgtggaacgantgttaanangttcgacatgganggcatgttattgatgcgngggttgctactttggcanaaggcattcttntttgctcagagnttcaagcttntaagatgaaaatgtgttgtctgaaanactcaacntggtanaacccatgagctgcaatcggntccaggttnttttatnttccggntggactggaccccntgaaaaaaganaaacatttttggccaaagtncaagccaattgccttgnaattactggatancaatcgnggggtnttatnttgtctntgtaggnganc

SEQ ID NO: 3529 - DNA, 610 bp, Fusarium venenatum
  misc_feature (1)...(610): n = A,T,C or G
gagacaaggcatctagtccgccgtttctaccgaatacatccaaatatcactttgctatacaaaatatacctcttttattctattgagataatcaatttctatcaattcctcttgctctcgctcagttaccctctgtaagctgtgtagcttcttgttagtgtccgcgtcaatgttctgcttgagatctcactctatttcaatgggaaaggctacttgggggtttacggttgccttacataaaggctcacccagacgagtataagtatctcgtcctccccctcttatgtcctgaatttcggtacgctcaatatcactcctctcctcctctcatccttcttataccgncaattcaactcatccagaccatcctgctctcagcctaagacacttattcgcttctgnggttttgatatatatctgngtcgtcccgtcgcatcaagcccttccttggccctagtatcggnccattttgtcccactgnccatatgaccgacctaccttggttttgtgtgatgtggcctaaggcgattaaaatcncgacttgnacccgtncgtacttttcctnctaagctaagtccccggaaccanatgnccttnagccggttaagga

SEQ ID NO: 3530 - DNA, 337 bp, Fusarium venenatum
  misc_feature (1)...(337): n = A,T,C or G
naaaaaaagtcgaacaaacccgctatccgctcttttttcgtatgggtgtcgccatgctattgctcgattaggncaagatcgagggggttatcctgagacgganctttgtatggagaggcgagtagtacagnagcccgtagcgaaatatttagatctttgttggggagcgcaaaagagttccgagatttttcttttcttcgccttactcctctcttcctttcttcttctacacatctctatcctccccctcctttgctgaagtttcgcgtatactctgcaaatctccccaatcgctaggcacantggccaccaaacaagcgaactgccaccactgttg

SEQ ID NO: 3531 - DNA, 323 bp, Fusarium venenatum
  misc_feature (1)...(323): n = A,T,C or G
naatctggtcatctgacgggcaatgtnctcgacttntttactcaggaaaggcgatagatgtgnnaaatgacggaagcntctgagtnctccaaaaatgtntttatggntcctactcccnaacaagggagccctgaaaaacagaacttattgntgagantcctgacagtgatcgcaagcagcgattcctcnactttncatcggntggcagtattcttccaccaacgtggtcgcactcagaagcagacggnntcctcgaaacctgtaaatggatctatcatctggcnnatggttcgtatncagaacctgaaccaggtatgagcaca

SEQ ID NO: 3532 - DNA, 129 bp, Fusarium venenatum
  misc_feature (1)...(129): n = A,T,C or G
nttnacagcgatgcccaagatgtgatatccnaaatctcgacgagtctgccatggananaccgttatcattcgcncatgctccagaactcgcgtgtcaagagtgccagatggcntcatngatctactaaa

SEQ ID NO: 3533 - DNA, 589 bp, Fusarium venenatum
  misc_feature (1)...(589): n = A,T,C or G
ccatcttcctcttcacctgcattactcattactccctcgccttttatactttaggcatctatacatacagactcaacatccacatatattacatcctcaacttacctgttcatcttcagctgctcttcatcgtcttccttgcctttgactaggaggcggggatcagaacaccagaaccccactcgcctggttactcctctctatttgtccccttcatttctttcagtattacggcaaaccgagctcttggaactgtttggcatccgtcgtcgtctatcgttctcgttgtttactatcctccttggttctttgactcaaccccgagtcagaccctcctcacacttcaaactcttgatctgaaganctgcacaggatatcatcaccctccctgatcacatctcangcggcanggtcagtttaccaagatgtattatctgcttgcttcattcacaanacgctgcacagctaccattgtcaacgaataagtgctctccactcgcccgcgatacctcacacaacggnggtatgatctgtgctgttcaacanataaatcggaaattcaaacacgccactaactaacttaacatgt

SEQ ID NO: 3534 - DNA, 627 bp, Fusarium venenatum
  misc_feature (1)...(627): n = A,T,C or G
caaggatttggcttcattcctacgaacagcttccagcaagcaaaatcgactgcaatttcatcgatttcaagttcgcccgttgcttcgtctggaattgtcgaccggtccttgggtgatgctgtttctatcanaaacggaaatatttgctactcaaaaaatatcggaattgcgcatatccacactaggaccanaacagactgaactttgattccactacagctcattccgaacgcaacccacgtatctttggtaagtacattgtgaagctgcaagttcaaaggagttgctttgcatgatgaaacaagttatatccattcaacgacatnatcttggccaagtcaccctcccgcaccttaaactccttgtgggttgatgatgggttgnggagtttctcttcggagtgttatgaanactccaagtgtcagggctgctggtagctcgtttttgggttatcagtatccagggccggtcgagctgactgaataaaaaccgnttggctgaactatcgcatactctttgcatcgngtataatcttccgcccgttatagccctcnactttgaacagtggctaacggataaatacagattnacgagtggtanatctcgatcttttgaanattggagggg

SEQ ID NO: 3535 - DNA, 101 bp, Fusarium venenatum
  misc_feature (1)...(101): n = A,T,C or G
ntgattgggnttggaggacctcgagaanatcctaantgnatacatgnncctcaggcagaccttaaaactaaggncatgctagactnaagcatgcaaggtgg

SEQ ID NO: 3536 - DNA, 633 bp, Fusarium venenatum
  misc_feature (1)...(633): n = A,T,C or G
ttttttttttaaaaaccttcggatgattactcgagatacattctaagtagcgccgtgcagtctcctatgaggctgccagcccgagcagttatcccttcaccctttgacacaatcgcaaccttgtttataaccgctcgccttggttgagacgtgggaatganacaagtcggtgctgtttggtaagcccgtaatgacatncttgtcnccccgagttcctcggcccattagaggataaagcgtcggcctatcaccaatgatgattttgaccgcgtatccgtgcatnaagattccaccgccgatatcctccagcttttactgctgatgtgaaaaaacaaaaagtatcagaaaagaaacacgccantataaaaggaaaagatgaggaaagggggcaagtaatccccctatggggaagattgaccatgatcaacanaacattgctgtatgaatcccaagttcagtatgcatgatcacacctcccctacataatctgatcctgagtcaagccgacgtgaggatctgtgtccatgacgtcntttcccgccttggttaaggtcttcaccaaactcaagttgnggggacnaccgccgttttgataaccctggaacttggaaaaggcagtctcagcggtcttan

SEQ ID NO: 3537 - DNA, 660 bp, Fusarium venenatum
  misc_feature (1)...(660): n = A,T,C or G
ccggggcccgacccgtcaaagtggtggatgaagaaatggactttttngaaagcctcaatgntgggcttttccgnggagaataaccgtttacttcacatagagcacaaaacgatacccaaaagttgattttattctacntgcattcaatccctttngaccgggttgaactactatttctgccgcaccagacggcccaaatccgatatgaagtgctcactccctacgactaggagtcgtaacaccgcaaaccatcggacttttgttgatcatggataggccatcggaacaagagatggaaaaacagtaaaaagcaagcgattttgaggccgctaaaccactcggnattgnatgcccagaccccacgccagacaccctttgacccttattttgaggagactgnggggatattcacaaagtgtccgacatgcggggaagccgtgggggtttgctcggacaanacccggggagaggttaatggcccatgccagcagagacngtcaaaggaaagggcttgctccctcaattgcgtttgatgcgggtttgaaggagtnaccgagtcanggtcatgtttggggcnaaatcccaaaattntgctttgcacaaagaaggtctgatgaancaantcgtggggctcgggttcaaatgtnataaaganacccc

SEQ ID NO: 3538 - DNA, 221 bp, Fusarium venenatum
  misc_feature (1)...(221): n = A,T,C or G
nttgagtccacgatttcccataactcctaagcggcgaggatgacaagcgatggaataacgggaagcgatgaggctgggaacatcaagcacgaacaaggccttcagtgaccagggataaatgcaggctacgtcattactagcggggtattaaactatcatattgtgctactttgcacgattcataaaatttttgagtaataaaagttaacgatgttagtatg

SEQ ID NO: 3539 - DNA, 163 bp, Fusarium venenatum
cgaagacgttctcgtggtttcaaggtctaagcggtttatggtgaaaattattggccttgggtggagttggggccagtttatggggcaaatgatgccgaacatcggcttgcaaatgggtcttgcatggaattggcgtgcctaggtatcacaaaattctacaatg

SEQ ID NO: 3540 - DNA, 525 bp, Fusarium venenatum
  misc_feature (1)...(525): n = A,T,C or G
gaataataatcctcaacctcagtcttcatccaaaccaagattggacttttcgtccgtatttccggtttttcgtcgcaatgccaagcttcaagtgctgccggtaaaggaaatttcagccgcaccgaaccacaagcctcttctcttagatgttccggatccgcaaggattcagtatagtctcggagccgaccccaatccaatccagcccagtcagttgagcgatcgattattaagcttgtaacacagctccgcgggtgccgaagctcgaatagtcttgttttgcccaatagtcgactgattgttgaangggaaatggcgagttccagctatgccgatgctgtcatggtacttatgcagctctcgagtggtggacgtgttgataancgttggctgaagatacattcacaattgttcagttgatacagcgaagtcgatcggcttncgtataatccttganatgttcttccctgcgatctcaatgtgtntagganatcctgcccaatcnccagggaatcctcacttaaca

SEQ ID NO: 3541 - DNA, 430 bp, Fusarium venenatum
  misc_feature (1)...(430): n = A,T,C or G
cgctcatcttgttgaagatggcatgacggccgatgagatccgaagactagaagaggaggaacgacanttggacgacgagattgaacgtgcagggagacgatagtgctgcctcgcaatgccagaagctatctcggtcgaaaagtcgagggatactctcgtttcttgcatcatggggtttggagttttcgggtaatgacatgtctgatcctcacggtcgctttgagctggccactcacttatgttgtgtaaaatgtgtgagtgagtaccgtagtgggtggttgattgataacatctatcgcgaaaataccggagccttttantttcaggcggactgaggaagggacaaaaatctatgataatttgcttaatgtgcacttcttgaagcgtatataaaccatgaagatcagttgttaatacacgttatttaggt

SEQ ID NO: 3542 - DNA, 483 bp, Fusarium venenatum
  misc_feature (1)...(483): n = A,T,C or G
gcaaccagctatcactgagcttntattaagctcacttttattgattagataccatccattacctcaataccccattccaaacacacccaccgtnttgttccaactgtcagtaaccccacgcttctaagcgccggggtatcggttcgtttcattggttcgctgtttcatacaagcctcatgtcttgacaaattcccggtaaatagaatgagtgccgaatgattgcattccatcaaggtcgcctacatgtgtaccgctcattctggagggcaagcaaggtantcctcagggtatcanaaaagttggccgctggaagcacaaganacaaaattagtggaccagtttatggtccttanactacgtatttctatcccccaaggctgaggaggncaacttttcccctacttactaaatagcccagcagtttcacaaggaanacgattggcgtttatgctatatcgtgtctcgaccacacaatcatttgc

SEQ ID NO: 3543 - DNA, 595 bp, Fusarium venenatum
  misc_feature (1)...(595): n = A,T,C or G
cccaaaaacggttatcgtccaactcatctatagagttcccaggcgaattctcgcagattgatttcggcccatcaatcgacgagcgaccggccagttttggcatggtgtcgcaacatggtgtcagccgagttgacccgttacaccgtgacgtcgatttgctcggcagctctgctgagcttgtcgaagatcctcccgcgagacctcgcacttgatcttgtcgtgttgatcggtgtcacaacaaatgatttgctgtttcccaacgcgattgcccgccatgacatgctctctataaacacaaccatcacctactacaccctttacgggttacatcttaatattattttctttttgtttggttaccctcagggttaaacgctatctatatgatctatagatcaaggtccataaggattttgcacatgagcacacatgctctcacctttctccttttctctctctttttggttacggatcatacacattcaatcacagccgtggagacntgcggaggaacacaagctacgaaagtacaagcgaaaggacaggcgttttacgtgaatttcgtggccatatttgctctaactggggacctatc

SEQ ID NO: 3544 - DNA, 240 bp, Fusarium venenatum
  misc_feature (1)...(240): n = A,T,C or G
natcttgnatcctcaanttttcatcaagtacacttcgccaagaaggactgngangaaatcaacgctcttnacactaagngnctggatntgcttgatacgacganccttttttagaacggcggcnacaancaccgattcgctgngtngcataccccgagcnatctttantatnctaaccgaaaacacattggtgggtatctggncaacatggaatacgttgttgancactaccgatcaaca

SEQ ID NO: 3545 - DNA, 583 bp, Fusarium venenatum
  misc_feature (1)...(583): n = A,T,C or G
atctttgccacgattttatcaacccctggttgccaggagttgatcgctccacaatctttgcccacattgaaagcgattcgttggcagcatgtctaagtcaagaaagaaagccacagcaacggtgagccatcatctacagatatccagctacaaggatgtttgcgcaggttcctttcgatctacctcaacgcacagaagcgcgaggccccccaatctctcacatgtgtcaagaactgccttatggccacgactattcttttcactggaggtcaaaaccacctgccagcttccgaagcccttgtagcacgttatctagacgagctgatggattgcctcactgatagaatgactgccaggattgcggccaactgcatcagatccatactgctccagtcgtcttcgactggcgctgacctcagcattgctcgctacttgttccccaagctggtagcttttgtgactgacacggancctgaagatccgaaaacgcaagggccttggttgctcacacgctttgccaatatgcgggtacagttgacaagggtcgacntctancaccattacagtggtgggtacccgactt

SEQ ID NO: 3546 - DNA, 301 bp, Fusarium venenatum
cgatcacgatgatgttatgaagcgattcgctgctgccggtgttcagatttcccagattgccaatgaccaggagcccgtggacctgagcaaccaggagaacactgacggtctgtggaacgatttgttgcagtacttccaaaaggccgctacggatacagagcacaagatattcaagtggcctgctgtcacccaggttgtttacccttacagtcaggaaatttaagaacggcagggatatgaaataaaatattatgatgtttttagcgctttatagacaatagaaatgatatctaatcaccta

SEQ ID NO: 3547 - DNA, 144 bp, Fusarium venenatum
  misc_feature (1)...(144): n = A,T,C or G
nacaaggtcttgactgtantggtataaggcganccntaggtactacatganccttgaagangacagacctgatgatggggaatanattcatcaatctaacatcttcgntgataaagncnttcatttacgagngtccaacgaatg

SEQ ID NO: 3548 - DNA, 485 bp, Fusarium venenatum
  misc_feature (1)...(485): n = A,T,C or G
gaacggtcaacgacttgttgatatctcaatcacaatgccagagacactagatcctggaactccaaccattacgccgcccgtctctccgggcggcgtanagaggcgtcggtcgcgaaaccctctcaagaacatgatgcaacatctaactgtggatccccctccggatgatgatgttcgtgaacccaggagagcttcgctcatacgccgcatcagctggggccgcaaganccgcagtccttctgctcattctgatagatcaggaggtcnacctcaagatccgaatctatgcaccgcctgtgctggttgggctgccgacattgactctacattcgataccntggatgacttttttacaagggctctaaatcctacttctgcagacacttcgaaaacaagancatctctaggtcnactnaaggactcgaagaaaaccgcttcctctcnaaatttctctctgcaaatntcctctcagtccacatcccacc

SEQ ID NO: 3549 - DNA, 109 bp, Fusarium venenatum
  misc_feature (1)...(109): n = A,T,C or G
naggcgaaagaggnccgcnaacgagaggctgttctcggaaagaagggcaagaagaaatagaggatanattatgacagacttgacgattatgatcaatgaatanatcctg

SEQ ID NO: 3550 - DNA, 631 bp, Fusarium venenatum
  misc_feature (1)...(631): n = A,T,C or G
cgagggccaacgtgcgtactcctatccggactatgatgcgatcagcttaccgggtgcaacaaaagacggcaattcagtctcaaggcatggattcatgcggcagcgcgaggagagcatgacagatactgatgtgtcgccgggaatgtcaccgggaagaggttctttgtctagtgtgtgatgatgacctgtgtgatgccgtgaaagggatgttgtgttctgtttttcctagtgacgccttgttgtggaaacnaaactgcacacggtattgcacttgtgatgatgatatctcagtgtcaagatctaatttcattcttaaattctgagaagcgaaaacctgatatctaactcatccgcaaatgagtcaatgctccgctgatgcgcccttcactcctgggcttccagcagggccgaatactctggaaccttccatttctcatcgtgtcctaacccaaaaccttcatcgagacggagataggatcccgctcgtgctatcgagtggagcatccanattccaaattgtgtttttggcatgaacaatgcttcgcgantttngttcccttcgccgngcccagangtccgccatcggccgaaacactttcttgtatcggtttacgggcttaaccactggggg

SEQ ID NO: 3551 - DNA, 590 bp, Fusarium venenatum
  misc_feature (1)...(590): n = A,T,C or G
actttgagtacgcgcaagcctcagctacttcacttcctagtttccactaccaaacaagacaagatgtcaacttgaagctatttcttctcttctatgatccggactaagcgctcggcaaagcctgacacacccacccacttatgtacaccacccgtccccgtgctctgcctgtctacctctcgatccaaggcaaggatagtccacccaccactctttctgagatcgacttattccttgaacatgggggggctactatactttattatggacatactgtcgtagtagcagcatcttgagaagcctcatgatccttgccccacatcatccgactccaaaccccagcgccgtcatcacttttacccaatctctttgcttgnctttgcccccagcatcgccaagactttgaaatgttttggaaatctgttcgggtccatgagatatcagcgtattgnacatcaaccggtgggaaacacttcggcgtcattccgnccgcgtgcgtcaagggtccagtcagtacaagcccccatgttcctcgctgcaanagaccctgaggacgatctctggtcttaacgggcattaccaccnatctt

SEQ ID NO: 3552 - DNA, 585 bp, Fusarium venenatum
  misc_feature (1)...(585): n = A,T,C or G
cagatacatggtgttgaagatgacactacagacaagtccatatcgctcagcatgatagtgcgacacatacgcagaggtatatatccgctctctttgttctctttcgctttatcgcggcccatctggcaatccggtatctttccccatggtggtccctatcatcatcttggcaactttcaacagttgccgcgttagacgtgggtcggttcctttcccatcttgtcgatcggcttcccagactcccacgcccacacccccaatagcccgatgctttctcatgactaaaggctatcgtgcaagcatattagttctatgcttgatcaacttctacgccttcaagataggtcgtcttgtggtctcaagcacaaactctatctttgccttgtgcttccctttctgtcatctgcatactgagttgagtgtgagagccaatgatctctttccaacacttttacccaatcctactaaagatatatgcgtgggatgcatgcatgaatggttcaaagcatgttgnatctgaacngtccatgtttcnggcttttgtggccccattcacgttcacgtttcgattatgcctcatgtgtc

SEQ ID NO: 3553 - DNA, 163 bp, Fusarium venenatum
ccaccagaaccacaaccatgctcatgtggatgttgttgagctatgcctaggtggtctgagatgatcaagagcaagttgagtcgattatagttattgtacgcttagtctgggcttgaccaagcagatacatagcttctaaagaaacagagagctgaatttctag

SEQ ID NO: 3554 - DNA, 427 bp, Fusarium venenatum
  misc_feature (1)...(427): n = A,T,C or G
naagtgcaaccggcatttgaggcaaaatagtcagtcattcggacttgatggcttttttggtgtgacgccatnttttntttggtgtggngggtcattttanaatcatccttgtcaatcggatcagataactcagtcaacttatcaatcaccccactanaaaagttcgcctcggcttcatctanaaccttggactccattattcatcgcatcgagtctccgccagcgtgtcgattattactactctccgtatagnaacgggacnaaaagtaaccctactttcttgggctgcgaaaaaagtagtgcagnggangcccaaanaagctgcaagtcacaacttggggtgattgttgataaccanggangggtcgttgccaacgttcnctttgcagctgtttaaacncttaattcacaaacaaaaagaatcgtt

SEQ ID NO: 3555 - DNA, 422 bp, Fusarium venenatum
  misc_feature (1)...(422): n = A,T,C or G
caatctacaacgaccagttgcctcgagatgcaccggtggctcgcgatgacaatgtgaagatcctctcacacgttgaggccgatgtcagccatattccggaagaccagctttctcgtcgccaaggctcagacgggcaatggtactacgaattgaactgcaaaatagaggcagtctatctctcggcatctactacctatactctactttacaacggccagcgatacaacacagtgacgtgcgagtatgtctaatggtttacacggatcctgttgaacccgtatgtcgaaattgatatgtattctgattgngttctatcttttggtgcctgcngctttgcaatttcccctctttttaggtgaatgcattgcgctattcttaattaggcttcttcttattcatttgacttggcttttaccaatcag

SEQ ID NO: 3556 - DNA, 630 bp, Fusarium venenatum
  misc_feature (1)...(630): n = A,T,C or G
ccatacttagaatcattcgaccctctttaaggccatgagcgttgaagacatatttatctttcacttgtaagattttgttttgttaggcttctaaaacactcaacatcagtnngggcttttccctaccttcatttactcgacgcaagcacccacgagacgattggtcacatacaaagaatattatatacagccgaaacgaactgcgaagcaacccaccataaggaacagtgacggcaacagaagtggaatacatcatatactgtcacacagacgcaatacttggtgcacgaaaacagtcactatccgcccaagctcataccattctcttggcgaactaaatacaccagatttcttggttaactttcgagtatcaccattttgaacctggctacaatcgattaactgatcaacaaatactcggtaaatcgacaaacgatacgatggcggcagatcaagggtttggaggcccagttgagcggccagacggagtttgtcaacgtcgggccctgggcctaatggtgaaggcgaaaccccgaccagagaaggagaccaccagaaaaccatcagccgacgaaaanggacgaggccncccaatcatcacaagtnttaccgcgcgggtatgacaatgtt

SEQ ID NO: 3557 - DNA, 632 bp, Fusarium venenatum
  misc_feature (1)...(632): n = A,T,C or G
tgttgaaactcacgatgctcattgtttctttgaacgaactgctcgtaatagttccggtttaaagtgcaactcgagacctgaaagttcgatgccacactactatcaacaagatcagcaaagggcatgacttgaacgagacattanaaatgatcaaggcgcgttcagctcagcctttgggccctggtatccaataaatggcgcgctatnaaaagatccggcggcgatgattcactatcagacagcctcgatcagccacatgtctctgtaagtgattggcaactcgagcatggcttnttttccgctgtgataagtccctatccataagcaatgacgcagtctgtgcggtgaatcgccaagagataaatcgaagctcttgcatcgaccaaatcaaggataggctcaaacaatttgttctcttgttcgcnaactggggaacaagagtcgttttaaccttgtttttaacctcaacgatgnggggggttncacagagttttatcngagcccgcattgacatgttgactgaacatgttcaaattgaaaccncctacctgggggagtttctactcaacatggccnctgntgggatnttctgaagangcagcaatagcaagggacttnttttgataaaaaaa

SEQ ID NO: 3558 - DNA, 224 bp, Fusarium venenatum
  misc_feature (1)...(224): n = A,T,C or G
gaccctcgacgtgatncacnccgccccacgacaccctcgtcctggtnaacgaccaggagtcantctggctcctgagaactccaacaccaacgtcagcggcccttgcagttgctagaattacncccnaattttgaaagcattgatttttaaacaccttttatcaccctaccccatatacctaaccctcacttgaatctatgctggcacgctattctgcaccaact

SEQ ID NO: 3559 - DNA, 258 bp, Fusarium venenatum
cgaaggagtacaataacgggaatcagcactttatctgaattggaacagaatgtagctgctgccaagtcaattctcaaatcgacaaaggcatctgagagcttgcaggattatactgagctggatacacaggcagtggagagtcgttccgaactgtatgagcatattcgatcaatgcttgggacttgggtagactatgactttacagggaagaaagcgaaggaataagatagcactactagaactaacatatttatcctg

SEQ ID NO: 3560 - DNA, 590 bp, Fusarium venenatum
  misc_feature (1)...(590): n = A,T,C or G
ctgcgggcggcacggctcttacttgcggagtttatcattcatctctccgccaccgtgacagttactctgtacgagaattactgttacaacggtgtcactctgtataattcaagaccaggcaacccattaccatatccattcggccaaggctcgcaactttattatctgtcttgcttgagcttgattcgccatcacccattccaagctccagccttgttgacatttatcaacacttttaaatcccgggcaaccagtggattagaccaggtccaaccatacaacaacagtcctgactcggctgacactcagggcaacgactccaggtggtagcctaccggtagcctttaccagcctcgcgtcgcacttgtgttctcgtcaactgatantgtttgcatgggtcctaggataaaccagcaaacggtgtccaacaagctcatcataacattttttggaatcctgcctcgttggccgctcggtgcgtcgctcgtattccgtatcttacactatacgctacctaatctatctacatccacatcaaaaaaattccctccagggggtgtacgtctactgaacccnncccttttgctttg

SEQ ID NO: 3561 - DNA, 225 bp, Fusarium venenatum
  misc_feature (1)...(225): n = A,T,C or G
ngcaagaggacgatggggtacgacataagaanagaaangcnaggatatccgccaatggcaacgaaaacgtngatggagcattatcatngctgntatgctgccaaccttanctactgngcttgncttgatgtacnanccggcancttggnacttggcnggttgactacttcattacnacnataacgacgggcgctccnccagttttttttccttncaaataaaaaa

SEQ ID NO: 3562 - DNA, 618 bp, Fusarium venenatum
  misc_feature (1)...(618): n = A,T,C or G
ttatcgatcgagttcggcatgttcatggagcttgccaagcggtaaacctcaaaatggatcacgctcagccatcccgccagccatcaaactcagaaaagcgaatgtcagcggccaatgctttgcaacccttgtcatggcctcacttacaagagaccatcggcgaagcactagcttagccagactccactcagggtcttgcaaggacctgtccagttaggccgtcgatcctgctcaacctttcaaacgccccatcgacttgtctgtctggcgaggctttgcgctcgtgattgccagcgaacacgtcaaggatttatcccaaaatctccccattcaaggcactacaaccaataaagaatctccaatctgcagaatctggtctgcaaatcctgctcggaagatgcacgatatgtccgcgcacaagagttgatgcgataaatcgttccgcagctttagctctctacaaagcttatgggtcttgcaatagcttggacgaatgatcatgatcaaaangcacccggcgatcacccattgccttctcaatttggtggttcgggccccaacgattgattgtaaganccaatncatcgattgntttcgaaacagatattattccgtgag

SEQ ID NO: 3563 - DNA, 130 bp, Fusarium venenatum
  misc_feature (1)...(130): n = A,T,C or G
ngcggccatatatacntattttattgaggtngaaaaatatgacatactntcctggnacacaatatctttcaacccagcgcaacaaattcataaaanggacttggttgaaatttgccatgtncacatttgc

SEQ ID NO: 3564 - DNA, 169 bp, Fusarium venenatum
cgcgattctgccattccgacagacggaagaagacttggagatggatgattgggatgaggatctcgacgggccacgacctgtcaaggagactgctacagtcgccaatggagatagcgacacattagaaccaccatatacaccatcttttgtcctccgaaaaaaaaaaata

SEQ ID NO: 3565 - DNA, 247 bp, Fusarium venenatum
  misc_feature (1)...(247): n = A,T,C or G
natntttacgccttgttcttttngaacacttcatcagcgcgctaggagggcatcatgttgtcctctattgtaagaggngnatgggtgatacgggtggccgaccaaagcatgtcatggtngggcaggtgtgccctcaaaatctacatgtgaangatatgcctgtagtggnaaagagtagtttcgttggangaangttgactttggaagacttaaaatgagctaatagattttcttttatgcaaaaaaa

SEQ ID NO: 3566 - DNA, 145 bp, Fusarium venenatum
tgtacgagtccaattccacttaagcgacagcgtctgttttgtgtttttagcatttcattatccaaaagggtagagagaaacttatctagagcggtcatatattcatattttatgaggtagaagaatagacatactatcctgttac

SEQ ID NO: 3567 - DNA, 174 bp, Fusarium venenatum
  misc_feature (1)...(174): n = A,T,C or G
ntctatcgctcgntagaaaanngctctgaaaaagactcccttgcaccgttaataacatgatgtttaacaancttgttatcanatacatccgctaaagagcacagtttacctcgaggnggcttccnggctggttgaacncttttcccnaagaggggttggtnntttttgtaggaa

SEQ ID NO: 3568 - DNA, 562 bp, Fusarium venenatum
  misc_feature (1)...(562): n = A,T,C or G
gacgctgcgagaagccgtgacccagctgccggtgctgcaggtgctggctacagcgagtctgcctctcgatccgagacgcgcgacgcctatggaggcgcccccgaccgaagcatccagtaaatgcatcgacgacgtttaccacgacctgactgatttatctgtcaccgcggtcttttctcctttcctctactaacacacctgctttacttgctcaacttcctctgttaattgttattccttcgttgatttcttttatgttcatggactacagcagactgaaatcaggctctgcttacacaggagttcagtgtgatttgcgacagtaatgggattggaatcaaaaatgggtactcggcctgcgtcacttgagttttcttattgctggtcggttttgcgacaaggtcacagatggaccaaatatggcagcttccggatctttgcaaatcaaacacttcatcagtcatccatcgcgtcttcgacgactttatgatagcttttggcagcacaacatcaaccagatgtcgactcccggcctaatcggngaatccacatggactattaa

SEQ ID NO: 3569 - DNA, 589 bp, Fusarium venenatum
  misc_feature (1)...(589): n = A,T,C or G
caaattctatggccaagattctggtcgaggaagaaggtcgaattcttcgtgctggtcaccggttccgtgctggtttcttcaaacaggagcagatcgatctgctcagcacgattgacgacattggttccgatcctatgcacgtgggaatgctaacccgagatggccgaggatattggtggggagctgttggaactcgtcaagacgaagggtgctgttagggccttcaaagaagacagagacgttgcacttaagtgcatggccgaaagtgacccatancattgggagcgatttgtcgatgctcagaacaagtccgtgccaacattagcattcaccagcagcaaagcagggggatgcggnggacganaatgcaattgccgattagagtagtatcacccgtgggacgggtgtgtagtanaagcttgtttggtggttgcatggcaatgatttgctggccattgaggggcanacatacatgtttgangtggacaagaangacataacttgcgcatggacgcctgcgcactccttgattcccatttcctntttttctgctttgagcggggagttattaatctacntacaatctctt

SEQ ID NO: 3570 - DNA, 300 bp, Fusarium venenatum
  misc_feature (1)...(300): n = A,T,C or G
tggcgaattccgttcattgtttgtcagtagcagaagagcctcattatcgttattgttttgtcttcgagtagtcgngggtctacaagacancccctcattcgaggctgaaaaggacccctgttcttcatgttcctagactttctagcanggtccaccgnttnctttccccggcaaaaaagacnacccctcgatctggtcgaatcttctagccatccagacaggcggatgattgtgttgcctggcggttttgcttgaaaatggatccaattgaggcccgtcaatcataacaagnngggctgt

SEQ ID NO: 3571 - DNA, 114 bp, Fusarium venenatum
  misc_feature (1)...(114): n = A,T,C or G
nagctaaanatctcgatgacnatgatctnnacaaagctgtngagatgttnnaggggaaagccntatgcggtatcgcacggtagatgacgnacagagtggnatcgggaagaattg

SEQ ID NO: 3572 - DNA, 728 bp, Fusarium venenatum
  misc_feature (1)...(728): n = A,T,C or G
ctcgcatgtagtacatacccgagaatgcattaatcgtagctcacgtcgctaataaccattcaccacaaactctttcacgcaaagacagaccatcttgggccgcacagcaacgcgcaaacagtgacatgatttggcccattgttcactgtgccgattacaggctattggttcattaagctgattctctgttcatttgttgattgtgattcaagtaacagatgttcgaatctattcagaaatcaacaggcaagtattaacatatgcccaagcctgagtgacacaatgccagttgtataaagattctgaaatcatcatgaccagtccaagagaactactcgatatcagccattaacttctattaccaccaagtatccgcacacacattgaaaatgaagttcatttgggtatttaccactcttttcgctttcggtactgctgactcaaaccaatccaagcaacccagtcangggacttcacggtcgattacaactggggatgtgggtgctgaactctacacttgacctcgacagctgtgcatacctgctgaactagctcggaaccgcttccaagactggctggtggacgataggaacagccaacgtgatgagttggtcatctnggcttttgtcaagtgactatcaatctggactctttctcactttgtcctccacatgaatgggaaaaagttgatcaagtcntcangggtnacaaggaagggcaacttaaag

(The sequence listing continues in the following parts.)

What is claimed is:

1. A method for monitoring differential expression of a plurality of genes in a first filamentous fungal cell relative to expression of the same genes in one or more second filamentous fungal cells, comprising:
   (a) adding a mixture of fluorescence-labeled nucleic acids isolated from the filamentous fungal cells to a substrate containing an array of *Aspergillus oryzae* ESTs of SEQ ID NOs. 4377–7401 and fragments thereof, under conditions were the nucleic acids hybridize to complementary sequences of the ESTs in the array, wherein the nucleic acids from the first filamentous fungal cell are labeled with a first fluorescent reporter and the one or more second filamentous fungal cells are labeled with one or more different second fluorescent reporters; and
   (b) examining the array by fluorescence under fluorescence under fluorescence excitation conditions wherein the relative expression of the genes in the filamentous fungal cells is determined by the observed fluorescence emission color of each spot in the array in which (i) the fluorescence-labeled nucleic acids obtained from the first filamentous fungal cell that are hybridized to the ESTs in the array produce a distinct first fluorescence emission color and the fluorescence-labeled nucleic acids obtained from the one or more second filamentous fungal cells that are hybridized to the ESTs in the array produce a distinct second fluorescence emission color, and (ii) the fluorescence-labeled nucleic acids obtained from both the first and the one or more second filamentous fungal cells that are hybridized to the ESTs in the array produce a distinct combined fluorescence emission color.

2. The method of claim 1, wherein one or more of the filamentous fungal cells are selected from the group consisting of an *Acremonium, Aspergillus, Fusarium, Humicola, Mucor, Mycellophthora, Neurospora, Penicillium, Thielavia, Tolypocladium,* and *Trichoderma* cell.

3. The method of claim 1, wherein the two or more filamentous fungal cells are the same cell.

4. The method of claim 1, wherein the two or more filamentous fungal cells are *Fusarium venenatum* cells.

5. The method of claim 1, wherein the two or more filamentous fungal cells are *Asperigillus niger* cells.

6. The method of claim 1, wherein the two or more filamentous fungal cells are *Aspergillus oryzae* cells.

7. The method of claim 1, wherein the two or more filamentous fungal cells are different cells.

8. The method of claim 1, wherein the hybridization conditions are selected from the group consisting of very low, low, low-medium, medium, medium-high, high, and very high stringency conditions.

* * * * *